United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 200

SEQ ID NO: 8312178 - DNA, 22 bp, Homo sapiens
aggcagtgtattgctagcggct

SEQ ID NO: 8312179 - DNA, 22 bp, Homo sapiens
aggcagtgtgtagctggaagag

SEQ ID NO: 8312180 - DNA, 22 bp, Homo sapiens
cagtatgtttgggagacatgac

SEQ ID NO: 8312181 - DNA, 22 bp, Homo sapiens
cagtatttatggcttgagtatt

SEQ ID NO: 8312182 - DNA, 22 bp, Homo sapiens
cagtatgtctactggacaaagt

SEQ ID NO: 8312183 - DNA, 22 bp, Homo sapiens
cagtatgtactcttatcatgta

SEQ ID NO: 8312184 - DNA, 22 bp, Homo sapiens
cagtatgagagttgaatcaagg

SEQ ID NO: 8312185 - DNA, 22 bp, Homo sapiens
aggacagacctaggactggagc

SEQ ID NO: 8312186 - DNA, 22 bp, Homo sapiens
aggaatcccgcaccagctgctg

SEQ ID NO: 8312187 - DNA, 22 bp, Homo sapiens
caggtgggccatgaaaaatgac

SEQ ID NO: 8312188 - DNA, 21 bp, Homo sapiens
aggaagtggccagattgggaa

SEQ ID NO: 8312189 - DNA, 23 bp, Homo sapiens
cagggctgggcttggtgttaggc

SEQ ID NO: 8312190 - DNA, 18 bp, Homo sapiens
cagggctgtggggtcact

SEQ ID NO: 8312191 - DNA, 22 bp, Homo sapiens
cagggctgttagctgctgctct

SEQ ID NO: 8312192 - DNA, 22 bp, Homo sapiens
cagggcagggatgttgcggcag

SEQ ID NO: 8312193 - DNA, 22 bp, Homo sapiens
cagggcagggagcttagaatga

SEQ ID NO: 8312194 - DNA, 22 bp, Homo sapiens
cagggcagtaacgggaacatct

SEQ ID NO: 8312195 - DNA, 22 bp, Homo sapiens
cagggcagggccacaccccctg

SEQ ID NO: 8312196 - DNA, 22 bp, Homo sapiens
caggctgaagtgcagtggtgtg

SEQ ID NO: 8312197 - DNA, 22 bp, Homo sapiens
cagggcaggatgctgtgattat

SEQ ID NO: 8312198 - DNA, 22 bp, Homo sapiens
cagggctggctcatgaaaagtt

SEQ ID NO: 8312199 - DNA, 22 bp, Homo sapiens
cagggctggctgtggcaatctc

SEQ ID NO: 8312200 - DNA, 22 bp, Homo sapiens
cagctgggtttagtggggtgtg

SEQ ID NO: 8312201 - DNA, 22 bp, Homo sapiens
caggacctggaatgcttgtgaa

SEQ ID NO: 8312202 - DNA, 22 bp, Homo sapiens
caggagcaaggagcagtgggat

SEQ ID NO: 8312203 - DNA, 22 bp, Homo sapiens
caggcagagtgaggtggtctaa

SEQ ID NO: 8312204 - DNA, 20 bp, Homo sapiens
caggcacactcattcctgct

SEQ ID NO: 8312205 - DNA, 22 bp, Homo sapiens
caggatgggatgtagtgggccc

SEQ ID NO: 8312206 - DNA, 22 bp, Homo sapiens
caggatgggtgtcggccagcac

SEQ ID NO: 8312207 - DNA, 22 bp, Homo sapiens
caggatggtcagatgcattgtc

SEQ ID NO: 8312208 - DNA, 22 bp, Homo sapiens
caggagcccagagtcctcagct

SEQ ID NO: 8312209 - DNA, 22 bp, Homo sapiens
caggagcccagagtcctcagct

SEQ ID NO: 8312210 - DNA, 22 bp, Homo sapiens
caggagcagagggtggtcagca

SEQ ID NO: 8312211 - DNA, 18 bp, Homo sapiens
caggagcaggagttgaac

SEQ ID NO: 8312212 - DNA, 22 bp, Homo sapiens
agctggttcattcattcatggt

SEQ ID NO: 8312213 - DNA, 22 bp, Homo sapiens
agctgtcctggctcaggctgtg

SEQ ID NO: 8312214 - DNA, 22 bp, Homo sapiens
agctgtcagtgctgtgcctgta

SEQ ID NO: 8312215 - DNA, 22 bp, Homo sapiens
agctgtctacctgcagagtcct

SEQ ID NO: 8312216 - DNA, 22 bp, Homo sapiens
agctgtctccagatacaggatt

SEQ ID NO: 8312217 - DNA, 22 bp, Homo sapiens
agctgtctacctgcagagtcct

SEQ ID NO: 8312218 - DNA, 22 bp, Homo sapiens
caggcaggtgcagattcctctt

SEQ ID NO: 8312219 - DNA, 22 bp, Homo sapiens
caggcagggagctggaaaggat

SEQ ID NO: 8312220 - DNA, 22 bp, Homo sapiens
caggcagctcgatgccttgttg

SEQ ID NO: 8312221 - DNA, 22 bp, Homo sapiens
caggcagctcgatgccttgttg

SEQ ID NO: 8312222 - DNA, 22 bp, Homo sapiens
caggcagcgctcgtggcctggc

SEQ ID NO: 8312223 - DNA, 22 bp, Homo sapiens
caggcagcgtcctgcttcctgt

SEQ ID NO: 8312224 - DNA, 22 bp, Homo sapiens
caggcagccttctcgtctcaca

SEQ ID NO: 8312225 - DNA, 22 bp, Homo sapiens
caggcagcctgcggtctgcaca

SEQ ID NO: 8312226 - DNA, 22 bp, Homo sapiens
caggcagcctgcggtctgcaca

SEQ ID NO: 8312227 - DNA, 22 bp, Homo sapiens
agctgtctgtctcctgaggaga

SEQ ID NO: 8312228 - DNA, 22 bp, Homo sapiens
agctgtctttctgcctcctgat

SEQ ID NO: 8312229 - DNA, 22 bp, Homo sapiens
agcttcctgatgcaagagggct

SEQ ID NO: 8312230 - DNA, 21 bp, Homo sapiens
agcttcctgcagtgggaggtc

SEQ ID NO: 8312231 - DNA, 22 bp, Homo sapiens
agcttcctgttgagagagggag

SEQ ID NO: 8312232 - DNA, 22 bp, Homo sapiens
agcttccttggcgctgaggcct

SEQ ID NO: 8312233 - DNA, 22 bp, Homo sapiens
agcttcctacaaccatctcaga

SEQ ID NO: 8312234 - DNA, 22 bp, Homo sapiens
agcttcctcacctcagaggtct

SEQ ID NO: 8312235 - DNA, 22 bp, Homo sapiens
cagtgttccaggcggcagtgaa

SEQ ID NO: 8312236 - DNA, 22 bp, Homo sapiens
cagtgtgtggatcctcccagga

SEQ ID NO: 8312237 - DNA, 23 bp, Homo sapiens
aggagccaggtgcagcccttgtg

SEQ ID NO: 8312238 - DNA, 22 bp, Homo sapiens
aggagccaggaaacctgctctg

SEQ ID NO: 8312239 - DNA, 23 bp, Homo sapiens
aggagccaggaaccagcttcccc

SEQ ID NO: 8312240 - DNA, 22 bp, Homo sapiens
cagtgtggagggagagagcctg

SEQ ID NO: 8312241 - DNA, 22 bp, Homo sapiens
cagtccaggcctggaggagcca

SEQ ID NO: 8312242 - DNA, 22 bp, Homo sapiens
aggagccagttccaccccagga

SEQ ID NO: 8312243 - DNA, 22 bp, Homo sapiens
cataagaaataatgatgatgac

SEQ ID NO: 8312244 - DNA, 22 bp, Homo sapiens
cataactagagtgaaatgttga

SEQ ID NO: 8312245 - DNA, 19 bp, Homo sapiens
cataatacagtggatctga

SEQ ID NO: 8312246 - DNA, 22 bp, Homo sapiens
aggaggccgggattctggagat

SEQ ID NO: 8312247 - DNA, 23 bp, Homo sapiens
aggaggcctgaaactgaggctga

SEQ ID NO: 8312248 - DNA, 22 bp, Homo sapiens
aggagctgggttcctttggtgg

SEQ ID NO: 8312249 - DNA, 22 bp, Homo sapiens
aggagctgtcagagtgccagag

SEQ ID NO: 8312250 - DNA, 22 bp, Homo sapiens
catctctccacggcagctctcg

SEQ ID NO: 8312251 - DNA, 22 bp, Homo sapiens
catacatatgcatgtgtgtata

SEQ ID NO: 8312252 - DNA, 22 bp, Homo sapiens
aggatgggcctgggatatgctt

SEQ ID NO: 8312253 - DNA, 22 bp, Homo sapiens
aggatgggcctgggatatgctt

SEQ ID NO: 8312254 - DNA, 23 bp, Homo sapiens
aggatgtaggatgtatggcagag

SEQ ID NO: 8312255 - DNA, 22 bp, Homo sapiens
catgagataatttttctccagt

SEQ ID NO: 8312256 - DNA, 19 bp, Homo sapiens
catgagctgctcacttccc

SEQ ID NO: 8312257 - DNA, 22 bp, Homo sapiens
catgagctgctgggagcctgtc

SEQ ID NO: 8312258 - DNA, 22 bp, Homo sapiens
catttctgattacagaatacta

SEQ ID NO: 8312259 - DNA, 22 bp, Homo sapiens
catttactgttgaatccctagc

SEQ ID NO: 8312260 - DNA, 22 bp, Homo sapiens
catttacatttaaggttaatat

SEQ ID NO: 8312261 - DNA, 22 bp, Homo sapiens
aggcactgtgggtgtggccgga

SEQ ID NO: 8312262 - DNA, 22 bp, Homo sapiens
aggcactgttcccagttatcct

SEQ ID NO: 8312263 - DNA, 21 bp, Homo sapiens
aggcactgtttgtggtttggg

SEQ ID NO: 8312264 - DNA, 20 bp, Homo sapiens
aggcactgttgtctgtatcc

SEQ ID NO: 8312265 - DNA, 22 bp, Homo sapiens
cattgctgtgggcatttgctgc

SEQ ID NO: 8312266 - DNA, 22 bp, Homo sapiens
cattgctgttaattgtctctag

SEQ ID NO: 8312267 - DNA, 22 bp, Homo sapiens
cattgctttgtgcatatttaaa

SEQ ID NO: 8312268 - DNA, 22 bp, Homo sapiens
cattgcacttctgcttttcctc

SEQ ID NO: 8312269 - DNA, 22 bp, Homo sapiens
cattgcccagtaggatcaccag

SEQ ID NO: 8312270 - DNA, 22 bp, Homo sapiens
cattgctcaggcccagcaggaa

SEQ ID NO: 8312271 - DNA, 22 bp, Homo sapiens
cattgcactttgggtccaggac

SEQ ID NO: 8312272 - DNA, 22 bp, Homo sapiens
cattgcactgcagcccgggcaa

SEQ ID NO: 8312273 - DNA, 22 bp, Homo sapiens
cattgcactctggctggaacgg

SEQ ID NO: 8312274 - DNA, 22 bp, Homo sapiens
cattgcactctagtctgggtga

SEQ ID NO: 8312275 - DNA, 22 bp, Homo sapiens
cattgcactctagcctgggtga

SEQ ID NO: 8312276 - DNA, 22 bp, Homo sapiens
cattccttaacgtggggagtct

SEQ ID NO: 8312277 - DNA, 22 bp, Homo sapiens
aggcaagggggcgccaccttcc

SEQ ID NO: 8312278 - DNA, 22 bp, Homo sapiens
ccacccagccagatgcaggaag

SEQ ID NO: 8312279 - DNA, 22 bp, Homo sapiens
ccacccagccagatgcaggaag

SEQ ID NO: 8312280 - DNA, 20 bp, Homo sapiens
ccacctggccaaggctgtgc

SEQ ID NO: 8312281 - DNA, 21 bp, Homo sapiens
ccaccaggtcttctgctcggg

SEQ ID NO: 8312282 - DNA, 22 bp, Homo sapiens
catttctgttctcttcctgtac

SEQ ID NO: 8312283 - DNA, 22 bp, Homo sapiens
catttctgtcacgttcttttat

SEQ ID NO: 8312284 - DNA, 22 bp, Homo sapiens
catttctgtgacacttccatct

SEQ ID NO: 8312285 - DNA, 22 bp, Homo sapiens
catttctgtacatgttttggtg

SEQ ID NO: 8312286 - DNA, 22 bp, Homo sapiens
catttctgggagacatgctaga

SEQ ID NO: 8312287 - DNA, 22 bp, Homo sapiens
catttctgcagaattgctcttc

SEQ ID NO: 8312288 - DNA, 23 bp, Homo sapiens
catttctgggagatttataaaat

SEQ ID NO: 8312289 - DNA, 22 bp, Homo sapiens
ccacagagacagggtccttgct

SEQ ID NO: 8312290 - DNA, 22 bp, Homo sapiens
ccacagagacagagcccagggt

SEQ ID NO: 8312291 - DNA, 22 bp, Homo sapiens
ccacagagagtgtcagcctttg

SEQ ID NO: 8312292 - DNA, 22 bp, Homo sapiens
ccagagtctatgagtcctcatt

SEQ ID NO: 8312293 - DNA, 22 bp, Homo sapiens
ccagccaggctggctgtggagg

SEQ ID NO: 8312294 - DNA, 22 bp, Homo sapiens
ccagccaggcattgcaaactga

SEQ ID NO: 8312295 - DNA, 22 bp, Homo sapiens
ccagccagctgcccttggggcc

SEQ ID NO: 8312296 - DNA, 22 bp, Homo sapiens
ccagccagctgcccttggggcc

SEQ ID NO: 8312297 - DNA, 22 bp, Homo sapiens
ccagccagccttgatctgagta

SEQ ID NO: 8312298 - DNA, 22 bp, Homo sapiens
ccagccagccttgatctgagta

SEQ ID NO: 8312299 - DNA, 23 bp, Homo sapiens
aggccctgcctgtccctcttttt

SEQ ID NO: 8312300 - DNA, 22 bp, Homo sapiens
aggccctgcccagtgccacaag

SEQ ID NO: 8312301 - DNA, 22 bp, Homo sapiens
aggccctgcccagagctcctcg

SEQ ID NO: 8312302 - DNA, 22 bp, Homo sapiens
ccagccctgaaccctgctgcat

SEQ ID NO: 8312303 - DNA, 23 bp, Homo sapiens
ccagccctccaccagctctaggc

SEQ ID NO: 8312304 - DNA, 22 bp, Homo sapiens
ccagccctcctccatcagagga

SEQ ID NO: 8312305 - DNA, 22 bp, Homo sapiens
ccagaggcatgttcaaagcaat

SEQ ID NO: 8312306 - DNA, 20 bp, Homo sapiens
ccagagctgatggctgcccg

SEQ ID NO: 8312307 - DNA, 22 bp, Homo sapiens
ccagaggtgctgggagaggtct

SEQ ID NO: 8312308 - DNA, 21 bp, Homo sapiens
ccagaggcctctcttggccac

SEQ ID NO: 8312309 - DNA, 22 bp, Homo sapiens
aggccctgctttccagagctca

SEQ ID NO: 8312310 - DNA, 22 bp, Homo sapiens
ccagctccaggtagatgggcag

SEQ ID NO: 8312311 - DNA, 22 bp, Homo sapiens
ccagctccgggagttgctgctg

SEQ ID NO: 8312312 - DNA, 22 bp, Homo sapiens
ccagctccctgaagcctggtct

SEQ ID NO: 8312313 - DNA, 23 bp, Homo sapiens
ccagctcccaggtctgaggactg

SEQ ID NO: 8312314 - DNA, 22 bp, Homo sapiens
ccagctcccctcagcaggtaat

SEQ ID NO: 8312315 - DNA, 22 bp, Homo sapiens
ccaggaggtggagattgcagtg

SEQ ID NO: 8312316 - DNA, 22 bp, Homo sapiens
ccaggaggtggagattgcagtg

SEQ ID NO: 8312317 - DNA, 22 bp, Homo sapiens
aggctcagagatgagtaagcac

SEQ ID NO: 8312318 - DNA, 21 bp, Homo sapiens
aggctcagagatcaaacagta

SEQ ID NO: 8312319 - DNA, 22 bp, Homo sapiens
aggcctggtgtgccggatgcag

SEQ ID NO: 8312320 - DNA, 22 bp, Homo sapiens
aggcctggtgtgccggatgcag

SEQ ID NO: 8312321 - DNA, 22 bp, Homo sapiens
aggctcagagagctgtgtccat

SEQ ID NO: 8312322 - DNA, 19 bp, Homo sapiens
aggcctggggttttgcact

SEQ ID NO: 8312323 - DNA, 22 bp, Homo sapiens
aggcctgggtctcgtgcctacc

SEQ ID NO: 8312324 - DNA, 22 bp, Homo sapiens
aggcctgggcaagaaggggcgt

SEQ ID NO: 8312325 - DNA, 22 bp, Homo sapiens
aggcctggtgaatgaagtatct

SEQ ID NO: 8312326 - DNA, 22 bp, Homo sapiens
aggcctgggtgttcaccagaag

SEQ ID NO: 8312327 - DNA, 22 bp, Homo sapiens
aggcctgggtgttcaccagaag

SEQ ID NO: 8312328 - DNA, 20 bp, Homo sapiens
aggctcagagcagtagtaca

SEQ ID NO: 8312329 - DNA, 20 bp, Homo sapiens
ccaggcactgtcccatgcag

SEQ ID NO: 8312330 - DNA, 22 bp, Homo sapiens
ccagggcacttaggcccagccc

SEQ ID NO: 8312331 - DNA, 22 bp, Homo sapiens
ccagggcagaaaaagagggaat

SEQ ID NO: 8312332 - DNA, 22 bp, Homo sapiens
ccagggcagcgcccctccacgc

SEQ ID NO: 8312333 - DNA, 22 bp, Homo sapiens
ccaggtggtgaaagtgggccct

SEQ ID NO: 8312334 - DNA, 22 bp, Homo sapiens
ccagggcagcagaattggggca

SEQ ID NO: 8312335 - DNA, 22 bp, Homo sapiens
ccagggcagccaacccagatgc

SEQ ID NO: 8312336 - DNA, 19 bp, Homo sapiens
ccagtagagacagctgcag

SEQ ID NO: 8312337 - DNA, 18 bp, Homo sapiens
ccaggtggtgacagagat

SEQ ID NO: 8312338 - DNA, 22 bp, Homo sapiens
ccaggtggttcaggtcaccata

SEQ ID NO: 8312339 - DNA, 20 bp, Homo sapiens
ccaggtggtgcctggagagg

SEQ ID NO: 8312340 - DNA, 20 bp, Homo sapiens
ccaggtggtgcctggagagg

SEQ ID NO: 8312341 - DNA, 22 bp, Homo sapiens
aggctcagcccaaggtggagag

SEQ ID NO: 8312342 - DNA, 22 bp, Homo sapiens
aggctcagcatctgattcatat

SEQ ID NO: 8312343 - DNA, 21 bp, Homo sapiens
aggctcagcaggtgtataaag

SEQ ID NO: 8312344 - DNA, 22 bp, Homo sapiens
aggctctggttggcaagtaaag

SEQ ID NO: 8312345 - DNA, 22 bp, Homo sapiens
aggctcagatccttgtgtcctg

SEQ ID NO: 8312346 - DNA, 22 bp, Homo sapiens
ccaggcctttcttcttggtctg

SEQ ID NO: 8312347 - DNA, 22 bp, Homo sapiens
aggctcagattcacatttggtt

SEQ ID NO: 8312348 - DNA, 22 bp, Homo sapiens
ccaggcctcccttttccagcca

SEQ ID NO: 8312349 - DNA, 22 bp, Homo sapiens
ccaggcctgtgttgtgtggagg

SEQ ID NO: 8312350 - DNA, 22 bp, Homo sapiens
ccaggcctgtgttgtgtggagg

SEQ ID NO: 8312351 - DNA, 22 bp, Homo sapiens
ccaggccttccagtacgcagaa

SEQ ID NO: 8312352 - DNA, 22 bp, Homo sapiens
cccactctggctcccttctagt

SEQ ID NO: 8312353 - DNA, 18 bp, Homo sapiens
cccacggtgctgtagggc

SEQ ID NO: 8312354 - DNA, 22 bp, Homo sapiens
cccactccctgcacgcctgccg

SEQ ID NO: 8312355 - DNA, 22 bp, Homo sapiens
cccactccctgcacgcctgccg

SEQ ID NO: 8312356 - DNA, 22 bp, Homo sapiens
cccactccctacgacacgctcc

SEQ ID NO: 8312357 - DNA, 22 bp, Homo sapiens
cccagaggtgcttcagaggtgc

SEQ ID NO: 8312358 - DNA, 22 bp, Homo sapiens
aggctgccaaagcttctgtctc

SEQ ID NO: 8312359 - DNA, 23 bp, Homo sapiens
aggctgcagaagaatagggtcat

SEQ ID NO: 8312360 - DNA, 22 bp, Homo sapiens
aggctgcaggtctgggtcatgt

SEQ ID NO: 8312361 - DNA, 22 bp, Homo sapiens
aggctgcagtgcaggtaggatt

SEQ ID NO: 8312362 - DNA, 20 bp, Homo sapiens
aggctgccaggtctcacatc

SEQ ID NO: 8312363 - DNA, 22 bp, Homo sapiens
ccagtgggtgctgggctctgcc

SEQ ID NO: 8312364 - DNA, 22 bp, Homo sapiens
ccagtgggtaggccatggtgag

SEQ ID NO: 8312365 - DNA, 22 bp, Homo sapiens
ccagtgggtaggccatggtgag

SEQ ID NO: 8312366 - DNA, 22 bp, Homo sapiens
agggaaaggtagtgaggtcaca

SEQ ID NO: 8312367 - DNA, 21 bp, Homo sapiens
agggaaagaaaatgagctaat

SEQ ID NO: 8312368 - DNA, 22 bp, Homo sapiens
agggaaaggctgatgctgtggg

SEQ ID NO: 8312369 - DNA, 22 bp, Homo sapiens
agggaaagtaagcatttcatta

SEQ ID NO: 8312370 - DNA, 23 bp, Homo sapiens
agggaaagtagtaatggcctttg

SEQ ID NO: 8312371 - DNA, 22 bp, Homo sapiens
cccaggcctggtctgggccagt

SEQ ID NO: 8312372 - DNA, 22 bp, Homo sapiens
agggagctgtggtcagctcagt

SEQ ID NO: 8312373 - DNA, 22 bp, Homo sapiens
agggagcttccgaactacagct

SEQ ID NO: 8312374 - DNA, 22 bp, Homo sapiens
agggagctgctctgcttccgtg

SEQ ID NO: 8312375 - DNA, 22 bp, Homo sapiens
cccaggccagaacttggttgct

SEQ ID NO: 8312376 - DNA, 22 bp, Homo sapiens
cccaggccccagggcttgtcag

SEQ ID NO: 8312377 - DNA, 22 bp, Homo sapiens
agggacagttacatcatcagac

SEQ ID NO: 8312378 - DNA, 22 bp, Homo sapiens
agggacagtctactgttcactg

SEQ ID NO: 8312379 - DNA, 22 bp, Homo sapiens
ccctgaggggagtggtgaggtg

SEQ ID NO: 8312380 - DNA, 23 bp, Homo sapiens
agggcccaagcctggacagcagg

SEQ ID NO: 8312381 - DNA, 22 bp, Homo sapiens
agggccagggaagctgtatttt

SEQ ID NO: 8312382 - DNA, 22 bp, Homo sapiens
agggcccaggacagcatcaggg

SEQ ID NO: 8312383 - DNA, 22 bp, Homo sapiens
agggatgtaaattcttcttctt

SEQ ID NO: 8312384 - DNA, 22 bp, Homo sapiens
agggatggtggaggttgcaagt

SEQ ID NO: 8312385 - DNA, 22 bp, Homo sapiens
agggcagaaaccaccttgatgg

SEQ ID NO: 8312386 - DNA, 22 bp, Homo sapiens
cccaggtctgtgccagctctga

SEQ ID NO: 8312387 - DNA, 22 bp, Homo sapiens
cccaggtggcagaagctgcagt

SEQ ID NO: 8312388 - DNA, 22 bp, Homo sapiens
cccaggtgggttggcctctgtc

SEQ ID NO: 8312389 - DNA, 22 bp, Homo sapiens
agggcagaccacgtgcaaggat

SEQ ID NO: 8312390 - DNA, 22 bp, Homo sapiens
agggcagactaggatggaagtg

SEQ ID NO: 8312391 - DNA, 22 bp, Homo sapiens
agggcagactaggatggaagtg

SEQ ID NO: 8312392 - DNA, 22 bp, Homo sapiens
agggcagaagtacagacactta

SEQ ID NO: 8312393 - DNA, 22 bp, Homo sapiens
agggcagaccacgtgcaaggat

SEQ ID NO: 8312394 - DNA, 22 bp, Homo sapiens
agggcagaaatcgattacacct

SEQ ID NO: 8312395 - DNA, 22 bp, Homo sapiens
agggcagaaatattgatactgt

SEQ ID NO: 8312396 - DNA, 22 bp, Homo sapiens
agggcagagaaatgtagttgag

SEQ ID NO: 8312397 - DNA, 21 bp, Homo sapiens
cccctgggagccctgtcagta

SEQ ID NO: 8312398 - DNA, 22 bp, Homo sapiens
agggggtgctacttccagagtt

SEQ ID NO: 8312399 - DNA, 22 bp, Homo sapiens
aggggtgaaagagggccctcaa

SEQ ID NO: 8312400 - DNA, 22 bp, Homo sapiens
cctcctggtgggcgcttctggc

SEQ ID NO: 8312401 - DNA, 22 bp, Homo sapiens
cctcgacctccccaggctcagg

SEQ ID NO: 8312402 - DNA, 22 bp, Homo sapiens
aggggctgcctggcttggcact

SEQ ID NO: 8312403 - DNA, 22 bp, Homo sapiens
aggggctgactggaaagtgcca

SEQ ID NO: 8312404 - DNA, 22 bp, Homo sapiens
aggggctgactggaaagtgcca

SEQ ID NO: 8312405 - DNA, 22 bp, Homo sapiens
aggggctcctttgtgctgcgtc

SEQ ID NO: 8312406 - DNA, 22 bp, Homo sapiens
aggggctcagttactttggcag

SEQ ID NO: 8312407 - DNA, 22 bp, Homo sapiens
aggggcctggttggcctctgtt

SEQ ID NO: 8312408 - DNA, 21 bp, Homo sapiens
agggcctgtgctctccaggtc

SEQ ID NO: 8312409 - DNA, 22 bp, Homo sapiens
agggcctggcttcactttctca

SEQ ID NO: 8312410 - DNA, 19 bp, Homo sapiens
ccctggcaggcaagcctgg

SEQ ID NO: 8312411 - DNA, 22 bp, Homo sapiens
ccctggcataaaacttctccag

SEQ ID NO: 8312412 - DNA, 22 bp, Homo sapiens
ccctggcagaatgtctctgggc

SEQ ID NO: 8312413 - DNA, 22 bp, Homo sapiens
ccctggccagctcatgtctgag

SEQ ID NO: 8312414 - DNA, 22 bp, Homo sapiens
ccctggcatgcatgtccctggc

SEQ ID NO: 8312415 - DNA, 22 bp, Homo sapiens
ccctggccagctcatgtctgag

SEQ ID NO: 8312416 - DNA, 22 bp, Homo sapiens
agggcccatagatcgtcagctt

SEQ ID NO: 8312417 - DNA, 22 bp, Homo sapiens
cctcagggtggcatcagatctt

SEQ ID NO: 8312418 - DNA, 22 bp, Homo sapiens
cctcagggtctgaggagaccgt

SEQ ID NO: 8312419 - DNA, 22 bp, Homo sapiens
cctcaggggtgcccacagctgc

SEQ ID NO: 8312420 - DNA, 22 bp, Homo sapiens
cctcaggggcttttcgttgttg

SEQ ID NO: 8312421 - DNA, 18 bp, Homo sapiens
cctcaggggacctggcag

SEQ ID NO: 8312422 - DNA, 18 bp, Homo sapiens
cctcaggggacctggcag

SEQ ID NO: 8312423 - DNA, 22 bp, Homo sapiens
cctcagggaggcctctgtggct

SEQ ID NO: 8312424 - DNA, 22 bp, Homo sapiens
cctcagggccatctctgtccct

SEQ ID NO: 8312425 - DNA, 22 bp, Homo sapiens
agggctgggctgcttgttgtca

SEQ ID NO: 8312426 - DNA, 22 bp, Homo sapiens
cctcagggaggcctctgtggct

SEQ ID NO: 8312427 - DNA, 22 bp, Homo sapiens
agggctgagactaaggccagat

SEQ ID NO: 8312428 - DNA, 22 bp, Homo sapiens
ataccttttagacatgtagttg

SEQ ID NO: 8312429 - DNA, 22 bp, Homo sapiens
atacagtattacctgttcagga

SEQ ID NO: 8312430 - DNA, 23 bp, Homo sapiens
atacatacagtcttactgacttt

SEQ ID NO: 8312431 - DNA, 22 bp, Homo sapiens
atacatacgtacatacgtatgt

SEQ ID NO: 8312432 - DNA, 22 bp, Homo sapiens
ctggagagaaatgacaaagcta

SEQ ID NO: 8312433 - DNA, 22 bp, Homo sapiens
ctgctgccaagggtgccacagg

SEQ ID NO: 8312434 - DNA, 22 bp, Homo sapiens
ctgctgcattcctctttatgag

SEQ ID NO: 8312435 - DNA, 22 bp, Homo sapiens
ctgctgcattactcttctcaag

SEQ ID NO: 8312436 - DNA, 18 bp, Homo sapiens
ctgctgcaggcactcagg

SEQ ID NO: 8312437 - DNA, 22 bp, Homo sapiens
ctgctgcaggatgggcactctg

SEQ ID NO: 8312438 - DNA, 22 bp, Homo sapiens
ctggaatgcctccctgtcagag

SEQ ID NO: 8312439 - DNA, 22 bp, Homo sapiens
ctggctggcaagtagaacacaa

SEQ ID NO: 8312440 - DNA, 22 bp, Homo sapiens
ctggctcccagctttcagggag

SEQ ID NO: 8312441 - DNA, 22 bp, Homo sapiens
ctggctcccgttgtccttgaag

SEQ ID NO: 8312442 - DNA, 22 bp, Homo sapiens
ctggctccatccttgagctctg

SEQ ID NO: 8312443 - DNA, 22 bp, Homo sapiens
ctggctcacctccgctccagca

SEQ ID NO: 8312444 - DNA, 22 bp, Homo sapiens
ctggctcacaggtgagatgcat

SEQ ID NO: 8312445 - DNA, 22 bp, Homo sapiens
ctggctccatcactgggtgatg

SEQ ID NO: 8312446 - DNA, 22 bp, Homo sapiens
atagacttggttagtaaatttg

SEQ ID NO: 8312447 - DNA, 22 bp, Homo sapiens
ctggcccatggtgagctctggg

SEQ ID NO: 8312448 - DNA, 21 bp, Homo sapiens
ctgcatctcatagaacatgtc

SEQ ID NO: 8312449 - DNA, 22 bp, Homo sapiens
ctgcagagaattgtggggcttc

SEQ ID NO: 8312450 - DNA, 22 bp, Homo sapiens
ctgcagagaattgtggggcttc

SEQ ID NO: 8312451 - DNA, 22 bp, Homo sapiens
agttatattccatagattcaga

SEQ ID NO: 8312452 - DNA, 22 bp, Homo sapiens
agttattcatttattctgtaca

SEQ ID NO: 8312453 - DNA, 22 bp, Homo sapiens
ctgcaagattggaagatgcaat

SEQ ID NO: 8312454 - DNA, 22 bp, Homo sapiens
ataacagagttgggaagtgaaa

SEQ ID NO: 8312455 - DNA, 22 bp, Homo sapiens
ataacagatactctctgtgagg

SEQ ID NO: 8312456 - DNA, 22 bp, Homo sapiens
ataacagatgtgaagtgctaat

SEQ ID NO: 8312457 - DNA, 22 bp, Homo sapiens
ctgcctctcagcctgaccgcca

SEQ ID NO: 8312458 - DNA, 22 bp, Homo sapiens
ctgcctctccccagagtggccc

SEQ ID NO: 8312459 - DNA, 22 bp, Homo sapiens
ctgcctctccccagagtggccc

SEQ ID NO: 8312460 - DNA, 22 bp, Homo sapiens
ctgcctctcaggtccctgagat

SEQ ID NO: 8312461 - DNA, 22 bp, Homo sapiens
ctgcctctcaggtccctgagat

SEQ ID NO: 8312462 - DNA, 22 bp, Homo sapiens
ctgcctctccccagagtggccc

SEQ ID NO: 8312463 - DNA, 22 bp, Homo sapiens
ctgcctctgcgtcccacagagt

SEQ ID NO: 8312464 - DNA, 22 bp, Homo sapiens
ataagaaacattattctttcca

SEQ ID NO: 8312465 - DNA, 22 bp, Homo sapiens
ataatttactaagctctacctt

SEQ ID NO: 8312466 - DNA, 22 bp, Homo sapiens
ataagagctagtcttttccttg

SEQ ID NO: 8312467 - DNA, 22 bp, Homo sapiens
ctgctgaggtccttgctcagac

SEQ ID NO: 8312468 - DNA, 22 bp, Homo sapiens
atcaaagtttcccagaagttgt

SEQ ID NO: 8312469 - DNA, 23 bp, Homo sapiens
atcaaactggtgagaatgtcagt

SEQ ID NO: 8312470 - DNA, 22 bp, Homo sapiens
atcaaagtggaagtttactagg

SEQ ID NO: 8312471 - DNA, 22 bp, Homo sapiens
atcaaagttcgtaactgataac

SEQ ID NO: 8312472 - DNA, 23 bp, Homo sapiens
atcaaagtggaaatcaattatct

SEQ ID NO: 8312473 - DNA, 22 bp, Homo sapiens
atcaaagtccatcagaaggtag

SEQ ID NO: 8312474 - DNA, 22 bp, Homo sapiens
atcaaagtaggcatatgttttt

SEQ ID NO: 8312475 - DNA, 22 bp, Homo sapiens
ctgggctgagcctgggctgtgt

SEQ ID NO: 8312476 - DNA, 22 bp, Homo sapiens
atatgccattagctagaaataa

SEQ ID NO: 8312477 - DNA, 22 bp, Homo sapiens
atatgcatatgtcaaaacttat

SEQ ID NO: 8312478 - DNA, 22 bp, Homo sapiens
atatgcagtctcttgcccttct

SEQ ID NO: 8312479 - DNA, 22 bp, Homo sapiens
atatgcacatacatacataggt

SEQ ID NO: 8312480 - DNA, 22 bp, Homo sapiens
atatgcacactctgcccacaga

SEQ ID NO: 8312481 - DNA, 22 bp, Homo sapiens
ctgggctcagatgagaggaagg

SEQ ID NO: 8312482 - DNA, 22 bp, Homo sapiens
ctgggcctggtagggcttgaaa

SEQ ID NO: 8312483 - DNA, 22 bp, Homo sapiens
ctggctgggagcgagctgctca

SEQ ID NO: 8312484 - DNA, 22 bp, Homo sapiens
ctggctggccggagcgaggcgg

SEQ ID NO: 8312485 - DNA, 22 bp, Homo sapiens
ctggctggccggaggcatccct

SEQ ID NO: 8312486 - DNA, 22 bp, Homo sapiens
ctggctggccggaggcatccct

SEQ ID NO: 8312487 - DNA, 22 bp, Homo sapiens
ctggcttcctcaggagcagtgg

SEQ ID NO: 8312488 - DNA, 22 bp, Homo sapiens
ctggcttccatgctgtagtggc

SEQ ID NO: 8312489 - DNA, 22 bp, Homo sapiens
cttcttgctgggggcctcagtg

SEQ ID NO: 8312490 - DNA, 22 bp, Homo sapiens
cttcttgcaattttcatcttat

SEQ ID NO: 8312491 - DNA, 22 bp, Homo sapiens
cttcttaatgacagattaaaat

SEQ ID NO: 8312492 - DNA, 22 bp, Homo sapiens
atctgacaacctattgacttga

SEQ ID NO: 8312493 - DNA, 22 bp, Homo sapiens
cttcctcctccatctcgaaggc

SEQ ID NO: 8312494 - DNA, 22 bp, Homo sapiens
atctctgcatccctcaaggttg

SEQ ID NO: 8312495 - DNA, 22 bp, Homo sapiens
atctctgccaacagttaatgtt

SEQ ID NO: 8312496 - DNA, 22 bp, Homo sapiens
atctctgcgtccccagcatcga

SEQ ID NO: 8312497 - DNA, 17 bp, Homo sapiens
cttcccaccatctcctg

SEQ ID NO: 8312498 - DNA, 22 bp, Homo sapiens
cttcctcatgtgcaatgcaagc

SEQ ID NO: 8312499 - DNA, 22 bp, Homo sapiens
cttcctcacggtgcaacaggaa

SEQ ID NO: 8312500 - DNA, 22 bp, Homo sapiens
cttcctcccccacacactcact

SEQ ID NO: 8312501 - DNA, 22 bp, Homo sapiens
cttcctcccggcccatgctctg

SEQ ID NO: 8312502 - DNA, 22 bp, Homo sapiens
cttcccactagtatcacagagc

SEQ ID NO: 8312503 - DNA, 22 bp, Homo sapiens
cttcctcacggtgcaacaggaa

SEQ ID NO: 8312504 - DNA, 22 bp, Homo sapiens
cttagaaattgttactcattca

SEQ ID NO: 8312505 - DNA, 20 bp, Homo sapiens
cttagaaatttttaccctgg

SEQ ID NO: 8312506 - DNA, 22 bp, Homo sapiens
cttagagatgggttttacttag

SEQ ID NO: 8312507 - DNA, 22 bp, Homo sapiens
atcctgggcagtgtgtcactct

SEQ ID NO: 8312508 - DNA, 22 bp, Homo sapiens
ctgtgtggactggttgaggccc

SEQ ID NO: 8312509 - DNA, 22 bp, Homo sapiens
ctgtgtggcctcaagccagcct

SEQ ID NO: 8312510 - DNA, 22 bp, Homo sapiens
ctgtgtgctgaaatgcagtgag

SEQ ID NO: 8312511 - DNA, 22 bp, Homo sapiens
atccagttctcagtgcttacag

SEQ ID NO: 8312512 - DNA, 22 bp, Homo sapiens
atccagtttatgtcatattctt

SEQ ID NO: 8312513 - DNA, 22 bp, Homo sapiens
atccagggtgtggagagagctc

SEQ ID NO: 8312514 - DNA, 22 bp, Homo sapiens
atccagggataaaagtaaggtt

SEQ ID NO: 8312515 - DNA, 22 bp, Homo sapiens
ctgtggctaggaagctgtggga

SEQ ID NO: 8312516 - DNA, 22 bp, Homo sapiens
ctgtggctatggtgtacatact

SEQ ID NO: 8312517 - DNA, 22 bp, Homo sapiens
ctctgggcttgttgacctgcac

SEQ ID NO: 8312518 - DNA, 22 bp, Homo sapiens
ctctggctttgctcatgcatcc

SEQ ID NO: 8312519 - DNA, 22 bp, Homo sapiens
ctctggctttcccagggaggag

SEQ ID NO: 8312520 - DNA, 22 bp, Homo sapiens
ctctgggcttgttgacctgcac

SEQ ID NO: 8312521 - DNA, 18 bp, Homo sapiens
ctctgctaatgggcagct

SEQ ID NO: 8312522 - DNA, 23 bp, Homo sapiens
ctctgcaggagagtgggcagggc

SEQ ID NO: 8312523 - DNA, 23 bp, Homo sapiens
ctctgcaggagagtgggcagggc

SEQ ID NO: 8312524 - DNA, 22 bp, Homo sapiens
ctctgcaggggaggcatgcact

SEQ ID NO: 8312525 - DNA, 17 bp, Homo sapiens
ctctgcagtgcatggct

SEQ ID NO: 8312526 - DNA, 22 bp, Homo sapiens
ctctcaggcttgggtcgtggca

SEQ ID NO: 8312527 - DNA, 20 bp, Homo sapiens
ctctgcagcaaggcctgggt

SEQ ID NO: 8312528 - DNA, 22 bp, Homo sapiens
ctctgagcccgctgcagcccca

SEQ ID NO: 8312529 - DNA, 20 bp, Homo sapiens
agtgtctgggcctcaggccc

SEQ ID NO: 8312530 - DNA, 22 bp, Homo sapiens
ctgaaggaagcaggtggcctgt

SEQ ID NO: 8312531 - DNA, 22 bp, Homo sapiens
ctgaaggaagcagaagcgaggt

SEQ ID NO: 8312532 - DNA, 22 bp, Homo sapiens
ctgaaattccatttcagccaca

SEQ ID NO: 8312533 - DNA, 22 bp, Homo sapiens
ctgaatgtcgatcagcttgggt

SEQ ID NO: 8312534 - DNA, 22 bp, Homo sapiens
agttatataactatctagatgc

SEQ ID NO: 8312535 - DNA, 22 bp, Homo sapiens
ctgagctgggactcagtagcaa

SEQ ID NO: 8312536 - DNA, 22 bp, Homo sapiens
ctgaggagagatcacgtggtgt

SEQ ID NO: 8312537 - DNA, 22 bp, Homo sapiens
agttacttgagacgtttatgaa

SEQ ID NO: 8312538 - DNA, 22 bp, Homo sapiens
ctcctgggaatttagttgtgag

SEQ ID NO: 8312539 - DNA, 22 bp, Homo sapiens
agtggcagaggttgactgcagt

SEQ ID NO: 8312540 - DNA, 22 bp, Homo sapiens
agtggcagagctgtgtcttgaa

SEQ ID NO: 8312541 - DNA, 22 bp, Homo sapiens
agtggcagatctctggtctgga

SEQ ID NO: 8312542 - DNA, 18 bp, Homo sapiens
ctccagggaactcagtca

SEQ ID NO: 8312543 - DNA, 20 bp, Homo sapiens
ctccagggaacagactggag

SEQ ID NO: 8312544 - DNA, 22 bp, Homo sapiens
ctccagggaaaggggcgtccgc

SEQ ID NO: 8312545 - DNA, 22 bp, Homo sapiens
ctcctcactttccagactgggc

SEQ ID NO: 8312546 - DNA, 22 bp, Homo sapiens
ctcctcacacccactgcaacca

SEQ ID NO: 8312547 - DNA, 20 bp, Homo sapiens
agtccctttggtcaggtatt

SEQ ID NO: 8312548 - DNA, 22 bp, Homo sapiens
agtccctgtactttccactgcc

SEQ ID NO: 8312549 - DNA, 22 bp, Homo sapiens
agtcctggccccaaggaaggat

SEQ ID NO: 8312550 - DNA, 22 bp, Homo sapiens
ctcatggatataagaactgttt

SEQ ID NO: 8312551 - DNA, 22 bp, Homo sapiens
ctcattgcccagatccccacag

SEQ ID NO: 8312552 - DNA, 22 bp, Homo sapiens
agtcttcagagaaattaactct

SEQ ID NO: 8312553 - DNA, 22 bp, Homo sapiens
agtcttccctgtgccagagtgt

SEQ ID NO: 8312554 - DNA, 22 bp, Homo sapiens
agtcttccctgtgccagagtgt

SEQ ID NO: 8312555 - DNA, 22 bp, Homo sapiens
agtcttcccagaggaggtgcca

SEQ ID NO: 8312556 - DNA, 21 bp, Homo sapiens
aggtcccaggtttgggcagca

SEQ ID NO: 8312557 - DNA, 22 bp, Homo sapiens
aggtcccaggcatagctggtct

SEQ ID NO: 8312558 - DNA, 22 bp, Homo sapiens
cctggatgatccatgtcatgga

SEQ ID NO: 8312559 - DNA, 22 bp, Homo sapiens
cctggatgatccatgtcatgga

SEQ ID NO: 8312560 - DNA, 22 bp, Homo sapiens
aggtcattccttgtcttcttgc

SEQ ID NO: 8312561 - DNA, 22 bp, Homo sapiens
aggtcattgaagttattttctt

SEQ ID NO: 8312562 - DNA, 19 bp, Homo sapiens
aggtcattgatagtgcagg

SEQ ID NO: 8312563 - DNA, 22 bp, Homo sapiens
aggtcattacaattatcatttt

SEQ ID NO: 8312564 - DNA, 22 bp, Homo sapiens
aggtcattccagccattcccct

SEQ ID NO: 8312565 - DNA, 22 bp, Homo sapiens
aggtcattggggactatctccg

SEQ ID NO: 8312566 - DNA, 22 bp, Homo sapiens
aggtcattaaagttaaatgagg

SEQ ID NO: 8312567 - DNA, 22 bp, Homo sapiens
aggtacagggtgaaagtttatg

SEQ ID NO: 8312568 - DNA, 22 bp, Homo sapiens
aggtacagcaatataagaggtc

SEQ ID NO: 8312569 - DNA, 21 bp, Homo sapiens
cctgccaggaaactgagtgtc

SEQ ID NO: 8312570 - DNA, 21 bp, Homo sapiens
cctgccaggaaactgagtgtc

SEQ ID NO: 8312571 - DNA, 22 bp, Homo sapiens
aggtagggttaatggagatata

SEQ ID NO: 8312572 - DNA, 22 bp, Homo sapiens
cctgcagctccggatttctggg

SEQ ID NO: 8312573 - DNA, 22 bp, Homo sapiens
cctgccagatcccctgagctga

SEQ ID NO: 8312574 - DNA, 23 bp, Homo sapiens
cctgcagctgctggggctccacc

SEQ ID NO: 8312575 - DNA, 22 bp, Homo sapiens
cctgccagcatggcttatctcc

SEQ ID NO: 8312576 - DNA, 22 bp, Homo sapiens
cctgccagcccgcgttcatgcc

SEQ ID NO: 8312577 - DNA, 22 bp, Homo sapiens
cctgcagagccacgtgccagcg

SEQ ID NO: 8312578 - DNA, 18 bp, Homo sapiens
cctgcagcccaggaggcc

SEQ ID NO: 8312579 - DNA, 21 bp, Homo sapiens
cctgcagcaccagaaggagat

SEQ ID NO: 8312580 - DNA, 22 bp, Homo sapiens
cctgtctccctggcatggctca

SEQ ID NO: 8312581 - DNA, 22 bp, Homo sapiens
cctgtgaggtcatctgtggtaa

SEQ ID NO: 8312582 - DNA, 22 bp, Homo sapiens
cctgtgcatccggtggtcattg

SEQ ID NO: 8312583 - DNA, 22 bp, Homo sapiens
cctgtcctccaagagcacatct

SEQ ID NO: 8312584 - DNA, 20 bp, Homo sapiens
cctgtctcctcttacctggc

SEQ ID NO: 8312585 - DNA, 20 bp, Homo sapiens
cctgtctcacgttccgcccc

SEQ ID NO: 8312586 - DNA, 22 bp, Homo sapiens
cctgtctccctggcatggctca

SEQ ID NO: 8312587 - DNA, 22 bp, Homo sapiens
cctgtcatactaacgtagtggg

SEQ ID NO: 8312588 - DNA, 22 bp, Homo sapiens
aggtggggagtatatgtaattg

SEQ ID NO: 8312589 - DNA, 22 bp, Homo sapiens
aggtggggccaaatgctacagt

SEQ ID NO: 8312590 - DNA, 22 bp, Homo sapiens
aggtggggccaaatgctacagt

SEQ ID NO: 8312591 - DNA, 21 bp, Homo sapiens
aggtggggctgcacctctgct

SEQ ID NO: 8312592 - DNA, 21 bp, Homo sapiens
aggtggggctgcacctctgct

SEQ ID NO: 8312593 - DNA, 22 bp, Homo sapiens
aggtggggcccaccaatttgca

SEQ ID NO: 8312594 - DNA, 22 bp, Homo sapiens
aggtggggaggagtgtctcttt

SEQ ID NO: 8312595 - DNA, 22 bp, Homo sapiens
aggtggggaggagtgtctcttt

SEQ ID NO: 8312596 - DNA, 22 bp, Homo sapiens
cctgggcataaatcactccaag

SEQ ID NO: 8312597 - DNA, 22 bp, Homo sapiens
cctgggcataaatcactccaag

SEQ ID NO: 8312598 - DNA, 22 bp, Homo sapiens
cctggctctgtcctcgcgcaaa

SEQ ID NO: 8312599 - DNA, 22 bp, Homo sapiens
cctgggcttgcatctgtgctgg

SEQ ID NO: 8312600 - DNA, 22 bp, Homo sapiens
cctgggcttctgtctagatgtt

SEQ ID NO: 8312601 - DNA, 20 bp, Homo sapiens
cctgggctccaggagccccg

SEQ ID NO: 8312602 - DNA, 22 bp, Homo sapiens
cctgtcagttgctgtcagggat

SEQ ID NO: 8312603 - DNA, 22 bp, Homo sapiens
cctgtcagggtttgcctcagaa

SEQ ID NO: 8312604 - DNA, 22 bp, Homo sapiens
cctgtcagctgatggctatgta

SEQ ID NO: 8312605 - DNA, 22 bp, Homo sapiens
cctgggctttcaaaaccagcct

SEQ ID NO: 8312606 - DNA, 22 bp, Homo sapiens
agtatgtattttatacttacag

SEQ ID NO: 8312607 - DNA, 22 bp, Homo sapiens
agtatgtagtgcaatcagtcag

SEQ ID NO: 8312608 - DNA, 22 bp, Homo sapiens
agtatttcctggcttatctgct

SEQ ID NO: 8312609 - DNA, 22 bp, Homo sapiens
ctagaaatgctcaagagaaagt

SEQ ID NO: 8312610 - DNA, 22 bp, Homo sapiens
ctagaaatattttacagtcaag

SEQ ID NO: 8312611 - DNA, 22 bp, Homo sapiens
ctacatttttcaccgagcctct

SEQ ID NO: 8312612 - DNA, 22 bp, Homo sapiens
ctacatttggagagtataggaa

SEQ ID NO: 8312613 - DNA, 22 bp, Homo sapiens
ctacatttcccagctgccttcc

SEQ ID NO: 8312614 - DNA, 22 bp, Homo sapiens
ctacattttgtgattatgaaat

SEQ ID NO: 8312615 - DNA, 22 bp, Homo sapiens
ctacatttgttctatagctttt

SEQ ID NO: 8312616 - DNA, 22 bp, Homo sapiens
ctacattttaataagctgctta

SEQ ID NO: 8312617 - DNA, 22 bp, Homo sapiens
ctagtcactcagcactgacaaa

SEQ ID NO: 8312618 - DNA, 22 bp, Homo sapiens
agtcccagctactcaagaggct

SEQ ID NO: 8312619 - DNA, 22 bp, Homo sapiens
agtcccagctactcaagaggct

SEQ ID NO: 8312620 - DNA, 22 bp, Homo sapiens
ctagggtggatttgtgcagagt

SEQ ID NO: 8312621 - DNA, 22 bp, Homo sapiens
cgggcagatcacacagggcttg

SEQ ID NO: 8312622 - DNA, 22 bp, Homo sapiens
cgggcagattgggaaggttcat

SEQ ID NO: 8312623 - DNA, 21 bp, Homo sapiens
cgggctggccgggccctcacc

SEQ ID NO: 8312624 - DNA, 22 bp, Homo sapiens
agtacagacctgtctcttcctg

SEQ ID NO: 8312625 - DNA, 22 bp, Homo sapiens
cctgttcttgtctcattggcta

SEQ ID NO: 8312626 - DNA, 22 bp, Homo sapiens
cgaggcctcctcgccgccaccg

SEQ ID NO: 8312627 - DNA, 19 bp, Homo sapiens
cgcaggagccgaggtgacc

SEQ ID NO: 8312628 - DNA, 22 bp, Homo sapiens
aggttttcagctgtatcctgag

SEQ ID NO: 8312629 - DNA, 22 bp, Homo sapiens
gctgttctgcgtcccaggctgg

SEQ ID NO: 8312630 - DNA, 22 bp, Homo sapiens
gctgttcctgcttagaggtcgg

SEQ ID NO: 8312631 - DNA, 22 bp, Homo sapiens
gctgttcccatgtggggctcag

SEQ ID NO: 8312632 - DNA, 22 bp, Homo sapiens
caatgtgtttgcatattaaaat

SEQ ID NO: 8312633 - DNA, 22 bp, Homo sapiens
caatgtgtcaggaaaagggcca

SEQ ID NO: 8312634 - DNA, 22 bp, Homo sapiens
caatgtgtgcttacaggccagt

SEQ ID NO: 8312635 - DNA, 22 bp, Homo sapiens
caatgtgtgtgtttttctcaac

SEQ ID NO: 8312636 - DNA, 22 bp, Homo sapiens
caaggcctgcctctggcagaaa

SEQ ID NO: 8312637 - DNA, 22 bp, Homo sapiens
caaggcaggaagcctgtcttat

SEQ ID NO: 8312638 - DNA, 22 bp, Homo sapiens
gctggctgtatcacctggccag

SEQ ID NO: 8312639 - DNA, 22 bp, Homo sapiens
gctggctgggtccctgagaggc

SEQ ID NO: 8312640 - DNA, 22 bp, Homo sapiens
caagggtggtattgggagcata

SEQ ID NO: 8312641 - DNA, 22 bp, Homo sapiens
caagggtggtattgggagcata

SEQ ID NO: 8312642 - DNA, 20 bp, Homo sapiens
caagggtttgcattggcttt

SEQ ID NO: 8312643 - DNA, 19 bp, Homo sapiens
caagggttgggtctgtcat

SEQ ID NO: 8312644 - DNA, 22 bp, Homo sapiens
caaatgtgacttttgggcttct

SEQ ID NO: 8312645 - DNA, 22 bp, Homo sapiens
caaatgtgtaaggaagtgttag

SEQ ID NO: 8312646 - DNA, 22 bp, Homo sapiens
caaatgtggtttctcagcattc

SEQ ID NO: 8312647 - DNA, 22 bp, Homo sapiens
cacagagtggaggcttggcctg

SEQ ID NO: 8312648 - DNA, 22 bp, Homo sapiens
ggagcctgacagtgcccagcat

SEQ ID NO: 8312649 - DNA, 22 bp, Homo sapiens
ggagctgctccttcagccaagt

SEQ ID NO: 8312650 - DNA, 22 bp, Homo sapiens
ggagctgctcagagccagtccc

SEQ ID NO: 8312651 - DNA, 19 bp, Homo sapiens
ggagcctggagcacgtgcc

SEQ ID NO: 8312652 - DNA, 22 bp, Homo sapiens
ggagcctgcgggagctcccatt

SEQ ID NO: 8312653 - DNA, 22 bp, Homo sapiens
ggagctgctttgatctgaagaa

SEQ ID NO: 8312654 - DNA, 22 bp, Homo sapiens
ggaggcaggaaagacaggttca

SEQ ID NO: 8312655 - DNA, 22 bp, Homo sapiens
cacaggcttccagtccccagct

SEQ ID NO: 8312656 - DNA, 22 bp, Homo sapiens
cacaggcttgtcagcatgaggc

SEQ ID NO: 8312657 - DNA, 22 bp, Homo sapiens
ggaggcaggaaagacaggttca

SEQ ID NO: 8312658 - DNA, 22 bp, Homo sapiens
ggaggccaaagtgtgggcggct

SEQ ID NO: 8312659 - DNA, 22 bp, Homo sapiens
ggaggccaaggcaggcggatca

SEQ ID NO: 8312660 - DNA, 22 bp, Homo sapiens
ggaggccaaggcaggtggatca

SEQ ID NO: 8312661 - DNA, 22 bp, Homo sapiens
ggaggccaaggaggagcttgcc

SEQ ID NO: 8312662 - DNA, 22 bp, Homo sapiens
ggaggccaaggagggcggatca

SEQ ID NO: 8312663 - DNA, 22 bp, Homo sapiens
cacacagatggtaagggaggga

SEQ ID NO: 8312664 - DNA, 22 bp, Homo sapiens
ggaagggcctcgggcgtgggac

SEQ ID NO: 8312665 - DNA, 22 bp, Homo sapiens
cacacaggagagtgctggaggt

SEQ ID NO: 8312666 - DNA, 22 bp, Homo sapiens
cacagaataaattggtatcaga

SEQ ID NO: 8312667 - DNA, 22 bp, Homo sapiens
cacagaagtttcatagtctcga

SEQ ID NO: 8312668 - DNA, 22 bp, Homo sapiens
cacagaatctgtgactccaaga

SEQ ID NO: 8312669 - DNA, 22 bp, Homo sapiens
cacagaagaatcatgctgtgtt

SEQ ID NO: 8312670 - DNA, 22 bp, Homo sapiens
cacagaattaagggagaaatat

SEQ ID NO: 8312671 - DNA, 22 bp, Homo sapiens
ggactgggagaatggaggcaag

SEQ ID NO: 8312672 - DNA, 22 bp, Homo sapiens
cacagagagctacgtgcagcgt

SEQ ID NO: 8312673 - DNA, 22 bp, Homo sapiens
ggactggggccaacacctccct

SEQ ID NO: 8312674 - DNA, 17 bp, Homo sapiens
ggactgggcggggcagg

SEQ ID NO: 8312675 - DNA, 22 bp, Homo sapiens
ggactgggattctggatctgct

SEQ ID NO: 8312676 - DNA, 22 bp, Homo sapiens
ggactgggcatgggtgctctgc

SEQ ID NO: 8312677 - DNA, 22 bp, Homo sapiens
cacagaggaaaggcagttggta

SEQ ID NO: 8312678 - DNA, 22 bp, Homo sapiens
cacagaggactgtagcggggag

SEQ ID NO: 8312679 - DNA, 22 bp, Homo sapiens
cacagaggcaaccttctggggt

SEQ ID NO: 8312680 - DNA, 22 bp, Homo sapiens
ggcagggaggaggtgaaagtga

SEQ ID NO: 8312681 - DNA, 22 bp, Homo sapiens
cacataagtgggttccattgca

SEQ ID NO: 8312682 - DNA, 22 bp, Homo sapiens
cacatacaatggtgttatttgg

SEQ ID NO: 8312683 - DNA, 22 bp, Homo sapiens
ggaggtgaggccgtagggtgtg

SEQ ID NO: 8312684 - DNA, 22 bp, Homo sapiens
ggcaggtgcacctgagccatct

SEQ ID NO: 8312685 - DNA, 22 bp, Homo sapiens
ggccactccgctgctactggaa

SEQ ID NO: 8312686 - DNA, 22 bp, Homo sapiens
ggccaagatggaaggagagatg

SEQ ID NO: 8312687 - DNA, 22 bp, Homo sapiens
ggccgggcaggtctcagccagc

SEQ ID NO: 8312688 - DNA, 22 bp, Homo sapiens
cacctgtacagggccgggctgg

SEQ ID NO: 8312689 - DNA, 22 bp, Homo sapiens
ggcctctctccagtcagtgcag

SEQ ID NO: 8312690 - DNA, 22 bp, Homo sapiens
ggcctctctccctggcttgcag

SEQ ID NO: 8312691 - DNA, 22 bp, Homo sapiens
ggccactgctctccagcctggg

SEQ ID NO: 8312692 - DNA, 22 bp, Homo sapiens
ggccctgtcctggctgtctccg

SEQ ID NO: 8312693 - DNA, 22 bp, Homo sapiens
ggccctgtggttttgcaaagtc

SEQ ID NO: 8312694 - DNA, 22 bp, Homo sapiens
ggccctgttagagctcccacaa

SEQ ID NO: 8312695 - DNA, 22 bp, Homo sapiens
ggcctgtccagcctgcctggct

SEQ ID NO: 8312696 - DNA, 22 bp, Homo sapiens
ggcctgtaatcccagctactca

SEQ ID NO: 8312697 - DNA, 22 bp, Homo sapiens
ggcctgtctcacccccgggtgc

SEQ ID NO: 8312698 - DNA, 22 bp, Homo sapiens
ggcctgtgagcccttgcatgta

SEQ ID NO: 8312699 - DNA, 22 bp, Homo sapiens
ggcctgggctccgggagttact

SEQ ID NO: 8312700 - DNA, 21 bp, Homo sapiens
ggcctgagcacctgtccacct

SEQ ID NO: 8312701 - DNA, 22 bp, Homo sapiens
ggcctctctccttggcttgcag

SEQ ID NO: 8312702 - DNA, 22 bp, Homo sapiens
ggcctgagcagacagcatgatg

SEQ ID NO: 8312703 - DNA, 20 bp, Homo sapiens
ggcctgagcatggctggcag

SEQ ID NO: 8312704 - DNA, 22 bp, Homo sapiens
ggcctgagcagacagcatgatg

SEQ ID NO: 8312705 - DNA, 22 bp, Homo sapiens
ggcctgaggcaatagtcagaca

SEQ ID NO: 8312706 - DNA, 18 bp, Homo sapiens
ggcctgaggatttcagca

SEQ ID NO: 8312707 - DNA, 22 bp, Homo sapiens
ggcctgagctctggggaggcaa

SEQ ID NO: 8312708 - DNA, 20 bp, Homo sapiens
ggcctgagcatggctggcag

SEQ ID NO: 8312709 - DNA, 22 bp, Homo sapiens
ggcctgagcttgggcagcgtat

SEQ ID NO: 8312710 - DNA, 22 bp, Homo sapiens
ggcctgagctctggggaggcaa

SEQ ID NO: 8312711 - DNA, 18 bp, Homo sapiens
ggctcaggctatcctaac

SEQ ID NO: 8312712 - DNA, 22 bp, Homo sapiens
ggctcaggctggagtgcagtgg

SEQ ID NO: 8312713 - DNA, 22 bp, Homo sapiens
ggctcaggctggagtgcagtgg

SEQ ID NO: 8312714 - DNA, 22 bp, Homo sapiens
ggctcagggaatgaggaagaat

SEQ ID NO: 8312715 - DNA, 22 bp, Homo sapiens
ggctcaggggccaggcctgtcc

SEQ ID NO: 8312716 - DNA, 22 bp, Homo sapiens
ggctcagggaatgaggaagaat

SEQ ID NO: 8312717 - DNA, 19 bp, Homo sapiens
ggctcagggcgctgccgcc

SEQ ID NO: 8312718 - DNA, 22 bp, Homo sapiens
ggcctgtgtcctccttgccctg

SEQ ID NO: 8312719 - DNA, 22 bp, Homo sapiens
ggctcaatgcaacttctgcctc

SEQ ID NO: 8312720 - DNA, 22 bp, Homo sapiens
ggcctgtgtctgtgcctgtcct

SEQ ID NO: 8312721 - DNA, 22 bp, Homo sapiens
ggcctgtgtctgtgcctgtcct

SEQ ID NO: 8312722 - DNA, 22 bp, Homo sapiens
ggctctggtgggaaggttagat

SEQ ID NO: 8312723 - DNA, 22 bp, Homo sapiens
ggctctggtgccctggctccca

SEQ ID NO: 8312724 - DNA, 22 bp, Homo sapiens
ggctctggtgagggtaggagat

SEQ ID NO: 8312725 - DNA, 22 bp, Homo sapiens
ggctctggtgagggtaggagat

SEQ ID NO: 8312726 - DNA, 22 bp, Homo sapiens
ggctgagctcaggggcagcagg

SEQ ID NO: 8312727 - DNA, 22 bp, Homo sapiens
ggctgagcctggagcatctggt

SEQ ID NO: 8312728 - DNA, 22 bp, Homo sapiens
ggctcaggtttaaagtgcttta

SEQ ID NO: 8312729 - DNA, 22 bp, Homo sapiens
ggctcaggttaccagtccctcc

SEQ ID NO: 8312730 - DNA, 22 bp, Homo sapiens
ggctcaggttgggtcacatgac

SEQ ID NO: 8312731 - DNA, 22 bp, Homo sapiens
ggctctgggttctgcaatgcgt

SEQ ID NO: 8312732 - DNA, 20 bp, Homo sapiens
ggctctggaatctggtgggc

SEQ ID NO: 8312733 - DNA, 22 bp, Homo sapiens
ggctctggtcagtgaggggcct

SEQ ID NO: 8312734 - DNA, 22 bp, Homo sapiens
ggctgcctcaaagctcaagctc

SEQ ID NO: 8312735 - DNA, 22 bp, Homo sapiens
ggctgcctactttcccagagtt

SEQ ID NO: 8312736 - DNA, 22 bp, Homo sapiens
cagaaaacctgactctagaact

SEQ ID NO: 8312737 - DNA, 22 bp, Homo sapiens
ggctgccataacagagtaccac

SEQ ID NO: 8312738 - DNA, 22 bp, Homo sapiens
ggctgccataactgataccata

SEQ ID NO: 8312739 - DNA, 19 bp, Homo sapiens
ggctgtctcggcccagcca

SEQ ID NO: 8312740 - DNA, 19 bp, Homo sapiens
ggctgtctggcgtgtggat

SEQ ID NO: 8312741 - DNA, 22 bp, Homo sapiens
ggctgtctctgtgactgccacc

SEQ ID NO: 8312742 - DNA, 22 bp, Homo sapiens
ggctgtctgtggtggagcgttg

SEQ ID NO: 8312743 - DNA, 22 bp, Homo sapiens
ggctgtccttggccaaggcact

SEQ ID NO: 8312744 - DNA, 22 bp, Homo sapiens
ggctgtccttggccaaggcact

SEQ ID NO: 8312745 - DNA, 22 bp, Homo sapiens
ggggagagtcctttccagttcc

SEQ ID NO: 8312746 - DNA, 22 bp, Homo sapiens
cagagggctcttggctgcctgc

SEQ ID NO: 8312747 - DNA, 22 bp, Homo sapiens
cagagggctcagtcctgctgga

SEQ ID NO: 8312748 - DNA, 21 bp, Homo sapiens
cagaggggctagcctggctgc

SEQ ID NO: 8312749 - DNA, 19 bp, Homo sapiens
cagagtccttgaccagtcc

SEQ ID NO: 8312750 - DNA, 22 bp, Homo sapiens
cagagtcctggacacagagaca

SEQ ID NO: 8312751 - DNA, 22 bp, Homo sapiens
ggtcatgctgtgaatcagtgct

SEQ ID NO: 8312752 - DNA, 22 bp, Homo sapiens
ggtcattgtcagagcctgtact

SEQ ID NO: 8312753 - DNA, 22 bp, Homo sapiens
ggtcattgaaatcagaagggtt

SEQ ID NO: 8312754 - DNA, 22 bp, Homo sapiens
ggtcattgttcttttctgtgat

SEQ ID NO: 8312755 - DNA, 22 bp, Homo sapiens
cagaggtaccagcagcctctgg

SEQ ID NO: 8312756 - DNA, 22 bp, Homo sapiens
cagaggtagaaggcatgcagtg

SEQ ID NO: 8312757 - DNA, 22 bp, Homo sapiens
ggtcacaggggagaagagtgat

SEQ ID NO: 8312758 - DNA, 22 bp, Homo sapiens
cagaggtacaagctaagttggg

SEQ ID NO: 8312759 - DNA, 22 bp, Homo sapiens
ggtcaggtttttaggagtgacc

SEQ ID NO: 8312760 - DNA, 19 bp, Homo sapiens
ggtgaccacctggtcagtg

SEQ ID NO: 8312761 - DNA, 22 bp, Homo sapiens
cagcaagatttttaaagcaagg

SEQ ID NO: 8312762 - DNA, 22 bp, Homo sapiens
ggtgactggtttatctggcagt

SEQ ID NO: 8312763 - DNA, 22 bp, Homo sapiens
ggtgactggagggacccaggcc

SEQ ID NO: 8312764 - DNA, 17 bp, Homo sapiens
ggtgagacctcccactc

SEQ ID NO: 8312765 - DNA, 22 bp, Homo sapiens
ggtgctggacacgtggcactcc

SEQ ID NO: 8312766 - DNA, 22 bp, Homo sapiens
gggccagagcttggcagctggg

SEQ ID NO: 8312767 - DNA, 19 bp, Homo sapiens
cagagcctcagagctagaa

SEQ ID NO: 8312768 - DNA, 22 bp, Homo sapiens
cagagcctcagaatcctgtgga

SEQ ID NO: 8312769 - DNA, 22 bp, Homo sapiens
cagagcctaaaacgactccact

SEQ ID NO: 8312770 - DNA, 22 bp, Homo sapiens
gggctgactctgcactgagcca

SEQ ID NO: 8312771 - DNA, 22 bp, Homo sapiens
cagagcctgccacctttctccc

SEQ ID NO: 8312772 - DNA, 22 bp, Homo sapiens
cagagcctgcctctggctgtgg

SEQ ID NO: 8312773 - DNA, 22 bp, Homo sapiens
cagagcctgctcacgtctctgt

SEQ ID NO: 8312774 - DNA, 22 bp, Homo sapiens
cagagctgcttcccagtttgtg

SEQ ID NO: 8312775 - DNA, 22 bp, Homo sapiens
cagagctgggcatggtgaaagg

SEQ ID NO: 8312776 - DNA, 22 bp, Homo sapiens
cagagctgggtttgggaaacct

SEQ ID NO: 8312777 - DNA, 23 bp, Homo sapiens
cagagctggcttcatgggtgtgc

SEQ ID NO: 8312778 - DNA, 22 bp, Homo sapiens
cagagctgggatcccatgggcg

SEQ ID NO: 8312779 - DNA, 22 bp, Homo sapiens
gggctgaggggtatctcatggg

SEQ ID NO: 8312780 - DNA, 22 bp, Homo sapiens
gggctgagtctgctgcctgtca

SEQ ID NO: 8312781 - DNA, 22 bp, Homo sapiens
ggcttcaccaggtgcatgcatg

SEQ ID NO: 8312782 - DNA, 22 bp, Homo sapiens
ggcttcaccgcggggttgcagg

SEQ ID NO: 8312783 - DNA, 22 bp, Homo sapiens
cagaccctcgggtgagttggcc

SEQ ID NO: 8312784 - DNA, 19 bp, Homo sapiens
cagacctgtccagcctgtg

SEQ ID NO: 8312785 - DNA, 23 bp, Homo sapiens
cagacctggcagtcatcctcaac

SEQ ID NO: 8312786 - DNA, 22 bp, Homo sapiens
cagacctggaaaacaggcttgc

SEQ ID NO: 8312787 - DNA, 20 bp, Homo sapiens
cagacctgcacccacttcga

SEQ ID NO: 8312788 - DNA, 22 bp, Homo sapiens
cagacctgaggttgagtaccag

SEQ ID NO: 8312789 - DNA, 22 bp, Homo sapiens
cagactggccacatctgcactg

SEQ ID NO: 8312790 - DNA, 22 bp, Homo sapiens
gggcagcagagccctgccgagt

SEQ ID NO: 8312791 - DNA, 22 bp, Homo sapiens
cagagacagggcagggagtgtg

SEQ ID NO: 8312792 - DNA, 22 bp, Homo sapiens
cagagacagtttcacagggtct

SEQ ID NO: 8312793 - DNA, 22 bp, Homo sapiens
gggcagtggtccaggctacagc

SEQ ID NO: 8312794 - DNA, 22 bp, Homo sapiens
gggcagtggttacacagctgag

SEQ ID NO: 8312795 - DNA, 22 bp, Homo sapiens
gggcagtgggtggctgcagcct

SEQ ID NO: 8312796 - DNA, 22 bp, Homo sapiens
gggcagtggctcacgcctgtaa

SEQ ID NO: 8312797 - DNA, 20 bp, Homo sapiens
gggcagtggcgctatctcag

SEQ ID NO: 8312798 - DNA, 22 bp, Homo sapiens
gggcagcagcaggaggtctctg

SEQ ID NO: 8312799 - DNA, 22 bp, Homo sapiens
gggcagcagaggatcccttaat

SEQ ID NO: 8312800 - DNA, 22 bp, Homo sapiens
gtcccagaggctttggccacag

SEQ ID NO: 8312801 - DNA, 22 bp, Homo sapiens
gtcccagatgtctggaactccc

SEQ ID NO: 8312802 - DNA, 22 bp, Homo sapiens
gtcccagagagcactagtccat

SEQ ID NO: 8312803 - DNA, 22 bp, Homo sapiens
gtcccagaggacagggtcacat

SEQ ID NO: 8312804 - DNA, 22 bp, Homo sapiens
gtcccaggcagagtcaggaggg

SEQ ID NO: 8312805 - DNA, 22 bp, Homo sapiens
gtcccagaaacatattgctggt

SEQ ID NO: 8312806 - DNA, 22 bp, Homo sapiens
cagcaggctctgagtggctgcc

SEQ ID NO: 8312807 - DNA, 22 bp, Homo sapiens
cagcaggctgcgattgctcatt

SEQ ID NO: 8312808 - DNA, 22 bp, Homo sapiens
gtcatgccagcggagctcggga

SEQ ID NO: 8312809 - DNA, 22 bp, Homo sapiens
gtcatgcctggcttcttagaca

SEQ ID NO: 8312810 - DNA, 22 bp, Homo sapiens
cagcaggcgttgggagaaagac

SEQ ID NO: 8312811 - DNA, 20 bp, Homo sapiens
gtcatcgccggcagcaaaga

SEQ ID NO: 8312812 - DNA, 22 bp, Homo sapiens
cagcagctgcgtgcccaggccg

SEQ ID NO: 8312813 - DNA, 22 bp, Homo sapiens
cagcagctgggaaggaggctga

SEQ ID NO: 8312814 - DNA, 22 bp, Homo sapiens
cagcagctgatggggaagtgat

SEQ ID NO: 8312815 - DNA, 22 bp, Homo sapiens
cagcagctggtgagacacagcc

SEQ ID NO: 8312816 - DNA, 20 bp, Homo sapiens
cagcaggaaaagtgcctcag

SEQ ID NO: 8312817 - DNA, 22 bp, Homo sapiens
cagcagcttctgttgatcagaa

SEQ ID NO: 8312818 - DNA, 22 bp, Homo sapiens
cagcagctttgccaagtcagcc

SEQ ID NO: 8312819 - DNA, 22 bp, Homo sapiens
cagccctcaggtcctcagcagc

SEQ ID NO: 8312820 - DNA, 22 bp, Homo sapiens
gtctgtcatctgagatggagtg

SEQ ID NO: 8312821 - DNA, 22 bp, Homo sapiens
gtctgtctctctccagagtgca

SEQ ID NO: 8312822 - DNA, 22 bp, Homo sapiens
gtctgtctctctccagagtgca

SEQ ID NO: 8312823 - DNA, 22 bp, Homo sapiens
cagccccatggtgtgctccagc

SEQ ID NO: 8312824 - DNA, 22 bp, Homo sapiens
cagcccctcacagagctgtcct

SEQ ID NO: 8312825 - DNA, 22 bp, Homo sapiens
cagcccctccctcaggcaggtg

SEQ ID NO: 8312826 - DNA, 22 bp, Homo sapiens
cagccaggtatgggcgtgcggg

SEQ ID NO: 8312827 - DNA, 22 bp, Homo sapiens
cagccagggagggcaaatgaga

SEQ ID NO: 8312828 - DNA, 22 bp, Homo sapiens
cagccagggtcaggcagcttct

SEQ ID NO: 8312829 - DNA, 22 bp, Homo sapiens
gtccctggtctaccgtggcttc

SEQ ID NO: 8312830 - DNA, 22 bp, Homo sapiens
gtcccttggctcacaaacagct

SEQ ID NO: 8312831 - DNA, 22 bp, Homo sapiens
gtccctgggatgcccttctggg

SEQ ID NO: 8312832 - DNA, 22 bp, Homo sapiens
gtccctggggaatcagctggag

SEQ ID NO: 8312833 - DNA, 22 bp, Homo sapiens
gtcccaggcttatgtggagctt

SEQ ID NO: 8312834 - DNA, 22 bp, Homo sapiens
gtcccagggaagaaggcagcac

SEQ ID NO: 8312835 - DNA, 22 bp, Homo sapiens
cagccagggagcaaagagttga

SEQ ID NO: 8312836 - DNA, 22 bp, Homo sapiens
cagccaggcctggtgaccaaag

SEQ ID NO: 8312837 - DNA, 22 bp, Homo sapiens
gtctggagccaccctaagcatt

SEQ ID NO: 8312838 - DNA, 22 bp, Homo sapiens
cagccctgccatggagcctcct

SEQ ID NO: 8312839 - DNA, 22 bp, Homo sapiens
cagccctggaacagctgactca

SEQ ID NO: 8312840 - DNA, 20 bp, Homo sapiens
cagcctccactcactcagct

SEQ ID NO: 8312841 - DNA, 22 bp, Homo sapiens
cagcctgacaccagctttgggc

SEQ ID NO: 8312842 - DNA, 22 bp, Homo sapiens
cagcctgcagggctgcctgttg

SEQ ID NO: 8312843 - DNA, 20 bp, Homo sapiens
cagcctgcatcatctgcagc

SEQ ID NO: 8312844 - DNA, 20 bp, Homo sapiens
cagcctgcatcatctgcagc

SEQ ID NO: 8312845 - DNA, 22 bp, Homo sapiens
cagcctgccctggaagcccagc

SEQ ID NO: 8312846 - DNA, 22 bp, Homo sapiens
cagcctgcatttgtatctgtat

SEQ ID NO: 8312847 - DNA, 22 bp, Homo sapiens
cagcctgggctccagagtccct

SEQ ID NO: 8312848 - DNA, 22 bp, Homo sapiens
cagcctgtagaatacagtaaat

SEQ ID NO: 8312849 - DNA, 22 bp, Homo sapiens
cagcctgtctgggcagagtgga

SEQ ID NO: 8312850 - DNA, 22 bp, Homo sapiens
cagcctgctagggcaatgcctt

SEQ ID NO: 8312851 - DNA, 21 bp, Homo sapiens
atgacagatgctgcagatcgt

SEQ ID NO: 8312852 - DNA, 19 bp, Homo sapiens
atgatacaggtgaaaattg

SEQ ID NO: 8312853 - DNA, 22 bp, Homo sapiens
atgaaccataggcaagacaata

SEQ ID NO: 8312854 - DNA, 22 bp, Homo sapiens
ctttcttcaacctcattctgca

SEQ ID NO: 8312855 - DNA, 22 bp, Homo sapiens
cttctttactttctagaaataa

SEQ ID NO: 8312856 - DNA, 22 bp, Homo sapiens
atctggctattgacatgttata

SEQ ID NO: 8312857 - DNA, 22 bp, Homo sapiens
atctggctcacctgggtaaata

SEQ ID NO: 8312858 - DNA, 22 bp, Homo sapiens
atctggctatttctggtcgggg

SEQ ID NO: 8312859 - DNA, 22 bp, Homo sapiens
atctggctcacttagtctagga

SEQ ID NO: 8312860 - DNA, 22 bp, Homo sapiens
ctttcccttagccccattctat

SEQ ID NO: 8312861 - DNA, 22 bp, Homo sapiens
ctttcccttttgccttgcgtgg

SEQ ID NO: 8312862 - DNA, 22 bp, Homo sapiens
ctttcctagatggccatctttc

SEQ ID NO: 8312863 - DNA, 22 bp, Homo sapiens
gaatcacggtattctgcacggg

SEQ ID NO: 8312864 - DNA, 22 bp, Homo sapiens
gaacaatagtggtaacaaagcc

SEQ ID NO: 8312865 - DNA, 22 bp, Homo sapiens
gaaggctggctttctgagagca

SEQ ID NO: 8312866 - DNA, 22 bp, Homo sapiens
atgcacagcagtgagttcagtg

SEQ ID NO: 8312867 - DNA, 22 bp, Homo sapiens
atgcacagacccaaaggccatc

SEQ ID NO: 8312868 - DNA, 22 bp, Homo sapiens
gacatttcaatctcattatggg

SEQ ID NO: 8312869 - DNA, 22 bp, Homo sapiens
gacacatagatctatctcactc

SEQ ID NO: 8312870 - DNA, 22 bp, Homo sapiens
gactgggcagccggtagggaag

SEQ ID NO: 8312871 - DNA, 22 bp, Homo sapiens
atgctctggagtacgtgaaatt

SEQ ID NO: 8312872 - DNA, 22 bp, Homo sapiens
gatacaaattcatgtctgaatt

SEQ ID NO: 8312873 - DNA, 22 bp, Homo sapiens
gatatgaagtggcattgtgaag

SEQ ID NO: 8312874 - DNA, 22 bp, Homo sapiens
gaggtggcctcaagcagtcttc

SEQ ID NO: 8312875 - DNA, 22 bp, Homo sapiens
atgtgacaatatttggtcttat

SEQ ID NO: 8312876 - DNA, 22 bp, Homo sapiens
atgtgaaagaggtgttcagtgg

SEQ ID NO: 8312877 - DNA, 22 bp, Homo sapiens
atgtgaaactgaagcatccata

SEQ ID NO: 8312878 - DNA, 22 bp, Homo sapiens
gagggctgaagattgtggcccc

SEQ ID NO: 8312879 - DNA, 22 bp, Homo sapiens
atgtccttctcctcttacctgc

SEQ ID NO: 8312880 - DNA, 22 bp, Homo sapiens
atgtccttccattttgatctgt

SEQ ID NO: 8312881 - DNA, 22 bp, Homo sapiens
atgtctaaaagataaagtttaa

SEQ ID NO: 8312882 - DNA, 22 bp, Homo sapiens
atgtcctttgcttctctggtcc

SEQ ID NO: 8312883 - DNA, 22 bp, Homo sapiens
atgtagcagaagatgttttcct

SEQ ID NO: 8312884 - DNA, 20 bp, Homo sapiens
atgtagatgaaagcaaaggc

SEQ ID NO: 8312885 - DNA, 22 bp, Homo sapiens
atgtagcatgaggcactgtgcc

SEQ ID NO: 8312886 - DNA, 22 bp, Homo sapiens
atgtagcatctatcctgataaa

SEQ ID NO: 8312887 - DNA, 22 bp, Homo sapiens
atgtagcagatatttgtgcaca

SEQ ID NO: 8312888 - DNA, 22 bp, Homo sapiens
atggtgtagcatgtgatatgac

SEQ ID NO: 8312889 - DNA, 22 bp, Homo sapiens
gaggcagcagggctggttcctt

SEQ ID NO: 8312890 - DNA, 22 bp, Homo sapiens
gaggcagcatctatggtgggaa

SEQ ID NO: 8312891 - DNA, 22 bp, Homo sapiens
gaggcagcatggtaccttggag

SEQ ID NO: 8312892 - DNA, 18 bp, Homo sapiens
atggtctcatactgggag

SEQ ID NO: 8312893 - DNA, 22 bp, Homo sapiens
atgggctgtcctagtccagccc

SEQ ID NO: 8312894 - DNA, 22 bp, Homo sapiens
atggggagagaagggctgagct

SEQ ID NO: 8312895 - DNA, 22 bp, Homo sapiens
atgggctgtgaggtccggcagg

SEQ ID NO: 8312896 - DNA, 20 bp, Homo sapiens
gagatggctaagtgctgaac

SEQ ID NO: 8312897 - DNA, 22 bp, Homo sapiens
gagagtcactgtctgcatttcc

SEQ ID NO: 8312898 - DNA, 22 bp, Homo sapiens
gagacatggcaaaagcactggt

SEQ ID NO: 8312899 - DNA, 22 bp, Homo sapiens
gactgggctccaagagggagag

SEQ ID NO: 8312900 - DNA, 22 bp, Homo sapiens
gagagcacatgaacatggagga

SEQ ID NO: 8312901 - DNA, 17 bp, Homo sapiens
gagatgggtggatcacc

SEQ ID NO: 8312902 - DNA, 17 bp, Homo sapiens
gagatgggtggatcacc

SEQ ID NO: 8312903 - DNA, 22 bp, Homo sapiens
gagatggggaataggagcaagc

SEQ ID NO: 8312904 - DNA, 22 bp, Homo sapiens
gagatggggtcagctgggacat

SEQ ID NO: 8312905 - DNA, 22 bp, Homo sapiens
caaaatgtgagtcccacctcaa

SEQ ID NO: 8312906 - DNA, 22 bp, Homo sapiens
caaaatgttctggcacctttaa

SEQ ID NO: 8312907 - DNA, 22 bp, Homo sapiens
atttttctctttccactgagat

SEQ ID NO: 8312908 - DNA, 22 bp, Homo sapiens
atttttgtatccccagctcctg

SEQ ID NO: 8312909 - DNA, 22 bp, Homo sapiens
atttttctctcacacttaccag

SEQ ID NO: 8312910 - DNA, 22 bp, Homo sapiens
atttttctctccactccattaa

SEQ ID NO: 8312911 - DNA, 22 bp, Homo sapiens
atttttatgacaaaccatcctc

SEQ ID NO: 8312912 - DNA, 22 bp, Homo sapiens
atttttccatgatacttatctg

SEQ ID NO: 8312913 - DNA, 22 bp, Homo sapiens
atttttccaattaggataaaga

SEQ ID NO: 8312914 - DNA, 21 bp, Homo sapiens
gctcttggaaggggctcagct

SEQ ID NO: 8312915 - DNA, 22 bp, Homo sapiens
caaatgcatagaaagatgaaac

SEQ ID NO: 8312916 - DNA, 20 bp, Homo sapiens
gctgacccctgctgtcatgc

SEQ ID NO: 8312917 - DNA, 22 bp, Homo sapiens
caaatgcatagtttataagaag

SEQ ID NO: 8312918 - DNA, 22 bp, Homo sapiens
caaatgcatgagaaataagagg

SEQ ID NO: 8312919 - DNA, 22 bp, Homo sapiens
caaatgctaacttctttccaaa

SEQ ID NO: 8312920 - DNA, 22 bp, Homo sapiens
caaatgctggccctgctactta

SEQ ID NO: 8312921 - DNA, 22 bp, Homo sapiens
caaaggaggtaatgggtgtgag

SEQ ID NO: 8312922 - DNA, 22 bp, Homo sapiens
caaagtgctggaattacaggtg

SEQ ID NO: 8312923 - DNA, 22 bp, Homo sapiens
caaagctcatgctcttagccat

SEQ ID NO: 8312924 - DNA, 18 bp, Homo sapiens
caaagctcacgttccatc

SEQ ID NO: 8312925 - DNA, 22 bp, Homo sapiens
caaagcctctgatttcacttgt

SEQ ID NO: 8312926 - DNA, 22 bp, Homo sapiens
caaagcctctgatttcacttgt

SEQ ID NO: 8312927 - DNA, 22 bp, Homo sapiens
gccccctctttggagccagcca

SEQ ID NO: 8312928 - DNA, 22 bp, Homo sapiens
gcctgaagaacagctgtgagga

SEQ ID NO: 8312929 - DNA, 22 bp, Homo sapiens
gcctaggagtacagaatggttt

SEQ ID NO: 8312930 - DNA, 22 bp, Homo sapiens
gcctaggagtggggatggcggt

SEQ ID NO: 8312931 - DNA, 22 bp, Homo sapiens
gcctaggagacaagcgtgaaag

SEQ ID NO: 8312932 - DNA, 21 bp, Homo sapiens
gcctagggagatgggactgcc

SEQ ID NO: 8312933 - DNA, 22 bp, Homo sapiens
gcctggcacattgcagtggatt

SEQ ID NO: 8312934 - DNA, 22 bp, Homo sapiens
gcctggcaaggccctgttgact

SEQ ID NO: 8312935 - DNA, 22 bp, Homo sapiens
gcctggagttgtggtgaagcca

SEQ ID NO: 8312936 - DNA, 22 bp, Homo sapiens
gcctggaggaatgtagctgagg

SEQ ID NO: 8312937 - DNA, 22 bp, Homo sapiens
gcctgagattctgcatttctaa

SEQ ID NO: 8312938 - DNA, 22 bp, Homo sapiens
gcctgagattcccggagccgtg

SEQ ID NO: 8312939 - DNA, 22 bp, Homo sapiens
gcctgagacagtgtggtccaat

SEQ ID NO: 8312940 - DNA, 22 bp, Homo sapiens
gcctgagagacccatggggcaa

SEQ ID NO: 8312941 - DNA, 22 bp, Homo sapiens
gcctgagagtctgcatttctaa

SEQ ID NO: 8312942 - DNA, 22 bp, Homo sapiens
gcctgagaaggataggaagcga

SEQ ID NO: 8312943 - DNA, 22 bp, Homo sapiens
gcctgaagtttcatgcctctat

SEQ ID NO: 8312944 - DNA, 22 bp, Homo sapiens
gccaggtgctatccctgcgctg

SEQ ID NO: 8312945 - DNA, 22 bp, Homo sapiens
gccaggtgcatggctgagtctc

SEQ ID NO: 8312946 - DNA, 22 bp, Homo sapiens
gccaggctggtgcaaggatatt

SEQ ID NO: 8312947 - DNA, 22 bp, Homo sapiens
gccaggctggtcttgaactcct

SEQ ID NO: 8312948 - DNA, 22 bp, Homo sapiens
gccaggctggccagcaccttct

SEQ ID NO: 8312949 - DNA, 22 bp, Homo sapiens
gccaggctggaaagaacagaca

SEQ ID NO: 8312950 - DNA, 22 bp, Homo sapiens
gccaggctggcaaaaggaaacc

SEQ ID NO: 8312951 - DNA, 22 bp, Homo sapiens
atttctgataaacgtaagctgc

SEQ ID NO: 8312952 - DNA, 22 bp, Homo sapiens
gccccaggttgcctgtcccagg

SEQ ID NO: 8312953 - DNA, 22 bp, Homo sapiens
atttccatacacccatttctga

SEQ ID NO: 8312954 - DNA, 22 bp, Homo sapiens
gcagctggacccacacggctta

SEQ ID NO: 8312955 - DNA, 22 bp, Homo sapiens
gcagctgctgtggcatcaagct

SEQ ID NO: 8312956 - DNA, 22 bp, Homo sapiens
gcagctgctgtggcatcaagct

SEQ ID NO: 8312957 - DNA, 22 bp, Homo sapiens
gcagctggaagtgacactctgt

SEQ ID NO: 8312958 - DNA, 22 bp, Homo sapiens
gcagctgcctattcagggcttg

SEQ ID NO: 8312959 - DNA, 22 bp, Homo sapiens
gcagctgctggaagttcctgcc

SEQ ID NO: 8312960 - DNA, 22 bp, Homo sapiens
gcagctgctggaagttcctgcc

SEQ ID NO: 8312961 - DNA, 22 bp, Homo sapiens
attcttggcaaggagatttaaa

SEQ ID NO: 8312962 - DNA, 22 bp, Homo sapiens
attcttggagcagtcaaagaag

SEQ ID NO: 8312963 - DNA, 22 bp, Homo sapiens
gcagggctgctgaaacttgttt

SEQ ID NO: 8312964 - DNA, 22 bp, Homo sapiens
gcagggctgcagagggcactgt

SEQ ID NO: 8312965 - DNA, 22 bp, Homo sapiens
gcaggccttggcaatgagcctg

SEQ ID NO: 8312966 - DNA, 22 bp, Homo sapiens
gcaggcctgactgtagggggca

SEQ ID NO: 8312967 - DNA, 22 bp, Homo sapiens
gccaaagcagtcttgcctctgc

SEQ ID NO: 8312968 - DNA, 22 bp, Homo sapiens
attgtctgaatccaaagctctg

SEQ ID NO: 8312969 - DNA, 22 bp, Homo sapiens
attgtctgtactttaaaaatgt

SEQ ID NO: 8312970 - DNA, 22 bp, Homo sapiens
attgtcttctggtcttatcttt

SEQ ID NO: 8312971 - DNA, 22 bp, Homo sapiens
attgtctttggtgcttccagga

SEQ ID NO: 8312972 - DNA, 22 bp, Homo sapiens
gccaagagaatgtgagagaaat

SEQ ID NO: 8312973 - DNA, 22 bp, Homo sapiens
gccacagggcagatgcgcagag

SEQ ID NO: 8312974 - DNA, 17 bp, Homo sapiens
gccaaagggttccaatc

SEQ ID NO: 8312975 - DNA, 22 bp, Homo sapiens
gcatacagagaggatgtggcat

SEQ ID NO: 8312976 - DNA, 22 bp, Homo sapiens
gcagtgtgaccgagcttgcttc

SEQ ID NO: 8312977 - DNA, 20 bp, Homo sapiens
attgtcagccttcagaggag

SEQ ID NO: 8312978 - DNA, 22 bp, Homo sapiens
attgtcgcttatttaggtgctt

SEQ ID NO: 8312979 - DNA, 22 bp, Homo sapiens
attgtacttttattacatgtag

SEQ ID NO: 8312980 - DNA, 22 bp, Homo sapiens
gcagatggaaagtgcttgaggg

SEQ ID NO: 8312981 - DNA, 21 bp, Homo sapiens
gcagcagaggcttgacagaca

SEQ ID NO: 8312982 - DNA, 22 bp, Homo sapiens
gcagcagagctttgtcctggct

SEQ ID NO: 8312983 - DNA, 22 bp, Homo sapiens
gcagcagaggccctactctttg

SEQ ID NO: 8312984 - DNA, 22 bp, Homo sapiens
gcagcagagaacacaatgatgg

SEQ ID NO: 8312985 - DNA, 17 bp, Homo sapiens
gcagcagagagaccctc

SEQ ID NO: 8312986 - DNA, 22 bp, Homo sapiens
gcagcagagtttgggagatggt

SEQ ID NO: 8312987 - DNA, 22 bp, Homo sapiens
gcagcagatgctttcatggaca

SEQ ID NO: 8312988 - DNA, 22 bp, Homo sapiens
gcagcagagtttgggagatggt

SEQ ID NO: 8312989 - DNA, 22 bp, Homo sapiens
attcagttctaaggtcagtgcc

SEQ ID NO: 8312990 - DNA, 22 bp, Homo sapiens
gcactaaaccaacatgtaataa

SEQ ID NO: 8312991 - DNA, 22 bp, Homo sapiens
attcaagagcccatgtttcctg

SEQ ID NO: 8312992 - DNA, 21 bp, Homo sapiens
gatttcacttaccttcattta

SEQ ID NO: 8312993 - DNA, 22 bp, Homo sapiens
gatttccttgcatattggtaat

SEQ ID NO: 8312994 - DNA, 17 bp, Homo sapiens
gatttcctgaagttctt

SEQ ID NO: 8312995 - DNA, 22 bp, Homo sapiens
gatttcctagacatggggcaga

SEQ ID NO: 8312996 - DNA, 22 bp, Homo sapiens
gatttcctcactaacatccatc

SEQ ID NO: 8312997 - DNA, 22 bp, Homo sapiens
gatttcctaatgtggatctctg

SEQ ID NO: 8312998 - DNA, 22 bp, Homo sapiens
ccagtcccgcatggtccagaat

SEQ ID NO: 8312999 - DNA, 20 bp, Homo sapiens
ccagtccctgagcaccaggg

SEQ ID NO: 8313000 - DNA, 22 bp, Homo sapiens
tgagggctgcttccagagctag

SEQ ID NO: 8313001 - DNA, 22 bp, Homo sapiens
ccagtctgaggcctggtgaggg

SEQ ID NO: 8313002 - DNA, 22 bp, Homo sapiens
tgaggtaggtggtaagagatac

SEQ ID NO: 8313003 - DNA, 22 bp, Homo sapiens
ccattgtaaagagtatactttg

SEQ ID NO: 8313004 - DNA, 22 bp, Homo sapiens
cccaccctcaagggtgtctata

SEQ ID NO: 8313005 - DNA, 22 bp, Homo sapiens
cccacccctggacaggtgagtg

SEQ ID NO: 8313006 - DNA, 22 bp, Homo sapiens
cccagacataacagcagagagg

SEQ ID NO: 8313007 - DNA, 22 bp, Homo sapiens
cccagaaggtcgaggctgcagt

SEQ ID NO: 8313008 - DNA, 22 bp, Homo sapiens
cccagactcctctggctggtgg

SEQ ID NO: 8313009 - DNA, 22 bp, Homo sapiens
cccagactcatccctgggagct

SEQ ID NO: 8313010 - DNA, 22 bp, Homo sapiens
tgaggcagcaattgtattgtat

SEQ ID NO: 8313011 - DNA, 22 bp, Homo sapiens
tgaggcagaaattcctgttttc

SEQ ID NO: 8313012 - DNA, 22 bp, Homo sapiens
tgagacagttctgcagctgggt

SEQ ID NO: 8313013 - DNA, 17 bp, Homo sapiens
ccaggtgggaggtgggg

SEQ ID NO: 8313014 - DNA, 19 bp, Homo sapiens
ccaggtggaactgaggtag

SEQ ID NO: 8313015 - DNA, 17 bp, Homo sapiens
ccaggtggaatcgtgga

SEQ ID NO: 8313016 - DNA, 22 bp, Homo sapiens
ccaggtggaaggtctgtgctct

SEQ ID NO: 8313017 - DNA, 22 bp, Homo sapiens
ccaggtggaaggtctgtgctct

SEQ ID NO: 8313018 - DNA, 21 bp, Homo sapiens
ccagggtccagctgccatggt

SEQ ID NO: 8313019 - DNA, 22 bp, Homo sapiens
ccaggggctggtgctgagctgg

SEQ ID NO: 8313020 - DNA, 19 bp, Homo sapiens
tgagaaggcagtggggagc

SEQ ID NO: 8313021 - DNA, 17 bp, Homo sapiens
tgagaagtaggcatcat

SEQ ID NO: 8313022 - DNA, 22 bp, Homo sapiens
tgacaatacagagagagcaaaa

SEQ ID NO: 8313023 - DNA, 22 bp, Homo sapiens
ccaggggaaacagggagcactc

SEQ ID NO: 8313024 - DNA, 22 bp, Homo sapiens
ccaggctggagtgcagtggcac

SEQ ID NO: 8313025 - DNA, 22 bp, Homo sapiens
ccaggctggagtgcaatggtgc

SEQ ID NO: 8313026 - DNA, 22 bp, Homo sapiens
ccaggctggattttgcagttca

SEQ ID NO: 8313027 - DNA, 22 bp, Homo sapiens
ccagctctcagcgggagactca

SEQ ID NO: 8313028 - DNA, 22 bp, Homo sapiens
tctgcttctgtgaaggcagtct

SEQ ID NO: 8313029 - DNA, 23 bp, Homo sapiens
tctgcttctgtattttttcccat

SEQ ID NO: 8313030 - DNA, 22 bp, Homo sapiens
tctgctttattacactagccaa

SEQ ID NO: 8313031 - DNA, 22 bp, Homo sapiens
ccagagacgtcggtcagggcgc

SEQ ID NO: 8313032 - DNA, 22 bp, Homo sapiens
tctcagagaaatgtgtcaccat

SEQ ID NO: 8313033 - DNA, 22 bp, Homo sapiens
tctcagagaacagttggtgctt

SEQ ID NO: 8313034 - DNA, 22 bp, Homo sapiens
ccagctgctgtgaggaccacag

SEQ ID NO: 8313035 - DNA, 22 bp, Homo sapiens
ccagctgctgtgcagggaggct

SEQ ID NO: 8313036 - DNA, 22 bp, Homo sapiens
ccagctgcgggcatcgagagtt

SEQ ID NO: 8313037 - DNA, 22 bp, Homo sapiens
ccagctctgcagggcctggggt

SEQ ID NO: 8313038 - DNA, 22 bp, Homo sapiens
ccagctctgccaagcgtcagct

SEQ ID NO: 8313039 - DNA, 20 bp, Homo sapiens
ccagctgagccaaggggaga

SEQ ID NO: 8313040 - DNA, 22 bp, Homo sapiens
ccagctgaggcagccacacagg

SEQ ID NO: 8313041 - DNA, 22 bp, Homo sapiens
ccagctgattcggtggtggttg

SEQ ID NO: 8313042 - DNA, 22 bp, Homo sapiens
ccagctgcaggggagcagtgga

SEQ ID NO: 8313043 - DNA, 22 bp, Homo sapiens
ccagctgcaggtgttccagatg

SEQ ID NO: 8313044 - DNA, 22 bp, Homo sapiens
tctggtaacctttatccctcct

SEQ ID NO: 8313045 - DNA, 22 bp, Homo sapiens
tctgggagatccaagcagaact

SEQ ID NO: 8313046 - DNA, 22 bp, Homo sapiens
tctgggagcacacgcagtgatc

SEQ ID NO: 8313047 - DNA, 22 bp, Homo sapiens
ccaggactcagtggggaaaggg

SEQ ID NO: 8313048 - DNA, 22 bp, Homo sapiens
tctggttagccaataatgccaa

SEQ ID NO: 8313049 - DNA, 22 bp, Homo sapiens
ccaggacttattacagtataac

SEQ ID NO: 8313050 - DNA, 22 bp, Homo sapiens
ccaggactttaagtccagcact

SEQ ID NO: 8313051 - DNA, 22 bp, Homo sapiens
ccaggacttcgaggctacagtg

SEQ ID NO: 8313052 - DNA, 22 bp, Homo sapiens
ccaggacttcgaggctacagtg

SEQ ID NO: 8313053 - DNA, 22 bp, Homo sapiens
tctggctcagggctctgaggga

SEQ ID NO: 8313054 - DNA, 22 bp, Homo sapiens
tctggctcaggtcagacaggga

SEQ ID NO: 8313055 - DNA, 18 bp, Homo sapiens
tctggctcaggactgaac

SEQ ID NO: 8313056 - DNA, 22 bp, Homo sapiens
tctggctcaggagctgtgttca

SEQ ID NO: 8313057 - DNA, 22 bp, Homo sapiens
tctggctcaaaatacgtactct

SEQ ID NO: 8313058 - DNA, 22 bp, Homo sapiens
tctggctcacttcaggcttcac

SEQ ID NO: 8313059 - DNA, 17 bp, Homo sapiens
tctggccttcctgaact

SEQ ID NO: 8313060 - DNA, 22 bp, Homo sapiens
tctggcctgggcctgccggtgc

SEQ ID NO: 8313061 - DNA, 22 bp, Homo sapiens
tctggccttatctgtccaagcc

SEQ ID NO: 8313062 - DNA, 22 bp, Homo sapiens
tctggcctgaaagtccatgctt

SEQ ID NO: 8313063 - DNA, 22 bp, Homo sapiens
tctggcaggggttctgcacttg

SEQ ID NO: 8313064 - DNA, 22 bp, Homo sapiens
tctggcctatttctgtcagatc

SEQ ID NO: 8313065 - DNA, 22 bp, Homo sapiens
tctggcctactggagtccatga

SEQ ID NO: 8313066 - DNA, 22 bp, Homo sapiens
tctggcaggcaatcggctctgg

SEQ ID NO: 8313067 - DNA, 22 bp, Homo sapiens
ccaggccattcccagagttgct

SEQ ID NO: 8313068 - DNA, 19 bp, Homo sapiens
ccaggccatcccagttccc

SEQ ID NO: 8313069 - DNA, 22 bp, Homo sapiens
tctttcttgtgggtgccctttt

SEQ ID NO: 8313070 - DNA, 22 bp, Homo sapiens
tctttcttattagccattgttc

SEQ ID NO: 8313071 - DNA, 22 bp, Homo sapiens
ccaggcctgcatctgctgcgca

SEQ ID NO: 8313072 - DNA, 22 bp, Homo sapiens
ccaggcctggaccatgccaggg

SEQ ID NO: 8313073 - DNA, 22 bp, Homo sapiens
ccaggctggagtgcaatggtgc

SEQ ID NO: 8313074 - DNA, 22 bp, Homo sapiens
ccaggctggagtgcaatggcgt

SEQ ID NO: 8313075 - DNA, 22 bp, Homo sapiens
ccaggctggagtgcaatggcat

SEQ ID NO: 8313076 - DNA, 22 bp, Homo sapiens
ccaggctgctgttggtgtccgc

SEQ ID NO: 8313077 - DNA, 22 bp, Homo sapiens
ccaggctctgtctggtcagaag

SEQ ID NO: 8313078 - DNA, 22 bp, Homo sapiens
ccaggcctggccaggggatgcc

SEQ ID NO: 8313079 - DNA, 22 bp, Homo sapiens
ccaggcctggccaggggatgcc

SEQ ID NO: 8313080 - DNA, 21 bp, Homo sapiens
ccaggctcctgaggctggtca

SEQ ID NO: 8313081 - DNA, 22 bp, Homo sapiens
ccaggcctggacgggtggcctg

SEQ ID NO: 8313082 - DNA, 22 bp, Homo sapiens
tcttccagtgtagacatctgcc

SEQ ID NO: 8313083 - DNA, 22 bp, Homo sapiens
tcttcagagactctgagcccct

SEQ ID NO: 8313084 - DNA, 22 bp, Homo sapiens
ccaggccagcaggcacacctgc

SEQ ID NO: 8313085 - DNA, 22 bp, Homo sapiens
ccaggagttggaggctgcagtg

SEQ ID NO: 8313086 - DNA, 22 bp, Homo sapiens
ccaggagtttgaggctgcagtg

SEQ ID NO: 8313087 - DNA, 22 bp, Homo sapiens
ccaggagttggaggttgcagtg

SEQ ID NO: 8313088 - DNA, 22 bp, Homo sapiens
tcttagaatgtcaactgatgtt

SEQ ID NO: 8313089 - DNA, 22 bp, Homo sapiens
ccaggaggttgaggctgcagtg

SEQ ID NO: 8313090 - DNA, 22 bp, Homo sapiens
ccaggagtctggatgaggtgtc

SEQ ID NO: 8313091 - DNA, 22 bp, Homo sapiens
ccaggagtcaataaaggaagct

SEQ ID NO: 8313092 - DNA, 22 bp, Homo sapiens
ccaggaggttgaggctgcagtg

SEQ ID NO: 8313093 - DNA, 22 bp, Homo sapiens
ccaggaggttgaggctgcagtg

SEQ ID NO: 8313094 - DNA, 22 bp, Homo sapiens
tggagcaggcatctttctctct

SEQ ID NO: 8313095 - DNA, 22 bp, Homo sapiens
tggagcaggactgctgccctca

SEQ ID NO: 8313096 - DNA, 22 bp, Homo sapiens
tggagcaagctggagagaacat

SEQ ID NO: 8313097 - DNA, 22 bp, Homo sapiens
ccctgagcccatagttgacatt

SEQ ID NO: 8313098 - DNA, 22 bp, Homo sapiens
ccctgagagtgagtgccacctt

SEQ ID NO: 8313099 - DNA, 22 bp, Homo sapiens
ccctgagatgcctcaccctagt

SEQ ID NO: 8313100 - DNA, 18 bp, Homo sapiens
ccctctcctgctagtggg

SEQ ID NO: 8313101 - DNA, 20 bp, Homo sapiens
ccctgagacaaaggaggggc

SEQ ID NO: 8313102 - DNA, 20 bp, Homo sapiens
ccctgagaccagagagcagc

SEQ ID NO: 8313103 - DNA, 22 bp, Homo sapiens
tgctgttatacttagctggtta

SEQ ID NO: 8313104 - DNA, 22 bp, Homo sapiens
tgctgtgctggcggcagaggcc

SEQ ID NO: 8313105 - DNA, 22 bp, Homo sapiens
ccccttttcgcttggcctcatc

SEQ ID NO: 8313106 - DNA, 22 bp, Homo sapiens
ccccttccgtctcttgagtgtc

SEQ ID NO: 8313107 - DNA, 22 bp, Homo sapiens
ccccttccttcctcagacagcc

SEQ ID NO: 8313108 - DNA, 21 bp, Homo sapiens
tgctggcctcaagggtgactt

SEQ ID NO: 8313109 - DNA, 22 bp, Homo sapiens
tgctggccgtgagctctcggga

SEQ ID NO: 8313110 - DNA, 22 bp, Homo sapiens
tgctggccctggctcagggaac

SEQ ID NO: 8313111 - DNA, 22 bp, Homo sapiens
tgctggcccatgaagacgcagt

SEQ ID NO: 8313112 - DNA, 22 bp, Homo sapiens
tgctggccctggctcagggaac

SEQ ID NO: 8313113 - DNA, 22 bp, Homo sapiens
tgctggcccagtatggactgca

SEQ ID NO: 8313114 - DNA, 22 bp, Homo sapiens
cccaggtctatgccagctctga

SEQ ID NO: 8313115 - DNA, 22 bp, Homo sapiens
cccatttagataacagttcaaa

SEQ ID NO: 8313116 - DNA, 22 bp, Homo sapiens
cccatttaaacacaagctttca

SEQ ID NO: 8313117 - DNA, 22 bp, Homo sapiens
cccatttatcccaaggttactc

SEQ ID NO: 8313118 - DNA, 22 bp, Homo sapiens
ccccacccacctaagagaaact

SEQ ID NO: 8313119 - DNA, 22 bp, Homo sapiens
tgctggccaatggcagaggcgg

SEQ ID NO: 8313120 - DNA, 22 bp, Homo sapiens
tgccttcctggagctgaaggct

SEQ ID NO: 8313121 - DNA, 22 bp, Homo sapiens
cccagggattataaaggtgaaa

SEQ ID NO: 8313122 - DNA, 22 bp, Homo sapiens
tgcctgttgcccacctgataaa

SEQ ID NO: 8313123 - DNA, 22 bp, Homo sapiens
tgccttcaatcaggatggtctc

SEQ ID NO: 8313124 - DNA, 22 bp, Homo sapiens
cccagggacagctaggtggggc

SEQ ID NO: 8313125 - DNA, 22 bp, Homo sapiens
cccagggacagctaggtggggc

SEQ ID NO: 8313126 - DNA, 22 bp, Homo sapiens
cccagggacagatgggcagcta

SEQ ID NO: 8313127 - DNA, 22 bp, Homo sapiens
cccagggacagatgggcagcta

SEQ ID NO: 8313128 - DNA, 22 bp, Homo sapiens
cccagggtccctgctctctgtg

SEQ ID NO: 8313129 - DNA, 22 bp, Homo sapiens
cccaggctgagttagaggtgtc

SEQ ID NO: 8313130 - DNA, 22 bp, Homo sapiens
cccaggctggagtgcagtggcg

SEQ ID NO: 8313131 - DNA, 22 bp, Homo sapiens
cccaggctggagtgcaatggtg

SEQ ID NO: 8313132 - DNA, 22 bp, Homo sapiens
cccaggctggagtgcaatggca

SEQ ID NO: 8313133 - DNA, 22 bp, Homo sapiens
cccaggctggatttcggtggca

SEQ ID NO: 8313134 - DNA, 22 bp, Homo sapiens
cccagggaatgactctggcctt

SEQ ID NO: 8313135 - DNA, 21 bp, Homo sapiens
cccagggaagccgcagtcacc

SEQ ID NO: 8313136 - DNA, 22 bp, Homo sapiens
tgccagtgggtgtgcagagact

SEQ ID NO: 8313137 - DNA, 22 bp, Homo sapiens
cccaggctcccaggtgggacaa

SEQ ID NO: 8313138 - DNA, 22 bp, Homo sapiens
tgccacagaggtgaagcccact

SEQ ID NO: 8313139 - DNA, 22 bp, Homo sapiens
tgccagctccgaggagctgcag

SEQ ID NO: 8313140 - DNA, 22 bp, Homo sapiens
tgcacagagagatgagacacgt

SEQ ID NO: 8313141 - DNA, 22 bp, Homo sapiens
tgccaggaggaggtgggacaga

SEQ ID NO: 8313142 - DNA, 22 bp, Homo sapiens
tgccaggagagtgcatgcaggg

SEQ ID NO: 8313143 - DNA, 22 bp, Homo sapiens
cccaggagagaggccagttggc

SEQ ID NO: 8313144 - DNA, 22 bp, Homo sapiens
tgccaggctaagtggaggactt

SEQ ID NO: 8313145 - DNA, 18 bp, Homo sapiens
tggagcaggtaggcatga

SEQ ID NO: 8313146 - DNA, 22 bp, Homo sapiens
ccctgcagccttgcatgccttc

SEQ ID NO: 8313147 - DNA, 22 bp, Homo sapiens
tggagcaggccggaagtggctt

SEQ ID NO: 8313148 - DNA, 22 bp, Homo sapiens
tggagcagggcatcactgtgcg

SEQ ID NO: 8313149 - DNA, 22 bp, Homo sapiens
ccctgcaggggacctgcagcct

SEQ ID NO: 8313150 - DNA, 22 bp, Homo sapiens
ccctgcagcttttgcatagtca

SEQ ID NO: 8313151 - DNA, 22 bp, Homo sapiens
cccttcccttctgggagatcca

SEQ ID NO: 8313152 - DNA, 22 bp, Homo sapiens
cccttcctcccaggcttctgtg

SEQ ID NO: 8313153 - DNA, 22 bp, Homo sapiens
tggcagggttggccaccttacc

SEQ ID NO: 8313154 - DNA, 22 bp, Homo sapiens
tggcagggtgggcttcagcccc

SEQ ID NO: 8313155 - DNA, 20 bp, Homo sapiens
cctaggcatgctgagtctcc

SEQ ID NO: 8313156 - DNA, 22 bp, Homo sapiens
tggcagggtggcaacttttggt

SEQ ID NO: 8313157 - DNA, 22 bp, Homo sapiens
cctcagaggtgtggcatctctg

SEQ ID NO: 8313158 - DNA, 22 bp, Homo sapiens
cctcagaggtgaacatcagtgc

SEQ ID NO: 8313159 - DNA, 22 bp, Homo sapiens
cctaagaattaatgaatacacc

SEQ ID NO: 8313160 - DNA, 22 bp, Homo sapiens
tggcagaggctctgtgatgttg

SEQ ID NO: 8313161 - DNA, 19 bp, Homo sapiens
tggcagaggcagtttgtac

SEQ ID NO: 8313162 - DNA, 22 bp, Homo sapiens
tggcagaggaggctcagattga

SEQ ID NO: 8313163 - DNA, 22 bp, Homo sapiens
tggcagaggagaattaagatta

SEQ ID NO: 8313164 - DNA, 22 bp, Homo sapiens
cctagagctctgctttatctaa

SEQ ID NO: 8313165 - DNA, 22 bp, Homo sapiens
tggcctggctgccctgtctgga

SEQ ID NO: 8313166 - DNA, 22 bp, Homo sapiens
tggcctggctgccctgtctgga

SEQ ID NO: 8313167 - DNA, 22 bp, Homo sapiens
tggcctgggcatgaagcatcgt

SEQ ID NO: 8313168 - DNA, 22 bp, Homo sapiens
tggcctgggcatgaagcatcgt

SEQ ID NO: 8313169 - DNA, 22 bp, Homo sapiens
tggcctgggccggcagatatac

SEQ ID NO: 8313170 - DNA, 22 bp, Homo sapiens
tggcctgggcctgccggtgcaa

SEQ ID NO: 8313171 - DNA, 22 bp, Homo sapiens
tggcctgggcctgccggtgcaa

SEQ ID NO: 8313172 - DNA, 22 bp, Homo sapiens
tggcctgggcctgccggtgcaa

SEQ ID NO: 8313173 - DNA, 22 bp, Homo sapiens
tggcctggggaagaccatgggc

SEQ ID NO: 8313174 - DNA, 22 bp, Homo sapiens
tggcctggggaagaccatgggc

SEQ ID NO: 8313175 - DNA, 22 bp, Homo sapiens
tggctctgtcaaactgcacaca

SEQ ID NO: 8313176 - DNA, 21 bp, Homo sapiens
tggctctgggtaggagagtgc

SEQ ID NO: 8313177 - DNA, 22 bp, Homo sapiens
tggctctggtgcgggctcctgc

SEQ ID NO: 8313178 - DNA, 22 bp, Homo sapiens
tggctctggtgcgggctcctgc

SEQ ID NO: 8313179 - DNA, 21 bp, Homo sapiens
tggctctgggtaggagagtgc

SEQ ID NO: 8313180 - DNA, 22 bp, Homo sapiens
tggcctggggacctgtgagacc

SEQ ID NO: 8313181 - DNA, 22 bp, Homo sapiens
cctcatggccttgagctgaggg

SEQ ID NO: 8313182 - DNA, 22 bp, Homo sapiens
cctcatggtacttactgtagct

SEQ ID NO: 8313183 - DNA, 22 bp, Homo sapiens
cctcatggacctcagactgtcc

SEQ ID NO: 8313184 - DNA, 22 bp, Homo sapiens
tggcctggctcacagtgagatt

SEQ ID NO: 8313185 - DNA, 22 bp, Homo sapiens
cctcagggactccatgctgcag

SEQ ID NO: 8313186 - DNA, 22 bp, Homo sapiens
cctcagaggttttcattctgta

SEQ ID NO: 8313187 - DNA, 22 bp, Homo sapiens
cctcagagtaggtctcagctgt

SEQ ID NO: 8313188 - DNA, 22 bp, Homo sapiens
cctcaggcttacgggcaatgga

SEQ ID NO: 8313189 - DNA, 22 bp, Homo sapiens
tggcttcatctgcagcactgcc

SEQ ID NO: 8313190 - DNA, 22 bp, Homo sapiens
tggcttccaaaggaatgggcct

SEQ ID NO: 8313191 - DNA, 22 bp, Homo sapiens
tggctggcttgttcactgactg

SEQ ID NO: 8313192 - DNA, 17 bp, Homo sapiens
tggctctgtcctcagct

SEQ ID NO: 8313193 - DNA, 17 bp, Homo sapiens
tggctctgtcctcagct

SEQ ID NO: 8313194 - DNA, 22 bp, Homo sapiens
tggctctgtcactgtgagctat

SEQ ID NO: 8313195 - DNA, 22 bp, Homo sapiens
tggctctgtcactgtgagctat

SEQ ID NO: 8313196 - DNA, 19 bp, Homo sapiens
tggctctgtcgaaggcaca

SEQ ID NO: 8313197 - DNA, 22 bp, Homo sapiens
tggctgctcaagggaggaggct

SEQ ID NO: 8313198 - DNA, 22 bp, Homo sapiens
tggctgctagccagagcttcag

SEQ ID NO: 8313199 - DNA, 22 bp, Homo sapiens
tggctggctagtgggcaggatt

SEQ ID NO: 8313200 - DNA, 22 bp, Homo sapiens
tggcttccactgtgtgccccct

SEQ ID NO: 8313201 - DNA, 19 bp, Homo sapiens
tggcttccatctctctcat

SEQ ID NO: 8313202 - DNA, 22 bp, Homo sapiens
cctctgcctgcacatcatcctg

SEQ ID NO: 8313203 - DNA, 22 bp, Homo sapiens
cctctgagtcctccctggttgc

SEQ ID NO: 8313204 - DNA, 19 bp, Homo sapiens
cctctgcgctgtcctgctc

SEQ ID NO: 8313205 - DNA, 21 bp, Homo sapiens
cctctgctcgggcatgcgttt

SEQ ID NO: 8313206 - DNA, 22 bp, Homo sapiens
cctctgctccctggtgtctgag

SEQ ID NO: 8313207 - DNA, 22 bp, Homo sapiens
cctctgctccctggtgtctgag

SEQ ID NO: 8313208 - DNA, 22 bp, Homo sapiens
cctctgctgctgttgagcaccg

SEQ ID NO: 8313209 - DNA, 22 bp, Homo sapiens
cctctgctctggtccatgtgct

SEQ ID NO: 8313210 - DNA, 22 bp, Homo sapiens
cctctgctgctgttgagcaccg

SEQ ID NO: 8313211 - DNA, 22 bp, Homo sapiens
cctgagctgaactaagcagttt

SEQ ID NO: 8313212 - DNA, 22 bp, Homo sapiens
cctgagctggaagagcttgtgc

SEQ ID NO: 8313213 - DNA, 22 bp, Homo sapiens
tgggctgcttctattggtggtc

SEQ ID NO: 8313214 - DNA, 22 bp, Homo sapiens
tgggctgctgttacaggggctg

SEQ ID NO: 8313215 - DNA, 22 bp, Homo sapiens
tgggctgcttcctcagctgaga

SEQ ID NO: 8313216 - DNA, 22 bp, Homo sapiens
tgggctggagcttgttgcttcc

SEQ ID NO: 8313217 - DNA, 21 bp, Homo sapiens
cctgagcctgtttatccagaa

SEQ ID NO: 8313218 - DNA, 22 bp, Homo sapiens
tgggctggcccaccacacctcg

SEQ ID NO: 8313219 - DNA, 22 bp, Homo sapiens
tgggctggcccaccacacctcg

SEQ ID NO: 8313220 - DNA, 18 bp, Homo sapiens
tgggctgcctggcctctg

SEQ ID NO: 8313221 - DNA, 22 bp, Homo sapiens
tgggctgcggataggcctcgga

SEQ ID NO: 8313222 - DNA, 22 bp, Homo sapiens
tgggctgctgtctgcacatgct

SEQ ID NO: 8313223 - DNA, 22 bp, Homo sapiens
tgggctgctgtctgcacatgct

SEQ ID NO: 8313224 - DNA, 22 bp, Homo sapiens
tgggctgctgagaatgagagag

SEQ ID NO: 8313225 - DNA, 22 bp, Homo sapiens
tgggctgctgcggtgctcttgg

SEQ ID NO: 8313226 - DNA, 22 bp, Homo sapiens
tgggccctgacttcaagcatcc

SEQ ID NO: 8313227 - DNA, 22 bp, Homo sapiens
tgggcccaagagagtctccaac

SEQ ID NO: 8313228 - DNA, 22 bp, Homo sapiens
cctgagcctgagtggtgcaggg

SEQ ID NO: 8313229 - DNA, 18 bp, Homo sapiens
cctgagccctgcttactt

SEQ ID NO: 8313230 - DNA, 23 bp, Homo sapiens
tgggagtgttgggatctctgctc

SEQ ID NO: 8313231 - DNA, 22 bp, Homo sapiens
cctgagagagaagcgacctggt

SEQ ID NO: 8313232 - DNA, 22 bp, Homo sapiens
cctgagaccaagttgcagccat

SEQ ID NO: 8313233 - DNA, 22 bp, Homo sapiens
cctcttctgagtgagactccct

SEQ ID NO: 8313234 - DNA, 22 bp, Homo sapiens
tgggagtgttcttggcttgctt

SEQ ID NO: 8313235 - DNA, 22 bp, Homo sapiens
catgaagcacagctctcttttt

SEQ ID NO: 8313236 - DNA, 21 bp, Homo sapiens
catgaagccggttccctgttt

SEQ ID NO: 8313237 - DNA, 22 bp, Homo sapiens
catgaagcatgttttgtcatga

SEQ ID NO: 8313238 - DNA, 22 bp, Homo sapiens
catctgctgttccttggactca

SEQ ID NO: 8313239 - DNA, 19 bp, Homo sapiens
catctggatgattctcctg

SEQ ID NO: 8313240 - DNA, 19 bp, Homo sapiens
catctggatgattctcctg

SEQ ID NO: 8313241 - DNA, 22 bp, Homo sapiens
catctggctagctatcattgtg

SEQ ID NO: 8313242 - DNA, 22 bp, Homo sapiens
catctgcctaagtggccctgtt

SEQ ID NO: 8313243 - DNA, 22 bp, Homo sapiens
catgaagcttgaagcagtccac

SEQ ID NO: 8313244 - DNA, 22 bp, Homo sapiens
catgaatcagaatcacctagag

SEQ ID NO: 8313245 - DNA, 20 bp, Homo sapiens
tccagctgggaacagctgat

SEQ ID NO: 8313246 - DNA, 22 bp, Homo sapiens
catggcaggtgcagattctgtg

SEQ ID NO: 8313247 - DNA, 22 bp, Homo sapiens
catggcaggaggctgctggcag

SEQ ID NO: 8313248 - DNA, 22 bp, Homo sapiens
catggcagagaaggggaactgg

SEQ ID NO: 8313249 - DNA, 22 bp, Homo sapiens
catggaaggcaaaagacacaga

SEQ ID NO: 8313250 - DNA, 23 bp, Homo sapiens
catggcagcaagagctcatggcc

SEQ ID NO: 8313251 - DNA, 22 bp, Homo sapiens
tcagcagtcacatgttgtccca

SEQ ID NO: 8313252 - DNA, 17 bp, Homo sapiens
tcaggctgtgcctggta

SEQ ID NO: 8313253 - DNA, 22 bp, Homo sapiens
tcaggctgtgggcactggccat

SEQ ID NO: 8313254 - DNA, 22 bp, Homo sapiens
cagttgatgggactcatgtggg

SEQ ID NO: 8313255 - DNA, 22 bp, Homo sapiens
tcagagatgcagtgccacctac

SEQ ID NO: 8313256 - DNA, 22 bp, Homo sapiens
cagttgctacagttcaagtgtg

SEQ ID NO: 8313257 - DNA, 22 bp, Homo sapiens
tcagaggagccaaagttctgag

SEQ ID NO: 8313258 - DNA, 22 bp, Homo sapiens
cagtttttcaaaattacatgat

SEQ ID NO: 8313259 - DNA, 22 bp, Homo sapiens
cagtttttgccattaagagtaa

SEQ ID NO: 8313260 - DNA, 22 bp, Homo sapiens
cagtttttagattagttggtgg

SEQ ID NO: 8313261 - DNA, 18 bp, Homo sapiens
cagtttttatatctggca

SEQ ID NO: 8313262 - DNA, 22 bp, Homo sapiens
ccactgtcagaggggctgtgcc

SEQ ID NO: 8313263 - DNA, 22 bp, Homo sapiens
ccactgtctgcaggcctcagca

SEQ ID NO: 8313264 - DNA, 22 bp, Homo sapiens
ccactgtcttttccaggctgaa

SEQ ID NO: 8313265 - DNA, 22 bp, Homo sapiens
ccagagaccagaacatggggat

SEQ ID NO: 8313266 - DNA, 22 bp, Homo sapiens
tcctgggcttgctcctccagct

SEQ ID NO: 8313267 - DNA, 22 bp, Homo sapiens
tccttcagtcttctgagccata

SEQ ID NO: 8313268 - DNA, 17 bp, Homo sapiens
tccttcagtgcctctgc

SEQ ID NO: 8313269 - DNA, 22 bp, Homo sapiens
tccttcagttaaagatctcaca

SEQ ID NO: 8313270 - DNA, 22 bp, Homo sapiens
tccttcagtgtcccgctcaggt

SEQ ID NO: 8313271 - DNA, 22 bp, Homo sapiens
tccttcagttatcacagtactg

SEQ ID NO: 8313272 - DNA, 21 bp, Homo sapiens
tccttcagttctgcactttct

SEQ ID NO: 8313273 - DNA, 22 bp, Homo sapiens
tccttcagttcaattagtccgt

SEQ ID NO: 8313274 - DNA, 22 bp, Homo sapiens
tccttcctgcaggccaagtcct

SEQ ID NO: 8313275 - DNA, 22 bp, Homo sapiens
tccttcctcggggacccagatc

SEQ ID NO: 8313276 - DNA, 22 bp, Homo sapiens
ccacagaaagttgtctagagta

SEQ ID NO: 8313277 - DNA, 22 bp, Homo sapiens
ccacagaaagttgtctagagta

SEQ ID NO: 8313278 - DNA, 22 bp, Homo sapiens
ccacactgaacctcagtgtctt

SEQ ID NO: 8313279 - DNA, 17 bp, Homo sapiens
ccacaccctttccttcc

SEQ ID NO: 8313280 - DNA, 22 bp, Homo sapiens
ccacacagtcagtttccaagaa

SEQ ID NO: 8313281 - DNA, 22 bp, Homo sapiens
ccaaggagctcatattcttgtt

SEQ ID NO: 8313282 - DNA, 22 bp, Homo sapiens
ccaaggagctgcaggcacttgt

SEQ ID NO: 8313283 - DNA, 22 bp, Homo sapiens
ccaaggagcaagtttacacctg

SEQ ID NO: 8313284 - DNA, 22 bp, Homo sapiens
ccaaggagcaaggctcaacaag

SEQ ID NO: 8313285 - DNA, 22 bp, Homo sapiens
ccaaggagcaaggctcaacaag

SEQ ID NO: 8313286 - DNA, 22 bp, Homo sapiens
ccaaggagaatgacaccatgga

SEQ ID NO: 8313287 - DNA, 22 bp, Homo sapiens
ccaaggagtagagcaggaagct

SEQ ID NO: 8313288 - DNA, 22 bp, Homo sapiens
ccaaggagtagagcaggaagct

SEQ ID NO: 8313289 - DNA, 22 bp, Homo sapiens
ccaaggaggccccaggtcagct

SEQ ID NO: 8313290 - DNA, 22 bp, Homo sapiens
ccaaggaggccccaggtcagct

SEQ ID NO: 8313291 - DNA, 22 bp, Homo sapiens
ccaaggcttcccagagatgctc

SEQ ID NO: 8313292 - DNA, 22 bp, Homo sapiens
ccaaggctggagtgcagtggcg

SEQ ID NO: 8313293 - DNA, 22 bp, Homo sapiens
ccaaggctcctcagctggtctt

SEQ ID NO: 8313294 - DNA, 22 bp, Homo sapiens
cattgcactccagcctgggtaa

SEQ ID NO: 8313295 - DNA, 22 bp, Homo sapiens
cattgcactccagctctgggcg

SEQ ID NO: 8313296 - DNA, 22 bp, Homo sapiens
cattgcactccagccttggcaa

SEQ ID NO: 8313297 - DNA, 22 bp, Homo sapiens
cattgcactccagcctgggtga

SEQ ID NO: 8313298 - DNA, 22 bp, Homo sapiens
cattgcactccagcttgggcaa

SEQ ID NO: 8313299 - DNA, 22 bp, Homo sapiens
cattgcactccagtctgggcca

SEQ ID NO: 8313300 - DNA, 22 bp, Homo sapiens
cattgcactcctgcctgggcaa

SEQ ID NO: 8313301 - DNA, 22 bp, Homo sapiens
cattgcactccatcttgggcaa

SEQ ID NO: 8313302 - DNA, 22 bp, Homo sapiens
cattgcactccagcctaggcaa

SEQ ID NO: 8313303 - DNA, 22 bp, Homo sapiens
cattgcactccaccctaggcaa

SEQ ID NO: 8313304 - DNA, 22 bp, Homo sapiens
cattgcactccagcctgggcca

SEQ ID NO: 8313305 - DNA, 22 bp, Homo sapiens
cattgcactccagcctgggcaa

SEQ ID NO: 8313306 - DNA, 22 bp, Homo sapiens
tcccactcccaggcaggcctct

SEQ ID NO: 8313307 - DNA, 22 bp, Homo sapiens
cattgtcacccaaagctcatag

SEQ ID NO: 8313308 - DNA, 21 bp, Homo sapiens
cattgtcgacattttcccctc

SEQ ID NO: 8313309 - DNA, 18 bp, Homo sapiens
cattgtacaatgctttat

SEQ ID NO: 8313310 - DNA, 16 bp, Homo sapiens
cattgcactctagcct

SEQ ID NO: 8313311 - DNA, 22 bp, Homo sapiens
cattgtattgaggatacttaag

SEQ ID NO: 8313312 - DNA, 22 bp, Homo sapiens
tccctgggtcctgcttgctctc

SEQ ID NO: 8313313 - DNA, 22 bp, Homo sapiens
tccctggaacagagagacaacg

SEQ ID NO: 8313314 - DNA, 22 bp, Homo sapiens
cattagaagaacagttatatta

SEQ ID NO: 8313315 - DNA, 22 bp, Homo sapiens
cattacatggtccaggatatat

SEQ ID NO: 8313316 - DNA, 22 bp, Homo sapiens
cattacatttcaaaatgtttcc

SEQ ID NO: 8313317 - DNA, 22 bp, Homo sapiens
cattctgtgattctaaatccct

SEQ ID NO: 8313318 - DNA, 22 bp, Homo sapiens
tcccaccccttgactctttaag

SEQ ID NO: 8313319 - DNA, 22 bp, Homo sapiens
tcccaccccctccaaggaggaa

SEQ ID NO: 8313320 - DNA, 22 bp, Homo sapiens
tcccacccatcctgcatctctt

SEQ ID NO: 8313321 - DNA, 22 bp, Homo sapiens
catgggctacagaagcatgctg

SEQ ID NO: 8313322 - DNA, 22 bp, Homo sapiens
tccattttcatctcatgtataa

SEQ ID NO: 8313323 - DNA, 22 bp, Homo sapiens
tccattttgtaggtatgctaca

SEQ ID NO: 8313324 - DNA, 22 bp, Homo sapiens
tccaggagaggcctgaccaggt

SEQ ID NO: 8313325 - DNA, 22 bp, Homo sapiens
tccaggagaggtgtggggactg

SEQ ID NO: 8313326 - DNA, 23 bp, Homo sapiens
catgggagtgagaatgccagctc

SEQ ID NO: 8313327 - DNA, 22 bp, Homo sapiens
catgggaggtctgcaaggtgct

SEQ ID NO: 8313328 - DNA, 22 bp, Homo sapiens
catgggaggttggcttggcatg

SEQ ID NO: 8313329 - DNA, 22 bp, Homo sapiens
caggtgggtgtatgaatgcaaa

SEQ ID NO: 8313330 - DNA, 22 bp, Homo sapiens
caggtgggtgtatgaatgcaaa

SEQ ID NO: 8313331 - DNA, 22 bp, Homo sapiens
cagtcacacaagtggacttggg

SEQ ID NO: 8313332 - DNA, 22 bp, Homo sapiens
cagtcacatggatgatggatag

SEQ ID NO: 8313333 - DNA, 22 bp, Homo sapiens
cagtcacattgccctgcattta

SEQ ID NO: 8313334 - DNA, 20 bp, Homo sapiens
tatttgaaatggccaagtgt

SEQ ID NO: 8313335 - DNA, 22 bp, Homo sapiens
tcaaaaattttctgaggatgag

SEQ ID NO: 8313336 - DNA, 22 bp, Homo sapiens
tcaagcatcttggtctacgatc

SEQ ID NO: 8313337 - DNA, 22 bp, Homo sapiens
tcaagcagggtagcaagctggt

SEQ ID NO: 8313338 - DNA, 23 bp, Homo sapiens
caggtggctccacgaggggtggg

SEQ ID NO: 8313339 - DNA, 22 bp, Homo sapiens
tattagtagcttgaaattggtg

SEQ ID NO: 8313340 - DNA, 22 bp, Homo sapiens
caggtggatctctaaggactga

SEQ ID NO: 8313341 - DNA, 22 bp, Homo sapiens
caggtggagctgactgagggca

SEQ ID NO: 8313342 - DNA, 22 bp, Homo sapiens
caggtggcatgactgcctacaa

SEQ ID NO: 8313343 - DNA, 22 bp, Homo sapiens
tattatgtagagtaagggttaa

SEQ ID NO: 8313344 - DNA, 22 bp, Homo sapiens
caggtgggtacatcacagagac

SEQ ID NO: 8313345 - DNA, 22 bp, Homo sapiens
tattatcattggtaatatggtc

SEQ ID NO: 8313346 - DNA, 18 bp, Homo sapiens
caggtcagcctggcctca

SEQ ID NO: 8313347 - DNA, 22 bp, Homo sapiens
caggtgcccagctcctgctgtg

SEQ ID NO: 8313348 - DNA, 22 bp, Homo sapiens
caggtgccgggaatgcagcaat

SEQ ID NO: 8313349 - DNA, 22 bp, Homo sapiens
caggtgcctcaggatgagacaa

SEQ ID NO: 8313350 - DNA, 22 bp, Homo sapiens
caggtgctgtcctgcacatgtc

SEQ ID NO: 8313351 - DNA, 22 bp, Homo sapiens
caggtgctgcgtggcggagctg

SEQ ID NO: 8313352 - DNA, 22 bp, Homo sapiens
caggtgctcccagagaagtgct

SEQ ID NO: 8313353 - DNA, 22 bp, Homo sapiens
caggtcagaggcgcagccccca

SEQ ID NO: 8313354 - DNA, 22 bp, Homo sapiens
caggtcagagtccccctgtcct

SEQ ID NO: 8313355 - DNA, 22 bp, Homo sapiens
caggtaggatggaagggctcaa

SEQ ID NO: 8313356 - DNA, 22 bp, Homo sapiens
caggtacactcccttgtgctga

SEQ ID NO: 8313357 - DNA, 22 bp, Homo sapiens
caggtaagagacggattggccc

SEQ ID NO: 8313358 - DNA, 22 bp, Homo sapiens
cagggtggggctggctatcaaa

SEQ ID NO: 8313359 - DNA, 22 bp, Homo sapiens
cagggctgaaatcaaggtgtag

SEQ ID NO: 8313360 - DNA, 22 bp, Homo sapiens
cagggctgagaatttagagaca

SEQ ID NO: 8313361 - DNA, 22 bp, Homo sapiens
cagggctgtaaattagtgctga

SEQ ID NO: 8313362 - DNA, 22 bp, Homo sapiens
cagggctggtttgtcgaagaaa

SEQ ID NO: 8313363 - DNA, 23 bp, Homo sapiens
cagggctggtagggaagagcgtg

SEQ ID NO: 8313364 - DNA, 22 bp, Homo sapiens
caggggctgtttgcctcaggcc

SEQ ID NO: 8313365 - DNA, 22 bp, Homo sapiens
caggggcttaagtgacagaagg

SEQ ID NO: 8313366 - DNA, 22 bp, Homo sapiens
caggggcttttcctctataagg

SEQ ID NO: 8313367 - DNA, 22 bp, Homo sapiens
caggggcttaagtgacagaagg

SEQ ID NO: 8313368 - DNA, 22 bp, Homo sapiens
caggggctgtttgcctcaggcc

SEQ ID NO: 8313369 - DNA, 22 bp, Homo sapiens
caggggcttttcctctataagg

SEQ ID NO: 8313370 - DNA, 17 bp, Homo sapiens
cagggctgtctgcctag

SEQ ID NO: 8313371 - DNA, 22 bp, Homo sapiens
cagggctgtggctttgtgctgt

SEQ ID NO: 8313372 - DNA, 22 bp, Homo sapiens
cagggctgtgcccatcttcccc

SEQ ID NO: 8313373 - DNA, 22 bp, Homo sapiens
cagggtccggctgcctggctgt

SEQ ID NO: 8313374 - DNA, 22 bp, Homo sapiens
cagggtccatctttcatcactg

SEQ ID NO: 8313375 - DNA, 22 bp, Homo sapiens
caggggtgtttttggccaggag

SEQ ID NO: 8313376 - DNA, 22 bp, Homo sapiens
caggggtgtttttggccaggag

SEQ ID NO: 8313377 - DNA, 22 bp, Homo sapiens
cagggtagacagtaggtgtctg

SEQ ID NO: 8313378 - DNA, 22 bp, Homo sapiens
cagggtacagagttttctaaac

SEQ ID NO: 8313379 - DNA, 22 bp, Homo sapiens
caggggtggctgcagcagaggt

SEQ ID NO: 8313380 - DNA, 22 bp, Homo sapiens
taggcagggattagggttgatt

SEQ ID NO: 8313381 - DNA, 22 bp, Homo sapiens
taggcaggtgtgcactgcccac

SEQ ID NO: 8313382 - DNA, 22 bp, Homo sapiens
cagggcccaagacacaatgagg

SEQ ID NO: 8313383 - DNA, 22 bp, Homo sapiens
cagggcccaggccactgggttg

SEQ ID NO: 8313384 - DNA, 22 bp, Homo sapiens
taggccagaggagcagctttgg

SEQ ID NO: 8313385 - DNA, 22 bp, Homo sapiens
cagggcctcatcctcagagatt

SEQ ID NO: 8313386 - DNA, 22 bp, Homo sapiens
cagggcctcatcctcagagatt

SEQ ID NO: 8313387 - DNA, 22 bp, Homo sapiens
cagggcccatggctcaggtagg

SEQ ID NO: 8313388 - DNA, 18 bp, Homo sapiens
cagggccccagaattatc

SEQ ID NO: 8313389 - DNA, 22 bp, Homo sapiens
cagggccagttctcgcagcagt

SEQ ID NO: 8313390 - DNA, 22 bp, Homo sapiens
cagggccatatcttgtgcacca

SEQ ID NO: 8313391 - DNA, 22 bp, Homo sapiens
cagggccatgaggcacagggtc

SEQ ID NO: 8313392 - DNA, 22 bp, Homo sapiens
cagggccattggcgtggctgtc

SEQ ID NO: 8313393 - DNA, 22 bp, Homo sapiens
cagggagatcttggctcctggt

SEQ ID NO: 8313394 - DNA, 22 bp, Homo sapiens
tagatttctcattcatagattg

SEQ ID NO: 8313395 - DNA, 20 bp, Homo sapiens
tagatttcatacttctcttt

SEQ ID NO: 8313396 - DNA, 22 bp, Homo sapiens
tagatttcctcttcctcattcc

SEQ ID NO: 8313397 - DNA, 22 bp, Homo sapiens
tagatttcgctgcatctcaatc

SEQ ID NO: 8313398 - DNA, 22 bp, Homo sapiens
tagatttcaggctggcttgcgg

SEQ ID NO: 8313399 - DNA, 22 bp, Homo sapiens
tacattgtgatgtttcaataca

SEQ ID NO: 8313400 - DNA, 22 bp, Homo sapiens
tacattgtgatgtttcaataca

SEQ ID NO: 8313401 - DNA, 22 bp, Homo sapiens
tacattgttcatgcatgagaaa

SEQ ID NO: 8313402 - DNA, 23 bp, Homo sapiens
tacattgtggatggagtcctggg

SEQ ID NO: 8313403 - DNA, 22 bp, Homo sapiens
tacattgttttttcttgccatc

SEQ ID NO: 8313404 - DNA, 22 bp, Homo sapiens
tacatttataaggcttctctgt

SEQ ID NO: 8313405 - DNA, 22 bp, Homo sapiens
tactttagaaggaaataagttc

SEQ ID NO: 8313406 - DNA, 22 bp, Homo sapiens
tactttaaaaactgataattca

SEQ ID NO: 8313407 - DNA, 20 bp, Homo sapiens
caggcctctgggggccctgg

SEQ ID NO: 8313408 - DNA, 22 bp, Homo sapiens
caggcctctccttagtctggca

SEQ ID NO: 8313409 - DNA, 22 bp, Homo sapiens
caggcctctccttagtctggca

SEQ ID NO: 8313410 - DNA, 22 bp, Homo sapiens
caggcctctatggtcagctgag

SEQ ID NO: 8313411 - DNA, 22 bp, Homo sapiens
caggcctgcaggaaaggctccc

SEQ ID NO: 8313412 - DNA, 22 bp, Homo sapiens
caggcctgagtgtggaagtctt

SEQ ID NO: 8313413 - DNA, 22 bp, Homo sapiens
caggcctgatacactgaactct

SEQ ID NO: 8313414 - DNA, 22 bp, Homo sapiens
caggcctgatacactgaactct

SEQ ID NO: 8313415 - DNA, 22 bp, Homo sapiens
caggcctgagacatctgagata

SEQ ID NO: 8313416 - DNA, 22 bp, Homo sapiens
caggcctgagacatctgagata

SEQ ID NO: 8313417 - DNA, 22 bp, Homo sapiens
caggcctgaccctgagcttcac

SEQ ID NO: 8313418 - DNA, 22 bp, Homo sapiens
caggcctgaccctgagcttcac

SEQ ID NO: 8313419 - DNA, 22 bp, Homo sapiens
caggcctgaccctgagcttcac

SEQ ID NO: 8313420 - DNA, 22 bp, Homo sapiens
tagaaaatagggcctgtggagc

SEQ ID NO: 8313421 - DNA, 22 bp, Homo sapiens
caggctgggaacgccacccgct

SEQ ID NO: 8313422 - DNA, 22 bp, Homo sapiens
caggctgcagtgcagtggctat

SEQ ID NO: 8313423 - DNA, 22 bp, Homo sapiens
caggctgccgtgaagcaggcct

SEQ ID NO: 8313424 - DNA, 22 bp, Homo sapiens
caggctggagttcagtggtgtg

SEQ ID NO: 8313425 - DNA, 22 bp, Homo sapiens
caggcttgggagcagagccact

SEQ ID NO: 8313426 - DNA, 22 bp, Homo sapiens
caggctgtctgaatggaggccc

SEQ ID NO: 8313427 - DNA, 22 bp, Homo sapiens
cagggacaatggcagagcctga

SEQ ID NO: 8313428 - DNA, 22 bp, Homo sapiens
caggcaccccaggtgagcactg

SEQ ID NO: 8313429 - DNA, 22 bp, Homo sapiens
caggcagcagaggagtgtggga

SEQ ID NO: 8313430 - DNA, 22 bp, Homo sapiens
caggcagatttgctgccctcca

SEQ ID NO: 8313431 - DNA, 20 bp, Homo sapiens
gtgcttcagaagccattgct

SEQ ID NO: 8313432 - DNA, 22 bp, Homo sapiens
gtgcttaatacatgtcaataac

SEQ ID NO: 8313433 - DNA, 22 bp, Homo sapiens
gtgcttcctgcctggtgccttt

SEQ ID NO: 8313434 - DNA, 22 bp, Homo sapiens
gtgcttctcttcacacccaact

SEQ ID NO: 8313435 - DNA, 22 bp, Homo sapiens
gtgcttccatctagagggtcac

SEQ ID NO: 8313436 - DNA, 22 bp, Homo sapiens
gtgcttccccaagccacagcct

SEQ ID NO: 8313437 - DNA, 22 bp, Homo sapiens
cagctcaagtttcccaggtcag

SEQ ID NO: 8313438 - DNA, 22 bp, Homo sapiens
tacaaaagtaattacggttttt

SEQ ID NO: 8313439 - DNA, 22 bp, Homo sapiens
caggccaggtggcaggcaaaac

SEQ ID NO: 8313440 - DNA, 22 bp, Homo sapiens
caggccagtgtgcttcccaggc

SEQ ID NO: 8313441 - DNA, 22 bp, Homo sapiens
taatgtgtgtcatcagtagagt

SEQ ID NO: 8313442 - DNA, 22 bp, Homo sapiens
taatgtgttgaatatttgtaca

SEQ ID NO: 8313443 - DNA, 22 bp, Homo sapiens
taatgtgtcctgaaagcttctg

SEQ ID NO: 8313444 - DNA, 22 bp, Homo sapiens
taatatctacttcatagagttt

SEQ ID NO: 8313445 - DNA, 22 bp, Homo sapiens
taatcacatcagggtaaatggg

SEQ ID NO: 8313446 - DNA, 22 bp, Homo sapiens
taatccacaatagagattatct

SEQ ID NO: 8313447 - DNA, 22 bp, Homo sapiens
ttgaaaggtgacattgttagag

SEQ ID NO: 8313448 - DNA, 22 bp, Homo sapiens
ttgaaaggtgaacatgatgcac

SEQ ID NO: 8313449 - DNA, 23 bp, Homo sapiens
ttgaaaggtagctggcagctaga

SEQ ID NO: 8313450 - DNA, 22 bp, Homo sapiens
ttgaaaggtgctgtgtgctgat

SEQ ID NO: 8313451 - DNA, 22 bp, Homo sapiens
ttgaaagggttaaagtggtaaa

SEQ ID NO: 8313452 - DNA, 22 bp, Homo sapiens
ttgtctgtccaggcaccccaag

SEQ ID NO: 8313453 - DNA, 23 bp, Homo sapiens
ttgtctgtgcttttccagttgct

SEQ ID NO: 8313454 - DNA, 22 bp, Homo sapiens
ttgtctgtgaaatggaaatagt

SEQ ID NO: 8313455 - DNA, 22 bp, Homo sapiens
ttgtctgtcccagcttgtgcat

SEQ ID NO: 8313456 - DNA, 22 bp, Homo sapiens
ttgtcttaaatggatggacaat

SEQ ID NO: 8313457 - DNA, 23 bp, Homo sapiens
ttgtgggcagattccatggggag

SEQ ID NO: 8313458 - DNA, 22 bp, Homo sapiens
ttgtgaaacattcatggatttg

SEQ ID NO: 8313459 - DNA, 22 bp, Homo sapiens
ctcccaggcacagggaggagcc

SEQ ID NO: 8313460 - DNA, 22 bp, Homo sapiens
ctccattgaacatcctctcaga

SEQ ID NO: 8313461 - DNA, 22 bp, Homo sapiens
ctcccaaggggtaagggagctg

SEQ ID NO: 8313462 - DNA, 22 bp, Homo sapiens
ctcccactcctggctcaccaca

SEQ ID NO: 8313463 - DNA, 22 bp, Homo sapiens
ctcccactcctggctcaccaca

SEQ ID NO: 8313464 - DNA, 22 bp, Homo sapiens
ctcccagagaccaagctgagaa

SEQ ID NO: 8313465 - DNA, 22 bp, Homo sapiens
tttattgttgttagtcataagt

SEQ ID NO: 8313466 - DNA, 22 bp, Homo sapiens
tttattccatgtgtctatgacc

SEQ ID NO: 8313467 - DNA, 22 bp, Homo sapiens
tttagtaagttcactgcaaagc

SEQ ID NO: 8313468 - DNA, 22 bp, Homo sapiens
tttaatcaggcaaagcataata

SEQ ID NO: 8313469 - DNA, 22 bp, Homo sapiens
ctcccctccttaggtcttctag

SEQ ID NO: 8313470 - DNA, 20 bp, Homo sapiens
ctcccctctacagagggctg

SEQ ID NO: 8313471 - DNA, 22 bp, Homo sapiens
ctctctgaggcaggcctgtggg

SEQ ID NO: 8313472 - DNA, 22 bp, Homo sapiens
ctctctgagtgagggacaagct

SEQ ID NO: 8313473 - DNA, 22 bp, Homo sapiens
ctctctgcaagttttgaaatag

SEQ ID NO: 8313474 - DNA, 22 bp, Homo sapiens
ctctctgctgtatccttaggct

SEQ ID NO: 8313475 - DNA, 22 bp, Homo sapiens
ctctctgctgtatccttaggct

SEQ ID NO: 8313476 - DNA, 21 bp, Homo sapiens
ctctctgcttatgaatagtga

SEQ ID NO: 8313477 - DNA, 22 bp, Homo sapiens
ctctctggaagggggagctgat

SEQ ID NO: 8313478 - DNA, 22 bp, Homo sapiens
ctctctggaagggggagctgat

SEQ ID NO: 8313479 - DNA, 22 bp, Homo sapiens
ctctctctatgcgttgttccta

SEQ ID NO: 8313480 - DNA, 22 bp, Homo sapiens
ctctctctttagaagcgtctgg

SEQ ID NO: 8313481 - DNA, 22 bp, Homo sapiens
ctctctgaggaaggagcatctg

SEQ ID NO: 8313482 - DNA, 22 bp, Homo sapiens
ctctctcttgtgttgctgcaga

SEQ ID NO: 8313483 - DNA, 20 bp, Homo sapiens
ctctctctccattcccaggg

SEQ ID NO: 8313484 - DNA, 22 bp, Homo sapiens
tttcctatgatattctatgtgt

SEQ ID NO: 8313485 - DNA, 22 bp, Homo sapiens
tttcacatacagtgtatagtag

SEQ ID NO: 8313486 - DNA, 22 bp, Homo sapiens
tttcacataaatattatgccta

SEQ ID NO: 8313487 - DNA, 21 bp, Homo sapiens
tttcaatgtgttctttgtagt

SEQ ID NO: 8313488 - DNA, 22 bp, Homo sapiens
tttcaatgtaacatttccaggc

SEQ ID NO: 8313489 - DNA, 22 bp, Homo sapiens
tttcaatgtatgtctttctgag

SEQ ID NO: 8313490 - DNA, 22 bp, Homo sapiens
ctctggaaaaccactagcagga

SEQ ID NO: 8313491 - DNA, 20 bp, Homo sapiens
ctctgctttccacctttcag

SEQ ID NO: 8313492 - DNA, 22 bp, Homo sapiens
ctctgctttttagggagcctag

SEQ ID NO: 8313493 - DNA, 22 bp, Homo sapiens
ctctgctttttaaaaggagtcc

SEQ ID NO: 8313494 - DNA, 20 bp, Homo sapiens
ctctgctttaggagagtcag

SEQ ID NO: 8313495 - DNA, 22 bp, Homo sapiens
tttgctataaaagggtcacacg

SEQ ID NO: 8313496 - DNA, 22 bp, Homo sapiens
tttgctatttttctgtgcagct

SEQ ID NO: 8313497 - DNA, 22 bp, Homo sapiens
ctctggaatgtttacatgccct

SEQ ID NO: 8313498 - DNA, 22 bp, Homo sapiens
ctctggaattaaggaagcctgt

SEQ ID NO: 8313499 - DNA, 22 bp, Homo sapiens
tttgggaagaggaatctctgga

SEQ ID NO: 8313500 - DNA, 22 bp, Homo sapiens
tttgggaactctatcatggaaa

SEQ ID NO: 8313501 - DNA, 19 bp, Homo sapiens
ctctgcctccctcctgggt

SEQ ID NO: 8313502 - DNA, 22 bp, Homo sapiens
tttgcattttgataagatcact

SEQ ID NO: 8313503 - DNA, 22 bp, Homo sapiens
tttgcattttagatttaggcct

SEQ ID NO: 8313504 - DNA, 22 bp, Homo sapiens
ttttaatactgctattgtagga

SEQ ID NO: 8313505 - DNA, 22 bp, Homo sapiens
ttttagattgggaaatgtaaag

SEQ ID NO: 8313506 - DNA, 22 bp, Homo sapiens
ttttaagttaatataattgagg

SEQ ID NO: 8313507 - DNA, 22 bp, Homo sapiens
ttttaagatgctagtatttcag

SEQ ID NO: 8313508 - DNA, 22 bp, Homo sapiens
tttgttctgaaaatcttccctt

SEQ ID NO: 8313509 - DNA, 22 bp, Homo sapiens
ctcttagtttatctttgacaaa

SEQ ID NO: 8313510 - DNA, 22 bp, Homo sapiens
ctcttcagataaaagggatatt

SEQ ID NO: 8313511 - DNA, 22 bp, Homo sapiens
ctgacccatataagagtggagg

SEQ ID NO: 8313512 - DNA, 22 bp, Homo sapiens
ctctttcagttctgatagtctc

SEQ ID NO: 8313513 - DNA, 22 bp, Homo sapiens
ctctttccagggtaccccaggt

SEQ ID NO: 8313514 - DNA, 22 bp, Homo sapiens
ctctttcctcagccacagtcta

SEQ ID NO: 8313515 - DNA, 22 bp, Homo sapiens
ctgagccataagggaggctggg

SEQ ID NO: 8313516 - DNA, 22 bp, Homo sapiens
ctgagccagtagtcagggacaa

SEQ ID NO: 8313517 - DNA, 22 bp, Homo sapiens
ctgagccatgagcctgcgccca

SEQ ID NO: 8313518 - DNA, 22 bp, Homo sapiens
ctgagccatccataccagctta

SEQ ID NO: 8313519 - DNA, 22 bp, Homo sapiens
ctgagccaaccacagcaggagc

SEQ ID NO: 8313520 - DNA, 22 bp, Homo sapiens
ctgactctcctcaagcataaat

SEQ ID NO: 8313521 - DNA, 22 bp, Homo sapiens
ctgactcagcagctgatgatcc

SEQ ID NO: 8313522 - DNA, 22 bp, Homo sapiens
ctgagcccaggcgggagctgag

SEQ ID NO: 8313523 - DNA, 20 bp, Homo sapiens
ctgagcccccagcctgcagg

SEQ ID NO: 8313524 - DNA, 22 bp, Homo sapiens
ctgcacagagcagggcagacac

SEQ ID NO: 8313525 - DNA, 19 bp, Homo sapiens
ctgaggcccatgtaccatg

SEQ ID NO: 8313526 - DNA, 17 bp, Homo sapiens
ctgaggcccagggccca

SEQ ID NO: 8313527 - DNA, 22 bp, Homo sapiens
ctgaggccagctgcagagctct

SEQ ID NO: 8313528 - DNA, 22 bp, Homo sapiens
ctgcaggctcgaagacacggat

SEQ ID NO: 8313529 - DNA, 22 bp, Homo sapiens
ctgcaggcccccttcctggagt

SEQ ID NO: 8313530 - DNA, 22 bp, Homo sapiens
ctgcaggcccccttcctggagt

SEQ ID NO: 8313531 - DNA, 22 bp, Homo sapiens
ctgcaggcatctaactgtgggc

SEQ ID NO: 8313532 - DNA, 22 bp, Homo sapiens
ctgcagggcagggcctcctggc

SEQ ID NO: 8313533 - DNA, 22 bp, Homo sapiens
ctgcagggcccgcctgagccct

SEQ ID NO: 8313534 - DNA, 20 bp, Homo sapiens
cgtaaggcaagtgctgcatc

SEQ ID NO: 8313535 - DNA, 22 bp, Homo sapiens
ttcagaaagtgaatcttgttat

SEQ ID NO: 8313536 - DNA, 20 bp, Homo sapiens
ttcaggattctagaccacac

SEQ ID NO: 8313537 - DNA, 22 bp, Homo sapiens
cggggctgtagcacagctgagc

SEQ ID NO: 8313538 - DNA, 22 bp, Homo sapiens
cggggctgtagcacagctgagc

SEQ ID NO: 8313539 - DNA, 22 bp, Homo sapiens
cgccaggcttggtagctcatgc

SEQ ID NO: 8313540 - DNA, 22 bp, Homo sapiens
cctttctctttgctgatcatgt

SEQ ID NO: 8313541 - DNA, 17 bp, Homo sapiens
cctttctctttcatctc

SEQ ID NO: 8313542 - DNA, 22 bp, Homo sapiens
cctttctcttggataccgattg

SEQ ID NO: 8313543 - DNA, 17 bp, Homo sapiens
cctttctctttcatctc

SEQ ID NO: 8313544 - DNA, 22 bp, Homo sapiens
cctttctctggcagcaggacag

SEQ ID NO: 8313545 - DNA, 22 bp, Homo sapiens
cctttcagatgggcatggaccg

SEQ ID NO: 8313546 - DNA, 22 bp, Homo sapiens
cctttcctttttagtgtgggag

SEQ ID NO: 8313547 - DNA, 22 bp, Homo sapiens
cctttctcattttaagcattag

SEQ ID NO: 8313548 - DNA, 22 bp, Homo sapiens
cctttctctatcgacccatcgc

SEQ ID NO: 8313549 - DNA, 16 bp, Homo sapiens
cctttctctgccttcc

SEQ ID NO: 8313550 - DNA, 22 bp, Homo sapiens
ttcaagttttgcctccccatcc

SEQ ID NO: 8313551 - DNA, 22 bp, Homo sapiens
ctcacagatgctgtgggtcagg

SEQ ID NO: 8313552 - DNA, 22 bp, Homo sapiens
ctcacaggagaaagtcatggtc

SEQ ID NO: 8313553 - DNA, 22 bp, Homo sapiens
ctcacaggtaccagcaccctcc

SEQ ID NO: 8313554 - DNA, 22 bp, Homo sapiens
ctcacaggcatctcatcaggct

SEQ ID NO: 8313555 - DNA, 21 bp, Homo sapiens
ctcacaggatgcagtgttact

SEQ ID NO: 8313556 - DNA, 22 bp, Homo sapiens
ctcaaggaaagtctggagaaga

SEQ ID NO: 8313557 - DNA, 22 bp, Homo sapiens
ctcaaggacttattcatgcctg

SEQ ID NO: 8313558 - DNA, 22 bp, Homo sapiens
ctcaagtaagaaacagaattgg

SEQ ID NO: 8313559 - DNA, 22 bp, Homo sapiens
ctactttaattttctgcagaga

SEQ ID NO: 8313560 - DNA, 22 bp, Homo sapiens
ctagaaaaatactttattgtga

SEQ ID NO: 8313561 - DNA, 22 bp, Homo sapiens
ctacttctgtgatgaaactaca

SEQ ID NO: 8313562 - DNA, 22 bp, Homo sapiens
ctacccaggctggagtgcagta

SEQ ID NO: 8313563 - DNA, 22 bp, Homo sapiens
ctacccaggctggagtgcagta

SEQ ID NO: 8313564 - DNA, 22 bp, Homo sapiens
ctactctcccatgattctctgt

SEQ ID NO: 8313565 - DNA, 22 bp, Homo sapiens
ctactgagtccttcagctgcca

SEQ ID NO: 8313566 - DNA, 23 bp, Homo sapiens
cctgtctgtgctgggtggacaca

SEQ ID NO: 8313567 - DNA, 19 bp, Homo sapiens
cctgtctgtcttcagctag

SEQ ID NO: 8313568 - DNA, 22 bp, Homo sapiens
cctgtgccatcctgagcatccc

SEQ ID NO: 8313569 - DNA, 22 bp, Homo sapiens
cctgtctggaacatggcctgtt

SEQ ID NO: 8313570 - DNA, 20 bp, Homo sapiens
cctgtctggagacaaagaga

SEQ ID NO: 8313571 - DNA, 22 bp, Homo sapiens
cctgtctggccaccagggcgat

SEQ ID NO: 8313572 - DNA, 20 bp, Homo sapiens
cctgtctggagacaaagaga

SEQ ID NO: 8313573 - DNA, 22 bp, Homo sapiens
cctgtctggccttccacggggg

SEQ ID NO: 8313574 - DNA, 22 bp, Homo sapiens
cctgtctgtattggtttgctat

SEQ ID NO: 8313575 - DNA, 22 bp, Homo sapiens
cctgtctgtcctctcatgagcc

SEQ ID NO: 8313576 - DNA, 22 bp, Homo sapiens
cctgtctgtatcggttcagagt

SEQ ID NO: 8313577 - DNA, 22 bp, Homo sapiens
cctgtctgcatgagtgagcata

SEQ ID NO: 8313578 - DNA, 22 bp, Homo sapiens
cctgtctgcagatatctcaggt

SEQ ID NO: 8313579 - DNA, 22 bp, Homo sapiens
cctgtctgcatgatccctgcca

SEQ ID NO: 8313580 - DNA, 22 bp, Homo sapiens
cctgtctgcggaggagtggaag

SEQ ID NO: 8313581 - DNA, 22 bp, Homo sapiens
cctgtctgaggaggtgctcttt

SEQ ID NO: 8313582 - DNA, 20 bp, Homo sapiens
cctgtctgcaatggaggtca

SEQ ID NO: 8313583 - DNA, 22 bp, Homo sapiens
cctgtctgaaggcagggggatg

SEQ ID NO: 8313584 - DNA, 22 bp, Homo sapiens
cctgtctgagccagggtgggca

SEQ ID NO: 8313585 - DNA, 22 bp, Homo sapiens
cctgtctctttcaatctgagag

SEQ ID NO: 8313586 - DNA, 22 bp, Homo sapiens
cctgtctctgttaccacatttg

SEQ ID NO: 8313587 - DNA, 22 bp, Homo sapiens
cctgtcagatgaagtaattgtg

SEQ ID NO: 8313588 - DNA, 22 bp, Homo sapiens
cctgtgtcagcccctgcctcca

SEQ ID NO: 8313589 - DNA, 22 bp, Homo sapiens
cctgtgtcagcccctgcctcca

SEQ ID NO: 8313590 - DNA, 21 bp, Homo sapiens
cctgtggtctggagggagcac

SEQ ID NO: 8313591 - DNA, 22 bp, Homo sapiens
ttaaagttcattaaatgagcca

SEQ ID NO: 8313592 - DNA, 22 bp, Homo sapiens
cctgtgccctcagcctggctct

SEQ ID NO: 8313593 - DNA, 21 bp, Homo sapiens
cctgtgctccacacagggtcc

SEQ ID NO: 8313594 - DNA, 21 bp, Homo sapiens
ccttctccacagggtctccgg

SEQ ID NO: 8313595 - DNA, 23 bp, Homo sapiens
ttacttttgcaccaacctaatat

SEQ ID NO: 8313596 - DNA, 21 bp, Homo sapiens
ttacttttgcagcaacctaat

SEQ ID NO: 8313597 - DNA, 21 bp, Homo sapiens
ttacttttgcaccaacctaat

SEQ ID NO: 8313598 - DNA, 22 bp, Homo sapiens
ttagaaaacataagtggtaaag

SEQ ID NO: 8313599 - DNA, 22 bp, Homo sapiens
ttagaaaaaggctgtggtctta

SEQ ID NO: 8313600 - DNA, 22 bp, Homo sapiens
cctgtgtggaaaccgcatgacg

SEQ ID NO: 8313601 - DNA, 22 bp, Homo sapiens
cctgtgtgctgatgacgacaga

SEQ ID NO: 8313602 - DNA, 23 bp, Homo sapiens
cctgtgtgcccttaattcacagc

SEQ ID NO: 8313603 - DNA, 22 bp, Homo sapiens
cctgtgtctttgcctcagggtc

SEQ ID NO: 8313604 - DNA, 22 bp, Homo sapiens
cctgtgtgcacacgaggccatg

SEQ ID NO: 8313605 - DNA, 22 bp, Homo sapiens
cctgtgtcttccccactggtgt

SEQ ID NO: 8313606 - DNA, 19 bp, Homo sapiens
cctgtgtggggtagagatc

SEQ ID NO: 8313607 - DNA, 22 bp, Homo sapiens
cctgtgtggccaggctggagtc

SEQ ID NO: 8313608 - DNA, 22 bp, Homo sapiens
cctgtgtgtaggccaggggagt

SEQ ID NO: 8313609 - DNA, 21 bp, Homo sapiens
cctgtgtgtctgactgggcta

SEQ ID NO: 8313610 - DNA, 20 bp, Homo sapiens
ccttccccacccgctgaggt

SEQ ID NO: 8313611 - DNA, 22 bp, Homo sapiens
ccttcctggagcccatgcagat

SEQ ID NO: 8313612 - DNA, 19 bp, Homo sapiens
ccttcctccccagggccat

SEQ ID NO: 8313613 - DNA, 22 bp, Homo sapiens
ccttcctggctgtccgcctgat

SEQ ID NO: 8313614 - DNA, 22 bp, Homo sapiens
cctgggagtgtgccatctctgt

SEQ ID NO: 8313615 - DNA, 22 bp, Homo sapiens
cctgggagtgtcagacttgctt

SEQ ID NO: 8313616 - DNA, 22 bp, Homo sapiens
cctgggagtggcactcacagca

SEQ ID NO: 8313617 - DNA, 19 bp, Homo sapiens
cctgggagtcagctgaagg

SEQ ID NO: 8313618 - DNA, 22 bp, Homo sapiens
tgggggacaccagtctctctct

SEQ ID NO: 8313619 - DNA, 21 bp, Homo sapiens
tgggggagaattggttgcttt

SEQ ID NO: 8313620 - DNA, 22 bp, Homo sapiens
tgggggactgcactggcgtcag

SEQ ID NO: 8313621 - DNA, 23 bp, Homo sapiens
tggggccaagtgaggaagggtct

SEQ ID NO: 8313622 - DNA, 22 bp, Homo sapiens
tggggctgtggattctcacgaa

SEQ ID NO: 8313623 - DNA, 22 bp, Homo sapiens
tggggctgtgagactacaggat

SEQ ID NO: 8313624 - DNA, 22 bp, Homo sapiens
cctgggcaaatgccagagacaa

SEQ ID NO: 8313625 - DNA, 22 bp, Homo sapiens
cctgggcaacatagtgagacct

SEQ ID NO: 8313626 - DNA, 22 bp, Homo sapiens
cctgggcaacatagtgagaccc

SEQ ID NO: 8313627 - DNA, 22 bp, Homo sapiens
cctggtgttgtgaagtagccgt

SEQ ID NO: 8313628 - DNA, 22 bp, Homo sapiens
cctgggtgtcatgggcagctgg

SEQ ID NO: 8313629 - DNA, 22 bp, Homo sapiens
tgttccatcagtttttggttga

SEQ ID NO: 8313630 - DNA, 22 bp, Homo sapiens
cctggtgcttaccagagctttt

SEQ ID NO: 8313631 - DNA, 22 bp, Homo sapiens
tgttacacagcagaatagcaag

SEQ ID NO: 8313632 - DNA, 18 bp, Homo sapiens
tgttccaaggaaggaatc

SEQ ID NO: 8313633 - DNA, 22 bp, Homo sapiens
tgttccataagtggtgctttgt

SEQ ID NO: 8313634 - DNA, 22 bp, Homo sapiens
tgttaatcaatcaacagtatta

SEQ ID NO: 8313635 - DNA, 22 bp, Homo sapiens
cctgggctctatcctgacccag

SEQ ID NO: 8313636 - DNA, 22 bp, Homo sapiens
cctgggctcaagtgatcctcct

SEQ ID NO: 8313637 - DNA, 22 bp, Homo sapiens
cctgggctctgaggagggagtc

SEQ ID NO: 8313638 - DNA, 22 bp, Homo sapiens
cctgggctggagtacagcagtg

SEQ ID NO: 8313639 - DNA, 22 bp, Homo sapiens
gaagcccaggcttccttggctt

SEQ ID NO: 8313640 - DNA, 22 bp, Homo sapiens
gaagcccacgtttggtgatgta

SEQ ID NO: 8313641 - DNA, 22 bp, Homo sapiens
gaagccagtactgtgctctgca

SEQ ID NO: 8313642 - DNA, 22 bp, Homo sapiens
gaagccctatcctctcctggga

SEQ ID NO: 8313643 - DNA, 22 bp, Homo sapiens
gaagccccaaaccctcgccatc

SEQ ID NO: 8313644 - DNA, 22 bp, Homo sapiens
gaagccccaaaccctcgccatc

SEQ ID NO: 8313645 - DNA, 22 bp, Homo sapiens
gaagcccatttgtacagcacat

SEQ ID NO: 8313646 - DNA, 22 bp, Homo sapiens
gaagcccagggcgtggccgggc

SEQ ID NO: 8313647 - DNA, 22 bp, Homo sapiens
gaagagtggttatccctgctgt

SEQ ID NO: 8313648 - DNA, 22 bp, Homo sapiens
gaaccaagtaggatacaaggag

SEQ ID NO: 8313649 - DNA, 22 bp, Homo sapiens
gaagagcttagttgtcctagaa

SEQ ID NO: 8313650 - DNA, 22 bp, Homo sapiens
gaagagcttagacagaatcaaa

SEQ ID NO: 8313651 - DNA, 22 bp, Homo sapiens
gaagagctgtgattcaggctta

SEQ ID NO: 8313652 - DNA, 22 bp, Homo sapiens
gaagagctgtagcctgctcttt

SEQ ID NO: 8313653 - DNA, 22 bp, Homo sapiens
gaagagctgacagtgtcatcct

SEQ ID NO: 8313654 - DNA, 22 bp, Homo sapiens
gaagagctgctcagaacatgat

SEQ ID NO: 8313655 - DNA, 22 bp, Homo sapiens
gaagagctgcagtttcctgggc

SEQ ID NO: 8313656 - DNA, 22 bp, Homo sapiens
gaagagctatgtccagggagca

SEQ ID NO: 8313657 - DNA, 22 bp, Homo sapiens
gaagagctaaaggcacaggctt

SEQ ID NO: 8313658 - DNA, 22 bp, Homo sapiens
gaacagtaaatttatgcagcac

SEQ ID NO: 8313659 - DNA, 22 bp, Homo sapiens
gaacagctgctagagatctgtg

SEQ ID NO: 8313660 - DNA, 22 bp, Homo sapiens
gaacagcttcttgggagctggg

SEQ ID NO: 8313661 - DNA, 22 bp, Homo sapiens
gaacagccctgttaagtctgtt

SEQ ID NO: 8313662 - DNA, 22 bp, Homo sapiens
gaacagtatcagtagtgccagt

SEQ ID NO: 8313663 - DNA, 22 bp, Homo sapiens
gaaatgcaaattctctctcgct

SEQ ID NO: 8313664 - DNA, 22 bp, Homo sapiens
gaaatgcagattctgattctgt

SEQ ID NO: 8313665 - DNA, 22 bp, Homo sapiens
gaaatgcagaacctgagaccat

SEQ ID NO: 8313666 - DNA, 22 bp, Homo sapiens
gaaatgcaggcttggattcagc

SEQ ID NO: 8313667 - DNA, 22 bp, Homo sapiens
gaaatgcataatcttagtagat

SEQ ID NO: 8313668 - DNA, 22 bp, Homo sapiens
gaaatgcatggatcttggcaga

SEQ ID NO: 8313669 - DNA, 22 bp, Homo sapiens
ctttcattcttagatattagtg

SEQ ID NO: 8313670 - DNA, 22 bp, Homo sapiens
ctttatgtccttgaagagttgt

SEQ ID NO: 8313671 - DNA, 18 bp, Homo sapiens
ctttatgtgcagagcttt

SEQ ID NO: 8313672 - DNA, 22 bp, Homo sapiens
ctttcaatgtgcctgccttggg

SEQ ID NO: 8313673 - DNA, 22 bp, Homo sapiens
ctttcagaggttactcaggaaa

SEQ ID NO: 8313674 - DNA, 18 bp, Homo sapiens
ctttcagatggatatgct

SEQ ID NO: 8313675 - DNA, 22 bp, Homo sapiens
gaaggaaaacagatctgcctga

SEQ ID NO: 8313676 - DNA, 22 bp, Homo sapiens
gaaggaaaaatactctgtaagg

SEQ ID NO: 8313677 - DNA, 22 bp, Homo sapiens
gaaggaaatctgtgatttatgc

SEQ ID NO: 8313678 - DNA, 22 bp, Homo sapiens
gaaggaaaggtctcatgccttt

SEQ ID NO: 8313679 - DNA, 22 bp, Homo sapiens
gacacagagataggcctgtgtt

SEQ ID NO: 8313680 - DNA, 22 bp, Homo sapiens
gacaggggtccctctgggctgt

SEQ ID NO: 8313681 - DNA, 21 bp, Homo sapiens
gacaggggaagaagcaaggag

SEQ ID NO: 8313682 - DNA, 21 bp, Homo sapiens
gacaggggaagaagcaaggag

SEQ ID NO: 8313683 - DNA, 22 bp, Homo sapiens
gacagggtacgggctaggcaca

SEQ ID NO: 8313684 - DNA, 22 bp, Homo sapiens
gacaggtggggaaactaaggta

SEQ ID NO: 8313685 - DNA, 22 bp, Homo sapiens
gaccctgtttctacaaataatt

SEQ ID NO: 8313686 - DNA, 22 bp, Homo sapiens
gagccagggtttgaaactagac

SEQ ID NO: 8313687 - DNA, 22 bp, Homo sapiens
gagccaggttggaggctgcagt

SEQ ID NO: 8313688 - DNA, 22 bp, Homo sapiens
gagccaggtcgggccgcggcga

SEQ ID NO: 8313689 - DNA, 16 bp, Homo sapiens
gagccaggtgccttga

SEQ ID NO: 8313690 - DNA, 22 bp, Homo sapiens
gagccagccgcaagagctgtga

SEQ ID NO: 8313691 - DNA, 22 bp, Homo sapiens
gagcagcttatgtcaagccaga

SEQ ID NO: 8313692 - DNA, 22 bp, Homo sapiens
gagcagctgcagtgcagaccct

SEQ ID NO: 8313693 - DNA, 22 bp, Homo sapiens
gagcagctggacaggcctccct

SEQ ID NO: 8313694 - DNA, 22 bp, Homo sapiens
gagcagctggtaggtgaaccca

SEQ ID NO: 8313695 - DNA, 22 bp, Homo sapiens
gagcagctgtccccaaagcttc

SEQ ID NO: 8313696 - DNA, 22 bp, Homo sapiens
gagatgtacaatgtgtattaat

SEQ ID NO: 8313697 - DNA, 22 bp, Homo sapiens
gagattggcctggcttgccaac

SEQ ID NO: 8313698 - DNA, 22 bp, Homo sapiens
gagattggatttaatggccaaa

SEQ ID NO: 8313699 - DNA, 22 bp, Homo sapiens
gagattctgtagtcaggcatct

SEQ ID NO: 8313700 - DNA, 22 bp, Homo sapiens
gagcagatgtgtgccaggatgc

SEQ ID NO: 8313701 - DNA, 22 bp, Homo sapiens
gagaggccaaaatccctgcccc

SEQ ID NO: 8313702 - DNA, 22 bp, Homo sapiens
gagaggccacctgacgagcagt

SEQ ID NO: 8313703 - DNA, 22 bp, Homo sapiens
gagaggccatggctgtgcagtg

SEQ ID NO: 8313704 - DNA, 19 bp, Homo sapiens
gagaggcctgtgcttgaag

SEQ ID NO: 8313705 - DNA, 19 bp, Homo sapiens
gagaggcctgtgcttgaag

SEQ ID NO: 8313706 - DNA, 22 bp, Homo sapiens
gagaggctatgaggttctgtgt

SEQ ID NO: 8313707 - DNA, 18 bp, Homo sapiens
gagaggcccggctgtgcc

SEQ ID NO: 8313708 - DNA, 22 bp, Homo sapiens
gagatgaatgtaaacaaaggca

SEQ ID NO: 8313709 - DNA, 22 bp, Homo sapiens
gagacaaaagttggagtgcaag

SEQ ID NO: 8313710 - DNA, 22 bp, Homo sapiens
gaggaggctaagtgggctctgg

SEQ ID NO: 8313711 - DNA, 20 bp, Homo sapiens
gaggaaaagctgccaggcct

SEQ ID NO: 8313712 - DNA, 22 bp, Homo sapiens
gaggaaaagagacaggttattg

SEQ ID NO: 8313713 - DNA, 22 bp, Homo sapiens
gaggcagaagttgcagtgagca

SEQ ID NO: 8313714 - DNA, 22 bp, Homo sapiens
gaggccagcgcgcagcactttt

SEQ ID NO: 8313715 - DNA, 22 bp, Homo sapiens
gaggcagaggaaggtggtctct

SEQ ID NO: 8313716 - DNA, 22 bp, Homo sapiens
gagcctggatagccttgttcca

SEQ ID NO: 8313717 - DNA, 22 bp, Homo sapiens
gagcctggattgaagtgggtgg

SEQ ID NO: 8313718 - DNA, 22 bp, Homo sapiens
gagcctggattgtcaccgactt

SEQ ID NO: 8313719 - DNA, 22 bp, Homo sapiens
gagcctggagctggaacgaagc

SEQ ID NO: 8313720 - DNA, 22 bp, Homo sapiens
gagcctcctcctggtgtgccga

SEQ ID NO: 8313721 - DNA, 22 bp, Homo sapiens
gagcctgaaatacaggtcactg

SEQ ID NO: 8313722 - DNA, 22 bp, Homo sapiens
gagcctcgtggcggccactgcg

SEQ ID NO: 8313723 - DNA, 22 bp, Homo sapiens
gagcctgatgaaacaggcagac

SEQ ID NO: 8313724 - DNA, 22 bp, Homo sapiens
gagcctgaatttgacctgctta

SEQ ID NO: 8313725 - DNA, 22 bp, Homo sapiens
gagcctgagtgctgcctcccct

SEQ ID NO: 8313726 - DNA, 22 bp, Homo sapiens
gagcctgatgaaacaggcagac

SEQ ID NO: 8313727 - DNA, 21 bp, Homo sapiens
gagctctcaggcaagaagcag

SEQ ID NO: 8313728 - DNA, 22 bp, Homo sapiens
gagctctgactgctgggtgaca

SEQ ID NO: 8313729 - DNA, 22 bp, Homo sapiens
gagctctgtgtagcctgagggt

SEQ ID NO: 8313730 - DNA, 22 bp, Homo sapiens
gagctctgtgtagcctgagggt

SEQ ID NO: 8313731 - DNA, 22 bp, Homo sapiens
gagcttaggccagggacaggga

SEQ ID NO: 8313732 - DNA, 22 bp, Homo sapiens
gagcttccatggacgccatctg

SEQ ID NO: 8313733 - DNA, 22 bp, Homo sapiens
gagcttccactctagaaggagt

SEQ ID NO: 8313734 - DNA, 22 bp, Homo sapiens
gagcttccctctgcagtccctg

SEQ ID NO: 8313735 - DNA, 22 bp, Homo sapiens
gagcttcctgatgccgaccagt

SEQ ID NO: 8313736 - DNA, 22 bp, Homo sapiens
cttcctgcaggacagccatctg

SEQ ID NO: 8313737 - DNA, 22 bp, Homo sapiens
cttcctgcattgtgccagagtt

SEQ ID NO: 8313738 - DNA, 22 bp, Homo sapiens
cttcctggccattgccatggca

SEQ ID NO: 8313739 - DNA, 22 bp, Homo sapiens
cttgcaggattttgctgctgta

SEQ ID NO: 8313740 - DNA, 22 bp, Homo sapiens
cttgcaggcagggcctcctgga

SEQ ID NO: 8313741 - DNA, 23 bp, Homo sapiens
cttgcagggctggaggcttagaa

SEQ ID NO: 8313742 - DNA, 22 bp, Homo sapiens
ctttatgtccaccagactgcaa

SEQ ID NO: 8313743 - DNA, 22 bp, Homo sapiens
cttgtctgtgtcggataaaact

SEQ ID NO: 8313744 - DNA, 22 bp, Homo sapiens
cttgtcctttacttgagactca

SEQ ID NO: 8313745 - DNA, 22 bp, Homo sapiens
cttgtattcccctatctctaaa

SEQ ID NO: 8313746 - DNA, 22 bp, Homo sapiens
cttgtacaggaatccatggtat

SEQ ID NO: 8313747 - DNA, 22 bp, Homo sapiens
cttgtacatagagaagaagcct

SEQ ID NO: 8313748 - DNA, 22 bp, Homo sapiens
cttgtagaattgaaatggtctc

SEQ ID NO: 8313749 - DNA, 22 bp, Homo sapiens
cttcagaactataaaaagtact

SEQ ID NO: 8313750 - DNA, 22 bp, Homo sapiens
cttcctctgcggcgccgggcgc

SEQ ID NO: 8313751 - DNA, 22 bp, Homo sapiens
cttcctgaacaatgccatcaat

SEQ ID NO: 8313752 - DNA, 18 bp, Homo sapiens
cttcagtgacagtctggc

SEQ ID NO: 8313753 - DNA, 22 bp, Homo sapiens
cttcagggtgacgcaggctgca

SEQ ID NO: 8313754 - DNA, 20 bp, Homo sapiens
cttcaggacccatcctcccc

SEQ ID NO: 8313755 - DNA, 22 bp, Homo sapiens
ctgtgtcctcccgctgcaccca

SEQ ID NO: 8313756 - DNA, 22 bp, Homo sapiens
ctgtgtcctgcgtcaagccaat

SEQ ID NO: 8313757 - DNA, 20 bp, Homo sapiens
ctgtggctcatgcatctgcc

SEQ ID NO: 8313758 - DNA, 23 bp, Homo sapiens
ctgtggctgagtcctgttggagt

SEQ ID NO: 8313759 - DNA, 19 bp, Homo sapiens
ctgtggctgacctctggcc

SEQ ID NO: 8313760 - DNA, 22 bp, Homo sapiens
ctgtggctgcagccttggtcct

SEQ ID NO: 8313761 - DNA, 22 bp, Homo sapiens
ctgtggctgcagccttggtcct

SEQ ID NO: 8313762 - DNA, 22 bp, Homo sapiens
ctgtgtctctccttacaagact

SEQ ID NO: 8313763 - DNA, 22 bp, Homo sapiens
ctgttcatgctgattctgtatg

SEQ ID NO: 8313764 - DNA, 22 bp, Homo sapiens
ctgttctctggcggtggctgtt

SEQ ID NO: 8313765 - DNA, 22 bp, Homo sapiens
ctgggtgagttgatgaaggaga

SEQ ID NO: 8313766 - DNA, 22 bp, Homo sapiens
ctgtcctggagggcataggacg

SEQ ID NO: 8313767 - DNA, 22 bp, Homo sapiens
ctgtcctgtagctccatcagtc

SEQ ID NO: 8313768 - DNA, 22 bp, Homo sapiens
ctgtcctgatggtgccactggt

SEQ ID NO: 8313769 - DNA, 22 bp, Homo sapiens
ctgtcctgcagttgggggcagg

SEQ ID NO: 8313770 - DNA, 22 bp, Homo sapiens
ctgtgcagtaggtcagggctgg

SEQ ID NO: 8313771 - DNA, 22 bp, Homo sapiens
ctgtgcattgtcttgtctgtag

SEQ ID NO: 8313772 - DNA, 22 bp, Homo sapiens
ctgtgccaggcccagctgactt

SEQ ID NO: 8313773 - DNA, 22 bp, Homo sapiens
ctggggctgcggacgggagccc

SEQ ID NO: 8313774 - DNA, 22 bp, Homo sapiens
ctggggctgcagcgatcttcat

SEQ ID NO: 8313775 - DNA, 22 bp, Homo sapiens
ctggggctgcagcgatcttcat

SEQ ID NO: 8313776 - DNA, 22 bp, Homo sapiens
ctggggctgcggtggaggagcc

SEQ ID NO: 8313777 - DNA, 22 bp, Homo sapiens
ctggggtgtgctcagagcaggg

SEQ ID NO: 8313778 - DNA, 22 bp, Homo sapiens
ctggggctcactttggtcaggc

SEQ ID NO: 8313779 - DNA, 22 bp, Homo sapiens
ctggggctcactttggtcaggc

SEQ ID NO: 8313780 - DNA, 22 bp, Homo sapiens
ctggggctctctggaatgcttg

SEQ ID NO: 8313781 - DNA, 22 bp, Homo sapiens
ctggggccacaacggcgcacgc

SEQ ID NO: 8313782 - DNA, 22 bp, Homo sapiens
ctggggcccatcgagggctgag

SEQ ID NO: 8313783 - DNA, 22 bp, Homo sapiens
ctgggctgcagttcctggtcct

SEQ ID NO: 8313784 - DNA, 22 bp, Homo sapiens
ctgggctgcagttcctggtcct

SEQ ID NO: 8313785 - DNA, 22 bp, Homo sapiens
ctgggctgcatcaaagaggcat

SEQ ID NO: 8313786 - DNA, 22 bp, Homo sapiens
ctgggctgcaggagtggggcaa

SEQ ID NO: 8313787 - DNA, 22 bp, Homo sapiens
ctgggctgcagcgggagcgacg

SEQ ID NO: 8313788 - DNA, 22 bp, Homo sapiens
ctgggccagatccagcctcaca

SEQ ID NO: 8313789 - DNA, 20 bp, Homo sapiens
ctggggaggaggatgtgttc

SEQ ID NO: 8313790 - DNA, 20 bp, Homo sapiens
ctgggctgcccagctatggg

SEQ ID NO: 8313791 - DNA, 20 bp, Homo sapiens
ctgggctgcccagctatggg

SEQ ID NO: 8313792 - DNA, 22 bp, Homo sapiens
ctgggctgcgggcgcccctcca

SEQ ID NO: 8313793 - DNA, 22 bp, Homo sapiens
ctgggagctagctctgagctga

SEQ ID NO: 8313794 - DNA, 22 bp, Homo sapiens
ctgggaggattcattgaggtga

SEQ ID NO: 8313795 - DNA, 22 bp, Homo sapiens
ctgggaggcaccgcgtcgtgct

SEQ ID NO: 8313796 - DNA, 22 bp, Homo sapiens
ctgggaggcactattcaggagg

SEQ ID NO: 8313797 - DNA, 22 bp, Homo sapiens
ctgggaggcagaggttgcagtg

SEQ ID NO: 8313798 - DNA, 22 bp, Homo sapiens
ctgggaggcagaggttgtagtg

SEQ ID NO: 8313799 - DNA, 22 bp, Homo sapiens
ctgggaggcggagcttgcagtg

SEQ ID NO: 8313800 - DNA, 22 bp, Homo sapiens
ctgggaggcccacgttgggaag

SEQ ID NO: 8313801 - DNA, 22 bp, Homo sapiens
ctgggaggcagtctctctagaa

SEQ ID NO: 8313802 - DNA, 22 bp, Homo sapiens
ctgggcaggagggctctatgga

SEQ ID NO: 8313803 - DNA, 22 bp, Homo sapiens
ctgggcagtttattcagttctg

SEQ ID NO: 8313804 - DNA, 22 bp, Homo sapiens
ctgggcagttttacatcattgc

SEQ ID NO: 8313805 - DNA, 22 bp, Homo sapiens
ctggcaggcggcagagcccagg

SEQ ID NO: 8313806 - DNA, 22 bp, Homo sapiens
ctggcaggcagacttctgcaag

SEQ ID NO: 8313807 - DNA, 22 bp, Homo sapiens
ctggcaggagcattcacagagg

SEQ ID NO: 8313808 - DNA, 20 bp, Homo sapiens
ctggcaggagcgagtctacc

SEQ ID NO: 8313809 - DNA, 22 bp, Homo sapiens
ctggccagagttggagggtgtg

SEQ ID NO: 8313810 - DNA, 22 bp, Homo sapiens
ctggccagcatttttgctttag

SEQ ID NO: 8313811 - DNA, 22 bp, Homo sapiens
ctgccacttactaggcatggtg

SEQ ID NO: 8313812 - DNA, 22 bp, Homo sapiens
ctgccactttcacccagtgctc

SEQ ID NO: 8313813 - DNA, 22 bp, Homo sapiens
ctgccactagctttcacatctt

SEQ ID NO: 8313814 - DNA, 22 bp, Homo sapiens
ctgccaaggctggggaggacaa

SEQ ID NO: 8313815 - DNA, 22 bp, Homo sapiens
ctgcatccatctcctagcacag

SEQ ID NO: 8313816 - DNA, 22 bp, Homo sapiens
ctgccagctcgccacaatgaca

SEQ ID NO: 8313817 - DNA, 22 bp, Homo sapiens
ctggcagccaagtgggatactc

SEQ ID NO: 8313818 - DNA, 22 bp, Homo sapiens
ctgccagctcaaagcgcagcta

SEQ ID NO: 8313819 - DNA, 22 bp, Homo sapiens
ctgccagcagaggccagcgctg

SEQ ID NO: 8313820 - DNA, 22 bp, Homo sapiens
ctgccagccaggccaggtaggc

SEQ ID NO: 8313821 - DNA, 22 bp, Homo sapiens
ctgccagcaatgtgaccatgct

SEQ ID NO: 8313822 - DNA, 22 bp, Homo sapiens
ctgccagcactgcctcctgagg

SEQ ID NO: 8313823 - DNA, 22 bp, Homo sapiens
ctgccagcactgcctcctgagg

SEQ ID NO: 8313824 - DNA, 22 bp, Homo sapiens
ctggcaggaagttagatggtaa

SEQ ID NO: 8313825 - DNA, 22 bp, Homo sapiens
ctggcaggaagaggaaaggtca

SEQ ID NO: 8313826 - DNA, 22 bp, Homo sapiens
ctggcagcccaacctagagtct

SEQ ID NO: 8313827 - DNA, 22 bp, Homo sapiens
ctggcagcttcaggacactcgg

SEQ ID NO: 8313828 - DNA, 19 bp, Homo sapiens
ctggcagcctgtctgtgtc

SEQ ID NO: 8313829 - DNA, 22 bp, Homo sapiens
ctggcagcttcctttgcatctg

SEQ ID NO: 8313830 - DNA, 22 bp, Homo sapiens
ctggctcttcagtgcttggttc

SEQ ID NO: 8313831 - DNA, 22 bp, Homo sapiens
ctggctgcaggaaggagtgggc

SEQ ID NO: 8313832 - DNA, 22 bp, Homo sapiens
ctggctgcaggatgaggctgcc

SEQ ID NO: 8313833 - DNA, 22 bp, Homo sapiens
ctggctcatccaggtgttgctc

SEQ ID NO: 8313834 - DNA, 22 bp, Homo sapiens
ctggctcatagagcagctccaa

SEQ ID NO: 8313835 - DNA, 22 bp, Homo sapiens
ctggctcagtgccttcagaagt

SEQ ID NO: 8313836 - DNA, 22 bp, Homo sapiens
ctggctcagttcttggttttca

SEQ ID NO: 8313837 - DNA, 22 bp, Homo sapiens
ctggctcattttagcatcaggt

SEQ ID NO: 8313838 - DNA, 23 bp, Homo sapiens
ctggctcatcctggttgcagtgg

SEQ ID NO: 8313839 - DNA, 22 bp, Homo sapiens
ctggctcatgtgatgagggcaa

SEQ ID NO: 8313840 - DNA, 22 bp, Homo sapiens
ctggctgccacttcagggtctt

SEQ ID NO: 8313841 - DNA, 22 bp, Homo sapiens
ctggctgctggcctgaggatgc

SEQ ID NO: 8313842 - DNA, 22 bp, Homo sapiens
ctggctgcttgtagactcgact

SEQ ID NO: 8313843 - DNA, 22 bp, Homo sapiens
ctggctgcgtctgctctgacag

SEQ ID NO: 8313844 - DNA, 22 bp, Homo sapiens
ctggcctggtctggcctctcca

SEQ ID NO: 8313845 - DNA, 22 bp, Homo sapiens
ctggcctggtctggcctctcca

SEQ ID NO: 8313846 - DNA, 22 bp, Homo sapiens
ctggctcactagccctgccctg

SEQ ID NO: 8313847 - DNA, 22 bp, Homo sapiens
ctggcctgtcctgacccagcct

SEQ ID NO: 8313848 - DNA, 22 bp, Homo sapiens
ctggctcagacagctgtgcagt

SEQ ID NO: 8313849 - DNA, 22 bp, Homo sapiens
ctggctcaggaaagttgctgct

SEQ ID NO: 8313850 - DNA, 22 bp, Homo sapiens
ctggctcagggtggtctgggtc

SEQ ID NO: 8313851 - DNA, 22 bp, Homo sapiens
ctggcccagtctcagagtgtca

SEQ ID NO: 8313852 - DNA, 22 bp, Homo sapiens
gtctgccctcacgccagctggg

SEQ ID NO: 8313853 - DNA, 22 bp, Homo sapiens
gtcctgggcctgctgaggctga

SEQ ID NO: 8313854 - DNA, 22 bp, Homo sapiens
gtcctggggaatacagaagccg

SEQ ID NO: 8313855 - DNA, 22 bp, Homo sapiens
gtcctggggatacagaagtgaa

SEQ ID NO: 8313856 - DNA, 22 bp, Homo sapiens
gtcctggggattatagagtgtt

SEQ ID NO: 8313857 - DNA, 22 bp, Homo sapiens
gtctgctgcagagcatggcttt

SEQ ID NO: 8313858 - DNA, 22 bp, Homo sapiens
gtctggaggaggaagaaggcac

SEQ ID NO: 8313859 - DNA, 22 bp, Homo sapiens
gtgaaatctgaggcccatgatg

SEQ ID NO: 8313860 - DNA, 22 bp, Homo sapiens
gtctggagtggggcctgagaat

SEQ ID NO: 8313861 - DNA, 18 bp, Homo sapiens
gtctggaggtcaggagct

SEQ ID NO: 8313862 - DNA, 22 bp, Homo sapiens
gtgaccatcagagaataacaaa

SEQ ID NO: 8313863 - DNA, 22 bp, Homo sapiens
gtgagcaggatttcatggtgta

SEQ ID NO: 8313864 - DNA, 22 bp, Homo sapiens
gtgcagagaaatgagaagtcga

SEQ ID NO: 8313865 - DNA, 22 bp, Homo sapiens
gtgactcacacaggcctgggct

SEQ ID NO: 8313866 - DNA, 22 bp, Homo sapiens
gtgcatttggtgactctcaccc

SEQ ID NO: 8313867 - DNA, 22 bp, Homo sapiens
gtgcatttgacgaatactcact

SEQ ID NO: 8313868 - DNA, 20 bp, Homo sapiens
gtgcatttcacctgtactgt

SEQ ID NO: 8313869 - DNA, 22 bp, Homo sapiens
gtgcatttctcatacactaaat

SEQ ID NO: 8313870 - DNA, 22 bp, Homo sapiens
gtgcatttgtgcatgcacatgt

SEQ ID NO: 8313871 - DNA, 22 bp, Homo sapiens
gtgctaggattacaggcatggg

SEQ ID NO: 8313872 - DNA, 22 bp, Homo sapiens
gtgcatatatgcacatatgtgt

SEQ ID NO: 8313873 - DNA, 22 bp, Homo sapiens
gtgcattggtgcgccacttcac

SEQ ID NO: 8313874 - DNA, 22 bp, Homo sapiens
gtgcattgcgatgcagacgacc

SEQ ID NO: 8313875 - DNA, 22 bp, Homo sapiens
gtgcagtgagcagtgcagcacc

SEQ ID NO: 8313876 - DNA, 22 bp, Homo sapiens
gtgcagtgagcagtgcagcacc

SEQ ID NO: 8313877 - DNA, 22 bp, Homo sapiens
gtgcagtggcagatcctagctc

SEQ ID NO: 8313878 - DNA, 22 bp, Homo sapiens
gtgcagtgaccctggagagctg

SEQ ID NO: 8313879 - DNA, 22 bp, Homo sapiens
gtgcagtgaccctggagagctg

SEQ ID NO: 8313880 - DNA, 22 bp, Homo sapiens
gtgcagtgaaaaaagaatgtcc

SEQ ID NO: 8313881 - DNA, 22 bp, Homo sapiens
gtgcaggtgttttggctgccag

SEQ ID NO: 8313882 - DNA, 22 bp, Homo sapiens
gtcctgggcccaggggctgcct

SEQ ID NO: 8313883 - DNA, 17 bp, Homo sapiens
gtcctgggaggagagag

SEQ ID NO: 8313884 - DNA, 17 bp, Homo sapiens
gtcctgggaggagagag

SEQ ID NO: 8313885 - DNA, 22 bp, Homo sapiens
gtccctgccctcctgggactca

SEQ ID NO: 8313886 - DNA, 22 bp, Homo sapiens
gtccctggaatggactctgcgc

SEQ ID NO: 8313887 - DNA, 20 bp, Homo sapiens
gtcctgggagccacagcaca

SEQ ID NO: 8313888 - DNA, 22 bp, Homo sapiens
gtcctgggaaggaagccaggga

SEQ ID NO: 8313889 - DNA, 22 bp, Homo sapiens
gtcctgggaaggaagccaggga

SEQ ID NO: 8313890 - DNA, 22 bp, Homo sapiens
gtccctgcatcaccacgggact

SEQ ID NO: 8313891 - DNA, 22 bp, Homo sapiens
gtccctctgtgtccctgcagtc

SEQ ID NO: 8313892 - DNA, 22 bp, Homo sapiens
gtccctagtggaaagacatgat

SEQ ID NO: 8313893 - DNA, 22 bp, Homo sapiens
gtccacataggaacccagcttc

SEQ ID NO: 8313894 - DNA, 22 bp, Homo sapiens
gtccacagctctgaggtctccc

SEQ ID NO: 8313895 - DNA, 22 bp, Homo sapiens
gtcattttctagaattatttga

SEQ ID NO: 8313896 - DNA, 22 bp, Homo sapiens
gtcattttgctgcatatttaga

SEQ ID NO: 8313897 - DNA, 22 bp, Homo sapiens
ggtttgcacgatatttccatgg

SEQ ID NO: 8313898 - DNA, 22 bp, Homo sapiens
ggtttgcattctgaaaggctca

SEQ ID NO: 8313899 - DNA, 22 bp, Homo sapiens
ggtttgcatgtgatgttgggca

SEQ ID NO: 8313900 - DNA, 22 bp, Homo sapiens
gtacattttgaggttaaaacaa

SEQ ID NO: 8313901 - DNA, 22 bp, Homo sapiens
gtacattttactttgtttgaat

SEQ ID NO: 8313902 - DNA, 22 bp, Homo sapiens
gtacatttcatttaaatgatgt

SEQ ID NO: 8313903 - DNA, 22 bp, Homo sapiens
gtagaagtgatgtcatgttata

SEQ ID NO: 8313904 - DNA, 22 bp, Homo sapiens
gtatttataggggaatgagagt

SEQ ID NO: 8313905 - DNA, 21 bp, Homo sapiens
gtattgcagagttatgtgctc

SEQ ID NO: 8313906 - DNA, 21 bp, Homo sapiens
gtattctttatgaagtgaaaa

SEQ ID NO: 8313907 - DNA, 22 bp, Homo sapiens
gtattcttggttatcaaaatac

SEQ ID NO: 8313908 - DNA, 22 bp, Homo sapiens
ggtggcctccagggcataggtg

SEQ ID NO: 8313909 - DNA, 22 bp, Homo sapiens
ggtggcctcggtggtgcacagg

SEQ ID NO: 8313910 - DNA, 22 bp, Homo sapiens
ggtggcctctgcaggcctcgac

SEQ ID NO: 8313911 - DNA, 22 bp, Homo sapiens
ggtggcctcggtggtgcacagg

SEQ ID NO: 8313912 - DNA, 22 bp, Homo sapiens
ggtggcctctcatgcaaggtag

SEQ ID NO: 8313913 - DNA, 22 bp, Homo sapiens
ggtggcctcggtggtgcacagg

SEQ ID NO: 8313914 - DNA, 18 bp, Homo sapiens
ggtggccttgacttctct

SEQ ID NO: 8313915 - DNA, 22 bp, Homo sapiens
ggtggcctttcagtggatcagg

SEQ ID NO: 8313916 - DNA, 17 bp, Homo sapiens
ggtggcctgcagtggct

SEQ ID NO: 8313917 - DNA, 22 bp, Homo sapiens
ggtggcctgccctgatccctgg

SEQ ID NO: 8313918 - DNA, 18 bp, Homo sapiens
ggtggctcagtcatgggg

SEQ ID NO: 8313919 - DNA, 22 bp, Homo sapiens
ggtctctgttgcctccatcaag

SEQ ID NO: 8313920 - DNA, 22 bp, Homo sapiens
ggtccctggttccctctgagct

SEQ ID NO: 8313921 - DNA, 22 bp, Homo sapiens
ggtctcagactggcaggcagtg

SEQ ID NO: 8313922 - DNA, 19 bp, Homo sapiens
ggtctcagtgcagctgcag

SEQ ID NO: 8313923 - DNA, 22 bp, Homo sapiens
ggtctcagctggagtccttggt

SEQ ID NO: 8313924 - DNA, 22 bp, Homo sapiens
ggtctcaggagactggagagca

SEQ ID NO: 8313925 - DNA, 22 bp, Homo sapiens
ggtctcagcagttgctttgact

SEQ ID NO: 8313926 - DNA, 22 bp, Homo sapiens
ggtctcagatctttattaaggc

SEQ ID NO: 8313927 - DNA, 22 bp, Homo sapiens
ggtctcagccctcgccagcagc

SEQ ID NO: 8313928 - DNA, 19 bp, Homo sapiens
ggtcacaggggttacaagg

SEQ ID NO: 8313929 - DNA, 22 bp, Homo sapiens
ggtcactgctctaaacaaaagt

SEQ ID NO: 8313930 - DNA, 22 bp, Homo sapiens
gggtggcacaggtgcagagggt

SEQ ID NO: 8313931 - DNA, 20 bp, Homo sapiens
gggtggagttgcggtctgtg

SEQ ID NO: 8313932 - DNA, 22 bp, Homo sapiens
gggtggctcctatgggcatagc

SEQ ID NO: 8313933 - DNA, 22 bp, Homo sapiens
ggggctggctcactaagagact

SEQ ID NO: 8313934 - DNA, 22 bp, Homo sapiens
ggggctgggatttgaacccagg

SEQ ID NO: 8313935 - DNA, 22 bp, Homo sapiens
gggtggaggagaacaggcccca

SEQ ID NO: 8313936 - DNA, 22 bp, Homo sapiens
gggtggagtagaaagatgaatt

SEQ ID NO: 8313937 - DNA, 22 bp, Homo sapiens
ggggtggggttactcattgtgc

SEQ ID NO: 8313938 - DNA, 22 bp, Homo sapiens
ggggtggggttactcattgtgc

SEQ ID NO: 8313939 - DNA, 22 bp, Homo sapiens
ggggtgtgagtagagctgggga

SEQ ID NO: 8313940 - DNA, 22 bp, Homo sapiens
ggggtgggcgtgcagggacacc

SEQ ID NO: 8313941 - DNA, 22 bp, Homo sapiens
ggggtgggcgtgcagggacacc

SEQ ID NO: 8313942 - DNA, 22 bp, Homo sapiens
ggggctggtggtggtttctcca

SEQ ID NO: 8313943 - DNA, 22 bp, Homo sapiens
gggcatggtggcaggcacctgt

SEQ ID NO: 8313944 - DNA, 22 bp, Homo sapiens
gggcatggtggtgcacacctgt

SEQ ID NO: 8313945 - DNA, 22 bp, Homo sapiens
gggccacacagaacctcctggt

SEQ ID NO: 8313946 - DNA, 22 bp, Homo sapiens
gggcatggtgatgtgcacctgt

SEQ ID NO: 8313947 - DNA, 22 bp, Homo sapiens
gggcatggtgatgtgcacctgt

SEQ ID NO: 8313948 - DNA, 22 bp, Homo sapiens
gggcatggccaggtgaggggtc

SEQ ID NO: 8313949 - DNA, 18 bp, Homo sapiens
gggcatggatgcagcatc

SEQ ID NO: 8313950 - DNA, 21 bp, Homo sapiens
gggccacaccttctgcagacc

SEQ ID NO: 8313951 - DNA, 22 bp, Homo sapiens
gggctgccaagcctgcctgcct

SEQ ID NO: 8313952 - DNA, 22 bp, Homo sapiens
gggctgcacagatcttcaaggg

SEQ ID NO: 8313953 - DNA, 22 bp, Homo sapiens
gggctgcacgtattctgctcac

SEQ ID NO: 8313954 - DNA, 22 bp, Homo sapiens
gggctgcctttcttctgggagc

SEQ ID NO: 8313955 - DNA, 22 bp, Homo sapiens
gggctgcctttcttctgggagc

SEQ ID NO: 8313956 - DNA, 22 bp, Homo sapiens
gggctgctgccaatcacagcct

SEQ ID NO: 8313957 - DNA, 23 bp, Homo sapiens
gggctgctccaggccaaggctgg

SEQ ID NO: 8313958 - DNA, 19 bp, Homo sapiens
gggcttggggctgaagcct

SEQ ID NO: 8313959 - DNA, 22 bp, Homo sapiens
gggcttggcacatgggctcagc

SEQ ID NO: 8313960 - DNA, 22 bp, Homo sapiens
gggcttgctgatttgggcagga

SEQ ID NO: 8313961 - DNA, 22 bp, Homo sapiens
gggctgctgcccaggaggcacc

SEQ ID NO: 8313962 - DNA, 22 bp, Homo sapiens
gggctgctgccaccaggtggat

SEQ ID NO: 8313963 - DNA, 22 bp, Homo sapiens
gggctgctgtagagaacatgtt

SEQ ID NO: 8313964 - DNA, 22 bp, Homo sapiens
gggctgctgctgccagcgacac

SEQ ID NO: 8313965 - DNA, 22 bp, Homo sapiens
ggcgaggccgggacaggctgga

SEQ ID NO: 8313966 - DNA, 22 bp, Homo sapiens
ggcgaggccgggacaggctgga

SEQ ID NO: 8313967 - DNA, 22 bp, Homo sapiens
ggcgctggccacggtggctctg

SEQ ID NO: 8313968 - DNA, 22 bp, Homo sapiens
ggccttggtaaagggatgcatg

SEQ ID NO: 8313969 - DNA, 22 bp, Homo sapiens
ggccttggtgctctgtgttgca

SEQ ID NO: 8313970 - DNA, 22 bp, Homo sapiens
ggccttggtgccatggccagtt

SEQ ID NO: 8313971 - DNA, 20 bp, Homo sapiens
ggccttgggtttcgcctgtt

SEQ ID NO: 8313972 - DNA, 17 bp, Homo sapiens
ggccttggggcctcagt

SEQ ID NO: 8313973 - DNA, 22 bp, Homo sapiens
ggccttgggctggctgcagtat

SEQ ID NO: 8313974 - DNA, 22 bp, Homo sapiens
ggccttggggaggatggtgtcc

SEQ ID NO: 8313975 - DNA, 17 bp, Homo sapiens
ggccttgggctgctctt

SEQ ID NO: 8313976 - DNA, 22 bp, Homo sapiens
ggcctgaggcgtcccagctgtg

SEQ ID NO: 8313977 - DNA, 22 bp, Homo sapiens
ggcctgagaaccatggggccaa

SEQ ID NO: 8313978 - DNA, 22 bp, Homo sapiens
ggcctgaggcgtcccagctgtg

SEQ ID NO: 8313979 - DNA, 22 bp, Homo sapiens
ggcctgcacagaggtggctcta

SEQ ID NO: 8313980 - DNA, 22 bp, Homo sapiens
ggccttgggcagacacgtcaca

SEQ ID NO: 8313981 - DNA, 22 bp, Homo sapiens
ggccttgggatgtggctgcagc

SEQ ID NO: 8313982 - DNA, 21 bp, Homo sapiens
ggcctgagtataggacaggcc

SEQ ID NO: 8313983 - DNA, 22 bp, Homo sapiens
ggcctgagtcacatcaggagag

SEQ ID NO: 8313984 - DNA, 22 bp, Homo sapiens
ggcctgagtcccacctggctgt

SEQ ID NO: 8313985 - DNA, 22 bp, Homo sapiens
ggcctctgtttggagccaggat

SEQ ID NO: 8313986 - DNA, 22 bp, Homo sapiens
ggcctctgttctgcattcctcc

SEQ ID NO: 8313987 - DNA, 23 bp, Homo sapiens
ggcctctgtgttctgcccacatg

SEQ ID NO: 8313988 - DNA, 22 bp, Homo sapiens
ggcctctggttcacagggagga

SEQ ID NO: 8313989 - DNA, 22 bp, Homo sapiens
ggcctctggttcgtggtgacct

SEQ ID NO: 8313990 - DNA, 21 bp, Homo sapiens
ggcctctgtcatcctgggaag

SEQ ID NO: 8313991 - DNA, 21 bp, Homo sapiens
ggcctctgtcatcctgggaag

SEQ ID NO: 8313992 - DNA, 22 bp, Homo sapiens
ggcctcagtttctccatgggtt

SEQ ID NO: 8313993 - DNA, 22 bp, Homo sapiens
ggcctcagtttcttcaactgta

SEQ ID NO: 8313994 - DNA, 23 bp, Homo sapiens
ggcctcagtgatgatgggttaaa

SEQ ID NO: 8313995 - DNA, 22 bp, Homo sapiens
ggcctcagtgggccgctgcagg

SEQ ID NO: 8313996 - DNA, 23 bp, Homo sapiens
ggccatggagacttagaatgggc

SEQ ID NO: 8313997 - DNA, 22 bp, Homo sapiens
ggccatggaccccgagctgacc

SEQ ID NO: 8313998 - DNA, 22 bp, Homo sapiens
ggcctcagaccggagctggcca

SEQ ID NO: 8313999 - DNA, 22 bp, Homo sapiens
ggccagggggcttcagactcca

SEQ ID NO: 8314000 - DNA, 22 bp, Homo sapiens
ggccagggcctggggactgtcc

SEQ ID NO: 8314001 - DNA, 20 bp, Homo sapiens
ggcatgggtggggctcccag

SEQ ID NO: 8314002 - DNA, 22 bp, Homo sapiens
ggcatgtttcatcacatcaaga

SEQ ID NO: 8314003 - DNA, 19 bp, Homo sapiens
ggccaggctgactgtggtc

SEQ ID NO: 8314004 - DNA, 22 bp, Homo sapiens
ggcagtcagtgtggttcataaa

SEQ ID NO: 8314005 - DNA, 22 bp, Homo sapiens
ggcagtgaatgaaacagaggct

SEQ ID NO: 8314006 - DNA, 22 bp, Homo sapiens
ggcagtgaaaaagtatgtttcc

SEQ ID NO: 8314007 - DNA, 22 bp, Homo sapiens
ggcatggctgggttctggtgag

SEQ ID NO: 8314008 - DNA, 22 bp, Homo sapiens
ggcatgggagtgagcaacctta

SEQ ID NO: 8314009 - DNA, 22 bp, Homo sapiens
ggcatggctcggagtcagaaca

SEQ ID NO: 8314010 - DNA, 22 bp, Homo sapiens
ggcatggggtgtatgtggcacg

SEQ ID NO: 8314011 - DNA, 22 bp, Homo sapiens
ggcatgggccgaggtgcctcct

SEQ ID NO: 8314012 - DNA, 22 bp, Homo sapiens
ggcaggaggtgagtggcgggtg

SEQ ID NO: 8314013 - DNA, 22 bp, Homo sapiens
ggcaggagggcggacaatgacc

SEQ ID NO: 8314014 - DNA, 22 bp, Homo sapiens
ggcagaggtagctggaaccagg

SEQ ID NO: 8314015 - DNA, 22 bp, Homo sapiens
ggcagaggtagctggaaccagg

SEQ ID NO: 8314016 - DNA, 22 bp, Homo sapiens
ggcagaggagctggaaacatgg

SEQ ID NO: 8314017 - DNA, 22 bp, Homo sapiens
ggcagaggagctggaaacatgg

SEQ ID NO: 8314018 - DNA, 22 bp, Homo sapiens
ggcagaggaaggatgaattcac

SEQ ID NO: 8314019 - DNA, 22 bp, Homo sapiens
ggagccagagggatgcagttga

SEQ ID NO: 8314020 - DNA, 22 bp, Homo sapiens
ggagccagagtctgcagtgtaa

SEQ ID NO: 8314021 - DNA, 22 bp, Homo sapiens
ggagccagaggctgctgctgtg

SEQ ID NO: 8314022 - DNA, 22 bp, Homo sapiens
ggagccagaggctgctgctgtg

SEQ ID NO: 8314023 - DNA, 22 bp, Homo sapiens
ggagccagcagggtgacactga

SEQ ID NO: 8314024 - DNA, 22 bp, Homo sapiens
ggagtcagcctgtcagagtgta

SEQ ID NO: 8314025 - DNA, 21 bp, Homo sapiens
ggagtcagggtctggctgggg

SEQ ID NO: 8314026 - DNA, 22 bp, Homo sapiens
ggagtcaggagcaggctgggct

SEQ ID NO: 8314027 - DNA, 22 bp, Homo sapiens
ggagtcccagcaaagccttccc

SEQ ID NO: 8314028 - DNA, 21 bp, Homo sapiens
ggagtcattagtcatttcctt

SEQ ID NO: 8314029 - DNA, 22 bp, Homo sapiens
ggcaaaaagttcccatcagtgt

SEQ ID NO: 8314030 - DNA, 22 bp, Homo sapiens
ggcaaaaaccacaattactttt

SEQ ID NO: 8314031 - DNA, 22 bp, Homo sapiens
ggcaaaaacagcaatgactttt

SEQ ID NO: 8314032 - DNA, 22 bp, Homo sapiens
ggcaaaaaccgcaataacttct

SEQ ID NO: 8314033 - DNA, 22 bp, Homo sapiens
ggcaaaaaccataattactttt

SEQ ID NO: 8314034 - DNA, 22 bp, Homo sapiens
ggagtgagtactggagtagctg

SEQ ID NO: 8314035 - DNA, 23 bp, Homo sapiens
ggagtgcaatggcgccatctcgg

SEQ ID NO: 8314036 - DNA, 23 bp, Homo sapiens
ggagtgcaatggcgccatctcgg

SEQ ID NO: 8314037 - DNA, 22 bp, Homo sapiens
ggcaaagttttcatctcataac

SEQ ID NO: 8314038 - DNA, 22 bp, Homo sapiens
gggagctggttcctgccctcca

SEQ ID NO: 8314039 - DNA, 22 bp, Homo sapiens
gggagctgtagtccagataccg

SEQ ID NO: 8314040 - DNA, 22 bp, Homo sapiens
gggagagcgcgctagggccgag

SEQ ID NO: 8314041 - DNA, 22 bp, Homo sapiens
gggagagagaaaacgtggcgca

SEQ ID NO: 8314042 - DNA, 22 bp, Homo sapiens
gggagagatgctgattgccaat

SEQ ID NO: 8314043 - DNA, 22 bp, Homo sapiens
gggagagagagctcatgttgaa

SEQ ID NO: 8314044 - DNA, 22 bp, Homo sapiens
gggacagctgtagtgcttggct

SEQ ID NO: 8314045 - DNA, 23 bp, Homo sapiens
gggagaatatgaggatgatggtg

SEQ ID NO: 8314046 - DNA, 23 bp, Homo sapiens
gggaccagctagggctgtgacct

SEQ ID NO: 8314047 - DNA, 22 bp, Homo sapiens
gggacaggcccctcgctagctt

SEQ ID NO: 8314048 - DNA, 22 bp, Homo sapiens
gggatggggggaagcgtccatg

SEQ ID NO: 8314049 - DNA, 22 bp, Homo sapiens
gggatggggtcgggaccctgct

SEQ ID NO: 8314050 - DNA, 22 bp, Homo sapiens
gggatggggtcaacatgtacct

SEQ ID NO: 8314051 - DNA, 22 bp, Homo sapiens
gggatggggtcaacatgtacct

SEQ ID NO: 8314052 - DNA, 22 bp, Homo sapiens
gggatgtcactgtgcctggcac

SEQ ID NO: 8314053 - DNA, 22 bp, Homo sapiens
gggcatggaggtctgtctgcag

SEQ ID NO: 8314054 - DNA, 18 bp, Homo sapiens
gggcatggatgcagcatc

SEQ ID NO: 8314055 - DNA, 22 bp, Homo sapiens
gggcaggatgcagtttcagaga

SEQ ID NO: 8314056 - DNA, 22 bp, Homo sapiens
gggcagctgccaagtgcatcgc

SEQ ID NO: 8314057 - DNA, 22 bp, Homo sapiens
gggcagctctggctgtgggaag

SEQ ID NO: 8314058 - DNA, 22 bp, Homo sapiens
gggcagctgcagggatggtgac

SEQ ID NO: 8314059 - DNA, 22 bp, Homo sapiens
gggcacagctgctacccagtgc

SEQ ID NO: 8314060 - DNA, 22 bp, Homo sapiens
ggcgggggtccaggagcctgca

SEQ ID NO: 8314061 - DNA, 22 bp, Homo sapiens
ggcgggggtccaggagcctgca

SEQ ID NO: 8314062 - DNA, 22 bp, Homo sapiens
ggctgaaacagatttcaagaca

SEQ ID NO: 8314063 - DNA, 22 bp, Homo sapiens
ggctgaagtgtagtggctcact

SEQ ID NO: 8314064 - DNA, 23 bp, Homo sapiens
ggctgagactacaggcgcttgcc

SEQ ID NO: 8314065 - DNA, 22 bp, Homo sapiens
ggctctggcgtccaatggagcg

SEQ ID NO: 8314066 - DNA, 22 bp, Homo sapiens
ggctctggcaaggggaggctac

SEQ ID NO: 8314067 - DNA, 22 bp, Homo sapiens
ggctctggagcacagacgtctg

SEQ ID NO: 8314068 - DNA, 22 bp, Homo sapiens
ggctctggagacatgtggagag

SEQ ID NO: 8314069 - DNA, 22 bp, Homo sapiens
ggctgagcaattttgatgacat

SEQ ID NO: 8314070 - DNA, 22 bp, Homo sapiens
ggctgagcactttaggcaggag

SEQ ID NO: 8314071 - DNA, 22 bp, Homo sapiens
ggctgctgcccacccctgcatg

SEQ ID NO: 8314072 - DNA, 22 bp, Homo sapiens
ggctgctgagttggccaggaga

SEQ ID NO: 8314073 - DNA, 22 bp, Homo sapiens
ggctgctggcattgaggtaggt

SEQ ID NO: 8314074 - DNA, 22 bp, Homo sapiens
ggctgctgggaatatgccagct

SEQ ID NO: 8314075 - DNA, 22 bp, Homo sapiens
ggctgctggaagactgaacaag

SEQ ID NO: 8314076 - DNA, 22 bp, Homo sapiens
ggctgggcaaacaagactcttc

SEQ ID NO: 8314077 - DNA, 22 bp, Homo sapiens
ggctgggctcgctgattggctg

SEQ ID NO: 8314078 - DNA, 22 bp, Homo sapiens
ggctgggctccgggagcatgcg

SEQ ID NO: 8314079 - DNA, 22 bp, Homo sapiens
ggctgggctccgggagcatgcg

SEQ ID NO: 8314080 - DNA, 22 bp, Homo sapiens
ggctgggcctctccctcagctg

SEQ ID NO: 8314081 - DNA, 22 bp, Homo sapiens
ggctgggcaggtctgcacaggg

SEQ ID NO: 8314082 - DNA, 22 bp, Homo sapiens
ggctgggcaggtctgcacaggg

SEQ ID NO: 8314083 - DNA, 22 bp, Homo sapiens
ggctgggccagggcctgtggac

SEQ ID NO: 8314084 - DNA, 22 bp, Homo sapiens
ggcttctcccctttgagtcttc

SEQ ID NO: 8314085 - DNA, 22 bp, Homo sapiens
ggcttctctcttcacatggctt

SEQ ID NO: 8314086 - DNA, 22 bp, Homo sapiens
ggcttctctcccccagctccac

SEQ ID NO: 8314087 - DNA, 22 bp, Homo sapiens
ggcttctcgtgccgaagcaaga

SEQ ID NO: 8314088 - DNA, 22 bp, Homo sapiens
ggctgggctgctgggtcagagc

SEQ ID NO: 8314089 - DNA, 22 bp, Homo sapiens
ggcttctgaaatctctgtgcgt

SEQ ID NO: 8314090 - DNA, 22 bp, Homo sapiens
ggcttctgagtgctctgctgtt

SEQ ID NO: 8314091 - DNA, 22 bp, Homo sapiens
ggcttctgccacgagagggaag

SEQ ID NO: 8314092 - DNA, 22 bp, Homo sapiens
ggcttctgtcctctggatctgt

SEQ ID NO: 8314093 - DNA, 22 bp, Homo sapiens
ggcttctggtaaagaccacacc

SEQ ID NO: 8314094 - DNA, 22 bp, Homo sapiens
gcaggcagatcacctgtcagga

SEQ ID NO: 8314095 - DNA, 22 bp, Homo sapiens
gcaggcagatcacctgtcagga

SEQ ID NO: 8314096 - DNA, 22 bp, Homo sapiens
gcaggcaggtggcatcttgtga

SEQ ID NO: 8314097 - DNA, 22 bp, Homo sapiens
gcaggcagaggtggaggagaca

SEQ ID NO: 8314098 - DNA, 21 bp, Homo sapiens
gcagggacaaagcttcaggag

SEQ ID NO: 8314099 - DNA, 22 bp, Homo sapiens
gcaggcagtcatctttcatatt

SEQ ID NO: 8314100 - DNA, 19 bp, Homo sapiens
gcaggcagtggcattcgga

SEQ ID NO: 8314101 - DNA, 22 bp, Homo sapiens
gcaggcagttatttagtagaat

SEQ ID NO: 8314102 - DNA, 22 bp, Homo sapiens
gcagggctgttcaggagggtgg

SEQ ID NO: 8314103 - DNA, 22 bp, Homo sapiens
gcagggctgtggacactttggt

SEQ ID NO: 8314104 - DNA, 22 bp, Homo sapiens
gcagggctgggtgggagacaga

SEQ ID NO: 8314105 - DNA, 22 bp, Homo sapiens
gcagggacctgccactgctgtc

SEQ ID NO: 8314106 - DNA, 22 bp, Homo sapiens
gcagggctctgctgtagtccta

SEQ ID NO: 8314107 - DNA, 22 bp, Homo sapiens
gcagggacaactgtgcacctga

SEQ ID NO: 8314108 - DNA, 22 bp, Homo sapiens
gcagggacaaggcaggtgttct

SEQ ID NO: 8314109 - DNA, 22 bp, Homo sapiens
gcagggacagggcagggccttt

SEQ ID NO: 8314110 - DNA, 22 bp, Homo sapiens
gcagggacacctttgtgaagct

SEQ ID NO: 8314111 - DNA, 22 bp, Homo sapiens
gcagggacatctttgtctagta

SEQ ID NO: 8314112 - DNA, 23 bp, Homo sapiens
gcagatggccccagagtgctgcc

SEQ ID NO: 8314113 - DNA, 22 bp, Homo sapiens
gcagatggcagcccaggctggg

SEQ ID NO: 8314114 - DNA, 22 bp, Homo sapiens
gcagatggcagcccaggctggg

SEQ ID NO: 8314115 - DNA, 22 bp, Homo sapiens
gcagatggcagcccaggctggg

SEQ ID NO: 8314116 - DNA, 22 bp, Homo sapiens
gcagatggtggggcaggaaaat

SEQ ID NO: 8314117 - DNA, 22 bp, Homo sapiens
gcagatggtgccatgtcttgtg

SEQ ID NO: 8314118 - DNA, 22 bp, Homo sapiens
gcagatggctcagacactgggg

SEQ ID NO: 8314119 - DNA, 22 bp, Homo sapiens
gcagatggctgagcctgcagat

SEQ ID NO: 8314120 - DNA, 22 bp, Homo sapiens
gcagatggtgggggaggagtac

SEQ ID NO: 8314121 - DNA, 22 bp, Homo sapiens
gcagcccagagcgcaggacccc

SEQ ID NO: 8314122 - DNA, 22 bp, Homo sapiens
gcagcccaggtgtagctctttg

SEQ ID NO: 8314123 - DNA, 22 bp, Homo sapiens
gcagccccaggagacgcccagg

SEQ ID NO: 8314124 - DNA, 22 bp, Homo sapiens
gcaggaaaggttgagactttgc

SEQ ID NO: 8314125 - DNA, 22 bp, Homo sapiens
gcagctttttggatgtcagtta

SEQ ID NO: 8314126 - DNA, 22 bp, Homo sapiens
gcagctttgtggagaggcccat

SEQ ID NO: 8314127 - DNA, 22 bp, Homo sapiens
gcaggaagatgagctcaggtaa

SEQ ID NO: 8314128 - DNA, 22 bp, Homo sapiens
gcagatggactgtatgacctga

SEQ ID NO: 8314129 - DNA, 22 bp, Homo sapiens
gcagaggccatcaactttgcca

SEQ ID NO: 8314130 - DNA, 22 bp, Homo sapiens
gcagaggcatttctgacgctgc

SEQ ID NO: 8314131 - DNA, 22 bp, Homo sapiens
gcagagcagtactctcttgact

SEQ ID NO: 8314132 - DNA, 22 bp, Homo sapiens
gcagagaaagttttgtcctcag

SEQ ID NO: 8314133 - DNA, 21 bp, Homo sapiens
gcagactgccctgctgtcccc

SEQ ID NO: 8314134 - DNA, 22 bp, Homo sapiens
gcagactgtatcaatgtcagta

SEQ ID NO: 8314135 - DNA, 22 bp, Homo sapiens
gcagactggtcttcagccttgg

SEQ ID NO: 8314136 - DNA, 21 bp, Homo sapiens
gcacagtgccaggcacacagt

SEQ ID NO: 8314137 - DNA, 22 bp, Homo sapiens
gcacatgagctgctgggatggg

SEQ ID NO: 8314138 - DNA, 22 bp, Homo sapiens
gcacacagtatatgctcattaa

SEQ ID NO: 8314139 - DNA, 22 bp, Homo sapiens
gcacagaacagagaaatagcca

SEQ ID NO: 8314140 - DNA, 22 bp, Homo sapiens
gcacaccctctcaccagcactg

SEQ ID NO: 8314141 - DNA, 19 bp, Homo sapiens
gcacaccctgcaccaccat

SEQ ID NO: 8314142 - DNA, 22 bp, Homo sapiens
gcacagggctgccaggcggctt

SEQ ID NO: 8314143 - DNA, 22 bp, Homo sapiens
gcacaggttgcaaaagttcaca

SEQ ID NO: 8314144 - DNA, 22 bp, Homo sapiens
gcaaaggtagccaaggagctca

SEQ ID NO: 8314145 - DNA, 22 bp, Homo sapiens
gcaaagtctgcatctggatcag

SEQ ID NO: 8314146 - DNA, 22 bp, Homo sapiens
gcaaagtctcaagacccaagtg

SEQ ID NO: 8314147 - DNA, 22 bp, Homo sapiens
gcaaagctgggtgtgaatgcac

SEQ ID NO: 8314148 - DNA, 22 bp, Homo sapiens
gcagtgggaaggttggcacatg

SEQ ID NO: 8314149 - DNA, 22 bp, Homo sapiens
gcagtggctaggagtctggcgt

SEQ ID NO: 8314150 - DNA, 22 bp, Homo sapiens
gcagtggctaagctcgcatgca

SEQ ID NO: 8314151 - DNA, 22 bp, Homo sapiens
gcagtgggagcttaggcagtgc

SEQ ID NO: 8314152 - DNA, 22 bp, Homo sapiens
gcagtggcatgatgtgggctca

SEQ ID NO: 8314153 - DNA, 22 bp, Homo sapiens
gcagtggcaccgctggctctgg

SEQ ID NO: 8314154 - DNA, 22 bp, Homo sapiens
gcagtggatccaatggtatctt

SEQ ID NO: 8314155 - DNA, 22 bp, Homo sapiens
gcaggggagtggatgatggatt

SEQ ID NO: 8314156 - DNA, 22 bp, Homo sapiens
gcaggggagtccactctatgca

SEQ ID NO: 8314157 - DNA, 22 bp, Homo sapiens
gcaggggagtggcaggcccgga

SEQ ID NO: 8314158 - DNA, 22 bp, Homo sapiens
gcaggggagtggcaggcccgga

SEQ ID NO: 8314159 - DNA, 22 bp, Homo sapiens
gcagtgacagggctgctgcctt

SEQ ID NO: 8314160 - DNA, 22 bp, Homo sapiens
gcagtgaatctggcaagaattt

SEQ ID NO: 8314161 - DNA, 22 bp, Homo sapiens
gcagtgctttagtctgtccttt

SEQ ID NO: 8314162 - DNA, 22 bp, Homo sapiens
gcatgctgcaccagagcctctc

SEQ ID NO: 8314163 - DNA, 22 bp, Homo sapiens
gcatgctgcaccagagcctctc

SEQ ID NO: 8314164 - DNA, 21 bp, Homo sapiens
gcatgcctgcatcttagtgtt

SEQ ID NO: 8314165 - DNA, 22 bp, Homo sapiens
gccaccagtgggggcctgggca

SEQ ID NO: 8314166 - DNA, 22 bp, Homo sapiens
gccaccaggttagatccagcct

SEQ ID NO: 8314167 - DNA, 22 bp, Homo sapiens
gccaccagccccatgcgctgtg

SEQ ID NO: 8314168 - DNA, 22 bp, Homo sapiens
gccaccaggagcccagtccaaa

SEQ ID NO: 8314169 - DNA, 22 bp, Homo sapiens
gccaccagggggctccagtgag

SEQ ID NO: 8314170 - DNA, 22 bp, Homo sapiens
gccacatgcaattgcagcacgt

SEQ ID NO: 8314171 - DNA, 22 bp, Homo sapiens
gccagcctgtgggggctctgtg

SEQ ID NO: 8314172 - DNA, 22 bp, Homo sapiens
gccagcctgtgggggctctgtg

SEQ ID NO: 8314173 - DNA, 21 bp, Homo sapiens
gccagcctgtttacctgtggt

SEQ ID NO: 8314174 - DNA, 22 bp, Homo sapiens
gccagcctgtgcttggccaggc

SEQ ID NO: 8314175 - DNA, 22 bp, Homo sapiens
gccagccttctgtggcctgcaa

SEQ ID NO: 8314176 - DNA, 23 bp, Homo sapiens
gccagccttgctctcctgcagcc

SEQ ID NO: 8314177 - DNA, 22 bp, Homo sapiens
gccaccccataggtgttaggtg

SEQ ID NO: 8314178 - DNA, 22 bp, Homo sapiens
gccacccccaagtaggtggtct

SEQ ID NO: 8314179 - DNA, 22 bp, Homo sapiens
gccacccccaagtaggtggtct

SEQ ID NO: 8314180 - DNA, 21 bp, Homo sapiens
gccacccctggcacaggtgct

SEQ ID NO: 8314181 - DNA, 21 bp, Homo sapiens
gccacccctggcacaggtgct

SEQ ID NO: 8314182 - DNA, 20 bp, Homo sapiens
gccagccctgacacaggagc

SEQ ID NO: 8314183 - DNA, 22 bp, Homo sapiens
gccagctcccaagtgagcccct

SEQ ID NO: 8314184 - DNA, 22 bp, Homo sapiens
gccagctcagtgccaggcccct

SEQ ID NO: 8314185 - DNA, 22 bp, Homo sapiens
gccagctcagatgcaggaagga

SEQ ID NO: 8314186 - DNA, 22 bp, Homo sapiens
gccagggctcgcggtccctcgt

SEQ ID NO: 8314187 - DNA, 22 bp, Homo sapiens
gccagggcaggggagcatctgc

SEQ ID NO: 8314188 - DNA, 22 bp, Homo sapiens
gccagggagtctgggccacaga

SEQ ID NO: 8314189 - DNA, 22 bp, Homo sapiens
gccagggaggctgtagggtcct

SEQ ID NO: 8314190 - DNA, 21 bp, Homo sapiens
gccagggaagagagttggctg

SEQ ID NO: 8314191 - DNA, 22 bp, Homo sapiens
gccagggaacccaagggcctca

SEQ ID NO: 8314192 - DNA, 22 bp, Homo sapiens
gccaggcagatatgtgagctta

SEQ ID NO: 8314193 - DNA, 22 bp, Homo sapiens
gccaggcagcagcgaggatggt

SEQ ID NO: 8314194 - DNA, 22 bp, Homo sapiens
gccaggcagcaggaagccagtg

SEQ ID NO: 8314195 - DNA, 22 bp, Homo sapiens
gccaggcagccaccctctgcga

SEQ ID NO: 8314196 - DNA, 22 bp, Homo sapiens
gccaggcagctgggagggtgcc

SEQ ID NO: 8314197 - DNA, 22 bp, Homo sapiens
gcctcctgaaaggaagagctcc

SEQ ID NO: 8314198 - DNA, 22 bp, Homo sapiens
gcctcctggcctttgctcctca

SEQ ID NO: 8314199 - DNA, 23 bp, Homo sapiens
gcctctggagccccagtgctcag

SEQ ID NO: 8314200 - DNA, 22 bp, Homo sapiens
gcctcctggttgcttctccaac

SEQ ID NO: 8314201 - DNA, 22 bp, Homo sapiens
gcctcctgagaagccacaggct

SEQ ID NO: 8314202 - DNA, 22 bp, Homo sapiens
gcctcctggattttagtgccat

SEQ ID NO: 8314203 - DNA, 22 bp, Homo sapiens
gccctgtgcgactctagaggtt

SEQ ID NO: 8314204 - DNA, 22 bp, Homo sapiens
gccctgtgccagtcacgctgtg

SEQ ID NO: 8314205 - DNA, 22 bp, Homo sapiens
gccctgggattgggtggaggct

SEQ ID NO: 8314206 - DNA, 22 bp, Homo sapiens
gccctgggattgggtggaggct

SEQ ID NO: 8314207 - DNA, 22 bp, Homo sapiens
gccctgggattgggtggaggct

SEQ ID NO: 8314208 - DNA, 22 bp, Homo sapiens
gccctggccttcatctcagaca

SEQ ID NO: 8314209 - DNA, 20 bp, Homo sapiens
gccctggagccttgtcctgg

SEQ ID NO: 8314210 - DNA, 22 bp, Homo sapiens
gccccagctctgccacaactag

SEQ ID NO: 8314211 - DNA, 22 bp, Homo sapiens
gccccagcctcccgagtagctg

SEQ ID NO: 8314212 - DNA, 22 bp, Homo sapiens
gccccagccaaggtgacacgaa

SEQ ID NO: 8314213 - DNA, 22 bp, Homo sapiens
gccaggggacgcggagcgacga

SEQ ID NO: 8314214 - DNA, 22 bp, Homo sapiens
gccagggggtcagcaggcactt

SEQ ID NO: 8314215 - DNA, 21 bp, Homo sapiens
gcccagcaaggtgagaaggcc

SEQ ID NO: 8314216 - DNA, 22 bp, Homo sapiens
gcccagcacagctggaagagtc

SEQ ID NO: 8314217 - DNA, 21 bp, Homo sapiens
gcccagcaaggtgagaaggcc

SEQ ID NO: 8314218 - DNA, 22 bp, Homo sapiens
gcccagcacattgctgaggacc

SEQ ID NO: 8314219 - DNA, 22 bp, Homo sapiens
gcccagcacattgctgaggacc

SEQ ID NO: 8314220 - DNA, 22 bp, Homo sapiens
gcccagcctccaagctccaagg

SEQ ID NO: 8314221 - DNA, 22 bp, Homo sapiens
gcccagctgcaccctggtgggt

SEQ ID NO: 8314222 - DNA, 22 bp, Homo sapiens
gcccagctcctctgcagaccct

SEQ ID NO: 8314223 - DNA, 22 bp, Homo sapiens
gcccagcagctggtggagaagg

SEQ ID NO: 8314224 - DNA, 22 bp, Homo sapiens
gcccagcagatctcagtgtctc

SEQ ID NO: 8314225 - DNA, 22 bp, Homo sapiens
gcccagcacctctctcagggtt

SEQ ID NO: 8314226 - DNA, 22 bp, Homo sapiens
gcccagcacctctctcagggtt

SEQ ID NO: 8314227 - DNA, 22 bp, Homo sapiens
gcccagcacattgctgaggacc

SEQ ID NO: 8314228 - DNA, 22 bp, Homo sapiens
gcccagctgtctggcagggatg

SEQ ID NO: 8314229 - DNA, 22 bp, Homo sapiens
gcccagctggcttccagcacat

SEQ ID NO: 8314230 - DNA, 22 bp, Homo sapiens
gcccagctttttgaggcaggca

SEQ ID NO: 8314231 - DNA, 22 bp, Homo sapiens
gcccatggcagaactgtgagca

SEQ ID NO: 8314232 - DNA, 22 bp, Homo sapiens
gccccaccgagggtgcagtcct

SEQ ID NO: 8314233 - DNA, 22 bp, Homo sapiens
ggacacagctgcagccacaccc

SEQ ID NO: 8314234 - DNA, 22 bp, Homo sapiens
ggacacagtggaagacagcttg

SEQ ID NO: 8314235 - DNA, 22 bp, Homo sapiens
ggacagggtaagtactagtgtg

SEQ ID NO: 8314236 - DNA, 22 bp, Homo sapiens
ggagacagtatggcttgtagct

SEQ ID NO: 8314237 - DNA, 20 bp, Homo sapiens
ggaccaggtggggcggtggc

SEQ ID NO: 8314238 - DNA, 19 bp, Homo sapiens
ggaccaggtcctgggcagc

SEQ ID NO: 8314239 - DNA, 22 bp, Homo sapiens
ggagcatgtggggtgagcaggg

SEQ ID NO: 8314240 - DNA, 22 bp, Homo sapiens
ggagagaaattgaggtagcaag

SEQ ID NO: 8314241 - DNA, 22 bp, Homo sapiens
ggagagaattccatggacatgt

SEQ ID NO: 8314242 - DNA, 22 bp, Homo sapiens
ggagaccagaaggaagcttcga

SEQ ID NO: 8314243 - DNA, 22 bp, Homo sapiens
ggagacagtgacttagagactg

SEQ ID NO: 8314244 - DNA, 22 bp, Homo sapiens
ggagacagtggtagggcctaag

SEQ ID NO: 8314245 - DNA, 20 bp, Homo sapiens
ggaagcagagaactgttttc

SEQ ID NO: 8314246 - DNA, 22 bp, Homo sapiens
gctttcctggccctgtccctgc

SEQ ID NO: 8314247 - DNA, 22 bp, Homo sapiens
gctttctcttcactgatgttca

SEQ ID NO: 8314248 - DNA, 22 bp, Homo sapiens
ggaagaagggtcattggcagcc

SEQ ID NO: 8314249 - DNA, 22 bp, Homo sapiens
gcttgctcaacccccgtctctc

SEQ ID NO: 8314250 - DNA, 22 bp, Homo sapiens
gctttatgtaagtccaaaggca

SEQ ID NO: 8314251 - DNA, 22 bp, Homo sapiens
gcttggaagtaggattgggaga

SEQ ID NO: 8314252 - DNA, 22 bp, Homo sapiens
gcttgctggtgcctgcaggctc

SEQ ID NO: 8314253 - DNA, 22 bp, Homo sapiens
gcttgctggtgcctgcaggctc

SEQ ID NO: 8314254 - DNA, 22 bp, Homo sapiens
gctgtgtgaaaactgggcctgg

SEQ ID NO: 8314255 - DNA, 22 bp, Homo sapiens
gctgtgtcctcacacagccttt

SEQ ID NO: 8314256 - DNA, 22 bp, Homo sapiens
gctgtggctgtacagagaccat

SEQ ID NO: 8314257 - DNA, 22 bp, Homo sapiens
gctgtgctatatctctgagtgt

SEQ ID NO: 8314258 - DNA, 19 bp, Homo sapiens
gctgtgcctctctcctgct

SEQ ID NO: 8314259 - DNA, 19 bp, Homo sapiens
gctggggcctgaccagaca

SEQ ID NO: 8314260 - DNA, 22 bp, Homo sapiens
gctggggctgggctgaggaaga

SEQ ID NO: 8314261 - DNA, 22 bp, Homo sapiens
gctgggcttggtttccctgctt

SEQ ID NO: 8314262 - DNA, 22 bp, Homo sapiens
gctggggaggcagcagagaaca

SEQ ID NO: 8314263 - DNA, 22 bp, Homo sapiens
gctgggcttctcaatgctgcct

SEQ ID NO: 8314264 - DNA, 22 bp, Homo sapiens
gctggggagggcgtcaaggcca

SEQ ID NO: 8314265 - DNA, 22 bp, Homo sapiens
gctggctgcgtcatcacagggc

SEQ ID NO: 8314266 - DNA, 22 bp, Homo sapiens
gctggctttgcactgggtgcat

SEQ ID NO: 8314267 - DNA, 22 bp, Homo sapiens
gctggctgtgttccttctgcca

SEQ ID NO: 8314268 - DNA, 22 bp, Homo sapiens
gctggctgtgtttcatctctga

SEQ ID NO: 8314269 - DNA, 22 bp, Homo sapiens
gctggctgttggaggtacctgc

SEQ ID NO: 8314270 - DNA, 22 bp, Homo sapiens
gccttgggggtgaaagaggcta

SEQ ID NO: 8314271 - DNA, 22 bp, Homo sapiens
gcctttcagttccatcaaagga

SEQ ID NO: 8314272 - DNA, 22 bp, Homo sapiens
gcctttgcctgcgacgtggctg

SEQ ID NO: 8314273 - DNA, 22 bp, Homo sapiens
gcctttgcaccatcagtgcaat

SEQ ID NO: 8314274 - DNA, 22 bp, Homo sapiens
gcggtgggggaaaggagcggtt

SEQ ID NO: 8314275 - DNA, 22 bp, Homo sapiens
gcgtaaggcctctggtctcgga

SEQ ID NO: 8314276 - DNA, 22 bp, Homo sapiens
gcctctggtccctcatgctgtg

SEQ ID NO: 8314277 - DNA, 22 bp, Homo sapiens
gcctctggtccctcatgctgtg

SEQ ID NO: 8314278 - DNA, 22 bp, Homo sapiens
gcctctgggctctgcccctggc

SEQ ID NO: 8314279 - DNA, 22 bp, Homo sapiens
gcctctggggcagctgagtcat

SEQ ID NO: 8314280 - DNA, 22 bp, Homo sapiens
gcctgagcaggcgtggaccatg

SEQ ID NO: 8314281 - DNA, 22 bp, Homo sapiens
gcctgagcaggcgtggaccatg

SEQ ID NO: 8314282 - DNA, 22 bp, Homo sapiens
gcctgagcccaggtgtgcagag

SEQ ID NO: 8314283 - DNA, 19 bp, Homo sapiens
gcctgagccagccatgcaa

SEQ ID NO: 8314284 - DNA, 22 bp, Homo sapiens
gccttggccttcctaggcctga

SEQ ID NO: 8314285 - DNA, 22 bp, Homo sapiens
gccttggccaacaccttgcaaa

SEQ ID NO: 8314286 - DNA, 22 bp, Homo sapiens
gccttggctgatgtgcgaatga

SEQ ID NO: 8314287 - DNA, 22 bp, Homo sapiens
gccttgggaaagtgggaggaga

SEQ ID NO: 8314288 - DNA, 22 bp, Homo sapiens
gccttgcctcagccatggaaac

SEQ ID NO: 8314289 - DNA, 22 bp, Homo sapiens
gccttgctttgcttctggacag

SEQ ID NO: 8314290 - DNA, 20 bp, Homo sapiens
gcctgagctccgcctcctgt

SEQ ID NO: 8314291 - DNA, 22 bp, Homo sapiens
gcctgagctactagggagtctg

SEQ ID NO: 8314292 - DNA, 22 bp, Homo sapiens
gcctgagccgcctgagcggcgg

SEQ ID NO: 8314293 - DNA, 20 bp, Homo sapiens
gcctgagctattgccaggat

SEQ ID NO: 8314294 - DNA, 22 bp, Homo sapiens
gctcccacaaccttcttgctcc

SEQ ID NO: 8314295 - DNA, 22 bp, Homo sapiens
gctcccacaaccttcttgctcc

SEQ ID NO: 8314296 - DNA, 22 bp, Homo sapiens
gctccaggtatttgccctttta

SEQ ID NO: 8314297 - DNA, 22 bp, Homo sapiens
gctccctgaaaagaacaaagtc

SEQ ID NO: 8314298 - DNA, 22 bp, Homo sapiens
gctcccagaaccaaggctgggg

SEQ ID NO: 8314299 - DNA, 22 bp, Homo sapiens
gctcccactgcagccctgagcc

SEQ ID NO: 8314300 - DNA, 22 bp, Homo sapiens
gctcccacgcaattcttttcag

SEQ ID NO: 8314301 - DNA, 22 bp, Homo sapiens
gctcccaccaggcagacctacc

SEQ ID NO: 8314302 - DNA, 22 bp, Homo sapiens
gctcccaccgccgctatgggta

SEQ ID NO: 8314303 - DNA, 22 bp, Homo sapiens
gctcccaccgccgctatgggta

SEQ ID NO: 8314304 - DNA, 22 bp, Homo sapiens
gctcccacctccagcctgagtt

SEQ ID NO: 8314305 - DNA, 22 bp, Homo sapiens
gctcccacctttgctatcagta

SEQ ID NO: 8314306 - DNA, 22 bp, Homo sapiens
gctcccaccttaaccttcacat

SEQ ID NO: 8314307 - DNA, 22 bp, Homo sapiens
gctcccacctccagcctgagtt

SEQ ID NO: 8314308 - DNA, 22 bp, Homo sapiens
gctcccacctccagcctgagtt

SEQ ID NO: 8314309 - DNA, 22 bp, Homo sapiens
gctccctggtagccatgctctc

SEQ ID NO: 8314310 - DNA, 20 bp, Homo sapiens
gctccctggtagaaatgttt

SEQ ID NO: 8314311 - DNA, 21 bp, Homo sapiens
gctccctggctgtgtgacctg

SEQ ID NO: 8314312 - DNA, 21 bp, Homo sapiens
gctccctgctcagctcctggg

SEQ ID NO: 8314313 - DNA, 22 bp, Homo sapiens
gctccctgcctacacggacctt

SEQ ID NO: 8314314 - DNA, 22 bp, Homo sapiens
gctccctgcagctgagagttcc

SEQ ID NO: 8314315 - DNA, 22 bp, Homo sapiens
gctccctgcactctgcagccct

SEQ ID NO: 8314316 - DNA, 22 bp, Homo sapiens
gctccctgactcagttcctgag

SEQ ID NO: 8314317 - DNA, 17 bp, Homo sapiens
gctccctgaggacagct

SEQ ID NO: 8314318 - DNA, 22 bp, Homo sapiens
gctcagccgaacttcagagcag

SEQ ID NO: 8314319 - DNA, 23 bp, Homo sapiens
gctcagaggtttttctctggatg

SEQ ID NO: 8314320 - DNA, 22 bp, Homo sapiens
gctacctgagcaagagcttcaa

SEQ ID NO: 8314321 - DNA, 22 bp, Homo sapiens
gctcagagggaacaaggggctg

SEQ ID NO: 8314322 - DNA, 19 bp, Homo sapiens
gctcagagggccctgtgct

SEQ ID NO: 8314323 - DNA, 22 bp, Homo sapiens
gctcagaggagcatcataagga

SEQ ID NO: 8314324 - DNA, 22 bp, Homo sapiens
gctcagagcttgaagttccact

SEQ ID NO: 8314325 - DNA, 22 bp, Homo sapiens
gctcagaggatgctcctttatg

SEQ ID NO: 8314326 - DNA, 22 bp, Homo sapiens
gctcagaggcacgacctcttgg

SEQ ID NO: 8314327 - DNA, 22 bp, Homo sapiens
gctgcctgtcctgaggagtccg

SEQ ID NO: 8314328 - DNA, 22 bp, Homo sapiens
gctgcctcaggcacctcctggc

SEQ ID NO: 8314329 - DNA, 22 bp, Homo sapiens
gctgccctgtggtccagcaggt

SEQ ID NO: 8314330 - DNA, 22 bp, Homo sapiens
gctgcccattccactggatggt

SEQ ID NO: 8314331 - DNA, 22 bp, Homo sapiens
gctgccctaatatcacatgtta

SEQ ID NO: 8314332 - DNA, 22 bp, Homo sapiens
gctgccctgtctgcagcaggac

SEQ ID NO: 8314333 - DNA, 22 bp, Homo sapiens
gctgcccagcaggccccagggg

SEQ ID NO: 8314334 - DNA, 22 bp, Homo sapiens
gctgcccagttctgctgctgcc

SEQ ID NO: 8314335 - DNA, 22 bp, Homo sapiens
gctgcccagggtggagccggct

SEQ ID NO: 8314336 - DNA, 22 bp, Homo sapiens
gctgagggctgtaacagcagag

SEQ ID NO: 8314337 - DNA, 22 bp, Homo sapiens
gctgagggcatgtgtggcgact

SEQ ID NO: 8314338 - DNA, 22 bp, Homo sapiens
gctgctccgtctgagctctggt

SEQ ID NO: 8314339 - DNA, 22 bp, Homo sapiens
gctgcttctctgatggagtcca

SEQ ID NO: 8314340 - DNA, 22 bp, Homo sapiens
gctgcttcctttcctgctgacc

SEQ ID NO: 8314341 - DNA, 22 bp, Homo sapiens
gctgccttcagttctgattcat

SEQ ID NO: 8314342 - DNA, 22 bp, Homo sapiens
gctgcctgttgaagggtctgtg

SEQ ID NO: 8314343 - DNA, 20 bp, Homo sapiens
gctgcctgtttctgtaagta

SEQ ID NO: 8314344 - DNA, 20 bp, Homo sapiens
gctgcctgtttctgtaagta

SEQ ID NO: 8314345 - DNA, 22 bp, Homo sapiens
gctgcctgtctgctgacccagg

SEQ ID NO: 8314346 - DNA, 22 bp, Homo sapiens
gctgcctgtctgtttcttttat

SEQ ID NO: 8314347 - DNA, 22 bp, Homo sapiens
gctgcctgtcctgaggagtccg

SEQ ID NO: 8314348 - DNA, 22 bp, Homo sapiens
gctgcctgtgcactttctcgta

SEQ ID NO: 8314349 - DNA, 22 bp, Homo sapiens
gctgcctgtggcccttctgggt

SEQ ID NO: 8314350 - DNA, 22 bp, Homo sapiens
gctgcctgtggcccttctgggt

SEQ ID NO: 8314351 - DNA, 22 bp, Homo sapiens
gctgcctgtggcccttctgggt

SEQ ID NO: 8314352 - DNA, 22 bp, Homo sapiens
gctgcctgtgtggccactcact

SEQ ID NO: 8314353 - DNA, 22 bp, Homo sapiens
gctgcctgttgaagggtctgtg

SEQ ID NO: 8314354 - DNA, 22 bp, Homo sapiens
gctgcctgtgtggccactcact

SEQ ID NO: 8314355 - DNA, 22 bp, Homo sapiens
gctgcctgtgtggccactcact

SEQ ID NO: 8314356 - DNA, 22 bp, Homo sapiens
gctgcctgtgtggccactcact

SEQ ID NO: 8314357 - DNA, 22 bp, Homo sapiens
gctctgggctgccctctggaca

SEQ ID NO: 8314358 - DNA, 22 bp, Homo sapiens
gctctgggattaccagccttag

SEQ ID NO: 8314359 - DNA, 22 bp, Homo sapiens
gctctgggattaccagccttag

SEQ ID NO: 8314360 - DNA, 22 bp, Homo sapiens
gctctgggaactgactgccttc

SEQ ID NO: 8314361 - DNA, 22 bp, Homo sapiens
gctccctgttctcagccatgat

SEQ ID NO: 8314362 - DNA, 22 bp, Homo sapiens
gctgagagtgagcactggatat

SEQ ID NO: 8314363 - DNA, 22 bp, Homo sapiens
gctgagagcagtgtggccttaa

SEQ ID NO: 8314364 - DNA, 22 bp, Homo sapiens
gctgagagcaaagcatgtctag

SEQ ID NO: 8314365 - DNA, 22 bp, Homo sapiens
gctgagaggcactatctccgga

SEQ ID NO: 8314366 - DNA, 22 bp, Homo sapiens
gctgagagcggccagctgggaa

SEQ ID NO: 8314367 - DNA, 21 bp, Homo sapiens
gctgagaggttgggaagttca

SEQ ID NO: 8314368 - DNA, 22 bp, Homo sapiens
gctgagagaaaagtgaggttct

SEQ ID NO: 8314369 - DNA, 22 bp, Homo sapiens
tatgagaaaataaatatctgtt

SEQ ID NO: 8314370 - DNA, 22 bp, Homo sapiens
tatctacaggtgtcaggtaaga

SEQ ID NO: 8314371 - DNA, 22 bp, Homo sapiens
tatctactcctctttcagatgc

SEQ ID NO: 8314372 - DNA, 21 bp, Homo sapiens
tatctactggtgtctttcaga

SEQ ID NO: 8314373 - DNA, 22 bp, Homo sapiens
tatagtaaaattttcatttatg

SEQ ID NO: 8314374 - DNA, 22 bp, Homo sapiens
tatagtacatggaatcttcata

SEQ ID NO: 8314375 - DNA, 22 bp, Homo sapiens
tatatcttatatgtgcaggtac

SEQ ID NO: 8314376 - DNA, 22 bp, Homo sapiens
tatccaattcaccattgatggg

SEQ ID NO: 8314377 - DNA, 20 bp, Homo sapiens
tataacagtgttgggtgtgt

SEQ ID NO: 8314378 - DNA, 22 bp, Homo sapiens
tataacagtttaggtggtgtca

SEQ ID NO: 8314379 - DNA, 22 bp, Homo sapiens
tataacactcagaaagaatcat

SEQ ID NO: 8314380 - DNA, 22 bp, Homo sapiens
taggggtgaggccaggcatcag

SEQ ID NO: 8314381 - DNA, 22 bp, Homo sapiens
tatttataatctgccaaagaga

SEQ ID NO: 8314382 - DNA, 22 bp, Homo sapiens
tattgacagagggtcagaagag

SEQ ID NO: 8314383 - DNA, 22 bp, Homo sapiens
tatttctgaatccaaaaggtca

SEQ ID NO: 8314384 - DNA, 22 bp, Homo sapiens
tattgacaatttgtgaaactat

SEQ ID NO: 8314385 - DNA, 22 bp, Homo sapiens
tattgacaataggcaactgagg

SEQ ID NO: 8314386 - DNA, 22 bp, Homo sapiens
tattgaaattcttcatgtcctc

SEQ ID NO: 8314387 - DNA, 22 bp, Homo sapiens
tattgaaatccattacgttctt

SEQ ID NO: 8314388 - DNA, 22 bp, Homo sapiens
tattgaaatgaatgacagtgat

SEQ ID NO: 8314389 - DNA, 22 bp, Homo sapiens
tatgtacaccggggaaggtggg

SEQ ID NO: 8314390 - DNA, 22 bp, Homo sapiens
tatgtacacatacacttgtaat

SEQ ID NO: 8314391 - DNA, 22 bp, Homo sapiens
tatgtacataacatgaaatgca

SEQ ID NO: 8314392 - DNA, 22 bp, Homo sapiens
tatgtacataacatgaaatgca

SEQ ID NO: 8314393 - DNA, 22 bp, Homo sapiens
tatgtacagggatagaacttga

SEQ ID NO: 8314394 - DNA, 22 bp, Homo sapiens
tatgtacagtccttaacttaaa

SEQ ID NO: 8314395 - DNA, 22 bp, Homo sapiens
tatgtacaatcagcagttcata

SEQ ID NO: 8314396 - DNA, 22 bp, Homo sapiens
tatgtacaatcagcagttcata

SEQ ID NO: 8314397 - DNA, 20 bp, Homo sapiens
tatgagtattactttcagga

SEQ ID NO: 8314398 - DNA, 22 bp, Homo sapiens
tatgagtacaaggactctgtct

SEQ ID NO: 8314399 - DNA, 22 bp, Homo sapiens
tatgagcttccagtgttgcatg

SEQ ID NO: 8314400 - DNA, 22 bp, Homo sapiens
tattactgaggttttatggagt

SEQ ID NO: 8314401 - DNA, 22 bp, Homo sapiens
tatgtgcagtttgctcttaaca

SEQ ID NO: 8314402 - DNA, 22 bp, Homo sapiens
tatgtgaatacagcagtggatg

SEQ ID NO: 8314403 - DNA, 19 bp, Homo sapiens
tagaatgcccacttaaaaa

SEQ ID NO: 8314404 - DNA, 22 bp, Homo sapiens
tagacacaagagaagggtataa

SEQ ID NO: 8314405 - DNA, 22 bp, Homo sapiens
tagacagatttaaaggaatgga

SEQ ID NO: 8314406 - DNA, 22 bp, Homo sapiens
tagacacatccgtggaagcttc

SEQ ID NO: 8314407 - DNA, 22 bp, Homo sapiens
tagacacatcaagtatagttaa

SEQ ID NO: 8314408 - DNA, 22 bp, Homo sapiens
tagaaagtaaatcagttttatt

SEQ ID NO: 8314409 - DNA, 22 bp, Homo sapiens
tagaaagcttggggtgtttaaa

SEQ ID NO: 8314410 - DNA, 22 bp, Homo sapiens
tagaaatgcagtgtactgtgtc

SEQ ID NO: 8314411 - DNA, 22 bp, Homo sapiens
tagaaatgcccagattctgcta

SEQ ID NO: 8314412 - DNA, 22 bp, Homo sapiens
tagaaatgattttgatgcttca

SEQ ID NO: 8314413 - DNA, 22 bp, Homo sapiens
tagaaatcatttagaagtattg

SEQ ID NO: 8314414 - DNA, 21 bp, Homo sapiens
tagaaatcagctggtgcctct

SEQ ID NO: 8314415 - DNA, 22 bp, Homo sapiens
tagaaatcaggtttttagaaag

SEQ ID NO: 8314416 - DNA, 22 bp, Homo sapiens
tagaaatccccagtctcatagt

SEQ ID NO: 8314417 - DNA, 22 bp, Homo sapiens
tagaaatctacttagactttct

SEQ ID NO: 8314418 - DNA, 20 bp, Homo sapiens
tagaaatcttataaaagact

SEQ ID NO: 8314419 - DNA, 22 bp, Homo sapiens
tagaaatcagcaggcatatgta

SEQ ID NO: 8314420 - DNA, 22 bp, Homo sapiens
tagaaagtgaaggttaattaat

SEQ ID NO: 8314421 - DNA, 22 bp, Homo sapiens
tactttgtcattctaaccttcc

SEQ ID NO: 8314422 - DNA, 22 bp, Homo sapiens
tactttggatccttacaatagc

SEQ ID NO: 8314423 - DNA, 19 bp, Homo sapiens
tacatttgtgtacacttgt

SEQ ID NO: 8314424 - DNA, 22 bp, Homo sapiens
tagaaaagaattttatttgata

SEQ ID NO: 8314425 - DNA, 22 bp, Homo sapiens
tagaaaagaattttatttgata

SEQ ID NO: 8314426 - DNA, 22 bp, Homo sapiens
tagaaaagataacattctgtgc

SEQ ID NO: 8314427 - DNA, 22 bp, Homo sapiens
tactttttgtctctttgaatgt

SEQ ID NO: 8314428 - DNA, 19 bp, Homo sapiens
tactttttcaggacagagt

SEQ ID NO: 8314429 - DNA, 22 bp, Homo sapiens
tacttttagcctatttgattct

SEQ ID NO: 8314430 - DNA, 22 bp, Homo sapiens
tagaaactcaggatactcttcc

SEQ ID NO: 8314431 - DNA, 22 bp, Homo sapiens
tagaaactgatagtcttgtgct

SEQ ID NO: 8314432 - DNA, 22 bp, Homo sapiens
tagaaacatgttctgttctgtt

SEQ ID NO: 8314433 - DNA, 22 bp, Homo sapiens
tagaaacacagatctggtgtca

SEQ ID NO: 8314434 - DNA, 22 bp, Homo sapiens
tagaaacatataggatggcagg

SEQ ID NO: 8314435 - DNA, 22 bp, Homo sapiens
tagccgggtgttgtgtcatgca

SEQ ID NO: 8314436 - DNA, 22 bp, Homo sapiens
tagccgggtgtggtggaactcc

SEQ ID NO: 8314437 - DNA, 22 bp, Homo sapiens
tagccttctcaagacaaagttg

SEQ ID NO: 8314438 - DNA, 22 bp, Homo sapiens
tagcctctggaatcctttctct

SEQ ID NO: 8314439 - DNA, 22 bp, Homo sapiens
tagcctctctcctccacaacct

SEQ ID NO: 8314440 - DNA, 22 bp, Homo sapiens
tagccgcttaattatttggtga

SEQ ID NO: 8314441 - DNA, 22 bp, Homo sapiens
tagcagctcacagcctcccatt

SEQ ID NO: 8314442 - DNA, 22 bp, Homo sapiens
tagcagagcagggatcagagcc

SEQ ID NO: 8314443 - DNA, 22 bp, Homo sapiens
tagaggtgacactgagaccata

SEQ ID NO: 8314444 - DNA, 22 bp, Homo sapiens
tagaggtgtcactttgggaagt

SEQ ID NO: 8314445 - DNA, 22 bp, Homo sapiens
tagctttaccatagaagagtat

SEQ ID NO: 8314446 - DNA, 22 bp, Homo sapiens
tagctttacaaagtgctgcacc

SEQ ID NO: 8314447 - DNA, 22 bp, Homo sapiens
taggaaaagtctagattgatga

SEQ ID NO: 8314448 - DNA, 22 bp, Homo sapiens
taggaaaaatacagaattatat

SEQ ID NO: 8314449 - DNA, 22 bp, Homo sapiens
tagggcagagcttgtacacgat

SEQ ID NO: 8314450 - DNA, 22 bp, Homo sapiens
tagggaggctacttcttgtagg

SEQ ID NO: 8314451 - DNA, 20 bp, Homo sapiens
tacagaaacaggacttttgg

SEQ ID NO: 8314452 - DNA, 22 bp, Homo sapiens
tacagaaaaactggcattgaag

SEQ ID NO: 8314453 - DNA, 22 bp, Homo sapiens
tacactttttactacagattct

SEQ ID NO: 8314454 - DNA, 22 bp, Homo sapiens
tacaaagtttgagaatgctttc

SEQ ID NO: 8314455 - DNA, 22 bp, Homo sapiens
tacaaagtttgagaatgctttc

SEQ ID NO: 8314456 - DNA, 22 bp, Homo sapiens
tacaaagttttcttggattgag

SEQ ID NO: 8314457 - DNA, 22 bp, Homo sapiens
tacaaagtttggggtcctcaaa

SEQ ID NO: 8314458 - DNA, 22 bp, Homo sapiens
tacaaagtgtgcccatgctgag

SEQ ID NO: 8314459 - DNA, 22 bp, Homo sapiens
tacaaagtgagcaacctctttt

SEQ ID NO: 8314460 - DNA, 22 bp, Homo sapiens
tacaaagtcaccagcttcttgc

SEQ ID NO: 8314461 - DNA, 22 bp, Homo sapiens
tacagagtggtgagatcttttg

SEQ ID NO: 8314462 - DNA, 22 bp, Homo sapiens
tacagatacagatctagataca

SEQ ID NO: 8314463 - DNA, 22 bp, Homo sapiens
tacagaaatcacatcgctttga

SEQ ID NO: 8314464 - DNA, 22 bp, Homo sapiens
tacagtagaatttttagtaact

SEQ ID NO: 8314465 - DNA, 22 bp, Homo sapiens
tacagtagacaatgttagtatg

SEQ ID NO: 8314466 - DNA, 22 bp, Homo sapiens
tacaggaggattatcaaaggat

SEQ ID NO: 8314467 - DNA, 22 bp, Homo sapiens
tacagtaaccttatttgtcatt

SEQ ID NO: 8314468 - DNA, 22 bp, Homo sapiens
tacatagcaaggaaatgacaga

SEQ ID NO: 8314469 - DNA, 22 bp, Homo sapiens
tacatagcaaggaaatgacaga

SEQ ID NO: 8314470 - DNA, 22 bp, Homo sapiens
tacatagtattcacattgtttt

SEQ ID NO: 8314471 - DNA, 22 bp, Homo sapiens
tacatatactgagtgatttgct

SEQ ID NO: 8314472 - DNA, 22 bp, Homo sapiens
tacatagttccatttacaggaa

SEQ ID NO: 8314473 - DNA, 22 bp, Homo sapiens
tacatatagacagttactctag

SEQ ID NO: 8314474 - DNA, 22 bp, Homo sapiens
tacattctggaaaggcacagac

SEQ ID NO: 8314475 - DNA, 22 bp, Homo sapiens
tacattctactttttcactccc

SEQ ID NO: 8314476 - DNA, 22 bp, Homo sapiens
tacatttgctttgattttcagc

SEQ ID NO: 8314477 - DNA, 22 bp, Homo sapiens
taagtaaatttataatgtgatt

SEQ ID NO: 8314478 - DNA, 22 bp, Homo sapiens
taagtgcaatgttttacttaaa

SEQ ID NO: 8314479 - DNA, 22 bp, Homo sapiens
taaggcattctcatgctgtgaa

SEQ ID NO: 8314480 - DNA, 20 bp, Homo sapiens
taaggctgttttgtattcct

SEQ ID NO: 8314481 - DNA, 22 bp, Homo sapiens
taaggtcatggtgaataataag

SEQ ID NO: 8314482 - DNA, 22 bp, Homo sapiens
taattataacagttacatctta

SEQ ID NO: 8314483 - DNA, 22 bp, Homo sapiens
taatacttttgccttgtattca

SEQ ID NO: 8314484 - DNA, 22 bp, Homo sapiens
taatacttaccttgcagagtct

SEQ ID NO: 8314485 - DNA, 22 bp, Homo sapiens
tacaaacttgttttaagtaagt

SEQ ID NO: 8314486 - DNA, 22 bp, Homo sapiens
tacaaagctgtatagcctggtc

SEQ ID NO: 8314487 - DNA, 22 bp, Homo sapiens
tacaaagcctggtagatatctg

SEQ ID NO: 8314488 - DNA, 22 bp, Homo sapiens
tacaaagtatatttctagctgt

SEQ ID NO: 8314489 - DNA, 22 bp, Homo sapiens
tacaaagtagaaattcagtaaa

SEQ ID NO: 8314490 - DNA, 22 bp, Homo sapiens
gttcagggagggacagatgaag

SEQ ID NO: 8314491 - DNA, 22 bp, Homo sapiens
gttcacatccttgtgaggattt

SEQ ID NO: 8314492 - DNA, 22 bp, Homo sapiens
gttcacatcacttcactgaacc

SEQ ID NO: 8314493 - DNA, 22 bp, Homo sapiens
gttcatattactttgagtgcag

SEQ ID NO: 8314494 - DNA, 22 bp, Homo sapiens
gttcatttatgatgtaacatgt

SEQ ID NO: 8314495 - DNA, 22 bp, Homo sapiens
gttgagtgggttaggatgctga

SEQ ID NO: 8314496 - DNA, 22 bp, Homo sapiens
gtgtgccaccagtcaaggtgaa

SEQ ID NO: 8314497 - DNA, 22 bp, Homo sapiens
gtgtgccaggaactggctgctg

SEQ ID NO: 8314498 - DNA, 22 bp, Homo sapiens
gtgtgccagacatgatgctatg

SEQ ID NO: 8314499 - DNA, 22 bp, Homo sapiens
gtgtgccaacaaaagacagtgc

SEQ ID NO: 8314500 - DNA, 23 bp, Homo sapiens
gtgtgccaagcactgtgccagga

SEQ ID NO: 8314501 - DNA, 22 bp, Homo sapiens
gtgtgcatgcatagacaccaca

SEQ ID NO: 8314502 - DNA, 22 bp, Homo sapiens
gtgtgcagtgagcaaaagatct

SEQ ID NO: 8314503 - DNA, 22 bp, Homo sapiens
gtgctctgtgtattaggatgtc

SEQ ID NO: 8314504 - DNA, 21 bp, Homo sapiens
gtgctctgggcagcagagggc

SEQ ID NO: 8314505 - DNA, 21 bp, Homo sapiens
gtgctctgggcagcagagggc

SEQ ID NO: 8314506 - DNA, 22 bp, Homo sapiens
gtgctctggctggtctcccggt

SEQ ID NO: 8314507 - DNA, 22 bp, Homo sapiens
gtgctctcctggctgccctgac

SEQ ID NO: 8314508 - DNA, 22 bp, Homo sapiens
gtgctctcctggctgccctgac

SEQ ID NO: 8314509 - DNA, 23 bp, Homo sapiens
gtgctctgcggtctgctagtctg

SEQ ID NO: 8314510 - DNA, 22 bp, Homo sapiens
gtgctccctccttcctcaagga

SEQ ID NO: 8314511 - DNA, 22 bp, Homo sapiens
gtgctcaggaagctgttcctgc

SEQ ID NO: 8314512 - DNA, 22 bp, Homo sapiens
gtgctcactgtgagacgtcctg

SEQ ID NO: 8314513 - DNA, 22 bp, Homo sapiens
gttaataaaggtatagaatcag

SEQ ID NO: 8314514 - DNA, 22 bp, Homo sapiens
gtgtggctgattgacatggtca

SEQ ID NO: 8314515 - DNA, 22 bp, Homo sapiens
gtgtggctgccagccaagaggc

SEQ ID NO: 8314516 - DNA, 22 bp, Homo sapiens
gtgtggctgtgggagatgttca

SEQ ID NO: 8314517 - DNA, 22 bp, Homo sapiens
gtgtggctacctcagaggagca

SEQ ID NO: 8314518 - DNA, 22 bp, Homo sapiens
taaattgttttctagaagttgt

SEQ ID NO: 8314519 - DNA, 22 bp, Homo sapiens
taaattcccaactctgctcttc

SEQ ID NO: 8314520 - DNA, 22 bp, Homo sapiens
taaattctacaacttcaaagat

SEQ ID NO: 8314521 - DNA, 22 bp, Homo sapiens
taaattctgatcaagttccttc

SEQ ID NO: 8314522 - DNA, 22 bp, Homo sapiens
taaccatattttccattaagtt

SEQ ID NO: 8314523 - DNA, 22 bp, Homo sapiens
taaaggtatgtcttaatcaaac

SEQ ID NO: 8314524 - DNA, 22 bp, Homo sapiens
taaaggtagttttaaaggtgct

SEQ ID NO: 8314525 - DNA, 22 bp, Homo sapiens
taaaggtagtgtgacatattgt

SEQ ID NO: 8314526 - DNA, 22 bp, Homo sapiens
taaaggtagcatgaaactgcaa

SEQ ID NO: 8314527 - DNA, 22 bp, Homo sapiens
taaaggtaacatgaactgcttt

SEQ ID NO: 8314528 - DNA, 22 bp, Homo sapiens
taaaggtacgaagtgagggatt

SEQ ID NO: 8314529 - DNA, 22 bp, Homo sapiens
taaaagttttagttgtacataa

SEQ ID NO: 8314530 - DNA, 19 bp, Homo sapiens
taaaatgtctgtggtcagt

SEQ ID NO: 8314531 - DNA, 22 bp, Homo sapiens
taaaatgtagcttctaggctgg

SEQ ID NO: 8314532 - DNA, 22 bp, Homo sapiens
gtttttatctaatagcagttat

SEQ ID NO: 8314533 - DNA, 22 bp, Homo sapiens
gttttgttttgagtcaactcca

SEQ ID NO: 8314534 - DNA, 22 bp, Homo sapiens
taaacagaaagcagatgtactt

SEQ ID NO: 8314535 - DNA, 22 bp, Homo sapiens
taaaatgtttgcaagagaccag

SEQ ID NO: 8314536 - DNA, 22 bp, Homo sapiens
taaaatgtgtttctgtatggtt

SEQ ID NO: 8314537 - DNA, 22 bp, Homo sapiens
gttttctttgaatgcttctaga

SEQ ID NO: 8314538 - DNA, 22 bp, Homo sapiens
gttttctttgaatgcttctaga

SEQ ID NO: 8314539 - DNA, 22 bp, Homo sapiens
gttttgttgctgcagagctcaa

SEQ ID NO: 8314540 - DNA, 22 bp, Homo sapiens
gttttgttgctgcagagctcaa

SEQ ID NO: 8314541 - DNA, 22 bp, Homo sapiens
gtttccatggctctgttaatgg

SEQ ID NO: 8314542 - DNA, 22 bp, Homo sapiens
tcacttttgatccctatgcagt

SEQ ID NO: 8314543 - DNA, 22 bp, Homo sapiens
tcagacagtttgcagtgtgcct

SEQ ID NO: 8314544 - DNA, 22 bp, Homo sapiens
tcagaccatcctgctgttagtg

SEQ ID NO: 8314545 - DNA, 22 bp, Homo sapiens
tcagcaatgtgatactgtgcaa

SEQ ID NO: 8314546 - DNA, 22 bp, Homo sapiens
tcagcaatatgataggctttgt

SEQ ID NO: 8314547 - DNA, 22 bp, Homo sapiens
tcagcaatcctcccacaggtgg

SEQ ID NO: 8314548 - DNA, 22 bp, Homo sapiens
tcagcaatgagaactggcattt

SEQ ID NO: 8314549 - DNA, 22 bp, Homo sapiens
tcagaggaaaggtcagatggct

SEQ ID NO: 8314550 - DNA, 22 bp, Homo sapiens
tcagagctaaggggagagcaaa

SEQ ID NO: 8314551 - DNA, 22 bp, Homo sapiens
tcagagcccctccgctgtccca

SEQ ID NO: 8314552 - DNA, 22 bp, Homo sapiens
tcagagctgcccatgcaagggg

SEQ ID NO: 8314553 - DNA, 22 bp, Homo sapiens
tcagagctttggagaccaggaa

SEQ ID NO: 8314554 - DNA, 22 bp, Homo sapiens
tcagagcttatctcttgctgga

SEQ ID NO: 8314555 - DNA, 22 bp, Homo sapiens
tcagagccaatcatggtgcatt

SEQ ID NO: 8314556 - DNA, 22 bp, Homo sapiens
tcaccactgaacagacctttgg

SEQ ID NO: 8314557 - DNA, 22 bp, Homo sapiens
tcacattttccttggtatctgt

SEQ ID NO: 8314558 - DNA, 22 bp, Homo sapiens
tcacattttcatattctctgag

SEQ ID NO: 8314559 - DNA, 22 bp, Homo sapiens
tcacattttctactactgtacg

SEQ ID NO: 8314560 - DNA, 22 bp, Homo sapiens
tcactgaatacttgtctcatcc

SEQ ID NO: 8314561 - DNA, 22 bp, Homo sapiens
tcactgaagactgggctctaaa

SEQ ID NO: 8314562 - DNA, 22 bp, Homo sapiens
tcactctgtggcccaggcagtg

SEQ ID NO: 8314563 - DNA, 22 bp, Homo sapiens
tcactctgggccagcgcaggta

SEQ ID NO: 8314564 - DNA, 22 bp, Homo sapiens
tcacttgcctagcccagttcag

SEQ ID NO: 8314565 - DNA, 22 bp, Homo sapiens
tcaaggtgctgtgctgtgctag

SEQ ID NO: 8314566 - DNA, 22 bp, Homo sapiens
tcaagtatatctagtcattagg

SEQ ID NO: 8314567 - DNA, 22 bp, Homo sapiens
tcaaggaggtgcttggcttcac

SEQ ID NO: 8314568 - DNA, 19 bp, Homo sapiens
tcaaggctccctgagggat

SEQ ID NO: 8314569 - DNA, 22 bp, Homo sapiens
tcaaggctaaactttcagagta

SEQ ID NO: 8314570 - DNA, 22 bp, Homo sapiens
tcaagtgtagtggtgtcaggtc

SEQ ID NO: 8314571 - DNA, 22 bp, Homo sapiens
tcaagaatttggataagaaatg

SEQ ID NO: 8314572 - DNA, 22 bp, Homo sapiens
tatttcttgagtggtcagtttc

SEQ ID NO: 8314573 - DNA, 22 bp, Homo sapiens
tatttctgtcagccagatatgg

SEQ ID NO: 8314574 - DNA, 22 bp, Homo sapiens
tatttctgtatgcataaaagga

SEQ ID NO: 8314575 - DNA, 22 bp, Homo sapiens
tatttctgtaactcagggtctg

SEQ ID NO: 8314576 - DNA, 22 bp, Homo sapiens
tatttctgaggcccaggaagtg

SEQ ID NO: 8314577 - DNA, 22 bp, Homo sapiens
tatttctgattgctcatgaggc

SEQ ID NO: 8314578 - DNA, 22 bp, Homo sapiens
tatttctggctttgagggtgat

SEQ ID NO: 8314579 - DNA, 22 bp, Homo sapiens
tatttctgggagttcagaaatt

SEQ ID NO: 8314580 - DNA, 20 bp, Homo sapiens
tatttctgggcaaccattta

SEQ ID NO: 8314581 - DNA, 20 bp, Homo sapiens
tatttctgggcaaccattta

SEQ ID NO: 8314582 - DNA, 22 bp, Homo sapiens
tcaagagattgaataataactg

SEQ ID NO: 8314583 - DNA, 22 bp, Homo sapiens
tcaagagagtgctgcttggggt

SEQ ID NO: 8314584 - DNA, 22 bp, Homo sapiens
tcaagagaaggggaaatagact

SEQ ID NO: 8314585 - DNA, 18 bp, Homo sapiens
tcaagacatcatgaaata

SEQ ID NO: 8314586 - DNA, 22 bp, Homo sapiens
tcaagagaagtgctccacagta

SEQ ID NO: 8314587 - DNA, 22 bp, Homo sapiens
tcaagagacaggacgtgtttca

SEQ ID NO: 8314588 - DNA, 22 bp, Homo sapiens
tcaagataccaccattatatgt

SEQ ID NO: 8314589 - DNA, 22 bp, Homo sapiens
tcacagaaataagatagttatt

SEQ ID NO: 8314590 - DNA, 22 bp, Homo sapiens
tcacaggctccagggcctggat

SEQ ID NO: 8314591 - DNA, 23 bp, Homo sapiens
tcacagggcactggctggggttg

SEQ ID NO: 8314592 - DNA, 22 bp, Homo sapiens
tcacagggatggaatagaaata

SEQ ID NO: 8314593 - DNA, 23 bp, Homo sapiens
tcacaggggccagcgctctgtgg

SEQ ID NO: 8314594 - DNA, 20 bp, Homo sapiens
tcacaggggaccaggagcag

SEQ ID NO: 8314595 - DNA, 22 bp, Homo sapiens
tcacagggcattatggctccag

SEQ ID NO: 8314596 - DNA, 22 bp, Homo sapiens
tcacagggtgtacatcacctat

SEQ ID NO: 8314597 - DNA, 22 bp, Homo sapiens
tcacagggtatctgggatggat

SEQ ID NO: 8314598 - DNA, 22 bp, Homo sapiens
tcacagggtttggaagcctcct

SEQ ID NO: 8314599 - DNA, 19 bp, Homo sapiens
tcacaggcatctccccaga

SEQ ID NO: 8314600 - DNA, 22 bp, Homo sapiens
tcattgaacgaagagctccatt

SEQ ID NO: 8314601 - DNA, 19 bp, Homo sapiens
tcattcaggaccagtggat

SEQ ID NO: 8314602 - DNA, 22 bp, Homo sapiens
tcattcaggttgggcaagtgtc

SEQ ID NO: 8314603 - DNA, 22 bp, Homo sapiens
tcattacagagatataatctac

SEQ ID NO: 8314604 - DNA, 22 bp, Homo sapiens
tcatggagactttgagcctgtt

SEQ ID NO: 8314605 - DNA, 22 bp, Homo sapiens
tcatggcacttagcacagtcct

SEQ ID NO: 8314606 - DNA, 22 bp, Homo sapiens
tcatgccacttacaaaataatg

SEQ ID NO: 8314607 - DNA, 23 bp, Homo sapiens
tcatgcccaggctccagatgtca

SEQ ID NO: 8314608 - DNA, 22 bp, Homo sapiens
tcatgcccagagcagtaaatta

SEQ ID NO: 8314609 - DNA, 17 bp, Homo sapiens
tcatgcccaactattac

SEQ ID NO: 8314610 - DNA, 23 bp, Homo sapiens
tcagtgatgttgaacctagcagt

SEQ ID NO: 8314611 - DNA, 20 bp, Homo sapiens
tcagtgattatctctgagtg

SEQ ID NO: 8314612 - DNA, 22 bp, Homo sapiens
tcagtgcagaatagtgatgcat

SEQ ID NO: 8314613 - DNA, 22 bp, Homo sapiens
tcagtgtccggagcctgagtgc

SEQ ID NO: 8314614 - DNA, 22 bp, Homo sapiens
tcagtgtagcagacttgtagcc

SEQ ID NO: 8314615 - DNA, 22 bp, Homo sapiens
tcagtgtaagttatgtagatgt

SEQ ID NO: 8314616 - DNA, 22 bp, Homo sapiens
tcagggacatttagacactgat

SEQ ID NO: 8314617 - DNA, 22 bp, Homo sapiens
tcaggtgttagaagaaatttca

SEQ ID NO: 8314618 - DNA, 18 bp, Homo sapiens
tcagcctgttgtctgcct

SEQ ID NO: 8314619 - DNA, 22 bp, Homo sapiens
tcagcctggtgattcctctgtc

SEQ ID NO: 8314620 - DNA, 22 bp, Homo sapiens
tcagcctggcaggatggcctgg

SEQ ID NO: 8314621 - DNA, 22 bp, Homo sapiens
tcagctcctcatgcaggggata

SEQ ID NO: 8314622 - DNA, 22 bp, Homo sapiens
tcagctcctcatgcaggggata

SEQ ID NO: 8314623 - DNA, 21 bp, Homo sapiens
tcagcagcttttgcagtccct

SEQ ID NO: 8314624 - DNA, 22 bp, Homo sapiens
tcagcctgctccaagtgctgcc

SEQ ID NO: 8314625 - DNA, 22 bp, Homo sapiens
tcaggagtcctgcctgcagcct

SEQ ID NO: 8314626 - DNA, 22 bp, Homo sapiens
tcaggagtctgtgcagttccac

SEQ ID NO: 8314627 - DNA, 20 bp, Homo sapiens
tcaggcagtggggaaaggca

SEQ ID NO: 8314628 - DNA, 22 bp, Homo sapiens
tcaggccacggctcactgagac

SEQ ID NO: 8314629 - DNA, 22 bp, Homo sapiens
tcaggccacttcacaggtgatt

SEQ ID NO: 8314630 - DNA, 22 bp, Homo sapiens
tcaggatccatagactcccaaa

SEQ ID NO: 8314631 - DNA, 22 bp, Homo sapiens
tcaggatcaggggcctttcctt

SEQ ID NO: 8314632 - DNA, 17 bp, Homo sapiens
tcaggatccagggttct

SEQ ID NO: 8314633 - DNA, 22 bp, Homo sapiens
tcaggatcggcctttttttaag

SEQ ID NO: 8314634 - DNA, 22 bp, Homo sapiens
tcaggctggaatgcagtggggc

SEQ ID NO: 8314635 - DNA, 22 bp, Homo sapiens
tccagaggctccaaagggagat

SEQ ID NO: 8314636 - DNA, 22 bp, Homo sapiens
tccagagggcgatggctggggg

SEQ ID NO: 8314637 - DNA, 23 bp, Homo sapiens
tccagcagccaagaagggtagaa

SEQ ID NO: 8314638 - DNA, 22 bp, Homo sapiens
tccagcagaccatcaaggctca

SEQ ID NO: 8314639 - DNA, 23 bp, Homo sapiens
tccagcagagccttccaggaggg

SEQ ID NO: 8314640 - DNA, 22 bp, Homo sapiens
tccagcagcccgaaggcccatc

SEQ ID NO: 8314641 - DNA, 22 bp, Homo sapiens
tccagcagggaattagtagtct

SEQ ID NO: 8314642 - DNA, 22 bp, Homo sapiens
tccagcaggtccgagacaagtt

SEQ ID NO: 8314643 - DNA, 22 bp, Homo sapiens
tccagagcctatatgttcaact

SEQ ID NO: 8314644 - DNA, 18 bp, Homo sapiens
tccagagctactgtggtg

SEQ ID NO: 8314645 - DNA, 22 bp, Homo sapiens
tccagagcaggtggtcagaagg

SEQ ID NO: 8314646 - DNA, 17 bp, Homo sapiens
tccagagcacagagctc

SEQ ID NO: 8314647 - DNA, 22 bp, Homo sapiens
tcattgcagttgagttgtgtta

SEQ ID NO: 8314648 - DNA, 22 bp, Homo sapiens
tcattgcatttattcactggca

SEQ ID NO: 8314649 - DNA, 22 bp, Homo sapiens
tcattgcagactaacaatctca

SEQ ID NO: 8314650 - DNA, 22 bp, Homo sapiens
tcattgcagtgatgttgtatgt

SEQ ID NO: 8314651 - DNA, 22 bp, Homo sapiens
tcattgcagtagggagagaccc

SEQ ID NO: 8314652 - DNA, 22 bp, Homo sapiens
tcattgcaggcattcccctgcc

SEQ ID NO: 8314653 - DNA, 22 bp, Homo sapiens
tcattgcagcttcaggtgttca

SEQ ID NO: 8314654 - DNA, 22 bp, Homo sapiens
tcattgcagaaataaaggtgaa

SEQ ID NO: 8314655 - DNA, 22 bp, Homo sapiens
tcattgcaccccagtcccagct

SEQ ID NO: 8314656 - DNA, 22 bp, Homo sapiens
tcattgcactccagcctgggca

SEQ ID NO: 8314657 - DNA, 20 bp, Homo sapiens
tcattgcacataatggaagc

SEQ ID NO: 8314658 - DNA, 22 bp, Homo sapiens
tcattgcaagctcatttatctg

SEQ ID NO: 8314659 - DNA, 22 bp, Homo sapiens
tcattgaatttcacagctttat

SEQ ID NO: 8314660 - DNA, 22 bp, Homo sapiens
tccagccaactgcctagggagc

SEQ ID NO: 8314661 - DNA, 22 bp, Homo sapiens
tccagccaagggaggttactag

SEQ ID NO: 8314662 - DNA, 22 bp, Homo sapiens
tccagccaagccttggtagctg

SEQ ID NO: 8314663 - DNA, 22 bp, Homo sapiens
tccagcctttctactcactgag

SEQ ID NO: 8314664 - DNA, 22 bp, Homo sapiens
tccagcaggttggtcaggtgca

SEQ ID NO: 8314665 - DNA, 18 bp, Homo sapiens
tccagcgtgctccagggc

SEQ ID NO: 8314666 - DNA, 20 bp, Homo sapiens
tccagctgtctttcagagac

SEQ ID NO: 8314667 - DNA, 22 bp, Homo sapiens
tccagctctaacatgctgggcc

SEQ ID NO: 8314668 - DNA, 21 bp, Homo sapiens
tccaggagtggctgggcaggg

SEQ ID NO: 8314669 - DNA, 22 bp, Homo sapiens
tccaggagggttttctgccttc

SEQ ID NO: 8314670 - DNA, 22 bp, Homo sapiens
tccaggaggtttggaggaagca

SEQ ID NO: 8314671 - DNA, 22 bp, Homo sapiens
tccaggctaggtttacaggaca

SEQ ID NO: 8314672 - DNA, 22 bp, Homo sapiens
tccagggccaagtcatggaacc

SEQ ID NO: 8314673 - DNA, 22 bp, Homo sapiens
tccatcagattccctcctgaga

SEQ ID NO: 8314674 - DNA, 20 bp, Homo sapiens
tccagggctagggagctcat

SEQ ID NO: 8314675 - DNA, 22 bp, Homo sapiens
tcccaaggcacagggcagggac

SEQ ID NO: 8314676 - DNA, 22 bp, Homo sapiens
tcccaagtgtcttggaccaggg

SEQ ID NO: 8314677 - DNA, 22 bp, Homo sapiens
tcccacacagcccgctcaccgg

SEQ ID NO: 8314678 - DNA, 22 bp, Homo sapiens
tcccagggtgcgcctgccctcg

SEQ ID NO: 8314679 - DNA, 22 bp, Homo sapiens
tcccagggactgggctaggctt

SEQ ID NO: 8314680 - DNA, 22 bp, Homo sapiens
tcccagtgtggcaggccatgga

SEQ ID NO: 8314681 - DNA, 22 bp, Homo sapiens
tccccaagcaggcaatctcccg

SEQ ID NO: 8314682 - DNA, 22 bp, Homo sapiens
tccccaagcaggcaatctcccg

SEQ ID NO: 8314683 - DNA, 22 bp, Homo sapiens
tccccaatttgagtcacctctg

SEQ ID NO: 8314684 - DNA, 22 bp, Homo sapiens
tccccacctacacactgctcct

SEQ ID NO: 8314685 - DNA, 22 bp, Homo sapiens
tttttcatgagactagaagtca

SEQ ID NO: 8314686 - DNA, 22 bp, Homo sapiens
tttttcctaagcagtggagctg

SEQ ID NO: 8314687 - DNA, 22 bp, Homo sapiens
tttttccaccgtacttcctgag

SEQ ID NO: 8314688 - DNA, 22 bp, Homo sapiens
tttttcattgcagcctctctcc

SEQ ID NO: 8314689 - DNA, 22 bp, Homo sapiens
tttttccttaggggttactcac

SEQ ID NO: 8314690 - DNA, 20 bp, Homo sapiens
tttttccttctctacaggca

SEQ ID NO: 8314691 - DNA, 22 bp, Homo sapiens
tttttcctagcgatttgtcagc

SEQ ID NO: 8314692 - DNA, 22 bp, Homo sapiens
tttttcctagcgatttgtcagc

SEQ ID NO: 8314693 - DNA, 22 bp, Homo sapiens
tttttcctagcgatttgtcagc

SEQ ID NO: 8314694 - DNA, 22 bp, Homo sapiens
tttttcctagtgctttctggta

SEQ ID NO: 8314695 - DNA, 22 bp, Homo sapiens
ttttgaaagccaggtttgtatg

SEQ ID NO: 8314696 - DNA, 22 bp, Homo sapiens
ttttgaaagagtcctgctacag

SEQ ID NO: 8314697 - DNA, 22 bp, Homo sapiens
ttttgaaagggtgatttggctt

SEQ ID NO: 8314698 - DNA, 22 bp, Homo sapiens
ttttctaacatctagtaatttg

SEQ ID NO: 8314699 - DNA, 22 bp, Homo sapiens
ttttctagggtgctaaatgaac

SEQ ID NO: 8314700 - DNA, 22 bp, Homo sapiens
ttttttgtcttgaagaaatggt

SEQ ID NO: 8314701 - DNA, 22 bp, Homo sapiens
ttttttgtcccagagagcctgg

SEQ ID NO: 8314702 - DNA, 22 bp, Homo sapiens
tttttgcaccaacctaatagaa

SEQ ID NO: 8314703 - DNA, 22 bp, Homo sapiens
tttttgctaatccccagccact

SEQ ID NO: 8314704 - DNA, 22 bp, Homo sapiens
tttttgaaggctgatgtgatta

SEQ ID NO: 8314705 - DNA, 22 bp, Homo sapiens
tttttccttggatgtgtctctc

SEQ ID NO: 8314706 - DNA, 22 bp, Homo sapiens
tttgttcagagatgttcaagct

SEQ ID NO: 8314707 - DNA, 22 bp, Homo sapiens
tttgtcagtcatgtctgctttt

SEQ ID NO: 8314708 - DNA, 22 bp, Homo sapiens
tttgttttcaatgtgtcattca

SEQ ID NO: 8314709 - DNA, 22 bp, Homo sapiens
tttgttttcaatgtgtcattca

SEQ ID NO: 8314710 - DNA, 22 bp, Homo sapiens
ttttatcaatcattaagacatt

SEQ ID NO: 8314711 - DNA, 22 bp, Homo sapiens
tttgcaaataccatgaaacttg

SEQ ID NO: 8314712 - DNA, 23 bp, Homo sapiens
tttgcaaattggacacaaccaca

SEQ ID NO: 8314713 - DNA, 22 bp, Homo sapiens
tttgcaatttgtgctgcaaatg

SEQ ID NO: 8314714 - DNA, 22 bp, Homo sapiens
tttgcagcaaggagagagcatt

SEQ ID NO: 8314715 - DNA, 19 bp, Homo sapiens
tttggcactctgaagtgtt

SEQ ID NO: 8314716 - DNA, 22 bp, Homo sapiens
tttctcatctggaaacagtgct

SEQ ID NO: 8314717 - DNA, 22 bp, Homo sapiens
tttctcctcatgactggttgtg

SEQ ID NO: 8314718 - DNA, 22 bp, Homo sapiens
tttcctgcctggacctctgctt

SEQ ID NO: 8314719 - DNA, 22 bp, Homo sapiens
tttcctctttgtaccttgacta

SEQ ID NO: 8314720 - DNA, 22 bp, Homo sapiens
tttcctctttgtgacacagctg

SEQ ID NO: 8314721 - DNA, 22 bp, Homo sapiens
tttccttcatcatctgagagct

SEQ ID NO: 8314722 - DNA, 22 bp, Homo sapiens
tttccttccaaatgcccgggag

SEQ ID NO: 8314723 - DNA, 22 bp, Homo sapiens
tttccttccaggttcctaaggc

SEQ ID NO: 8314724 - DNA, 22 bp, Homo sapiens
tttccttccttgctagcctgag

SEQ ID NO: 8314725 - DNA, 22 bp, Homo sapiens
tttcagatggaggtttaggaca

SEQ ID NO: 8314726 - DNA, 22 bp, Homo sapiens
tttcagatcattttttaagtac

SEQ ID NO: 8314727 - DNA, 22 bp, Homo sapiens
tttcagatgcaattaattttca

SEQ ID NO: 8314728 - DNA, 22 bp, Homo sapiens
tttcagatgcaattaattttca

SEQ ID NO: 8314729 - DNA, 22 bp, Homo sapiens
tttcagtgcttctgtttaccgg

SEQ ID NO: 8314730 - DNA, 22 bp, Homo sapiens
tttcctcttctggcaggcaggg

SEQ ID NO: 8314731 - DNA, 22 bp, Homo sapiens
tttcctcttccgagggggaggc

SEQ ID NO: 8314732 - DNA, 22 bp, Homo sapiens
tttcctcttcgattaagtttgg

SEQ ID NO: 8314733 - DNA, 22 bp, Homo sapiens
tttcctcttcttcccatgtcat

SEQ ID NO: 8314734 - DNA, 22 bp, Homo sapiens
tttcctcttatacagtgtttat

SEQ ID NO: 8314735 - DNA, 22 bp, Homo sapiens
tttcctctgtcatgacagctga

SEQ ID NO: 8314736 - DNA, 22 bp, Homo sapiens
tttcctctgctgccattgcccc

SEQ ID NO: 8314737 - DNA, 22 bp, Homo sapiens
tttcctctgggccctgccaccc

SEQ ID NO: 8314738 - DNA, 22 bp, Homo sapiens
tttctgtaattaaaagggcagg

SEQ ID NO: 8314739 - DNA, 22 bp, Homo sapiens
tttctgtagggatttcacagtt

SEQ ID NO: 8314740 - DNA, 22 bp, Homo sapiens
tttctggcagcgggacaggggt

SEQ ID NO: 8314741 - DNA, 22 bp, Homo sapiens
tttctgcttaggactctgtgga

SEQ ID NO: 8314742 - DNA, 22 bp, Homo sapiens
tttctgctgtgctttcttgcgt

SEQ ID NO: 8314743 - DNA, 22 bp, Homo sapiens
tttctgcttccttgagaaggag

SEQ ID NO: 8314744 - DNA, 22 bp, Homo sapiens
tttctgcttctcagaccctgaa

SEQ ID NO: 8314745 - DNA, 22 bp, Homo sapiens
tttctgctaatcttttactgag

SEQ ID NO: 8314746 - DNA, 22 bp, Homo sapiens
tttctctaaatagggaggctta

SEQ ID NO: 8314747 - DNA, 22 bp, Homo sapiens
tttctcttaatgtctctgtgct

SEQ ID NO: 8314748 - DNA, 17 bp, Homo sapiens
tttctccttccatctca

SEQ ID NO: 8314749 - DNA, 22 bp, Homo sapiens
tttctcctgtgtaagccgccca

SEQ ID NO: 8314750 - DNA, 22 bp, Homo sapiens
tttctcctgagttccacgctac

SEQ ID NO: 8314751 - DNA, 22 bp, Homo sapiens
tttctcttcactgtgtgcctca

SEQ ID NO: 8314752 - DNA, 22 bp, Homo sapiens
tttctgtatttaaaagatctgg

SEQ ID NO: 8314753 - DNA, 22 bp, Homo sapiens
tttctgtctgacatccctgcct

SEQ ID NO: 8314754 - DNA, 23 bp, Homo sapiens
tttctgttgggtatatatccaag

SEQ ID NO: 8314755 - DNA, 22 bp, Homo sapiens
tttctgttaggcatcattttaa

SEQ ID NO: 8314756 - DNA, 22 bp, Homo sapiens
tttcttctgagatcagggagaa

SEQ ID NO: 8314757 - DNA, 22 bp, Homo sapiens
tttcttctctaatctcaatgat

SEQ ID NO: 8314758 - DNA, 22 bp, Homo sapiens
tttcttctcacccaggacagag

SEQ ID NO: 8314759 - DNA, 22 bp, Homo sapiens
tttcttccttaccttactagag

SEQ ID NO: 8314760 - DNA, 22 bp, Homo sapiens
tttcttccttaccttactagag

SEQ ID NO: 8314761 - DNA, 22 bp, Homo sapiens
tttatttgtcttgccatttagt

SEQ ID NO: 8314762 - DNA, 22 bp, Homo sapiens
tttattatagtggtggggactg

SEQ ID NO: 8314763 - DNA, 22 bp, Homo sapiens
tttattattctctggagaatgt

SEQ ID NO: 8314764 - DNA, 22 bp, Homo sapiens
tttattatgtacaggcactata

SEQ ID NO: 8314765 - DNA, 22 bp, Homo sapiens
tttattatgatggacaccttcg

SEQ ID NO: 8314766 - DNA, 22 bp, Homo sapiens
ttgtttttatgaacatccagga

SEQ ID NO: 8314767 - DNA, 22 bp, Homo sapiens
ttgtttttgtgaggcagcccat

SEQ ID NO: 8314768 - DNA, 22 bp, Homo sapiens
ttgtttttatgaacatccagga

SEQ ID NO: 8314769 - DNA, 23 bp, Homo sapiens
ttgtttttagaggtggcatgaga

SEQ ID NO: 8314770 - DNA, 22 bp, Homo sapiens
ttgtttttagagaagccctgaa

SEQ ID NO: 8314771 - DNA, 23 bp, Homo sapiens
ttgtttttagaggtggcatgaga

SEQ ID NO: 8314772 - DNA, 22 bp, Homo sapiens
tttagaaattgcagagtgggtg

SEQ ID NO: 8314773 - DNA, 22 bp, Homo sapiens
tttagaaattcatctatggcct

SEQ ID NO: 8314774 - DNA, 22 bp, Homo sapiens
tttactttgtgtcaagtcaaga

SEQ ID NO: 8314775 - DNA, 22 bp, Homo sapiens
tttacaactttctgttctgtat

SEQ ID NO: 8314776 - DNA, 22 bp, Homo sapiens
ttgtccttggatgaagctggga

SEQ ID NO: 8314777 - DNA, 22 bp, Homo sapiens
ttgtccttacctcaatctggaa

SEQ ID NO: 8314778 - DNA, 22 bp, Homo sapiens
ttgtctgaaagatcattacatt

SEQ ID NO: 8314779 - DNA, 22 bp, Homo sapiens
ttgtgaaatgtttcaaaatagt

SEQ ID NO: 8314780 - DNA, 22 bp, Homo sapiens
ttgtctgtaaagacggccacca

SEQ ID NO: 8314781 - DNA, 19 bp, Homo sapiens
ttggtggtggttttggttc

SEQ ID NO: 8314782 - DNA, 22 bp, Homo sapiens
ttggggtgttggatggagcaag

SEQ ID NO: 8314783 - DNA, 22 bp, Homo sapiens
ttgtttgtatgctgagaagaat

SEQ ID NO: 8314784 - DNA, 20 bp, Homo sapiens
ttgtttctgctattttctaa

SEQ ID NO: 8314785 - DNA, 22 bp, Homo sapiens
ttgtttctgagttttcatgtat

SEQ ID NO: 8314786 - DNA, 22 bp, Homo sapiens
ttgttttcacagctttgcccgg

SEQ ID NO: 8314787 - DNA, 22 bp, Homo sapiens
ttgttttctccactgcatctta

SEQ ID NO: 8314788 - DNA, 22 bp, Homo sapiens
ttgttttgctaaagggtcatca

SEQ ID NO: 8314789 - DNA, 22 bp, Homo sapiens
ttgttttggaagaacttactct

SEQ ID NO: 8314790 - DNA, 22 bp, Homo sapiens
ttgtttttaaacatgtgactga

SEQ ID NO: 8314791 - DNA, 22 bp, Homo sapiens
ttgttttggagatgagctaaaa

SEQ ID NO: 8314792 - DNA, 22 bp, Homo sapiens
ttgttacagcagtgatttcaga

SEQ ID NO: 8314793 - DNA, 22 bp, Homo sapiens
ttgttacagcagtgatttcaga

SEQ ID NO: 8314794 - DNA, 22 bp, Homo sapiens
ttgttacatcttatgtaagtgg

SEQ ID NO: 8314795 - DNA, 21 bp, Homo sapiens
ttctttccccagaggactaaa

SEQ ID NO: 8314796 - DNA, 22 bp, Homo sapiens
ttctttcccttccagcagctcc

SEQ ID NO: 8314797 - DNA, 22 bp, Homo sapiens
ttctttccccatggagttcgga

SEQ ID NO: 8314798 - DNA, 22 bp, Homo sapiens
ttctttcctcccagcctttgga

SEQ ID NO: 8314799 - DNA, 22 bp, Homo sapiens
ttgaagatggatcgccactctc

SEQ ID NO: 8314800 - DNA, 23 bp, Homo sapiens
ttctttcaagaagttcacagtgc

SEQ ID NO: 8314801 - DNA, 22 bp, Homo sapiens
ttctttcagaacacaagtgatt

SEQ ID NO: 8314802 - DNA, 20 bp, Homo sapiens
ttctttcatctacacgttgt

SEQ ID NO: 8314803 - DNA, 22 bp, Homo sapiens
ttctttccacagaggggatgat

SEQ ID NO: 8314804 - DNA, 22 bp, Homo sapiens
ttctttccaaccagatattggt

SEQ ID NO: 8314805 - DNA, 22 bp, Homo sapiens
ttctttcccagtagatgtgaaa

SEQ ID NO: 8314806 - DNA, 22 bp, Homo sapiens
ttctttcccagaagatatgttt

SEQ ID NO: 8314807 - DNA, 22 bp, Homo sapiens
ttgaaggacatcctatttctag

SEQ ID NO: 8314808 - DNA, 22 bp, Homo sapiens
ttgaagcattgtggcttgtatt

SEQ ID NO: 8314809 - DNA, 22 bp, Homo sapiens
ttgaagcatttctttgagcttc

SEQ ID NO: 8314810 - DNA, 22 bp, Homo sapiens
ttgaagcatttgctatagcatt

SEQ ID NO: 8314811 - DNA, 22 bp, Homo sapiens
ttgaagcatggtacttgttcaa

SEQ ID NO: 8314812 - DNA, 22 bp, Homo sapiens
ttgaagcaggaaaatttctatt

SEQ ID NO: 8314813 - DNA, 22 bp, Homo sapiens
ttgaagcagctcaggaggctta

SEQ ID NO: 8314814 - DNA, 21 bp, Homo sapiens
ttgaagcaagggtggctctga

SEQ ID NO: 8314815 - DNA, 22 bp, Homo sapiens
ttgaagcaaggcgaatcttgtg

SEQ ID NO: 8314816 - DNA, 22 bp, Homo sapiens
ttgaagcaaattctgtgcagta

SEQ ID NO: 8314817 - DNA, 22 bp, Homo sapiens
ttgaagcacaatgtcttttatc

SEQ ID NO: 8314818 - DNA, 22 bp, Homo sapiens
ttgaagcagagaaatacttgaa

SEQ ID NO: 8314819 - DNA, 22 bp, Homo sapiens
ttgaggagtgtttagggtgagg

SEQ ID NO: 8314820 - DNA, 22 bp, Homo sapiens
ttcttgatttcatgcagttaag

SEQ ID NO: 8314821 - DNA, 22 bp, Homo sapiens
ttctttaaaatagtgagaaaga

SEQ ID NO: 8314822 - DNA, 22 bp, Homo sapiens
ttcttacagccctattactaaa

SEQ ID NO: 8314823 - DNA, 22 bp, Homo sapiens
ttcttacagccctattactaaa

SEQ ID NO: 8314824 - DNA, 22 bp, Homo sapiens
ttcttcttgtctgccctcacat

SEQ ID NO: 8314825 - DNA, 22 bp, Homo sapiens
ttctgctgctgctgcacccaat

SEQ ID NO: 8314826 - DNA, 22 bp, Homo sapiens
ttctgctgtagttgcatctgtt

SEQ ID NO: 8314827 - DNA, 21 bp, Homo sapiens
ttctgctgtgccatgcctctg

SEQ ID NO: 8314828 - DNA, 21 bp, Homo sapiens
ttctgctgttcaccaccaccc

SEQ ID NO: 8314829 - DNA, 22 bp, Homo sapiens
ttctgcttagagggcatttgca

SEQ ID NO: 8314830 - DNA, 21 bp, Homo sapiens
ttctgctccagctcctctggg

SEQ ID NO: 8314831 - DNA, 19 bp, Homo sapiens
ttctgctgttcctaggctg

SEQ ID NO: 8314832 - DNA, 22 bp, Homo sapiens
ttctgcttggttcttggtatga

SEQ ID NO: 8314833 - DNA, 22 bp, Homo sapiens
ttctgctttcagttcttctggg

SEQ ID NO: 8314834 - DNA, 20 bp, Homo sapiens
ttctgcttttgcttagggac

SEQ ID NO: 8314835 - DNA, 22 bp, Homo sapiens
ttctagtgtccttggacttgct

SEQ ID NO: 8314836 - DNA, 22 bp, Homo sapiens
ttagataaattaagactttaca

SEQ ID NO: 8314837 - DNA, 22 bp, Homo sapiens
ttcaaaggcaggatagcagctg

SEQ ID NO: 8314838 - DNA, 22 bp, Homo sapiens
ttcaacacaggaacatgatata

SEQ ID NO: 8314839 - DNA, 22 bp, Homo sapiens
ttcacattatcaggattgtttc

SEQ ID NO: 8314840 - DNA, 22 bp, Homo sapiens
ttcacattataatcagttctgc

SEQ ID NO: 8314841 - DNA, 22 bp, Homo sapiens
ttcacattagtggttctatata

SEQ ID NO: 8314842 - DNA, 22 bp, Homo sapiens
ttcaggagctggctgcgaagga

SEQ ID NO: 8314843 - DNA, 22 bp, Homo sapiens
ttcagtcagtgactaagcagtt

SEQ ID NO: 8314844 - DNA, 22 bp, Homo sapiens
ttcatgtatttatcatgtaaat

SEQ ID NO: 8314845 - DNA, 22 bp, Homo sapiens
ttcatgtaattccataaggtaa

SEQ ID NO: 8314846 - DNA, 22 bp, Homo sapiens
ttccttctcagccctcgaggat

SEQ ID NO: 8314847 - DNA, 22 bp, Homo sapiens
ttccttctcagccctcgaggat

SEQ ID NO: 8314848 - DNA, 22 bp, Homo sapiens
ttcctgtattctaaagggaaag

SEQ ID NO: 8314849 - DNA, 22 bp, Homo sapiens
ttcctgtattttgcgaattttc

SEQ ID NO: 8314850 - DNA, 22 bp, Homo sapiens
ttcctgtccgcaatggcctggg

SEQ ID NO: 8314851 - DNA, 22 bp, Homo sapiens
ttcctgtatgtcagtgaagagc

SEQ ID NO: 8314852 - DNA, 20 bp, Homo sapiens
ttccagagatctgcatttta

SEQ ID NO: 8314853 - DNA, 22 bp, Homo sapiens
ttccagaattttgttctgcttg

SEQ ID NO: 8314854 - DNA, 22 bp, Homo sapiens
ttcctcatctgtgcacctcact

SEQ ID NO: 8314855 - DNA, 22 bp, Homo sapiens
ttcctcatggggttccttcaga

SEQ ID NO: 8314856 - DNA, 22 bp, Homo sapiens
ttcctccacgtgacaggagcca

SEQ ID NO: 8314857 - DNA, 22 bp, Homo sapiens
ttcctatttccatgaaacacaa

SEQ ID NO: 8314858 - DNA, 22 bp, Homo sapiens
ttcctcagaaaatactgtccaa

SEQ ID NO: 8314859 - DNA, 22 bp, Homo sapiens
ttcctcagagggcgctggggaa

SEQ ID NO: 8314860 - DNA, 17 bp, Homo sapiens
tgtggccttctgagctt

SEQ ID NO: 8314861 - DNA, 22 bp, Homo sapiens
tgtggcctccccacttctgggg

SEQ ID NO: 8314862 - DNA, 22 bp, Homo sapiens
tgtggcctcctgttcctgggta

SEQ ID NO: 8314863 - DNA, 22 bp, Homo sapiens
tgtggcctcaaggctgccctca

SEQ ID NO: 8314864 - DNA, 22 bp, Homo sapiens
tgtggcctggaaggggctgctc

SEQ ID NO: 8314865 - DNA, 22 bp, Homo sapiens
tgtggtctcgttatgttgccca

SEQ ID NO: 8314866 - DNA, 18 bp, Homo sapiens
tgtggtggagctgccttc

SEQ ID NO: 8314867 - DNA, 22 bp, Homo sapiens
tgtggtgagaaactggtagatt

SEQ ID NO: 8314868 - DNA, 19 bp, Homo sapiens
tgtgtaaagtctgtggtca

SEQ ID NO: 8314869 - DNA, 22 bp, Homo sapiens
tgtgtccttctgggagtcccag

SEQ ID NO: 8314870 - DNA, 22 bp, Homo sapiens
tgtgtccattcaggcactgacc

SEQ ID NO: 8314871 - DNA, 22 bp, Homo sapiens
tgtgtcccttggaacctcagct

SEQ ID NO: 8314872 - DNA, 22 bp, Homo sapiens
tgtgtgacccccagtgaagcct

SEQ ID NO: 8314873 - DNA, 22 bp, Homo sapiens
tgtggccagcaggtggctgtgt

SEQ ID NO: 8314874 - DNA, 22 bp, Homo sapiens
tgtggcccagatgagtgtgcta

SEQ ID NO: 8314875 - DNA, 19 bp, Homo sapiens
tgtggccatggttcagctg

SEQ ID NO: 8314876 - DNA, 22 bp, Homo sapiens
tgtggccaccagagctgctatt

SEQ ID NO: 8314877 - DNA, 22 bp, Homo sapiens
tcccccaggctggagtgcagtg

SEQ ID NO: 8314878 - DNA, 22 bp, Homo sapiens
tcccccactctaaaggagcctt

SEQ ID NO: 8314879 - DNA, 22 bp, Homo sapiens
tcccctccaactccaactatgg

SEQ ID NO: 8314880 - DNA, 22 bp, Homo sapiens
tgttcctaaatatgaatggaga

SEQ ID NO: 8314881 - DNA, 20 bp, Homo sapiens
tgttcacagtagttgctgct

SEQ ID NO: 8314882 - DNA, 21 bp, Homo sapiens
tgttcacatggagcagaatgt

SEQ ID NO: 8314883 - DNA, 22 bp, Homo sapiens
tgttcaatccccaggtcctgaa

SEQ ID NO: 8314884 - DNA, 22 bp, Homo sapiens
tgttatctgagcaacgtcgacg

SEQ ID NO: 8314885 - DNA, 22 bp, Homo sapiens
tgttattgaggttacttataag

SEQ ID NO: 8314886 - DNA, 22 bp, Homo sapiens
tgtgtgcagcctctgtctttgg

SEQ ID NO: 8314887 - DNA, 20 bp, Homo sapiens
tgtgtgcacacatgacattc

SEQ ID NO: 8314888 - DNA, 22 bp, Homo sapiens
tgtgttttgaactcatctactg

SEQ ID NO: 8314889 - DNA, 22 bp, Homo sapiens
tgtgttttacaaattctcttaa

SEQ ID NO: 8314890 - DNA, 20 bp, Homo sapiens
tgtttcttttaatgagcggc

SEQ ID NO: 8314891 - DNA, 22 bp, Homo sapiens
tgttctctaagccacccatttt

SEQ ID NO: 8314892 - DNA, 22 bp, Homo sapiens
tgtttaatctataaaatggaga

SEQ ID NO: 8314893 - DNA, 22 bp, Homo sapiens
tgtttttcaaatattgctctgt

SEQ ID NO: 8314894 - DNA, 19 bp, Homo sapiens
tgttttgttaaagcagtcc

SEQ ID NO: 8314895 - DNA, 22 bp, Homo sapiens
tgttttgtttatgagagcacag

SEQ ID NO: 8314896 - DNA, 22 bp, Homo sapiens
ttaataaacaggtgcagctgaa

SEQ ID NO: 8314897 - DNA, 22 bp, Homo sapiens
ttaataaacaggtgcagctgaa

SEQ ID NO: 8314898 - DNA, 22 bp, Homo sapiens
ttaatttatgtccaaaccagat

SEQ ID NO: 8314899 - DNA, 22 bp, Homo sapiens
ttaagtcacttatctaaagaca

SEQ ID NO: 8314900 - DNA, 22 bp, Homo sapiens
ttaagtccttggtaattttctt

SEQ ID NO: 8314901 - DNA, 22 bp, Homo sapiens
ttaagtcatttctgattataga

SEQ ID NO: 8314902 - DNA, 22 bp, Homo sapiens
ttaagaatggaatgaggaattt

SEQ ID NO: 8314903 - DNA, 22 bp, Homo sapiens
ttaacagatgtttatggagcat

SEQ ID NO: 8314904 - DNA, 22 bp, Homo sapiens
ttaacagacatatatatttgta

SEQ ID NO: 8314905 - DNA, 22 bp, Homo sapiens
ttaacagagtgcctggcatgta

SEQ ID NO: 8314906 - DNA, 22 bp, Homo sapiens
ttaacagagaacatagaagtag

SEQ ID NO: 8314907 - DNA, 22 bp, Homo sapiens
ttacaggggacattggggacat

SEQ ID NO: 8314908 - DNA, 23 bp, Homo sapiens
ttacagtaggagttggaaaacca

SEQ ID NO: 8314909 - DNA, 22 bp, Homo sapiens
ttacagtatgatcaacttttca

SEQ ID NO: 8314910 - DNA, 22 bp, Homo sapiens
ttacagtattgttaaactcttt

SEQ ID NO: 8314911 - DNA, 19 bp, Homo sapiens
ttacatctgcaacactggt

SEQ ID NO: 8314912 - DNA, 22 bp, Homo sapiens
ttacatctaaactgtgaacaat

SEQ ID NO: 8314913 - DNA, 22 bp, Homo sapiens
ttactttggatggtcaagaaag

SEQ ID NO: 8314914 - DNA, 22 bp, Homo sapiens
ttactttggatggtcaagaaag

SEQ ID NO: 8314915 - DNA, 22 bp, Homo sapiens
ttactttgttctcaagatatgt

SEQ ID NO: 8314916 - DNA, 22 bp, Homo sapiens
ttactttgatgatcaatgagcg

SEQ ID NO: 8314917 - DNA, 19 bp, Homo sapiens
ttagaaactgttgacactg

SEQ ID NO: 8314918 - DNA, 22 bp, Homo sapiens
ttagaaacccagactcttaggt

SEQ ID NO: 8314919 - DNA, 22 bp, Homo sapiens
ttagaaaatttgcttctttgga

SEQ ID NO: 8314920 - DNA, 22 bp, Homo sapiens
ttagagaaattctggtaatgta

SEQ ID NO: 8314921 - DNA, 22 bp, Homo sapiens
ttactgaaaattcttcaggatt

SEQ ID NO: 8314922 - DNA, 22 bp, Homo sapiens
gatttccctatagttttctctt

SEQ ID NO: 8314923 - DNA, 22 bp, Homo sapiens
gatttcccagaaaagtgatctc

SEQ ID NO: 8314924 - DNA, 22 bp, Homo sapiens
attactgaggcaaagtagtttt

SEQ ID NO: 8314925 - DNA, 22 bp, Homo sapiens
gatattcctgaaggacagggtt

SEQ ID NO: 8314926 - DNA, 22 bp, Homo sapiens
attactgagcttgtagctgcat

SEQ ID NO: 8314927 - DNA, 22 bp, Homo sapiens
attacatgagagaatgtaaata

SEQ ID NO: 8314928 - DNA, 22 bp, Homo sapiens
attcaacttataagatattaat

SEQ ID NO: 8314929 - DNA, 22 bp, Homo sapiens
attcaactatgtatagtcttct

SEQ ID NO: 8314930 - DNA, 22 bp, Homo sapiens
attcaaagtctagatgtagtgt

SEQ ID NO: 8314931 - DNA, 22 bp, Homo sapiens
gcacggctaatttttgtatttt

SEQ ID NO: 8314932 - DNA, 19 bp, Homo sapiens
attcacatccctgggaagg

SEQ ID NO: 8314933 - DNA, 18 bp, Homo sapiens
gcaccttaccaattctac

SEQ ID NO: 8314934 - DNA, 22 bp, Homo sapiens
attcacctgttagtaaaaatct

SEQ ID NO: 8314935 - DNA, 22 bp, Homo sapiens
attcacattttatttcactgga

SEQ ID NO: 8314936 - DNA, 22 bp, Homo sapiens
attcacatttacaaagcactca

SEQ ID NO: 8314937 - DNA, 22 bp, Homo sapiens
attcacatttagcctctgacat

SEQ ID NO: 8314938 - DNA, 22 bp, Homo sapiens
attcacattgagcttcactgtg

SEQ ID NO: 8314939 - DNA, 22 bp, Homo sapiens
attcacatgcccaagcagcacc

SEQ ID NO: 8314940 - DNA, 21 bp, Homo sapiens
gcagcagaggcttgacagaca

SEQ ID NO: 8314941 - DNA, 22 bp, Homo sapiens
gcagcagagtagacagagccct

SEQ ID NO: 8314942 - DNA, 22 bp, Homo sapiens
attgtatttgtacaagacatgt

SEQ ID NO: 8314943 - DNA, 22 bp, Homo sapiens
gcagtgtgaccgagcttgcttc

SEQ ID NO: 8314944 - DNA, 22 bp, Homo sapiens
gcagtgtgtctcttggcttcct

SEQ ID NO: 8314945 - DNA, 20 bp, Homo sapiens
gccaacgcgctggggctgcc

SEQ ID NO: 8314946 - DNA, 22 bp, Homo sapiens
gccaagcctgggaagagcccat

SEQ ID NO: 8314947 - DNA, 22 bp, Homo sapiens
attgtctttccactgagaagtt

SEQ ID NO: 8314948 - DNA, 22 bp, Homo sapiens
attgtcttctggtcttatcttt

SEQ ID NO: 8314949 - DNA, 22 bp, Homo sapiens
attgtcttctgtcttatagttc

SEQ ID NO: 8314950 - DNA, 22 bp, Homo sapiens
gcattctgtgctacagccattc

SEQ ID NO: 8314951 - DNA, 22 bp, Homo sapiens
attgactttcccttctcctcat

SEQ ID NO: 8314952 - DNA, 22 bp, Homo sapiens
gcagggctgcagagggcactgt

SEQ ID NO: 8314953 - DNA, 18 bp, Homo sapiens
gcagggctgcacacgcat

SEQ ID NO: 8314954 - DNA, 22 bp, Homo sapiens
attgatttagctcaagacacat

SEQ ID NO: 8314955 - DNA, 23 bp, Homo sapiens
attgattccctcttggaagggat

SEQ ID NO: 8314956 - DNA, 22 bp, Homo sapiens
attgattctaccagctactttg

SEQ ID NO: 8314957 - DNA, 22 bp, Homo sapiens
attgattctcataggaccatct

SEQ ID NO: 8314958 - DNA, 22 bp, Homo sapiens
attgattctgtaagtcaacaat

SEQ ID NO: 8314959 - DNA, 19 bp, Homo sapiens
attcttggtgcaccttgta

SEQ ID NO: 8314960 - DNA, 19 bp, Homo sapiens
attcttgttaagtgtcatc

SEQ ID NO: 8314961 - DNA, 22 bp, Homo sapiens
attctttaattcaattgaagga

SEQ ID NO: 8314962 - DNA, 22 bp, Homo sapiens
atttcccaacacattagaaaat

SEQ ID NO: 8314963 - DNA, 23 bp, Homo sapiens
gcccaccctcagcgtcctcacgg

SEQ ID NO: 8314964 - DNA, 17 bp, Homo sapiens
gcccacccttaggagct

SEQ ID NO: 8314965 - DNA, 22 bp, Homo sapiens
gcccacagttaatgggggctct

SEQ ID NO: 8314966 - DNA, 22 bp, Homo sapiens
gcccacagtgtagcaggtactc

SEQ ID NO: 8314967 - DNA, 21 bp, Homo sapiens
gcccacagtgaggaggatccc

SEQ ID NO: 8314968 - DNA, 22 bp, Homo sapiens
gcccacagtctatcagtttgcg

SEQ ID NO: 8314969 - DNA, 22 bp, Homo sapiens
gccccaggttgcctgtcccagg

SEQ ID NO: 8314970 - DNA, 22 bp, Homo sapiens
atttctgtgcagtaaatggtga

SEQ ID NO: 8314971 - DNA, 22 bp, Homo sapiens
atttctgtgcagtaaatggtga

SEQ ID NO: 8314972 - DNA, 22 bp, Homo sapiens
atttctgatacccggtcaccct

SEQ ID NO: 8314973 - DNA, 22 bp, Homo sapiens
atttctgataaacgtaagctgc

SEQ ID NO: 8314974 - DNA, 17 bp, Homo sapiens
gcccacccttaggagct

SEQ ID NO: 8314975 - DNA, 22 bp, Homo sapiens
gccaggctggaaagaacagaca

SEQ ID NO: 8314976 - DNA, 22 bp, Homo sapiens
gccaggctggccagcaccttct

SEQ ID NO: 8314977 - DNA, 22 bp, Homo sapiens
gccaggctggcaaaaggaaacc

SEQ ID NO: 8314978 - DNA, 22 bp, Homo sapiens
gccaggctggtcttgaactcct

SEQ ID NO: 8314979 - DNA, 22 bp, Homo sapiens
gccaggctggtcttgaactcct

SEQ ID NO: 8314980 - DNA, 22 bp, Homo sapiens
gccaggctggggggagatgtct

SEQ ID NO: 8314981 - DNA, 22 bp, Homo sapiens
gccaggctggccagcaccttct

SEQ ID NO: 8314982 - DNA, 22 bp, Homo sapiens
gccaggctggtgcaaggatatt

SEQ ID NO: 8314983 - DNA, 22 bp, Homo sapiens
atttggaagcatttccaaagca

SEQ ID NO: 8314984 - DNA, 22 bp, Homo sapiens
atttggaaggtttacaaagaga

SEQ ID NO: 8314985 - DNA, 22 bp, Homo sapiens
atttggaatagctgtagaaata

SEQ ID NO: 8314986 - DNA, 22 bp, Homo sapiens
gcctggagttgtggtgaagcca

SEQ ID NO: 8314987 - DNA, 22 bp, Homo sapiens
gcctggattccttgtttctcag

SEQ ID NO: 8314988 - DNA, 21 bp, Homo sapiens
gcctagggagatgggactgcc

SEQ ID NO: 8314989 - DNA, 22 bp, Homo sapiens
gcctcttgtttccttacatgga

SEQ ID NO: 8314990 - DNA, 22 bp, Homo sapiens
atttggaaaagtttcttcaact

SEQ ID NO: 8314991 - DNA, 22 bp, Homo sapiens
atttggaaaatctggttataga

SEQ ID NO: 8314992 - DNA, 22 bp, Homo sapiens
gcccccgtagtagatgaggcgc

SEQ ID NO: 8314993 - DNA, 22 bp, Homo sapiens
gcccccgtagtagatgaggcgc

SEQ ID NO: 8314994 - DNA, 22 bp, Homo sapiens
caaagtgctggaattacaggtg

SEQ ID NO: 8314995 - DNA, 22 bp, Homo sapiens
caaagtgctggaattacaggtg

SEQ ID NO: 8314996 - DNA, 22 bp, Homo sapiens
caaagtgctgggattacaggct

SEQ ID NO: 8314997 - DNA, 22 bp, Homo sapiens
caaatactgagtttattttcaa

SEQ ID NO: 8314998 - DNA, 21 bp, Homo sapiens
caaatgctggctggatgagga

SEQ ID NO: 8314999 - DNA, 22 bp, Homo sapiens
caaatgccaggaatctctgaag

SEQ ID NO: 8315000 - DNA, 22 bp, Homo sapiens
gctcttggccaagtggaagggt

SEQ ID NO: 8315001 - DNA, 22 bp, Homo sapiens
gctcttggtctcagcctctgaa

SEQ ID NO: 8315002 - DNA, 22 bp, Homo sapiens
gctcttggtctcagcctctgaa

SEQ ID NO: 8315003 - DNA, 20 bp, Homo sapiens
gctgaccataaatcacactg

SEQ ID NO: 8315004 - DNA, 22 bp, Homo sapiens
gctgacagttactgctgtaaca

SEQ ID NO: 8315005 - DNA, 22 bp, Homo sapiens
gctgacagttgtacctgcccct

SEQ ID NO: 8315006 - DNA, 22 bp, Homo sapiens
gctgacagcgtttccagtgatg

SEQ ID NO: 8315007 - DNA, 22 bp, Homo sapiens
gctgaaaaatagtgtcgtgttt

SEQ ID NO: 8315008 - DNA, 23 bp, Homo sapiens
gctctttgttcatgtggatgcct

SEQ ID NO: 8315009 - DNA, 22 bp, Homo sapiens
gctgacagagtgcctggcctca

SEQ ID NO: 8315010 - DNA, 22 bp, Homo sapiens
atttttccaattaggataaaga

SEQ ID NO: 8315011 - DNA, 22 bp, Homo sapiens
atttttccatgatacttatctg

SEQ ID NO: 8315012 - DNA, 22 bp, Homo sapiens
atttttcagcttcattgaggca

SEQ ID NO: 8315013 - DNA, 22 bp, Homo sapiens
atttttcaactttggaaatggc

SEQ ID NO: 8315014 - DNA, 22 bp, Homo sapiens
atttttcaactttggaaatggc

SEQ ID NO: 8315015 - DNA, 22 bp, Homo sapiens
atttttatgacaaaccatcctc

SEQ ID NO: 8315016 - DNA, 22 bp, Homo sapiens
attttagagaaacaaacgtagg

SEQ ID NO: 8315017 - DNA, 22 bp, Homo sapiens
atttttctctttccactgagat

SEQ ID NO: 8315018 - DNA, 22 bp, Homo sapiens
atttttctctcacacttaccag

SEQ ID NO: 8315019 - DNA, 22 bp, Homo sapiens
atttttcctgggtgctttagtt

SEQ ID NO: 8315020 - DNA, 23 bp, Homo sapiens
atttttcctggaacagtcaccca

SEQ ID NO: 8315021 - DNA, 22 bp, Homo sapiens
atttttcctgctggatctgctc

SEQ ID NO: 8315022 - DNA, 22 bp, Homo sapiens
atttttccattctctgttagta

SEQ ID NO: 8315023 - DNA, 18 bp, Homo sapiens
atttttcccagatggata

SEQ ID NO: 8315024 - DNA, 22 bp, Homo sapiens
atttttgtatccccagctcctg

SEQ ID NO: 8315025 - DNA, 22 bp, Homo sapiens
atttttgccctgcagtacataa

SEQ ID NO: 8315026 - DNA, 22 bp, Homo sapiens
atttttctctttccactgagat

SEQ ID NO: 8315027 - DNA, 22 bp, Homo sapiens
caaaatgatgtgattttattgt

SEQ ID NO: 8315028 - DNA, 22 bp, Homo sapiens
caaacatagtgaagcaatgaca

SEQ ID NO: 8315029 - DNA, 22 bp, Homo sapiens
caaaattagggagtgagctgga

SEQ ID NO: 8315030 - DNA, 22 bp, Homo sapiens
caaaattagggagtgagctgga

SEQ ID NO: 8315031 - DNA, 22 bp, Homo sapiens
caaaattctgcatttctaataa

SEQ ID NO: 8315032 - DNA, 22 bp, Homo sapiens
caaaattagaaatgcagctgtt

SEQ ID NO: 8315033 - DNA, 22 bp, Homo sapiens
caaaattagaaatgcagctgtt

SEQ ID NO: 8315034 - DNA, 22 bp, Homo sapiens
gagatggggaataggagcaagc

SEQ ID NO: 8315035 - DNA, 22 bp, Homo sapiens
atggcattccaagtcttctttt

SEQ ID NO: 8315036 - DNA, 20 bp, Homo sapiens
atggccaacctgcttatgac

SEQ ID NO: 8315037 - DNA, 22 bp, Homo sapiens
atggccaagaagtattcctgac

SEQ ID NO: 8315038 - DNA, 22 bp, Homo sapiens
atggccaagaaattgccgactg

SEQ ID NO: 8315039 - DNA, 22 bp, Homo sapiens
atggccaactgaaatgaaagat

SEQ ID NO: 8315040 - DNA, 22 bp, Homo sapiens
atggccaagcatatacagattg

SEQ ID NO: 8315041 - DNA, 22 bp, Homo sapiens
atggccaagatcacagacttca

SEQ ID NO: 8315042 - DNA, 22 bp, Homo sapiens
atggccaagagtcgatttgggg

SEQ ID NO: 8315043 - DNA, 22 bp, Homo sapiens
atggccaagaatatttctcaac

SEQ ID NO: 8315044 - DNA, 22 bp, Homo sapiens
atggccaaagccacagcagagg

SEQ ID NO: 8315045 - DNA, 22 bp, Homo sapiens
atggccaaataacagcttgcat

SEQ ID NO: 8315046 - DNA, 22 bp, Homo sapiens
atggccaaatctaaactgttgg

SEQ ID NO: 8315047 - DNA, 22 bp, Homo sapiens
atggcatttgaccgctttgtgg

SEQ ID NO: 8315048 - DNA, 22 bp, Homo sapiens
atggcatttgaatctgtctttt

SEQ ID NO: 8315049 - DNA, 22 bp, Homo sapiens
atggccagagagagcacacctg

SEQ ID NO: 8315050 - DNA, 22 bp, Homo sapiens
atggccaagcatgcctgtggcc

SEQ ID NO: 8315051 - DNA, 22 bp, Homo sapiens
atggccaagcttactctgttgt

SEQ ID NO: 8315052 - DNA, 22 bp, Homo sapiens
atggccaaggggcctaggcagg

SEQ ID NO: 8315053 - DNA, 22 bp, Homo sapiens
atggctggcatccaggtgggct

SEQ ID NO: 8315054 - DNA, 22 bp, Homo sapiens
gagagcacggtcttgggcatgg

SEQ ID NO: 8315055 - DNA, 22 bp, Homo sapiens
gagagaggcctccatgtactga

SEQ ID NO: 8315056 - DNA, 22 bp, Homo sapiens
gactggggctctagccaggcct

SEQ ID NO: 8315057 - DNA, 22 bp, Homo sapiens
gagagagacatgtaaacgcggt

SEQ ID NO: 8315058 - DNA, 22 bp, Homo sapiens
gagaggttgaacaacatactct

SEQ ID NO: 8315059 - DNA, 22 bp, Homo sapiens
atggagggtgtcagagagcgaa

SEQ ID NO: 8315060 - DNA, 22 bp, Homo sapiens
gagatgggcgagaaggtggact

SEQ ID NO: 8315061 - DNA, 18 bp, Homo sapiens
atggaggcagagagctga

SEQ ID NO: 8315062 - DNA, 22 bp, Homo sapiens
atggagggaaaagtggagagcc

SEQ ID NO: 8315063 - DNA, 21 bp, Homo sapiens
atggagggaccagggaagcag

SEQ ID NO: 8315064 - DNA, 21 bp, Homo sapiens
atggagggaccagggaagcag

SEQ ID NO: 8315065 - DNA, 22 bp, Homo sapiens
atggggaagagccagtgagctg

SEQ ID NO: 8315066 - DNA, 22 bp, Homo sapiens
atggggagagaagggctgagct

SEQ ID NO: 8315067 - DNA, 22 bp, Homo sapiens
atggggaagcaattggatttcc

SEQ ID NO: 8315068 - DNA, 22 bp, Homo sapiens
atggggagagcctctgtcccca

SEQ ID NO: 8315069 - DNA, 22 bp, Homo sapiens
atggggagagcctctgtcccca

SEQ ID NO: 8315070 - DNA, 22 bp, Homo sapiens
atggggagctcaccacctgttt

SEQ ID NO: 8315071 - DNA, 22 bp, Homo sapiens
atgggctgtcctagtccagccc

SEQ ID NO: 8315072 - DNA, 22 bp, Homo sapiens
atgggctgcttctccagcacct

SEQ ID NO: 8315073 - DNA, 22 bp, Homo sapiens
gaggagaagggcacggagaaaa

SEQ ID NO: 8315074 - DNA, 22 bp, Homo sapiens
gaggagaagctattggaaggac

SEQ ID NO: 8315075 - DNA, 22 bp, Homo sapiens
gaggagaagctaagaaacacag

SEQ ID NO: 8315076 - DNA, 22 bp, Homo sapiens
gaggagaaatttggggacctga

SEQ ID NO: 8315077 - DNA, 22 bp, Homo sapiens
gaggcagcattcgcatagacag

SEQ ID NO: 8315078 - DNA, 22 bp, Homo sapiens
gaggcagcctcagtggacctcg

SEQ ID NO: 8315079 - DNA, 22 bp, Homo sapiens
atgtagaaataatttcagttcc

SEQ ID NO: 8315080 - DNA, 22 bp, Homo sapiens
atgtagaattccttctactttg

SEQ ID NO: 8315081 - DNA, 22 bp, Homo sapiens
atgtccttttatttaaagcagg

SEQ ID NO: 8315082 - DNA, 22 bp, Homo sapiens
atgtcctggagcagaggcaagg

SEQ ID NO: 8315083 - DNA, 22 bp, Homo sapiens
gagggctgaagattgtggcccc

SEQ ID NO: 8315084 - DNA, 22 bp, Homo sapiens
atgtgacagtgtttgacagatg

SEQ ID NO: 8315085 - DNA, 22 bp, Homo sapiens
gaggtggatgttgcagtgagct

SEQ ID NO: 8315086 - DNA, 22 bp, Homo sapiens
atgtgagggctcaggctgactg

SEQ ID NO: 8315087 - DNA, 22 bp, Homo sapiens
gaggtagggcagaggctgaatg

SEQ ID NO: 8315088 - DNA, 22 bp, Homo sapiens
atgtctgataaataatgcataa

SEQ ID NO: 8315089 - DNA, 20 bp, Homo sapiens
atgtctgaagtaatccattt

SEQ ID NO: 8315090 - DNA, 22 bp, Homo sapiens
gagggctccattccccgtgccc

SEQ ID NO: 8315091 - DNA, 22 bp, Homo sapiens
gagggctcactgagaaagcagt

SEQ ID NO: 8315092 - DNA, 22 bp, Homo sapiens
gaggtggcccttgctcagcctt

SEQ ID NO: 8315093 - DNA, 22 bp, Homo sapiens
gatacacaagtggaaggagacg

SEQ ID NO: 8315094 - DNA, 22 bp, Homo sapiens
gatacaaaatataaatggagag

SEQ ID NO: 8315095 - DNA, 22 bp, Homo sapiens
gataattttagtctgaaaattg

SEQ ID NO: 8315096 - DNA, 22 bp, Homo sapiens
atgtttaaaggagtcagagact

SEQ ID NO: 8315097 - DNA, 22 bp, Homo sapiens
atgtttaatcggctgcctttcc

SEQ ID NO: 8315098 - DNA, 22 bp, Homo sapiens
gagttcatattcagagatcgct

SEQ ID NO: 8315099 - DNA, 22 bp, Homo sapiens
atgtttaaagggttgagaaata

SEQ ID NO: 8315100 - DNA, 22 bp, Homo sapiens
gactggagtcaatgagcagcac

SEQ ID NO: 8315101 - DNA, 22 bp, Homo sapiens
gacgggtgtatgctcccagcca

SEQ ID NO: 8315102 - DNA, 22 bp, Homo sapiens
gacgggtgtccctatgtccatt

SEQ ID NO: 8315103 - DNA, 22 bp, Homo sapiens
gacgcctcttccctgctgcact

SEQ ID NO: 8315104 - DNA, 22 bp, Homo sapiens
gacaattgcttttgccgaataa

SEQ ID NO: 8315105 - DNA, 21 bp, Homo sapiens
gacacaaagggtagtaatggt

SEQ ID NO: 8315106 - DNA, 22 bp, Homo sapiens
gacacaaagtttgtcagaaatt

SEQ ID NO: 8315107 - DNA, 22 bp, Homo sapiens
gacataatcctcctcacctact

SEQ ID NO: 8315108 - DNA, 22 bp, Homo sapiens
gacactcagtaggacttcaagg

SEQ ID NO: 8315109 - DNA, 22 bp, Homo sapiens
gacactacgtggctcacatttc

SEQ ID NO: 8315110 - DNA, 22 bp, Homo sapiens
gaccacagactggaaagagggc

SEQ ID NO: 8315111 - DNA, 22 bp, Homo sapiens
gaccaaggccaggccagggcgt

SEQ ID NO: 8315112 - DNA, 22 bp, Homo sapiens
gaaggctggggccttctcatct

SEQ ID NO: 8315113 - DNA, 22 bp, Homo sapiens
gaacaatacaggctttattcct

SEQ ID NO: 8315114 - DNA, 22 bp, Homo sapiens
gaacaatagtggtaacaaagcc

SEQ ID NO: 8315115 - DNA, 22 bp, Homo sapiens
gaacaaactgggtcccaatgat

SEQ ID NO: 8315116 - DNA, 22 bp, Homo sapiens
gaatcacactcgtaagtgagtt

SEQ ID NO: 8315117 - DNA, 22 bp, Homo sapiens
gacaataagaaaagaggaggca

SEQ ID NO: 8315118 - DNA, 22 bp, Homo sapiens
gacaataaagtgatacatggga

SEQ ID NO: 8315119 - DNA, 22 bp, Homo sapiens
gacaatatagttgaatgagcaa

SEQ ID NO: 8315120 - DNA, 22 bp, Homo sapiens
gacaataagaacagatactgtg

SEQ ID NO: 8315121 - DNA, 22 bp, Homo sapiens
gaataatattgactttgcaggc

SEQ ID NO: 8315122 - DNA, 22 bp, Homo sapiens
gaataattgtgatgcttgaagt

SEQ ID NO: 8315123 - DNA, 22 bp, Homo sapiens
gaataattttgatcagaaggga

SEQ ID NO: 8315124 - DNA, 22 bp, Homo sapiens
gaataatagcagaaattagcag

SEQ ID NO: 8315125 - DNA, 22 bp, Homo sapiens
atgaaaagttcgatctagaagg

SEQ ID NO: 8315126 - DNA, 22 bp, Homo sapiens
ctttcccttttgccttgcgtgg

SEQ ID NO: 8315127 - DNA, 22 bp, Homo sapiens
ctttcccttttgccttgcgtgg

SEQ ID NO: 8315128 - DNA, 22 bp, Homo sapiens
ctttcccttttgccttgcgtgg

SEQ ID NO: 8315129 - DNA, 22 bp, Homo sapiens
ctttcccttagccccattctat

SEQ ID NO: 8315130 - DNA, 22 bp, Homo sapiens
ctttcccttagccccattctat

SEQ ID NO: 8315131 - DNA, 22 bp, Homo sapiens
ctttcccacgcagtggatgaga

SEQ ID NO: 8315132 - DNA, 22 bp, Homo sapiens
ctttcccagagtagttgatgct

SEQ ID NO: 8315133 - DNA, 22 bp, Homo sapiens
ctttccctgcttagaaggattt

SEQ ID NO: 8315134 - DNA, 22 bp, Homo sapiens
ctttcccttagccccattctat

SEQ ID NO: 8315135 - DNA, 22 bp, Homo sapiens
ctttcccttagccccattctat

SEQ ID NO: 8315136 - DNA, 22 bp, Homo sapiens
ctttcaaaacgctctgtatgca

SEQ ID NO: 8315137 - DNA, 22 bp, Homo sapiens
ctttcaagctcgcccccgctct

SEQ ID NO: 8315138 - DNA, 22 bp, Homo sapiens
ctttcaaagagtaggaggtttt

SEQ ID NO: 8315139 - DNA, 22 bp, Homo sapiens
cttctttaatgtatacaaaaga

SEQ ID NO: 8315140 - DNA, 22 bp, Homo sapiens
cttcttgtgcactctctatgta

SEQ ID NO: 8315141 - DNA, 18 bp, Homo sapiens
cttcttgtttgatttggg

SEQ ID NO: 8315142 - DNA, 22 bp, Homo sapiens
atgaaacagtgtgtatagcaaa

SEQ ID NO: 8315143 - DNA, 22 bp, Homo sapiens
atgaaaatgtacatgtgtataa

SEQ ID NO: 8315144 - DNA, 22 bp, Homo sapiens
gaaagtatttacattaacatct

SEQ ID NO: 8315145 - DNA, 22 bp, Homo sapiens
gaaagtatttaagtccatattt

SEQ ID NO: 8315146 - DNA, 22 bp, Homo sapiens
gaaagtattagcctagaagtca

SEQ ID NO: 8315147 - DNA, 22 bp, Homo sapiens
gaaagtacagattcctggccag

SEQ ID NO: 8315148 - DNA, 22 bp, Homo sapiens
gaaatagacactttctatgaat

SEQ ID NO: 8315149 - DNA, 22 bp, Homo sapiens
gaaatactgtaaagttattatt

SEQ ID NO: 8315150 - DNA, 22 bp, Homo sapiens
gaaagtcatggatgaacactac

SEQ ID NO: 8315151 - DNA, 22 bp, Homo sapiens
gaaagtgcagtcagacaaggca

SEQ ID NO: 8315152 - DNA, 22 bp, Homo sapiens
gaaagtgcagtcagacaaggca

SEQ ID NO: 8315153 - DNA, 21 bp, Homo sapiens
atgacagatgctgcagatcgt

SEQ ID NO: 8315154 - DNA, 22 bp, Homo sapiens
atgacagcattttcttctaagg

SEQ ID NO: 8315155 - DNA, 22 bp, Homo sapiens
atgacagatgctgtggggaggt

SEQ ID NO: 8315156 - DNA, 22 bp, Homo sapiens
gaaacattgagcagaaggagaa

SEQ ID NO: 8315157 - DNA, 22 bp, Homo sapiens
cagctaccatggtttgttccag

SEQ ID NO: 8315158 - DNA, 22 bp, Homo sapiens
cagctacagtctgattggttca

SEQ ID NO: 8315159 - DNA, 22 bp, Homo sapiens
cagctacaaatacttttgtatg

SEQ ID NO: 8315160 - DNA, 22 bp, Homo sapiens
gtgcccagtaaatgaaagcttt

SEQ ID NO: 8315161 - DNA, 22 bp, Homo sapiens
gtgcccagtcctgccttgacag

SEQ ID NO: 8315162 - DNA, 22 bp, Homo sapiens
gtgcccagtcctgccttgacag

SEQ ID NO: 8315163 - DNA, 22 bp, Homo sapiens
gtgcccaggtgtccctgagaag

SEQ ID NO: 8315164 - DNA, 16 bp, Homo sapiens
cagcctgcagtggtca

SEQ ID NO: 8315165 - DNA, 22 bp, Homo sapiens
cagccctgcttccccgctagtt

SEQ ID NO: 8315166 - DNA, 22 bp, Homo sapiens
gtgcccagtgcaggcccgcagg

SEQ ID NO: 8315167 - DNA, 22 bp, Homo sapiens
gtgcccagttgaggccaggact

SEQ ID NO: 8315168 - DNA, 22 bp, Homo sapiens
gtgcccagttgaggccaggact

SEQ ID NO: 8315169 - DNA, 22 bp, Homo sapiens
gtcccaggctccatggcagcca

SEQ ID NO: 8315170 - DNA, 22 bp, Homo sapiens
gtccctggggaatcagctggag

SEQ ID NO: 8315171 - DNA, 22 bp, Homo sapiens
gtccctgggaaaggagagggca

SEQ ID NO: 8315172 - DNA, 22 bp, Homo sapiens
gtccctgggaaaggagagggca

SEQ ID NO: 8315173 - DNA, 22 bp, Homo sapiens
gtcccttcctcattccacttta

SEQ ID NO: 8315174 - DNA, 22 bp, Homo sapiens
gtcccttcctcattccacttta

SEQ ID NO: 8315175 - DNA, 19 bp, Homo sapiens
gtcccttcactcctgctgg

SEQ ID NO: 8315176 - DNA, 22 bp, Homo sapiens
gtccctgggtctaaggcagtaa

SEQ ID NO: 8315177 - DNA, 22 bp, Homo sapiens
cagccccttgtccggtagccac

SEQ ID NO: 8315178 - DNA, 22 bp, Homo sapiens
cagccccttcctggcatctgga

SEQ ID NO: 8315179 - DNA, 22 bp, Homo sapiens
gtctgtggagttgcttgctgga

SEQ ID NO: 8315180 - DNA, 22 bp, Homo sapiens
gtctgtgcttattcagcagggg

SEQ ID NO: 8315181 - DNA, 22 bp, Homo sapiens
gtctgtggtccctgctggggac

SEQ ID NO: 8315182 - DNA, 22 bp, Homo sapiens
gtctgtagtcacacaggtgaca

SEQ ID NO: 8315183 - DNA, 22 bp, Homo sapiens
gtctgtaattattaaagaaagg

SEQ ID NO: 8315184 - DNA, 22 bp, Homo sapiens
gtcagcatagttcacacacagt

SEQ ID NO: 8315185 - DNA, 22 bp, Homo sapiens
cagcagctgcaaatggaaacag

SEQ ID NO: 8315186 - DNA, 22 bp, Homo sapiens
cagcacctacccatcctgagtc

SEQ ID NO: 8315187 - DNA, 22 bp, Homo sapiens
cagcaccctttccactgccttg

SEQ ID NO: 8315188 - DNA, 18 bp, Homo sapiens
gtcatgggtagtttagta

SEQ ID NO: 8315189 - DNA, 22 bp, Homo sapiens
gggcagtgggtggctgcagcct

SEQ ID NO: 8315190 - DNA, 22 bp, Homo sapiens
cagagacaggagtgctcccagt

SEQ ID NO: 8315191 - DNA, 22 bp, Homo sapiens
cagactcttgagctgattgtat

SEQ ID NO: 8315192 - DNA, 22 bp, Homo sapiens
cagactctgatgcagccttgtg

SEQ ID NO: 8315193 - DNA, 22 bp, Homo sapiens
cagactctcttccatgcatcac

SEQ ID NO: 8315194 - DNA, 22 bp, Homo sapiens
cagactctcttccatgcatcac

SEQ ID NO: 8315195 - DNA, 22 bp, Homo sapiens
cagaccatcttgaagcaaactg

SEQ ID NO: 8315196 - DNA, 22 bp, Homo sapiens
ggcttagcaactcctgaggctc

SEQ ID NO: 8315197 - DNA, 22 bp, Homo sapiens
gggctgagtctgctgcctgtca

SEQ ID NO: 8315198 - DNA, 22 bp, Homo sapiens
gggctgagtgacctcaggccaa

SEQ ID NO: 8315199 - DNA, 22 bp, Homo sapiens
gggctgagtgacctcaggccaa

SEQ ID NO: 8315200 - DNA, 22 bp, Homo sapiens
gggctgagtctgctgcctgtca

SEQ ID NO: 8315201 - DNA, 22 bp, Homo sapiens
gggctgaggggtatctcatggg

SEQ ID NO: 8315202 - DNA, 22 bp, Homo sapiens
cagagctgggatcccatgggcg

SEQ ID NO: 8315203 - DNA, 22 bp, Homo sapiens
gggctgacagtttcccctgaaa

SEQ ID NO: 8315204 - DNA, 22 bp, Homo sapiens
gggctgaccccacccctcactc

SEQ ID NO: 8315205 - DNA, 22 bp, Homo sapiens
gggctgacaccacccaggcgca

SEQ ID NO: 8315206 - DNA, 22 bp, Homo sapiens
gggccagcctactgctagaccc

SEQ ID NO: 8315207 - DNA, 23 bp, Homo sapiens
cagcacagtacatttcctgtctc

SEQ ID NO: 8315208 - DNA, 22 bp, Homo sapiens
cagcacatttactcagccctca

SEQ ID NO: 8315209 - DNA, 22 bp, Homo sapiens
cagcacagtgcagatgctgact

SEQ ID NO: 8315210 - DNA, 22 bp, Homo sapiens
cagcacagtttcccccatgagc

SEQ ID NO: 8315211 - DNA, 22 bp, Homo sapiens
cagcacagtttcccccatgagc

SEQ ID NO: 8315212 - DNA, 22 bp, Homo sapiens
cagcacagtcctttgcttactg

SEQ ID NO: 8315213 - DNA, 22 bp, Homo sapiens
ggtgagactttagaagagccag

SEQ ID NO: 8315214 - DNA, 22 bp, Homo sapiens
ggtgacgaatccatagcatcga

SEQ ID NO: 8315215 - DNA, 22 bp, Homo sapiens
ggtgacggggcccaggtttcct

SEQ ID NO: 8315216 - DNA, 22 bp, Homo sapiens
cagcaaatactactagttttta

SEQ ID NO: 8315217 - DNA, 22 bp, Homo sapiens
ggtgacagtggttaaaatttgt

SEQ ID NO: 8315218 - DNA, 22 bp, Homo sapiens
ggtctgctttccttgccactgt

SEQ ID NO: 8315219 - DNA, 22 bp, Homo sapiens
ggtctggaataaggtccaggaa

SEQ ID NO: 8315220 - DNA, 22 bp, Homo sapiens
ggtctgagtgccagggagagaa

SEQ ID NO: 8315221 - DNA, 22 bp, Homo sapiens
ggtctgaggctccaaggaggtg

SEQ ID NO: 8315222 - DNA, 22 bp, Homo sapiens
ggtctgagtagagggctggcga

SEQ ID NO: 8315223 - DNA, 22 bp, Homo sapiens
ggtctgagatatttgttcagct

SEQ ID NO: 8315224 - DNA, 22 bp, Homo sapiens
ggtctgagcttgagcccatgct

SEQ ID NO: 8315225 - DNA, 22 bp, Homo sapiens
ggtctgaggctccaaggaggtg

SEQ ID NO: 8315226 - DNA, 22 bp, Homo sapiens
cagaggtacagccattgaagat

SEQ ID NO: 8315227 - DNA, 22 bp, Homo sapiens
cagagtcatgggccgtcaggca

SEQ ID NO: 8315228 - DNA, 22 bp, Homo sapiens
cagagtcattgacttccaggag

SEQ ID NO: 8315229 - DNA, 22 bp, Homo sapiens
ggtctgagatatttgttcagct

SEQ ID NO: 8315230 - DNA, 17 bp, Homo sapiens
cagagtctgtctgcatc

SEQ ID NO: 8315231 - DNA, 21 bp, Homo sapiens
cagaggggctagcctggctgc

SEQ ID NO: 8315232 - DNA, 21 bp, Homo sapiens
cagaggggctagcctggctgc

SEQ ID NO: 8315233 - DNA, 22 bp, Homo sapiens
cagaggggctgacacccttggc

SEQ ID NO: 8315234 - DNA, 22 bp, Homo sapiens
cagaggggctgacacccttggc

SEQ ID NO: 8315235 - DNA, 21 bp, Homo sapiens
cagagggcttttctctgttct

SEQ ID NO: 8315236 - DNA, 22 bp, Homo sapiens
cagaggggtgtagagatcactg

SEQ ID NO: 8315237 - DNA, 22 bp, Homo sapiens
cagagggctcggcggccgctcc

SEQ ID NO: 8315238 - DNA, 22 bp, Homo sapiens
cagagggctcggcggccgctcc

SEQ ID NO: 8315239 - DNA, 22 bp, Homo sapiens
cagagggcgtccgggttaactt

SEQ ID NO: 8315240 - DNA, 21 bp, Homo sapiens
cagagggccggcatgtggtct

SEQ ID NO: 8315241 - DNA, 22 bp, Homo sapiens
cagagggctcttggctgcctgc

SEQ ID NO: 8315242 - DNA, 22 bp, Homo sapiens
cagagggctgccctgagttcgt

SEQ ID NO: 8315243 - DNA, 22 bp, Homo sapiens
cagagggctgtgtaaggatgtt

SEQ ID NO: 8315244 - DNA, 22 bp, Homo sapiens
cagagggcttcaggttcaggat

SEQ ID NO: 8315245 - DNA, 22 bp, Homo sapiens
cagagggcttcaggttcaggat

SEQ ID NO: 8315246 - DNA, 22 bp, Homo sapiens
cagagggcttcaggttcaggat

SEQ ID NO: 8315247 - DNA, 22 bp, Homo sapiens
ggggagagtcctttccagttcc

SEQ ID NO: 8315248 - DNA, 22 bp, Homo sapiens
cagaggcacagtgcgggccact

SEQ ID NO: 8315249 - DNA, 22 bp, Homo sapiens
ggggagcaggctgggctgtctg

SEQ ID NO: 8315250 - DNA, 22 bp, Homo sapiens
ggggagcaattgcccccttaga

SEQ ID NO: 8315251 - DNA, 22 bp, Homo sapiens
ggctggtgttacagtcggcagc

SEQ ID NO: 8315252 - DNA, 22 bp, Homo sapiens
ggctgtctctgtgactgccacc

SEQ ID NO: 8315253 - DNA, 22 bp, Homo sapiens
ggctgttgacagacataggttt

SEQ ID NO: 8315254 - DNA, 23 bp, Homo sapiens
cagaaataaactggtttgtagat

SEQ ID NO: 8315255 - DNA, 22 bp, Homo sapiens
cagaaagtgatttgctattcca

SEQ ID NO: 8315256 - DNA, 18 bp, Homo sapiens
cagaaagttatttactct

SEQ ID NO: 8315257 - DNA, 23 bp, Homo sapiens
cagaaagtttgagaagatacatc

SEQ ID NO: 8315258 - DNA, 22 bp, Homo sapiens
cagaaaagggtgtttgttcagg

SEQ ID NO: 8315259 - DNA, 22 bp, Homo sapiens
cagaaaataaagtttctacgca

SEQ ID NO: 8315260 - DNA, 22 bp, Homo sapiens
cagaaaataaacatttgtggaa

SEQ ID NO: 8315261 - DNA, 22 bp, Homo sapiens
cagaaaataaacatttgtggaa

SEQ ID NO: 8315262 - DNA, 22 bp, Homo sapiens
cacttttaacaggagaattccc

SEQ ID NO: 8315263 - DNA, 22 bp, Homo sapiens
cactttggtagctgttttggga

SEQ ID NO: 8315264 - DNA, 22 bp, Homo sapiens
ggctgcctactttcccagagtt

SEQ ID NO: 8315265 - DNA, 22 bp, Homo sapiens
ggctgcctagacttggaatttc

SEQ ID NO: 8315266 - DNA, 22 bp, Homo sapiens
ggctccaggtgcatgccaggct

SEQ ID NO: 8315267 - DNA, 22 bp, Homo sapiens
ggctccaggtttaagggtatgt

SEQ ID NO: 8315268 - DNA, 22 bp, Homo sapiens
ggctccagggtacccctggatg

SEQ ID NO: 8315269 - DNA, 22 bp, Homo sapiens
ggctccagggtctctccttgtg

SEQ ID NO: 8315270 - DNA, 22 bp, Homo sapiens
ggctccagggtacccctggatg

SEQ ID NO: 8315271 - DNA, 22 bp, Homo sapiens
ggctgagccccctctgcgtagg

SEQ ID NO: 8315272 - DNA, 22 bp, Homo sapiens
ggctgagcctggagcatctggt

SEQ ID NO: 8315273 - DNA, 22 bp, Homo sapiens
ggctgagcgtggctgccgtggg

SEQ ID NO: 8315274 - DNA, 22 bp, Homo sapiens
ggctctggtgagggtaggagat

SEQ ID NO: 8315275 - DNA, 22 bp, Homo sapiens
ggcctgtgtcctccttgccctg

SEQ ID NO: 8315276 - DNA, 19 bp, Homo sapiens
ggctcagggcgctgccgcc

SEQ ID NO: 8315277 - DNA, 22 bp, Homo sapiens
ggcctgagctctggggaggcaa

SEQ ID NO: 8315278 - DNA, 22 bp, Homo sapiens
ggcctgggctccgggagttact

SEQ ID NO: 8315279 - DNA, 22 bp, Homo sapiens
ggcccttcctgctctcttagct

SEQ ID NO: 8315280 - DNA, 22 bp, Homo sapiens
ggcccttcctcttgtgctggca

SEQ ID NO: 8315281 - DNA, 22 bp, Homo sapiens
ggccccaggtagaagatataga

SEQ ID NO: 8315282 - DNA, 22 bp, Homo sapiens
cacgcatttattcacgtattcg

SEQ ID NO: 8315283 - DNA, 22 bp, Homo sapiens
cacgcacgctgggtggaggcgc

SEQ ID NO: 8315284 - DNA, 22 bp, Homo sapiens
caccttccatctccttggctag

SEQ ID NO: 8315285 - DNA, 21 bp, Homo sapiens
ggccgccgccttgtgctctgc

SEQ ID NO: 8315286 - DNA, 22 bp, Homo sapiens
ggccaagatcccattatacaaa

SEQ ID NO: 8315287 - DNA, 22 bp, Homo sapiens
ggcatttttgacaaagagcaat

SEQ ID NO: 8315288 - DNA, 22 bp, Homo sapiens
ggccaaggatggtggctctggt

SEQ ID NO: 8315289 - DNA, 22 bp, Homo sapiens
ggcatttgagccattggcctgt

SEQ ID NO: 8315290 - DNA, 22 bp, Homo sapiens
ggcagggcaggaaagtcaggaa

SEQ ID NO: 8315291 - DNA, 22 bp, Homo sapiens
ggaggtgctgatcccagtcaac

SEQ ID NO: 8315292 - DNA, 19 bp, Homo sapiens
cacagggagaccacatgtc

SEQ ID NO: 8315293 - DNA, 22 bp, Homo sapiens
cacagttttatcttatactgat

SEQ ID NO: 8315294 - DNA, 22 bp, Homo sapiens
cacagtttggttttgctgtaat

SEQ ID NO: 8315295 - DNA, 22 bp, Homo sapiens
cacagtttggttttgctgtaat

SEQ ID NO: 8315296 - DNA, 22 bp, Homo sapiens
ggaggtgctggcggccagctct

SEQ ID NO: 8315297 - DNA, 22 bp, Homo sapiens
cacatacaatggtgttatttgg

SEQ ID NO: 8315298 - DNA, 22 bp, Homo sapiens
cacataaatggtgccatgtttt

SEQ ID NO: 8315299 - DNA, 22 bp, Homo sapiens
cacagttttgcccagggcttct

SEQ ID NO: 8315300 - DNA, 22 bp, Homo sapiens
cacagttttgtcttggtttcca

SEQ ID NO: 8315301 - DNA, 22 bp, Homo sapiens
cacatacatacgtatgtataca

SEQ ID NO: 8315302 - DNA, 21 bp, Homo sapiens
cacagaggcgctgtatggctg

SEQ ID NO: 8315303 - DNA, 22 bp, Homo sapiens
ggactgggattctggatctgct

SEQ ID NO: 8315304 - DNA, 22 bp, Homo sapiens
ggactgggcatgggtgctctgc

SEQ ID NO: 8315305 - DNA, 22 bp, Homo sapiens
ggactgggccaggggttggact

SEQ ID NO: 8315306 - DNA, 22 bp, Homo sapiens
ggactgggagaatggaggcaag

SEQ ID NO: 8315307 - DNA, 22 bp, Homo sapiens
cacagactccccgccatagtgg

SEQ ID NO: 8315308 - DNA, 20 bp, Homo sapiens
cacagactgtatgggcacca

SEQ ID NO: 8315309 - DNA, 22 bp, Homo sapiens
cacagacagtgtccctttgttg

SEQ ID NO: 8315310 - DNA, 22 bp, Homo sapiens
cacagaactggttaatagcaga

SEQ ID NO: 8315311 - DNA, 21 bp, Homo sapiens
ggaagggctctgaggacggct

SEQ ID NO: 8315312 - DNA, 22 bp, Homo sapiens
ggaaggggagctggaaagggta

SEQ ID NO: 8315313 - DNA, 22 bp, Homo sapiens
ggaaggggagctggaaagggta

SEQ ID NO: 8315314 - DNA, 22 bp, Homo sapiens
cacacagatggtaagggaggga

SEQ ID NO: 8315315 - DNA, 22 bp, Homo sapiens
cacacagacagctctctgaaga

SEQ ID NO: 8315316 - DNA, 20 bp, Homo sapiens
ggagctggcatccagcctct

SEQ ID NO: 8315317 - DNA, 22 bp, Homo sapiens
cacaggaatcagcattaatggc

SEQ ID NO: 8315318 - DNA, 22 bp, Homo sapiens
cacaggaatataagtttgagtt

SEQ ID NO: 8315319 - DNA, 22 bp, Homo sapiens
ggagctggagagtacagagttt

SEQ ID NO: 8315320 - DNA, 19 bp, Homo sapiens
ggagcctggagcacgtgcc

SEQ ID NO: 8315321 - DNA, 22 bp, Homo sapiens
ggagctgctccttcagccaagt

SEQ ID NO: 8315322 - DNA, 22 bp, Homo sapiens
ggagcccttctattccatggag

SEQ ID NO: 8315323 - DNA, 20 bp, Homo sapiens
cacagatgggacaggaaagg

SEQ ID NO: 8315324 - DNA, 20 bp, Homo sapiens
cacagatgggacaggaaagg

SEQ ID NO: 8315325 - DNA, 22 bp, Homo sapiens
caagcaggatgaagcccaggga

SEQ ID NO: 8315326 - DNA, 22 bp, Homo sapiens
caaatgtaaattcttttgaagc

SEQ ID NO: 8315327 - DNA, 22 bp, Homo sapiens
caaatgtaatggcaggttttgc

SEQ ID NO: 8315328 - DNA, 22 bp, Homo sapiens
caaatgtataaatgtactttct

SEQ ID NO: 8315329 - DNA, 22 bp, Homo sapiens
caaatgtaattgcggtttttgc

SEQ ID NO: 8315330 - DNA, 22 bp, Homo sapiens
gctggaggatggactggaagaa

SEQ ID NO: 8315331 - DNA, 22 bp, Homo sapiens
gctggctgtatcacctggccag

SEQ ID NO: 8315332 - DNA, 22 bp, Homo sapiens
gctggctgtatcacctggccag

SEQ ID NO: 8315333 - DNA, 21 bp, Homo sapiens
gctggctgtcccagggaagca

SEQ ID NO: 8315334 - DNA, 22 bp, Homo sapiens
gctggctgggtccctgagaggc

SEQ ID NO: 8315335 - DNA, 22 bp, Homo sapiens
gctggctgtatcacctggccag

SEQ ID NO: 8315336 - DNA, 22 bp, Homo sapiens
gctggctggtccagcaggggct

SEQ ID NO: 8315337 - DNA, 22 bp, Homo sapiens
gctggctggctgtgcaaaggca

SEQ ID NO: 8315338 - DNA, 22 bp, Homo sapiens
gctggctgggacagattccatt

SEQ ID NO: 8315339 - DNA, 22 bp, Homo sapiens
caaggccactccagagactggt

SEQ ID NO: 8315340 - DNA, 22 bp, Homo sapiens
gctggaggcagttcagacacca

SEQ ID NO: 8315341 - DNA, 22 bp, Homo sapiens
caatgtatcaagaagcatcagt

SEQ ID NO: 8315342 - DNA, 22 bp, Homo sapiens
gctttgctagcactgcgcttcc

SEQ ID NO: 8315343 - DNA, 22 bp, Homo sapiens
caataactttgatattttgcgg

SEQ ID NO: 8315344 - DNA, 22 bp, Homo sapiens
caataactgctgaggagaagca

SEQ ID NO: 8315345 - DNA, 22 bp, Homo sapiens
caagttttctgggttcagagca

SEQ ID NO: 8315346 - DNA, 22 bp, Homo sapiens
caagtttgtgttctatcattct

SEQ ID NO: 8315347 - DNA, 22 bp, Homo sapiens
caagtttgctgatccttgtttt

SEQ ID NO: 8315348 - DNA, 22 bp, Homo sapiens
caataactgctaaattccctgt

SEQ ID NO: 8315349 - DNA, 22 bp, Homo sapiens
caataactagtaattattccgg

SEQ ID NO: 8315350 - DNA, 22 bp, Homo sapiens
caataaagaagatttttgcaat

SEQ ID NO: 8315351 - DNA, 19 bp, Homo sapiens
gctgttctgaccatcaccc

SEQ ID NO: 8315352 - DNA, 22 bp, Homo sapiens
caagtaaagaatcacatttctt

SEQ ID NO: 8315353 - DNA, 20 bp, Homo sapiens
caagggtttgcattggcttt

SEQ ID NO: 8315354 - DNA, 22 bp, Homo sapiens
caaggtctggttcctctgggtg

SEQ ID NO: 8315355 - DNA, 22 bp, Homo sapiens
caaggtctggttcctctgggtg

SEQ ID NO: 8315356 - DNA, 22 bp, Homo sapiens
agtaaaaagttcagaatggttg

SEQ ID NO: 8315357 - DNA, 22 bp, Homo sapiens
agtaaaaagttcagaatggttg

SEQ ID NO: 8315358 - DNA, 22 bp, Homo sapiens
agtaaaaatatgcttgtggcta

SEQ ID NO: 8315359 - DNA, 22 bp, Homo sapiens
agtaaaaagttcagaatggttg

SEQ ID NO: 8315360 - DNA, 20 bp, Homo sapiens
cggctcagcctctccctccc

SEQ ID NO: 8315361 - DNA, 22 bp, Homo sapiens
cgcaggctggcgcggagtggca

SEQ ID NO: 8315362 - DNA, 20 bp, Homo sapiens
cctgttggatgaggtccaga

SEQ ID NO: 8315363 - DNA, 22 bp, Homo sapiens
cctgtgttagttatgggtctct

SEQ ID NO: 8315364 - DNA, 19 bp, Homo sapiens
cctgttcttggctgaggct

SEQ ID NO: 8315365 - DNA, 22 bp, Homo sapiens
cctgttcagagctaagcatcat

SEQ ID NO: 8315366 - DNA, 22 bp, Homo sapiens
agtacagatttagacacgatag

SEQ ID NO: 8315367 - DNA, 22 bp, Homo sapiens
agtacacacagtagaatagagt

SEQ ID NO: 8315368 - DNA, 20 bp, Homo sapiens
agtacaatgtatgattcaga

SEQ ID NO: 8315369 - DNA, 21 bp, Homo sapiens
ctaagcaaggagcaggggtag

SEQ ID NO: 8315370 - DNA, 22 bp, Homo sapiens
ctaagcaagaatgagtgcaaca

SEQ ID NO: 8315371 - DNA, 21 bp, Homo sapiens
cgggctggccgggccctcacc

SEQ ID NO: 8315372 - DNA, 17 bp, Homo sapiens
cgggcatggagggcagg

SEQ ID NO: 8315373 - DNA, 17 bp, Homo sapiens
cgggcatggagggcagg

SEQ ID NO: 8315374 - DNA, 22 bp, Homo sapiens
ctagggtcaggggcctgcgtcg

SEQ ID NO: 8315375 - DNA, 22 bp, Homo sapiens
agtcccaacagcttacaaggaa

SEQ ID NO: 8315376 - DNA, 22 bp, Homo sapiens
agtcccaacagcttacaaggaa

SEQ ID NO: 8315377 - DNA, 18 bp, Homo sapiens
agtccatgcatggctata

SEQ ID NO: 8315378 - DNA, 22 bp, Homo sapiens
ctagtaaagtactcaaatagcc

SEQ ID NO: 8315379 - DNA, 22 bp, Homo sapiens
ctaggtgatccactgctctctt

SEQ ID NO: 8315380 - DNA, 22 bp, Homo sapiens
ctagaaatattttacagtcaag

SEQ ID NO: 8315381 - DNA, 22 bp, Homo sapiens
ctagaaatgctcaagagaaagt

SEQ ID NO: 8315382 - DNA, 22 bp, Homo sapiens
ctagaaatctctgtttacatca

SEQ ID NO: 8315383 - DNA, 22 bp, Homo sapiens
cctggtgccggtagacgcgcag

SEQ ID NO: 8315384 - DNA, 22 bp, Homo sapiens
cctggctctggttccctcagct

SEQ ID NO: 8315385 - DNA, 22 bp, Homo sapiens
cctggctctgggatcttcgctt

SEQ ID NO: 8315386 - DNA, 22 bp, Homo sapiens
cctggctctggttccctcagct

SEQ ID NO: 8315387 - DNA, 22 bp, Homo sapiens
cctggctctgtcctcgcgcaaa

SEQ ID NO: 8315388 - DNA, 22 bp, Homo sapiens
cctgggcataaatcactccaag

SEQ ID NO: 8315389 - DNA, 22 bp, Homo sapiens
cctgggctcaagtgatggtccc

SEQ ID NO: 8315390 - DNA, 22 bp, Homo sapiens
aggtggggaggagtgtctcttt

SEQ ID NO: 8315391 - DNA, 22 bp, Homo sapiens
cctgtgccagccccttctgctg

SEQ ID NO: 8315392 - DNA, 21 bp, Homo sapiens
cctgtgccaaagtgtgttagg

SEQ ID NO: 8315393 - DNA, 22 bp, Homo sapiens
cctgtcatactaacgtagtggg

SEQ ID NO: 8315394 - DNA, 22 bp, Homo sapiens
cctgtcatttttatcaatgtct

SEQ ID NO: 8315395 - DNA, 22 bp, Homo sapiens
cctgtcccccaggcctgtacca

SEQ ID NO: 8315396 - DNA, 22 bp, Homo sapiens
cctgtgaggtcttgcatgtgaa

SEQ ID NO: 8315397 - DNA, 22 bp, Homo sapiens
cctgtgacttggcaaacctcca

SEQ ID NO: 8315398 - DNA, 22 bp, Homo sapiens
cctgcagcccttcaaaggctga

SEQ ID NO: 8315399 - DNA, 18 bp, Homo sapiens
cctgcagcccaggaggcc

SEQ ID NO: 8315400 - DNA, 21 bp, Homo sapiens
cctgccaggaaactgagtgtc

SEQ ID NO: 8315401 - DNA, 22 bp, Homo sapiens
cctggcacagagcggtggtcac

SEQ ID NO: 8315402 - DNA, 22 bp, Homo sapiens
cctggcaagtgggctcccagat

SEQ ID NO: 8315403 - DNA, 21 bp, Homo sapiens
aggtagtaaatgtttgctcct

SEQ ID NO: 8315404 - DNA, 22 bp, Homo sapiens
aggtagtaaagttcttgatcct

SEQ ID NO: 8315405 - DNA, 22 bp, Homo sapiens
aggtagtattcatgattaaatt

SEQ ID NO: 8315406 - DNA, 22 bp, Homo sapiens
aggtagtagcatgtatcagtac

SEQ ID NO: 8315407 - DNA, 23 bp, Homo sapiens
cctggagtactaaggggatggaa

SEQ ID NO: 8315408 - DNA, 22 bp, Homo sapiens
cctggagttgaaggaaggtggg

SEQ ID NO: 8315409 - DNA, 22 bp, Homo sapiens
aggtccagttttctgacaaggg

SEQ ID NO: 8315410 - DNA, 22 bp, Homo sapiens
cctggctctgcagccactccag

SEQ ID NO: 8315411 - DNA, 18 bp, Homo sapiens
agtcttctgatccatttt

SEQ ID NO: 8315412 - DNA, 22 bp, Homo sapiens
ctccagcctcatctcctggctg

SEQ ID NO: 8315413 - DNA, 22 bp, Homo sapiens
ctccaggaaagcctgaggcccg

SEQ ID NO: 8315414 - DNA, 22 bp, Homo sapiens
ctccaggctggggtgcaggttg

SEQ ID NO: 8315415 - DNA, 22 bp, Homo sapiens
ctcagtgttggagaccttcagg

SEQ ID NO: 8315416 - DNA, 18 bp, Homo sapiens
ctcagtgtttgctgaaaa

SEQ ID NO: 8315417 - DNA, 22 bp, Homo sapiens
agtcctggccccaaggaaggat

SEQ ID NO: 8315418 - DNA, 19 bp, Homo sapiens
agtcctggcctgggggacc

SEQ ID NO: 8315419 - DNA, 22 bp, Homo sapiens
agtcccttgagggagtactgtt

SEQ ID NO: 8315420 - DNA, 21 bp, Homo sapiens
agtcccctgtccttacttcta

SEQ ID NO: 8315421 - DNA, 22 bp, Homo sapiens
ctcctaggtgctcactggggtc

SEQ ID NO: 8315422 - DNA, 22 bp, Homo sapiens
ctcctggctcgcccccagctga

SEQ ID NO: 8315423 - DNA, 18 bp, Homo sapiens
ctcctggctgatggtgag

SEQ ID NO: 8315424 - DNA, 22 bp, Homo sapiens
ctcctgcccacgtgctacttct

SEQ ID NO: 8315425 - DNA, 22 bp, Homo sapiens
ctcctcagaagagggtaacaca

SEQ ID NO: 8315426 - DNA, 20 bp, Homo sapiens
ctcctggtccaggagcctga

SEQ ID NO: 8315427 - DNA, 22 bp, Homo sapiens
ctcctgggaaatgaaggggcag

SEQ ID NO: 8315428 - DNA, 22 bp, Homo sapiens
ctcctgggggacagcggcaggg

SEQ ID NO: 8315429 - DNA, 22 bp, Homo sapiens
ctgagaaacatatttccatcta

SEQ ID NO: 8315430 - DNA, 22 bp, Homo sapiens
agttagaatggatgttgagagc

SEQ ID NO: 8315431 - DNA, 22 bp, Homo sapiens
ctgaggagaccatcaactaatt

SEQ ID NO: 8315432 - DNA, 22 bp, Homo sapiens
ctgagcagcaattgctggccca

SEQ ID NO: 8315433 - DNA, 20 bp, Homo sapiens
ctgacagaaaatatttcatc

SEQ ID NO: 8315434 - DNA, 22 bp, Homo sapiens
ctgagaaaatttcaggaagtgt

SEQ ID NO: 8315435 - DNA, 22 bp, Homo sapiens
ctgagaaaagctttcttataca

SEQ ID NO: 8315436 - DNA, 22 bp, Homo sapiens
ctgagaaaagacatttctagat

SEQ ID NO: 8315437 - DNA, 22 bp, Homo sapiens
agtgtctgcctgggaggagcat

SEQ ID NO: 8315438 - DNA, 22 bp, Homo sapiens
ctgaaatgttaaatacttggct

SEQ ID NO: 8315439 - DNA, 22 bp, Homo sapiens
ctgaaatggttgcctggagaat

SEQ ID NO: 8315440 - DNA, 22 bp, Homo sapiens
agtgtctgctcagacagctaca

SEQ ID NO: 8315441 - DNA, 22 bp, Homo sapiens
agtgtctgcgggcagaggagcg

SEQ ID NO: 8315442 - DNA, 22 bp, Homo sapiens
agtgtctgctttgagtcaggtg

SEQ ID NO: 8315443 - DNA, 19 bp, Homo sapiens
ctctcagcctgtctccttg

SEQ ID NO: 8315444 - DNA, 17 bp, Homo sapiens
ctctgcagtgcatggct

SEQ ID NO: 8315445 - DNA, 22 bp, Homo sapiens
ctctgcaggggaggcatgcact

SEQ ID NO: 8315446 - DNA, 21 bp, Homo sapiens
ctctgcagccctgcttccagg

SEQ ID NO: 8315447 - DNA, 22 bp, Homo sapiens
ctctgcaggcacccagggtggg

SEQ ID NO: 8315448 - DNA, 18 bp, Homo sapiens
ctctgctaatgggcagct

SEQ ID NO: 8315449 - DNA, 22 bp, Homo sapiens
ctctgctagggctgaggtgttc

SEQ ID NO: 8315450 - DNA, 22 bp, Homo sapiens
ctctgctactgttaaaccattt

SEQ ID NO: 8315451 - DNA, 22 bp, Homo sapiens
ctctgctgatctcagctgggct

SEQ ID NO: 8315452 - DNA, 22 bp, Homo sapiens
ctctgctgcaggaaggcgtgca

SEQ ID NO: 8315453 - DNA, 21 bp, Homo sapiens
ctctgctgagtcctaggattc

SEQ ID NO: 8315454 - DNA, 22 bp, Homo sapiens
ctctgcattttaacagatgatt

SEQ ID NO: 8315455 - DNA, 22 bp, Homo sapiens
ctctttggtgcaccttgcagtc

SEQ ID NO: 8315456 - DNA, 22 bp, Homo sapiens
ctctggggtggaggaggctgac

SEQ ID NO: 8315457 - DNA, 22 bp, Homo sapiens
ctgaaatgggcaaaagtagatt

SEQ ID NO: 8315458 - DNA, 22 bp, Homo sapiens
ctgaaatgacggtttggggcaa

SEQ ID NO: 8315459 - DNA, 17 bp, Homo sapiens
ctgaaatattatgataa

SEQ ID NO: 8315460 - DNA, 22 bp, Homo sapiens
ctctttggttaatcacacagat

SEQ ID NO: 8315461 - DNA, 22 bp, Homo sapiens
ctgtggctaggaagctgtggga

SEQ ID NO: 8315462 - DNA, 23 bp, Homo sapiens
ctgtgggaagtcggggagcgcgc

SEQ ID NO: 8315463 - DNA, 21 bp, Homo sapiens
ctgtggcctggctagcaccgt

SEQ ID NO: 8315464 - DNA, 22 bp, Homo sapiens
ctgtggcctttgttggaggtcc

SEQ ID NO: 8315465 - DNA, 23 bp, Homo sapiens
ctgtggccctgcttcatgcagcc

SEQ ID NO: 8315466 - DNA, 22 bp, Homo sapiens
ctgtggccctgtgatctggcac

SEQ ID NO: 8315467 - DNA, 23 bp, Homo sapiens
ctgtggccctgcttcatgcagcc

SEQ ID NO: 8315468 - DNA, 23 bp, Homo sapiens
ctgtggccctgcttcatgcagcc

SEQ ID NO: 8315469 - DNA, 22 bp, Homo sapiens
atcctgggcagttttgagtgct

SEQ ID NO: 8315470 - DNA, 22 bp, Homo sapiens
atcctgggcagtgtgtcactct

SEQ ID NO: 8315471 - DNA, 22 bp, Homo sapiens
cttagaaattgttactcattca

SEQ ID NO: 8315472 - DNA, 22 bp, Homo sapiens
cttccagtctagagctatctgt

SEQ ID NO: 8315473 - DNA, 22 bp, Homo sapiens
cttccagtagtatcattctcat

SEQ ID NO: 8315474 - DNA, 22 bp, Homo sapiens
atctctttgatggctcctgtga

SEQ ID NO: 8315475 - DNA, 22 bp, Homo sapiens
atctgacaacctattgacttga

SEQ ID NO: 8315476 - DNA, 21 bp, Homo sapiens
atctgaagtttgagaggaaag

SEQ ID NO: 8315477 - DNA, 22 bp, Homo sapiens
atctgaagtccttataatctga

SEQ ID NO: 8315478 - DNA, 22 bp, Homo sapiens
atctgaagtccttataatctga

SEQ ID NO: 8315479 - DNA, 22 bp, Homo sapiens
atctgaagggaagtggaaggca

SEQ ID NO: 8315480 - DNA, 22 bp, Homo sapiens
atctgaagctatctgcacttca

SEQ ID NO: 8315481 - DNA, 22 bp, Homo sapiens
atctgaagaatgaatggaatta

SEQ ID NO: 8315482 - DNA, 21 bp, Homo sapiens
atctgaaatgtcaaagcagat

SEQ ID NO: 8315483 - DNA, 22 bp, Homo sapiens
atctgaaagctaggagttctca

SEQ ID NO: 8315484 - DNA, 22 bp, Homo sapiens
cttcttaatgcataaactgtgt

SEQ ID NO: 8315485 - DNA, 22 bp, Homo sapiens
atctgacatctccctctgacat

SEQ ID NO: 8315486 - DNA, 22 bp, Homo sapiens
atctgcacttaagcgaggcctg

SEQ ID NO: 8315487 - DNA, 22 bp, Homo sapiens
ctggcttccatgctgtagtggc

SEQ ID NO: 8315488 - DNA, 22 bp, Homo sapiens
ctggctgtgtcttggaggagct

SEQ ID NO: 8315489 - DNA, 22 bp, Homo sapiens
ctggctggccggagcgaggcgg

SEQ ID NO: 8315490 - DNA, 22 bp, Homo sapiens
ctgggctcagatgagaggaagg

SEQ ID NO: 8315491 - DNA, 22 bp, Homo sapiens
atatgcagtctcttgcccttct

SEQ ID NO: 8315492 - DNA, 22 bp, Homo sapiens
atatgcatatgtcaaaacttat

SEQ ID NO: 8315493 - DNA, 22 bp, Homo sapiens
atattacataaacatgagtgaa

SEQ ID NO: 8315494 - DNA, 22 bp, Homo sapiens
atattataagttatttcaagtt

SEQ ID NO: 8315495 - DNA, 22 bp, Homo sapiens
atattcttcttgttcagactat

SEQ ID NO: 8315496 - DNA, 22 bp, Homo sapiens
atattcttgaagggagattata

SEQ ID NO: 8315497 - DNA, 22 bp, Homo sapiens
atattatagacagagtcttctg

SEQ ID NO: 8315498 - DNA, 22 bp, Homo sapiens
atcaaagtaattaacactgaga

SEQ ID NO: 8315499 - DNA, 22 bp, Homo sapiens
atcaaagtgatttgtaaacagg

SEQ ID NO: 8315500 - DNA, 22 bp, Homo sapiens
atattttggggtgatgtgcatc

SEQ ID NO: 8315501 - DNA, 22 bp, Homo sapiens
atatttaactggtcccaatata

SEQ ID NO: 8315502 - DNA, 22 bp, Homo sapiens
atatttaaacagggtaccaata

SEQ ID NO: 8315503 - DNA, 22 bp, Homo sapiens
atattgttgactataagagtaa

SEQ ID NO: 8315504 - DNA, 21 bp, Homo sapiens
atattgtaggtaaagtgcagg

SEQ ID NO: 8315505 - DNA, 22 bp, Homo sapiens
atattgatcttggaactgattt

SEQ ID NO: 8315506 - DNA, 22 bp, Homo sapiens
atattcttgtgattataaagta

SEQ ID NO: 8315507 - DNA, 22 bp, Homo sapiens
atcaaataaaggtacctagctt

SEQ ID NO: 8315508 - DNA, 22 bp, Homo sapiens
atcaaatacaaagggcataagg

SEQ ID NO: 8315509 - DNA, 22 bp, Homo sapiens
atcaaatataataattttcgct

SEQ ID NO: 8315510 - DNA, 22 bp, Homo sapiens
atcaaatacaaagggcataagg

SEQ ID NO: 8315511 - DNA, 22 bp, Homo sapiens
atcaaatataataattttcgct

SEQ ID NO: 8315512 - DNA, 22 bp, Homo sapiens
atcaaatataataattttcgct

SEQ ID NO: 8315513 - DNA, 22 bp, Homo sapiens
atcaacaggtatggatgagatt

SEQ ID NO: 8315514 - DNA, 22 bp, Homo sapiens
atcaacttgtccttgatgttaa

SEQ ID NO: 8315515 - DNA, 22 bp, Homo sapiens
atcactttggtaccaattcagc

SEQ ID NO: 8315516 - DNA, 22 bp, Homo sapiens
ataatttggcttcctagatgta

SEQ ID NO: 8315517 - DNA, 22 bp, Homo sapiens
ataagaataattaagttagtcc

SEQ ID NO: 8315518 - DNA, 22 bp, Homo sapiens
ataagaaacattattctttcca

SEQ ID NO: 8315519 - DNA, 22 bp, Homo sapiens
ataagacacgccccactcactc

SEQ ID NO: 8315520 - DNA, 22 bp, Homo sapiens
ataacttattagattggagctg

SEQ ID NO: 8315521 - DNA, 22 bp, Homo sapiens
ataacttagagtaggcaaaagt

SEQ ID NO: 8315522 - DNA, 22 bp, Homo sapiens
ataacttaatgggtcatgctct

SEQ ID NO: 8315523 - DNA, 22 bp, Homo sapiens
ctgcctctgcgtcccacagagt

SEQ ID NO: 8315524 - DNA, 22 bp, Homo sapiens
ataaatctcttaagactcaaca

SEQ ID NO: 8315525 - DNA, 22 bp, Homo sapiens
ataaatggctttcattcctagg

SEQ ID NO: 8315526 - DNA, 22 bp, Homo sapiens
ctgcctctcaggtccctgagat

SEQ ID NO: 8315527 - DNA, 22 bp, Homo sapiens
ctgcctctccccagagtggccc

SEQ ID NO: 8315528 - DNA, 22 bp, Homo sapiens
ctgcctctcagcctgaccgcca

SEQ ID NO: 8315529 - DNA, 22 bp, Homo sapiens
ataaccttggctagtattgtgc

SEQ ID NO: 8315530 - DNA, 22 bp, Homo sapiens
ctgcaagtatctaccattctct

SEQ ID NO: 8315531 - DNA, 22 bp, Homo sapiens
ctgcaatagtttagaataattg

SEQ ID NO: 8315532 - DNA, 22 bp, Homo sapiens
ctgcaatatgatgtctgagaaa

SEQ ID NO: 8315533 - DNA, 23 bp, Homo sapiens
ctgatccaggaggtctgtcgtga

SEQ ID NO: 8315534 - DNA, 19 bp, Homo sapiens
agttattgatctattcagg

SEQ ID NO: 8315535 - DNA, 22 bp, Homo sapiens
ctgaggagcagctggcccgcta

SEQ ID NO: 8315536 - DNA, 23 bp, Homo sapiens
ctgcagagaactgagggacagcc

SEQ ID NO: 8315537 - DNA, 22 bp, Homo sapiens
ctgcagagagtgccgggcagcc

SEQ ID NO: 8315538 - DNA, 22 bp, Homo sapiens
ctgcagagatgaagaaggtggc

SEQ ID NO: 8315539 - DNA, 22 bp, Homo sapiens
ctgcagggagaggggacagcct

SEQ ID NO: 8315540 - DNA, 20 bp, Homo sapiens
ctgcagggtgagtgggcgat

SEQ ID NO: 8315541 - DNA, 20 bp, Homo sapiens
ctgcagggttagaggctcca

SEQ ID NO: 8315542 - DNA, 22 bp, Homo sapiens
ctgcagggttcggagagttccc

SEQ ID NO: 8315543 - DNA, 22 bp, Homo sapiens
ctgcagggtttcgccagttgtg

SEQ ID NO: 8315544 - DNA, 22 bp, Homo sapiens
ctggcccattgccttctctctc

SEQ ID NO: 8315545 - DNA, 20 bp, Homo sapiens
ctggcccatctaccgctctg

SEQ ID NO: 8315546 - DNA, 22 bp, Homo sapiens
ctggcccatggtgagctctggg

SEQ ID NO: 8315547 - DNA, 22 bp, Homo sapiens
ctggccccaggcagcctgctgg

SEQ ID NO: 8315548 - DNA, 22 bp, Homo sapiens
atagcaaaagcatgtgcaatac

SEQ ID NO: 8315549 - DNA, 22 bp, Homo sapiens
atagcaaaaggcaccagagtga

SEQ ID NO: 8315550 - DNA, 22 bp, Homo sapiens
atagcaaaggacaatagtcagt

SEQ ID NO: 8315551 - DNA, 22 bp, Homo sapiens
atagcaaaggacaatagtcagt

SEQ ID NO: 8315552 - DNA, 22 bp, Homo sapiens
ctggcccagttctgcgttttgc

SEQ ID NO: 8315553 - DNA, 22 bp, Homo sapiens
ctggctccatcctaggcaaatg

SEQ ID NO: 8315554 - DNA, 22 bp, Homo sapiens
ctggctccatcactgggtgatg

SEQ ID NO: 8315555 - DNA, 22 bp, Homo sapiens
ctggctcacaggtgagatgcat

SEQ ID NO: 8315556 - DNA, 22 bp, Homo sapiens
ctggctcccatgagctctcacg

SEQ ID NO: 8315557 - DNA, 22 bp, Homo sapiens
ctggctcccgaagccctcagtg

SEQ ID NO: 8315558 - DNA, 22 bp, Homo sapiens
ctggctggcaagtagaacacaa

SEQ ID NO: 8315559 - DNA, 22 bp, Homo sapiens
ctggctggccatgcagcgccag

SEQ ID NO: 8315560 - DNA, 22 bp, Homo sapiens
atagcaaatattttaatgagca

SEQ ID NO: 8315561 - DNA, 22 bp, Homo sapiens
atagcaaattctttaggtgctt

SEQ ID NO: 8315562 - DNA, 22 bp, Homo sapiens
atagcaaggtatgactggagcc

SEQ ID NO: 8315563 - DNA, 22 bp, Homo sapiens
ctggaagtggggttggcttgaa

SEQ ID NO: 8315564 - DNA, 22 bp, Homo sapiens
ctggagacctctcctgagagtg

SEQ ID NO: 8315565 - DNA, 17 bp, Homo sapiens
atacagtttattttaca

SEQ ID NO: 8315566 - DNA, 17 bp, Homo sapiens
atacagtttattttaca

SEQ ID NO: 8315567 - DNA, 22 bp, Homo sapiens
ataccttttactcattatccat

SEQ ID NO: 8315568 - DNA, 22 bp, Homo sapiens
atacctatgtgacagtattatt

SEQ ID NO: 8315569 - DNA, 22 bp, Homo sapiens
agggctgagcccaggcatgtag

SEQ ID NO: 8315570 - DNA, 18 bp, Homo sapiens
cctcagggagatccagtg

SEQ ID NO: 8315571 - DNA, 22 bp, Homo sapiens
agggctgagaatgacagggccg

SEQ ID NO: 8315572 - DNA, 22 bp, Homo sapiens
agggctgacagtggcgtggcgt

SEQ ID NO: 8315573 - DNA, 22 bp, Homo sapiens
cctacagttatattcttgattg

SEQ ID NO: 8315574 - DNA, 18 bp, Homo sapiens
cctcaggggacctggcag

SEQ ID NO: 8315575 - DNA, 22 bp, Homo sapiens
cctcagggaggcctctgtggct

SEQ ID NO: 8315576 - DNA, 22 bp, Homo sapiens
cctcagggccatctctgtccct

SEQ ID NO: 8315577 - DNA, 22 bp, Homo sapiens
cctcaggggcttttcgttgttg

SEQ ID NO: 8315578 - DNA, 23 bp, Homo sapiens
cctcaggggacctgtgagcctga

SEQ ID NO: 8315579 - DNA, 22 bp, Homo sapiens
cctcaggggtgcccacagctgc

SEQ ID NO: 8315580 - DNA, 22 bp, Homo sapiens
cctcaggggtcactgtgaggag

SEQ ID NO: 8315581 - DNA, 22 bp, Homo sapiens
cctcagggtctgaggagaccgt

SEQ ID NO: 8315582 - DNA, 22 bp, Homo sapiens
cctcagggttcggatgagaaca

SEQ ID NO: 8315583 - DNA, 22 bp, Homo sapiens
cctcagggtggcatcagatctt

SEQ ID NO: 8315584 - DNA, 23 bp, Homo sapiens
cctcagggtctagcagagagaag

SEQ ID NO: 8315585 - DNA, 22 bp, Homo sapiens
cctcagggtctctcacagcacc

SEQ ID NO: 8315586 - DNA, 22 bp, Homo sapiens
cctcaggggtgcccacagctgc

SEQ ID NO: 8315587 - DNA, 22 bp, Homo sapiens
cctcagggtcatcctagtaata

SEQ ID NO: 8315588 - DNA, 22 bp, Homo sapiens
agggcccatagatcgtcagctt

SEQ ID NO: 8315589 - DNA, 22 bp, Homo sapiens
agggcccatgtgggagcacttg

SEQ ID NO: 8315590 - DNA, 22 bp, Homo sapiens
agggccccatagtcactgcccg

SEQ ID NO: 8315591 - DNA, 22 bp, Homo sapiens
ccctggccagggcacagggagg

SEQ ID NO: 8315592 - DNA, 22 bp, Homo sapiens
agggcctgtccgctcccgcccg

SEQ ID NO: 8315593 - DNA, 22 bp, Homo sapiens
cctaagtaagttgactttcaga

SEQ ID NO: 8315594 - DNA, 22 bp, Homo sapiens
cctaatttgattttaaatagcc

SEQ ID NO: 8315595 - DNA, 22 bp, Homo sapiens
cctaagtattttcagtgttaac

SEQ ID NO: 8315596 - DNA, 18 bp, Homo sapiens
cctaatatgaggggtcct

SEQ ID NO: 8315597 - DNA, 22 bp, Homo sapiens
aggggcctggttggcctctgtt

SEQ ID NO: 8315598 - DNA, 22 bp, Homo sapiens
aggggctgactggaaagtgcca

SEQ ID NO: 8315599 - DNA, 22 bp, Homo sapiens
aggggctgcctggcttggcact

SEQ ID NO: 8315600 - DNA, 22 bp, Homo sapiens
cctcctggtgggcgcttctggc

SEQ ID NO: 8315601 - DNA, 22 bp, Homo sapiens
cctcctggttgcaatgaaatgg

SEQ ID NO: 8315602 - DNA, 22 bp, Homo sapiens
cctcctggtgacaaggcaaagc

SEQ ID NO: 8315603 - DNA, 22 bp, Homo sapiens
aggggaaatgccttggtggtac

SEQ ID NO: 8315604 - DNA, 22 bp, Homo sapiens
aggggaaatctctcgccatctg

SEQ ID NO: 8315605 - DNA, 22 bp, Homo sapiens
aggggtgaaagagggccctcaa

SEQ ID NO: 8315606 - DNA, 22 bp, Homo sapiens
aggggtcttgggagtcctggct

SEQ ID NO: 8315607 - DNA, 22 bp, Homo sapiens
cctgagtctgtgttttcctaag

SEQ ID NO: 8315608 - DNA, 20 bp, Homo sapiens
aggggtctagcagcagtgct

SEQ ID NO: 8315609 - DNA, 22 bp, Homo sapiens
aggggtctatcctgagatggtc

SEQ ID NO: 8315610 - DNA, 20 bp, Homo sapiens
cctctgtgtcctgtgtcata

SEQ ID NO: 8315611 - DNA, 22 bp, Homo sapiens
cctctgtgtcctggtcattgaa

SEQ ID NO: 8315612 - DNA, 22 bp, Homo sapiens
cctctgtgtctccaagaggcct

SEQ ID NO: 8315613 - DNA, 22 bp, Homo sapiens
cctctgtgtgtgcatgcatgcg

SEQ ID NO: 8315614 - DNA, 22 bp, Homo sapiens
agggggtgaatgtctgtctaca

SEQ ID NO: 8315615 - DNA, 22 bp, Homo sapiens
agggggtgaatgtctgtctaca

SEQ ID NO: 8315616 - DNA, 22 bp, Homo sapiens
agggggtctcctatcatggaag

SEQ ID NO: 8315617 - DNA, 22 bp, Homo sapiens
agggggctccttggtgtgcaga

SEQ ID NO: 8315618 - DNA, 22 bp, Homo sapiens
agggggctgccaaggaatgtaa

SEQ ID NO: 8315619 - DNA, 22 bp, Homo sapiens
agggggctgccaaggaatgtaa

SEQ ID NO: 8315620 - DNA, 21 bp, Homo sapiens
cccctgggagccctgtcagta

SEQ ID NO: 8315621 - DNA, 22 bp, Homo sapiens
cccctgcgaggacagtgggaca

SEQ ID NO: 8315622 - DNA, 22 bp, Homo sapiens
cccctgaagacaatggagaggt

SEQ ID NO: 8315623 - DNA, 23 bp, Homo sapiens
agggcccaagcctggacagcagg

SEQ ID NO: 8315624 - DNA, 22 bp, Homo sapiens
ccctgaggccctcctggggtct

SEQ ID NO: 8315625 - DNA, 20 bp, Homo sapiens
ccccttcatctacagcctga

SEQ ID NO: 8315626 - DNA, 22 bp, Homo sapiens
agggacagtctactgttcactg

SEQ ID NO: 8315627 - DNA, 22 bp, Homo sapiens
agggacagttacatcatcagac

SEQ ID NO: 8315628 - DNA, 22 bp, Homo sapiens
agggaccaatcaccgacaggct

SEQ ID NO: 8315629 - DNA, 22 bp, Homo sapiens
agggaccacatcccctctgtgg

SEQ ID NO: 8315630 - DNA, 22 bp, Homo sapiens
agggaccagcctgcccagggct

SEQ ID NO: 8315631 - DNA, 22 bp, Homo sapiens
agggaccagcgtgagtctgagg

SEQ ID NO: 8315632 - DNA, 22 bp, Homo sapiens
agggaccaggggtagctgagat

SEQ ID NO: 8315633 - DNA, 22 bp, Homo sapiens
agggacccatagagagaccagt

SEQ ID NO: 8315634 - DNA, 22 bp, Homo sapiens
cccaggcctggtctgggccagt

SEQ ID NO: 8315635 - DNA, 22 bp, Homo sapiens
agggaaagtaagcatttcatta

SEQ ID NO: 8315636 - DNA, 22 bp, Homo sapiens
aggctttgttttatctcattta

SEQ ID NO: 8315637 - DNA, 22 bp, Homo sapiens
aggctgcaggtctgggtcatgt

SEQ ID NO: 8315638 - DNA, 22 bp, Homo sapiens
aggctgcagcttgtctcgtggg

SEQ ID NO: 8315639 - DNA, 21 bp, Homo sapiens
aggctgcatgcatgagtgtgg

SEQ ID NO: 8315640 - DNA, 22 bp, Homo sapiens
ccagtgtatttttgggacctgc

SEQ ID NO: 8315641 - DNA, 22 bp, Homo sapiens
cccacacaaatcatggggagaa

SEQ ID NO: 8315642 - DNA, 22 bp, Homo sapiens
cccacacatttttcacttaccg

SEQ ID NO: 8315643 - DNA, 22 bp, Homo sapiens
aggctgtggtgatgattgggtc

SEQ ID NO: 8315644 - DNA, 22 bp, Homo sapiens
aggctgtgggagttgagagtct

SEQ ID NO: 8315645 - DNA, 22 bp, Homo sapiens
aggctgtggccctggtctagca

SEQ ID NO: 8315646 - DNA, 22 bp, Homo sapiens
cccacgttgaaccgcttacaga

SEQ ID NO: 8315647 - DNA, 22 bp, Homo sapiens
aggctgtgacagggtcatggag

SEQ ID NO: 8315648 - DNA, 22 bp, Homo sapiens
aggctgtgcattttggagggcc

SEQ ID NO: 8315649 - DNA, 22 bp, Homo sapiens
aggctcagcccaaggtggagag

SEQ ID NO: 8315650 - DNA, 22 bp, Homo sapiens
aggctcagcccaaggtggagag

SEQ ID NO: 8315651 - DNA, 22 bp, Homo sapiens
aggctcagcctgggcctagagc

SEQ ID NO: 8315652 - DNA, 17 bp, Homo sapiens
ccagtcacaccaccctt

SEQ ID NO: 8315653 - DNA, 22 bp, Homo sapiens
ccagggcagccaacccagatgc

SEQ ID NO: 8315654 - DNA, 22 bp, Homo sapiens
ccaggtgcaaactcccagcagg

SEQ ID NO: 8315655 - DNA, 22 bp, Homo sapiens
aggctctgtatgaaggtttggg

SEQ ID NO: 8315656 - DNA, 22 bp, Homo sapiens
ccaggcactggctgggttcttt

SEQ ID NO: 8315657 - DNA, 20 bp, Homo sapiens
aggctcagagcagtagtaca

SEQ ID NO: 8315658 - DNA, 22 bp, Homo sapiens
aggcctgggtctcgtgcctacc

SEQ ID NO: 8315659 - DNA, 22 bp, Homo sapiens
ccaggaggtggagattgcagtg

SEQ ID NO: 8315660 - DNA, 22 bp, Homo sapiens
ccaggaggtggaggttgcggtg

SEQ ID NO: 8315661 - DNA, 22 bp, Homo sapiens
ccaggaggtggaggttgcggtg

SEQ ID NO: 8315662 - DNA, 22 bp, Homo sapiens
ccaggaggtggcaggacttgcc

SEQ ID NO: 8315663 - DNA, 22 bp, Homo sapiens
aggcctgggacgggagccgtga

SEQ ID NO: 8315664 - DNA, 22 bp, Homo sapiens
aggccctgctttccagagctca

SEQ ID NO: 8315665 - DNA, 22 bp, Homo sapiens
aggccctgctgaggcctccctc

SEQ ID NO: 8315666 - DNA, 22 bp, Homo sapiens
ccactcccttccggtccagggc

SEQ ID NO: 8315667 - DNA, 22 bp, Homo sapiens
aggccctgcccagtgccacaag

SEQ ID NO: 8315668 - DNA, 22 bp, Homo sapiens
ccagccagctggttggacgcct

SEQ ID NO: 8315669 - DNA, 22 bp, Homo sapiens
ccacagagactctgcaggactg

SEQ ID NO: 8315670 - DNA, 22 bp, Homo sapiens
ccacagagacagggtccttgct

SEQ ID NO: 8315671 - DNA, 22 bp, Homo sapiens
catttgaaaatactcttttcca

SEQ ID NO: 8315672 - DNA, 22 bp, Homo sapiens
ccaatgagacagaaagagcctc

SEQ ID NO: 8315673 - DNA, 23 bp, Homo sapiens
ccacagagctgccaattcctgtg

SEQ ID NO: 8315674 - DNA, 21 bp, Homo sapiens
ccaccaggtcttctgctcggg

SEQ ID NO: 8315675 - DNA, 22 bp, Homo sapiens
ccaccaggcactcacagggaag

SEQ ID NO: 8315676 - DNA, 20 bp, Homo sapiens
ccacagtggagactggagac

SEQ ID NO: 8315677 - DNA, 22 bp, Homo sapiens
ccacccagaccagggatctggg

SEQ ID NO: 8315678 - DNA, 22 bp, Homo sapiens
ccactcagaccaacgacccttc

SEQ ID NO: 8315679 - DNA, 22 bp, Homo sapiens
ccacgagggaaccaggtggggt

SEQ ID NO: 8315680 - DNA, 22 bp, Homo sapiens
ccacgaggctatcctgctaggg

SEQ ID NO: 8315681 - DNA, 22 bp, Homo sapiens
ccacgagggaaccaggtggggt

SEQ ID NO: 8315682 - DNA, 22 bp, Homo sapiens
cattgcacttctgcttttcctc

SEQ ID NO: 8315683 - DNA, 22 bp, Homo sapiens
cattgcttcctatgtcccttct

SEQ ID NO: 8315684 - DNA, 22 bp, Homo sapiens
cattgcttgatagctgaaaatt

SEQ ID NO: 8315685 - DNA, 22 bp, Homo sapiens
cattgtaagctgttgaatcctc

SEQ ID NO: 8315686 - DNA, 22 bp, Homo sapiens
cattgtaagaggctttgcagca

SEQ ID NO: 8315687 - DNA, 22 bp, Homo sapiens
cattggccttttatcctagagg

SEQ ID NO: 8315688 - DNA, 22 bp, Homo sapiens
aggcacttgattaatgtgaatt

SEQ ID NO: 8315689 - DNA, 22 bp, Homo sapiens
catttcaattatttgctcttct

SEQ ID NO: 8315690 - DNA, 22 bp, Homo sapiens
catttcaattatttgctcttct

SEQ ID NO: 8315691 - DNA, 22 bp, Homo sapiens
catttcaatacagtttgtaaat

SEQ ID NO: 8315692 - DNA, 22 bp, Homo sapiens
catttcaagcattgacttctat

SEQ ID NO: 8315693 - DNA, 22 bp, Homo sapiens
catgagatttgggaggggccag

SEQ ID NO: 8315694 - DNA, 19 bp, Homo sapiens
catgaggcagctgcacccc

SEQ ID NO: 8315695 - DNA, 22 bp, Homo sapiens
catgagataatttttctccagt

SEQ ID NO: 8315696 - DNA, 22 bp, Homo sapiens
aggatgtgagccagcctggcct

SEQ ID NO: 8315697 - DNA, 22 bp, Homo sapiens
aggatggcttgcaggaggctgt

SEQ ID NO: 8315698 - DNA, 22 bp, Homo sapiens
catcttcacatatttccaatga

SEQ ID NO: 8315699 - DNA, 22 bp, Homo sapiens
aggaggctgaactagggtctgg

SEQ ID NO: 8315700 - DNA, 22 bp, Homo sapiens
aggagctgtcagagtgccagag

SEQ ID NO: 8315701 - DNA, 23 bp, Homo sapiens
aggaggcctgaaactgaggctga

SEQ ID NO: 8315702 - DNA, 22 bp, Homo sapiens
aggaggcctacgcacatgtcta

SEQ ID NO: 8315703 - DNA, 22 bp, Homo sapiens
aggaggcctacgcacatgtcta

SEQ ID NO: 8315704 - DNA, 22 bp, Homo sapiens
aggaggccgctgatgggctccc

SEQ ID NO: 8315705 - DNA, 22 bp, Homo sapiens
cagttttattggttgaaatctg

SEQ ID NO: 8315706 - DNA, 22 bp, Homo sapiens
cagtccagctcatcagtggcac

SEQ ID NO: 8315707 - DNA, 22 bp, Homo sapiens
cagtccagccagtagggtgtgg

SEQ ID NO: 8315708 - DNA, 22 bp, Homo sapiens
aggagccaggccccatggggct

SEQ ID NO: 8315709 - DNA, 22 bp, Homo sapiens
agcttccattaactgctacact

SEQ ID NO: 8315710 - DNA, 22 bp, Homo sapiens
agctggttcattcattcatggt

SEQ ID NO: 8315711 - DNA, 22 bp, Homo sapiens
agctggtttgcaagtataatca

SEQ ID NO: 8315712 - DNA, 20 bp, Homo sapiens
caggcacactcattcctgct

SEQ ID NO: 8315713 - DNA, 22 bp, Homo sapiens
caggagaaggtttggagtgcag

SEQ ID NO: 8315714 - DNA, 22 bp, Homo sapiens
caggactggctcgcagtgggtg

SEQ ID NO: 8315715 - DNA, 22 bp, Homo sapiens
cagctgggtttagtggggtgtg

SEQ ID NO: 8315716 - DNA, 22 bp, Homo sapiens
cagggctggctgtggcaatctc

SEQ ID NO: 8315717 - DNA, 22 bp, Homo sapiens
cagggctggctcatgaaaagtt

SEQ ID NO: 8315718 - DNA, 22 bp, Homo sapiens
aggaagagcccgggtgacataa

SEQ ID NO: 8315719 - DNA, 22 bp, Homo sapiens
cagggctggcttccaagttgtt

SEQ ID NO: 8315720 - DNA, 22 bp, Homo sapiens
aggaagtgactaggtaacccaa

SEQ ID NO: 8315721 - DNA, 22 bp, Homo sapiens
aggaagtgcagggggaagtact

SEQ ID NO: 8315722 - DNA, 22 bp, Homo sapiens
cagggctgttagctgctgctct

SEQ ID NO: 8315723 - DNA, 22 bp, Homo sapiens
aggaagtgggaagggtctgcca

SEQ ID NO: 8315724 - DNA, 22 bp, Homo sapiens
aggacacttggctattgttcca

SEQ ID NO: 8315725 - DNA, 22 bp, Homo sapiens
aggacacagtggtggggaaaag

SEQ ID NO: 8315726 - DNA, 22 bp, Homo sapiens
cagtatctgtcagtaatcaggt

SEQ ID NO: 8315727 - DNA, 22 bp, Homo sapiens
cagtatttcattcagaattgtt

SEQ ID NO: 8315728 - DNA, 22 bp, Homo sapiens
cagtatttgttacagcattagc

SEQ ID NO: 8315729 - DNA, 22 bp, Homo sapiens
cagtaacacaaccactccgtga

SEQ ID NO: 8315730 - DNA, 22 bp, Homo sapiens
cagtaacagtgatcacctgtgg

SEQ ID NO: 8315731 - DNA, 22 bp, Homo sapiens
cagtaacaggctctgtggtata

SEQ ID NO: 8315732 - DNA, 22 bp, Homo sapiens
aggacagagggaccagagccca

SEQ ID NO: 8315733 - DNA, 22 bp, Homo sapiens
aggcagtgtgtagctggaagag

SEQ ID NO: 8315734 - DNA, 22 bp, Homo sapiens
acatatatgtaaagtactttgt

SEQ ID NO: 8315735 - DNA, 22 bp, Homo sapiens
acatatattactagtaaagaca

SEQ ID NO: 8315736 - DNA, 22 bp, Homo sapiens
aggcagaagccagccagggtcc

SEQ ID NO: 8315737 - DNA, 22 bp, Homo sapiens
aggcagaagccagccagggtcc

SEQ ID NO: 8315738 - DNA, 22 bp, Homo sapiens
aggcacagcacacctggccccc

SEQ ID NO: 8315739 - DNA, 22 bp, Homo sapiens
acagccactcaaagggccgaag

SEQ ID NO: 8315740 - DNA, 22 bp, Homo sapiens
acagcattcaataaataataac

SEQ ID NO: 8315741 - DNA, 22 bp, Homo sapiens
acagcatttaaagaaaatgaac

SEQ ID NO: 8315742 - DNA, 22 bp, Homo sapiens
agcttcttggctcagcacttgg

SEQ ID NO: 8315743 - DNA, 22 bp, Homo sapiens
aggaaagaagtacattctcatg

SEQ ID NO: 8315744 - DNA, 22 bp, Homo sapiens
acaggcaagtcacacaacttgt

SEQ ID NO: 8315745 - DNA, 23 bp, Homo sapiens
acaggcaataaagggagtctcca

SEQ ID NO: 8315746 - DNA, 22 bp, Homo sapiens
acaggatgataaaggatggcca

SEQ ID NO: 8315747 - DNA, 22 bp, Homo sapiens
aggaaaggggtaggtgtggacg

SEQ ID NO: 8315748 - DNA, 18 bp, Homo sapiens
acaggctattgcaggaga

SEQ ID NO: 8315749 - DNA, 22 bp, Homo sapiens
aggaaataggaccagacaaagc

SEQ ID NO: 8315750 - DNA, 22 bp, Homo sapiens
aggactgggtgcagagggcatc

SEQ ID NO: 8315751 - DNA, 22 bp, Homo sapiens
aggactggcggtcggtggggat

SEQ ID NO: 8315752 - DNA, 22 bp, Homo sapiens
aggactggccctgaggggaggc

SEQ ID NO: 8315753 - DNA, 22 bp, Homo sapiens
aggactggcagtgtgaggggtc

SEQ ID NO: 8315754 - DNA, 22 bp, Homo sapiens
aggactggcagtgtgaggggtc

SEQ ID NO: 8315755 - DNA, 22 bp, Homo sapiens
aggacagtggacactagtccct

SEQ ID NO: 8315756 - DNA, 22 bp, Homo sapiens
aggacagtccggggtcctccac

SEQ ID NO: 8315757 - DNA, 22 bp, Homo sapiens
aggacaggtgtagtgggctctg

SEQ ID NO: 8315758 - DNA, 22 bp, Homo sapiens
aggacaggtgtagtgggctctg

SEQ ID NO: 8315759 - DNA, 20 bp, Homo sapiens
agggaggtgctgggcctgag

SEQ ID NO: 8315760 - DNA, 20 bp, Homo sapiens
agggaggtgctgggcctgag

SEQ ID NO: 8315761 - DNA, 22 bp, Homo sapiens
agggaggtctggctgccctgag

SEQ ID NO: 8315762 - DNA, 22 bp, Homo sapiens
agggaggcattagctactgcga

SEQ ID NO: 8315763 - DNA, 22 bp, Homo sapiens
agggcacatctgctgggaatgg

SEQ ID NO: 8315764 - DNA, 21 bp, Homo sapiens
agggcacccccgctgcctacc

SEQ ID NO: 8315765 - DNA, 22 bp, Homo sapiens
agggaggcaggaaagttgtctg

SEQ ID NO: 8315766 - DNA, 20 bp, Homo sapiens
accagagctctcagtatgtg

SEQ ID NO: 8315767 - DNA, 22 bp, Homo sapiens
agggccagcactcctggcagga

SEQ ID NO: 8315768 - DNA, 22 bp, Homo sapiens
aggggcatcagttgcacatttt

SEQ ID NO: 8315769 - DNA, 22 bp, Homo sapiens
accctttcttactcacacgctc

SEQ ID NO: 8315770 - DNA, 18 bp, Homo sapiens
accctttccaaactgcag

SEQ ID NO: 8315771 - DNA, 20 bp, Homo sapiens
aggggtgatcgggtgacact

SEQ ID NO: 8315772 - DNA, 20 bp, Homo sapiens
aggggtgatcgggtgacact

SEQ ID NO: 8315773 - DNA, 22 bp, Homo sapiens
aggggtggagagtgttgccagt

SEQ ID NO: 8315774 - DNA, 22 bp, Homo sapiens
aggggtggagagtgttgccagt

SEQ ID NO: 8315775 - DNA, 22 bp, Homo sapiens
aggggtgatttgggacaggaca

SEQ ID NO: 8315776 - DNA, 23 bp, Homo sapiens
aggggtggtcagtacccgcagtg

SEQ ID NO: 8315777 - DNA, 22 bp, Homo sapiens
agggtagctacccaactccaga

SEQ ID NO: 8315778 - DNA, 22 bp, Homo sapiens
agggtagctacccaactccaga

SEQ ID NO: 8315779 - DNA, 22 bp, Homo sapiens
aggggaggagcttttcttgcct

SEQ ID NO: 8315780 - DNA, 22 bp, Homo sapiens
aggggcaggtgctgcacttaga

SEQ ID NO: 8315781 - DNA, 22 bp, Homo sapiens
aggggcagttccaagttttgtg

SEQ ID NO: 8315782 - DNA, 22 bp, Homo sapiens
aggggagctaacaccagagccc

SEQ ID NO: 8315783 - DNA, 22 bp, Homo sapiens
aggggagcttgcctggtcaccc

SEQ ID NO: 8315784 - DNA, 22 bp, Homo sapiens
aggggagcttgcctggtcaccc

SEQ ID NO: 8315785 - DNA, 22 bp, Homo sapiens
aggggagcttgcctggtcaccc

SEQ ID NO: 8315786 - DNA, 22 bp, Homo sapiens
aggggagcccctggtcctggtg

SEQ ID NO: 8315787 - DNA, 22 bp, Homo sapiens
aggggagcgacattccgtgccg

SEQ ID NO: 8315788 - DNA, 22 bp, Homo sapiens
aggggagccgaggggcatctgt

SEQ ID NO: 8315789 - DNA, 22 bp, Homo sapiens
aggggagccgaggggcatctgt

SEQ ID NO: 8315790 - DNA, 22 bp, Homo sapiens
aggggagcaaggccgtggtgta

SEQ ID NO: 8315791 - DNA, 22 bp, Homo sapiens
aggggagcaaggccgtggtgta

SEQ ID NO: 8315792 - DNA, 22 bp, Homo sapiens
aggggagcatctgtgatggtta

SEQ ID NO: 8315793 - DNA, 22 bp, Homo sapiens
agggctgacaaatggcagtgac

SEQ ID NO: 8315794 - DNA, 22 bp, Homo sapiens
aggctcaagcactgatattttt

SEQ ID NO: 8315795 - DNA, 22 bp, Homo sapiens
acatgtatgctttatgaagtag

SEQ ID NO: 8315796 - DNA, 22 bp, Homo sapiens
aggctcgcatgccctgcaccac

SEQ ID NO: 8315797 - DNA, 22 bp, Homo sapiens
acattaaatttcatagtgatta

SEQ ID NO: 8315798 - DNA, 22 bp, Homo sapiens
acattaaacttgcttggctgta

SEQ ID NO: 8315799 - DNA, 22 bp, Homo sapiens
acattaaagagtaaggttagtt

SEQ ID NO: 8315800 - DNA, 22 bp, Homo sapiens
acattaaagagtaaggttagtt

SEQ ID NO: 8315801 - DNA, 22 bp, Homo sapiens
acattaaatttcatagtgatta

SEQ ID NO: 8315802 - DNA, 22 bp, Homo sapiens
acattaaaaaatgttgcatgaa

SEQ ID NO: 8315803 - DNA, 22 bp, Homo sapiens
acattaaaaaatgttgcatgaa

SEQ ID NO: 8315804 - DNA, 22 bp, Homo sapiens
acattaaaattgggtggggtaa

SEQ ID NO: 8315805 - DNA, 22 bp, Homo sapiens
acattaaaatggagaattttga

SEQ ID NO: 8315806 - DNA, 22 bp, Homo sapiens
aggctctggagtgtggtgctgg

SEQ ID NO: 8315807 - DNA, 22 bp, Homo sapiens
aggctctggagtgtggtgctgg

SEQ ID NO: 8315808 - DNA, 22 bp, Homo sapiens
acatttctccctgcatgcctgc

SEQ ID NO: 8315809 - DNA, 22 bp, Homo sapiens
aggctggcttcccaagcgtcct

SEQ ID NO: 8315810 - DNA, 23 bp, Homo sapiens
aggctggcttcaggagcctctcc

SEQ ID NO: 8315811 - DNA, 22 bp, Homo sapiens
aggctggccagtgctgcagtgg

SEQ ID NO: 8315812 - DNA, 23 bp, Homo sapiens
aggctgcagaagaatagggtcat

SEQ ID NO: 8315813 - DNA, 22 bp, Homo sapiens
aggctgctgaggccaccacgct

SEQ ID NO: 8315814 - DNA, 22 bp, Homo sapiens
aggctctggcaacagctggtgt

SEQ ID NO: 8315815 - DNA, 22 bp, Homo sapiens
aggctctggcaacagctggtgt

SEQ ID NO: 8315816 - DNA, 22 bp, Homo sapiens
aggctggctttggtagcatggt

SEQ ID NO: 8315817 - DNA, 22 bp, Homo sapiens
aggctgggaaatgtagtcttcc

SEQ ID NO: 8315818 - DNA, 22 bp, Homo sapiens
aggctgtgagaggtggctccca

SEQ ID NO: 8315819 - DNA, 22 bp, Homo sapiens
aggctgtgagaagtccttcagt

SEQ ID NO: 8315820 - DNA, 19 bp, Homo sapiens
aggctgtgagggaggactc

SEQ ID NO: 8315821 - DNA, 19 bp, Homo sapiens
aggctgtgagggaggactc

SEQ ID NO: 8315822 - DNA, 22 bp, Homo sapiens
accactgcccatggtgaaaact

SEQ ID NO: 8315823 - DNA, 22 bp, Homo sapiens
agtgagatgtgtaatcaggggt

SEQ ID NO: 8315824 - DNA, 20 bp, Homo sapiens
agtgaggcagttcagtgggc

SEQ ID NO: 8315825 - DNA, 22 bp, Homo sapiens
agtgctttgaacgaaaggctga

SEQ ID NO: 8315826 - DNA, 22 bp, Homo sapiens
agtgcttataccaaagactctt

SEQ ID NO: 8315827 - DNA, 22 bp, Homo sapiens
agtgctttcagtgtgctctttt

SEQ ID NO: 8315828 - DNA, 22 bp, Homo sapiens
agtgctttccctgaaaccttcc

SEQ ID NO: 8315829 - DNA, 22 bp, Homo sapiens
agtggggccgcggtcctgccct

SEQ ID NO: 8315830 - DNA, 22 bp, Homo sapiens
agttacaaccatgacacaagca

SEQ ID NO: 8315831 - DNA, 22 bp, Homo sapiens
agttacaagctattttacttaa

SEQ ID NO: 8315832 - DNA, 22 bp, Homo sapiens
agttacaactgtttgaatgtca

SEQ ID NO: 8315833 - DNA, 22 bp, Homo sapiens
agttacaactgtttgaatgtca

SEQ ID NO: 8315834 - DNA, 22 bp, Homo sapiens
agttacaagtacaggctttgga

SEQ ID NO: 8315835 - DNA, 22 bp, Homo sapiens
agttaccatatatcaaacatgg

SEQ ID NO: 8315836 - DNA, 22 bp, Homo sapiens
agttacaaacactatcagttct

SEQ ID NO: 8315837 - DNA, 22 bp, Homo sapiens
actggggtgaaattggagtgtc

SEQ ID NO: 8315838 - DNA, 22 bp, Homo sapiens
actggggtttaggcctgggcaa

SEQ ID NO: 8315839 - DNA, 17 bp, Homo sapiens
agtgtgtaacttgtgta

SEQ ID NO: 8315840 - DNA, 22 bp, Homo sapiens
agtgtctttagcaagtttagtc

SEQ ID NO: 8315841 - DNA, 22 bp, Homo sapiens
agtgtctttcatatcctccatc

SEQ ID NO: 8315842 - DNA, 22 bp, Homo sapiens
agtgtcttacatgaattgattt

SEQ ID NO: 8315843 - DNA, 22 bp, Homo sapiens
agtgtctggtgagggctctctc

SEQ ID NO: 8315844 - DNA, 22 bp, Homo sapiens
agtgtctgtgatgaggtcagga

SEQ ID NO: 8315845 - DNA, 22 bp, Homo sapiens
agtgtctgttgagtttcaaaag

SEQ ID NO: 8315846 - DNA, 22 bp, Homo sapiens
agtgggggcagagcctctctcg

SEQ ID NO: 8315847 - DNA, 22 bp, Homo sapiens
agtggggcggacaggaccagga

SEQ ID NO: 8315848 - DNA, 22 bp, Homo sapiens
agtgggggctggctctgtctgt

SEQ ID NO: 8315849 - DNA, 22 bp, Homo sapiens
agtaacttaggagatacatggg

SEQ ID NO: 8315850 - DNA, 23 bp, Homo sapiens
agtaacatgcaaataacagtctg

SEQ ID NO: 8315851 - DNA, 22 bp, Homo sapiens
agtcagtcaccatttaagaaca

SEQ ID NO: 8315852 - DNA, 22 bp, Homo sapiens
agtaataatagctgtaaagtgc

SEQ ID NO: 8315853 - DNA, 22 bp, Homo sapiens
agtaagtgcagaaaagatgtgg

SEQ ID NO: 8315854 - DNA, 22 bp, Homo sapiens
agtaagtgagtcactgtgctgg

SEQ ID NO: 8315855 - DNA, 17 bp, Homo sapiens
agtaagtgtgtcacttc

SEQ ID NO: 8315856 - DNA, 22 bp, Homo sapiens
actctgctctgtatttcactgt

SEQ ID NO: 8315857 - DNA, 22 bp, Homo sapiens
actctgctattgcagtgcaaaa

SEQ ID NO: 8315858 - DNA, 22 bp, Homo sapiens
actctgctccctaagccatgat

SEQ ID NO: 8315859 - DNA, 22 bp, Homo sapiens
actctgctcaaagtcctgaggc

SEQ ID NO: 8315860 - DNA, 22 bp, Homo sapiens
actctgctaaatgtgtaggctc

SEQ ID NO: 8315861 - DNA, 22 bp, Homo sapiens
actctgctatcttagcaaaagg

SEQ ID NO: 8315862 - DNA, 21 bp, Homo sapiens
aggttccagcagccagagaat

SEQ ID NO: 8315863 - DNA, 20 bp, Homo sapiens
aggttccagccacaaccagc

SEQ ID NO: 8315864 - DNA, 22 bp, Homo sapiens
aggttcccagagatagagctgt

SEQ ID NO: 8315865 - DNA, 22 bp, Homo sapiens
aggtgggttccgcggcggcccg

SEQ ID NO: 8315866 - DNA, 22 bp, Homo sapiens
aggtggagaagagatgggcagt

SEQ ID NO: 8315867 - DNA, 22 bp, Homo sapiens
aggtggagacccagagaaggcg

SEQ ID NO: 8315868 - DNA, 22 bp, Homo sapiens
agggtgcagaaggagcctagga

SEQ ID NO: 8315869 - DNA, 22 bp, Homo sapiens
agggtgcaggggaagctgccct

SEQ ID NO: 8315870 - DNA, 23 bp, Homo sapiens
agggtgagcaagctatggagacc

SEQ ID NO: 8315871 - DNA, 22 bp, Homo sapiens
agggtgagggtctggccttgag

SEQ ID NO: 8315872 - DNA, 22 bp, Homo sapiens
agggtgcaaaagcaaggacagt

SEQ ID NO: 8315873 - DNA, 22 bp, Homo sapiens
aggtggaaatggctttcctagg

SEQ ID NO: 8315874 - DNA, 22 bp, Homo sapiens
agggtgcagtcacaggaaatgt

SEQ ID NO: 8315875 - DNA, 21 bp, Homo sapiens
aggtgcaggcctcaagcccca

SEQ ID NO: 8315876 - DNA, 22 bp, Homo sapiens
atacacttccaaatattgatta

SEQ ID NO: 8315877 - DNA, 22 bp, Homo sapiens
agaaaaggcttgaagaggtttt

SEQ ID NO: 8315878 - DNA, 22 bp, Homo sapiens
agaaaagggcaggagggataca

SEQ ID NO: 8315879 - DNA, 22 bp, Homo sapiens
agaaaaggattgatggatcaga

SEQ ID NO: 8315880 - DNA, 22 bp, Homo sapiens
atagttatttctgtcactgtca

SEQ ID NO: 8315881 - DNA, 22 bp, Homo sapiens
atagttgagatcagattcaact

SEQ ID NO: 8315882 - DNA, 22 bp, Homo sapiens
ataggagccataaataaaatct

SEQ ID NO: 8315883 - DNA, 22 bp, Homo sapiens
ataggaaagaaaattatgtagg

SEQ ID NO: 8315884 - DNA, 22 bp, Homo sapiens
atagctgactccagacatagct

SEQ ID NO: 8315885 - DNA, 22 bp, Homo sapiens
ataacaatagtggtagtgctgg

SEQ ID NO: 8315886 - DNA, 22 bp, Homo sapiens
ataacaatagtggtagtgctgg

SEQ ID NO: 8315887 - DNA, 22 bp, Homo sapiens
agttgcagacgcagagatgttg

SEQ ID NO: 8315888 - DNA, 19 bp, Homo sapiens
ataaataaaaagtgggaga

SEQ ID NO: 8315889 - DNA, 22 bp, Homo sapiens
agttgcagacgcagagatgttg

SEQ ID NO: 8315890 - DNA, 22 bp, Homo sapiens
ataaattctctgatgtatagta

SEQ ID NO: 8315891 - DNA, 22 bp, Homo sapiens
agttgaaattagagtcctggct

SEQ ID NO: 8315892 - DNA, 22 bp, Homo sapiens
agttcactctttatgagaaagt

SEQ ID NO: 8315893 - DNA, 22 bp, Homo sapiens
agttcactatagaagacagtgt

SEQ ID NO: 8315894 - DNA, 22 bp, Homo sapiens
agttcactttctgtagtggaag

SEQ ID NO: 8315895 - DNA, 22 bp, Homo sapiens
atacaagttgtgataatgtaaa

SEQ ID NO: 8315896 - DNA, 22 bp, Homo sapiens
ataaggtatgaaaagtaaatgg

SEQ ID NO: 8315897 - DNA, 19 bp, Homo sapiens
atacacgtgtatacataca

SEQ ID NO: 8315898 - DNA, 22 bp, Homo sapiens
agaaagagctcgggattaacag

SEQ ID NO: 8315899 - DNA, 22 bp, Homo sapiens
agaaagaacgttggttatctta

SEQ ID NO: 8315900 - DNA, 22 bp, Homo sapiens
atattaattatttacacatgag

SEQ ID NO: 8315901 - DNA, 22 bp, Homo sapiens
atattaatgggatttagtcagg

SEQ ID NO: 8315902 - DNA, 22 bp, Homo sapiens
atattaatgagcaagtaagtga

SEQ ID NO: 8315903 - DNA, 22 bp, Homo sapiens
agaaatcaatatctatatgttg

SEQ ID NO: 8315904 - DNA, 22 bp, Homo sapiens
agaaatatgctgattagatgaa

SEQ ID NO: 8315905 - DNA, 22 bp, Homo sapiens
agaaatatgctgattagatgaa

SEQ ID NO: 8315906 - DNA, 22 bp, Homo sapiens
atcaagttctgtcacatttgtc

SEQ ID NO: 8315907 - DNA, 22 bp, Homo sapiens
agaaatgttacagttgttattt

SEQ ID NO: 8315908 - DNA, 22 bp, Homo sapiens
agaaatgttgaatacacaaaat

SEQ ID NO: 8315909 - DNA, 22 bp, Homo sapiens
agaaatgttgaatacacaaaat

SEQ ID NO: 8315910 - DNA, 22 bp, Homo sapiens
agaaatgtccagggctaggatc

SEQ ID NO: 8315911 - DNA, 22 bp, Homo sapiens
agaaatgtatagtgaatttttc

SEQ ID NO: 8315912 - DNA, 22 bp, Homo sapiens
agaaatgtaattgcaactgtct

SEQ ID NO: 8315913 - DNA, 22 bp, Homo sapiens
agaaatgtaattgcaactgtct

SEQ ID NO: 8315914 - DNA, 20 bp, Homo sapiens
agaagcattcaaagaaaact

SEQ ID NO: 8315915 - DNA, 22 bp, Homo sapiens
agaaatgttgaatacatcagga

SEQ ID NO: 8315916 - DNA, 21 bp, Homo sapiens
agaagcctgggtggaggtggg

SEQ ID NO: 8315917 - DNA, 22 bp, Homo sapiens
agaagctaggctagacaagtga

SEQ ID NO: 8315918 - DNA, 21 bp, Homo sapiens
agaagctagtcactaaatcca

SEQ ID NO: 8315919 - DNA, 22 bp, Homo sapiens
agaagctataacaacaattata

SEQ ID NO: 8315920 - DNA, 22 bp, Homo sapiens
agaagctgcctacatgaccagc

SEQ ID NO: 8315921 - DNA, 22 bp, Homo sapiens
agaagctgcgtttatttaaatc

SEQ ID NO: 8315922 - DNA, 22 bp, Homo sapiens
atcctgggaagctgacattgaa

SEQ ID NO: 8315923 - DNA, 22 bp, Homo sapiens
cactgcactccatcctgggaaa

SEQ ID NO: 8315924 - DNA, 22 bp, Homo sapiens
cactgcactccagcccgggcaa

SEQ ID NO: 8315925 - DNA, 22 bp, Homo sapiens
cactgcactccatcctgggaaa

SEQ ID NO: 8315926 - DNA, 22 bp, Homo sapiens
cactgcactccagcccgggcaa

SEQ ID NO: 8315927 - DNA, 22 bp, Homo sapiens
cactgcacttcagcctgggtga

SEQ ID NO: 8315928 - DNA, 20 bp, Homo sapiens
cagaaagaaggtagattttt

SEQ ID NO: 8315929 - DNA, 22 bp, Homo sapiens
agcattttctgagagtatagat

SEQ ID NO: 8315930 - DNA, 22 bp, Homo sapiens
cacatgggtgtgcctggaggaa

SEQ ID NO: 8315931 - DNA, 22 bp, Homo sapiens
cacatgtcctgggaaaataact

SEQ ID NO: 8315932 - DNA, 22 bp, Homo sapiens
cacatgggcttagcaggcaggg

SEQ ID NO: 8315933 - DNA, 22 bp, Homo sapiens
cacatggcctgtgtggccagac

SEQ ID NO: 8315934 - DNA, 22 bp, Homo sapiens
cacatttaagcagatgtggacc

SEQ ID NO: 8315935 - DNA, 22 bp, Homo sapiens
cacagaaaaaggcttgaaaatc

SEQ ID NO: 8315936 - DNA, 22 bp, Homo sapiens
cacacttgtgaccgatataatg

SEQ ID NO: 8315937 - DNA, 22 bp, Homo sapiens
cacacatgtctctccatgctct

SEQ ID NO: 8315938 - DNA, 22 bp, Homo sapiens
caatttttgtacttatagtact

SEQ ID NO: 8315939 - DNA, 22 bp, Homo sapiens
caatttttaaactatgaagttg

SEQ ID NO: 8315940 - DNA, 18 bp, Homo sapiens
caattttacccagtccct

SEQ ID NO: 8315941 - DNA, 20 bp, Homo sapiens
cacagaacaaattgcaggac

SEQ ID NO: 8315942 - DNA, 22 bp, Homo sapiens
cacaggaaatgattctgcagca

SEQ ID NO: 8315943 - DNA, 22 bp, Homo sapiens
caaggaaaacagatgatcaaca

SEQ ID NO: 8315944 - DNA, 22 bp, Homo sapiens
caagctgggtcccaacaattac

SEQ ID NO: 8315945 - DNA, 22 bp, Homo sapiens
agcagagaccatatagcccaga

SEQ ID NO: 8315946 - DNA, 22 bp, Homo sapiens
caaggaaggagagatgatgggt

SEQ ID NO: 8315947 - DNA, 22 bp, Homo sapiens
caagtccatcctactgccttct

SEQ ID NO: 8315948 - DNA, 22 bp, Homo sapiens
caagtccaagatcaagaagcca

SEQ ID NO: 8315949 - DNA, 22 bp, Homo sapiens
caatgatagattttacaaatta

SEQ ID NO: 8315950 - DNA, 22 bp, Homo sapiens
cagagtgaaataggggatcaag

SEQ ID NO: 8315951 - DNA, 22 bp, Homo sapiens
cagagtgatggcacctgctggg

SEQ ID NO: 8315952 - DNA, 18 bp, Homo sapiens
cagagtgggccaagagac

SEQ ID NO: 8315953 - DNA, 22 bp, Homo sapiens
agcccttcaagagctctgtcct

SEQ ID NO: 8315954 - DNA, 22 bp, Homo sapiens
agcccttcaacctgcctactcc

SEQ ID NO: 8315955 - DNA, 22 bp, Homo sapiens
agcctattccaggatgagctca

SEQ ID NO: 8315956 - DNA, 22 bp, Homo sapiens
agcctgcttgagagtcctggct

SEQ ID NO: 8315957 - DNA, 22 bp, Homo sapiens
cagagccaggcctgccctcttt

SEQ ID NO: 8315958 - DNA, 22 bp, Homo sapiens
cagagctgttgcggggcttggc

SEQ ID NO: 8315959 - DNA, 22 bp, Homo sapiens
agccagggctgcgagcagacag

SEQ ID NO: 8315960 - DNA, 22 bp, Homo sapiens
agccaagaatcatgagctaata

SEQ ID NO: 8315961 - DNA, 22 bp, Homo sapiens
agccaagagacagatgcccacc

SEQ ID NO: 8315962 - DNA, 22 bp, Homo sapiens
agccaagacatttagaaaagct

SEQ ID NO: 8315963 - DNA, 22 bp, Homo sapiens
agccaagagatgaggctgcagg

SEQ ID NO: 8315964 - DNA, 22 bp, Homo sapiens
agccaagaggagcctaaagcga

SEQ ID NO: 8315965 - DNA, 22 bp, Homo sapiens
cagccatcagtaaagacagctt

SEQ ID NO: 8315966 - DNA, 22 bp, Homo sapiens
agcggaaggcctggctgatccg

SEQ ID NO: 8315967 - DNA, 22 bp, Homo sapiens
cagcccagagaaggggcccgtg

SEQ ID NO: 8315968 - DNA, 22 bp, Homo sapiens
cagcccatttctgggacctgag

SEQ ID NO: 8315969 - DNA, 22 bp, Homo sapiens
cagcccattccttcctgggggt

SEQ ID NO: 8315970 - DNA, 22 bp, Homo sapiens
cagcccattcctgccatgccgc

SEQ ID NO: 8315971 - DNA, 22 bp, Homo sapiens
cagcctctctgtatctcaggat

SEQ ID NO: 8315972 - DNA, 22 bp, Homo sapiens
cagcccaggtggcggaggttgc

SEQ ID NO: 8315973 - DNA, 22 bp, Homo sapiens
cagcccatggtttgtggccagt

SEQ ID NO: 8315974 - DNA, 22 bp, Homo sapiens
cagcccatctagctttagagat

SEQ ID NO: 8315975 - DNA, 23 bp, Homo sapiens
cagcccatggcattttttacagt

SEQ ID NO: 8315976 - DNA, 22 bp, Homo sapiens
cagcccatccaaggcttggcat

SEQ ID NO: 8315977 - DNA, 22 bp, Homo sapiens
cagcccataccagaagtggagt

SEQ ID NO: 8315978 - DNA, 22 bp, Homo sapiens
cagcactgtgataactgagcca

SEQ ID NO: 8315979 - DNA, 22 bp, Homo sapiens
cagcatggtggagctgctcttt

SEQ ID NO: 8315980 - DNA, 22 bp, Homo sapiens
agcgccactgcactccagcctg

SEQ ID NO: 8315981 - DNA, 22 bp, Homo sapiens
agctgagctcaggctgatgtaa

SEQ ID NO: 8315982 - DNA, 22 bp, Homo sapiens
agctgagctgcagatgactgta

SEQ ID NO: 8315983 - DNA, 17 bp, Homo sapiens
agctgagctggccaggg

SEQ ID NO: 8315984 - DNA, 22 bp, Homo sapiens
cagctgggtgatcttgggcagg

SEQ ID NO: 8315985 - DNA, 22 bp, Homo sapiens
cagctggcaagtggagcagggt

SEQ ID NO: 8315986 - DNA, 22 bp, Homo sapiens
cagcctcttgcactttgaaggc

SEQ ID NO: 8315987 - DNA, 18 bp, Homo sapiens
cagcctctgattggttgc

SEQ ID NO: 8315988 - DNA, 22 bp, Homo sapiens
cagcctctgagccttggcagat

SEQ ID NO: 8315989 - DNA, 22 bp, Homo sapiens
cagcgtctcgttgtgggcctcg

SEQ ID NO: 8315990 - DNA, 22 bp, Homo sapiens
cagcgtctcgttgtgggcctcg

SEQ ID NO: 8315991 - DNA, 22 bp, Homo sapiens
cagcgctggggtaggagcacct

SEQ ID NO: 8315992 - DNA, 22 bp, Homo sapiens
cagcgctgtgggaacagggcta

SEQ ID NO: 8315993 - DNA, 22 bp, Homo sapiens
cagcggaggacagatgggagct

SEQ ID NO: 8315994 - DNA, 22 bp, Homo sapiens
agacataagtgctatgacattg

SEQ ID NO: 8315995 - DNA, 22 bp, Homo sapiens
atgccacataattacaaataga

SEQ ID NO: 8315996 - DNA, 22 bp, Homo sapiens
atgccagaaaatgatggctgca

SEQ ID NO: 8315997 - DNA, 22 bp, Homo sapiens
atgcaacagctgggaatatgta

SEQ ID NO: 8315998 - DNA, 22 bp, Homo sapiens
atgcaacagggttgggaggcgg

SEQ ID NO: 8315999 - DNA, 22 bp, Homo sapiens
atgcaacaggtcagccaggaag

SEQ ID NO: 8316000 - DNA, 22 bp, Homo sapiens
atgcaacagttcatagttttat

SEQ ID NO: 8316001 - DNA, 22 bp, Homo sapiens
atgcaacagtcagtacatccgg

SEQ ID NO: 8316002 - DNA, 22 bp, Homo sapiens
atgcaacagaaaattgcctggg

SEQ ID NO: 8316003 - DNA, 22 bp, Homo sapiens
atgcaacagagaaaatattgag

SEQ ID NO: 8316004 - DNA, 22 bp, Homo sapiens
atgcaacacccctatggatgga

SEQ ID NO: 8316005 - DNA, 22 bp, Homo sapiens
atgcaacacatttgatgagcga

SEQ ID NO: 8316006 - DNA, 22 bp, Homo sapiens
atgcaacaatgtatttatgtat

SEQ ID NO: 8316007 - DNA, 19 bp, Homo sapiens
atgcaacaaaagtgtaaga

SEQ ID NO: 8316008 - DNA, 22 bp, Homo sapiens
atgcaacaaattgtgtgcaata

SEQ ID NO: 8316009 - DNA, 22 bp, Homo sapiens
atgcaacaaatgctacgaatcg

SEQ ID NO: 8316010 - DNA, 22 bp, Homo sapiens
atgctgaggtgtgtttaattta

SEQ ID NO: 8316011 - DNA, 21 bp, Homo sapiens
atcttaaaaggtcttaacttt

SEQ ID NO: 8316012 - DNA, 22 bp, Homo sapiens
atcttagacccttggtagaaaa

SEQ ID NO: 8316013 - DNA, 22 bp, Homo sapiens
atcttagaagtttgataaaatc

SEQ ID NO: 8316014 - DNA, 22 bp, Homo sapiens
atgacaatacttcaataagctg

SEQ ID NO: 8316015 - DNA, 22 bp, Homo sapiens
atgactcagaagatattttcca

SEQ ID NO: 8316016 - DNA, 22 bp, Homo sapiens
atgactcaaaattattgttttg

SEQ ID NO: 8316017 - DNA, 22 bp, Homo sapiens
atgatttccagttgttgctaag

SEQ ID NO: 8316018 - DNA, 22 bp, Homo sapiens
atgatttaaagtcattgtgaac

SEQ ID NO: 8316019 - DNA, 20 bp, Homo sapiens
atgattcatgatgatgtctc

SEQ ID NO: 8316020 - DNA, 22 bp, Homo sapiens
atgagaaaattgaggcccatag

SEQ ID NO: 8316021 - DNA, 18 bp, Homo sapiens
agagatggtgtagagttt

SEQ ID NO: 8316022 - DNA, 22 bp, Homo sapiens
atgttcccaagggatagaaaga

SEQ ID NO: 8316023 - DNA, 22 bp, Homo sapiens
agagcctgttttgtgggagatg

SEQ ID NO: 8316024 - DNA, 22 bp, Homo sapiens
atgttctacagatggaaagggg

SEQ ID NO: 8316025 - DNA, 22 bp, Homo sapiens
agagcggggatagttaatattc

SEQ ID NO: 8316026 - DNA, 21 bp, Homo sapiens
agagctcaaggcaaaaataat

SEQ ID NO: 8316027 - DNA, 22 bp, Homo sapiens
attaaatactgcaggctaagca

SEQ ID NO: 8316028 - DNA, 22 bp, Homo sapiens
attaaatactgcaggctaagca

SEQ ID NO: 8316029 - DNA, 22 bp, Homo sapiens
atgtagtttggggctagattta

SEQ ID NO: 8316030 - DNA, 22 bp, Homo sapiens
atgtagttgaagtgctataaag

SEQ ID NO: 8316031 - DNA, 22 bp, Homo sapiens
atgtatatgaagctagtatttt

SEQ ID NO: 8316032 - DNA, 22 bp, Homo sapiens
atgtataatgctaattagctag

SEQ ID NO: 8316033 - DNA, 22 bp, Homo sapiens
agagatggcgtctcagagcctg

SEQ ID NO: 8316034 - DNA, 22 bp, Homo sapiens
agagatgggcgggggcttctgc

SEQ ID NO: 8316035 - DNA, 22 bp, Homo sapiens
agagatggtagaacagtcataa

SEQ ID NO: 8316036 - DNA, 20 bp, Homo sapiens
agagatggggtatcaccgta

SEQ ID NO: 8316037 - DNA, 18 bp, Homo sapiens
agagatgggagttggaaa

SEQ ID NO: 8316038 - DNA, 22 bp, Homo sapiens
agagatgggaaggcagacttca

SEQ ID NO: 8316039 - DNA, 22 bp, Homo sapiens
atggacaggtactgcagtgggt

SEQ ID NO: 8316040 - DNA, 21 bp, Homo sapiens
agatgaggatactgaggccta

SEQ ID NO: 8316041 - DNA, 22 bp, Homo sapiens
atttgaatgcaggtagctgagt

SEQ ID NO: 8316042 - DNA, 22 bp, Homo sapiens
atttacagccttgccatctata

SEQ ID NO: 8316043 - DNA, 22 bp, Homo sapiens
atttacaggacagcttggcatt

SEQ ID NO: 8316044 - DNA, 23 bp, Homo sapiens
atttacagctgtgtgagcaagtt

SEQ ID NO: 8316045 - DNA, 23 bp, Homo sapiens
atttacagctgtgtgagcaagtt

SEQ ID NO: 8316046 - DNA, 22 bp, Homo sapiens
agatttatgtggtcacactcag

SEQ ID NO: 8316047 - DNA, 22 bp, Homo sapiens
attttggcaacagccatgagcc

SEQ ID NO: 8316048 - DNA, 22 bp, Homo sapiens
agattcaggactggccacagcc

SEQ ID NO: 8316049 - DNA, 22 bp, Homo sapiens
agcaatgcttattgctgactat

SEQ ID NO: 8316050 - DNA, 22 bp, Homo sapiens
caaataattactatcctcactt

SEQ ID NO: 8316051 - DNA, 22 bp, Homo sapiens
caaataattactatcctcactt

SEQ ID NO: 8316052 - DNA, 22 bp, Homo sapiens
caaagtgctgggattacaggtg

SEQ ID NO: 8316053 - DNA, 22 bp, Homo sapiens
caaagtgctgggattataggca

SEQ ID NO: 8316054 - DNA, 22 bp, Homo sapiens
caaagtgctgggattagtgctg

SEQ ID NO: 8316055 - DNA, 22 bp, Homo sapiens
caaagtgctgggattacaggct

SEQ ID NO: 8316056 - DNA, 22 bp, Homo sapiens
caaagtgctgggattacaggtg

SEQ ID NO: 8316057 - DNA, 22 bp, Homo sapiens
agcaatatgacattgctacatc

SEQ ID NO: 8316058 - DNA, 22 bp, Homo sapiens
agcaataatttaggcctttcct

SEQ ID NO: 8316059 - DNA, 23 bp, Homo sapiens
attttttgtctttgtaactagat

SEQ ID NO: 8316060 - DNA, 22 bp, Homo sapiens
agcaataacagaaaactttcct

SEQ ID NO: 8316061 - DNA, 20 bp, Homo sapiens
attttgtttatgttcctctc

SEQ ID NO: 8316062 - DNA, 22 bp, Homo sapiens
attttgttatagaactctgtga

SEQ ID NO: 8316063 - DNA, 22 bp, Homo sapiens
attttgttatagaactctgtga

SEQ ID NO: 8316064 - DNA, 22 bp, Homo sapiens
attttgttatcagggctttgca

SEQ ID NO: 8316065 - DNA, 22 bp, Homo sapiens
attgttaaactgaagcattact

SEQ ID NO: 8316066 - DNA, 22 bp, Homo sapiens
attgtattagcacaatacaatt

SEQ ID NO: 8316067 - DNA, 22 bp, Homo sapiens
attgtattagcacaatacaatt

SEQ ID NO: 8316068 - DNA, 22 bp, Homo sapiens
attgtatttccagcttgaatgt

SEQ ID NO: 8316069 - DNA, 22 bp, Homo sapiens
agatacaactgtttaaacatta

SEQ ID NO: 8316070 - DNA, 22 bp, Homo sapiens
agatacaaggcagagatgtgca

SEQ ID NO: 8316071 - DNA, 22 bp, Homo sapiens
agatacagaagtttttccctat

SEQ ID NO: 8316072 - DNA, 22 bp, Homo sapiens
attgaaaatataattctaggag

SEQ ID NO: 8316073 - DNA, 22 bp, Homo sapiens
attgaaaaatgactattgctta

SEQ ID NO: 8316074 - DNA, 22 bp, Homo sapiens
attgaaaataaggccagaaaca

SEQ ID NO: 8316075 - DNA, 22 bp, Homo sapiens
attgagaaaggcttatgtttgc

SEQ ID NO: 8316076 - DNA, 22 bp, Homo sapiens
attgtatacaagcttaattgtt

SEQ ID NO: 8316077 - DNA, 22 bp, Homo sapiens
attgtataagtctatttacaat

SEQ ID NO: 8316078 - DNA, 22 bp, Homo sapiens
attgtataagtctatttacaat

SEQ ID NO: 8316079 - DNA, 22 bp, Homo sapiens
agaggcctaaccaagatgtcct

SEQ ID NO: 8316080 - DNA, 22 bp, Homo sapiens
agaggccctgggctggtgtgct

SEQ ID NO: 8316081 - DNA, 22 bp, Homo sapiens
agaggccctggctagagcagct

SEQ ID NO: 8316082 - DNA, 22 bp, Homo sapiens
attatttctcactcacataata

SEQ ID NO: 8316083 - DNA, 22 bp, Homo sapiens
attatttctcactcacataata

SEQ ID NO: 8316084 - DNA, 22 bp, Homo sapiens
attattttatgtgcggcctgat

SEQ ID NO: 8316085 - DNA, 22 bp, Homo sapiens
attattttatgtgcggcctgat

SEQ ID NO: 8316086 - DNA, 22 bp, Homo sapiens
agaggccctctctgctcagtct

SEQ ID NO: 8316087 - DNA, 22 bp, Homo sapiens
attaataaaataccactttgtt

SEQ ID NO: 8316088 - DNA, 22 bp, Homo sapiens
attaataaaataccactttgtt

SEQ ID NO: 8316089 - DNA, 22 bp, Homo sapiens
attcgacaaccttgttttgtac

SEQ ID NO: 8316090 - DNA, 22 bp, Homo sapiens
attcccaccaagcaggccatgc

SEQ ID NO: 8316091 - DNA, 22 bp, Homo sapiens
attcccactagctctttataga

SEQ ID NO: 8316092 - DNA, 22 bp, Homo sapiens
attcaaagaacctttagcattg

SEQ ID NO: 8316093 - DNA, 22 bp, Homo sapiens
attcaaaagaccatgcagactc

SEQ ID NO: 8316094 - DNA, 22 bp, Homo sapiens
attcaaaagaccatgcagactc

SEQ ID NO: 8316095 - DNA, 22 bp, Homo sapiens
attctaagcacgctgaagtctt

SEQ ID NO: 8316096 - DNA, 22 bp, Homo sapiens
attctccctgttcctcgacacc

SEQ ID NO: 8316097 - DNA, 22 bp, Homo sapiens
attgaaaaatgactattgctta

SEQ ID NO: 8316098 - DNA, 22 bp, Homo sapiens
attctctgaagtcaatggaaat

SEQ ID NO: 8316099 - DNA, 22 bp, Homo sapiens
aaatatttgtctgaggcggttg

SEQ ID NO: 8316100 - DNA, 22 bp, Homo sapiens
aaatatttgtctgaggcggttg

SEQ ID NO: 8316101 - DNA, 23 bp, Homo sapiens
aaatgacatatggtttctgaagg

SEQ ID NO: 8316102 - DNA, 22 bp, Homo sapiens
aaatgactaatgatcctgggca

SEQ ID NO: 8316103 - DNA, 20 bp, Homo sapiens
aaatgcttttgacacatatt

SEQ ID NO: 8316104 - DNA, 23 bp, Homo sapiens
aaatgccagggagacaggaacca

SEQ ID NO: 8316105 - DNA, 22 bp, Homo sapiens
aaatgccaggattattagaggc

SEQ ID NO: 8316106 - DNA, 22 bp, Homo sapiens
aaatgccagcacacgtctgtgg

SEQ ID NO: 8316107 - DNA, 22 bp, Homo sapiens
aaatgccaaggagagactgtta

SEQ ID NO: 8316108 - DNA, 22 bp, Homo sapiens
aaatgcacagaaaggatgtgga

SEQ ID NO: 8316109 - DNA, 22 bp, Homo sapiens
aagagagagcattcttctgtta

SEQ ID NO: 8316110 - DNA, 22 bp, Homo sapiens
aagagagagtgcgctcacagaa

SEQ ID NO: 8316111 - DNA, 22 bp, Homo sapiens
aagaaggcggaccagaagggag

SEQ ID NO: 8316112 - DNA, 22 bp, Homo sapiens
aaatacaaaaattagccaggca

SEQ ID NO: 8316113 - DNA, 22 bp, Homo sapiens
aaatacatacactgtacgtggc

SEQ ID NO: 8316114 - DNA, 22 bp, Homo sapiens
aagagagaagtctctctggttc

SEQ ID NO: 8316115 - DNA, 22 bp, Homo sapiens
aagagagaagtctctctggttc

SEQ ID NO: 8316116 - DNA, 22 bp, Homo sapiens
aaatacagtgtgtgttctttga

SEQ ID NO: 8316117 - DNA, 22 bp, Homo sapiens
aaattccattatgataatttcg

SEQ ID NO: 8316118 - DNA, 22 bp, Homo sapiens
aaagacatgacacattggagag

SEQ ID NO: 8316119 - DNA, 22 bp, Homo sapiens
aacatgaagttttctatagtga

SEQ ID NO: 8316120 - DNA, 22 bp, Homo sapiens
aaaggaggccacatggctagga

SEQ ID NO: 8316121 - DNA, 22 bp, Homo sapiens
aaagtcttcacggcactagtgt

SEQ ID NO: 8316122 - DNA, 22 bp, Homo sapiens
aaagtctgaaagataagagtga

SEQ ID NO: 8316123 - DNA, 22 bp, Homo sapiens
aacttcctgacttctaatgagt

SEQ ID NO: 8316124 - DNA, 22 bp, Homo sapiens
aacttccttctagttcatatgt

SEQ ID NO: 8316125 - DNA, 22 bp, Homo sapiens
aacttccttgggtatgaaaaca

SEQ ID NO: 8316126 - DNA, 22 bp, Homo sapiens
aaagtcctagcgatccacagaa

SEQ ID NO: 8316127 - DNA, 22 bp, Homo sapiens
aaagtccttgcagtttcctctt

SEQ ID NO: 8316128 - DNA, 22 bp, Homo sapiens
aaagttacacatctagtaagtg

SEQ ID NO: 8316129 - DNA, 22 bp, Homo sapiens
aaagttacacatctagtaagtg

SEQ ID NO: 8316130 - DNA, 19 bp, Homo sapiens
aaagttctgactgtagagc

SEQ ID NO: 8316131 - DNA, 22 bp, Homo sapiens
aaaggctctaacaaggagagag

SEQ ID NO: 8316132 - DNA, 22 bp, Homo sapiens
aaaggctatgagatagaagata

SEQ ID NO: 8316133 - DNA, 22 bp, Homo sapiens
aaaggctcacgcagttagtgat

SEQ ID NO: 8316134 - DNA, 22 bp, Homo sapiens
aacatgagtgataaaattacct

SEQ ID NO: 8316135 - DNA, 22 bp, Homo sapiens
aaaggcttaacagaagaccttt

SEQ ID NO: 8316136 - DNA, 22 bp, Homo sapiens
aaaggcttgcgattccttgtaa

SEQ ID NO: 8316137 - DNA, 22 bp, Homo sapiens
aaaggcttctttgctccatgtc

SEQ ID NO: 8316138 - DNA, 22 bp, Homo sapiens
aaaggcttttggtatataggag

SEQ ID NO: 8316139 - DNA, 22 bp, Homo sapiens
aaaaatgaaacggctggttggc

SEQ ID NO: 8316140 - DNA, 22 bp, Homo sapiens
aaaacacaagaagcagggtaca

SEQ ID NO: 8316141 - DNA, 22 bp, Homo sapiens
aaaaccaggcgtttcctattat

SEQ ID NO: 8316142 - DNA, 22 bp, Homo sapiens
aaaagagtcttaggcagtcata

SEQ ID NO: 8316143 - DNA, 22 bp, Homo sapiens
aaaacattgaattgcacactat

SEQ ID NO: 8316144 - DNA, 22 bp, Homo sapiens
aaaagccatgcatacctaagag

SEQ ID NO: 8316145 - DNA, 22 bp, Homo sapiens
aaaagccaaggtcctcttcaga

SEQ ID NO: 8316146 - DNA, 22 bp, Homo sapiens
aaaagcatctcaaaggagcttc

SEQ ID NO: 8316147 - DNA, 22 bp, Homo sapiens
aaaatgtaaagcttgagtgtag

SEQ ID NO: 8316148 - DNA, 22 bp, Homo sapiens
aaaatgggtttcttcaacctca

SEQ ID NO: 8316149 - DNA, 22 bp, Homo sapiens
aaaatgtaaagcttgagtgtag

SEQ ID NO: 8316150 - DNA, 22 bp, Homo sapiens
aaaatgcatgagaatgtgctcg

SEQ ID NO: 8316151 - DNA, 22 bp, Homo sapiens
aaaatgaggtcaatatcctttt

SEQ ID NO: 8316152 - DNA, 22 bp, Homo sapiens
aaaatgaggtcaatatcctttt

SEQ ID NO: 8316153 - DNA, 22 bp, Homo sapiens
aaaatgatatcctgacttttat

SEQ ID NO: 8316154 - DNA, 22 bp, Homo sapiens
aaaatgaggaacggatcatggc

SEQ ID NO: 8316155 - DNA, 20 bp, Homo sapiens
aaaatgatgggcagggcagg

SEQ ID NO: 8316156 - DNA, 22 bp, Homo sapiens
aaaatgatgctgtaatttggca

SEQ ID NO: 8316157 - DNA, 22 bp, Homo sapiens
aaaagctttgttaataggtttg

SEQ ID NO: 8316158 - DNA, 21 bp, Homo sapiens
aaaaggaaggtctgtttgggg

SEQ ID NO: 8316159 - DNA, 19 bp, Homo sapiens
aaaaggaatattctttggg

SEQ ID NO: 8316160 - DNA, 19 bp, Homo sapiens
aaaaggaatattctttggg

SEQ ID NO: 8316161 - DNA, 22 bp, Homo sapiens
aaaagttcattagtgagcttct

SEQ ID NO: 8316162 - DNA, 22 bp, Homo sapiens
aaaagttacctctgtaatataa

SEQ ID NO: 8316163 - DNA, 22 bp, Homo sapiens
aaaagttacctctgtaatataa

SEQ ID NO: 8316164 - DNA, 22 bp, Homo sapiens
aaaatactactgtcttcttccc

SEQ ID NO: 8316165 - DNA, 22 bp, Homo sapiens
aaaatactgtggagtgttgaaa

SEQ ID NO: 8316166 - DNA, 22 bp, Homo sapiens
aaaatactactgtcttcttccc

SEQ ID NO: 8316167 - DNA, 22 bp, Homo sapiens
aaaatgagcatattgatccttt

SEQ ID NO: 8316168 - DNA, 22 bp, Homo sapiens
aaaatgagcatattgatccttt

SEQ ID NO: 8316169 - DNA, 22 bp, Homo sapiens
aaaatgagacacatgtgactcc

SEQ ID NO: 8316170 - DNA, 22 bp, Homo sapiens
aaaatgagacacatgtgactcc

SEQ ID NO: 8316171 - DNA, 22 bp, Homo sapiens
aaaataacttctactatttgca

SEQ ID NO: 8316172 - DNA, 22 bp, Homo sapiens
aaagacatatttctaagtttat

SEQ ID NO: 8316173 - DNA, 22 bp, Homo sapiens
aaagacacatgtctcttagatt

SEQ ID NO: 8316174 - DNA, 22 bp, Homo sapiens
aaatgtctgtaggggctgcagg

SEQ ID NO: 8316175 - DNA, 23 bp, Homo sapiens
aaacttcagtagtgtcatcagcc

SEQ ID NO: 8316176 - DNA, 22 bp, Homo sapiens
aaacttcagtgaatgacttatg

SEQ ID NO: 8316177 - DNA, 21 bp, Homo sapiens
aaatgaatgtggtagtgcaag

SEQ ID NO: 8316178 - DNA, 21 bp, Homo sapiens
aaatgaatgtggtagtgcaag

SEQ ID NO: 8316179 - DNA, 22 bp, Homo sapiens
aaatgacaataaaagtccatgc

SEQ ID NO: 8316180 - DNA, 22 bp, Homo sapiens
aaatgacactcattcagtgtca

SEQ ID NO: 8316181 - DNA, 22 bp, Homo sapiens
aaatgacactcattcagtgtca

SEQ ID NO: 8316182 - DNA, 22 bp, Homo sapiens
aaatgacagagctgggactagt

SEQ ID NO: 8316183 - DNA, 22 bp, Homo sapiens
aaatgacactcattcagtgtca

SEQ ID NO: 8316184 - DNA, 22 bp, Homo sapiens
aaatgacagagtaagctgttta

SEQ ID NO: 8316185 - DNA, 22 bp, Homo sapiens
aaatgacagttctctctgagta

SEQ ID NO: 8316186 - DNA, 22 bp, Homo sapiens
aaatacagagttgcttaaaagc

SEQ ID NO: 8316187 - DNA, 22 bp, Homo sapiens
aaatacagattccagggtctta

SEQ ID NO: 8316188 - DNA, 21 bp, Homo sapiens
aaatacagatgcaaatctgtt

SEQ ID NO: 8316189 - DNA, 22 bp, Homo sapiens
aaatacacgtacatgtgtaaaa

SEQ ID NO: 8316190 - DNA, 22 bp, Homo sapiens
aaataaaggaactgttttccca

SEQ ID NO: 8316191 - DNA, 22 bp, Homo sapiens
aaagttccttttatagacatga

SEQ ID NO: 8316192 - DNA, 22 bp, Homo sapiens
aaataaactgaagcacagagag

SEQ ID NO: 8316193 - DNA, 22 bp, Homo sapiens
aaagtttttaagcaagaccctt

SEQ ID NO: 8316194 - DNA, 22 bp, Homo sapiens
aaagttttctgccttcattaga

SEQ ID NO: 8316195 - DNA, 19 bp, Homo sapiens
aaagttttattctcatttg

SEQ ID NO: 8316196 - DNA, 22 bp, Homo sapiens
aaagttttctgccttcattaga

SEQ ID NO: 8316197 - DNA, 22 bp, Homo sapiens
aaagtacatgcaattcttctga

SEQ ID NO: 8316198 - DNA, 22 bp, Homo sapiens
aaagtacatagcatattccaac

SEQ ID NO: 8316199 - DNA, 22 bp, Homo sapiens
aaagtacatgagattcaagggg

SEQ ID NO: 8316200 - DNA, 22 bp, Homo sapiens
aaagtacatagcatattccaac

SEQ ID NO: 8316201 - DNA, 22 bp, Homo sapiens
aaagtacagatggtgaggttgg

SEQ ID NO: 8316202 - DNA, 22 bp, Homo sapiens
aaagtacaggaaagcctagcca

SEQ ID NO: 8316203 - DNA, 22 bp, Homo sapiens
aaagtacagccacatccaagta

SEQ ID NO: 8316204 - DNA, 22 bp, Homo sapiens
aaagtacacacagagccaagaa

SEQ ID NO: 8316205 - DNA, 22 bp, Homo sapiens
aaagtacaaggaaaggatctga

SEQ ID NO: 8316206 - DNA, 22 bp, Homo sapiens
aaagctcacagtaatacaaggc

SEQ ID NO: 8316207 - DNA, 22 bp, Homo sapiens
aaagctctcccactgtatgaag

SEQ ID NO: 8316208 - DNA, 22 bp, Homo sapiens
aaagctctgggaatgcttatct

SEQ ID NO: 8316209 - DNA, 22 bp, Homo sapiens
aaaattgtcagaagttgatctt

SEQ ID NO: 8316210 - DNA, 22 bp, Homo sapiens
aaaattgtgaaggtttctgaaa

SEQ ID NO: 8316211 - DNA, 22 bp, Homo sapiens
aaaattttcagcttgacttgat

SEQ ID NO: 8316212 - DNA, 22 bp, Homo sapiens
aaaattttcagcttgacttgat

SEQ ID NO: 8316213 - DNA, 22 bp, Homo sapiens
aaaattttactggtgtttcctt

SEQ ID NO: 8316214 - DNA, 22 bp, Homo sapiens
aaaattttgccctatccttcat

SEQ ID NO: 8316215 - DNA, 22 bp, Homo sapiens
aaagccagggacagtgtgcatg

SEQ ID NO: 8316216 - DNA, 22 bp, Homo sapiens
aaatggatctttttataatgca

SEQ ID NO: 8316217 - DNA, 22 bp, Homo sapiens
aaggagggaaagcagtgcttct

SEQ ID NO: 8316218 - DNA, 22 bp, Homo sapiens
aaggagggttcccaggtcctgg

SEQ ID NO: 8316219 - DNA, 22 bp, Homo sapiens
aaatggatgttgagttaaatgt

SEQ ID NO: 8316220 - DNA, 22 bp, Homo sapiens
aaatggatggaattgacattta

SEQ ID NO: 8316221 - DNA, 21 bp, Homo sapiens
aaggtctgtaaagtgacagga

SEQ ID NO: 8316222 - DNA, 22 bp, Homo sapiens
aagggcagggagtttgtgtcta

SEQ ID NO: 8316223 - DNA, 22 bp, Homo sapiens
aagtaacaggtgcttagtttat

SEQ ID NO: 8316224 - DNA, 20 bp, Homo sapiens
aaggttactgaaatccatta

SEQ ID NO: 8316225 - DNA, 22 bp, Homo sapiens
aagtaagtggctattagctgtg

SEQ ID NO: 8316226 - DNA, 22 bp, Homo sapiens
aagtaagtttctctctccaaga

SEQ ID NO: 8316227 - DNA, 22 bp, Homo sapiens
aagtctttttgaatctataact

SEQ ID NO: 8316228 - DNA, 22 bp, Homo sapiens
aagtgcattagatagaatgatg

SEQ ID NO: 8316229 - DNA, 22 bp, Homo sapiens
aagtgcatggtatggtctccat

SEQ ID NO: 8316230 - DNA, 22 bp, Homo sapiens
aagtgcatatttttgttgtaga

SEQ ID NO: 8316231 - DNA, 22 bp, Homo sapiens
aagtgcatcactactcattaca

SEQ ID NO: 8316232 - DNA, 21 bp, Homo sapiens
aagtgccacccacagatgcat

SEQ ID NO: 8316233 - DNA, 22 bp, Homo sapiens
aagtgcctgggcaacatagcaa

SEQ ID NO: 8316234 - DNA, 22 bp, Homo sapiens
aagtcttttgctaagagtaatg

SEQ ID NO: 8316235 - DNA, 22 bp, Homo sapiens
aacagtaagagatgttttatct

SEQ ID NO: 8316236 - DNA, 22 bp, Homo sapiens
aacagtaacgagatgtcctaac

SEQ ID NO: 8316237 - DNA, 17 bp, Homo sapiens
aacagtaagccctgttt

SEQ ID NO: 8316238 - DNA, 22 bp, Homo sapiens
aacagtgctgattattttacct

SEQ ID NO: 8316239 - DNA, 22 bp, Homo sapiens
aagtgctgtttctgatgaatgc

SEQ ID NO: 8316240 - DNA, 22 bp, Homo sapiens
aagtgctgtacagtgtgtaaat

SEQ ID NO: 8316241 - DNA, 22 bp, Homo sapiens
aacagtgcttcattcacacatt

SEQ ID NO: 8316242 - DNA, 22 bp, Homo sapiens
aatatttctgcagaatggtttt

SEQ ID NO: 8316243 - DNA, 22 bp, Homo sapiens
aatatttctgtagctatgttct

SEQ ID NO: 8316244 - DNA, 22 bp, Homo sapiens
aatatttatatttctcttccct

SEQ ID NO: 8316245 - DNA, 22 bp, Homo sapiens
aatacagtaattttgatgagtt

SEQ ID NO: 8316246 - DNA, 22 bp, Homo sapiens
aatacatatggaattccatgtt

SEQ ID NO: 8316247 - DNA, 22 bp, Homo sapiens
aatatcctttccagagtacagt

SEQ ID NO: 8316248 - DNA, 22 bp, Homo sapiens
aagttacagtcagaggttaaca

SEQ ID NO: 8316249 - DNA, 22 bp, Homo sapiens
aagttacagttacagaatggag

SEQ ID NO: 8316250 - DNA, 22 bp, Homo sapiens
aagttacagttattatttaaaa

SEQ ID NO: 8316251 - DNA, 22 bp, Homo sapiens
aagttacatattcttgggctat

SEQ ID NO: 8316252 - DNA, 22 bp, Homo sapiens
aagttacagttggaactgtgaa

SEQ ID NO: 8316253 - DNA, 22 bp, Homo sapiens
aagttacacagagttggaggct

SEQ ID NO: 8316254 - DNA, 21 bp, Homo sapiens
aacagttctctttgaaggtgt

SEQ ID NO: 8316255 - DNA, 22 bp, Homo sapiens
aataatgtacatacatatttcg

SEQ ID NO: 8316256 - DNA, 22 bp, Homo sapiens
aatacagatattcagtggtact

SEQ ID NO: 8316257 - DNA, 22 bp, Homo sapiens
aatctgtagggaacaactgtac

SEQ ID NO: 8316258 - DNA, 22 bp, Homo sapiens
aatctggacacagttctcatgc

SEQ ID NO: 8316259 - DNA, 22 bp, Homo sapiens
aatgaaatagttggctgtagag

SEQ ID NO: 8316260 - DNA, 22 bp, Homo sapiens
aatctctttggctcaaggatcc

SEQ ID NO: 8316261 - DNA, 22 bp, Homo sapiens
aatctcttgtatttcctttgac

SEQ ID NO: 8316262 - DNA, 22 bp, Homo sapiens
aatgcagaccagtatgaaaaac

SEQ ID NO: 8316263 - DNA, 22 bp, Homo sapiens
aatgcacatgccacatgtggta

SEQ ID NO: 8316264 - DNA, 22 bp, Homo sapiens
aatgcacatatatgtgtataca

SEQ ID NO: 8316265 - DNA, 22 bp, Homo sapiens
aatgcacagctaaagtggttcc

SEQ ID NO: 8316266 - DNA, 18 bp, Homo sapiens
aatgcacacatttactcc

SEQ ID NO: 8316267 - DNA, 22 bp, Homo sapiens
aatgaaatgtagcttatccata

SEQ ID NO: 8316268 - DNA, 22 bp, Homo sapiens
aatgaaatgaagatatgatcag

SEQ ID NO: 8316269 - DNA, 22 bp, Homo sapiens
aatgcagttgaatttgggtatg

SEQ ID NO: 8316270 - DNA, 22 bp, Homo sapiens
aatgctttagcagtgattagtg

SEQ ID NO: 8316271 - DNA, 22 bp, Homo sapiens
aatgctttaattgcatgtagtg

SEQ ID NO: 8316272 - DNA, 22 bp, Homo sapiens
aatgctttaattgcatgtagtg

SEQ ID NO: 8316273 - DNA, 21 bp, Homo sapiens
aacttgtatttctccttattc

SEQ ID NO: 8316274 - DNA, 20 bp, Homo sapiens
aacttgttttgttttctaat

SEQ ID NO: 8316275 - DNA, 22 bp, Homo sapiens
aacttgtttcttccattcaaca

SEQ ID NO: 8316276 - DNA, 22 bp, Homo sapiens
acaatgtaggctgaaaaagctt

SEQ ID NO: 8316277 - DNA, 22 bp, Homo sapiens
acaatgtagagtaaaatatgtt

SEQ ID NO: 8316278 - DNA, 22 bp, Homo sapiens
acaatgtcaaaataggaaacat

SEQ ID NO: 8316279 - DNA, 22 bp, Homo sapiens
acaatatagtccatgagcatgc

SEQ ID NO: 8316280 - DNA, 22 bp, Homo sapiens
acaatatacacatcctaatggg

SEQ ID NO: 8316281 - DNA, 22 bp, Homo sapiens
acaatatagtccatgagcatgc

SEQ ID NO: 8316282 - DNA, 22 bp, Homo sapiens
acaacaaaatcactagtcttcc

SEQ ID NO: 8316283 - DNA, 22 bp, Homo sapiens
acaaatttcataggcaaatttt

SEQ ID NO: 8316284 - DNA, 22 bp, Homo sapiens
acaaatttattgaagggcatat

SEQ ID NO: 8316285 - DNA, 22 bp, Homo sapiens
acaaattgttgggactcagccc

SEQ ID NO: 8316286 - DNA, 22 bp, Homo sapiens
acaaatttgtgtagttatggca

SEQ ID NO: 8316287 - DNA, 22 bp, Homo sapiens
acaaatttgtgtagttatggca

SEQ ID NO: 8316288 - DNA, 22 bp, Homo sapiens
acaaatttgaatcctgacttct

SEQ ID NO: 8316289 - DNA, 22 bp, Homo sapiens
acaaatttggtgagagtaaata

SEQ ID NO: 8316290 - DNA, 22 bp, Homo sapiens
acacagcaaggtctgactttgg

SEQ ID NO: 8316291 - DNA, 22 bp, Homo sapiens
aagataatgtgtctgtctttgc

SEQ ID NO: 8316292 - DNA, 22 bp, Homo sapiens
aagataatattcattaactaga

SEQ ID NO: 8316293 - DNA, 22 bp, Homo sapiens
acacagagcaaatcatgacaga

SEQ ID NO: 8316294 - DNA, 22 bp, Homo sapiens
acacagagccagggaatacagt

SEQ ID NO: 8316295 - DNA, 22 bp, Homo sapiens
acacagagccagggaatacagt

SEQ ID NO: 8316296 - DNA, 17 bp, Homo sapiens
acacagagattaacaca

SEQ ID NO: 8316297 - DNA, 17 bp, Homo sapiens
acacagagattaacaca

SEQ ID NO: 8316298 - DNA, 22 bp, Homo sapiens
acacacatgcctttcctaagta

SEQ ID NO: 8316299 - DNA, 22 bp, Homo sapiens
acacagaagctttttctattcc

SEQ ID NO: 8316300 - DNA, 22 bp, Homo sapiens
acaaaagtgagtgtgtctcaga

SEQ ID NO: 8316301 - DNA, 22 bp, Homo sapiens
aagaatcatctgaactttgagg

SEQ ID NO: 8316302 - DNA, 22 bp, Homo sapiens
aagaatatagattttttgaagt

SEQ ID NO: 8316303 - DNA, 22 bp, Homo sapiens
aagaatatctgttttatttagg

SEQ ID NO: 8316304 - DNA, 22 bp, Homo sapiens
acaaatatttactgaatccact

SEQ ID NO: 8316305 - DNA, 22 bp, Homo sapiens
aagaatctatggtacatccaag

SEQ ID NO: 8316306 - DNA, 22 bp, Homo sapiens
aagaatctccatctgattcact

SEQ ID NO: 8316307 - DNA, 22 bp, Homo sapiens
aagaatctgacataatttcctg

SEQ ID NO: 8316308 - DNA, 22 bp, Homo sapiens
aattttatctctaagcaggctt

SEQ ID NO: 8316309 - DNA, 22 bp, Homo sapiens
acaaaaattagctgggcatggt

SEQ ID NO: 8316310 - DNA, 22 bp, Homo sapiens
aagaagaagtgttatttttaga

SEQ ID NO: 8316311 - DNA, 22 bp, Homo sapiens
aagaactgtatcaagatgtagt

SEQ ID NO: 8316312 - DNA, 22 bp, Homo sapiens
aatgtacaataagacaaagagg

SEQ ID NO: 8316313 - DNA, 22 bp, Homo sapiens
aagcagggctagaccaagaaga

SEQ ID NO: 8316314 - DNA, 22 bp, Homo sapiens
aagcagggtcttcctcagttgg

SEQ ID NO: 8316315 - DNA, 18 bp, Homo sapiens
aagcagggtccattgtgc

SEQ ID NO: 8316316 - DNA, 22 bp, Homo sapiens
aagcaggcgagggcctggagca

SEQ ID NO: 8316317 - DNA, 23 bp, Homo sapiens
aagcagggagattcttagctgag

SEQ ID NO: 8316318 - DNA, 21 bp, Homo sapiens
aagcagggactgcccaggtcc

SEQ ID NO: 8316319 - DNA, 22 bp, Homo sapiens
aagcccataaaaagaggtccct

SEQ ID NO: 8316320 - DNA, 22 bp, Homo sapiens
aagcccattcggctgccctgca

SEQ ID NO: 8316321 - DNA, 22 bp, Homo sapiens
aagcccatgaaatggcctcaat

SEQ ID NO: 8316322 - DNA, 20 bp, Homo sapiens
aagcccattaccatgcttgg

SEQ ID NO: 8316323 - DNA, 23 bp, Homo sapiens
acagaaatcatttgtaaggtacc

SEQ ID NO: 8316324 - DNA, 22 bp, Homo sapiens
acagaaatgatgtttggcaata

SEQ ID NO: 8316325 - DNA, 22 bp, Homo sapiens
acagaaatgatgtttggcaata

SEQ ID NO: 8316326 - DNA, 22 bp, Homo sapiens
acagacatttaataaatgctga

SEQ ID NO: 8316327 - DNA, 23 bp, Homo sapiens
acagacattccataatgtacacc

SEQ ID NO: 8316328 - DNA, 23 bp, Homo sapiens
acagacattgtacatcttgtttt

SEQ ID NO: 8316329 - DNA, 22 bp, Homo sapiens
acagagatgaataatacaggtg

SEQ ID NO: 8316330 - DNA, 22 bp, Homo sapiens
acagagatgaataatacaggtg

SEQ ID NO: 8316331 - DNA, 20 bp, Homo sapiens
acagagatcctctctttatc

SEQ ID NO: 8316332 - DNA, 22 bp, Homo sapiens
acagactccccaggttatctca

SEQ ID NO: 8316333 - DNA, 22 bp, Homo sapiens
acagactcctttccatccgtgg

SEQ ID NO: 8316334 - DNA, 22 bp, Homo sapiens
acagagcaatgcgtgttctcta

SEQ ID NO: 8316335 - DNA, 22 bp, Homo sapiens
acagagcaacttgagtatcctc

SEQ ID NO: 8316336 - DNA, 22 bp, Homo sapiens
acagagatggcacagagaaggt

SEQ ID NO: 8316337 - DNA, 22 bp, Homo sapiens
acagagatgagtcaacacagct

SEQ ID NO: 8316338 - DNA, 22 bp, Homo sapiens
acagagatgtcagattggcagc

SEQ ID NO: 8316339 - DNA, 22 bp, Homo sapiens
acagagatggcttttcagaggc

SEQ ID NO: 8316340 - DNA, 22 bp, Homo sapiens
acacataagcctaatcatctcc

SEQ ID NO: 8316341 - DNA, 22 bp, Homo sapiens
acacataagcctaatcatctcc

SEQ ID NO: 8316342 - DNA, 22 bp, Homo sapiens
aagatacacgttgtattgaata

SEQ ID NO: 8316343 - DNA, 22 bp, Homo sapiens
aagatacacgttgtattgaata

SEQ ID NO: 8316344 - DNA, 22 bp, Homo sapiens
acacatataccactgtaaatga

SEQ ID NO: 8316345 - DNA, 22 bp, Homo sapiens
acacttgataggtcaaatcagt

SEQ ID NO: 8316346 - DNA, 22 bp, Homo sapiens
acacttgaggtttttaggtgcg

SEQ ID NO: 8316347 - DNA, 22 bp, Homo sapiens
acacttgaggaatgtggtgatt

SEQ ID NO: 8316348 - DNA, 20 bp, Homo sapiens
acacttgacaccagaaatgg

SEQ ID NO: 8316349 - DNA, 22 bp, Homo sapiens
acacttctctttgaagaacaat

SEQ ID NO: 8316350 - DNA, 21 bp, Homo sapiens
aatgtgtgctatttatctttt

SEQ ID NO: 8316351 - DNA, 22 bp, Homo sapiens
aatgtgtgaacactaatgcaac

SEQ ID NO: 8316352 - DNA, 22 bp, Homo sapiens
agagcaattagcttaggtaaaa

SEQ ID NO: 8316353 - DNA, 22 bp, Homo sapiens
agagaagggggaaagatctcac

SEQ ID NO: 8316354 - DNA, 22 bp, Homo sapiens
aatgtattatacataatttgtg

SEQ ID NO: 8316355 - DNA, 22 bp, Homo sapiens
agacatttattcacacatttat

SEQ ID NO: 8316356 - DNA, 22 bp, Homo sapiens
agacatggagaaggagccagtg

SEQ ID NO: 8316357 - DNA, 22 bp, Homo sapiens
aatgctgaatttagtatttatg

SEQ ID NO: 8316358 - DNA, 22 bp, Homo sapiens
aatgctctctgccatagctaac

SEQ ID NO: 8316359 - DNA, 22 bp, Homo sapiens
aatgccttggagagcctagagg

SEQ ID NO: 8316360 - DNA, 22 bp, Homo sapiens
agaggatgttctaggcactcat

SEQ ID NO: 8316361 - DNA, 23 bp, Homo sapiens
aatttcccctgtctctgatttgg

SEQ ID NO: 8316362 - DNA, 22 bp, Homo sapiens
agaggatgattttaaggacact

SEQ ID NO: 8316363 - DNA, 22 bp, Homo sapiens
agaggagtgggaagcagtgcaa

SEQ ID NO: 8316364 - DNA, 21 bp, Homo sapiens
agaggaagtgattggtctggc

SEQ ID NO: 8316365 - DNA, 22 bp, Homo sapiens
agagctggaagctgctcttaga

SEQ ID NO: 8316366 - DNA, 22 bp, Homo sapiens
aattaattttgttcattcagtc

SEQ ID NO: 8316367 - DNA, 22 bp, Homo sapiens
aattaattcagtttttaaggga

SEQ ID NO: 8316368 - DNA, 22 bp, Homo sapiens
agcacaggctttggtgtgaggg

SEQ ID NO: 8316369 - DNA, 22 bp, Homo sapiens
agcacaggctttggtgtgaggg

SEQ ID NO: 8316370 - DNA, 22 bp, Homo sapiens
agcacagggacaatgccaggtg

SEQ ID NO: 8316371 - DNA, 22 bp, Homo sapiens
acacaaattgtaggataattgc

SEQ ID NO: 8316372 - DNA, 22 bp, Homo sapiens
agcacaagtttctggcagacag

SEQ ID NO: 8316373 - DNA, 22 bp, Homo sapiens
agcaaggcagtcagctggctgg

SEQ ID NO: 8316374 - DNA, 22 bp, Homo sapiens
agcaaggcagtcagctggctgg

SEQ ID NO: 8316375 - DNA, 22 bp, Homo sapiens
agcaaaagatagattaacaaga

SEQ ID NO: 8316376 - DNA, 19 bp, Homo sapiens
agcaaatacatcaaaattg

SEQ ID NO: 8316377 - DNA, 22 bp, Homo sapiens
acaacattatacatagaaagct

SEQ ID NO: 8316378 - DNA, 22 bp, Homo sapiens
acaatagaaggaaactgacata

SEQ ID NO: 8316379 - DNA, 22 bp, Homo sapiens
acaatagaaggaaactgacata

SEQ ID NO: 8316380 - DNA, 22 bp, Homo sapiens
acaatagaaataattaagcaca

SEQ ID NO: 8316381 - DNA, 22 bp, Homo sapiens
acaatactattttcagtatcct

SEQ ID NO: 8316382 - DNA, 22 bp, Homo sapiens
agcaaatacttgaataaaaaga

SEQ ID NO: 8316383 - DNA, 19 bp, Homo sapiens
agcaaatataatagtgttc

SEQ ID NO: 8316384 - DNA, 22 bp, Homo sapiens
agagttcacactcagtgcaccc

SEQ ID NO: 8316385 - DNA, 22 bp, Homo sapiens
agagtgacagccactgcagtaa

SEQ ID NO: 8316386 - DNA, 20 bp, Homo sapiens
agagtgggtgtcacaggctg

SEQ ID NO: 8316387 - DNA, 22 bp, Homo sapiens
aatttgtacaaaatgtttataa

SEQ ID NO: 8316388 - DNA, 18 bp, Homo sapiens
aatttctttgacaactta

SEQ ID NO: 8316389 - DNA, 22 bp, Homo sapiens
aatttgattcagcaaatgttca

SEQ ID NO: 8316390 - DNA, 22 bp, Homo sapiens
aatttgattcagcaaatgttca

SEQ ID NO: 8316391 - DNA, 22 bp, Homo sapiens
aatttctcggttttgatattgt

SEQ ID NO: 8316392 - DNA, 22 bp, Homo sapiens
aatttctcggttttgatattgt

SEQ ID NO: 8316393 - DNA, 22 bp, Homo sapiens
aatttctccaagaatgcttaga

SEQ ID NO: 8316394 - DNA, 22 bp, Homo sapiens
aatttctcatggattcagttat

SEQ ID NO: 8316395 - DNA, 22 bp, Homo sapiens
aatttcttcagctctaaaatgg

SEQ ID NO: 8316396 - DNA, 22 bp, Homo sapiens
agagttctctctcatttgagct

SEQ ID NO: 8316397 - DNA, 20 bp, Homo sapiens
acaaagtattgaggacaagt

SEQ ID NO: 8316398 - DNA, 22 bp, Homo sapiens
agagttcagttgtagccatatt

SEQ ID NO: 8316399 - DNA, 22 bp, Homo sapiens
acaaagtgttttctgaaggcct

SEQ ID NO: 8316400 - DNA, 22 bp, Homo sapiens
acaaagtgtgcggagcccaggg

SEQ ID NO: 8316401 - DNA, 22 bp, Homo sapiens
agatgctgctccacaggccagg

SEQ ID NO: 8316402 - DNA, 22 bp, Homo sapiens
acaacagtaggaaaacatgtct

SEQ ID NO: 8316403 - DNA, 22 bp, Homo sapiens
acagaatactacagactggtta

SEQ ID NO: 8316404 - DNA, 23 bp, Homo sapiens
acagaataccattgactaggtgt

SEQ ID NO: 8316405 - DNA, 22 bp, Homo sapiens
acagaggccatgagctgccacc

SEQ ID NO: 8316406 - DNA, 17 bp, Homo sapiens
acagaggcaggagtgga

SEQ ID NO: 8316407 - DNA, 22 bp, Homo sapiens
acagaatatttggcatgcgtct

SEQ ID NO: 8316408 - DNA, 22 bp, Homo sapiens
acagaatattttatttagatca

SEQ ID NO: 8316409 - DNA, 22 bp, Homo sapiens
acagaatattgtaagtgccact

SEQ ID NO: 8316410 - DNA, 22 bp, Homo sapiens
acagaatattggttactgttgc

SEQ ID NO: 8316411 - DNA, 22 bp, Homo sapiens
acagaatattggttactgttgc

SEQ ID NO: 8316412 - DNA, 22 bp, Homo sapiens
acagaatagtagcttaaagtca

SEQ ID NO: 8316413 - DNA, 22 bp, Homo sapiens
acagaataggtacagtcagtca

SEQ ID NO: 8316414 - DNA, 22 bp, Homo sapiens
acagaatagtagcttaaagtca

SEQ ID NO: 8316415 - DNA, 22 bp, Homo sapiens
agcgggctcaagtggccagcag

SEQ ID NO: 8316416 - DNA, 22 bp, Homo sapiens
agcggctgtcggccagccggag

SEQ ID NO: 8316417 - DNA, 22 bp, Homo sapiens
agcgtggactgctgggcaaggt

SEQ ID NO: 8316418 - DNA, 22 bp, Homo sapiens
acagaggccccgtgggagagcc

SEQ ID NO: 8316419 - DNA, 22 bp, Homo sapiens
acagaggcctcgtaggtacaac

SEQ ID NO: 8316420 - DNA, 22 bp, Homo sapiens
acagaggcctcggcctgcccag

SEQ ID NO: 8316421 - DNA, 23 bp, Homo sapiens
acagaggcttaaatgagtggcag

SEQ ID NO: 8316422 - DNA, 22 bp, Homo sapiens
acagaggctgcgcttgggaacg

SEQ ID NO: 8316423 - DNA, 22 bp, Homo sapiens
acagagggtgtggaggaagacg

SEQ ID NO: 8316424 - DNA, 22 bp, Homo sapiens
acagagggtctgggcacaggac

SEQ ID NO: 8316425 - DNA, 22 bp, Homo sapiens
acagcagatttccctgggctcc

SEQ ID NO: 8316426 - DNA, 22 bp, Homo sapiens
acagcagatctggctacaggtt

SEQ ID NO: 8316427 - DNA, 22 bp, Homo sapiens
acagcagatctggctacaggtt

SEQ ID NO: 8316428 - DNA, 22 bp, Homo sapiens
acagcagagtgtgagatagcca

SEQ ID NO: 8316429 - DNA, 22 bp, Homo sapiens
acagcagagtggagatgagcac

SEQ ID NO: 8316430 - DNA, 19 bp, Homo sapiens
agcaggccacagggccagc

SEQ ID NO: 8316431 - DNA, 22 bp, Homo sapiens
acacagtttatggtattctgtt

SEQ ID NO: 8316432 - DNA, 22 bp, Homo sapiens
agcagggaagcctccagaacct

SEQ ID NO: 8316433 - DNA, 22 bp, Homo sapiens
acacagttcaggatcaaatagc

SEQ ID NO: 8316434 - DNA, 22 bp, Homo sapiens
acacagttcatgcatgaggtct

SEQ ID NO: 8316435 - DNA, 22 bp, Homo sapiens
acacagtttaaacgattagtac

SEQ ID NO: 8316436 - DNA, 22 bp, Homo sapiens
acacagttctttcactgttggt

SEQ ID NO: 8316437 - DNA, 22 bp, Homo sapiens
acacagttgattgtcactcagg

SEQ ID NO: 8316438 - DNA, 22 bp, Homo sapiens
agcagggactgagccagtggga

SEQ ID NO: 8316439 - DNA, 22 bp, Homo sapiens
acacatatgtcattgaaaaatc

SEQ ID NO: 8316440 - DNA, 22 bp, Homo sapiens
acacatcatgccaagtttcacc

SEQ ID NO: 8316441 - DNA, 22 bp, Homo sapiens
acacatctcaggggacactctc

SEQ ID NO: 8316442 - DNA, 22 bp, Homo sapiens
acacagtatcaaatttcatctt

SEQ ID NO: 8316443 - DNA, 22 bp, Homo sapiens
acacagtattgtgactataact

SEQ ID NO: 8316444 - DNA, 22 bp, Homo sapiens
acacacaattagttttatgctt

SEQ ID NO: 8316445 - DNA, 22 bp, Homo sapiens
acacaatgtgcaggacacctgt

SEQ ID NO: 8316446 - DNA, 22 bp, Homo sapiens
acacaataaatttatcctttga

SEQ ID NO: 8316447 - DNA, 22 bp, Homo sapiens
acacaagattgtgtattgaatt

SEQ ID NO: 8316448 - DNA, 22 bp, Homo sapiens
agccagaggaagcctggccctc

SEQ ID NO: 8316449 - DNA, 23 bp, Homo sapiens
acacttcacccattgtgatagga

SEQ ID NO: 8316450 - DNA, 22 bp, Homo sapiens
acactgttccacactaagaagg

SEQ ID NO: 8316451 - DNA, 22 bp, Homo sapiens
acacttaagcatgaagtataaa

SEQ ID NO: 8316452 - DNA, 22 bp, Homo sapiens
agccaaggcagctagagctctg

SEQ ID NO: 8316453 - DNA, 22 bp, Homo sapiens
acactgtgtgacttctgagact

SEQ ID NO: 8316454 - DNA, 20 bp, Homo sapiens
aagttttctccaaatacagt

SEQ ID NO: 8316455 - DNA, 22 bp, Homo sapiens
actgcagtcatcatctccctgg

SEQ ID NO: 8316456 - DNA, 22 bp, Homo sapiens
actgcactccagcctgggtgac

SEQ ID NO: 8316457 - DNA, 22 bp, Homo sapiens
actgaaaatgaattagaaacag

SEQ ID NO: 8316458 - DNA, 22 bp, Homo sapiens
actgaaaaagtatgattcactg

SEQ ID NO: 8316459 - DNA, 22 bp, Homo sapiens
actgaaaaagtatgattcactg

SEQ ID NO: 8316460 - DNA, 22 bp, Homo sapiens
aagttcaatggaaaagctttag

SEQ ID NO: 8316461 - DNA, 22 bp, Homo sapiens
aagttcaatcagatgaaaaagc

SEQ ID NO: 8316462 - DNA, 22 bp, Homo sapiens
aagttcaagtgtaatctttatt

SEQ ID NO: 8316463 - DNA, 22 bp, Homo sapiens
aagttcaagtctgcatcttttt

SEQ ID NO: 8316464 - DNA, 22 bp, Homo sapiens
acctgcctcagtgcagctggat

SEQ ID NO: 8316465 - DNA, 22 bp, Homo sapiens
aagtgtctgacacaaaatatgt

SEQ ID NO: 8316466 - DNA, 22 bp, Homo sapiens
aagtgtctgatggagcgaaatg

SEQ ID NO: 8316467 - DNA, 22 bp, Homo sapiens
aagtgtctttatatttgagaaa

SEQ ID NO: 8316468 - DNA, 22 bp, Homo sapiens
aagtgtgtttccgtgattgagg

SEQ ID NO: 8316469 - DNA, 22 bp, Homo sapiens
aagtgtgttttcagtgtactta

SEQ ID NO: 8316470 - DNA, 22 bp, Homo sapiens
aagtgtgttctctgataaactc

SEQ ID NO: 8316471 - DNA, 22 bp, Homo sapiens
aagtgtgtatttttcttcagtg

SEQ ID NO: 8316472 - DNA, 22 bp, Homo sapiens
actcttggccactcttggtgtc

SEQ ID NO: 8316473 - DNA, 22 bp, Homo sapiens
aagtgttatgtaggatttcaga

SEQ ID NO: 8316474 - DNA, 22 bp, Homo sapiens
actggggagtggttttgggaag

SEQ ID NO: 8316475 - DNA, 22 bp, Homo sapiens
actgtacaactgctgagcagaa

SEQ ID NO: 8316476 - DNA, 22 bp, Homo sapiens
actgtacacacttctctgtctt

SEQ ID NO: 8316477 - DNA, 22 bp, Homo sapiens
actgtcctagaacctgcagctc

SEQ ID NO: 8316478 - DNA, 22 bp, Homo sapiens
aatagaatgtaatctaatacat

SEQ ID NO: 8316479 - DNA, 22 bp, Homo sapiens
aatagcaaagttatcaaattaa

SEQ ID NO: 8316480 - DNA, 22 bp, Homo sapiens
aatagcaaagttatcaaattaa

SEQ ID NO: 8316481 - DNA, 22 bp, Homo sapiens
aatagcaaatgctcatttgaaa

SEQ ID NO: 8316482 - DNA, 22 bp, Homo sapiens
actggctgagtttatgttcaca

SEQ ID NO: 8316483 - DNA, 22 bp, Homo sapiens
actggctgatatggctaggaag

SEQ ID NO: 8316484 - DNA, 22 bp, Homo sapiens
aagttttgaaatactgaagtgt

SEQ ID NO: 8316485 - DNA, 20 bp, Homo sapiens
aataaaagaagccttcaccc

SEQ ID NO: 8316486 - DNA, 22 bp, Homo sapiens
aataaaatgaactggtagagtt

SEQ ID NO: 8316487 - DNA, 22 bp, Homo sapiens
aataaaatgaactggtagagtt

SEQ ID NO: 8316488 - DNA, 22 bp, Homo sapiens
aataaggtgtgggtgctaatat

SEQ ID NO: 8316489 - DNA, 22 bp, Homo sapiens
aataatacatgagattaatgtt

SEQ ID NO: 8316490 - DNA, 22 bp, Homo sapiens
aataatacatgagattaatgtt

SEQ ID NO: 8316491 - DNA, 22 bp, Homo sapiens
aataatactgcatgtaaggtgc

SEQ ID NO: 8316492 - DNA, 22 bp, Homo sapiens
aataatagcagagtttacaatc

SEQ ID NO: 8316493 - DNA, 22 bp, Homo sapiens
actggggagagtcatgccagca

SEQ ID NO: 8316494 - DNA, 22 bp, Homo sapiens
actggggaatggaactgggaat

SEQ ID NO: 8316495 - DNA, 22 bp, Homo sapiens
actttgttttcatgaaacagct

SEQ ID NO: 8316496 - DNA, 22 bp, Homo sapiens
actttgtttggctattagagtc

SEQ ID NO: 8316497 - DNA, 22 bp, Homo sapiens
aatagcttatgggatagatgtt

SEQ ID NO: 8316498 - DNA, 22 bp, Homo sapiens
aatagcatgttcatgataaaat

SEQ ID NO: 8316499 - DNA, 22 bp, Homo sapiens
aataggaagcaccaaattctcc

SEQ ID NO: 8316500 - DNA, 22 bp, Homo sapiens
aatagctttggtcaccatctgg

SEQ ID NO: 8316501 - DNA, 22 bp, Homo sapiens
aatcacagagtccagcagatga

SEQ ID NO: 8316502 - DNA, 22 bp, Homo sapiens
aatcacatcactgagaatgagg

SEQ ID NO: 8316503 - DNA, 22 bp, Homo sapiens
agaaactgacaggaaatgaatt

SEQ ID NO: 8316504 - DNA, 22 bp, Homo sapiens
agaaaggaggaagaatgacctc

SEQ ID NO: 8316505 - DNA, 22 bp, Homo sapiens
agaaggaaggaagcattctgtt

SEQ ID NO: 8316506 - DNA, 22 bp, Homo sapiens
aatgccaatgggcagaactaga

SEQ ID NO: 8316507 - DNA, 22 bp, Homo sapiens
aatgccaatattcatttgtgtt

SEQ ID NO: 8316508 - DNA, 22 bp, Homo sapiens
aatgccaacttggatatacatt

SEQ ID NO: 8316509 - DNA, 22 bp, Homo sapiens
aatgcattttattatatgtgac

SEQ ID NO: 8316510 - DNA, 22 bp, Homo sapiens
aatgcattagctacatatgtct

SEQ ID NO: 8316511 - DNA, 21 bp, Homo sapiens
aatgcattaacataaagctga

SEQ ID NO: 8316512 - DNA, 21 bp, Homo sapiens
aatgcattaacataaagctga

SEQ ID NO: 8316513 - DNA, 21 bp, Homo sapiens
aatgcattaacataaagctga

SEQ ID NO: 8316514 - DNA, 22 bp, Homo sapiens
agaacacacgtcagagtttcct

SEQ ID NO: 8316515 - DNA, 22 bp, Homo sapiens
aatgaagtgttatttagtttca

SEQ ID NO: 8316516 - DNA, 22 bp, Homo sapiens
aatgaagttctattcattttct

SEQ ID NO: 8316517 - DNA, 22 bp, Homo sapiens
aatgaagacacatctttctcat

SEQ ID NO: 8316518 - DNA, 22 bp, Homo sapiens
acatcctcccgatctactggct

SEQ ID NO: 8316519 - DNA, 17 bp, Homo sapiens
aaggcacagggcactgg

SEQ ID NO: 8316520 - DNA, 22 bp, Homo sapiens
aaggccagagtactagaggctg

SEQ ID NO: 8316521 - DNA, 22 bp, Homo sapiens
aaggccagagcgtgtcctgcct

SEQ ID NO: 8316522 - DNA, 22 bp, Homo sapiens
aaggccagattcactttacaat

SEQ ID NO: 8316523 - DNA, 22 bp, Homo sapiens
aaggacacctgcagagggacca

SEQ ID NO: 8316524 - DNA, 19 bp, Homo sapiens
aaggacacaacagagatag

SEQ ID NO: 8316525 - DNA, 22 bp, Homo sapiens
aaggatctgacagactatagaa

SEQ ID NO: 8316526 - DNA, 22 bp, Homo sapiens
aaggaaggaattgatcatgcgc

SEQ ID NO: 8316527 - DNA, 22 bp, Homo sapiens
aaggaagggaaatagtgatgtc

SEQ ID NO: 8316528 - DNA, 22 bp, Homo sapiens
aaggaaggttcatagtcaaaga

SEQ ID NO: 8316529 - DNA, 22 bp, Homo sapiens
aaggaaggtactcagtgattct

SEQ ID NO: 8316530 - DNA, 22 bp, Homo sapiens
acctctgcaatgcaatgtcatg

SEQ ID NO: 8316531 - DNA, 20 bp, Homo sapiens
acctcctggaagcaggtgcc

SEQ ID NO: 8316532 - DNA, 20 bp, Homo sapiens
acctagtacaatctgtttct

SEQ ID NO: 8316533 - DNA, 22 bp, Homo sapiens
acccaggggcagccttgctgtg

SEQ ID NO: 8316534 - DNA, 19 bp, Homo sapiens
acccaggggtttatgtgtg

SEQ ID NO: 8316535 - DNA, 22 bp, Homo sapiens
acccagggcttaaggcggtgca

SEQ ID NO: 8316536 - DNA, 22 bp, Homo sapiens
acccagggagtgctcctgttct

SEQ ID NO: 8316537 - DNA, 22 bp, Homo sapiens
aagtagacaataataagacatg

SEQ ID NO: 8316538 - DNA, 22 bp, Homo sapiens
acatttcagtgagctattgaag

SEQ ID NO: 8316539 - DNA, 22 bp, Homo sapiens
aagggtgcgacctaggagtgag

SEQ ID NO: 8316540 - DNA, 22 bp, Homo sapiens
aaggtacagttttaagaataag

SEQ ID NO: 8316541 - DNA, 22 bp, Homo sapiens
accagagcttacatgctagaaa

SEQ ID NO: 8316542 - DNA, 22 bp, Homo sapiens
accagatgctctggcgccttcc

SEQ ID NO: 8316543 - DNA, 22 bp, Homo sapiens
aagggggccacacctggtgtga

SEQ ID NO: 8316544 - DNA, 22 bp, Homo sapiens
aagggggcacagtcactgtaat

SEQ ID NO: 8316545 - DNA, 22 bp, Homo sapiens
aagggggcgaagacgtgattga

SEQ ID NO: 8316546 - DNA, 22 bp, Homo sapiens
aagggggcccagcactaagttg

SEQ ID NO: 8316547 - DNA, 22 bp, Homo sapiens
aagggggcccagcactaagttg

SEQ ID NO: 8316548 - DNA, 22 bp, Homo sapiens
aagggggccacacctggtgtga

SEQ ID NO: 8316549 - DNA, 22 bp, Homo sapiens
aagggggcggcagccagtggaa

SEQ ID NO: 8316550 - DNA, 22 bp, Homo sapiens
aagggggcggcagccagtggaa

SEQ ID NO: 8316551 - DNA, 22 bp, Homo sapiens
aagggggcggcagccagtggaa

SEQ ID NO: 8316552 - DNA, 22 bp, Homo sapiens
aagggggcgaagacgtgattga

SEQ ID NO: 8316553 - DNA, 22 bp, Homo sapiens
tcccatttcacaacaaaactgg

SEQ ID NO: 8316554 - DNA, 22 bp, Homo sapiens
tccccacactttcactcctggc

SEQ ID NO: 8316555 - DNA, 22 bp, Homo sapiens
tccccacatctctgcatcaggc

SEQ ID NO: 8316556 - DNA, 21 bp, Homo sapiens
tccccacatttctaaacagac

SEQ ID NO: 8316557 - DNA, 22 bp, Homo sapiens
tccccaggggcatctctctgct

SEQ ID NO: 8316558 - DNA, 22 bp, Homo sapiens
tccccagggctgcagagggtgt

SEQ ID NO: 8316559 - DNA, 22 bp, Homo sapiens
tcccagtttttctccactaagg

SEQ ID NO: 8316560 - DNA, 22 bp, Homo sapiens
tcccagtgggtgactggaggct

SEQ ID NO: 8316561 - DNA, 22 bp, Homo sapiens
tcccagtgaggtcctggctgtc

SEQ ID NO: 8316562 - DNA, 23 bp, Homo sapiens
tcccatgggctcactgccctgca

SEQ ID NO: 8316563 - DNA, 22 bp, Homo sapiens
tcccattctgccaaggacattg

SEQ ID NO: 8316564 - DNA, 22 bp, Homo sapiens
tcccacaggtggagcttgcagt

SEQ ID NO: 8316565 - DNA, 22 bp, Homo sapiens
tcccacagcttcgtgcttcccc

SEQ ID NO: 8316566 - DNA, 22 bp, Homo sapiens
tcccacaggcccagggcggaaa

SEQ ID NO: 8316567 - DNA, 21 bp, Homo sapiens
tcccacagaaactgcgaaatt

SEQ ID NO: 8316568 - DNA, 21 bp, Homo sapiens
tcccacagcgccagctcctgt

SEQ ID NO: 8316569 - DNA, 22 bp, Homo sapiens
tcccacagatgctgtccagagt

SEQ ID NO: 8316570 - DNA, 22 bp, Homo sapiens
tccatctggtaaaattcattga

SEQ ID NO: 8316571 - DNA, 22 bp, Homo sapiens
tccatccctgactcctcctgga

SEQ ID NO: 8316572 - DNA, 22 bp, Homo sapiens
tccagggctacaaggcaccaga

SEQ ID NO: 8316573 - DNA, 21 bp, Homo sapiens
tccagggcgggcgcacggaga

SEQ ID NO: 8316574 - DNA, 22 bp, Homo sapiens
tccagggcagggtgcgcatggg

SEQ ID NO: 8316575 - DNA, 19 bp, Homo sapiens
tccagggcaggaacatgta

SEQ ID NO: 8316576 - DNA, 22 bp, Homo sapiens
tccaggctggaaatgtcaaact

SEQ ID NO: 8316577 - DNA, 22 bp, Homo sapiens
tccaggctgccacagtgcaacg

SEQ ID NO: 8316578 - DNA, 22 bp, Homo sapiens
tccaggctgcagtcttgccctc

SEQ ID NO: 8316579 - DNA, 22 bp, Homo sapiens
tccagggccatgaagttgcaca

SEQ ID NO: 8316580 - DNA, 22 bp, Homo sapiens
tccagggccccccagttgcacg

SEQ ID NO: 8316581 - DNA, 22 bp, Homo sapiens
tccagggccacagaggatgcta

SEQ ID NO: 8316582 - DNA, 22 bp, Homo sapiens
tccaggctcagcacttgctact

SEQ ID NO: 8316583 - DNA, 22 bp, Homo sapiens
tccaggctcagcacttgctact

SEQ ID NO: 8316584 - DNA, 22 bp, Homo sapiens
tccaggctaggtttacaggaca

SEQ ID NO: 8316585 - DNA, 22 bp, Homo sapiens
tccaggctctcaggtgtcagca

SEQ ID NO: 8316586 - DNA, 22 bp, Homo sapiens
tccaggctctaggctgctctcc

SEQ ID NO: 8316587 - DNA, 22 bp, Homo sapiens
tccaggctgatccatgaagaat

SEQ ID NO: 8316588 - DNA, 21 bp, Homo sapiens
tccaggctgatgatgtcaact

SEQ ID NO: 8316589 - DNA, 22 bp, Homo sapiens
tccaggctgcaaggccacaggg

SEQ ID NO: 8316590 - DNA, 22 bp, Homo sapiens
tccaggctgcaaggccacaggg

SEQ ID NO: 8316591 - DNA, 23 bp, Homo sapiens
tccaggctgaaggagcagatttt

SEQ ID NO: 8316592 - DNA, 19 bp, Homo sapiens
tccaggctgagagtcagct

SEQ ID NO: 8316593 - DNA, 22 bp, Homo sapiens
tccaggctgacgcagctattta

SEQ ID NO: 8316594 - DNA, 22 bp, Homo sapiens
tccaggagtcctgggtggcccc

SEQ ID NO: 8316595 - DNA, 22 bp, Homo sapiens
tccaggagggttttctgccttc

SEQ ID NO: 8316596 - DNA, 22 bp, Homo sapiens
tccaggaggtgaggggaccaaa

SEQ ID NO: 8316597 - DNA, 21 bp, Homo sapiens
tccaggagtggctgggcaggg

SEQ ID NO: 8316598 - DNA, 19 bp, Homo sapiens
tccagctggtatgcccaga

SEQ ID NO: 8316599 - DNA, 22 bp, Homo sapiens
tccagctggggcagtggctggg

SEQ ID NO: 8316600 - DNA, 19 bp, Homo sapiens
tccagctgttttgagtcac

SEQ ID NO: 8316601 - DNA, 22 bp, Homo sapiens
tccagcagtgctcaggactcac

SEQ ID NO: 8316602 - DNA, 22 bp, Homo sapiens
tccagaatcaatagcagttatc

SEQ ID NO: 8316603 - DNA, 22 bp, Homo sapiens
tccagcaggtccgagacaagtt

SEQ ID NO: 8316604 - DNA, 22 bp, Homo sapiens
tccagcagccacacctctggac

SEQ ID NO: 8316605 - DNA, 23 bp, Homo sapiens
tccagcagagccttccaggaggg

SEQ ID NO: 8316606 - DNA, 22 bp, Homo sapiens
tcaggctggaatgcagtggggc

SEQ ID NO: 8316607 - DNA, 22 bp, Homo sapiens
tcagggaaatagcagggctgaa

SEQ ID NO: 8316608 - DNA, 22 bp, Homo sapiens
tcagggaaaagtcacactgggt

SEQ ID NO: 8316609 - DNA, 22 bp, Homo sapiens
tcaggctggggtgctaaggtgt

SEQ ID NO: 8316610 - DNA, 22 bp, Homo sapiens
tcagcactttgaagcagaagga

SEQ ID NO: 8316611 - DNA, 21 bp, Homo sapiens
tcagcagaaagcaaggtcagt

SEQ ID NO: 8316612 - DNA, 22 bp, Homo sapiens
tcagctccagagttgcacagtg

SEQ ID NO: 8316613 - DNA, 18 bp, Homo sapiens
tcagcctgttgtctgcct

SEQ ID NO: 8316614 - DNA, 22 bp, Homo sapiens
tcagctccacagctcctctgcc

SEQ ID NO: 8316615 - DNA, 19 bp, Homo sapiens
tcagggaagttcaaagctc

SEQ ID NO: 8316616 - DNA, 22 bp, Homo sapiens
tcagggaagacttcttagagga

SEQ ID NO: 8316617 - DNA, 22 bp, Homo sapiens
tcagtgtaagttatgtagatgt

SEQ ID NO: 8316618 - DNA, 18 bp, Homo sapiens
tcagtgtagatctgtgta

SEQ ID NO: 8316619 - DNA, 22 bp, Homo sapiens
tcagtgtagcagacttgtagcc

SEQ ID NO: 8316620 - DNA, 22 bp, Homo sapiens
tcagtgtaagtttttggatagg

SEQ ID NO: 8316621 - DNA, 21 bp, Homo sapiens
tcagtgtatttaagaatgttg

SEQ ID NO: 8316622 - DNA, 22 bp, Homo sapiens
tcagtgtagggcagacccctgg

SEQ ID NO: 8316623 - DNA, 20 bp, Homo sapiens
tcagtgtatcctcagtggct

SEQ ID NO: 8316624 - DNA, 22 bp, Homo sapiens
tcagtgtatggagtgctggatt

SEQ ID NO: 8316625 - DNA, 22 bp, Homo sapiens
tcatgctatgagcgagggcctg

SEQ ID NO: 8316626 - DNA, 22 bp, Homo sapiens
tcatatttaggcctttaattca

SEQ ID NO: 8316627 - DNA, 22 bp, Homo sapiens
tcatataagtttaaaactatct

SEQ ID NO: 8316628 - DNA, 22 bp, Homo sapiens
tcatataactggatattttcaa

SEQ ID NO: 8316629 - DNA, 22 bp, Homo sapiens
tcatataagagctttagagtca

SEQ ID NO: 8316630 - DNA, 22 bp, Homo sapiens
tcatagttctgttttgaaggat

SEQ ID NO: 8316631 - DNA, 22 bp, Homo sapiens
tcatatctttgtctaccaggaa

SEQ ID NO: 8316632 - DNA, 22 bp, Homo sapiens
tcatgcttaaaagacacttgag

SEQ ID NO: 8316633 - DNA, 22 bp, Homo sapiens
tcattcactttgaaataaacga

SEQ ID NO: 8316634 - DNA, 22 bp, Homo sapiens
tcacagtactgtgactattgac

SEQ ID NO: 8316635 - DNA, 22 bp, Homo sapiens
tcacagtactgtgtgacttgag

SEQ ID NO: 8316636 - DNA, 22 bp, Homo sapiens
tcacagtaaatccagaagaaat

SEQ ID NO: 8316637 - DNA, 22 bp, Homo sapiens
tcacaagagtaagttcatgcct

SEQ ID NO: 8316638 - DNA, 22 bp, Homo sapiens
tcacaaaagcttttgaatttgg

SEQ ID NO: 8316639 - DNA, 22 bp, Homo sapiens
tcaagataagtcagtatatcaa

SEQ ID NO: 8316640 - DNA, 22 bp, Homo sapiens
tcaagataccaccattatatgt

SEQ ID NO: 8316641 - DNA, 22 bp, Homo sapiens
tcaaggaagggatattcttgaa

SEQ ID NO: 8316642 - DNA, 22 bp, Homo sapiens
tcaaggaatgactatatgagga

SEQ ID NO: 8316643 - DNA, 22 bp, Homo sapiens
tatttcttcgggattcaagcta

SEQ ID NO: 8316644 - DNA, 22 bp, Homo sapiens
tatttcttgagtggtcagtttc

SEQ ID NO: 8316645 - DNA, 22 bp, Homo sapiens
tatttcttcgggattcaagcta

SEQ ID NO: 8316646 - DNA, 22 bp, Homo sapiens
tatttcttgagactcgtcttcc

SEQ ID NO: 8316647 - DNA, 22 bp, Homo sapiens
tcaagtgtagtggtgtcaggtc

SEQ ID NO: 8316648 - DNA, 20 bp, Homo sapiens
tcaagttttgcttgacaaga

SEQ ID NO: 8316649 - DNA, 22 bp, Homo sapiens
tcaataaatccctctgaccctg

SEQ ID NO: 8316650 - DNA, 22 bp, Homo sapiens
tcaataaatagcttggctcagc

SEQ ID NO: 8316651 - DNA, 22 bp, Homo sapiens
tcaataaaattgttttcctatc

SEQ ID NO: 8316652 - DNA, 22 bp, Homo sapiens
tcaaggtttgtctgctcagcat

SEQ ID NO: 8316653 - DNA, 22 bp, Homo sapiens
tcaaggttaagccagggcctca

SEQ ID NO: 8316654 - DNA, 22 bp, Homo sapiens
tcaaggttgttgaggcctgact

SEQ ID NO: 8316655 - DNA, 22 bp, Homo sapiens
tcaaggttgcggggaggcacga

SEQ ID NO: 8316656 - DNA, 22 bp, Homo sapiens
tcaaggttcaaggctggcttct

SEQ ID NO: 8316657 - DNA, 23 bp, Homo sapiens
tcacttgaagctagaatctgccc

SEQ ID NO: 8316658 - DNA, 22 bp, Homo sapiens
tcactttacagatgggaaaact

SEQ ID NO: 8316659 - DNA, 22 bp, Homo sapiens
tcacattttctactactgtacg

SEQ ID NO: 8316660 - DNA, 22 bp, Homo sapiens
tcacagtagccatttcatgagt

SEQ ID NO: 8316661 - DNA, 22 bp, Homo sapiens
tcacagtatagagttattttgg

SEQ ID NO: 8316662 - DNA, 22 bp, Homo sapiens
tcacagtatagagttattttgg

SEQ ID NO: 8316663 - DNA, 22 bp, Homo sapiens
tcactctggagtccgctaccag

SEQ ID NO: 8316664 - DNA, 22 bp, Homo sapiens
tcagaggaaagggaacatagtc

SEQ ID NO: 8316665 - DNA, 22 bp, Homo sapiens
tcagaggaactggactaaagcc

SEQ ID NO: 8316666 - DNA, 22 bp, Homo sapiens
tcagcaccagttatcctcaggg

SEQ ID NO: 8316667 - DNA, 22 bp, Homo sapiens
tcagaaaagaccacattattct

SEQ ID NO: 8316668 - DNA, 22 bp, Homo sapiens
tcagaaaagaccacattattct

SEQ ID NO: 8316669 - DNA, 22 bp, Homo sapiens
tcagaaaagagaaaatcttata

SEQ ID NO: 8316670 - DNA, 22 bp, Homo sapiens
tcagaaaataactgttagtttg

SEQ ID NO: 8316671 - DNA, 22 bp, Homo sapiens
gtttccatgggagaagacagtg

SEQ ID NO: 8316672 - DNA, 22 bp, Homo sapiens
gtttccattgtcctatctatag

SEQ ID NO: 8316673 - DNA, 22 bp, Homo sapiens
gtttcccaaattgttcacaggg

SEQ ID NO: 8316674 - DNA, 22 bp, Homo sapiens
gtttcccaggctgtggggccct

SEQ ID NO: 8316675 - DNA, 22 bp, Homo sapiens
gtttcccagtctgcagagttct

SEQ ID NO: 8316676 - DNA, 22 bp, Homo sapiens
gtttccatgcagtagagcttag

SEQ ID NO: 8316677 - DNA, 22 bp, Homo sapiens
gtttccatgcagtagagcttag

SEQ ID NO: 8316678 - DNA, 22 bp, Homo sapiens
gtttccaagttttctttgagct

SEQ ID NO: 8316679 - DNA, 22 bp, Homo sapiens
gtttccaactagtatgatcagg

SEQ ID NO: 8316680 - DNA, 22 bp, Homo sapiens
gtttccaagatgctgccatcag

SEQ ID NO: 8316681 - DNA, 22 bp, Homo sapiens
gtttccaaccccaccaaagtgc

SEQ ID NO: 8316682 - DNA, 21 bp, Homo sapiens
gtttccaacaaacctctgctt

SEQ ID NO: 8316683 - DNA, 22 bp, Homo sapiens
gttttgatatatgcatacatta

SEQ ID NO: 8316684 - DNA, 22 bp, Homo sapiens
gttttctttgaatgcttctaga

SEQ ID NO: 8316685 - DNA, 21 bp, Homo sapiens
gttttctttgatagagggaag

SEQ ID NO: 8316686 - DNA, 22 bp, Homo sapiens
taaaattgcggtgaatatttcc

SEQ ID NO: 8316687 - DNA, 22 bp, Homo sapiens
taaaatttgtccctgagtgttg

SEQ ID NO: 8316688 - DNA, 22 bp, Homo sapiens
taaagggtaggttttactgtaa

SEQ ID NO: 8316689 - DNA, 22 bp, Homo sapiens
taaacaagctggactgataagt

SEQ ID NO: 8316690 - DNA, 22 bp, Homo sapiens
gtttttatctaatagcagttat

SEQ ID NO: 8316691 - DNA, 22 bp, Homo sapiens
gtttttattgtgtaaatgtggg

SEQ ID NO: 8316692 - DNA, 22 bp, Homo sapiens
gtttttatctaatagcagttat

SEQ ID NO: 8316693 - DNA, 22 bp, Homo sapiens
gtttttattgtgtaaatgtggg

SEQ ID NO: 8316694 - DNA, 22 bp, Homo sapiens
taaaagttttagttgtacataa

SEQ ID NO: 8316695 - DNA, 19 bp, Homo sapiens
taaaatgtctgtggtcagt

SEQ ID NO: 8316696 - DNA, 22 bp, Homo sapiens
taaaggtagtgtgacatattgt

SEQ ID NO: 8316697 - DNA, 22 bp, Homo sapiens
taaaggtagtgtgacatattgt

SEQ ID NO: 8316698 - DNA, 22 bp, Homo sapiens
taaaggtatgtcttaatcaaac

SEQ ID NO: 8316699 - DNA, 22 bp, Homo sapiens
taaaggtatgtcttaatcaaac

SEQ ID NO: 8316700 - DNA, 22 bp, Homo sapiens
taaaggttattgcactggagtt

SEQ ID NO: 8316701 - DNA, 22 bp, Homo sapiens
taaagtatccagttattcttct

SEQ ID NO: 8316702 - DNA, 22 bp, Homo sapiens
taaagtgcctcaggtcctgggt

SEQ ID NO: 8316703 - DNA, 22 bp, Homo sapiens
taaagtgctggatttgagtaaa

SEQ ID NO: 8316704 - DNA, 22 bp, Homo sapiens
taaagtgcttatgataaccaag

SEQ ID NO: 8316705 - DNA, 22 bp, Homo sapiens
taaagtgctgggattataggcc

SEQ ID NO: 8316706 - DNA, 22 bp, Homo sapiens
taaagtgcttatgataaccaag

SEQ ID NO: 8316707 - DNA, 22 bp, Homo sapiens
taaagtgctgggattataggcc

SEQ ID NO: 8316708 - DNA, 23 bp, Homo sapiens
taaagtgctgatggtgagggagc

SEQ ID NO: 8316709 - DNA, 22 bp, Homo sapiens
taaagtgctcataaaaatggat

SEQ ID NO: 8316710 - DNA, 22 bp, Homo sapiens
taaagtgcgacccagtccccag

SEQ ID NO: 8316711 - DNA, 22 bp, Homo sapiens
taaagtgcttcctaacccagag

SEQ ID NO: 8316712 - DNA, 22 bp, Homo sapiens
taaagtgcttcctaacccagag

SEQ ID NO: 8316713 - DNA, 22 bp, Homo sapiens
taaattagagccaggtaagttt

SEQ ID NO: 8316714 - DNA, 22 bp, Homo sapiens
taaattatgtcacatgactctg

SEQ ID NO: 8316715 - DNA, 22 bp, Homo sapiens
taaattagggactttagttaat

SEQ ID NO: 8316716 - DNA, 20 bp, Homo sapiens
taaattagccttgaagatta

SEQ ID NO: 8316717 - DNA, 20 bp, Homo sapiens
taaattagccttgaagatta

SEQ ID NO: 8316718 - DNA, 22 bp, Homo sapiens
taacattaaaagagataattga

SEQ ID NO: 8316719 - DNA, 22 bp, Homo sapiens
taacattacagacaccttgtgt

SEQ ID NO: 8316720 - DNA, 22 bp, Homo sapiens
taaccaaagggcctaaggaatg

SEQ ID NO: 8316721 - DNA, 22 bp, Homo sapiens
taactctagtcccaggcatgaa

SEQ ID NO: 8316722 - DNA, 22 bp, Homo sapiens
gttaagaagctagagatgaaca

SEQ ID NO: 8316723 - DNA, 23 bp, Homo sapiens
gttaataatgaacactttctccc

SEQ ID NO: 8316724 - DNA, 22 bp, Homo sapiens
gttaatatttacctgtcaagaa

SEQ ID NO: 8316725 - DNA, 22 bp, Homo sapiens
gttacaaagcacttcaagtgaa

SEQ ID NO: 8316726 - DNA, 22 bp, Homo sapiens
gttacaaagcacttcaagtgaa

SEQ ID NO: 8316727 - DNA, 22 bp, Homo sapiens
gttacaaaggaagcttcactgc

SEQ ID NO: 8316728 - DNA, 22 bp, Homo sapiens
gttacaaaggaagcttcactgc

SEQ ID NO: 8316729 - DNA, 22 bp, Homo sapiens
gttacaaactcaggtgccaaaa

SEQ ID NO: 8316730 - DNA, 22 bp, Homo sapiens
gttacaaactcaggtgccaaaa

SEQ ID NO: 8316731 - DNA, 22 bp, Homo sapiens
gtgctccctccttcctcaagga

SEQ ID NO: 8316732 - DNA, 22 bp, Homo sapiens
gtgctccctccttcctcaagga

SEQ ID NO: 8316733 - DNA, 22 bp, Homo sapiens
gtgtgcatgtgcttgcacagat

SEQ ID NO: 8316734 - DNA, 22 bp, Homo sapiens
gttgagtgggttaggatgctga

SEQ ID NO: 8316735 - DNA, 22 bp, Homo sapiens
gttcatatttaactaagatagg

SEQ ID NO: 8316736 - DNA, 22 bp, Homo sapiens
gttcacatgctctcatgctttt

SEQ ID NO: 8316737 - DNA, 22 bp, Homo sapiens
gttcacaaagtactgtatgcat

SEQ ID NO: 8316738 - DNA, 22 bp, Homo sapiens
gttacaaaggactgggggccac

SEQ ID NO: 8316739 - DNA, 22 bp, Homo sapiens
gttcacatgtgttatcttcttt

SEQ ID NO: 8316740 - DNA, 22 bp, Homo sapiens
gttcactggctgtgtgactctg

SEQ ID NO: 8316741 - DNA, 22 bp, Homo sapiens
gttcacatgtggtcatgctgtc

SEQ ID NO: 8316742 - DNA, 22 bp, Homo sapiens
gttcactgtactggtgatggtt

SEQ ID NO: 8316743 - DNA, 22 bp, Homo sapiens
gttgcattgagagttgcattgg

SEQ ID NO: 8316744 - DNA, 22 bp, Homo sapiens
gttgcattttaaatgcatgttg

SEQ ID NO: 8316745 - DNA, 22 bp, Homo sapiens
gttgcattttccctccagaggt

SEQ ID NO: 8316746 - DNA, 22 bp, Homo sapiens
gtttcattcggcagctcataag

SEQ ID NO: 8316747 - DNA, 22 bp, Homo sapiens
gtttcattcggcagctcataag

SEQ ID NO: 8316748 - DNA, 22 bp, Homo sapiens
gtttcatttacatctgtaggta

SEQ ID NO: 8316749 - DNA, 22 bp, Homo sapiens
gtttcattacctgacccatgag

SEQ ID NO: 8316750 - DNA, 22 bp, Homo sapiens
gtttcatataccaagcacttga

SEQ ID NO: 8316751 - DNA, 22 bp, Homo sapiens
gtttcatatgcagttaacagca

SEQ ID NO: 8316752 - DNA, 22 bp, Homo sapiens
gttgtacaaaatatcagtgagg

SEQ ID NO: 8316753 - DNA, 22 bp, Homo sapiens
tacaaagtatatttctagctgt

SEQ ID NO: 8316754 - DNA, 22 bp, Homo sapiens
tacaaagtagaaattcagtaaa

SEQ ID NO: 8316755 - DNA, 22 bp, Homo sapiens
tacaaagtcacattgaaatgaa

SEQ ID NO: 8316756 - DNA, 22 bp, Homo sapiens
tacaaagcctggtagatatctg

SEQ ID NO: 8316757 - DNA, 22 bp, Homo sapiens
tacaaagatagtgttagagtaa

SEQ ID NO: 8316758 - DNA, 22 bp, Homo sapiens
tacaaagatagtgttagagtaa

SEQ ID NO: 8316759 - DNA, 22 bp, Homo sapiens
tacaaacttgttttaagtaagt

SEQ ID NO: 8316760 - DNA, 20 bp, Homo sapiens
tacaaagaatgaggttcagg

SEQ ID NO: 8316761 - DNA, 22 bp, Homo sapiens
tacaaagagtttggtctctaga

SEQ ID NO: 8316762 - DNA, 22 bp, Homo sapiens
tacaaagaggtaattgcatata

SEQ ID NO: 8316763 - DNA, 22 bp, Homo sapiens
tacaaactctttatatttcata

SEQ ID NO: 8316764 - DNA, 22 bp, Homo sapiens
taatacttaccttgcagagtct

SEQ ID NO: 8316765 - DNA, 22 bp, Homo sapiens
taatacttgtcataaaggcatt

SEQ ID NO: 8316766 - DNA, 22 bp, Homo sapiens
taatagaaaggtattttttgca

SEQ ID NO: 8316767 - DNA, 22 bp, Homo sapiens
taatagaatagtggaaacattg

SEQ ID NO: 8316768 - DNA, 22 bp, Homo sapiens
taatgtttccagtctatgatgg

SEQ ID NO: 8316769 - DNA, 22 bp, Homo sapiens
taattacaggtccaaaacaatc

SEQ ID NO: 8316770 - DNA, 22 bp, Homo sapiens
taagggttcagaatgcagtggt

SEQ ID NO: 8316771 - DNA, 22 bp, Homo sapiens
taagggttcagaatgcagtggt

SEQ ID NO: 8316772 - DNA, 22 bp, Homo sapiens
taatacatcattcatctaagga

SEQ ID NO: 8316773 - DNA, 22 bp, Homo sapiens
taatacctagagatgatacaaa

SEQ ID NO: 8316774 - DNA, 22 bp, Homo sapiens
taatacattacctaacctctct

SEQ ID NO: 8316775 - DNA, 22 bp, Homo sapiens
taatacctggccttgatacagt

SEQ ID NO: 8316776 - DNA, 22 bp, Homo sapiens
taataagtctgttgtttaattg

SEQ ID NO: 8316777 - DNA, 22 bp, Homo sapiens
taagtggtaccaagctcagtga

SEQ ID NO: 8316778 - DNA, 22 bp, Homo sapiens
taagtggttgcttgttttcatt

SEQ ID NO: 8316779 - DNA, 22 bp, Homo sapiens
taataatagcagtagctgccac

SEQ ID NO: 8316780 - DNA, 22 bp, Homo sapiens
taatacagggcactttgagtga

SEQ ID NO: 8316781 - DNA, 22 bp, Homo sapiens
taataattaacagtgatgggtc

SEQ ID NO: 8316782 - DNA, 22 bp, Homo sapiens
taatacagtagcttttacacag

SEQ ID NO: 8316783 - DNA, 21 bp, Homo sapiens
tacattgactacaaataaagc

SEQ ID NO: 8316784 - DNA, 22 bp, Homo sapiens
tacattgacttggattgttaga

SEQ ID NO: 8316785 - DNA, 22 bp, Homo sapiens
tacattgagcacgtactatgtg

SEQ ID NO: 8316786 - DNA, 22 bp, Homo sapiens
tacattgaaagtcatttaatcc

SEQ ID NO: 8316787 - DNA, 22 bp, Homo sapiens
tacatctttgtctatgaccagc

SEQ ID NO: 8316788 - DNA, 22 bp, Homo sapiens
tacagtaagatgaaatagcaat

SEQ ID NO: 8316789 - DNA, 22 bp, Homo sapiens
tacagtaactggaattcttctt

SEQ ID NO: 8316790 - DNA, 22 bp, Homo sapiens
tacaggcatgtagcatggtgat

SEQ ID NO: 8316791 - DNA, 22 bp, Homo sapiens
tacaggcatgaatgaaatctgt

SEQ ID NO: 8316792 - DNA, 19 bp, Homo sapiens
tacaggaggcctgcaatct

SEQ ID NO: 8316793 - DNA, 20 bp, Homo sapiens
tacaggagtgagtgggtggg

SEQ ID NO: 8316794 - DNA, 22 bp, Homo sapiens
tacaggagcacaaaagagttga

SEQ ID NO: 8316795 - DNA, 22 bp, Homo sapiens
tacaggagcatggggaagggat

SEQ ID NO: 8316796 - DNA, 22 bp, Homo sapiens
tacagcacggtgcatttactac

SEQ ID NO: 8316797 - DNA, 22 bp, Homo sapiens
tacagtaatgtgtccctgcagg

SEQ ID NO: 8316798 - DNA, 22 bp, Homo sapiens
tacagtaatctggacatgattt

SEQ ID NO: 8316799 - DNA, 21 bp, Homo sapiens
tacagtaagttgggtggtcct

SEQ ID NO: 8316800 - DNA, 22 bp, Homo sapiens
tacagtaataaaatgagctaca

SEQ ID NO: 8316801 - DNA, 22 bp, Homo sapiens
tacatacattacctcatttagt

SEQ ID NO: 8316802 - DNA, 23 bp, Homo sapiens
tacagaaggagtagtcactaaga

SEQ ID NO: 8316803 - DNA, 22 bp, Homo sapiens
tacagataactgaatgcagact

SEQ ID NO: 8316804 - DNA, 22 bp, Homo sapiens
tacagagttttcctgccaagaa

SEQ ID NO: 8316805 - DNA, 22 bp, Homo sapiens
tacagattgaggtttttaatat

SEQ ID NO: 8316806 - DNA, 22 bp, Homo sapiens
tacaaagtcccattgccatgga

SEQ ID NO: 8316807 - DNA, 22 bp, Homo sapiens
tacaaagtgattttggaattga

SEQ ID NO: 8316808 - DNA, 22 bp, Homo sapiens
tacaaagtgtgcccatgctgag

SEQ ID NO: 8316809 - DNA, 22 bp, Homo sapiens
tacaaagtttgagaatgctttc

SEQ ID NO: 8316810 - DNA, 20 bp, Homo sapiens
tacaacaagtagagacatac

SEQ ID NO: 8316811 - DNA, 22 bp, Homo sapiens
tacaacagaagtgtttatttag

SEQ ID NO: 8316812 - DNA, 22 bp, Homo sapiens
tacaacaatttccacattagaa

SEQ ID NO: 8316813 - DNA, 22 bp, Homo sapiens
tacaacaggaatttcaactttg

SEQ ID NO: 8316814 - DNA, 22 bp, Homo sapiens
tacaacagacaggaataagatt

SEQ ID NO: 8316815 - DNA, 20 bp, Homo sapiens
tacagaaacaggacttttgg

SEQ ID NO: 8316816 - DNA, 22 bp, Homo sapiens
tacagaaagggatgattgatct

SEQ ID NO: 8316817 - DNA, 22 bp, Homo sapiens
tagggaggagggttttcaaatc

SEQ ID NO: 8316818 - DNA, 22 bp, Homo sapiens
tagggcaatatttcccagaaaa

SEQ ID NO: 8316819 - DNA, 22 bp, Homo sapiens
taggaaaaagaggctggcaagg

SEQ ID NO: 8316820 - DNA, 22 bp, Homo sapiens
tagctttgttagaatgtcttca

SEQ ID NO: 8316821 - DNA, 22 bp, Homo sapiens
taggaaaagtctagattgatga

SEQ ID NO: 8316822 - DNA, 22 bp, Homo sapiens
tagctttgcctgaagtaatcag

SEQ ID NO: 8316823 - DNA, 22 bp, Homo sapiens
tagctttgcctgttaatcacaa

SEQ ID NO: 8316824 - DNA, 22 bp, Homo sapiens
taggagggttagagggaaatat

SEQ ID NO: 8316825 - DNA, 22 bp, Homo sapiens
taggagggggaacaaggcatac

SEQ ID NO: 8316826 - DNA, 22 bp, Homo sapiens
taggagggggaacaaggcatac

SEQ ID NO: 8316827 - DNA, 22 bp, Homo sapiens
taggagggccctgaaaatggca

SEQ ID NO: 8316828 - DNA, 22 bp, Homo sapiens
taggaaactaatacagtctgga

SEQ ID NO: 8316829 - DNA, 22 bp, Homo sapiens
tagaggtgttcattctctccat

SEQ ID NO: 8316830 - DNA, 22 bp, Homo sapiens
tagcagaagttccaatgcatat

SEQ ID NO: 8316831 - DNA, 22 bp, Homo sapiens
tagcagaagttgcaaactaggg

SEQ ID NO: 8316832 - DNA, 22 bp, Homo sapiens
tagcagaagaacaacatgatct

SEQ ID NO: 8316833 - DNA, 22 bp, Homo sapiens
tagaggtatttttgatggtcat

SEQ ID NO: 8316834 - DNA, 18 bp, Homo sapiens
tagagggggcctgggcat

SEQ ID NO: 8316835 - DNA, 22 bp, Homo sapiens
tagaggggaatctgcctcctct

SEQ ID NO: 8316836 - DNA, 22 bp, Homo sapiens
tagaggtagagttacattagtc

SEQ ID NO: 8316837 - DNA, 22 bp, Homo sapiens
tagagggttattaggacagaag

SEQ ID NO: 8316838 - DNA, 22 bp, Homo sapiens
tagcagaggaaaagagaacatt

SEQ ID NO: 8316839 - DNA, 22 bp, Homo sapiens
tagcccatatgaaatgatttgg

SEQ ID NO: 8316840 - DNA, 22 bp, Homo sapiens
tagcccatatggtgcctttgtg

SEQ ID NO: 8316841 - DNA, 22 bp, Homo sapiens
tagcccatgatggtggaaggca

SEQ ID NO: 8316842 - DNA, 22 bp, Homo sapiens
tagcccctgcctttgaacctgg

SEQ ID NO: 8316843 - DNA, 17 bp, Homo sapiens
tagcccatggctgccag

SEQ ID NO: 8316844 - DNA, 22 bp, Homo sapiens
tagcccatgcagctctgtcatt

SEQ ID NO: 8316845 - DNA, 22 bp, Homo sapiens
tagcccatggactggtcagctg

SEQ ID NO: 8316846 - DNA, 22 bp, Homo sapiens
tagcccatgtgcgtgttggggg

SEQ ID NO: 8316847 - DNA, 22 bp, Homo sapiens
tagcccattacctttggattgg

SEQ ID NO: 8316848 - DNA, 23 bp, Homo sapiens
tagcccattgtgcttgtggtttt

SEQ ID NO: 8316849 - DNA, 22 bp, Homo sapiens
tagcccatttgttggaagcatg

SEQ ID NO: 8316850 - DNA, 22 bp, Homo sapiens
tagctgttcaagttcctggaaa

SEQ ID NO: 8316851 - DNA, 22 bp, Homo sapiens
tagctgtttatcaagttcttga

SEQ ID NO: 8316852 - DNA, 22 bp, Homo sapiens
tagctgtttgaagtatttttct

SEQ ID NO: 8316853 - DNA, 22 bp, Homo sapiens
tagaaacagcatatattagccc

SEQ ID NO: 8316854 - DNA, 22 bp, Homo sapiens
tagaaacagcatatattagccc

SEQ ID NO: 8316855 - DNA, 22 bp, Homo sapiens
tagaaacagatgtttttgaaga

SEQ ID NO: 8316856 - DNA, 22 bp, Homo sapiens
tagaaacagagagatatgcccc

SEQ ID NO: 8316857 - DNA, 22 bp, Homo sapiens
tagaaacagaaaactgtaatag

SEQ ID NO: 8316858 - DNA, 22 bp, Homo sapiens
tagaaacagaatatgagtgaga

SEQ ID NO: 8316859 - DNA, 22 bp, Homo sapiens
tagaaacagaatatgagtgaga

SEQ ID NO: 8316860 - DNA, 22 bp, Homo sapiens
tagaaacaatgacatgcttgta

SEQ ID NO: 8316861 - DNA, 22 bp, Homo sapiens
tagaaacatgttctgttctgtt

SEQ ID NO: 8316862 - DNA, 22 bp, Homo sapiens
tagaaacatatgtttgagacat

SEQ ID NO: 8316863 - DNA, 22 bp, Homo sapiens
tagaaactagattgatagcgga

SEQ ID NO: 8316864 - DNA, 22 bp, Homo sapiens
tagaaacattcagttgcagtcc

SEQ ID NO: 8316865 - DNA, 22 bp, Homo sapiens
tagaaactactagaataagaga

SEQ ID NO: 8316866 - DNA, 22 bp, Homo sapiens
tactttttatgataagaactga

SEQ ID NO: 8316867 - DNA, 22 bp, Homo sapiens
tactttttgtctctttgaatgt

SEQ ID NO: 8316868 - DNA, 22 bp, Homo sapiens
tactttttgtctctttgaatgt

SEQ ID NO: 8316869 - DNA, 22 bp, Homo sapiens
tagaaaagaattttatttgata

SEQ ID NO: 8316870 - DNA, 22 bp, Homo sapiens
taccaaaagcttgtttcataca

SEQ ID NO: 8316871 - DNA, 22 bp, Homo sapiens
taccaaaagcttgtttcataca

SEQ ID NO: 8316872 - DNA, 22 bp, Homo sapiens
tactttggggacaatatggaat

SEQ ID NO: 8316873 - DNA, 22 bp, Homo sapiens
tactttggatccttacaatagc

SEQ ID NO: 8316874 - DNA, 22 bp, Homo sapiens
tactttgcagcttgataaaatg

SEQ ID NO: 8316875 - DNA, 22 bp, Homo sapiens
tacttttagcctatttgattct

SEQ ID NO: 8316876 - DNA, 22 bp, Homo sapiens
tagaaagtggttgagagtttag

SEQ ID NO: 8316877 - DNA, 22 bp, Homo sapiens
tagaaatcagcaggcatatgta

SEQ ID NO: 8316878 - DNA, 21 bp, Homo sapiens
tagaaatcagctggtgcctct

SEQ ID NO: 8316879 - DNA, 22 bp, Homo sapiens
tagaaatcatttagaagtattg

SEQ ID NO: 8316880 - DNA, 22 bp, Homo sapiens
tagaaatgattggttgagctct

SEQ ID NO: 8316881 - DNA, 22 bp, Homo sapiens
tagaaatcttgttactatgtgt

SEQ ID NO: 8316882 - DNA, 22 bp, Homo sapiens
tagaaatgaatgtttaaaagtc

SEQ ID NO: 8316883 - DNA, 22 bp, Homo sapiens
tagaaatgattgagctgtaata

SEQ ID NO: 8316884 - DNA, 22 bp, Homo sapiens
tagaaagctgagtaatacattt

SEQ ID NO: 8316885 - DNA, 22 bp, Homo sapiens
tagaaagaacttcatgtaaaac

SEQ ID NO: 8316886 - DNA, 22 bp, Homo sapiens
tagaaagtactaaatttaactg

SEQ ID NO: 8316887 - DNA, 22 bp, Homo sapiens
tagaaagtaaatcagttttatt

SEQ ID NO: 8316888 - DNA, 22 bp, Homo sapiens
tagaaagtagccacttacagag

SEQ ID NO: 8316889 - DNA, 22 bp, Homo sapiens
tagaaagtactaaatttaactg

SEQ ID NO: 8316890 - DNA, 22 bp, Homo sapiens
tagaaagtaaatcagttttatt

SEQ ID NO: 8316891 - DNA, 22 bp, Homo sapiens
tagaaagtaaacacgaagtctc

SEQ ID NO: 8316892 - DNA, 22 bp, Homo sapiens
tagaaagtaaatcagttttatt

SEQ ID NO: 8316893 - DNA, 22 bp, Homo sapiens
tagaaagtaaacacgaagtctc

SEQ ID NO: 8316894 - DNA, 22 bp, Homo sapiens
tagaaagtcatgaattacacca

SEQ ID NO: 8316895 - DNA, 21 bp, Homo sapiens
tagaaagtcaaagctatcagc

SEQ ID NO: 8316896 - DNA, 22 bp, Homo sapiens
tagaaagtcaaaacactgtgtt

SEQ ID NO: 8316897 - DNA, 21 bp, Homo sapiens
tagaaagtcaaagctatcagc

SEQ ID NO: 8316898 - DNA, 21 bp, Homo sapiens
tagaaagtcaaagctatcagc

SEQ ID NO: 8316899 - DNA, 22 bp, Homo sapiens
tagaaagtgaaggttaattaat

SEQ ID NO: 8316900 - DNA, 22 bp, Homo sapiens
tagaaagtgaaggttaattaat

SEQ ID NO: 8316901 - DNA, 22 bp, Homo sapiens
tagaaagtcatgaattacacca

SEQ ID NO: 8316902 - DNA, 22 bp, Homo sapiens
tagaaagtcaaaacactgtgtt

SEQ ID NO: 8316903 - DNA, 22 bp, Homo sapiens
tagaaagtagccacttacagag

SEQ ID NO: 8316904 - DNA, 22 bp, Homo sapiens
tagaaagtagggaaggtaggat

SEQ ID NO: 8316905 - DNA, 22 bp, Homo sapiens
tagacacatcaaggatcagttt

SEQ ID NO: 8316906 - DNA, 22 bp, Homo sapiens
tagacacatcttcatccacaat

SEQ ID NO: 8316907 - DNA, 22 bp, Homo sapiens
tagacagatgttttctggctgt

SEQ ID NO: 8316908 - DNA, 22 bp, Homo sapiens
tagaggcctgaaagaatgatca

SEQ ID NO: 8316909 - DNA, 22 bp, Homo sapiens
tagagggaaggaagaatggatt

SEQ ID NO: 8316910 - DNA, 22 bp, Homo sapiens
tagacacaagagaagggtataa

SEQ ID NO: 8316911 - DNA, 22 bp, Homo sapiens
tagacacatacccttgcccaaa

SEQ ID NO: 8316912 - DNA, 22 bp, Homo sapiens
tagacacaaatctcagtgacac

SEQ ID NO: 8316913 - DNA, 22 bp, Homo sapiens
tagacaatatttgaaagtagtg

SEQ ID NO: 8316914 - DNA, 22 bp, Homo sapiens
tagaaatggagaacagattaat

SEQ ID NO: 8316915 - DNA, 22 bp, Homo sapiens
tattagaaagcttaatatcgtg

SEQ ID NO: 8316916 - DNA, 22 bp, Homo sapiens
tattacagttcgagtttctagg

SEQ ID NO: 8316917 - DNA, 22 bp, Homo sapiens
tatgaggtaagagggacttagc

SEQ ID NO: 8316918 - DNA, 22 bp, Homo sapiens
tatgaggttttggatctgtgtt

SEQ ID NO: 8316919 - DNA, 22 bp, Homo sapiens
tatgagatcccttttcctagag

SEQ ID NO: 8316920 - DNA, 20 bp, Homo sapiens
tatgagatttgacctcaaca

SEQ ID NO: 8316921 - DNA, 21 bp, Homo sapiens
tatgagatatacttattcttt

SEQ ID NO: 8316922 - DNA, 22 bp, Homo sapiens
tatgagatattcccagcgtcta

SEQ ID NO: 8316923 - DNA, 22 bp, Homo sapiens
tatgagatttggattcagtgaa

SEQ ID NO: 8316924 - DNA, 22 bp, Homo sapiens
tatgagataaatggtgccccct

SEQ ID NO: 8316925 - DNA, 22 bp, Homo sapiens
tatgagatactacagattgtga

SEQ ID NO: 8316926 - DNA, 22 bp, Homo sapiens
tatgtacagtccttaacttaaa

SEQ ID NO: 8316927 - DNA, 22 bp, Homo sapiens
tattcttgtcttttccagaaat

SEQ ID NO: 8316928 - DNA, 22 bp, Homo sapiens
tattgaattagaccctaaaatg

SEQ ID NO: 8316929 - DNA, 22 bp, Homo sapiens
tattattaaatggcagaatttt

SEQ ID NO: 8316930 - DNA, 22 bp, Homo sapiens
tattattgacatttacttggtg

SEQ ID NO: 8316931 - DNA, 22 bp, Homo sapiens
tattattgactattcagaatgt

SEQ ID NO: 8316932 - DNA, 22 bp, Homo sapiens
tattattgcaagtatataaagt

SEQ ID NO: 8316933 - DNA, 19 bp, Homo sapiens
tattatttgtagcaaggcc

SEQ ID NO: 8316934 - DNA, 22 bp, Homo sapiens
tattattatgcatagcatgaaa

SEQ ID NO: 8316935 - DNA, 22 bp, Homo sapiens
tattattgaatcagttctttga

SEQ ID NO: 8316936 - DNA, 22 bp, Homo sapiens
tattattttagcactgaggatt

SEQ ID NO: 8316937 - DNA, 22 bp, Homo sapiens
tattattttagcactgaggatt

SEQ ID NO: 8316938 - DNA, 22 bp, Homo sapiens
tattcaaagtaccttcattgcc

SEQ ID NO: 8316939 - DNA, 22 bp, Homo sapiens
tatttctgaatccaaaaggtca

SEQ ID NO: 8316940 - DNA, 22 bp, Homo sapiens
tatttctcagcattttacatcc

SEQ ID NO: 8316941 - DNA, 22 bp, Homo sapiens
tatttattctttgtactgcctt

SEQ ID NO: 8316942 - DNA, 22 bp, Homo sapiens
taggggtgtttcgagagaggtt

SEQ ID NO: 8316943 - DNA, 22 bp, Homo sapiens
taggtctgatttccattcagtc

SEQ ID NO: 8316944 - DNA, 22 bp, Homo sapiens
tataaatctttgttcctagaat

SEQ ID NO: 8316945 - DNA, 22 bp, Homo sapiens
tataaatgcacttttgaaatat

SEQ ID NO: 8316946 - DNA, 22 bp, Homo sapiens
tataaagtttcgaaagatgtat

SEQ ID NO: 8316947 - DNA, 22 bp, Homo sapiens
tataaatgccaggactttagat

SEQ ID NO: 8316948 - DNA, 22 bp, Homo sapiens
tatacaagtaatgctgaatgat

SEQ ID NO: 8316949 - DNA, 22 bp, Homo sapiens
tatacaagtgagaagaagagtt

SEQ ID NO: 8316950 - DNA, 22 bp, Homo sapiens
tatacaatgagtacattctggg

SEQ ID NO: 8316951 - DNA, 22 bp, Homo sapiens
tataatttggggaaagtggtgt

SEQ ID NO: 8316952 - DNA, 22 bp, Homo sapiens
tatacacatttttacctatagt

SEQ ID NO: 8316953 - DNA, 22 bp, Homo sapiens
tatacagaacattaagaactgt

SEQ ID NO: 8316954 - DNA, 22 bp, Homo sapiens
tatacagaaagaattcaagtct

SEQ ID NO: 8316955 - DNA, 22 bp, Homo sapiens
tatacacatcctccaaagatag

SEQ ID NO: 8316956 - DNA, 23 bp, Homo sapiens
tatacacatgtggcagtatagtg

SEQ ID NO: 8316957 - DNA, 22 bp, Homo sapiens
tatccaaagtggcatattatag

SEQ ID NO: 8316958 - DNA, 22 bp, Homo sapiens
tatatctaggaaccctgagatt

SEQ ID NO: 8316959 - DNA, 22 bp, Homo sapiens
tataggtatgtcgagaaatgaa

SEQ ID NO: 8316960 - DNA, 22 bp, Homo sapiens
tatagtaaaattttcatttatg

SEQ ID NO: 8316961 - DNA, 22 bp, Homo sapiens
tataggtacttggaaaataagg

SEQ ID NO: 8316962 - DNA, 22 bp, Homo sapiens
tatcccatgcctcattaaagtt

SEQ ID NO: 8316963 - DNA, 22 bp, Homo sapiens
tatgacttatttcatcagttct

SEQ ID NO: 8316964 - DNA, 22 bp, Homo sapiens
gctgagagaaaagtgaggttct

SEQ ID NO: 8316965 - DNA, 22 bp, Homo sapiens
gctgagagaaaagtgaggttct

SEQ ID NO: 8316966 - DNA, 22 bp, Homo sapiens
gctgagacttccactgccatct

SEQ ID NO: 8316967 - DNA, 22 bp, Homo sapiens
gctgagacttccactgccatct

SEQ ID NO: 8316968 - DNA, 17 bp, Homo sapiens
gctgagaaggggaagag

SEQ ID NO: 8316969 - DNA, 22 bp, Homo sapiens
gctgagaatgttcctactggta

SEQ ID NO: 8316970 - DNA, 17 bp, Homo sapiens
gctgagaggcagcacag

SEQ ID NO: 8316971 - DNA, 22 bp, Homo sapiens
gctgagagcggccagctgggaa

SEQ ID NO: 8316972 - DNA, 22 bp, Homo sapiens
gctgaggccaggccccaccgga

SEQ ID NO: 8316973 - DNA, 22 bp, Homo sapiens
gctgaggccccagggtgatggg

SEQ ID NO: 8316974 - DNA, 22 bp, Homo sapiens
gctgaggcctcagaaggctgag

SEQ ID NO: 8316975 - DNA, 22 bp, Homo sapiens
gctgaggcctcagaaggctgag

SEQ ID NO: 8316976 - DNA, 22 bp, Homo sapiens
gctgaggcggaaggattgctag

SEQ ID NO: 8316977 - DNA, 22 bp, Homo sapiens
gctgaggctgggagcagcctgt

SEQ ID NO: 8316978 - DNA, 22 bp, Homo sapiens
gctgaggcttagctaaaaattt

SEQ ID NO: 8316979 - DNA, 22 bp, Homo sapiens
gctgagggaccatgtttcagga

SEQ ID NO: 8316980 - DNA, 22 bp, Homo sapiens
gctgaggctcaatccccttctg

SEQ ID NO: 8316981 - DNA, 22 bp, Homo sapiens
gctgaggctcaagtcatgggtc

SEQ ID NO: 8316982 - DNA, 22 bp, Homo sapiens
gctcctctattccccacatttt

SEQ ID NO: 8316983 - DNA, 22 bp, Homo sapiens
gctgcctgttgaagggtctgtg

SEQ ID NO: 8316984 - DNA, 22 bp, Homo sapiens
gctgagggcagcctcctaggtc

SEQ ID NO: 8316985 - DNA, 22 bp, Homo sapiens
gctgagggatagctgctcactg

SEQ ID NO: 8316986 - DNA, 22 bp, Homo sapiens
gctgagggcatgtgtggcgact

SEQ ID NO: 8316987 - DNA, 22 bp, Homo sapiens
gctgagggccgcatagggtcat

SEQ ID NO: 8316988 - DNA, 22 bp, Homo sapiens
gctgcccagacattgaatcagg

SEQ ID NO: 8316989 - DNA, 22 bp, Homo sapiens
gctgcctcactccagcccaata

SEQ ID NO: 8316990 - DNA, 22 bp, Homo sapiens
gctgcctgtcctgaggagtccg

SEQ ID NO: 8316991 - DNA, 22 bp, Homo sapiens
gctgcctccaatctgtgccccg

SEQ ID NO: 8316992 - DNA, 22 bp, Homo sapiens
gctactgattgaccttggagag

SEQ ID NO: 8316993 - DNA, 23 bp, Homo sapiens
gctcagaggtttttctctggatg

SEQ ID NO: 8316994 - DNA, 19 bp, Homo sapiens
gctcagagggccctgtgct

SEQ ID NO: 8316995 - DNA, 23 bp, Homo sapiens
gctcagaggtttttctctggatg

SEQ ID NO: 8316996 - DNA, 21 bp, Homo sapiens
gctcagcaaaggtgaggtgca

SEQ ID NO: 8316997 - DNA, 17 bp, Homo sapiens
gctccctgaggacagct

SEQ ID NO: 8316998 - DNA, 22 bp, Homo sapiens
gctccctgcactctgcagccct

SEQ ID NO: 8316999 - DNA, 20 bp, Homo sapiens
gcctgagctattgccaggat

SEQ ID NO: 8317000 - DNA, 19 bp, Homo sapiens
gccttggcattctctgctt

SEQ ID NO: 8317001 - DNA, 22 bp, Homo sapiens
gccttggcccacagtgctcctg

SEQ ID NO: 8317002 - DNA, 22 bp, Homo sapiens
gcctctgtggctcagccttgct

SEQ ID NO: 8317003 - DNA, 22 bp, Homo sapiens
gcctctgtcatagctcatgtga

SEQ ID NO: 8317004 - DNA, 18 bp, Homo sapiens
gcctctgttgcttgcctg

SEQ ID NO: 8317005 - DNA, 22 bp, Homo sapiens
gcctctggggtggagcccagca

SEQ ID NO: 8317006 - DNA, 22 bp, Homo sapiens
gcggtggggaaaggaggtgctg

SEQ ID NO: 8317007 - DNA, 22 bp, Homo sapiens
gcggtgaggaactggtgggaag

SEQ ID NO: 8317008 - DNA, 22 bp, Homo sapiens
gcgtggcttagagtggggtacc

SEQ ID NO: 8317009 - DNA, 22 bp, Homo sapiens
gcgtggagacaactctggggtg

SEQ ID NO: 8317010 - DNA, 18 bp, Homo sapiens
gcgtggagcgggctcggt

SEQ ID NO: 8317011 - DNA, 22 bp, Homo sapiens
gcctttcatctcagctggccgg

SEQ ID NO: 8317012 - DNA, 22 bp, Homo sapiens
gcctttcagttccatcaaagga

SEQ ID NO: 8317013 - DNA, 22 bp, Homo sapiens
gcctttcatgcttggagggcca

SEQ ID NO: 8317014 - DNA, 22 bp, Homo sapiens
gcggggttccgtgccccagagt

SEQ ID NO: 8317015 - DNA, 22 bp, Homo sapiens
gcctttcagtgccttctgttca

SEQ ID NO: 8317016 - DNA, 22 bp, Homo sapiens
gcctttcactggtgccggctgt

SEQ ID NO: 8317017 - DNA, 22 bp, Homo sapiens
gcctttcacagagatttaaaaa

SEQ ID NO: 8317018 - DNA, 22 bp, Homo sapiens
gccttgtttcattacacgtggt

SEQ ID NO: 8317019 - DNA, 22 bp, Homo sapiens
gctggctgttggaggtacctgc

SEQ ID NO: 8317020 - DNA, 22 bp, Homo sapiens
gctggctgttggaggtacctgc

SEQ ID NO: 8317021 - DNA, 22 bp, Homo sapiens
gctggcttaatagggatgggct

SEQ ID NO: 8317022 - DNA, 21 bp, Homo sapiens
gctggcttcctgagggctgag

SEQ ID NO: 8317023 - DNA, 18 bp, Homo sapiens
gctggcttgctgggtttg

SEQ ID NO: 8317024 - DNA, 22 bp, Homo sapiens
gctggctgtgtttcatctctga

SEQ ID NO: 8317025 - DNA, 22 bp, Homo sapiens
gctggctgttgaataatggcat

SEQ ID NO: 8317026 - DNA, 22 bp, Homo sapiens
gctggctgtgttccttctgcca

SEQ ID NO: 8317027 - DNA, 22 bp, Homo sapiens
gctggctgtgtttcatctctga

SEQ ID NO: 8317028 - DNA, 22 bp, Homo sapiens
gctggctgtggcttaagcaaac

SEQ ID NO: 8317029 - DNA, 22 bp, Homo sapiens
gctggctgtgggctccacgctc

SEQ ID NO: 8317030 - DNA, 22 bp, Homo sapiens
gctggctgtgggctccacgctc

SEQ ID NO: 8317031 - DNA, 22 bp, Homo sapiens
gctggctgtgggctccacgctc

SEQ ID NO: 8317032 - DNA, 21 bp, Homo sapiens
gctggctggctgaccggcctt

SEQ ID NO: 8317033 - DNA, 22 bp, Homo sapiens
gctggctggcgggtgcgtcctc

SEQ ID NO: 8317034 - DNA, 22 bp, Homo sapiens
gctggctttgtcaagggcagca

SEQ ID NO: 8317035 - DNA, 22 bp, Homo sapiens
gctggctttgcactgggtgcat

SEQ ID NO: 8317036 - DNA, 21 bp, Homo sapiens
gctggctttcctggatgtgca

SEQ ID NO: 8317037 - DNA, 22 bp, Homo sapiens
gctggcttgtcccaggacaaag

SEQ ID NO: 8317038 - DNA, 22 bp, Homo sapiens
gctggctttatggggcttgtgg

SEQ ID NO: 8317039 - DNA, 22 bp, Homo sapiens
gctgggctggaaggccaaggca

SEQ ID NO: 8317040 - DNA, 22 bp, Homo sapiens
gctggctgcgtcatcacagggc

SEQ ID NO: 8317041 - DNA, 22 bp, Homo sapiens
gctggctgctgttgagacttgt

SEQ ID NO: 8317042 - DNA, 22 bp, Homo sapiens
gctggctgctaggacagctaca

SEQ ID NO: 8317043 - DNA, 22 bp, Homo sapiens
gctggctgctaggacagctaca

SEQ ID NO: 8317044 - DNA, 22 bp, Homo sapiens
gctggagaaacaggaggaggaa

SEQ ID NO: 8317045 - DNA, 22 bp, Homo sapiens
gctgctttagaattgaaacaga

SEQ ID NO: 8317046 - DNA, 22 bp, Homo sapiens
gctggagacctcagagaaccca

SEQ ID NO: 8317047 - DNA, 22 bp, Homo sapiens
gctggagaaactgcagctgagg

SEQ ID NO: 8317048 - DNA, 22 bp, Homo sapiens
gctggagaaactgcagctgagg

SEQ ID NO: 8317049 - DNA, 22 bp, Homo sapiens
gctggctggcgggtgcgtcctc

SEQ ID NO: 8317050 - DNA, 23 bp, Homo sapiens
gctggctggcagtaaaggttgtt

SEQ ID NO: 8317051 - DNA, 22 bp, Homo sapiens
gctggctggagtgagctaccct

SEQ ID NO: 8317052 - DNA, 22 bp, Homo sapiens
gctggctggatggttggttcgc

SEQ ID NO: 8317053 - DNA, 22 bp, Homo sapiens
gctggctggcacgttcgcacgt

SEQ ID NO: 8317054 - DNA, 22 bp, Homo sapiens
gctggctggcacgttcgcacgt

SEQ ID NO: 8317055 - DNA, 22 bp, Homo sapiens
gctggctggaggtgaggaagaa

SEQ ID NO: 8317056 - DNA, 22 bp, Homo sapiens
gctggctggagtaaggagggag

SEQ ID NO: 8317057 - DNA, 22 bp, Homo sapiens
gctggctggagtgagctaccct

SEQ ID NO: 8317058 - DNA, 19 bp, Homo sapiens
gctggctggaggagggaca

SEQ ID NO: 8317059 - DNA, 22 bp, Homo sapiens
gctggctggaggagggaggttg

SEQ ID NO: 8317060 - DNA, 22 bp, Homo sapiens
gctggctggaatgggagaagaa

SEQ ID NO: 8317061 - DNA, 22 bp, Homo sapiens
gctggctggaactagcagttgg

SEQ ID NO: 8317062 - DNA, 22 bp, Homo sapiens
gctggggcctgaacagtcagct

SEQ ID NO: 8317063 - DNA, 22 bp, Homo sapiens
gctggggaggcagcagagaaca

SEQ ID NO: 8317064 - DNA, 22 bp, Homo sapiens
gctggggcctgaacagtcagct

SEQ ID NO: 8317065 - DNA, 19 bp, Homo sapiens
gctgtgggacagcagggtg

SEQ ID NO: 8317066 - DNA, 22 bp, Homo sapiens
gctgtggctgacattgcagaca

SEQ ID NO: 8317067 - DNA, 22 bp, Homo sapiens
gctgtgggtaaacgctgagggt

SEQ ID NO: 8317068 - DNA, 22 bp, Homo sapiens
gcttctggtgaggcctcaggaa

SEQ ID NO: 8317069 - DNA, 22 bp, Homo sapiens
gctgtgtaaacttgtacagtgc

SEQ ID NO: 8317070 - DNA, 22 bp, Homo sapiens
gctgtgtccaggtgggggtgac

SEQ ID NO: 8317071 - DNA, 22 bp, Homo sapiens
gcttgctggtgcctgcaggctc

SEQ ID NO: 8317072 - DNA, 19 bp, Homo sapiens
gcttgctggcgggggtctg

SEQ ID NO: 8317073 - DNA, 19 bp, Homo sapiens
gcttgctgctaggtaggga

SEQ ID NO: 8317074 - DNA, 22 bp, Homo sapiens
gcttgatgatacctaggagatg

SEQ ID NO: 8317075 - DNA, 22 bp, Homo sapiens
gctttggagtcagaaagaccta

SEQ ID NO: 8317076 - DNA, 22 bp, Homo sapiens
ggaagacaagcagtggctgagc

SEQ ID NO: 8317077 - DNA, 22 bp, Homo sapiens
gctttgctatgactcaccagca

SEQ ID NO: 8317078 - DNA, 22 bp, Homo sapiens
gctttgctggcttgaaatgctg

SEQ ID NO: 8317079 - DNA, 22 bp, Homo sapiens
gctttgcttccttccccttcaa

SEQ ID NO: 8317080 - DNA, 22 bp, Homo sapiens
gctttggaacttaaatccttgg

SEQ ID NO: 8317081 - DNA, 22 bp, Homo sapiens
gctttggaacttaaatccttgg

SEQ ID NO: 8317082 - DNA, 22 bp, Homo sapiens
gctttcatgaaaataatctact

SEQ ID NO: 8317083 - DNA, 22 bp, Homo sapiens
gctttccctgccctcagaagga

SEQ ID NO: 8317084 - DNA, 22 bp, Homo sapiens
ggaagatgagaagtggggctcc

SEQ ID NO: 8317085 - DNA, 22 bp, Homo sapiens
ggaagagtgcaggtttgtttca

SEQ ID NO: 8317086 - DNA, 22 bp, Homo sapiens
ggaagagggaaccacgactgta

SEQ ID NO: 8317087 - DNA, 18 bp, Homo sapiens
ggacacagataggtacag

SEQ ID NO: 8317088 - DNA, 22 bp, Homo sapiens
ggacaaaaatcagccatctcta

SEQ ID NO: 8317089 - DNA, 22 bp, Homo sapiens
ggagacagtgacttagagactg

SEQ ID NO: 8317090 - DNA, 22 bp, Homo sapiens
ggagagaactgacctgaaagga

SEQ ID NO: 8317091 - DNA, 22 bp, Homo sapiens
ggagacttgagtttttgtctta

SEQ ID NO: 8317092 - DNA, 22 bp, Homo sapiens
ggagagagagctcattagctgc

SEQ ID NO: 8317093 - DNA, 22 bp, Homo sapiens
ggagagagagattgtgtttatt

SEQ ID NO: 8317094 - DNA, 22 bp, Homo sapiens
ggagagagacctccatgcccag

SEQ ID NO: 8317095 - DNA, 17 bp, Homo sapiens
ggaccaggggttgccat

SEQ ID NO: 8317096 - DNA, 22 bp, Homo sapiens
ggaccaggggcgcactccctgc

SEQ ID NO: 8317097 - DNA, 19 bp, Homo sapiens
ggaccaggtcctgggcagc

SEQ ID NO: 8317098 - DNA, 22 bp, Homo sapiens
ggaccaggagctcagagccctc

SEQ ID NO: 8317099 - DNA, 22 bp, Homo sapiens
ggaccaggactggtggtatctc

SEQ ID NO: 8317100 - DNA, 22 bp, Homo sapiens
ggaccaggagctcagagccctc

SEQ ID NO: 8317101 - DNA, 22 bp, Homo sapiens
ggaccaggcaagctgaggcggg

SEQ ID NO: 8317102 - DNA, 22 bp, Homo sapiens
ggaccaggccagcctccctgcg

SEQ ID NO: 8317103 - DNA, 22 bp, Homo sapiens
ggaccaggctgagcacctgcct

SEQ ID NO: 8317104 - DNA, 22 bp, Homo sapiens
ggaccaggctgagcacctgcct

SEQ ID NO: 8317105 - DNA, 20 bp, Homo sapiens
ggaccagctgtctgaggggc

SEQ ID NO: 8317106 - DNA, 22 bp, Homo sapiens
ggacacaggcagctgggtgggt

SEQ ID NO: 8317107 - DNA, 22 bp, Homo sapiens
ggacagtgaatctggaggtata

SEQ ID NO: 8317108 - DNA, 22 bp, Homo sapiens
gccccaccttgagagcagaaac

SEQ ID NO: 8317109 - DNA, 22 bp, Homo sapiens
gcccatggtcagggaggcaggg

SEQ ID NO: 8317110 - DNA, 22 bp, Homo sapiens
gcccatggcttccctaggcaca

SEQ ID NO: 8317111 - DNA, 22 bp, Homo sapiens
gcccatggcagaactgtgagca

SEQ ID NO: 8317112 - DNA, 22 bp, Homo sapiens
gcccaggagaggccagggctga

SEQ ID NO: 8317113 - DNA, 22 bp, Homo sapiens
gcccaggagcctggagatgtgt

SEQ ID NO: 8317114 - DNA, 22 bp, Homo sapiens
gcccagctggcttccagcacat

SEQ ID NO: 8317115 - DNA, 22 bp, Homo sapiens
gcccaggaaataaaagtgggct

SEQ ID NO: 8317116 - DNA, 22 bp, Homo sapiens
gcccaggaaagatagggcctca

SEQ ID NO: 8317117 - DNA, 22 bp, Homo sapiens
gcccaggaagttgaggctgccg

SEQ ID NO: 8317118 - DNA, 16 bp, Homo sapiens
gcccaggacgggaggc

SEQ ID NO: 8317119 - DNA, 17 bp, Homo sapiens
gcccaggaaggacggcc

SEQ ID NO: 8317120 - DNA, 22 bp, Homo sapiens
gcccaggaagtgactcagatgt

SEQ ID NO: 8317121 - DNA, 22 bp, Homo sapiens
gcccaggaaatgccccgtggtg

SEQ ID NO: 8317122 - DNA, 22 bp, Homo sapiens
gcccagcgagcagaggtggacg

SEQ ID NO: 8317123 - DNA, 19 bp, Homo sapiens
gcccagcgaaggggatgac

SEQ ID NO: 8317124 - DNA, 22 bp, Homo sapiens
gcccagcctccaagctccaagg

SEQ ID NO: 8317125 - DNA, 22 bp, Homo sapiens
gcccagccctgaggtcacagct

SEQ ID NO: 8317126 - DNA, 22 bp, Homo sapiens
gcccagcacattgctgaggacc

SEQ ID NO: 8317127 - DNA, 22 bp, Homo sapiens
gcccagcacatctggccttgaa

SEQ ID NO: 8317128 - DNA, 22 bp, Homo sapiens
gcccagcacagctggaagagtc

SEQ ID NO: 8317129 - DNA, 21 bp, Homo sapiens
gcccagcaaggtgagaaggcc

SEQ ID NO: 8317130 - DNA, 22 bp, Homo sapiens
gccccagcctcccgagtagctg

SEQ ID NO: 8317131 - DNA, 22 bp, Homo sapiens
gccccagccaaggtgacacgaa

SEQ ID NO: 8317132 - DNA, 22 bp, Homo sapiens
gccccagccctgtggaccatgg

SEQ ID NO: 8317133 - DNA, 22 bp, Homo sapiens
gccccagcctgggaactggagg

SEQ ID NO: 8317134 - DNA, 22 bp, Homo sapiens
gccctgggattgggtggaggct

SEQ ID NO: 8317135 - DNA, 22 bp, Homo sapiens
gccctgggattgggtggaggct

SEQ ID NO: 8317136 - DNA, 22 bp, Homo sapiens
gcctcctgagaagccacaggct

SEQ ID NO: 8317137 - DNA, 22 bp, Homo sapiens
gcctcctgagaagccacaggct

SEQ ID NO: 8317138 - DNA, 22 bp, Homo sapiens
gcctcctgagtagctgggattg

SEQ ID NO: 8317139 - DNA, 22 bp, Homo sapiens
gcctcctcttgagggtcaggga

SEQ ID NO: 8317140 - DNA, 22 bp, Homo sapiens
gcctcctgaagtgctgggatta

SEQ ID NO: 8317141 - DNA, 22 bp, Homo sapiens
gcctcctccttcccgagggtct

SEQ ID NO: 8317142 - DNA, 22 bp, Homo sapiens
gcctccggagttgcagtgtctt

SEQ ID NO: 8317143 - DNA, 22 bp, Homo sapiens
gcctccggagtcacagtgtctt

SEQ ID NO: 8317144 - DNA, 22 bp, Homo sapiens
gccagggaacccaagggcctca

SEQ ID NO: 8317145 - DNA, 22 bp, Homo sapiens
gccagggagtctgggccacaga

SEQ ID NO: 8317146 - DNA, 22 bp, Homo sapiens
gccagctcagtttcaaagtagg

SEQ ID NO: 8317147 - DNA, 20 bp, Homo sapiens
gccagccctgacacaggagc

SEQ ID NO: 8317148 - DNA, 21 bp, Homo sapiens
gccacccctggcacaggtgct

SEQ ID NO: 8317149 - DNA, 22 bp, Homo sapiens
gccacccccaagtaggtggtct

SEQ ID NO: 8317150 - DNA, 22 bp, Homo sapiens
gccaccccataggtgttaggtg

SEQ ID NO: 8317151 - DNA, 22 bp, Homo sapiens
gccaccccaacctccctaagtt

SEQ ID NO: 8317152 - DNA, 21 bp, Homo sapiens
gccagcctgtttacctgtggt

SEQ ID NO: 8317153 - DNA, 22 bp, Homo sapiens
gccacatgcaattgcagcacgt

SEQ ID NO: 8317154 - DNA, 22 bp, Homo sapiens
gccacatgtcatgtgctcagta

SEQ ID NO: 8317155 - DNA, 22 bp, Homo sapiens
gccacatccttcagaaagcttt

SEQ ID NO: 8317156 - DNA, 21 bp, Homo sapiens
gcatgcctgcatcttagtgtt

SEQ ID NO: 8317157 - DNA, 22 bp, Homo sapiens
gcatggctgttgaagtcagctc

SEQ ID NO: 8317158 - DNA, 22 bp, Homo sapiens
gcatggctattctaactcacat

SEQ ID NO: 8317159 - DNA, 22 bp, Homo sapiens
gcagtgatggggatctcactgg

SEQ ID NO: 8317160 - DNA, 22 bp, Homo sapiens
gcagtggcagagacagcaccaa

SEQ ID NO: 8317161 - DNA, 22 bp, Homo sapiens
gcagtggctaggagtctggcgt

SEQ ID NO: 8317162 - DNA, 22 bp, Homo sapiens
gcaaagacaaattagaactcct

SEQ ID NO: 8317163 - DNA, 22 bp, Homo sapiens
gcaaagatattagaatagagta

SEQ ID NO: 8317164 - DNA, 22 bp, Homo sapiens
gaggcccagagaggttgcatga

SEQ ID NO: 8317165 - DNA, 20 bp, Homo sapiens
gaggcccagagaggtgaagc

SEQ ID NO: 8317166 - DNA, 22 bp, Homo sapiens
gaggccagggtaccatcaacat

SEQ ID NO: 8317167 - DNA, 21 bp, Homo sapiens
gcacagtaagaaaagctgcct

SEQ ID NO: 8317168 - DNA, 22 bp, Homo sapiens
gcacagtgataggcagttgtgc

SEQ ID NO: 8317169 - DNA, 22 bp, Homo sapiens
gcacagggctgccaggcggctt

SEQ ID NO: 8317170 - DNA, 22 bp, Homo sapiens
gcacaggctccggaggagagct

SEQ ID NO: 8317171 - DNA, 19 bp, Homo sapiens
gcacaccctgcaccaccat

SEQ ID NO: 8317172 - DNA, 22 bp, Homo sapiens
gcacaggccatgggaggacagc

SEQ ID NO: 8317173 - DNA, 22 bp, Homo sapiens
gcaaatcaccacctagctggat

SEQ ID NO: 8317174 - DNA, 22 bp, Homo sapiens
gcagagaagatgcccaggcttc

SEQ ID NO: 8317175 - DNA, 21 bp, Homo sapiens
gcagaggcacggcaccaaggg

SEQ ID NO: 8317176 - DNA, 22 bp, Homo sapiens
gcagaggcacagccccagatga

SEQ ID NO: 8317177 - DNA, 22 bp, Homo sapiens
gcagaggccaggccaccagcaa

SEQ ID NO: 8317178 - DNA, 22 bp, Homo sapiens
gcagaggccaggccaccagcaa

SEQ ID NO: 8317179 - DNA, 22 bp, Homo sapiens
gcagaggcatttctgacgctgc

SEQ ID NO: 8317180 - DNA, 22 bp, Homo sapiens
gcagagggtcctgtgccagcag

SEQ ID NO: 8317181 - DNA, 22 bp, Homo sapiens
gcagccctggcctggcctactt

SEQ ID NO: 8317182 - DNA, 18 bp, Homo sapiens
gcagcccctcttccttcc

SEQ ID NO: 8317183 - DNA, 22 bp, Homo sapiens
gcagccctcgggtactcacgtg

SEQ ID NO: 8317184 - DNA, 22 bp, Homo sapiens
gcagggacagggcagggccttt

SEQ ID NO: 8317185 - DNA, 22 bp, Homo sapiens
gcagggaccaaaagaggcagta

SEQ ID NO: 8317186 - DNA, 22 bp, Homo sapiens
gcagggctggggctgctcctga

SEQ ID NO: 8317187 - DNA, 22 bp, Homo sapiens
gcagggctgaaggtcccaggcc

SEQ ID NO: 8317188 - DNA, 22 bp, Homo sapiens
ggcttctgctcagcctgcacgc

SEQ ID NO: 8317189 - DNA, 21 bp, Homo sapiens
ggctgctgggagagctgcgtg

SEQ ID NO: 8317190 - DNA, 21 bp, Homo sapiens
ggctgctgggagagctgcgtg

SEQ ID NO: 8317191 - DNA, 22 bp, Homo sapiens
ggctggcttgcggagtcacaga

SEQ ID NO: 8317192 - DNA, 22 bp, Homo sapiens
ggctgctggcagatgtagttta

SEQ ID NO: 8317193 - DNA, 22 bp, Homo sapiens
ggctgctggcattgaggtaggt

SEQ ID NO: 8317194 - DNA, 22 bp, Homo sapiens
ggctgctgggaatatgccagct

SEQ ID NO: 8317195 - DNA, 22 bp, Homo sapiens
ggctgctgggaatatgccagct

SEQ ID NO: 8317196 - DNA, 22 bp, Homo sapiens
ggctgctgagttggccaggaga

SEQ ID NO: 8317197 - DNA, 22 bp, Homo sapiens
ggctgctgagttggccaggaga

SEQ ID NO: 8317198 - DNA, 22 bp, Homo sapiens
ggctgctgagtcacgacagtga

SEQ ID NO: 8317199 - DNA, 22 bp, Homo sapiens
ggctgctgccctcctaagtgca

SEQ ID NO: 8317200 - DNA, 22 bp, Homo sapiens
ggctgctgcccacccctgcatg

SEQ ID NO: 8317201 - DNA, 22 bp, Homo sapiens
ggctgctgacttcatccagctt

SEQ ID NO: 8317202 - DNA, 22 bp, Homo sapiens
ggctgagaggacgtcgggctca

SEQ ID NO: 8317203 - DNA, 22 bp, Homo sapiens
ggctgagagtggatcccaggga

SEQ ID NO: 8317204 - DNA, 22 bp, Homo sapiens
ggctctggctcctggctttgtg

SEQ ID NO: 8317205 - DNA, 22 bp, Homo sapiens
ggctgagactagagtgaggcat

SEQ ID NO: 8317206 - DNA, 23 bp, Homo sapiens
ggctgagactacaggcgcttgcc

SEQ ID NO: 8317207 - DNA, 22 bp, Homo sapiens
ggctgagactagagtgaggcat

SEQ ID NO: 8317208 - DNA, 22 bp, Homo sapiens
ggctgagaatcaacaacctgct

SEQ ID NO: 8317209 - DNA, 22 bp, Homo sapiens
ggctgagaatcaacaacctgct

SEQ ID NO: 8317210 - DNA, 22 bp, Homo sapiens
ggctgagaagacagtggggtgg

SEQ ID NO: 8317211 - DNA, 22 bp, Homo sapiens
ggctgagaaggagtgggtgagg

SEQ ID NO: 8317212 - DNA, 22 bp, Homo sapiens
ggctgagaacaggcccagcctc

SEQ ID NO: 8317213 - DNA, 22 bp, Homo sapiens
ggctgaaaggtagtagtaggct

SEQ ID NO: 8317214 - DNA, 22 bp, Homo sapiens
ggctcttgaaatgtggctggcg

SEQ ID NO: 8317215 - DNA, 22 bp, Homo sapiens
ggctcttgagaggcacaggttt

SEQ ID NO: 8317216 - DNA, 22 bp, Homo sapiens
ggctcttgcccgcccaggctgg

SEQ ID NO: 8317217 - DNA, 22 bp, Homo sapiens
ggcgggaggctgaggagttggt

SEQ ID NO: 8317218 - DNA, 22 bp, Homo sapiens
ggcgggaggctgaggagttggt

SEQ ID NO: 8317219 - DNA, 22 bp, Homo sapiens
ggcgggaagttcttgcccactt

SEQ ID NO: 8317220 - DNA, 22 bp, Homo sapiens
ggctccagatgtcccctggcaa

SEQ ID NO: 8317221 - DNA, 22 bp, Homo sapiens
ggctccagatgtcccctggcaa

SEQ ID NO: 8317222 - DNA, 22 bp, Homo sapiens
ggctccagaggccttacctgca

SEQ ID NO: 8317223 - DNA, 22 bp, Homo sapiens
ggctccagaaacttcagtccat

SEQ ID NO: 8317224 - DNA, 22 bp, Homo sapiens
ggctccaccctgcttccagaag

SEQ ID NO: 8317225 - DNA, 22 bp, Homo sapiens
ggctccagaaacttcagtccat

SEQ ID NO: 8317226 - DNA, 22 bp, Homo sapiens
ggctccagctaatggtttctat

SEQ ID NO: 8317227 - DNA, 22 bp, Homo sapiens
ggctccaggaacctcctctcct

SEQ ID NO: 8317228 - DNA, 18 bp, Homo sapiens
ggctccaggacctaccca

SEQ ID NO: 8317229 - DNA, 18 bp, Homo sapiens
ggctccaggacctaccca

SEQ ID NO: 8317230 - DNA, 18 bp, Homo sapiens
ggctccaggacctaccca

SEQ ID NO: 8317231 - DNA, 22 bp, Homo sapiens
ggctccagatgtctcctggcaa

SEQ ID NO: 8317232 - DNA, 22 bp, Homo sapiens
ggctccagatgtctcctggcaa

SEQ ID NO: 8317233 - DNA, 22 bp, Homo sapiens
ggctctgctgcaagtcttcctc

SEQ ID NO: 8317234 - DNA, 22 bp, Homo sapiens
ggctctggagacatgtggagag

SEQ ID NO: 8317235 - DNA, 22 bp, Homo sapiens
ggctccaggagatgctgggcag

SEQ ID NO: 8317236 - DNA, 22 bp, Homo sapiens
ggctccaggagggccttggcca

SEQ ID NO: 8317237 - DNA, 22 bp, Homo sapiens
ggctccaggagggccttggcca

SEQ ID NO: 8317238 - DNA, 22 bp, Homo sapiens
gggcacaggaatttgggatgtg

SEQ ID NO: 8317239 - DNA, 22 bp, Homo sapiens
gggcacaggaatttgggatgtg

SEQ ID NO: 8317240 - DNA, 22 bp, Homo sapiens
gggcagctctggctgtgggaag

SEQ ID NO: 8317241 - DNA, 22 bp, Homo sapiens
gggcagctgcagggatggtgac

SEQ ID NO: 8317242 - DNA, 22 bp, Homo sapiens
gggcagctgccagaggccatgg

SEQ ID NO: 8317243 - DNA, 22 bp, Homo sapiens
gggcaggctgagcatgtcacct

SEQ ID NO: 8317244 - DNA, 22 bp, Homo sapiens
gggcaggctgagcatgtcacct

SEQ ID NO: 8317245 - DNA, 22 bp, Homo sapiens
gggatggggtcgggaccctgct

SEQ ID NO: 8317246 - DNA, 22 bp, Homo sapiens
gggcacagcccagtggggtccc

SEQ ID NO: 8317247 - DNA, 22 bp, Homo sapiens
gggcacagcctaactatggaga

SEQ ID NO: 8317248 - DNA, 22 bp, Homo sapiens
gggaggagcttggagattcact

SEQ ID NO: 8317249 - DNA, 22 bp, Homo sapiens
gggaggagcttggagattcact

SEQ ID NO: 8317250 - DNA, 22 bp, Homo sapiens
gggaggagctgagtgtgtgtgc

SEQ ID NO: 8317251 - DNA, 22 bp, Homo sapiens
gggaggaaatgtgcagcgaatt

SEQ ID NO: 8317252 - DNA, 23 bp, Homo sapiens
gggaccagctagggctgtgacct

SEQ ID NO: 8317253 - DNA, 22 bp, Homo sapiens
gggaccagaggctgtgcacaat

SEQ ID NO: 8317254 - DNA, 23 bp, Homo sapiens
gggaccagctagggctgtgacct

SEQ ID NO: 8317255 - DNA, 22 bp, Homo sapiens
gggaccactccgacatgtaggg

SEQ ID NO: 8317256 - DNA, 22 bp, Homo sapiens
gggaccagaagaaggatggtga

SEQ ID NO: 8317257 - DNA, 22 bp, Homo sapiens
gggacagctggtctacctggta

SEQ ID NO: 8317258 - DNA, 22 bp, Homo sapiens
gggacagcagaaagaaggcaag

SEQ ID NO: 8317259 - DNA, 20 bp, Homo sapiens
ggcttgtctgagtccctggc

SEQ ID NO: 8317260 - DNA, 22 bp, Homo sapiens
gggagagatgctgattgccaat

SEQ ID NO: 8317261 - DNA, 19 bp, Homo sapiens
gggagagccaggctcaccc

SEQ ID NO: 8317262 - DNA, 22 bp, Homo sapiens
gggagagaattattgccagacc

SEQ ID NO: 8317263 - DNA, 22 bp, Homo sapiens
gggagagaattattgccagacc

SEQ ID NO: 8317264 - DNA, 22 bp, Homo sapiens
gggagacacgctgcaggcataa

SEQ ID NO: 8317265 - DNA, 22 bp, Homo sapiens
gggagctgtagtccagataccg

SEQ ID NO: 8317266 - DNA, 22 bp, Homo sapiens
gggagaggttacccgagcaact

SEQ ID NO: 8317267 - DNA, 22 bp, Homo sapiens
gggagaggttacccgagcaact

SEQ ID NO: 8317268 - DNA, 22 bp, Homo sapiens
gggagaggttacccgagcaact

SEQ ID NO: 8317269 - DNA, 17 bp, Homo sapiens
gggagatgaagggatat

SEQ ID NO: 8317270 - DNA, 22 bp, Homo sapiens
gggagatgaatcagaagtgatc

SEQ ID NO: 8317271 - DNA, 22 bp, Homo sapiens
ggcaacaactggacatagctgg

SEQ ID NO: 8317272 - DNA, 22 bp, Homo sapiens
ggcaaaagtattatctctttaa

SEQ ID NO: 8317273 - DNA, 22 bp, Homo sapiens
ggcaaacagacttgaccatctt

SEQ ID NO: 8317274 - DNA, 22 bp, Homo sapiens
ggcaaagagatgatctttgcaa

SEQ ID NO: 8317275 - DNA, 22 bp, Homo sapiens
ggagtctacgacctgcttcagg

SEQ ID NO: 8317276 - DNA, 22 bp, Homo sapiens
ggagtgaggcatttgtagctga

SEQ ID NO: 8317277 - DNA, 19 bp, Homo sapiens
ggagccagctgtggaaggc

SEQ ID NO: 8317278 - DNA, 22 bp, Homo sapiens
ggagccagagcactggggagcc

SEQ ID NO: 8317279 - DNA, 22 bp, Homo sapiens
ggagccagagtctgcagtgtaa

SEQ ID NO: 8317280 - DNA, 22 bp, Homo sapiens
ggcacagcgactaccatcgaaa

SEQ ID NO: 8317281 - DNA, 22 bp, Homo sapiens
ggcacagctcaggtcccagctc

SEQ ID NO: 8317282 - DNA, 22 bp, Homo sapiens
ggcacagctgatgcagacacac

SEQ ID NO: 8317283 - DNA, 22 bp, Homo sapiens
ggcagaggtagctggaaccagg

SEQ ID NO: 8317284 - DNA, 22 bp, Homo sapiens
ggcagaggtagctggaaccagg

SEQ ID NO: 8317285 - DNA, 20 bp, Homo sapiens
ggcagagggcctgggagaag

SEQ ID NO: 8317286 - DNA, 22 bp, Homo sapiens
ggccaaggctcttgagggctga

SEQ ID NO: 8317287 - DNA, 22 bp, Homo sapiens
ggccaaggtggagaaggcactg

SEQ ID NO: 8317288 - DNA, 19 bp, Homo sapiens
ggccaggctgactgtggtc

SEQ ID NO: 8317289 - DNA, 22 bp, Homo sapiens
ggccagggcctggggactgtcc

SEQ ID NO: 8317290 - DNA, 22 bp, Homo sapiens
ggcctcagagaaggctgtgcgg

SEQ ID NO: 8317291 - DNA, 23 bp, Homo sapiens
ggcctcagcgcacagaaactgct

SEQ ID NO: 8317292 - DNA, 18 bp, Homo sapiens
ggcctcagcctggccgga

SEQ ID NO: 8317293 - DNA, 21 bp, Homo sapiens
ggcctcagccacctggctctg

SEQ ID NO: 8317294 - DNA, 21 bp, Homo sapiens
ggcctcagccacctggctctg

SEQ ID NO: 8317295 - DNA, 22 bp, Homo sapiens
ggcctcagtgggccgctgcagg

SEQ ID NO: 8317296 - DNA, 22 bp, Homo sapiens
ggcctcagggttgggcccatta

SEQ ID NO: 8317297 - DNA, 22 bp, Homo sapiens
ggcctcagtttcttcaactgta

SEQ ID NO: 8317298 - DNA, 21 bp, Homo sapiens
ggcctctgtcatcctgggaag

SEQ ID NO: 8317299 - DNA, 22 bp, Homo sapiens
ggcctgagtcacatcaggagag

SEQ ID NO: 8317300 - DNA, 22 bp, Homo sapiens
ggcctgagtcacatcaggagag

SEQ ID NO: 8317301 - DNA, 21 bp, Homo sapiens
ggcctgagtataggacaggcc

SEQ ID NO: 8317302 - DNA, 22 bp, Homo sapiens
gggctgctgctgccagcgacac

SEQ ID NO: 8317303 - DNA, 22 bp, Homo sapiens
gggctgctgtagagaacatgtt

SEQ ID NO: 8317304 - DNA, 22 bp, Homo sapiens
gggctgctgccaccaggtggat

SEQ ID NO: 8317305 - DNA, 22 bp, Homo sapiens
gggctgctgccaatcacagcct

SEQ ID NO: 8317306 - DNA, 22 bp, Homo sapiens
gggcttgaacaacttggaggtg

SEQ ID NO: 8317307 - DNA, 22 bp, Homo sapiens
gggcttgaggtgaaggtaggga

SEQ ID NO: 8317308 - DNA, 22 bp, Homo sapiens
gggcttcttgagctgccggccc

SEQ ID NO: 8317309 - DNA, 22 bp, Homo sapiens
gggcttgctgatttgggcagga

SEQ ID NO: 8317310 - DNA, 22 bp, Homo sapiens
gggcttgcttaaggtcacccgg

SEQ ID NO: 8317311 - DNA, 22 bp, Homo sapiens
gggcttggcacatgggctcagc

SEQ ID NO: 8317312 - DNA, 22 bp, Homo sapiens
gggctgctataacaagatacct

SEQ ID NO: 8317313 - DNA, 22 bp, Homo sapiens
gggctgccaagcctgcctgcct

SEQ ID NO: 8317314 - DNA, 22 bp, Homo sapiens
gggctgcatcagcaggacccgg

SEQ ID NO: 8317315 - DNA, 22 bp, Homo sapiens
gggctgcactagggcaaggtga

SEQ ID NO: 8317316 - DNA, 22 bp, Homo sapiens
gggctgagttcctgcctcactc

SEQ ID NO: 8317317 - DNA, 22 bp, Homo sapiens
gggctgaggctaccactggtct

SEQ ID NO: 8317318 - DNA, 22 bp, Homo sapiens
gggctgagagtgactgttctgt

SEQ ID NO: 8317319 - DNA, 22 bp, Homo sapiens
gggctgagattggtgccctgtc

SEQ ID NO: 8317320 - DNA, 22 bp, Homo sapiens
gggctgagctaagctgggttga

SEQ ID NO: 8317321 - DNA, 22 bp, Homo sapiens
gggctgagctaagctgggttga

SEQ ID NO: 8317322 - DNA, 22 bp, Homo sapiens
gggctgagcacatactgacagc

SEQ ID NO: 8317323 - DNA, 22 bp, Homo sapiens
gggctgagcacatactgacagc

SEQ ID NO: 8317324 - DNA, 22 bp, Homo sapiens
gggctgagccacagcttttgtt

SEQ ID NO: 8317325 - DNA, 22 bp, Homo sapiens
gggcatggtgatgtgcacctgt

SEQ ID NO: 8317326 - DNA, 22 bp, Homo sapiens
gggccaagggtgcgtggcagga

SEQ ID NO: 8317327 - DNA, 22 bp, Homo sapiens
ggggctggtggtggtttctcca

SEQ ID NO: 8317328 - DNA, 22 bp, Homo sapiens
ggggtgggcgtgcagggacacc

SEQ ID NO: 8317329 - DNA, 22 bp, Homo sapiens
ggggtgggcgtgcagggacacc

SEQ ID NO: 8317330 - DNA, 22 bp, Homo sapiens
ggggtgtcagcaccagcccctg

SEQ ID NO: 8317331 - DNA, 22 bp, Homo sapiens
ggggtgtctgtgttcttcagtt

SEQ ID NO: 8317332 - DNA, 21 bp, Homo sapiens
ggggttggcaagagcagagac

SEQ ID NO: 8317333 - DNA, 22 bp, Homo sapiens
ggggtgtggacggctgtgccag

SEQ ID NO: 8317334 - DNA, 22 bp, Homo sapiens
gggtggaggagaacaggcccca

SEQ ID NO: 8317335 - DNA, 22 bp, Homo sapiens
gggtggagcttggacaccagta

SEQ ID NO: 8317336 - DNA, 22 bp, Homo sapiens
gggtggaggagaacaggcccca

SEQ ID NO: 8317337 - DNA, 22 bp, Homo sapiens
gggtaggctctgcaggctgggt

SEQ ID NO: 8317338 - DNA, 22 bp, Homo sapiens
gggtaggagaggtgtctgtgtg

SEQ ID NO: 8317339 - DNA, 22 bp, Homo sapiens
gggtaggatggtagaagggacc

SEQ ID NO: 8317340 - DNA, 20 bp, Homo sapiens
ggggctgcatgcagagaaga

SEQ ID NO: 8317341 - DNA, 22 bp, Homo sapiens
ggggctgatggaactcaggcct

SEQ ID NO: 8317342 - DNA, 22 bp, Homo sapiens
ggggctccagtcttcacatttt

SEQ ID NO: 8317343 - DNA, 22 bp, Homo sapiens
ggggctcagttcggacagcctg

SEQ ID NO: 8317344 - DNA, 22 bp, Homo sapiens
ggggctgacgggcatgtggctt

SEQ ID NO: 8317345 - DNA, 22 bp, Homo sapiens
ggggctgaacctggaggtggtc

SEQ ID NO: 8317346 - DNA, 22 bp, Homo sapiens
ggggcctatttgttcaacttcc

SEQ ID NO: 8317347 - DNA, 22 bp, Homo sapiens
ggggaagagcattgcacggtgt

SEQ ID NO: 8317348 - DNA, 22 bp, Homo sapiens
gggtggctgactgttttgtgga

SEQ ID NO: 8317349 - DNA, 22 bp, Homo sapiens
gggtggctcctatgggcatagc

SEQ ID NO: 8317350 - DNA, 22 bp, Homo sapiens
gggtggctaggtatcccccatt

SEQ ID NO: 8317351 - DNA, 20 bp, Homo sapiens
gggtggagttgcggtctgtg

SEQ ID NO: 8317352 - DNA, 22 bp, Homo sapiens
gggtggcacaggtgcagagggt

SEQ ID NO: 8317353 - DNA, 22 bp, Homo sapiens
ggtcacgtgaccgcacctgcct

SEQ ID NO: 8317354 - DNA, 22 bp, Homo sapiens
ggtcacccatgatcacatcacc

SEQ ID NO: 8317355 - DNA, 22 bp, Homo sapiens
ggtcagagccgttagcattcag

SEQ ID NO: 8317356 - DNA, 22 bp, Homo sapiens
ggtcagaggggattccttggga

SEQ ID NO: 8317357 - DNA, 22 bp, Homo sapiens
ggtcagagggtgggctgcctgt

SEQ ID NO: 8317358 - DNA, 19 bp, Homo sapiens
ggtcagagagatccaggct

SEQ ID NO: 8317359 - DNA, 22 bp, Homo sapiens
ggtctcagccctcgccagcagc

SEQ ID NO: 8317360 - DNA, 22 bp, Homo sapiens
ggtctcagaggtttctgctcag

SEQ ID NO: 8317361 - DNA, 22 bp, Homo sapiens
ggtctcagactggcaggcagtg

SEQ ID NO: 8317362 - DNA, 22 bp, Homo sapiens
ggtctcaggagactggagagca

SEQ ID NO: 8317363 - DNA, 22 bp, Homo sapiens
ggtctcaggtagggcctaggaa

SEQ ID NO: 8317364 - DNA, 19 bp, Homo sapiens
ggtctcagtgcagctgcag

SEQ ID NO: 8317365 - DNA, 22 bp, Homo sapiens
ggtctctgttgcctccatcaag

SEQ ID NO: 8317366 - DNA, 22 bp, Homo sapiens
ggtctctgcagctcccggcccc

SEQ ID NO: 8317367 - DNA, 22 bp, Homo sapiens
ggtctctgaacttccactgcgc

SEQ ID NO: 8317368 - DNA, 22 bp, Homo sapiens
ggtctctgaacttccactgcgc

SEQ ID NO: 8317369 - DNA, 22 bp, Homo sapiens
ggtctcctgacctttagtccct

SEQ ID NO: 8317370 - DNA, 22 bp, Homo sapiens
ggtcgctgtgtaggttcagcta

SEQ ID NO: 8317371 - DNA, 18 bp, Homo sapiens
ggtcctgggcctggctca

SEQ ID NO: 8317372 - DNA, 22 bp, Homo sapiens
ggtctggaatggagtaggggtg

SEQ ID NO: 8317373 - DNA, 22 bp, Homo sapiens
ggtctggaccctcctggagtgg

SEQ ID NO: 8317374 - DNA, 22 bp, Homo sapiens
ggtggcctcagcaaggctggca

SEQ ID NO: 8317375 - DNA, 22 bp, Homo sapiens
ggtctggcctccgggcaggtgg

SEQ ID NO: 8317376 - DNA, 22 bp, Homo sapiens
ggtggctcacgcctgtaagccc

SEQ ID NO: 8317377 - DNA, 17 bp, Homo sapiens
ggtggcctgcagtggct

SEQ ID NO: 8317378 - DNA, 22 bp, Homo sapiens
ggtggcctgaattagctcaggg

SEQ ID NO: 8317379 - DNA, 22 bp, Homo sapiens
ggtggcctggaatcttaacaag

SEQ ID NO: 8317380 - DNA, 22 bp, Homo sapiens
ggtggcctctcatgcaaggtag

SEQ ID NO: 8317381 - DNA, 22 bp, Homo sapiens
ggtggcctctgcaggcctcgac

SEQ ID NO: 8317382 - DNA, 22 bp, Homo sapiens
ggtggcctcttgtttagccagc

SEQ ID NO: 8317383 - DNA, 22 bp, Homo sapiens
ggtggcctcggtggtgcacagg

SEQ ID NO: 8317384 - DNA, 22 bp, Homo sapiens
ggtggcctcgccgcggctctgc

SEQ ID NO: 8317385 - DNA, 19 bp, Homo sapiens
ggtgtgtgctggggcctgt

SEQ ID NO: 8317386 - DNA, 22 bp, Homo sapiens
ggtgtggatcatctgaggtcag

SEQ ID NO: 8317387 - DNA, 22 bp, Homo sapiens
gtattcccagagtgttacatac

SEQ ID NO: 8317388 - DNA, 22 bp, Homo sapiens
gtatttaattccattaagttag

SEQ ID NO: 8317389 - DNA, 22 bp, Homo sapiens
gtagaaattccatttactttga

SEQ ID NO: 8317390 - DNA, 22 bp, Homo sapiens
gtagaaatgtaaccaggagata

SEQ ID NO: 8317391 - DNA, 22 bp, Homo sapiens
gtagaaatggtgtgtttcttct

SEQ ID NO: 8317392 - DNA, 22 bp, Homo sapiens
gtattacatttagtaattaggc

SEQ ID NO: 8317393 - DNA, 22 bp, Homo sapiens
gtaaaaggtcaaggccaagtct

SEQ ID NO: 8317394 - DNA, 22 bp, Homo sapiens
gtaaaactgtctaatggtatat

SEQ ID NO: 8317395 - DNA, 22 bp, Homo sapiens
gtaaaactgcagaacttggagg

SEQ ID NO: 8317396 - DNA, 22 bp, Homo sapiens
gtaaaacatgttttaactagga

SEQ ID NO: 8317397 - DNA, 22 bp, Homo sapiens
gtaaaacaagctttatggttcc

SEQ ID NO: 8317398 - DNA, 22 bp, Homo sapiens
ggttttattaccccttaaacac

SEQ ID NO: 8317399 - DNA, 22 bp, Homo sapiens
ggttttattaactttaacatca

SEQ ID NO: 8317400 - DNA, 22 bp, Homo sapiens
ggttttatagcagtactatcag

SEQ ID NO: 8317401 - DNA, 22 bp, Homo sapiens
ggttttatcctacccacacagc

SEQ ID NO: 8317402 - DNA, 22 bp, Homo sapiens
gtccccagagctggtggtggtt

SEQ ID NO: 8317403 - DNA, 22 bp, Homo sapiens
gtccccagaaaggtgaggcagg

SEQ ID NO: 8317404 - DNA, 22 bp, Homo sapiens
gtccccagctaatctctttgcc

SEQ ID NO: 8317405 - DNA, 22 bp, Homo sapiens
gtcccctgtccagggccagcca

SEQ ID NO: 8317406 - DNA, 22 bp, Homo sapiens
gtccccttaaacatgctctctt

SEQ ID NO: 8317407 - DNA, 22 bp, Homo sapiens
gtccccttggtaaccttcagct

SEQ ID NO: 8317408 - DNA, 22 bp, Homo sapiens
gtcccctggtggctggagctgc

SEQ ID NO: 8317409 - DNA, 22 bp, Homo sapiens
gtcccctggcccccagcgtcgg

SEQ ID NO: 8317410 - DNA, 22 bp, Homo sapiens
gtccctggaaaagagctggtga

SEQ ID NO: 8317411 - DNA, 17 bp, Homo sapiens
gtcctgggaggagagag

SEQ ID NO: 8317412 - DNA, 22 bp, Homo sapiens
gtgcagtgaaaaaagaatgtcc

SEQ ID NO: 8317413 - DNA, 22 bp, Homo sapiens
gtgcagaggacgtggcggcctc

SEQ ID NO: 8317414 - DNA, 21 bp, Homo sapiens
gtgcagaggaatgtagggggc

SEQ ID NO: 8317415 - DNA, 22 bp, Homo sapiens
gtgcagagcaagggctgagggc

SEQ ID NO: 8317416 - DNA, 20 bp, Homo sapiens
gtgcagaggcagcctgtggg

SEQ ID NO: 8317417 - DNA, 22 bp, Homo sapiens
gtgcagggtagcgacggcagga

SEQ ID NO: 8317418 - DNA, 23 bp, Homo sapiens
gtgactgggtctccacctcttgg

SEQ ID NO: 8317419 - DNA, 22 bp, Homo sapiens
gtgactgtttttaggaggagta

SEQ ID NO: 8317420 - DNA, 22 bp, Homo sapiens
gtgagaaatggaacttcatacg

SEQ ID NO: 8317421 - DNA, 22 bp, Homo sapiens
gtgagaaaattgcctaattttg

SEQ ID NO: 8317422 - DNA, 22 bp, Homo sapiens
gtgagacaagatttgtaggcag

SEQ ID NO: 8317423 - DNA, 22 bp, Homo sapiens
gtgagacaattcctcagtagac

SEQ ID NO: 8317424 - DNA, 22 bp, Homo sapiens
gtgcagagaggaccttggggag

SEQ ID NO: 8317425 - DNA, 22 bp, Homo sapiens
gtgcactgtctggtcaagagca

SEQ ID NO: 8317426 - DNA, 22 bp, Homo sapiens
gtgcacttgatctagacagatt

SEQ ID NO: 8317427 - DNA, 22 bp, Homo sapiens
gtgcagaagtaacaattaaaga

SEQ ID NO: 8317428 - DNA, 22 bp, Homo sapiens
gtgcacagatttaattttattc

SEQ ID NO: 8317429 - DNA, 22 bp, Homo sapiens
gtgaccatcagagaataacaaa

SEQ ID NO: 8317430 - DNA, 22 bp, Homo sapiens
gtgaccataatagattatgagt

SEQ ID NO: 8317431 - DNA, 22 bp, Homo sapiens
gtgaccatcctggtaatgaatc

SEQ ID NO: 8317432 - DNA, 22 bp, Homo sapiens
gtgaccatttgacatatccttg

SEQ ID NO: 8317433 - DNA, 22 bp, Homo sapiens
gtgaagaaggcaatacaaagaa

SEQ ID NO: 8317434 - DNA, 22 bp, Homo sapiens
gtgaaaataaggctggttcttg

SEQ ID NO: 8317435 - DNA, 22 bp, Homo sapiens
gtctgctcatgctaccgcgggc

SEQ ID NO: 8317436 - DNA, 22 bp, Homo sapiens
gtctgccctgcagacatgcctc

SEQ ID NO: 8317437 - DNA, 22 bp, Homo sapiens
gtctgcccttggctcagccata

SEQ ID NO: 8317438 - DNA, 22 bp, Homo sapiens
gtcctgggcggagggctgctgt

SEQ ID NO: 8317439 - DNA, 22 bp, Homo sapiens
gtcctgggcctgctgaggctga

SEQ ID NO: 8317440 - DNA, 22 bp, Homo sapiens
gtctgccctgagctcccagtgc

SEQ ID NO: 8317441 - DNA, 22 bp, Homo sapiens
gtctgcccggccttcctccacc

SEQ ID NO: 8317442 - DNA, 22 bp, Homo sapiens
gtctgccctcacatgcactctt

SEQ ID NO: 8317443 - DNA, 22 bp, Homo sapiens
gtctgccctcacgccagctggg

SEQ ID NO: 8317444 - DNA, 22 bp, Homo sapiens
gtctgccctggggcatcagttt

SEQ ID NO: 8317445 - DNA, 22 bp, Homo sapiens
gtctgccctgctgatctcaccc

SEQ ID NO: 8317446 - DNA, 22 bp, Homo sapiens
gtctgcccttcctctccacgat

SEQ ID NO: 8317447 - DNA, 22 bp, Homo sapiens
gtctgcccttggcctgggactt

SEQ ID NO: 8317448 - DNA, 22 bp, Homo sapiens
gtctgccccagaccctgaccca

SEQ ID NO: 8317449 - DNA, 22 bp, Homo sapiens
gtctgcccgcctgcaaagtgtt

SEQ ID NO: 8317450 - DNA, 22 bp, Homo sapiens
gtctgccccacaggctcagttg

SEQ ID NO: 8317451 - DNA, 20 bp, Homo sapiens
gtctgcccaggccaccacgg

SEQ ID NO: 8317452 - DNA, 22 bp, Homo sapiens
gtctgcccatctccgggcgggg

SEQ ID NO: 8317453 - DNA, 22 bp, Homo sapiens
ctggcccagtctcagagtgtca

SEQ ID NO: 8317454 - DNA, 22 bp, Homo sapiens
ctggccaggccccttgcagggc

SEQ ID NO: 8317455 - DNA, 22 bp, Homo sapiens
ctggcccaggtggtcgttgagg

SEQ ID NO: 8317456 - DNA, 22 bp, Homo sapiens
ctggccaggcatcccctgatcc

SEQ ID NO: 8317457 - DNA, 19 bp, Homo sapiens
ctggccaggccaggggccc

SEQ ID NO: 8317458 - DNA, 22 bp, Homo sapiens
ctggctcagacagctgtgcagt

SEQ ID NO: 8317459 - DNA, 22 bp, Homo sapiens
ctggctcacctccgctccagca

SEQ ID NO: 8317460 - DNA, 22 bp, Homo sapiens
ctggctgcctggagtgagggag

SEQ ID NO: 8317461 - DNA, 22 bp, Homo sapiens
ctggctgccagcatttggggga

SEQ ID NO: 8317462 - DNA, 20 bp, Homo sapiens
ctggctggaaacttagcctt

SEQ ID NO: 8317463 - DNA, 22 bp, Homo sapiens
ctggctggaacgccgaggcggc

SEQ ID NO: 8317464 - DNA, 16 bp, Homo sapiens
ctggctggaagcctgg

SEQ ID NO: 8317465 - DNA, 22 bp, Homo sapiens
ctggctggaagttagagaactt

SEQ ID NO: 8317466 - DNA, 22 bp, Homo sapiens
ctggctggagcaggcatcttgt

SEQ ID NO: 8317467 - DNA, 22 bp, Homo sapiens
ctggctggacttgtgcatgtca

SEQ ID NO: 8317468 - DNA, 22 bp, Homo sapiens
ctggctgcaggatgaggctgcc

SEQ ID NO: 8317469 - DNA, 22 bp, Homo sapiens
ctggctgcaggaaggagtgggc

SEQ ID NO: 8317470 - DNA, 22 bp, Homo sapiens
ctggctcttctgggttctgtgt

SEQ ID NO: 8317471 - DNA, 22 bp, Homo sapiens
ctggctccaaggaagaggtttt

SEQ ID NO: 8317472 - DNA, 22 bp, Homo sapiens
ctggcaggaagttagatggtaa

SEQ ID NO: 8317473 - DNA, 22 bp, Homo sapiens
ctgccagcaagctaccctggca

SEQ ID NO: 8317474 - DNA, 22 bp, Homo sapiens
ctgccagccaggccaggtaggc

SEQ ID NO: 8317475 - DNA, 22 bp, Homo sapiens
ctgccagccaggccaggtaggc

SEQ ID NO: 8317476 - DNA, 22 bp, Homo sapiens
ctgcatccatgttgctgcaaag

SEQ ID NO: 8317477 - DNA, 22 bp, Homo sapiens
ctgccacaggggagcaggcaga

SEQ ID NO: 8317478 - DNA, 22 bp, Homo sapiens
ctgccaccatgccccagcagag

SEQ ID NO: 8317479 - DNA, 22 bp, Homo sapiens
ctgccactagctttcacatctt

SEQ ID NO: 8317480 - DNA, 21 bp, Homo sapiens
ctgccacctgctccatcagca

SEQ ID NO: 8317481 - DNA, 22 bp, Homo sapiens
ctggccagatgttacgtccaat

SEQ ID NO: 8317482 - DNA, 21 bp, Homo sapiens
ctggccactgcacctcttcct

SEQ ID NO: 8317483 - DNA, 22 bp, Homo sapiens
ctggccagctgacagcagggct

SEQ ID NO: 8317484 - DNA, 22 bp, Homo sapiens
ctggccaggaggtaaccagatg

SEQ ID NO: 8317485 - DNA, 22 bp, Homo sapiens
ctggccagcctgtcgatgccct

SEQ ID NO: 8317486 - DNA, 22 bp, Homo sapiens
ctggccagcctcccaggtaccc

SEQ ID NO: 8317487 - DNA, 22 bp, Homo sapiens
ctggcaggcaaattggtgggag

SEQ ID NO: 8317488 - DNA, 22 bp, Homo sapiens
ctggcaggcggaggttgcagtg

SEQ ID NO: 8317489 - DNA, 22 bp, Homo sapiens
ctggcaggctctctggtcggtt

SEQ ID NO: 8317490 - DNA, 22 bp, Homo sapiens
ctggccacccatgcctccctga

SEQ ID NO: 8317491 - DNA, 22 bp, Homo sapiens
ctggccactgattcctcccctg

SEQ ID NO: 8317492 - DNA, 23 bp, Homo sapiens
ctgggcatggagcttcagaggct

SEQ ID NO: 8317493 - DNA, 22 bp, Homo sapiens
ctgggccacttcctcaggggaa

SEQ ID NO: 8317494 - DNA, 22 bp, Homo sapiens
ctgggccactccagatgcccac

SEQ ID NO: 8317495 - DNA, 22 bp, Homo sapiens
ctgggaggcccacgttgggaag

SEQ ID NO: 8317496 - DNA, 22 bp, Homo sapiens
ctgggaggcagaggttgtagtg

SEQ ID NO: 8317497 - DNA, 22 bp, Homo sapiens
ctgggaggcagaggttgtagtg

SEQ ID NO: 8317498 - DNA, 22 bp, Homo sapiens
ctgggaggcagaggttgcagtg

SEQ ID NO: 8317499 - DNA, 22 bp, Homo sapiens
ctgggaggcagaggttgcagtg

SEQ ID NO: 8317500 - DNA, 22 bp, Homo sapiens
ctgggaggcactattcaggagg

SEQ ID NO: 8317501 - DNA, 22 bp, Homo sapiens
ctgggaggattcattgaggtga

SEQ ID NO: 8317502 - DNA, 22 bp, Homo sapiens
ctgggaggattcattgaggtga

SEQ ID NO: 8317503 - DNA, 22 bp, Homo sapiens
ctggctgtgctgactgagaggg

SEQ ID NO: 8317504 - DNA, 22 bp, Homo sapiens
ctgggctgcgggcgcccctcca

SEQ ID NO: 8317505 - DNA, 20 bp, Homo sapiens
ctgggctgcccagctatggg

SEQ ID NO: 8317506 - DNA, 22 bp, Homo sapiens
ctgggctgccaggtaggcacac

SEQ ID NO: 8317507 - DNA, 20 bp, Homo sapiens
ctggggaggaggatgtgttc

SEQ ID NO: 8317508 - DNA, 20 bp, Homo sapiens
ctggggaggaggatgtgttc

SEQ ID NO: 8317509 - DNA, 22 bp, Homo sapiens
ctgggctgcttgctgaaggggt

SEQ ID NO: 8317510 - DNA, 22 bp, Homo sapiens
ctgggctgcttgctgaaggggt

SEQ ID NO: 8317511 - DNA, 22 bp, Homo sapiens
ctgggctgctgtccactagggt

SEQ ID NO: 8317512 - DNA, 22 bp, Homo sapiens
ctgggctgctgtccactagggt

SEQ ID NO: 8317513 - DNA, 19 bp, Homo sapiens
ctgggccagagctgtcctc

SEQ ID NO: 8317514 - DNA, 22 bp, Homo sapiens
ctgggctgcaggagtggggcaa

SEQ ID NO: 8317515 - DNA, 22 bp, Homo sapiens
ctggggcccatcgagggctgag

SEQ ID NO: 8317516 - DNA, 22 bp, Homo sapiens
ctggggccagtgaggaggcttt

SEQ ID NO: 8317517 - DNA, 22 bp, Homo sapiens
ctggggccacaacggcgcacgc

SEQ ID NO: 8317518 - DNA, 22 bp, Homo sapiens
ctggggcattgggagaggcctg

SEQ ID NO: 8317519 - DNA, 22 bp, Homo sapiens
ctggggcccgagccttgggcca

SEQ ID NO: 8317520 - DNA, 22 bp, Homo sapiens
ctggggtgtgctcagagcaggg

SEQ ID NO: 8317521 - DNA, 22 bp, Homo sapiens
ctggggtgtgctcagagcaggg

SEQ ID NO: 8317522 - DNA, 22 bp, Homo sapiens
ctggggctgcggtggaggagcc

SEQ ID NO: 8317523 - DNA, 22 bp, Homo sapiens
ctggggctgcggtggaggagcc

SEQ ID NO: 8317524 - DNA, 22 bp, Homo sapiens
ctggggctgcggtggaggagcc

SEQ ID NO: 8317525 - DNA, 22 bp, Homo sapiens
ctggggctgcagcgatcttcat

SEQ ID NO: 8317526 - DNA, 22 bp, Homo sapiens
ctggggctgcggacgggagccc

SEQ ID NO: 8317527 - DNA, 22 bp, Homo sapiens
ctggggctgcggacgggagccc

SEQ ID NO: 8317528 - DNA, 22 bp, Homo sapiens
ctgggtctggctactgcttcct

SEQ ID NO: 8317529 - DNA, 22 bp, Homo sapiens
ctgggtctggccacaggaagta

SEQ ID NO: 8317530 - DNA, 22 bp, Homo sapiens
ctgtggccagatggtgccagtt

SEQ ID NO: 8317531 - DNA, 22 bp, Homo sapiens
ctgtgccacctgagggactcta

SEQ ID NO: 8317532 - DNA, 22 bp, Homo sapiens
ctgtcctgcagttgggggcagg

SEQ ID NO: 8317533 - DNA, 22 bp, Homo sapiens
ctgtcctgcccaccctgcaggg

SEQ ID NO: 8317534 - DNA, 22 bp, Homo sapiens
ctgtcctgatggtgccactggt

SEQ ID NO: 8317535 - DNA, 22 bp, Homo sapiens
ctgtcctgagttcttggaggtc

SEQ ID NO: 8317536 - DNA, 22 bp, Homo sapiens
ctgtcctgagataaagatgagg

SEQ ID NO: 8317537 - DNA, 21 bp, Homo sapiens
ctgtcctggtctagaggcaca

SEQ ID NO: 8317538 - DNA, 22 bp, Homo sapiens
ctgtcctggtgctggggatccc

SEQ ID NO: 8317539 - DNA, 22 bp, Homo sapiens
ctgtcctggagggcataggacg

SEQ ID NO: 8317540 - DNA, 22 bp, Homo sapiens
ctgtcctgaaagggagattggg

SEQ ID NO: 8317541 - DNA, 22 bp, Homo sapiens
ctgttgcttcaggaaacagtaa

SEQ ID NO: 8317542 - DNA, 22 bp, Homo sapiens
ctgtgtctgcctgggatccatt

SEQ ID NO: 8317543 - DNA, 22 bp, Homo sapiens
ctgtgtctcccaaggagggtca

SEQ ID NO: 8317544 - DNA, 22 bp, Homo sapiens
ctgtggctgcgccctgggggag

SEQ ID NO: 8317545 - DNA, 22 bp, Homo sapiens
ctgtggctctttagttgagcac

SEQ ID NO: 8317546 - DNA, 22 bp, Homo sapiens
ctgtggctgaactctgaagagg

SEQ ID NO: 8317547 - DNA, 20 bp, Homo sapiens
ctgtggctcatgcatctgcc

SEQ ID NO: 8317548 - DNA, 22 bp, Homo sapiens
ctgtggctgtgaaacttctcag

SEQ ID NO: 8317549 - DNA, 22 bp, Homo sapiens
cttcaggaaaatctctaaggat

SEQ ID NO: 8317550 - DNA, 22 bp, Homo sapiens
cttccctttttatgtcttcagc

SEQ ID NO: 8317551 - DNA, 22 bp, Homo sapiens
cttcaaaagccagaagcctgcg

SEQ ID NO: 8317552 - DNA, 22 bp, Homo sapiens
cttattttaagtcagtttgggt

SEQ ID NO: 8317553 - DNA, 22 bp, Homo sapiens
cttattttgctgatgacccagg

SEQ ID NO: 8317554 - DNA, 22 bp, Homo sapiens
cttatattttaggaacagacaa

SEQ ID NO: 8317555 - DNA, 22 bp, Homo sapiens
cttatcatatcatacatggcta

SEQ ID NO: 8317556 - DNA, 22 bp, Homo sapiens
cttatattttaggaacagacaa

SEQ ID NO: 8317557 - DNA, 22 bp, Homo sapiens
ctgttgttcatcatctgtcatt

SEQ ID NO: 8317558 - DNA, 22 bp, Homo sapiens
ctgttgtattattcaatattat

SEQ ID NO: 8317559 - DNA, 22 bp, Homo sapiens
cttattggtgctttttctcata

SEQ ID NO: 8317560 - DNA, 22 bp, Homo sapiens
cttattctactccacaagctct

SEQ ID NO: 8317561 - DNA, 22 bp, Homo sapiens
cttgtagctgactatcttgttc

SEQ ID NO: 8317562 - DNA, 22 bp, Homo sapiens
cttgggtgctggaggctgccgc

SEQ ID NO: 8317563 - DNA, 22 bp, Homo sapiens
cttgggtgctcagggaaagctt

SEQ ID NO: 8317564 - DNA, 22 bp, Homo sapiens
cttgtattcagagtggacatga

SEQ ID NO: 8317565 - DNA, 22 bp, Homo sapiens
cttgtattaggaagaatgcttt

SEQ ID NO: 8317566 - DNA, 22 bp, Homo sapiens
cttgtatagggaaagataaatc

SEQ ID NO: 8317567 - DNA, 22 bp, Homo sapiens
cttgtattctgcctaaccttca

SEQ ID NO: 8317568 - DNA, 22 bp, Homo sapiens
cttgtattcttgtacctttcaa

SEQ ID NO: 8317569 - DNA, 22 bp, Homo sapiens
cttgtcagccaattgtggattt

SEQ ID NO: 8317570 - DNA, 22 bp, Homo sapiens
cttgtctagttcctggtgatgt

SEQ ID NO: 8317571 - DNA, 22 bp, Homo sapiens
cttgcacatttcacacaatagg

SEQ ID NO: 8317572 - DNA, 19 bp, Homo sapiens
cttgatcttggacttccag

SEQ ID NO: 8317573 - DNA, 22 bp, Homo sapiens
cttgacactgtcactcaggcca

SEQ ID NO: 8317574 - DNA, 19 bp, Homo sapiens
cttcctggaggagagcctc

SEQ ID NO: 8317575 - DNA, 22 bp, Homo sapiens
gagctgaattacggtgagtcat

SEQ ID NO: 8317576 - DNA, 22 bp, Homo sapiens
gagctgaacaaattgcgagtgg

SEQ ID NO: 8317577 - DNA, 22 bp, Homo sapiens
gagcgggaggaacggctcgggc

SEQ ID NO: 8317578 - DNA, 22 bp, Homo sapiens
gagcctcgtggcggccactgcg

SEQ ID NO: 8317579 - DNA, 22 bp, Homo sapiens
gagcccttttcctagatactgt

SEQ ID NO: 8317580 - DNA, 22 bp, Homo sapiens
gagcctggacatctcaggccca

SEQ ID NO: 8317581 - DNA, 22 bp, Homo sapiens
gaggcagaggaaggtggtctct

SEQ ID NO: 8317582 - DNA, 22 bp, Homo sapiens
gaggccagatactctcttctgc

SEQ ID NO: 8317583 - DNA, 22 bp, Homo sapiens
gaggccagctagtccaggaagt

SEQ ID NO: 8317584 - DNA, 22 bp, Homo sapiens
gaggccaggacatgaaagctga

SEQ ID NO: 8317585 - DNA, 22 bp, Homo sapiens
gaggcagaagttgcagtgagca

SEQ ID NO: 8317586 - DNA, 22 bp, Homo sapiens
gaggcactgcagtacagtgact

SEQ ID NO: 8317587 - DNA, 22 bp, Homo sapiens
gaggcacatcacttggtgcatt

SEQ ID NO: 8317588 - DNA, 20 bp, Homo sapiens
gaggaaaagctgccaggcct

SEQ ID NO: 8317589 - DNA, 22 bp, Homo sapiens
gaggaaaataacaactaagggc

SEQ ID NO: 8317590 - DNA, 22 bp, Homo sapiens
gaggagcttgtgagaagatgtc

SEQ ID NO: 8317591 - DNA, 22 bp, Homo sapiens
gaggaggctaagtgggctctgg

SEQ ID NO: 8317592 - DNA, 22 bp, Homo sapiens
gaggcaagagaagccagctttc

SEQ ID NO: 8317593 - DNA, 22 bp, Homo sapiens
gaggcaaggccgcacgtctcag

SEQ ID NO: 8317594 - DNA, 22 bp, Homo sapiens
gagaagggatatgccactctcg

SEQ ID NO: 8317595 - DNA, 22 bp, Homo sapiens
gagaagggatatggcttcttga

SEQ ID NO: 8317596 - DNA, 22 bp, Homo sapiens
gagaaggactacggaaaacaga

SEQ ID NO: 8317597 - DNA, 22 bp, Homo sapiens
gagatgaatgtaaacaaaggca

SEQ ID NO: 8317598 - DNA, 22 bp, Homo sapiens
gagatgatctttcctgtagtcc

SEQ ID NO: 8317599 - DNA, 22 bp, Homo sapiens
gagatgcaagcaagtctatttt

SEQ ID NO: 8317600 - DNA, 20 bp, Homo sapiens
gagatgcaagtgtatctgac

SEQ ID NO: 8317601 - DNA, 22 bp, Homo sapiens
gagaggctgtgtgccattgttg

SEQ ID NO: 8317602 - DNA, 22 bp, Homo sapiens
gagagggagccagccaggaacc

SEQ ID NO: 8317603 - DNA, 18 bp, Homo sapiens
gagaggcccggctgtgcc

SEQ ID NO: 8317604 - DNA, 22 bp, Homo sapiens
gagaggccctgaagcccacaga

SEQ ID NO: 8317605 - DNA, 22 bp, Homo sapiens
gagaggccctgtggtcccagct

SEQ ID NO: 8317606 - DNA, 19 bp, Homo sapiens
gagaggcctgtgcttgaag

SEQ ID NO: 8317607 - DNA, 22 bp, Homo sapiens
gagaggcctgagaggctgcgga

SEQ ID NO: 8317608 - DNA, 22 bp, Homo sapiens
gagacacaaacacatttagagg

SEQ ID NO: 8317609 - DNA, 23 bp, Homo sapiens
gagatttagcagacaaagctctt

SEQ ID NO: 8317610 - DNA, 22 bp, Homo sapiens
gagattctcgagggcttccagc

SEQ ID NO: 8317611 - DNA, 22 bp, Homo sapiens
gagattctcagaagtactagga

SEQ ID NO: 8317612 - DNA, 22 bp, Homo sapiens
gagatggagtctttttctgtca

SEQ ID NO: 8317613 - DNA, 22 bp, Homo sapiens
gagatggagaaggaagctgttt

SEQ ID NO: 8317614 - DNA, 22 bp, Homo sapiens
gagatggaatctgtgtggaggg

SEQ ID NO: 8317615 - DNA, 20 bp, Homo sapiens
gagatggacagatgaagggg

SEQ ID NO: 8317616 - DNA, 22 bp, Homo sapiens
gagccaagatcgcaccactgca

SEQ ID NO: 8317617 - DNA, 22 bp, Homo sapiens
gagccaagcaccacattaagtt

SEQ ID NO: 8317618 - DNA, 22 bp, Homo sapiens
gagccagagctacaagtgtctg

SEQ ID NO: 8317619 - DNA, 22 bp, Homo sapiens
gagccagactgcctgaagctca

SEQ ID NO: 8317620 - DNA, 22 bp, Homo sapiens
gagccagaaaagctgcctgact

SEQ ID NO: 8317621 - DNA, 22 bp, Homo sapiens
gagccaccttcaactcaggaat

SEQ ID NO: 8317622 - DNA, 22 bp, Homo sapiens
gaccctggtgggcactggcacc

SEQ ID NO: 8317623 - DNA, 22 bp, Homo sapiens
gacagtaaggtggcttcttctt

SEQ ID NO: 8317624 - DNA, 22 bp, Homo sapiens
gacagtaagtcagagacttggt

SEQ ID NO: 8317625 - DNA, 22 bp, Homo sapiens
gacagtaagaccttaccagcct

SEQ ID NO: 8317626 - DNA, 22 bp, Homo sapiens
gacagtaagagtgtctgggttc

SEQ ID NO: 8317627 - DNA, 22 bp, Homo sapiens
gacagtaactgagagatgtaat

SEQ ID NO: 8317628 - DNA, 22 bp, Homo sapiens
gacagtaactacagttctgtgg

SEQ ID NO: 8317629 - DNA, 22 bp, Homo sapiens
gacagtaaatgcagtctagcac

SEQ ID NO: 8317630 - DNA, 18 bp, Homo sapiens
gacagtaaacttccccat

SEQ ID NO: 8317631 - DNA, 22 bp, Homo sapiens
gacagggttgagtaaactggga

SEQ ID NO: 8317632 - DNA, 22 bp, Homo sapiens
gacaggccaggggctgaggtgg

SEQ ID NO: 8317633 - DNA, 22 bp, Homo sapiens
gacaggccaggggctgaggtgg

SEQ ID NO: 8317634 - DNA, 22 bp, Homo sapiens
gacaggcccgagtagctgatga

SEQ ID NO: 8317635 - DNA, 22 bp, Homo sapiens
gacaggccccctcaggactgat

SEQ ID NO: 8317636 - DNA, 22 bp, Homo sapiens
gacacagaatttactcccgata

SEQ ID NO: 8317637 - DNA, 22 bp, Homo sapiens
gacacagacagttagaggtaat

SEQ ID NO: 8317638 - DNA, 22 bp, Homo sapiens
gacaataaaatgatcttacagt

SEQ ID NO: 8317639 - DNA, 22 bp, Homo sapiens
gacacagaattcccctccaagt

SEQ ID NO: 8317640 - DNA, 22 bp, Homo sapiens
gacaagtgatgattataattca

SEQ ID NO: 8317641 - DNA, 22 bp, Homo sapiens
gacaagtcatctggggcctgtg

SEQ ID NO: 8317642 - DNA, 22 bp, Homo sapiens
gacaaggcgcccagcctgccaa

SEQ ID NO: 8317643 - DNA, 22 bp, Homo sapiens
gaatacatggcagggagtcatc

SEQ ID NO: 8317644 - DNA, 22 bp, Homo sapiens
gaatatattggtgaaaatagtt

SEQ ID NO: 8317645 - DNA, 22 bp, Homo sapiens
gaatatattggtgaaaatagtt

SEQ ID NO: 8317646 - DNA, 22 bp, Homo sapiens
ctttcataaaggaaatgatgag

SEQ ID NO: 8317647 - DNA, 22 bp, Homo sapiens
ctttcagttagtacctagtggc

SEQ ID NO: 8317648 - DNA, 22 bp, Homo sapiens
ctttcaatgtgcctgccttggg

SEQ ID NO: 8317649 - DNA, 22 bp, Homo sapiens
ctttcaatgtcatctgtgaatg

SEQ ID NO: 8317650 - DNA, 22 bp, Homo sapiens
ctttcaagtgatggggcatata

SEQ ID NO: 8317651 - DNA, 22 bp, Homo sapiens
ctttcaatcaaagtttctagtg

SEQ ID NO: 8317652 - DNA, 22 bp, Homo sapiens
ctttcacacacatacatttgga

SEQ ID NO: 8317653 - DNA, 22 bp, Homo sapiens
ctttcattcttagatattagtg

SEQ ID NO: 8317654 - DNA, 22 bp, Homo sapiens
ctttcatccgcagatgagcctc

SEQ ID NO: 8317655 - DNA, 22 bp, Homo sapiens
ctttcatccgcagatgagcctc

SEQ ID NO: 8317656 - DNA, 22 bp, Homo sapiens
ctttcatttgataagaatgcca

SEQ ID NO: 8317657 - DNA, 22 bp, Homo sapiens
ctttccaactctagtgaaattt

SEQ ID NO: 8317658 - DNA, 22 bp, Homo sapiens
gaaatcagttctgaaatttaca

SEQ ID NO: 8317659 - DNA, 22 bp, Homo sapiens
gaacagcagtcactcatgttat

SEQ ID NO: 8317660 - DNA, 22 bp, Homo sapiens
gaaatgtactttaaagccatcc

SEQ ID NO: 8317661 - DNA, 22 bp, Homo sapiens
gaaatgcaggcttggattcagc

SEQ ID NO: 8317662 - DNA, 22 bp, Homo sapiens
gaaatgcaaattctctctcgct

SEQ ID NO: 8317663 - DNA, 22 bp, Homo sapiens
gaaatcattagcaaagatatgt

SEQ ID NO: 8317664 - DNA, 22 bp, Homo sapiens
gaagagaagcatcaataggtaa

SEQ ID NO: 8317665 - DNA, 22 bp, Homo sapiens
gaaccattgttgaaaagaatag

SEQ ID NO: 8317666 - DNA, 22 bp, Homo sapiens
gaaccatttctgaatagtttgt

SEQ ID NO: 8317667 - DNA, 22 bp, Homo sapiens
gaagacactctgcagagttatc

SEQ ID NO: 8317668 - DNA, 22 bp, Homo sapiens
gaagataattcctacttataac

SEQ ID NO: 8317669 - DNA, 22 bp, Homo sapiens
gaagattaaacatatttagtgt

SEQ ID NO: 8317670 - DNA, 22 bp, Homo sapiens
cctgggctctgaggagggagtc

SEQ ID NO: 8317671 - DNA, 22 bp, Homo sapiens
tgttacaaactgttgtttctat

SEQ ID NO: 8317672 - DNA, 22 bp, Homo sapiens
tgttaatatactaaaatccact

SEQ ID NO: 8317673 - DNA, 22 bp, Homo sapiens
cctgggctgttgcatcatcctt

SEQ ID NO: 8317674 - DNA, 22 bp, Homo sapiens
tgttcattcgctattgtctatg

SEQ ID NO: 8317675 - DNA, 22 bp, Homo sapiens
tgttacaatattatcaactgag

SEQ ID NO: 8317676 - DNA, 22 bp, Homo sapiens
cctggtgcttaccagagctttt

SEQ ID NO: 8317677 - DNA, 22 bp, Homo sapiens
cctgggtgtcatgggcagctgg

SEQ ID NO: 8317678 - DNA, 22 bp, Homo sapiens
cctggtggagaggggcggagcg

SEQ ID NO: 8317679 - DNA, 22 bp, Homo sapiens
cctggtggaaggtgagtgaggc

SEQ ID NO: 8317680 - DNA, 22 bp, Homo sapiens
cctggtggcttctgggtggacg

SEQ ID NO: 8317681 - DNA, 22 bp, Homo sapiens
cctggtggcgaatggtggtagg

SEQ ID NO: 8317682 - DNA, 22 bp, Homo sapiens
cctggtttatgccagatcctgt

SEQ ID NO: 8317683 - DNA, 22 bp, Homo sapiens
cctggtttaatgctcactgttg

SEQ ID NO: 8317684 - DNA, 22 bp, Homo sapiens
tgtttacttcatcgagtacttc

SEQ ID NO: 8317685 - DNA, 22 bp, Homo sapiens
tgtttacttcatcgagtacttc

SEQ ID NO: 8317686 - DNA, 22 bp, Homo sapiens
tgtttacttatgtgggtcacat

SEQ ID NO: 8317687 - DNA, 22 bp, Homo sapiens
tgtttacttaaatgttttcata

SEQ ID NO: 8317688 - DNA, 22 bp, Homo sapiens
tggggctgtgagactacaggat

SEQ ID NO: 8317689 - DNA, 22 bp, Homo sapiens
tggggctgtggattctcacgaa

SEQ ID NO: 8317690 - DNA, 19 bp, Homo sapiens
tggggctgtgttttgaccc

SEQ ID NO: 8317691 - DNA, 23 bp, Homo sapiens
tggggccaagtgaggaagggtct

SEQ ID NO: 8317692 - DNA, 22 bp, Homo sapiens
tggggcatggatgataagctgg

SEQ ID NO: 8317693 - DNA, 22 bp, Homo sapiens
tggggccacacatctctttcta

SEQ ID NO: 8317694 - DNA, 22 bp, Homo sapiens
tggggcagtggcttttcaccct

SEQ ID NO: 8317695 - DNA, 22 bp, Homo sapiens
tggggcagttaataaacattct

SEQ ID NO: 8317696 - DNA, 22 bp, Homo sapiens
tggggcagggatgggaaactat

SEQ ID NO: 8317697 - DNA, 22 bp, Homo sapiens
tggggcagggatgggaaactat

SEQ ID NO: 8317698 - DNA, 22 bp, Homo sapiens
tggggcagccacatagacaaca

SEQ ID NO: 8317699 - DNA, 22 bp, Homo sapiens
tggggcagctccatctattcca

SEQ ID NO: 8317700 - DNA, 21 bp, Homo sapiens
tgggggagaattggttgcttt

SEQ ID NO: 8317701 - DNA, 21 bp, Homo sapiens
tgggggagaattggttgcttt

SEQ ID NO: 8317702 - DNA, 19 bp, Homo sapiens
cctgggagtcagctgaagg

SEQ ID NO: 8317703 - DNA, 22 bp, Homo sapiens
cctgggaggctgaggctgcagt

SEQ ID NO: 8317704 - DNA, 22 bp, Homo sapiens
cctgggatttcctgagcactct

SEQ ID NO: 8317705 - DNA, 22 bp, Homo sapiens
ccttccctaaagcgtcgcttag

SEQ ID NO: 8317706 - DNA, 22 bp, Homo sapiens
ccttcctcatccatttctcttg

SEQ ID NO: 8317707 - DNA, 17 bp, Homo sapiens
ccttcctcatctccttc

SEQ ID NO: 8317708 - DNA, 20 bp, Homo sapiens
ccttccccacccgctgaggt

SEQ ID NO: 8317709 - DNA, 22 bp, Homo sapiens
ccttcccatgcagcctgtctga

SEQ ID NO: 8317710 - DNA, 21 bp, Homo sapiens
cctgtgtgtctgactgggcta

SEQ ID NO: 8317711 - DNA, 22 bp, Homo sapiens
cctgtgtgattggaagctgaga

SEQ ID NO: 8317712 - DNA, 22 bp, Homo sapiens
ttagaatctaacattcttatct

SEQ ID NO: 8317713 - DNA, 21 bp, Homo sapiens
ttacttttgcaccaacctaat

SEQ ID NO: 8317714 - DNA, 21 bp, Homo sapiens
ttacttttgcagcaacctaat

SEQ ID NO: 8317715 - DNA, 23 bp, Homo sapiens
ttacttttgcaccaacctaatat

SEQ ID NO: 8317716 - DNA, 21 bp, Homo sapiens
cctgtgctatcagcttgggtt

SEQ ID NO: 8317717 - DNA, 22 bp, Homo sapiens
cctgtgccttccttaggcacct

SEQ ID NO: 8317718 - DNA, 22 bp, Homo sapiens
cctgtgccctgccaggctggtg

SEQ ID NO: 8317719 - DNA, 22 bp, Homo sapiens
ttaaaggatctttgtcattaat

SEQ ID NO: 8317720 - DNA, 20 bp, Homo sapiens
cctgtgctgccctcggggcc

SEQ ID NO: 8317721 - DNA, 22 bp, Homo sapiens
cctgtgctggacagggctgggc

SEQ ID NO: 8317722 - DNA, 22 bp, Homo sapiens
cctgtgctgggtgtgagggaca

SEQ ID NO: 8317723 - DNA, 21 bp, Homo sapiens
cctgtggtctggagggagcac

SEQ ID NO: 8317724 - DNA, 22 bp, Homo sapiens
cctgtggtttactctgtggcta

SEQ ID NO: 8317725 - DNA, 22 bp, Homo sapiens
cctgtgtcatcagctgtggcta

SEQ ID NO: 8317726 - DNA, 22 bp, Homo sapiens
tgtttactttccttctcacagg

SEQ ID NO: 8317727 - DNA, 22 bp, Homo sapiens
tgtttagatgcaaagtctcaca

SEQ ID NO: 8317728 - DNA, 22 bp, Homo sapiens
tgtttagactcaaaattgaaag

SEQ ID NO: 8317729 - DNA, 22 bp, Homo sapiens
cctgtctgaggaggtgctcttt

SEQ ID NO: 8317730 - DNA, 22 bp, Homo sapiens
cctgtctgcatgatccctgcca

SEQ ID NO: 8317731 - DNA, 22 bp, Homo sapiens
cctgtctgcatgagtgagcata

SEQ ID NO: 8317732 - DNA, 22 bp, Homo sapiens
cctgtctggccttccacggggg

SEQ ID NO: 8317733 - DNA, 22 bp, Homo sapiens
cctgtgccatcctgagcatccc

SEQ ID NO: 8317734 - DNA, 17 bp, Homo sapiens
cctgtcttgtttctgcc

SEQ ID NO: 8317735 - DNA, 23 bp, Homo sapiens
cctgtctgtgctgggtggacaca

SEQ ID NO: 8317736 - DNA, 22 bp, Homo sapiens
ctactgatgatgttggttgtgg

SEQ ID NO: 8317737 - DNA, 22 bp, Homo sapiens
ctactgatgctatacttctcag

SEQ ID NO: 8317738 - DNA, 22 bp, Homo sapiens
ctactgatgatgttggttgtgg

SEQ ID NO: 8317739 - DNA, 22 bp, Homo sapiens
ctactgatgctatacttctcag

SEQ ID NO: 8317740 - DNA, 21 bp, Homo sapiens
ttcctggggaaggagctgcct

SEQ ID NO: 8317741 - DNA, 22 bp, Homo sapiens
ctacttgttcactgtaggtcgc

SEQ ID NO: 8317742 - DNA, 22 bp, Homo sapiens
ctacttggtacctgaagatcgg

SEQ ID NO: 8317743 - DNA, 22 bp, Homo sapiens
ctacaacaccaggcacggagtg

SEQ ID NO: 8317744 - DNA, 22 bp, Homo sapiens
ctacaacatagtcttctacaga

SEQ ID NO: 8317745 - DNA, 22 bp, Homo sapiens
ttccaggactcgttctggctca

SEQ ID NO: 8317746 - DNA, 22 bp, Homo sapiens
ttcctgggcaggacgagagtct

SEQ ID NO: 8317747 - DNA, 22 bp, Homo sapiens
ctcaaggaaagtctggagaaga

SEQ ID NO: 8317748 - DNA, 22 bp, Homo sapiens
ctattattatcctaatttctgt

SEQ ID NO: 8317749 - DNA, 22 bp, Homo sapiens
ctcacaggtaccagcaccctcc

SEQ ID NO: 8317750 - DNA, 22 bp, Homo sapiens
ctcacaggagaaagtcatggtc

SEQ ID NO: 8317751 - DNA, 22 bp, Homo sapiens
ctcacagatgatgtctatgtgg

SEQ ID NO: 8317752 - DNA, 22 bp, Homo sapiens
ctattaaatactcttcaaattg

SEQ ID NO: 8317753 - DNA, 22 bp, Homo sapiens
ctattaaatactcttcaaattg

SEQ ID NO: 8317754 - DNA, 18 bp, Homo sapiens
ctatgcatgcattgtatc

SEQ ID NO: 8317755 - DNA, 22 bp, Homo sapiens
ttcaagttttgcctccccatcc

SEQ ID NO: 8317756 - DNA, 22 bp, Homo sapiens
ttcaagttttcagaatagccac

SEQ ID NO: 8317757 - DNA, 22 bp, Homo sapiens
ttcaagttttatattgaagcaa

SEQ ID NO: 8317758 - DNA, 22 bp, Homo sapiens
ttcaagttttatattgaagcaa

SEQ ID NO: 8317759 - DNA, 22 bp, Homo sapiens
ttcaagtttactttgaagttta

SEQ ID NO: 8317760 - DNA, 22 bp, Homo sapiens
ttcaagttacctttaaacagct

SEQ ID NO: 8317761 - DNA, 22 bp, Homo sapiens
ttcaagttagagatatatttag

SEQ ID NO: 8317762 - DNA, 22 bp, Homo sapiens
cgccccagtctgtaggtgcccc

SEQ ID NO: 8317763 - DNA, 22 bp, Homo sapiens
cgccggcttgaggcaggcggca

SEQ ID NO: 8317764 - DNA, 20 bp, Homo sapiens
cgcccagtgcggttctgacc

SEQ ID NO: 8317765 - DNA, 22 bp, Homo sapiens
cgcccagggcaggaggccgctc

SEQ ID NO: 8317766 - DNA, 22 bp, Homo sapiens
cgcccagctgaaatctccaggc

SEQ ID NO: 8317767 - DNA, 20 bp, Homo sapiens
cgcccaggagggcccatgtg

SEQ ID NO: 8317768 - DNA, 22 bp, Homo sapiens
cgcccaggctggagagcagtgg

SEQ ID NO: 8317769 - DNA, 22 bp, Homo sapiens
cctttcagatgggcatggaccg

SEQ ID NO: 8317770 - DNA, 22 bp, Homo sapiens
cctttcaacaagatttctggcc

SEQ ID NO: 8317771 - DNA, 22 bp, Homo sapiens
cctttcaaagttttgccatgct

SEQ ID NO: 8317772 - DNA, 22 bp, Homo sapiens
cctttcaaattacatgactgct

SEQ ID NO: 8317773 - DNA, 22 bp, Homo sapiens
cctttcaaagttttgccatgct

SEQ ID NO: 8317774 - DNA, 22 bp, Homo sapiens
cctttcaaaacagaacactagc

SEQ ID NO: 8317775 - DNA, 23 bp, Homo sapiens
cgcccagcctcagtgacctgggc

SEQ ID NO: 8317776 - DNA, 22 bp, Homo sapiens
ttaggcctttgattggggtgct

SEQ ID NO: 8317777 - DNA, 22 bp, Homo sapiens
cggggctgtagcacagctgagc

SEQ ID NO: 8317778 - DNA, 22 bp, Homo sapiens
cgggggagttgaggcacatggg

SEQ ID NO: 8317779 - DNA, 22 bp, Homo sapiens
ttcagggacttagtgtcagttt

SEQ ID NO: 8317780 - DNA, 22 bp, Homo sapiens
ttcagggactttgatgtatcag

SEQ ID NO: 8317781 - DNA, 22 bp, Homo sapiens
ttcagaggggctaagtacttgc

SEQ ID NO: 8317782 - DNA, 22 bp, Homo sapiens
cggtctcccgtgtgtgtgcgct

SEQ ID NO: 8317783 - DNA, 22 bp, Homo sapiens
ctaaataatccctctggtctta

SEQ ID NO: 8317784 - DNA, 22 bp, Homo sapiens
ctaaaattacctaccagtttag

SEQ ID NO: 8317785 - DNA, 22 bp, Homo sapiens
ctgcagggcccgcctgagccct

SEQ ID NO: 8317786 - DNA, 22 bp, Homo sapiens
ctgcagggcccaaggtcaacgg

SEQ ID NO: 8317787 - DNA, 22 bp, Homo sapiens
ctgcagggcagaagggcataga

SEQ ID NO: 8317788 - DNA, 22 bp, Homo sapiens
ctgcagggatgtgaggcccgtt

SEQ ID NO: 8317789 - DNA, 18 bp, Homo sapiens
ctgcacttcagcttgggc

SEQ ID NO: 8317790 - DNA, 22 bp, Homo sapiens
ctgcagggagcagatggcgtgt

SEQ ID NO: 8317791 - DNA, 22 bp, Homo sapiens
ctgcacagtgttggaagctgcc

SEQ ID NO: 8317792 - DNA, 22 bp, Homo sapiens
ctgaggcatgttacaggacata

SEQ ID NO: 8317793 - DNA, 17 bp, Homo sapiens
ctgaggcccagggccca

SEQ ID NO: 8317794 - DNA, 18 bp, Homo sapiens
ctgaggcccagagagggc

SEQ ID NO: 8317795 - DNA, 22 bp, Homo sapiens
ctgaggccagctgcagagctct

SEQ ID NO: 8317796 - DNA, 22 bp, Homo sapiens
ctgaggccggagcactgaagag

SEQ ID NO: 8317797 - DNA, 22 bp, Homo sapiens
ctgagcccctctgacctcagag

SEQ ID NO: 8317798 - DNA, 20 bp, Homo sapiens
ctgagcccagatcccaggtc

SEQ ID NO: 8317799 - DNA, 22 bp, Homo sapiens
ctgaggcagagggcagaccaga

SEQ ID NO: 8317800 - DNA, 22 bp, Homo sapiens
ctgagcctcctgcttctatttc

SEQ ID NO: 8317801 - DNA, 22 bp, Homo sapiens
ctgagcccttgtcttcctggtc

SEQ ID NO: 8317802 - DNA, 22 bp, Homo sapiens
ctgagcccttgaacccaagtcc

SEQ ID NO: 8317803 - DNA, 22 bp, Homo sapiens
ctgagccctggctcgcctggag

SEQ ID NO: 8317804 - DNA, 22 bp, Homo sapiens
ctgagccaaccacagcaggagc

SEQ ID NO: 8317805 - DNA, 22 bp, Homo sapiens
ctgagccatgagcctgcgccca

SEQ ID NO: 8317806 - DNA, 22 bp, Homo sapiens
ctgagccatgagcctgcgccca

SEQ ID NO: 8317807 - DNA, 22 bp, Homo sapiens
ctgagccatgggtctaagcact

SEQ ID NO: 8317808 - DNA, 22 bp, Homo sapiens
ctgagccataagggaggctggg

SEQ ID NO: 8317809 - DNA, 20 bp, Homo sapiens
ctgagccaactctcttcttg

SEQ ID NO: 8317810 - DNA, 22 bp, Homo sapiens
ctctttgaaatccatcactgct

SEQ ID NO: 8317811 - DNA, 22 bp, Homo sapiens
ctctttggagaagcacgtatta

SEQ ID NO: 8317812 - DNA, 22 bp, Homo sapiens
ctctttggccagaaaatgtttt

SEQ ID NO: 8317813 - DNA, 22 bp, Homo sapiens
ctctttggatgtttatgataag

SEQ ID NO: 8317814 - DNA, 22 bp, Homo sapiens
ctctttggatagaattacaaag

SEQ ID NO: 8317815 - DNA, 19 bp, Homo sapiens
ctctttggagatccttgga

SEQ ID NO: 8317816 - DNA, 19 bp, Homo sapiens
ctgacccaggacaccacgg

SEQ ID NO: 8317817 - DNA, 22 bp, Homo sapiens
ctgacagattagatgtgcatat

SEQ ID NO: 8317818 - DNA, 22 bp, Homo sapiens
ctgacagggtagacagagggca

SEQ ID NO: 8317819 - DNA, 22 bp, Homo sapiens
ctgacaggctgagatccctggt

SEQ ID NO: 8317820 - DNA, 22 bp, Homo sapiens
ctcttcatagcaaacatatggg

SEQ ID NO: 8317821 - DNA, 21 bp, Homo sapiens
ctcttgtctttgctcagtagc

SEQ ID NO: 8317822 - DNA, 22 bp, Homo sapiens
ttttcagagagcttttatgtcc

SEQ ID NO: 8317823 - DNA, 22 bp, Homo sapiens
ttttaagaactgttctgtgctt

SEQ ID NO: 8317824 - DNA, 22 bp, Homo sapiens
ttttaagatgctagtatttcag

SEQ ID NO: 8317825 - DNA, 22 bp, Homo sapiens
ttttaagaggaggctgtttgaa

SEQ ID NO: 8317826 - DNA, 22 bp, Homo sapiens
tttgtacactgtctactatgaa

SEQ ID NO: 8317827 - DNA, 22 bp, Homo sapiens
ttttaatactgctattgtagga

SEQ ID NO: 8317828 - DNA, 22 bp, Homo sapiens
ttttaagtttattccagtacat

SEQ ID NO: 8317829 - DNA, 22 bp, Homo sapiens
ttttaatactgctattgtagga

SEQ ID NO: 8317830 - DNA, 22 bp, Homo sapiens
ttttagatagtttaactgcact

SEQ ID NO: 8317831 - DNA, 22 bp, Homo sapiens
tttgcattttgataagatcact

SEQ ID NO: 8317832 - DNA, 22 bp, Homo sapiens
ctctgccctcgcacatctgcca

SEQ ID NO: 8317833 - DNA, 22 bp, Homo sapiens
ctctgcccgcggatgccacgtc

SEQ ID NO: 8317834 - DNA, 22 bp, Homo sapiens
ctctgccctcacttggggcctg

SEQ ID NO: 8317835 - DNA, 19 bp, Homo sapiens
ctctgccctacagaaagct

SEQ ID NO: 8317836 - DNA, 22 bp, Homo sapiens
ctctgcccgtgcctttcccagt

SEQ ID NO: 8317837 - DNA, 22 bp, Homo sapiens
ctctgcccagtgcccacaggag

SEQ ID NO: 8317838 - DNA, 22 bp, Homo sapiens
ctctgcccccagctggtgcttg

SEQ ID NO: 8317839 - DNA, 22 bp, Homo sapiens
ctctgcccccagctggtgcttg

SEQ ID NO: 8317840 - DNA, 20 bp, Homo sapiens
ctctgcccccagactgacag

SEQ ID NO: 8317841 - DNA, 22 bp, Homo sapiens
ctctgcccacgtcttgcccaga

SEQ ID NO: 8317842 - DNA, 21 bp, Homo sapiens
ctctgcccagggcctcctgcc

SEQ ID NO: 8317843 - DNA, 21 bp, Homo sapiens
ctctgcccagggcctcctgcc

SEQ ID NO: 8317844 - DNA, 22 bp, Homo sapiens
ctctgccagtttctggcctcag

SEQ ID NO: 8317845 - DNA, 22 bp, Homo sapiens
ctctgccaccatgcttcctgac

SEQ ID NO: 8317846 - DNA, 22 bp, Homo sapiens
ctctgcagattcatcccttcac

SEQ ID NO: 8317847 - DNA, 22 bp, Homo sapiens
tttcctttatgacatcaccact

SEQ ID NO: 8317848 - DNA, 20 bp, Homo sapiens
tttcctttcattttagtacc

SEQ ID NO: 8317849 - DNA, 22 bp, Homo sapiens
tttcctttatgacatcaccact

SEQ ID NO: 8317850 - DNA, 22 bp, Homo sapiens
tttgggaaccagaagttcaaaa

SEQ ID NO: 8317851 - DNA, 22 bp, Homo sapiens
tttgggaactggacttcctgct

SEQ ID NO: 8317852 - DNA, 22 bp, Homo sapiens
tttgggaagaggaatctctgga

SEQ ID NO: 8317853 - DNA, 22 bp, Homo sapiens
tttgggaaggcagacatcccac

SEQ ID NO: 8317854 - DNA, 22 bp, Homo sapiens
tttgccttctctgaacctattt

SEQ ID NO: 8317855 - DNA, 22 bp, Homo sapiens
tttgccctttctgagcctcatc

SEQ ID NO: 8317856 - DNA, 21 bp, Homo sapiens
tttgccttcacgaagcatcct

SEQ ID NO: 8317857 - DNA, 22 bp, Homo sapiens
ctcctggccctgagctcccagg

SEQ ID NO: 8317858 - DNA, 22 bp, Homo sapiens
tttcacaaatgtctttaacttg

SEQ ID NO: 8317859 - DNA, 22 bp, Homo sapiens
tttcacagtagaaatcattatg

SEQ ID NO: 8317860 - DNA, 22 bp, Homo sapiens
tttcacatacagtgtatagtag

SEQ ID NO: 8317861 - DNA, 22 bp, Homo sapiens
tttcacatagaaagtgatttac

SEQ ID NO: 8317862 - DNA, 22 bp, Homo sapiens
tttcacataaatattatgccta

SEQ ID NO: 8317863 - DNA, 22 bp, Homo sapiens
tttcacataaatggagtaaaga

SEQ ID NO: 8317864 - DNA, 22 bp, Homo sapiens
tttccactgtagagatgttgaa

SEQ ID NO: 8317865 - DNA, 20 bp, Homo sapiens
tttccactgtaatgtatgat

SEQ ID NO: 8317866 - DNA, 22 bp, Homo sapiens
tttcctagagtctctagaagaa

SEQ ID NO: 8317867 - DNA, 22 bp, Homo sapiens
tttcctaatcccaatgacattt

SEQ ID NO: 8317868 - DNA, 22 bp, Homo sapiens
tttcctcacacagaagatcttg

SEQ ID NO: 8317869 - DNA, 20 bp, Homo sapiens
ctctctctccattcccaggg

SEQ ID NO: 8317870 - DNA, 22 bp, Homo sapiens
ctctctggaagggggagctgat

SEQ ID NO: 8317871 - DNA, 22 bp, Homo sapiens
ctcccgtgatcctggaggagag

SEQ ID NO: 8317872 - DNA, 22 bp, Homo sapiens
ctcccgtgatcctggaggagag

SEQ ID NO: 8317873 - DNA, 22 bp, Homo sapiens
tttagagaagttaggaaataaa

SEQ ID NO: 8317874 - DNA, 22 bp, Homo sapiens
ctccccattgtgacctcatcca

SEQ ID NO: 8317875 - DNA, 23 bp, Homo sapiens
ctccccagtgtcctcatgcatct

SEQ ID NO: 8317876 - DNA, 22 bp, Homo sapiens
ctcctccagcttccagtggctc

SEQ ID NO: 8317877 - DNA, 22 bp, Homo sapiens
ctcctccagcttccagtggctc

SEQ ID NO: 8317878 - DNA, 22 bp, Homo sapiens
ctcctggcagttccccttgtca

SEQ ID NO: 8317879 - DNA, 17 bp, Homo sapiens
ctcctggcagcctcagg

SEQ ID NO: 8317880 - DNA, 22 bp, Homo sapiens
tttatttaccttatgtcctcca

SEQ ID NO: 8317881 - DNA, 22 bp, Homo sapiens
tttatttaaagtcgtgtgttaa

SEQ ID NO: 8317882 - DNA, 16 bp, Homo sapiens
tttatttactagtgtt

SEQ ID NO: 8317883 - DNA, 22 bp, Homo sapiens
ctcccagccttcgccagtctga

SEQ ID NO: 8317884 - DNA, 22 bp, Homo sapiens
ctcccaggccatgctctagcca

SEQ ID NO: 8317885 - DNA, 22 bp, Homo sapiens
tttaacagatgtgaaattttca

SEQ ID NO: 8317886 - DNA, 22 bp, Homo sapiens
tttaatatccagtggatacaaa

SEQ ID NO: 8317887 - DNA, 22 bp, Homo sapiens
tttaatatttctttcctgaagc

SEQ ID NO: 8317888 - DNA, 22 bp, Homo sapiens
ctccagtgcgcaggacagcccc

SEQ ID NO: 8317889 - DNA, 22 bp, Homo sapiens
ctccatggaaccggggctgctt

SEQ ID NO: 8317890 - DNA, 22 bp, Homo sapiens
ttgtcttagagtgaaaacttta

SEQ ID NO: 8317891 - DNA, 22 bp, Homo sapiens
ttgtctgtcccagcttgtgcat

SEQ ID NO: 8317892 - DNA, 22 bp, Homo sapiens
ttgtcttttgtgggaaatatgg

SEQ ID NO: 8317893 - DNA, 22 bp, Homo sapiens
ttgtctttcccagcttctagag

SEQ ID NO: 8317894 - DNA, 22 bp, Homo sapiens
ttgtctttggaaatttaatgtt

SEQ ID NO: 8317895 - DNA, 23 bp, Homo sapiens
ttgtatttttagtagagacaggg

SEQ ID NO: 8317896 - DNA, 22 bp, Homo sapiens
ctccagcctcatctcctggctg

SEQ ID NO: 8317897 - DNA, 22 bp, Homo sapiens
ctccagccagagtgcctctgtt

SEQ ID NO: 8317898 - DNA, 22 bp, Homo sapiens
ctccagccagagtgcctctgtt

SEQ ID NO: 8317899 - DNA, 20 bp, Homo sapiens
ctccagcccctgccctggtc

SEQ ID NO: 8317900 - DNA, 22 bp, Homo sapiens
ctcatttaacagattaaaaagt

SEQ ID NO: 8317901 - DNA, 22 bp, Homo sapiens
ttgaaagtccttcttgagttac

SEQ ID NO: 8317902 - DNA, 22 bp, Homo sapiens
ttggtcagctaataaggacagg

SEQ ID NO: 8317903 - DNA, 22 bp, Homo sapiens
ttgtacaaatgcatattcctgg

SEQ ID NO: 8317904 - DNA, 22 bp, Homo sapiens
ttgtacaacacatattctacag

SEQ ID NO: 8317905 - DNA, 22 bp, Homo sapiens
ctccagattccgtttattcagg

SEQ ID NO: 8317906 - DNA, 22 bp, Homo sapiens
ttgtacaagtattatgtgaaca

SEQ ID NO: 8317907 - DNA, 22 bp, Homo sapiens
taatatttctaccctgctgcct

SEQ ID NO: 8317908 - DNA, 22 bp, Homo sapiens
taatgtgttgaatatttgtaca

SEQ ID NO: 8317909 - DNA, 22 bp, Homo sapiens
taatgtctatgggccagataat

SEQ ID NO: 8317910 - DNA, 22 bp, Homo sapiens
taatgtctccagggttgaccta

SEQ ID NO: 8317911 - DNA, 22 bp, Homo sapiens
caggcagggagctggaaaggat

SEQ ID NO: 8317912 - DNA, 22 bp, Homo sapiens
caggccagtgtgcttcccaggc

SEQ ID NO: 8317913 - DNA, 22 bp, Homo sapiens
tacaaaacagtgctctggtcct

SEQ ID NO: 8317914 - DNA, 22 bp, Homo sapiens
tacaaaaaattgatactgacga

SEQ ID NO: 8317915 - DNA, 22 bp, Homo sapiens
tacaaaaaattgatactgacga

SEQ ID NO: 8317916 - DNA, 22 bp, Homo sapiens
caggcattgccattcctccaga

SEQ ID NO: 8317917 - DNA, 19 bp, Homo sapiens
taagtagtcaaatagtaac

SEQ ID NO: 8317918 - DNA, 21 bp, Homo sapiens
taataattccactacagagta

SEQ ID NO: 8317919 - DNA, 21 bp, Homo sapiens
taataattccactacagagta

SEQ ID NO: 8317920 - DNA, 22 bp, Homo sapiens
taataattagttattgatcgtg

SEQ ID NO: 8317921 - DNA, 22 bp, Homo sapiens
taataattggcaatgttgagca

SEQ ID NO: 8317922 - DNA, 22 bp, Homo sapiens
taataattttaaagaaggctag

SEQ ID NO: 8317923 - DNA, 22 bp, Homo sapiens
taataattggctaaccctggga

SEQ ID NO: 8317924 - DNA, 22 bp, Homo sapiens
taatacaatggagttgggcccc

SEQ ID NO: 8317925 - DNA, 22 bp, Homo sapiens
caggcagatgctgacaagagtt

SEQ ID NO: 8317926 - DNA, 22 bp, Homo sapiens
caggctggagttcagtggtgtg

SEQ ID NO: 8317927 - DNA, 22 bp, Homo sapiens
caggctgggaacgccacccgct

SEQ ID NO: 8317928 - DNA, 22 bp, Homo sapiens
tagaaaagtatgggactgacat

SEQ ID NO: 8317929 - DNA, 22 bp, Homo sapiens
caggctgggactgacccctgct

SEQ ID NO: 8317930 - DNA, 22 bp, Homo sapiens
tagaaaatggccaagcaggact

SEQ ID NO: 8317931 - DNA, 22 bp, Homo sapiens
tagaaacaaaatctgatgactc

SEQ ID NO: 8317932 - DNA, 22 bp, Homo sapiens
caggcctctatggtcagctgag

SEQ ID NO: 8317933 - DNA, 22 bp, Homo sapiens
cagggccaggctgatggcctgg

SEQ ID NO: 8317934 - DNA, 22 bp, Homo sapiens
cagggagccccaattccatgcc

SEQ ID NO: 8317935 - DNA, 22 bp, Homo sapiens
cagggcccagtccctgctgtca

SEQ ID NO: 8317936 - DNA, 22 bp, Homo sapiens
taggcatgcaaataaatgtgca

SEQ ID NO: 8317937 - DNA, 22 bp, Homo sapiens
tagcttatcccacagtgcccag

SEQ ID NO: 8317938 - DNA, 22 bp, Homo sapiens
cagggggtggtccaggctgcgc

SEQ ID NO: 8317939 - DNA, 22 bp, Homo sapiens
cagggtagggcaagggaacctg

SEQ ID NO: 8317940 - DNA, 22 bp, Homo sapiens
cagggtagtaatttaatacaag

SEQ ID NO: 8317941 - DNA, 17 bp, Homo sapiens
cagggctgtctgcctag

SEQ ID NO: 8317942 - DNA, 22 bp, Homo sapiens
cagggggcagcgtagaaaatga

SEQ ID NO: 8317943 - DNA, 22 bp, Homo sapiens
cagggggctcaaaggagagtgc

SEQ ID NO: 8317944 - DNA, 22 bp, Homo sapiens
cagggggcagcgtagaaaatga

SEQ ID NO: 8317945 - DNA, 22 bp, Homo sapiens
cagggggctcaaaggagagtgc

SEQ ID NO: 8317946 - DNA, 22 bp, Homo sapiens
cagggggctgtggctgtccagt

SEQ ID NO: 8317947 - DNA, 22 bp, Homo sapiens
cagggggctgtggctgtccagt

SEQ ID NO: 8317948 - DNA, 23 bp, Homo sapiens
cagggctggtagggaagagcgtg

SEQ ID NO: 8317949 - DNA, 22 bp, Homo sapiens
cagggctggtttgtcgaagaaa

SEQ ID NO: 8317950 - DNA, 22 bp, Homo sapiens
cagggctgtaaattagtgctga

SEQ ID NO: 8317951 - DNA, 22 bp, Homo sapiens
cagggctgtctccaaaggcccc

SEQ ID NO: 8317952 - DNA, 22 bp, Homo sapiens
cagggctgggttaaaagcaggg

SEQ ID NO: 8317953 - DNA, 22 bp, Homo sapiens
taggctgggcctgccttccagg

SEQ ID NO: 8317954 - DNA, 22 bp, Homo sapiens
taggctgggctgagctggacgg

SEQ ID NO: 8317955 - DNA, 20 bp, Homo sapiens
cagggctctgggcctggcct

SEQ ID NO: 8317956 - DNA, 22 bp, Homo sapiens
cagggtttcaccatgttagcag

SEQ ID NO: 8317957 - DNA, 22 bp, Homo sapiens
caggtaaggtcacattctgaag

SEQ ID NO: 8317958 - DNA, 22 bp, Homo sapiens
caggtagaggctgccatcagct

SEQ ID NO: 8317959 - DNA, 22 bp, Homo sapiens
caggtgcctcaggatgagacaa

SEQ ID NO: 8317960 - DNA, 18 bp, Homo sapiens
caggtgggtctcctgccc

SEQ ID NO: 8317961 - DNA, 22 bp, Homo sapiens
caggtggcatgactgcctacaa

SEQ ID NO: 8317962 - DNA, 22 bp, Homo sapiens
caggtggccagtactcaaggat

SEQ ID NO: 8317963 - DNA, 22 bp, Homo sapiens
caggtggccttgccatctcctg

SEQ ID NO: 8317964 - DNA, 22 bp, Homo sapiens
tcaagcagcagatcaagagcta

SEQ ID NO: 8317965 - DNA, 22 bp, Homo sapiens
tcaagctattggctgaggctgc

SEQ ID NO: 8317966 - DNA, 22 bp, Homo sapiens
tcaagcggactgagatactctg

SEQ ID NO: 8317967 - DNA, 22 bp, Homo sapiens
tcaaaacactattacctttaat

SEQ ID NO: 8317968 - DNA, 22 bp, Homo sapiens
tcaaaacccagccatcaggact

SEQ ID NO: 8317969 - DNA, 22 bp, Homo sapiens
tcaaaaattttctgaggatgag

SEQ ID NO: 8317970 - DNA, 22 bp, Homo sapiens
tcaaaacaacactcaggtgtaa

SEQ ID NO: 8317971 - DNA, 22 bp, Homo sapiens
tcaaaacaatcattggatgtgc

SEQ ID NO: 8317972 - DNA, 19 bp, Homo sapiens
tcaaaacacaaatggttga

SEQ ID NO: 8317973 - DNA, 22 bp, Homo sapiens
tattttaggtaatatccattgt

SEQ ID NO: 8317974 - DNA, 22 bp, Homo sapiens
tattttatctgccagagtggag

SEQ ID NO: 8317975 - DNA, 22 bp, Homo sapiens
tattttcaccatgtatccctgt

SEQ ID NO: 8317976 - DNA, 22 bp, Homo sapiens
tattttacaaatgggaatgctg

SEQ ID NO: 8317977 - DNA, 22 bp, Homo sapiens
cagtcacatttcgacataacta

SEQ ID NO: 8317978 - DNA, 22 bp, Homo sapiens
cagtcacaggtggagaaccgag

SEQ ID NO: 8317979 - DNA, 22 bp, Homo sapiens
cagtcacagtgacaggatgtgg

SEQ ID NO: 8317980 - DNA, 22 bp, Homo sapiens
cagtatattctgcagagcctta

SEQ ID NO: 8317981 - DNA, 21 bp, Homo sapiens
tccaggagcacgggactagga

SEQ ID NO: 8317982 - DNA, 22 bp, Homo sapiens
tccaggagcatccaggtgaagc

SEQ ID NO: 8317983 - DNA, 22 bp, Homo sapiens
tccaggagaggcctgaccaggt

SEQ ID NO: 8317984 - DNA, 22 bp, Homo sapiens
tcccacccatcctgcatctctt

SEQ ID NO: 8317985 - DNA, 22 bp, Homo sapiens
tcccaccccctccaaggaggaa

SEQ ID NO: 8317986 - DNA, 22 bp, Homo sapiens
tcccaccccctccaaggaggaa

SEQ ID NO: 8317987 - DNA, 22 bp, Homo sapiens
tcccaccccggtcaagggctga

SEQ ID NO: 8317988 - DNA, 22 bp, Homo sapiens
tcccaccccttgactctttaag

SEQ ID NO: 8317989 - DNA, 22 bp, Homo sapiens
tcccaccccggtcaagggctga

SEQ ID NO: 8317990 - DNA, 22 bp, Homo sapiens
cattcttacacaatattttaat

SEQ ID NO: 8317991 - DNA, 22 bp, Homo sapiens
cattcttacacaatattttaat

SEQ ID NO: 8317992 - DNA, 22 bp, Homo sapiens
cattctgggtctggctcaggga

SEQ ID NO: 8317993 - DNA, 21 bp, Homo sapiens
cattacatggttttagtgaac

SEQ ID NO: 8317994 - DNA, 22 bp, Homo sapiens
cattagaaggttttaaaggaat

SEQ ID NO: 8317995 - DNA, 22 bp, Homo sapiens
cattctcaatagtagatgagta

SEQ ID NO: 8317996 - DNA, 22 bp, Homo sapiens
tccctggaacagagagacaacg

SEQ ID NO: 8317997 - DNA, 22 bp, Homo sapiens
tccctctccctattgcctggag

SEQ ID NO: 8317998 - DNA, 22 bp, Homo sapiens
catttaaaggttgtgggtaaaa

SEQ ID NO: 8317999 - DNA, 22 bp, Homo sapiens
catttacaatgtacaggttgtg

SEQ ID NO: 8318000 - DNA, 22 bp, Homo sapiens
catttacacacagaggtgtgct

SEQ ID NO: 8318001 - DNA, 22 bp, Homo sapiens
catttaatctggctcatgagca

SEQ ID NO: 8318002 - DNA, 22 bp, Homo sapiens
tccctcctggccgtcaccgctg

SEQ ID NO: 8318003 - DNA, 22 bp, Homo sapiens
tcctggaggacagaggcatctc

SEQ ID NO: 8318004 - DNA, 22 bp, Homo sapiens
tcctggcactttgggggctcgc

SEQ ID NO: 8318005 - DNA, 22 bp, Homo sapiens
tcctggcagaaatggggctgtg

SEQ ID NO: 8318006 - DNA, 22 bp, Homo sapiens
tcctaattgcttcatgtgttgt

SEQ ID NO: 8318007 - DNA, 22 bp, Homo sapiens
tcctacacagataacagagacg

SEQ ID NO: 8318008 - DNA, 19 bp, Homo sapiens
ccacacagtgtgcaattta

SEQ ID NO: 8318009 - DNA, 22 bp, Homo sapiens
ccacactaaactgctcaaacca

SEQ ID NO: 8318010 - DNA, 22 bp, Homo sapiens
ccacagaaaataaagcacgatt

SEQ ID NO: 8318011 - DNA, 22 bp, Homo sapiens
tcctggcagggtggcagcgggt

SEQ ID NO: 8318012 - DNA, 22 bp, Homo sapiens
tcctggcaggtcagcaggagca

SEQ ID NO: 8318013 - DNA, 22 bp, Homo sapiens
tcctggctcctgatctgtcact

SEQ ID NO: 8318014 - DNA, 21 bp, Homo sapiens
tccttcccccttggcctggga

SEQ ID NO: 8318015 - DNA, 19 bp, Homo sapiens
tccttccccccagcacaga

SEQ ID NO: 8318016 - DNA, 22 bp, Homo sapiens
tcctttcaccaaaaagtgttgt

SEQ ID NO: 8318017 - DNA, 22 bp, Homo sapiens
tccttgtaaaggagctctaaca

SEQ ID NO: 8318018 - DNA, 22 bp, Homo sapiens
tccttaaagtgcacctcctcat

SEQ ID NO: 8318019 - DNA, 22 bp, Homo sapiens
tccttaaaggactagaagtcaa

SEQ ID NO: 8318020 - DNA, 22 bp, Homo sapiens
tcctgggcttgctcctccagct

SEQ ID NO: 8318021 - DNA, 22 bp, Homo sapiens
tcctgggcttagtggctaggtc

SEQ ID NO: 8318022 - DNA, 22 bp, Homo sapiens
tcctgggcttcacagactctgt

SEQ ID NO: 8318023 - DNA, 22 bp, Homo sapiens
tcctgggcttcacagactctgt

SEQ ID NO: 8318024 - DNA, 19 bp, Homo sapiens
tcctggggaggggcatggc

SEQ ID NO: 8318025 - DNA, 19 bp, Homo sapiens
tcctggggaggggcatggc

SEQ ID NO: 8318026 - DNA, 19 bp, Homo sapiens
tccttaaaaaagcagttct

SEQ ID NO: 8318027 - DNA, 22 bp, Homo sapiens
ccagagaattttagacaaaaat

SEQ ID NO: 8318028 - DNA, 22 bp, Homo sapiens
tctaataaataaatgctctagg

SEQ ID NO: 8318029 - DNA, 22 bp, Homo sapiens
ccactgtttttcagttaacttt

SEQ ID NO: 8318030 - DNA, 22 bp, Homo sapiens
ccactgtggaaagcagttcaga

SEQ ID NO: 8318031 - DNA, 22 bp, Homo sapiens
ccactgtgtccaccaggaatgc

SEQ ID NO: 8318032 - DNA, 22 bp, Homo sapiens
cagttttcttgttatatttggg

SEQ ID NO: 8318033 - DNA, 22 bp, Homo sapiens
cagtttttcaaaattacatgat

SEQ ID NO: 8318034 - DNA, 18 bp, Homo sapiens
cagtttttatatctggca

SEQ ID NO: 8318035 - DNA, 22 bp, Homo sapiens
cagtttttcaaaattacatgat

SEQ ID NO: 8318036 - DNA, 22 bp, Homo sapiens
cagtttttgccattaagagtaa

SEQ ID NO: 8318037 - DNA, 22 bp, Homo sapiens
tcaatatttttatgagcataga

SEQ ID NO: 8318038 - DNA, 22 bp, Homo sapiens
tcaatatattccatgttttctc

SEQ ID NO: 8318039 - DNA, 22 bp, Homo sapiens
tcaatatagcagtgtacttgag

SEQ ID NO: 8318040 - DNA, 22 bp, Homo sapiens
catagaaactgagacaaggatt

SEQ ID NO: 8318041 - DNA, 22 bp, Homo sapiens
catagaaactgagacaaggatt

SEQ ID NO: 8318042 - DNA, 22 bp, Homo sapiens
catagaaatcaggtgagaatct

SEQ ID NO: 8318043 - DNA, 22 bp, Homo sapiens
tcaggccctttgctgctgcccc

SEQ ID NO: 8318044 - DNA, 22 bp, Homo sapiens
tcagcagtcctccaggatcaag

SEQ ID NO: 8318045 - DNA, 22 bp, Homo sapiens
cataatcagatgtgtacataag

SEQ ID NO: 8318046 - DNA, 22 bp, Homo sapiens
cataattaaattctgggcaaga

SEQ ID NO: 8318047 - DNA, 18 bp, Homo sapiens
cataattttctttcttta

SEQ ID NO: 8318048 - DNA, 18 bp, Homo sapiens
cataattttctttcttta

SEQ ID NO: 8318049 - DNA, 22 bp, Homo sapiens
catgcattgtaatttttagtct

SEQ ID NO: 8318050 - DNA, 22 bp, Homo sapiens
catgcattcctcctctgcctta

SEQ ID NO: 8318051 - DNA, 22 bp, Homo sapiens
catggccagcccccagttcctc

SEQ ID NO: 8318052 - DNA, 22 bp, Homo sapiens
tccaggagaaggccatccagcg

SEQ ID NO: 8318053 - DNA, 22 bp, Homo sapiens
catggccacatctagctgcaag

SEQ ID NO: 8318054 - DNA, 22 bp, Homo sapiens
catgaagtcaggatttccatga

SEQ ID NO: 8318055 - DNA, 22 bp, Homo sapiens
catgcaggcctatggagcagtg

SEQ ID NO: 8318056 - DNA, 22 bp, Homo sapiens
catgacagatgcaaaggattgg

SEQ ID NO: 8318057 - DNA, 22 bp, Homo sapiens
catgcagggactagagaacagg

SEQ ID NO: 8318058 - DNA, 22 bp, Homo sapiens
catgcagtgtgtatctacttaa

SEQ ID NO: 8318059 - DNA, 22 bp, Homo sapiens
catctgcctaagtggccctgtt

SEQ ID NO: 8318060 - DNA, 22 bp, Homo sapiens
catctgccactctctcccacca

SEQ ID NO: 8318061 - DNA, 20 bp, Homo sapiens
catctgagcccacagaagtc

SEQ ID NO: 8318062 - DNA, 22 bp, Homo sapiens
catctggacaaaactctgaagg

SEQ ID NO: 8318063 - DNA, 22 bp, Homo sapiens
catctggttagttgatgaaact

SEQ ID NO: 8318064 - DNA, 22 bp, Homo sapiens
catctggtttaaaagaagaaag

SEQ ID NO: 8318065 - DNA, 22 bp, Homo sapiens
catgaaaataacattgttgtga

SEQ ID NO: 8318066 - DNA, 22 bp, Homo sapiens
catgaaaataacattgttgtga

SEQ ID NO: 8318067 - DNA, 22 bp, Homo sapiens
catgaaattgtattggcctcaa

SEQ ID NO: 8318068 - DNA, 22 bp, Homo sapiens
tcagtcccaaggtcctgaggtg

SEQ ID NO: 8318069 - DNA, 22 bp, Homo sapiens
tcagtccaggggctgtgatgtc

SEQ ID NO: 8318070 - DNA, 22 bp, Homo sapiens
tcagtccataggtgggcctgag

SEQ ID NO: 8318071 - DNA, 22 bp, Homo sapiens
tgggagtgttcttggcttgctt

SEQ ID NO: 8318072 - DNA, 19 bp, Homo sapiens
tgggagtggggaaggtcct

SEQ ID NO: 8318073 - DNA, 18 bp, Homo sapiens
tgggagtgggagtggata

SEQ ID NO: 8318074 - DNA, 18 bp, Homo sapiens
tgggagtgggagtggata

SEQ ID NO: 8318075 - DNA, 18 bp, Homo sapiens
cctgagccctgcttactt

SEQ ID NO: 8318076 - DNA, 22 bp, Homo sapiens
cctgagccgagcgctctttctc

SEQ ID NO: 8318077 - DNA, 22 bp, Homo sapiens
tgggcccaagagagtctccaac

SEQ ID NO: 8318078 - DNA, 22 bp, Homo sapiens
tgggccagtttctcattgaaat

SEQ ID NO: 8318079 - DNA, 22 bp, Homo sapiens
tgggcccaagtgcaatgcagtg

SEQ ID NO: 8318080 - DNA, 22 bp, Homo sapiens
tgggccccagcacgtctgggga

SEQ ID NO: 8318081 - DNA, 22 bp, Homo sapiens
tgggcccatcattgctgtgggc

SEQ ID NO: 8318082 - DNA, 22 bp, Homo sapiens
tgggccctgcccttgtctgtcc

SEQ ID NO: 8318083 - DNA, 22 bp, Homo sapiens
tgggctgctgagaatgagagag

SEQ ID NO: 8318084 - DNA, 22 bp, Homo sapiens
tgggctgctgtctgcacatgct

SEQ ID NO: 8318085 - DNA, 21 bp, Homo sapiens
cctgagcctgtttatccagaa

SEQ ID NO: 8318086 - DNA, 22 bp, Homo sapiens
tgggctgcttcctcagctgaga

SEQ ID NO: 8318087 - DNA, 22 bp, Homo sapiens
cctgagctcaagaaggtgacca

SEQ ID NO: 8318088 - DNA, 22 bp, Homo sapiens
tgggaagctgcattttaacaag

SEQ ID NO: 8318089 - DNA, 22 bp, Homo sapiens
cctcttccagctgttgcttcca

SEQ ID NO: 8318090 - DNA, 22 bp, Homo sapiens
cctctgctctggtccatgtgct

SEQ ID NO: 8318091 - DNA, 22 bp, Homo sapiens
cctctgctctggtccatgtgct

SEQ ID NO: 8318092 - DNA, 18 bp, Homo sapiens
cctctgcctttgtagagc

SEQ ID NO: 8318093 - DNA, 22 bp, Homo sapiens
cctctgcctttagtgaaagttg

SEQ ID NO: 8318094 - DNA, 20 bp, Homo sapiens
cctctgcctttctagtctga

SEQ ID NO: 8318095 - DNA, 20 bp, Homo sapiens
cctctgccccggggctgcta

SEQ ID NO: 8318096 - DNA, 22 bp, Homo sapiens
cctctgcctgcacatcatcctg

SEQ ID NO: 8318097 - DNA, 22 bp, Homo sapiens
cctctgcccttttcctgtatca

SEQ ID NO: 8318098 - DNA, 22 bp, Homo sapiens
cctctgcccttttcctgtatca

SEQ ID NO: 8318099 - DNA, 22 bp, Homo sapiens
cctctgcccttttcctgtatca

SEQ ID NO: 8318100 - DNA, 18 bp, Homo sapiens
tggctggctctgtcatct

SEQ ID NO: 8318101 - DNA, 22 bp, Homo sapiens
tggctggcttgttcactgactg

SEQ ID NO: 8318102 - DNA, 22 bp, Homo sapiens
tggctggctggaccacacctgc

SEQ ID NO: 8318103 - DNA, 22 bp, Homo sapiens
tggctggctgtccagctgggca

SEQ ID NO: 8318104 - DNA, 22 bp, Homo sapiens
cctcagggaatgggaggctggg

SEQ ID NO: 8318105 - DNA, 22 bp, Homo sapiens
cctcagggaatgggaggctggg

SEQ ID NO: 8318106 - DNA, 22 bp, Homo sapiens
tggcccagagcactgctgggca

SEQ ID NO: 8318107 - DNA, 22 bp, Homo sapiens
cctcagcatcctcctgctcagt

SEQ ID NO: 8318108 - DNA, 19 bp, Homo sapiens
tggcccagatggtcctggg

SEQ ID NO: 8318109 - DNA, 19 bp, Homo sapiens
tggcccagatggtcctggg

SEQ ID NO: 8318110 - DNA, 22 bp, Homo sapiens
tggcccagatctctgaccttga

SEQ ID NO: 8318111 - DNA, 20 bp, Homo sapiens
tggcccagcacgacgaggac

SEQ ID NO: 8318112 - DNA, 20 bp, Homo sapiens
tggcccagcacgacgaggac

SEQ ID NO: 8318113 - DNA, 22 bp, Homo sapiens
tggcccagcactccaagtaggg

SEQ ID NO: 8318114 - DNA, 22 bp, Homo sapiens
tggcccagcagttctgccccag

SEQ ID NO: 8318115 - DNA, 22 bp, Homo sapiens
cctcagggactccatgctgcag

SEQ ID NO: 8318116 - DNA, 22 bp, Homo sapiens
cctcagggacgggatcacttgg

SEQ ID NO: 8318117 - DNA, 22 bp, Homo sapiens
cctcagggactccatgctgcag

SEQ ID NO: 8318118 - DNA, 18 bp, Homo sapiens
cctcagggagagagacgc

SEQ ID NO: 8318119 - DNA, 20 bp, Homo sapiens
cctcagtgtcctggactggg

SEQ ID NO: 8318120 - DNA, 18 bp, Homo sapiens
cctcagggagagagacgc

SEQ ID NO: 8318121 - DNA, 22 bp, Homo sapiens
cctcagtgttaggataagagaa

SEQ ID NO: 8318122 - DNA, 22 bp, Homo sapiens
tggcctggctcacagtgagatt

SEQ ID NO: 8318123 - DNA, 22 bp, Homo sapiens
cctcatgctgcatctctgaggt

SEQ ID NO: 8318124 - DNA, 22 bp, Homo sapiens
tggcctggctgccctgtctgga

SEQ ID NO: 8318125 - DNA, 21 bp, Homo sapiens
cctagcctcttacccagcttt

SEQ ID NO: 8318126 - DNA, 22 bp, Homo sapiens
cctaaatagagtcagatgtaat

SEQ ID NO: 8318127 - DNA, 22 bp, Homo sapiens
cctaggagttgaggtggccaga

SEQ ID NO: 8318128 - DNA, 22 bp, Homo sapiens
cccttcctcccaggcttctgtg

SEQ ID NO: 8318129 - DNA, 22 bp, Homo sapiens
cccttcctcaaggagctgtgtt

SEQ ID NO: 8318130 - DNA, 22 bp, Homo sapiens
ccctgtggggtccgcctgtccg

SEQ ID NO: 8318131 - DNA, 22 bp, Homo sapiens
cccttcctcctcgcctgtcaga

SEQ ID NO: 8318132 - DNA, 22 bp, Homo sapiens
cccttcctggagtaccctctgt

SEQ ID NO: 8318133 - DNA, 22 bp, Homo sapiens
cccttccttgtgactggtgggg

SEQ ID NO: 8318134 - DNA, 22 bp, Homo sapiens
ccctgtgggccatgtgtctaca

SEQ ID NO: 8318135 - DNA, 22 bp, Homo sapiens
cccaggagataacgttcccaag

SEQ ID NO: 8318136 - DNA, 22 bp, Homo sapiens
tgccaggctaagtggaggactt

SEQ ID NO: 8318137 - DNA, 22 bp, Homo sapiens
cccaggagagaggccagttggc

SEQ ID NO: 8318138 - DNA, 22 bp, Homo sapiens
tgccctgggagttggagctgct

SEQ ID NO: 8318139 - DNA, 22 bp, Homo sapiens
cccaggctcctactgtattctg

SEQ ID NO: 8318140 - DNA, 22 bp, Homo sapiens
tgccctggggtctggagcagca

SEQ ID NO: 8318141 - DNA, 22 bp, Homo sapiens
tgccctggggagcccagccagg

SEQ ID NO: 8318142 - DNA, 21 bp, Homo sapiens
tgccctggggctcttccctca

SEQ ID NO: 8318143 - DNA, 22 bp, Homo sapiens
cccaggctcccaggtgggacaa

SEQ ID NO: 8318144 - DNA, 22 bp, Homo sapiens
cccaggctcagactggcttgtt

SEQ ID NO: 8318145 - DNA, 22 bp, Homo sapiens
cccaggctcagactggcttgtt

SEQ ID NO: 8318146 - DNA, 22 bp, Homo sapiens
cccaggctcactgtccgcttcc

SEQ ID NO: 8318147 - DNA, 22 bp, Homo sapiens
cccaggctagtatgatatcagt

SEQ ID NO: 8318148 - DNA, 22 bp, Homo sapiens
cccaggctagaaaggccaacaa

SEQ ID NO: 8318149 - DNA, 22 bp, Homo sapiens
tgcccagccagtttatggtaat

SEQ ID NO: 8318150 - DNA, 22 bp, Homo sapiens
tgcccagctgtcaaagtagata

SEQ ID NO: 8318151 - DNA, 19 bp, Homo sapiens
cccaggctacatggagagg

SEQ ID NO: 8318152 - DNA, 22 bp, Homo sapiens
tgcccagcccctatccctggga

SEQ ID NO: 8318153 - DNA, 22 bp, Homo sapiens
tgcccagcctaaacttggcaag

SEQ ID NO: 8318154 - DNA, 22 bp, Homo sapiens
tgcccagcgcccacattctgtc

SEQ ID NO: 8318155 - DNA, 22 bp, Homo sapiens
tgcccagctattcctttcttag

SEQ ID NO: 8318156 - DNA, 22 bp, Homo sapiens
tgcccagcgcccacattctgtc

SEQ ID NO: 8318157 - DNA, 22 bp, Homo sapiens
cccaggctggtcctgaactcct

SEQ ID NO: 8318158 - DNA, 22 bp, Homo sapiens
cccaggctggatttcggtggca

SEQ ID NO: 8318159 - DNA, 22 bp, Homo sapiens
cccaggctggagtgtaatggtg

SEQ ID NO: 8318160 - DNA, 22 bp, Homo sapiens
cccaggctggcactgctgaagt

SEQ ID NO: 8318161 - DNA, 22 bp, Homo sapiens
cccaggctgggaacgattctag

SEQ ID NO: 8318162 - DNA, 22 bp, Homo sapiens
cccaggctggggctcctccagc

SEQ ID NO: 8318163 - DNA, 22 bp, Homo sapiens
cccaggctggatttcggtggca

SEQ ID NO: 8318164 - DNA, 22 bp, Homo sapiens
cccaggctggcctccgcagtgc

SEQ ID NO: 8318165 - DNA, 22 bp, Homo sapiens
cccaggctggagtgcaatggca

SEQ ID NO: 8318166 - DNA, 22 bp, Homo sapiens
cccaggctggagtgcaatggca

SEQ ID NO: 8318167 - DNA, 22 bp, Homo sapiens
cccaggctggagtgcaatggtg

SEQ ID NO: 8318168 - DNA, 22 bp, Homo sapiens
cccaggctggagtgcaatggtg

SEQ ID NO: 8318169 - DNA, 22 bp, Homo sapiens
cccaggctggagtgcagtggcg

SEQ ID NO: 8318170 - DNA, 22 bp, Homo sapiens
cccaggctggagtgcagtggcg

SEQ ID NO: 8318171 - DNA, 22 bp, Homo sapiens
cccaggctgagttagaggtgtc

SEQ ID NO: 8318172 - DNA, 22 bp, Homo sapiens
cccaggctggagggcagtgtca

SEQ ID NO: 8318173 - DNA, 22 bp, Homo sapiens
tgccctggtgaagtgctctcct

SEQ ID NO: 8318174 - DNA, 22 bp, Homo sapiens
tgccctggtagacacagactgt

SEQ ID NO: 8318175 - DNA, 22 bp, Homo sapiens
cccagggtagctgagctggcag

SEQ ID NO: 8318176 - DNA, 22 bp, Homo sapiens
cccagggtgcggccctggctgg

SEQ ID NO: 8318177 - DNA, 22 bp, Homo sapiens
cccagggtccctgctctctgtg

SEQ ID NO: 8318178 - DNA, 22 bp, Homo sapiens
cccagggtggatgcaagcagca

SEQ ID NO: 8318179 - DNA, 23 bp, Homo sapiens
cccaggtagccctctagagcctg

SEQ ID NO: 8318180 - DNA, 22 bp, Homo sapiens
cccaggggttcaaggctgcagt

SEQ ID NO: 8318181 - DNA, 22 bp, Homo sapiens
cccaggggttctagaccagctt

SEQ ID NO: 8318182 - DNA, 22 bp, Homo sapiens
tgccttagggtacctggtgctt

SEQ ID NO: 8318183 - DNA, 22 bp, Homo sapiens
tgctggagcccaggcggccttt

SEQ ID NO: 8318184 - DNA, 22 bp, Homo sapiens
ccccaccctcgctccatttcgg

SEQ ID NO: 8318185 - DNA, 22 bp, Homo sapiens
ccccacccacctaagagaaact

SEQ ID NO: 8318186 - DNA, 22 bp, Homo sapiens
ccccaccctcgctccatttcgg

SEQ ID NO: 8318187 - DNA, 22 bp, Homo sapiens
ccccacagtccgtgaggagcca

SEQ ID NO: 8318188 - DNA, 22 bp, Homo sapiens
ccccacagccgccagcagggag

SEQ ID NO: 8318189 - DNA, 22 bp, Homo sapiens
cccagttgttgccggctctgga

SEQ ID NO: 8318190 - DNA, 22 bp, Homo sapiens
tgctggcccagtatggactgca

SEQ ID NO: 8318191 - DNA, 22 bp, Homo sapiens
tgctggcctggttagaaagggg

SEQ ID NO: 8318192 - DNA, 22 bp, Homo sapiens
tgctggctttctgtccctggca

SEQ ID NO: 8318193 - DNA, 23 bp, Homo sapiens
tgctggctaagaatctgcatttt

SEQ ID NO: 8318194 - DNA, 22 bp, Homo sapiens
tgctggctttagtgattggggt

SEQ ID NO: 8318195 - DNA, 22 bp, Homo sapiens
ccccttccttcctcagacagcc

SEQ ID NO: 8318196 - DNA, 22 bp, Homo sapiens
tgctggcttttccttcaggcag

SEQ ID NO: 8318197 - DNA, 22 bp, Homo sapiens
tgctggctttttggtccttgct

SEQ ID NO: 8318198 - DNA, 22 bp, Homo sapiens
cccgagggccgaaagctgcttt

SEQ ID NO: 8318199 - DNA, 22 bp, Homo sapiens
cccgctccttacctgtccaacc

SEQ ID NO: 8318200 - DNA, 22 bp, Homo sapiens
cccggacagaggggcagagtgt

SEQ ID NO: 8318201 - DNA, 22 bp, Homo sapiens
cccctttctcccgcgactggcc

SEQ ID NO: 8318202 - DNA, 22 bp, Homo sapiens
cccctttctcccgcgtctggcc

SEQ ID NO: 8318203 - DNA, 22 bp, Homo sapiens
ccccttctggtcttcaatggtg

SEQ ID NO: 8318204 - DNA, 22 bp, Homo sapiens
tgctgtgtaaaaggtgattgaa

SEQ ID NO: 8318205 - DNA, 22 bp, Homo sapiens
tgctgtgtctttctgtgaaaag

SEQ ID NO: 8318206 - DNA, 22 bp, Homo sapiens
ccctcctctccctaagagtcac

SEQ ID NO: 8318207 - DNA, 22 bp, Homo sapiens
ccctgaccctatcagagggcca

SEQ ID NO: 8318208 - DNA, 22 bp, Homo sapiens
ccctgagaggttgagtgtctgc

SEQ ID NO: 8318209 - DNA, 22 bp, Homo sapiens
ccctgaggaaagggtggagggc

SEQ ID NO: 8318210 - DNA, 22 bp, Homo sapiens
ccaggaggttgaggctgcagtg

SEQ ID NO: 8318211 - DNA, 22 bp, Homo sapiens
ccaggaggttgaggctgcagtg

SEQ ID NO: 8318212 - DNA, 22 bp, Homo sapiens
ccaggagttggaggctgcagtg

SEQ ID NO: 8318213 - DNA, 22 bp, Homo sapiens
ccaggagtttgaggctgcagtg

SEQ ID NO: 8318214 - DNA, 22 bp, Homo sapiens
ccaggagttggaggctgcagtg

SEQ ID NO: 8318215 - DNA, 22 bp, Homo sapiens
ccaggagttggaagctgccatg

SEQ ID NO: 8318216 - DNA, 22 bp, Homo sapiens
ccaggagtttgaggctgcagtg

SEQ ID NO: 8318217 - DNA, 22 bp, Homo sapiens
ccaggccagagtgcagtggcac

SEQ ID NO: 8318218 - DNA, 22 bp, Homo sapiens
ccaggccagcctggagcatggc

SEQ ID NO: 8318219 - DNA, 22 bp, Homo sapiens
tcttccctaatcaccatcttca

SEQ ID NO: 8318220 - DNA, 22 bp, Homo sapiens
tcttccctcttctgccaaatac

SEQ ID NO: 8318221 - DNA, 22 bp, Homo sapiens
tcttcagagcatttctgaggta

SEQ ID NO: 8318222 - DNA, 22 bp, Homo sapiens
tctttggtgaatggtcatccag

SEQ ID NO: 8318223 - DNA, 22 bp, Homo sapiens
tctttggtgatatctctttggt

SEQ ID NO: 8318224 - DNA, 22 bp, Homo sapiens
tctttgggagaaggggtcccag

SEQ ID NO: 8318225 - DNA, 22 bp, Homo sapiens
tctttggtattcacttgtgaag

SEQ ID NO: 8318226 - DNA, 23 bp, Homo sapiens
tctttggtaaataaagtggggat

SEQ ID NO: 8318227 - DNA, 22 bp, Homo sapiens
tctttggtcatcatgggaagca

SEQ ID NO: 8318228 - DNA, 22 bp, Homo sapiens
tctttggtcagaaagattacac

SEQ ID NO: 8318229 - DNA, 22 bp, Homo sapiens
tctttggctttgccacacccaa

SEQ ID NO: 8318230 - DNA, 22 bp, Homo sapiens
tctttggcttgtctcctcagtt

SEQ ID NO: 8318231 - DNA, 22 bp, Homo sapiens
tctttggccttaggagcccttg

SEQ ID NO: 8318232 - DNA, 22 bp, Homo sapiens
tctttgaaacaccctaaccttt

SEQ ID NO: 8318233 - DNA, 22 bp, Homo sapiens
ccaggccaggagagcgaggttt

SEQ ID NO: 8318234 - DNA, 22 bp, Homo sapiens
ccaggccagtgtttggtccagg

SEQ ID NO: 8318235 - DNA, 22 bp, Homo sapiens
tctttcaagggccctagtttgg

SEQ ID NO: 8318236 - DNA, 22 bp, Homo sapiens
tctttcaatccattcatatgtc

SEQ ID NO: 8318237 - DNA, 22 bp, Homo sapiens
tctggcaggccttgtcaatctg

SEQ ID NO: 8318238 - DNA, 22 bp, Homo sapiens
tctggctcaggtcagacaggga

SEQ ID NO: 8318239 - DNA, 22 bp, Homo sapiens
ccaggaccacacgacaggagag

SEQ ID NO: 8318240 - DNA, 22 bp, Homo sapiens
tctggtcctgaagtcaacttca

SEQ ID NO: 8318241 - DNA, 22 bp, Homo sapiens
tctggtgtcagtattctttgaa

SEQ ID NO: 8318242 - DNA, 22 bp, Homo sapiens
tctggtcccttttcctgcagtc

SEQ ID NO: 8318243 - DNA, 22 bp, Homo sapiens
ccaggactcaatgaccacaggg

SEQ ID NO: 8318244 - DNA, 22 bp, Homo sapiens
ccagctctctgcagaaaggact

SEQ ID NO: 8318245 - DNA, 22 bp, Homo sapiens
tctgctacagggaaggacccct

SEQ ID NO: 8318246 - DNA, 22 bp, Homo sapiens
ccagagagaaaatggagggcca

SEQ ID NO: 8318247 - DNA, 22 bp, Homo sapiens
ccagagagaaatggatttgagt

SEQ ID NO: 8318248 - DNA, 22 bp, Homo sapiens
tctgctttagacataaaaggta

SEQ ID NO: 8318249 - DNA, 22 bp, Homo sapiens
tctgctttcaaattcacttagt

SEQ ID NO: 8318250 - DNA, 22 bp, Homo sapiens
tctgctttcttactaaaaatga

SEQ ID NO: 8318251 - DNA, 22 bp, Homo sapiens
tctgctttcttactaaaaatga

SEQ ID NO: 8318252 - DNA, 22 bp, Homo sapiens
tctggaaataaaattatagttg

SEQ ID NO: 8318253 - DNA, 22 bp, Homo sapiens
tctggaaagatcattaaatcca

SEQ ID NO: 8318254 - DNA, 22 bp, Homo sapiens
ccaggctggattttgcagttca

SEQ ID NO: 8318255 - DNA, 20 bp, Homo sapiens
ccaggctggcaaatgggggc

SEQ ID NO: 8318256 - DNA, 22 bp, Homo sapiens
ccaggctggagtgcagtggcac

SEQ ID NO: 8318257 - DNA, 22 bp, Homo sapiens
tgacaacagccatcacttttag

SEQ ID NO: 8318258 - DNA, 23 bp, Homo sapiens
tgacaacagctctcagccatgtc

SEQ ID NO: 8318259 - DNA, 22 bp, Homo sapiens
tgaatgatctagttttgtagac

SEQ ID NO: 8318260 - DNA, 22 bp, Homo sapiens
tgaatgatctccgattagtcct

SEQ ID NO: 8318261 - DNA, 22 bp, Homo sapiens
tgaatgatacagaattatgtag

SEQ ID NO: 8318262 - DNA, 22 bp, Homo sapiens
tgaatgatatgtgaaaaggaac

SEQ ID NO: 8318263 - DNA, 22 bp, Homo sapiens
tgaatgatatattgggaataat

SEQ ID NO: 8318264 - DNA, 22 bp, Homo sapiens
tgaagttgttaaggttgccatt

SEQ ID NO: 8318265 - DNA, 22 bp, Homo sapiens
tgaatgatgaggggagaataat

SEQ ID NO: 8318266 - DNA, 21 bp, Homo sapiens
tgaatgatctggttgcctttt

SEQ ID NO: 8318267 - DNA, 22 bp, Homo sapiens
tgaatgatgcatttgtttccca

SEQ ID NO: 8318268 - DNA, 22 bp, Homo sapiens
tgaatgatgcagtataatgata

SEQ ID NO: 8318269 - DNA, 23 bp, Homo sapiens
tgaatgatggtgctcctcatctt

SEQ ID NO: 8318270 - DNA, 21 bp, Homo sapiens
tgaatgatgccccagagttgt

SEQ ID NO: 8318271 - DNA, 22 bp, Homo sapiens
tgaatgatttgggtgcattcag

SEQ ID NO: 8318272 - DNA, 22 bp, Homo sapiens
tgaatgatttcttaggcaattg

SEQ ID NO: 8318273 - DNA, 23 bp, Homo sapiens
tgaatgattgtactgagctttta

SEQ ID NO: 8318274 - DNA, 22 bp, Homo sapiens
tgaatgattaaaacccggacta

SEQ ID NO: 8318275 - DNA, 22 bp, Homo sapiens
tgaatgatggtgtgttcttgcc

SEQ ID NO: 8318276 - DNA, 22 bp, Homo sapiens
tgaatgatgtataatattgaga

SEQ ID NO: 8318277 - DNA, 22 bp, Homo sapiens
tgacaagtacataatttcatgt

SEQ ID NO: 8318278 - DNA, 22 bp, Homo sapiens
tgacagtgtcagtttcctaata

SEQ ID NO: 8318279 - DNA, 20 bp, Homo sapiens
tgacagtttcatatggttca

SEQ ID NO: 8318280 - DNA, 22 bp, Homo sapiens
tgacagttaaggtatacattca

SEQ ID NO: 8318281 - DNA, 22 bp, Homo sapiens
tgacagttgtattacatgggaa

SEQ ID NO: 8318282 - DNA, 22 bp, Homo sapiens
tgacatacttttagatagatgg

SEQ ID NO: 8318283 - DNA, 22 bp, Homo sapiens
tgagaataagagatagtttatt

SEQ ID NO: 8318284 - DNA, 19 bp, Homo sapiens
tgagaaggcagtggggagc

SEQ ID NO: 8318285 - DNA, 17 bp, Homo sapiens
ccaggtctccttgcttt

SEQ ID NO: 8318286 - DNA, 22 bp, Homo sapiens
ccaggtctcgggtctgctcgtg

SEQ ID NO: 8318287 - DNA, 22 bp, Homo sapiens
tgagacatgtgaatatttgtac

SEQ ID NO: 8318288 - DNA, 22 bp, Homo sapiens
cccagaaggctaagcgtggatt

SEQ ID NO: 8318289 - DNA, 22 bp, Homo sapiens
cccagaaggcttgccaggaagc

SEQ ID NO: 8318290 - DNA, 22 bp, Homo sapiens
cccagacagtgatttacttaat

SEQ ID NO: 8318291 - DNA, 22 bp, Homo sapiens
cccacccctggacaggtgagtg

SEQ ID NO: 8318292 - DNA, 22 bp, Homo sapiens
tgcaaatagcctgatgaaagaa

SEQ ID NO: 8318293 - DNA, 22 bp, Homo sapiens
ccattgtaaagagtatactttg

SEQ ID NO: 8318294 - DNA, 22 bp, Homo sapiens
tgattcaagagagttggggtat

SEQ ID NO: 8318295 - DNA, 22 bp, Homo sapiens
tgattcaagattggttagctgt

SEQ ID NO: 8318296 - DNA, 22 bp, Homo sapiens
tgattcaagccaccacatactg

SEQ ID NO: 8318297 - DNA, 22 bp, Homo sapiens
tgattcaagctactgttactgg

SEQ ID NO: 8318298 - DNA, 22 bp, Homo sapiens
tgattttattggtgaggaaatt

SEQ ID NO: 8318299 - DNA, 23 bp, Homo sapiens
tgattttaaaaagtaagttatca

SEQ ID NO: 8318300 - DNA, 23 bp, Homo sapiens
tgattttaaaaagtaagttatca

SEQ ID NO: 8318301 - DNA, 23 bp, Homo sapiens
tgattttaaaaagtaagttatca

SEQ ID NO: 8318302 - DNA, 22 bp, Homo sapiens
tgatttgattcttcttggagta

SEQ ID NO: 8318303 - DNA, 22 bp, Homo sapiens
ccattcaataccttagagaaaa

SEQ ID NO: 8318304 - DNA, 22 bp, Homo sapiens
ccattagaagatgtaatagaga

SEQ ID NO: 8318305 - DNA, 22 bp, Homo sapiens
ccattaagtattattaatgatt

SEQ ID NO: 8318306 - DNA, 22 bp, Homo sapiens
ccattaaagcaccactgtaata

SEQ ID NO: 8318307 - DNA, 22 bp, Homo sapiens
ccattaaacttgtggacccagt

SEQ ID NO: 8318308 - DNA, 22 bp, Homo sapiens
ccattaaaattgtgacatagga

SEQ ID NO: 8318309 - DNA, 22 bp, Homo sapiens
ccattaaaatggaatgtagtga

SEQ ID NO: 8318310 - DNA, 22 bp, Homo sapiens
ccattaaaatggaatgtagtga

SEQ ID NO: 8318311 - DNA, 19 bp, Homo sapiens
ccattgtaaagaaaaatgt

SEQ ID NO: 8318312 - DNA, 22 bp, Homo sapiens
ccattgcactccatcctgggca

SEQ ID NO: 8318313 - DNA, 22 bp, Homo sapiens
tgaggtaggtggtaagagatac

SEQ ID NO: 8318314 - DNA, 22 bp, Homo sapiens
tgaggtaggtaccattatcact

SEQ ID NO: 8318315 - DNA, 22 bp, Homo sapiens
tgaggtagggacttaaaactgt

SEQ ID NO: 8318316 - DNA, 22 bp, Homo sapiens
tgaggtagggagtttgttgttg

SEQ ID NO: 8318317 - DNA, 22 bp, Homo sapiens
tgaggtagggaaggctggtatt

SEQ ID NO: 8318318 - DNA, 22 bp, Homo sapiens
tgaggtaggcttgagatgggag

SEQ ID NO: 8318319 - DNA, 22 bp, Homo sapiens
tgaggtaggtgtcgagagaggt

SEQ ID NO: 8318320 - DNA, 22 bp, Homo sapiens
tgaggtaggttgaaagatagat

SEQ ID NO: 8318321 - DNA, 22 bp, Homo sapiens
tgaggtaggtggtgaaaaatga

SEQ ID NO: 8318322 - DNA, 22 bp, Homo sapiens
tgaggtaggtggtggcagccat

SEQ ID NO: 8318323 - DNA, 22 bp, Homo sapiens
tgaggtagtgtttagtccagtc

SEQ ID NO: 8318324 - DNA, 22 bp, Homo sapiens
tgaggtagtgcttgtcatgttt

SEQ ID NO: 8318325 - DNA, 22 bp, Homo sapiens
tgaggtagtaaaggtgttagtt

SEQ ID NO: 8318326 - DNA, 22 bp, Homo sapiens
tgaggtagtgattgtagaagtg

SEQ ID NO: 8318327 - DNA, 22 bp, Homo sapiens
tgaggtagtagatttttgtcca

SEQ ID NO: 8318328 - DNA, 22 bp, Homo sapiens
tgaggtagtttttcaagtattt

SEQ ID NO: 8318329 - DNA, 22 bp, Homo sapiens
tgaggtagtttgttgtacagta

SEQ ID NO: 8318330 - DNA, 20 bp, Homo sapiens
tgaggtatcaattcaaggca

SEQ ID NO: 8318331 - DNA, 21 bp, Homo sapiens
tgaggtagtgtttgtcaagtt

SEQ ID NO: 8318332 - DNA, 22 bp, Homo sapiens
tgaggtagttctaatattaaag

SEQ ID NO: 8318333 - DNA, 22 bp, Homo sapiens
tgaggtcacagctggggatgga

SEQ ID NO: 8318334 - DNA, 22 bp, Homo sapiens
tgaggtcacctggaggcagcct

SEQ ID NO: 8318335 - DNA, 22 bp, Homo sapiens
ccatgccctaaaggactggcag

SEQ ID NO: 8318336 - DNA, 22 bp, Homo sapiens
ccatgctgggatgctccaagtg

SEQ ID NO: 8318337 - DNA, 22 bp, Homo sapiens
ccatgcccacgttgtggctcag

SEQ ID NO: 8318338 - DNA, 22 bp, Homo sapiens
tgagggctaaattgtggcaggt

SEQ ID NO: 8318339 - DNA, 20 bp, Homo sapiens
tgagggctaaccagactctg

SEQ ID NO: 8318340 - DNA, 22 bp, Homo sapiens
tgagggctaaattgtggcaggt

SEQ ID NO: 8318341 - DNA, 22 bp, Homo sapiens
tgagggccgaggagctgtgggt

SEQ ID NO: 8318342 - DNA, 22 bp, Homo sapiens
tgagggcagagcactggggagc

SEQ ID NO: 8318343 - DNA, 22 bp, Homo sapiens
tgagggctgcttccagagctag

SEQ ID NO: 8318344 - DNA, 22 bp, Homo sapiens
ccagtcccgcatggtccagaat

SEQ ID NO: 8318345 - DNA, 22 bp, Homo sapiens
ttactctgaatgtttctactga

SEQ ID NO: 8318346 - DNA, 22 bp, Homo sapiens
ttactacattgtaacacagtac

SEQ ID NO: 8318347 - DNA, 22 bp, Homo sapiens
ttaccaaatcccgtgcacattc

SEQ ID NO: 8318348 - DNA, 22 bp, Homo sapiens
ttactgaaccctacttttacag

SEQ ID NO: 8318349 - DNA, 22 bp, Homo sapiens
ttactgatttttgggccctacc

SEQ ID NO: 8318350 - DNA, 22 bp, Homo sapiens
ttactgatggaacagagataga

SEQ ID NO: 8318351 - DNA, 22 bp, Homo sapiens
ttactgatacacataagaattt

SEQ ID NO: 8318352 - DNA, 22 bp, Homo sapiens
ttactgatacacataagaattt

SEQ ID NO: 8318353 - DNA, 22 bp, Homo sapiens
ttactgatggaacagagataga

SEQ ID NO: 8318354 - DNA, 22 bp, Homo sapiens
ttactggctgggcctgagggct

SEQ ID NO: 8318355 - DNA, 22 bp, Homo sapiens
ttactgggaatgttatggagaa

SEQ ID NO: 8318356 - DNA, 22 bp, Homo sapiens
ttacttaaaaattctaagcccc

SEQ ID NO: 8318357 - DNA, 22 bp, Homo sapiens
ttacttgaaaaccaccagtatt

SEQ ID NO: 8318358 - DNA, 22 bp, Homo sapiens
ttacttgattgtggagtctgag

SEQ ID NO: 8318359 - DNA, 22 bp, Homo sapiens
ttacttgatgtatgatgagtag

SEQ ID NO: 8318360 - DNA, 22 bp, Homo sapiens
ttacttgaatgctgtgatctca

SEQ ID NO: 8318361 - DNA, 22 bp, Homo sapiens
ttacttgacataaatgagttta

SEQ ID NO: 8318362 - DNA, 22 bp, Homo sapiens
ttagaggggctgctgaatggga

SEQ ID NO: 8318363 - DNA, 19 bp, Homo sapiens
ttagaaactgttgacactg

SEQ ID NO: 8318364 - DNA, 22 bp, Homo sapiens
ttagaaagaactttagatatca

SEQ ID NO: 8318365 - DNA, 20 bp, Homo sapiens
ttagaaagagcgtgataaga

SEQ ID NO: 8318366 - DNA, 22 bp, Homo sapiens
ttactttgctttctcattacag

SEQ ID NO: 8318367 - DNA, 22 bp, Homo sapiens
ttacatcattgagacatacata

SEQ ID NO: 8318368 - DNA, 22 bp, Homo sapiens
ttacatcatgcttatccctttc

SEQ ID NO: 8318369 - DNA, 22 bp, Homo sapiens
ttacatcactttacttaataat

SEQ ID NO: 8318370 - DNA, 22 bp, Homo sapiens
ttacactttggcaagctattaa

SEQ ID NO: 8318371 - DNA, 22 bp, Homo sapiens
ttacaggaggtgctaggtgttt

SEQ ID NO: 8318372 - DNA, 22 bp, Homo sapiens
ttacaggtggagaagtaaggct

SEQ ID NO: 8318373 - DNA, 22 bp, Homo sapiens
ttacagtagattttgaatgtgg

SEQ ID NO: 8318374 - DNA, 22 bp, Homo sapiens
ttacagtagatacaatgagtaa

SEQ ID NO: 8318375 - DNA, 22 bp, Homo sapiens
ttacacaaacacattccagata

SEQ ID NO: 8318376 - DNA, 22 bp, Homo sapiens
ttacaaagaaaattaggcattt

SEQ ID NO: 8318377 - DNA, 22 bp, Homo sapiens
ttacaaacaagatcttattctt

SEQ ID NO: 8318378 - DNA, 22 bp, Homo sapiens
ttacaaactccagtgagtgagc

SEQ ID NO: 8318379 - DNA, 22 bp, Homo sapiens
ttacacaacagtgcatcagcag

SEQ ID NO: 8318380 - DNA, 22 bp, Homo sapiens
ttacacaagttctttaacctat

SEQ ID NO: 8318381 - DNA, 22 bp, Homo sapiens
ttaattttctcatctgtgaaat

SEQ ID NO: 8318382 - DNA, 22 bp, Homo sapiens
ttaattttctcatctgtgaaat

SEQ ID NO: 8318383 - DNA, 18 bp, Homo sapiens
ttacactagccttggttc

SEQ ID NO: 8318384 - DNA, 22 bp, Homo sapiens
ttacacagtgaatttactcaag

SEQ ID NO: 8318385 - DNA, 22 bp, Homo sapiens
ttaacactatctgtcataatta

SEQ ID NO: 8318386 - DNA, 22 bp, Homo sapiens
ttaacagtggctaagactgagg

SEQ ID NO: 8318387 - DNA, 22 bp, Homo sapiens
ttaacatacatcatgaacaatg

SEQ ID NO: 8318388 - DNA, 22 bp, Homo sapiens
ttaacattgtccttagcagatt

SEQ ID NO: 8318389 - DNA, 22 bp, Homo sapiens
ttaagaaggtactcaaagatct

SEQ ID NO: 8318390 - DNA, 22 bp, Homo sapiens
ttaagacacatttctcagacgg

SEQ ID NO: 8318391 - DNA, 20 bp, Homo sapiens
ttaagaaaagcacatcctgc

SEQ ID NO: 8318392 - DNA, 22 bp, Homo sapiens
ttaacttgtcagaaaatacagt

SEQ ID NO: 8318393 - DNA, 22 bp, Homo sapiens
ttaagacatgtgagcataactt

SEQ ID NO: 8318394 - DNA, 22 bp, Homo sapiens
ttaagtaagaccttatgtcttg

SEQ ID NO: 8318395 - DNA, 22 bp, Homo sapiens
ttaagtgcctctaaaacaagcc

SEQ ID NO: 8318396 - DNA, 22 bp, Homo sapiens
ttaaggcattctcctactaata

SEQ ID NO: 8318397 - DNA, 22 bp, Homo sapiens
ttaatttatgtccaaaccagat

SEQ ID NO: 8318398 - DNA, 22 bp, Homo sapiens
ttaatttatgtccaaaccagat

SEQ ID NO: 8318399 - DNA, 22 bp, Homo sapiens
ttaatttatacataatcacagg

SEQ ID NO: 8318400 - DNA, 22 bp, Homo sapiens
ttaataaacaggtgcagctgaa

SEQ ID NO: 8318401 - DNA, 22 bp, Homo sapiens
ttaataaacaggtgcagctgaa

SEQ ID NO: 8318402 - DNA, 22 bp, Homo sapiens
ttaattactaagcacaatgcaa

SEQ ID NO: 8318403 - DNA, 22 bp, Homo sapiens
tgttttgtgcatttacaacatg

SEQ ID NO: 8318404 - DNA, 22 bp, Homo sapiens
tgttttctgggtggaaggtact

SEQ ID NO: 8318405 - DNA, 17 bp, Homo sapiens
tgttttctgctaccttt

SEQ ID NO: 8318406 - DNA, 22 bp, Homo sapiens
tgtttttactgtgatccagaaa

SEQ ID NO: 8318407 - DNA, 22 bp, Homo sapiens
ttaaatattttcagcagggtca

SEQ ID NO: 8318408 - DNA, 22 bp, Homo sapiens
ttaaatattatgttgtctgcaa

SEQ ID NO: 8318409 - DNA, 22 bp, Homo sapiens
ttaaatattatgttgtctgcaa

SEQ ID NO: 8318410 - DNA, 22 bp, Homo sapiens
ttaaattaggactctagttctg

SEQ ID NO: 8318411 - DNA, 22 bp, Homo sapiens
ttaacaatagagtttcttcagg

SEQ ID NO: 8318412 - DNA, 22 bp, Homo sapiens
ttaacaaagtaacgggaaaaga

SEQ ID NO: 8318413 - DNA, 22 bp, Homo sapiens
ttaacacatatttatcaattgc

SEQ ID NO: 8318414 - DNA, 22 bp, Homo sapiens
ttaaatgaggctgatgtagatt

SEQ ID NO: 8318415 - DNA, 22 bp, Homo sapiens
ttaaatggagggggaaatacgt

SEQ ID NO: 8318416 - DNA, 22 bp, Homo sapiens
ttaaatggggatgagtagatgg

SEQ ID NO: 8318417 - DNA, 22 bp, Homo sapiens
ttaaatgagatgttcagatatt

SEQ ID NO: 8318418 - DNA, 22 bp, Homo sapiens
ttaaatgaacgagatatgcaac

SEQ ID NO: 8318419 - DNA, 22 bp, Homo sapiens
tgtttaatgaagatggtttttc

SEQ ID NO: 8318420 - DNA, 22 bp, Homo sapiens
tgtttaataattctatgatagt

SEQ ID NO: 8318421 - DNA, 21 bp, Homo sapiens
tgtttaatacatatttgtgga

SEQ ID NO: 8318422 - DNA, 22 bp, Homo sapiens
tgtttaatttcacaaagttgac

SEQ ID NO: 8318423 - DNA, 22 bp, Homo sapiens
tgtttaattcaccatcatgttc

SEQ ID NO: 8318424 - DNA, 22 bp, Homo sapiens
tgtttacaaaaccgtggtactg

SEQ ID NO: 8318425 - DNA, 22 bp, Homo sapiens
tgtttacaagccacttgttaag

SEQ ID NO: 8318426 - DNA, 22 bp, Homo sapiens
tgtttacacaatagtctctctc

SEQ ID NO: 8318427 - DNA, 22 bp, Homo sapiens
tgtttacaaggagaatttgagg

SEQ ID NO: 8318428 - DNA, 22 bp, Homo sapiens
tgtttacaaggagtttatattg

SEQ ID NO: 8318429 - DNA, 22 bp, Homo sapiens
tgtttacatagtagctgccctg

SEQ ID NO: 8318430 - DNA, 22 bp, Homo sapiens
tgtttacagtttttagtaccct

SEQ ID NO: 8318431 - DNA, 22 bp, Homo sapiens
tgtttacagggtgattttacct

SEQ ID NO: 8318432 - DNA, 22 bp, Homo sapiens
tgtttacacttcaaggttaagg

SEQ ID NO: 8318433 - DNA, 22 bp, Homo sapiens
tgtttacagcactgcacactgc

SEQ ID NO: 8318434 - DNA, 22 bp, Homo sapiens
tgtttacagctgatcaggcatc

SEQ ID NO: 8318435 - DNA, 22 bp, Homo sapiens
tgtttacagaaggcagacttcc

SEQ ID NO: 8318436 - DNA, 22 bp, Homo sapiens
tgttctctctccttttgaagtg

SEQ ID NO: 8318437 - DNA, 22 bp, Homo sapiens
tgttccttgaatatatcagacg

SEQ ID NO: 8318438 - DNA, 22 bp, Homo sapiens
tgttccttttactgcatgcgta

SEQ ID NO: 8318439 - DNA, 22 bp, Homo sapiens
tgttctaagctgccaaaatgct

SEQ ID NO: 8318440 - DNA, 22 bp, Homo sapiens
tgttctcttttcctgctgagcc

SEQ ID NO: 8318441 - DNA, 22 bp, Homo sapiens
tgtttcttgagagtattaccct

SEQ ID NO: 8318442 - DNA, 22 bp, Homo sapiens
tgtttgaagttcttctgtgact

SEQ ID NO: 8318443 - DNA, 22 bp, Homo sapiens
tgtttgatgacgacattgtaga

SEQ ID NO: 8318444 - DNA, 22 bp, Homo sapiens
tgtttgcaacaactagatggag

SEQ ID NO: 8318445 - DNA, 22 bp, Homo sapiens
tgtttgagttctagcgcattta

SEQ ID NO: 8318446 - DNA, 22 bp, Homo sapiens
tgtttacatgcataagcttaag

SEQ ID NO: 8318447 - DNA, 22 bp, Homo sapiens
tgtttacatgcataagcttaag

SEQ ID NO: 8318448 - DNA, 22 bp, Homo sapiens
tgtttacatatttggtctcaga

SEQ ID NO: 8318449 - DNA, 22 bp, Homo sapiens
tgtttacatggaggttttcagc

SEQ ID NO: 8318450 - DNA, 22 bp, Homo sapiens
tgtttacatggaggttttcagc

SEQ ID NO: 8318451 - DNA, 19 bp, Homo sapiens
tgtttacatgtttcttcag

SEQ ID NO: 8318452 - DNA, 19 bp, Homo sapiens
tgtttacatgtttcttcag

SEQ ID NO: 8318453 - DNA, 22 bp, Homo sapiens
tgtttactatgatgtaacctat

SEQ ID NO: 8318454 - DNA, 22 bp, Homo sapiens
tgtttcaagcaatagcatttca

SEQ ID NO: 8318455 - DNA, 22 bp, Homo sapiens
tgtttccagaatgtagctgctt

SEQ ID NO: 8318456 - DNA, 22 bp, Homo sapiens
tgtttccccaaccccacaagta

SEQ ID NO: 8318457 - DNA, 22 bp, Homo sapiens
tgtttccctggaagaggagaga

SEQ ID NO: 8318458 - DNA, 22 bp, Homo sapiens
tgtttccctaaggtctggctct

SEQ ID NO: 8318459 - DNA, 22 bp, Homo sapiens
tgtttccaaagtcttttcttaa

SEQ ID NO: 8318460 - DNA, 22 bp, Homo sapiens
tgtgtttgggggagatgcattt

SEQ ID NO: 8318461 - DNA, 22 bp, Homo sapiens
tgtgttttatctattgtatctt

SEQ ID NO: 8318462 - DNA, 22 bp, Homo sapiens
tgtgttttatctattgtatctt

SEQ ID NO: 8318463 - DNA, 22 bp, Homo sapiens
tgtgtttagagagcacattcag

SEQ ID NO: 8318464 - DNA, 22 bp, Homo sapiens
tgtgtgcagacagatattactt

SEQ ID NO: 8318465 - DNA, 22 bp, Homo sapiens
tgttatttgggaaagttgtaca

SEQ ID NO: 8318466 - DNA, 22 bp, Homo sapiens
tgttcctgacggccaaagaggt

SEQ ID NO: 8318467 - DNA, 22 bp, Homo sapiens
tgttcctggttcctgcatgatg

SEQ ID NO: 8318468 - DNA, 22 bp, Homo sapiens
tccccccagcctttcacatgag

SEQ ID NO: 8318469 - DNA, 22 bp, Homo sapiens
tcccccactctaaaggagcctt

SEQ ID NO: 8318470 - DNA, 22 bp, Homo sapiens
tccccagggtccctgcttccat

SEQ ID NO: 8318471 - DNA, 22 bp, Homo sapiens
tccccagtcccggcggtgggtg

SEQ ID NO: 8318472 - DNA, 22 bp, Homo sapiens
tgtggccagccacaggcatggt

SEQ ID NO: 8318473 - DNA, 22 bp, Homo sapiens
tgtggccaggaaaaggagatgg

SEQ ID NO: 8318474 - DNA, 22 bp, Homo sapiens
tgtgtctaaatggttccttaat

SEQ ID NO: 8318475 - DNA, 22 bp, Homo sapiens
tgtgtacaaactaacaacatat

SEQ ID NO: 8318476 - DNA, 22 bp, Homo sapiens
tgtgtaaatttatttacataaa

SEQ ID NO: 8318477 - DNA, 21 bp, Homo sapiens
tgtgtaatatgtataagaata

SEQ ID NO: 8318478 - DNA, 22 bp, Homo sapiens
tgtggtgccgagagtctggacg

SEQ ID NO: 8318479 - DNA, 22 bp, Homo sapiens
tgtggtctccccagtgccagct

SEQ ID NO: 8318480 - DNA, 22 bp, Homo sapiens
tgtgggtggcatcgtcctggcc

SEQ ID NO: 8318481 - DNA, 22 bp, Homo sapiens
tgtggggaggctgcagtgctgc

SEQ ID NO: 8318482 - DNA, 22 bp, Homo sapiens
ttcctcagagggcgctggggaa

SEQ ID NO: 8318483 - DNA, 22 bp, Homo sapiens
ttcctcagctcagcgagagaga

SEQ ID NO: 8318484 - DNA, 22 bp, Homo sapiens
ttcctcagcacaaagccaagat

SEQ ID NO: 8318485 - DNA, 22 bp, Homo sapiens
ttcctagaatggttagaaaata

SEQ ID NO: 8318486 - DNA, 22 bp, Homo sapiens
ttcctcatctgtgcacctcact

SEQ ID NO: 8318487 - DNA, 22 bp, Homo sapiens
ttcctcagttagtgcctgaggc

SEQ ID NO: 8318488 - DNA, 22 bp, Homo sapiens
ttcctctggaggctctaggaga

SEQ ID NO: 8318489 - DNA, 22 bp, Homo sapiens
ttcctctgtagttgctgatgaa

SEQ ID NO: 8318490 - DNA, 22 bp, Homo sapiens
ttcctcagggaggctagcagta

SEQ ID NO: 8318491 - DNA, 22 bp, Homo sapiens
ttcctcagctgtgtcctggcga

SEQ ID NO: 8318492 - DNA, 21 bp, Homo sapiens
ttccacagtgagaactgcaag

SEQ ID NO: 8318493 - DNA, 22 bp, Homo sapiens
ttcctgtggccttacatctgtg

SEQ ID NO: 8318494 - DNA, 22 bp, Homo sapiens
ttcctgtgtgaccgagacagtg

SEQ ID NO: 8318495 - DNA, 22 bp, Homo sapiens
ttccttctctgtggggaaggca

SEQ ID NO: 8318496 - DNA, 22 bp, Homo sapiens
ttctaagtcactcagattttgg

SEQ ID NO: 8318497 - DNA, 22 bp, Homo sapiens
ttctaagctctgaaataaatct

SEQ ID NO: 8318498 - DNA, 22 bp, Homo sapiens
ttcctgtgtgttggtggcagaa

SEQ ID NO: 8318499 - DNA, 22 bp, Homo sapiens
ttctagcacaagatatgaaagt

SEQ ID NO: 8318500 - DNA, 20 bp, Homo sapiens
ttctagcatacttacaagga

SEQ ID NO: 8318501 - DNA, 19 bp, Homo sapiens
ttctaagttttgcttgctg

SEQ ID NO: 8318502 - DNA, 22 bp, Homo sapiens
ttctaagtcctacctgaaagca

SEQ ID NO: 8318503 - DNA, 22 bp, Homo sapiens
ttctactaggatgtcttgaaca

SEQ ID NO: 8318504 - DNA, 22 bp, Homo sapiens
ttcatgtaattccataaggtaa

SEQ ID NO: 8318505 - DNA, 20 bp, Homo sapiens
ttcatgggagcaaagaggcc

SEQ ID NO: 8318506 - DNA, 22 bp, Homo sapiens
ttcatgtagcttagcagagagg

SEQ ID NO: 8318507 - DNA, 22 bp, Homo sapiens
ttccaatttgtggtgagttaat

SEQ ID NO: 8318508 - DNA, 18 bp, Homo sapiens
ttcatcatgactctgtgg

SEQ ID NO: 8318509 - DNA, 18 bp, Homo sapiens
ttcatcatgactctgtgg

SEQ ID NO: 8318510 - DNA, 22 bp, Homo sapiens
ttcatgctgtgtctacaactta

SEQ ID NO: 8318511 - DNA, 22 bp, Homo sapiens
ttcacattgaaggtgctttctt

SEQ ID NO: 8318512 - DNA, 22 bp, Homo sapiens
ttcaacaattaagtatcagcct

SEQ ID NO: 8318513 - DNA, 22 bp, Homo sapiens
ttcaacaattaagtatcagcct

SEQ ID NO: 8318514 - DNA, 22 bp, Homo sapiens
ttcaacatgttctacataaggg

SEQ ID NO: 8318515 - DNA, 22 bp, Homo sapiens
ttcaacatagctgaggcatata

SEQ ID NO: 8318516 - DNA, 22 bp, Homo sapiens
ttcaactttaggcaaagaaaac

SEQ ID NO: 8318517 - DNA, 22 bp, Homo sapiens
ttcaactttggagatttaataa

SEQ ID NO: 8318518 - DNA, 22 bp, Homo sapiens
ttcaacaaactgttcacgaatg

SEQ ID NO: 8318519 - DNA, 22 bp, Homo sapiens
ttcaacaaaatatatttttcca

SEQ ID NO: 8318520 - DNA, 22 bp, Homo sapiens
ttcaacaagtagtacacacagt

SEQ ID NO: 8318521 - DNA, 22 bp, Homo sapiens
ttcaacaagtcttttttcactg

SEQ ID NO: 8318522 - DNA, 22 bp, Homo sapiens
ttcaacaagtcttttttcactg

SEQ ID NO: 8318523 - DNA, 22 bp, Homo sapiens
ttcaacaaggctgtcaaaagtt

SEQ ID NO: 8318524 - DNA, 22 bp, Homo sapiens
ttagataaattaagactttaca

SEQ ID NO: 8318525 - DNA, 22 bp, Homo sapiens
ttagataaattgcaacttgatt

SEQ ID NO: 8318526 - DNA, 22 bp, Homo sapiens
ttagataaaagtgttcaataaa

SEQ ID NO: 8318527 - DNA, 22 bp, Homo sapiens
ttcacaaagctggagcatttcc

SEQ ID NO: 8318528 - DNA, 22 bp, Homo sapiens
ttcacaataatgtccatcctct

SEQ ID NO: 8318529 - DNA, 22 bp, Homo sapiens
ttcacagtgagctatgtcttgt

SEQ ID NO: 8318530 - DNA, 22 bp, Homo sapiens
ttcacaaaaatgctgaacagtt

SEQ ID NO: 8318531 - DNA, 22 bp, Homo sapiens
ttctagttaaagtatgtattag

SEQ ID NO: 8318532 - DNA, 22 bp, Homo sapiens
ttctagtgtccttggacttgct

SEQ ID NO: 8318533 - DNA, 22 bp, Homo sapiens
ttctagtgtccttggacttgct

SEQ ID NO: 8318534 - DNA, 22 bp, Homo sapiens
ttctagttacagaagccttgct

SEQ ID NO: 8318535 - DNA, 22 bp, Homo sapiens
ttctagttttgccttatcaaca

SEQ ID NO: 8318536 - DNA, 22 bp, Homo sapiens
ttctgaaggtcagcagcttggt

SEQ ID NO: 8318537 - DNA, 22 bp, Homo sapiens
ttctgaagggctaagtgtctat

SEQ ID NO: 8318538 - DNA, 22 bp, Homo sapiens
ttctgacacattactacatgga

SEQ ID NO: 8318539 - DNA, 22 bp, Homo sapiens
ttctggaaaagaaagttaagat

SEQ ID NO: 8318540 - DNA, 22 bp, Homo sapiens
ttctgctgcctactcctgggga

SEQ ID NO: 8318541 - DNA, 22 bp, Homo sapiens
ttctgagcctcattcatgaggc

SEQ ID NO: 8318542 - DNA, 22 bp, Homo sapiens
ttcttacagccctattactaaa

SEQ ID NO: 8318543 - DNA, 22 bp, Homo sapiens
ttctttaaaatagtgagaaaga

SEQ ID NO: 8318544 - DNA, 22 bp, Homo sapiens
ttctttaaaatagtgagaaaga

SEQ ID NO: 8318545 - DNA, 22 bp, Homo sapiens
ttctttatcagttactcatagg

SEQ ID NO: 8318546 - DNA, 22 bp, Homo sapiens
ttctttatcagttactcatagg

SEQ ID NO: 8318547 - DNA, 22 bp, Homo sapiens
ttctttatcagttactcatagg

SEQ ID NO: 8318548 - DNA, 22 bp, Homo sapiens
ttctgtttataatttgcagttg

SEQ ID NO: 8318549 - DNA, 22 bp, Homo sapiens
ttctgtttactcagaaatacaa

SEQ ID NO: 8318550 - DNA, 22 bp, Homo sapiens
ttctgttttgcacagacttgaa

SEQ ID NO: 8318551 - DNA, 22 bp, Homo sapiens
ttctgtttgccatatatagtag

SEQ ID NO: 8318552 - DNA, 22 bp, Homo sapiens
ttctgttttagaaataagtagt

SEQ ID NO: 8318553 - DNA, 22 bp, Homo sapiens
ttctgggcctcctaggacaggc

SEQ ID NO: 8318554 - DNA, 22 bp, Homo sapiens
ttctggggccaattgccactgc

SEQ ID NO: 8318555 - DNA, 22 bp, Homo sapiens
ttgaatgaataaaagagtaagg

SEQ ID NO: 8318556 - DNA, 20 bp, Homo sapiens
ttgaatgaatgtctggctca

SEQ ID NO: 8318557 - DNA, 22 bp, Homo sapiens
ttgaatgaatttgagcagagat

SEQ ID NO: 8318558 - DNA, 22 bp, Homo sapiens
ttgaatgaattctacttccaga

SEQ ID NO: 8318559 - DNA, 22 bp, Homo sapiens
ttgaatgaatagttgctagaag

SEQ ID NO: 8318560 - DNA, 22 bp, Homo sapiens
ttgaatgaatggtccatataga

SEQ ID NO: 8318561 - DNA, 22 bp, Homo sapiens
ttgaatgagaagttattgccat

SEQ ID NO: 8318562 - DNA, 22 bp, Homo sapiens
ttgaatgaccatgatgcaaggg

SEQ ID NO: 8318563 - DNA, 16 bp, Homo sapiens
ttgaatgactgtgtgc

SEQ ID NO: 8318564 - DNA, 22 bp, Homo sapiens
ttgaatgagtgttttactcatg

SEQ ID NO: 8318565 - DNA, 22 bp, Homo sapiens
ttgaatgaggaagagcactggc

SEQ ID NO: 8318566 - DNA, 22 bp, Homo sapiens
ttgaatgatcctatctagcaca

SEQ ID NO: 8318567 - DNA, 22 bp, Homo sapiens
ttgaatgattaaagtcatctga

SEQ ID NO: 8318568 - DNA, 22 bp, Homo sapiens
ttctttcccagaagatatgttt

SEQ ID NO: 8318569 - DNA, 22 bp, Homo sapiens
ttctttcccagtagatgtgaaa

SEQ ID NO: 8318570 - DNA, 22 bp, Homo sapiens
ttctttccacagaggggatgat

SEQ ID NO: 8318571 - DNA, 22 bp, Homo sapiens
ttctttccaaccagatattggt

SEQ ID NO: 8318572 - DNA, 22 bp, Homo sapiens
ttctttattgagacttcattgt

SEQ ID NO: 8318573 - DNA, 22 bp, Homo sapiens
ttgaagagtctagattggttat

SEQ ID NO: 8318574 - DNA, 22 bp, Homo sapiens
ttctttccttgcctcagtgaag

SEQ ID NO: 8318575 - DNA, 22 bp, Homo sapiens
ttctttccccatggagttcgga

SEQ ID NO: 8318576 - DNA, 22 bp, Homo sapiens
ttgaagaagtaattttaagtct

SEQ ID NO: 8318577 - DNA, 22 bp, Homo sapiens
ttgaggccaaaaagtcctatga

SEQ ID NO: 8318578 - DNA, 22 bp, Homo sapiens
ttgatgtaaagtgattcatggg

SEQ ID NO: 8318579 - DNA, 22 bp, Homo sapiens
ttgatgcttaaggtaaaacaga

SEQ ID NO: 8318580 - DNA, 22 bp, Homo sapiens
ttgatgtagcctaagacagaac

SEQ ID NO: 8318581 - DNA, 22 bp, Homo sapiens
ttgatgtcagtattatgagttt

SEQ ID NO: 8318582 - DNA, 22 bp, Homo sapiens
ttgattaatcccatgtgagtag

SEQ ID NO: 8318583 - DNA, 22 bp, Homo sapiens
ttgattcaaaggggacaagtgg

SEQ ID NO: 8318584 - DNA, 22 bp, Homo sapiens
ttgattcaaaacaggaggtagg

SEQ ID NO: 8318585 - DNA, 20 bp, Homo sapiens
ttgattcaagggctgatgga

SEQ ID NO: 8318586 - DNA, 22 bp, Homo sapiens
ttgattcaaccacttaataatc

SEQ ID NO: 8318587 - DNA, 22 bp, Homo sapiens
ttgattcacaattaccaagact

SEQ ID NO: 8318588 - DNA, 22 bp, Homo sapiens
ttgattcagaaaaagatggaga

SEQ ID NO: 8318589 - DNA, 22 bp, Homo sapiens
ttgattcagagaagattggccc

SEQ ID NO: 8318590 - DNA, 22 bp, Homo sapiens
ttgattcagtaaagctaaattt

SEQ ID NO: 8318591 - DNA, 22 bp, Homo sapiens
ttgattcatatagatatgcgtg

SEQ ID NO: 8318592 - DNA, 18 bp, Homo sapiens
ttgattcatattaaccat

SEQ ID NO: 8318593 - DNA, 22 bp, Homo sapiens
ttgattcatcttctaataccca

SEQ ID NO: 8318594 - DNA, 22 bp, Homo sapiens
ttgattcatggacaggccaggt

SEQ ID NO: 8318595 - DNA, 22 bp, Homo sapiens
ttgattcatttattgagtgcct

SEQ ID NO: 8318596 - DNA, 23 bp, Homo sapiens
ttgatttcaaatgcagagaacac

SEQ ID NO: 8318597 - DNA, 21 bp, Homo sapiens
ttgattttaggaagtttgtca

SEQ ID NO: 8318598 - DNA, 21 bp, Homo sapiens
ttgattttaggaagtttgtca

SEQ ID NO: 8318599 - DNA, 21 bp, Homo sapiens
ttgattttaggaagtttgtca

SEQ ID NO: 8318600 - DNA, 22 bp, Homo sapiens
ttgattttcaattcattgacaa

SEQ ID NO: 8318601 - DNA, 22 bp, Homo sapiens
ttgcaaatgtgaataattacac

SEQ ID NO: 8318602 - DNA, 20 bp, Homo sapiens
ttgttagaggaatgccatag

SEQ ID NO: 8318603 - DNA, 22 bp, Homo sapiens
ttgttagtgcaatgtttggtga

SEQ ID NO: 8318604 - DNA, 22 bp, Homo sapiens
ttgttataaagactaaatatgt

SEQ ID NO: 8318605 - DNA, 22 bp, Homo sapiens
ttgtttaaaatgtagcaagaaa

SEQ ID NO: 8318606 - DNA, 22 bp, Homo sapiens
ttgtgtttcccttgcatattcc

SEQ ID NO: 8318607 - DNA, 22 bp, Homo sapiens
ttgtgttaaggtgcatctagtg

SEQ ID NO: 8318608 - DNA, 22 bp, Homo sapiens
ttgttttggagatgagctaaaa

SEQ ID NO: 8318609 - DNA, 22 bp, Homo sapiens
ttgttttcttgtatatagcctc

SEQ ID NO: 8318610 - DNA, 17 bp, Homo sapiens
ttgtttgttcttgcccc

SEQ ID NO: 8318611 - DNA, 20 bp, Homo sapiens
ttgttttaaatcctggatga

SEQ ID NO: 8318612 - DNA, 22 bp, Homo sapiens
ttgtttctgagttttcatgtat

SEQ ID NO: 8318613 - DNA, 20 bp, Homo sapiens
ttgtttctgctattttctaa

SEQ ID NO: 8318614 - DNA, 22 bp, Homo sapiens
ttgtttctggaaaaggcgagaa

SEQ ID NO: 8318615 - DNA, 21 bp, Homo sapiens
ttgtttcctcccaaaatgcca

SEQ ID NO: 8318616 - DNA, 22 bp, Homo sapiens
ttgtttctcctggtgcctgata

SEQ ID NO: 8318617 - DNA, 22 bp, Homo sapiens
ttgtttgtcataatatcattac

SEQ ID NO: 8318618 - DNA, 22 bp, Homo sapiens
ttggggtgttggatggagcaag

SEQ ID NO: 8318619 - DNA, 22 bp, Homo sapiens
ttggggtgttcagggtacttct

SEQ ID NO: 8318620 - DNA, 22 bp, Homo sapiens
ttggggtggaagtgaggatcat

SEQ ID NO: 8318621 - DNA, 22 bp, Homo sapiens
ttggtctgtgttacatcattta

SEQ ID NO: 8318622 - DNA, 22 bp, Homo sapiens
ttggtgtacatctccccttcat

SEQ ID NO: 8318623 - DNA, 22 bp, Homo sapiens
ttgcaacacaaagtttgattcc

SEQ ID NO: 8318624 - DNA, 22 bp, Homo sapiens
ttgcaacattgtaagtttatat

SEQ ID NO: 8318625 - DNA, 22 bp, Homo sapiens
ttgcaagttttacttacctgga

SEQ ID NO: 8318626 - DNA, 22 bp, Homo sapiens
ttgcaagttccttatgagaatc

SEQ ID NO: 8318627 - DNA, 22 bp, Homo sapiens
ttgcaaggtttctctctgccta

SEQ ID NO: 8318628 - DNA, 22 bp, Homo sapiens
ttgcaaggagccactctgcctg

SEQ ID NO: 8318629 - DNA, 22 bp, Homo sapiens
ttgtctgaaccatctccctggc

SEQ ID NO: 8318630 - DNA, 22 bp, Homo sapiens
ttgtctgaagtcacacagatgc

SEQ ID NO: 8318631 - DNA, 22 bp, Homo sapiens
ttgtctgacttctttagttact

SEQ ID NO: 8318632 - DNA, 22 bp, Homo sapiens
ttgtctgaattcttctaggcag

SEQ ID NO: 8318633 - DNA, 22 bp, Homo sapiens
ttgtctgaatctggagctctct

SEQ ID NO: 8318634 - DNA, 22 bp, Homo sapiens
ttgtctgaatatgtatgtatcc

SEQ ID NO: 8318635 - DNA, 22 bp, Homo sapiens
ttgtctgatgttccctcatgat

SEQ ID NO: 8318636 - DNA, 22 bp, Homo sapiens
ttgtctgagaaagtgagttgct

SEQ ID NO: 8318637 - DNA, 22 bp, Homo sapiens
ttgtctgagagatggcagaggt

SEQ ID NO: 8318638 - DNA, 22 bp, Homo sapiens
ttgtctgagggtttgagagaat

SEQ ID NO: 8318639 - DNA, 22 bp, Homo sapiens
ttgtctaatgagctccacttca

SEQ ID NO: 8318640 - DNA, 22 bp, Homo sapiens
ttggttttatcttaagattctt

SEQ ID NO: 8318641 - DNA, 20 bp, Homo sapiens
ttggttgagccagggcctgg

SEQ ID NO: 8318642 - DNA, 22 bp, Homo sapiens
tttacaagaaatcatgatgcta

SEQ ID NO: 8318643 - DNA, 22 bp, Homo sapiens
tttacaaggatcaagggatctc

SEQ ID NO: 8318644 - DNA, 22 bp, Homo sapiens
tttactaccattctgatcagtg

SEQ ID NO: 8318645 - DNA, 22 bp, Homo sapiens
tttactaagtacttgtatccct

SEQ ID NO: 8318646 - DNA, 22 bp, Homo sapiens
tttactaagtacttgtatccct

SEQ ID NO: 8318647 - DNA, 22 bp, Homo sapiens
tttactgttacacctaccttct

SEQ ID NO: 8318648 - DNA, 22 bp, Homo sapiens
tttactgacctccaatcccact

SEQ ID NO: 8318649 - DNA, 22 bp, Homo sapiens
tttactgagtgacctagaataa

SEQ ID NO: 8318650 - DNA, 23 bp, Homo sapiens
tttaaaagttgtaatgtaggctt

SEQ ID NO: 8318651 - DNA, 23 bp, Homo sapiens
tttaaaagttgtaatgtaggctt

SEQ ID NO: 8318652 - DNA, 22 bp, Homo sapiens
tttaaaatttagacctctccac

SEQ ID NO: 8318653 - DNA, 22 bp, Homo sapiens
tttaaaatcagatgggagttgg

SEQ ID NO: 8318654 - DNA, 22 bp, Homo sapiens
tttaatttgtatttctagaggg

SEQ ID NO: 8318655 - DNA, 21 bp, Homo sapiens
tttaatttgcatgtatgacgc

SEQ ID NO: 8318656 - DNA, 22 bp, Homo sapiens
tttaatttgaaatgagtaaccc

SEQ ID NO: 8318657 - DNA, 22 bp, Homo sapiens
tttattattctctggagaatgt

SEQ ID NO: 8318658 - DNA, 22 bp, Homo sapiens
tttattatccagtgttgtcatg

SEQ ID NO: 8318659 - DNA, 22 bp, Homo sapiens
tttcaaaagcgtacgtagtgaa

SEQ ID NO: 8318660 - DNA, 22 bp, Homo sapiens
tttatagtcgtctcagtaataa

SEQ ID NO: 8318661 - DNA, 20 bp, Homo sapiens
tttatagtgatcaatttata

SEQ ID NO: 8318662 - DNA, 22 bp, Homo sapiens
tttatataacagagactgctat

SEQ ID NO: 8318663 - DNA, 21 bp, Homo sapiens
tttattaacaactgtggacgt

SEQ ID NO: 8318664 - DNA, 22 bp, Homo sapiens
tttattaatgtagcatccatgg

SEQ ID NO: 8318665 - DNA, 22 bp, Homo sapiens
tttattaatgtagcatccatgg

SEQ ID NO: 8318666 - DNA, 22 bp, Homo sapiens
tttataattatctctactctta

SEQ ID NO: 8318667 - DNA, 22 bp, Homo sapiens
tttataaacagtaccacggtgc

SEQ ID NO: 8318668 - DNA, 22 bp, Homo sapiens
tttataaaatagactgggtcta

SEQ ID NO: 8318669 - DNA, 22 bp, Homo sapiens
tttataaacagtaccacggtgc

SEQ ID NO: 8318670 - DNA, 22 bp, Homo sapiens
tttataaaatagactgggtcta

SEQ ID NO: 8318671 - DNA, 22 bp, Homo sapiens
tttagttcacaccagggtagca

SEQ ID NO: 8318672 - DNA, 22 bp, Homo sapiens
tttcttcctaaatatgatttcc

SEQ ID NO: 8318673 - DNA, 20 bp, Homo sapiens
tttcttgtcggctgttgctg

SEQ ID NO: 8318674 - DNA, 22 bp, Homo sapiens
tttctttaggctgtgttgccaa

SEQ ID NO: 8318675 - DNA, 22 bp, Homo sapiens
tttcttgtgcctaattttgggc

SEQ ID NO: 8318676 - DNA, 22 bp, Homo sapiens
tttctgttaggcatcattttaa

SEQ ID NO: 8318677 - DNA, 23 bp, Homo sapiens
tttctgttcctctagctttgcat

SEQ ID NO: 8318678 - DNA, 23 bp, Homo sapiens
tttctgttcctctagctttgcat

SEQ ID NO: 8318679 - DNA, 21 bp, Homo sapiens
tttcttatctgtaaagtggga

SEQ ID NO: 8318680 - DNA, 22 bp, Homo sapiens
tttctgttgtacttaaactagg

SEQ ID NO: 8318681 - DNA, 22 bp, Homo sapiens
tttctgttgtacttaaactagg

SEQ ID NO: 8318682 - DNA, 22 bp, Homo sapiens
tttctgtagggatttcacagtt

SEQ ID NO: 8318683 - DNA, 22 bp, Homo sapiens
tttctgtattttgtcataacct

SEQ ID NO: 8318684 - DNA, 22 bp, Homo sapiens
tttcttatgagcaagactctat

SEQ ID NO: 8318685 - DNA, 22 bp, Homo sapiens
tttctcttcactgtgtgcctca

SEQ ID NO: 8318686 - DNA, 22 bp, Homo sapiens
tttctgaagatacagctttgct

SEQ ID NO: 8318687 - DNA, 17 bp, Homo sapiens
tttctccttccatctca

SEQ ID NO: 8318688 - DNA, 22 bp, Homo sapiens
tttctgaattcctaggatgttg

SEQ ID NO: 8318689 - DNA, 22 bp, Homo sapiens
tttctgctttcagagtgagaca

SEQ ID NO: 8318690 - DNA, 22 bp, Homo sapiens
tttctggaaacgggttcaagct

SEQ ID NO: 8318691 - DNA, 22 bp, Homo sapiens
tttctggaaacgggttcaagct

SEQ ID NO: 8318692 - DNA, 22 bp, Homo sapiens
tttctggaaccacaaaagtatg

SEQ ID NO: 8318693 - DNA, 22 bp, Homo sapiens
tttctggcagcgggacaggggt

SEQ ID NO: 8318694 - DNA, 22 bp, Homo sapiens
tttctgtaaggacttaatgcaa

SEQ ID NO: 8318695 - DNA, 20 bp, Homo sapiens
tttctgtagctcagtattca

SEQ ID NO: 8318696 - DNA, 22 bp, Homo sapiens
tttcctctgctgccattgcccc

SEQ ID NO: 8318697 - DNA, 22 bp, Homo sapiens
tttcctctgtcatgacagctga

SEQ ID NO: 8318698 - DNA, 22 bp, Homo sapiens
tttcctcttatacagtgtttat

SEQ ID NO: 8318699 - DNA, 22 bp, Homo sapiens
tttcctcttcgattaagtttgg

SEQ ID NO: 8318700 - DNA, 22 bp, Homo sapiens
tttcctcttcgattaagtttgg

SEQ ID NO: 8318701 - DNA, 22 bp, Homo sapiens
tttccaaaggctaaactcagtt

SEQ ID NO: 8318702 - DNA, 22 bp, Homo sapiens
tttccaaaggaggaaccagttt

SEQ ID NO: 8318703 - DNA, 22 bp, Homo sapiens
tttccaaaggtggcaggaacaa

SEQ ID NO: 8318704 - DNA, 22 bp, Homo sapiens
tttcattggcagagcctgtttt

SEQ ID NO: 8318705 - DNA, 22 bp, Homo sapiens
tttcattgtcaataaactgtat

SEQ ID NO: 8318706 - DNA, 22 bp, Homo sapiens
tttcattgtcagagctttgaat

SEQ ID NO: 8318707 - DNA, 22 bp, Homo sapiens
tttcattgtccccaggcaagac

SEQ ID NO: 8318708 - DNA, 22 bp, Homo sapiens
tttcattgtctacatatgacat

SEQ ID NO: 8318709 - DNA, 22 bp, Homo sapiens
tttcattgtgatgcttttatca

SEQ ID NO: 8318710 - DNA, 22 bp, Homo sapiens
tttcatttcatagaattgtgtt

SEQ ID NO: 8318711 - DNA, 22 bp, Homo sapiens
tttccaaagctgagttgagcaa

SEQ ID NO: 8318712 - DNA, 22 bp, Homo sapiens
tttccaaaatgaatctaatgca

SEQ ID NO: 8318713 - DNA, 22 bp, Homo sapiens
tttcaaagcaactgaaaaggaa

SEQ ID NO: 8318714 - DNA, 22 bp, Homo sapiens
tttcaaagggaagttatgaagt

SEQ ID NO: 8318715 - DNA, 22 bp, Homo sapiens
tttctaaggtgatcctttctta

SEQ ID NO: 8318716 - DNA, 22 bp, Homo sapiens
tttctaaggtgaggtagaaaat

SEQ ID NO: 8318717 - DNA, 22 bp, Homo sapiens
tttcctctttgtgacacagctg

SEQ ID NO: 8318718 - DNA, 22 bp, Homo sapiens
tttctaagtatcttgcagtttt

SEQ ID NO: 8318719 - DNA, 22 bp, Homo sapiens
tttctaagtaagattaacttct

SEQ ID NO: 8318720 - DNA, 21 bp, Homo sapiens
tttctaagtaactggcagcat

SEQ ID NO: 8318721 - DNA, 22 bp, Homo sapiens
tttctaagtaaacacagcatac

SEQ ID NO: 8318722 - DNA, 22 bp, Homo sapiens
tttctaagtaaacacagcatac

SEQ ID NO: 8318723 - DNA, 22 bp, Homo sapiens
tttctaagtatcttgcagtttt

SEQ ID NO: 8318724 - DNA, 21 bp, Homo sapiens
tttctaagtgcttggtttggg

SEQ ID NO: 8318725 - DNA, 22 bp, Homo sapiens
tttctaagtgaacattcaagtt

SEQ ID NO: 8318726 - DNA, 22 bp, Homo sapiens
tttctaatatcacttccagctg

SEQ ID NO: 8318727 - DNA, 22 bp, Homo sapiens
tttctaagtgtgtttcatagga

SEQ ID NO: 8318728 - DNA, 22 bp, Homo sapiens
tttctaagtgtgattttagatt

SEQ ID NO: 8318729 - DNA, 22 bp, Homo sapiens
tttctaagtgtgattttagatt

SEQ ID NO: 8318730 - DNA, 22 bp, Homo sapiens
tttctaagtgtgtttcatagga

SEQ ID NO: 8318731 - DNA, 22 bp, Homo sapiens
tttctaagtgtattgagcttgg

SEQ ID NO: 8318732 - DNA, 22 bp, Homo sapiens
tttctaagtgtattgagcttgg

SEQ ID NO: 8318733 - DNA, 21 bp, Homo sapiens
tttctaagtgcttggtttggg

SEQ ID NO: 8318734 - DNA, 22 bp, Homo sapiens
tttctacatttgtaaccagatt

SEQ ID NO: 8318735 - DNA, 22 bp, Homo sapiens
tttctactaagaaagttgatta

SEQ ID NO: 8318736 - DNA, 22 bp, Homo sapiens
tttctcctaactcaaatttaag

SEQ ID NO: 8318737 - DNA, 22 bp, Homo sapiens
tttctcccaaagtgcaaccaca

SEQ ID NO: 8318738 - DNA, 22 bp, Homo sapiens
tttctccctttataagactgta

SEQ ID NO: 8318739 - DNA, 22 bp, Homo sapiens
tttctccccagtctaatctgga

SEQ ID NO: 8318740 - DNA, 22 bp, Homo sapiens
tttctcatctggaaacagtgct

SEQ ID NO: 8318741 - DNA, 22 bp, Homo sapiens
tttctcatggaacatagctcct

SEQ ID NO: 8318742 - DNA, 22 bp, Homo sapiens
tttctcagtcacatgaaccaat

SEQ ID NO: 8318743 - DNA, 22 bp, Homo sapiens
tttctcagctcagcatctgggt

SEQ ID NO: 8318744 - DNA, 21 bp, Homo sapiens
tttctcataaaatactcatta

SEQ ID NO: 8318745 - DNA, 21 bp, Homo sapiens
tttctcagttgtgtgagcagc

SEQ ID NO: 8318746 - DNA, 22 bp, Homo sapiens
tttctacttctcctgaatgtct

SEQ ID NO: 8318747 - DNA, 22 bp, Homo sapiens
tttggagagcagctaggccctt

SEQ ID NO: 8318748 - DNA, 22 bp, Homo sapiens
tttggagatagggcctagcaat

SEQ ID NO: 8318749 - DNA, 22 bp, Homo sapiens
tttgcaaatgaagctctgagga

SEQ ID NO: 8318750 - DNA, 22 bp, Homo sapiens
tttgcaaaatgaggtgaagagt

SEQ ID NO: 8318751 - DNA, 22 bp, Homo sapiens
ttttatcaatcattaagacatt

SEQ ID NO: 8318752 - DNA, 22 bp, Homo sapiens
ttttatcagcagggataacaag

SEQ ID NO: 8318753 - DNA, 22 bp, Homo sapiens
ttttatatggcacattggttgg

SEQ ID NO: 8318754 - DNA, 20 bp, Homo sapiens
ttttatatgtagggtatatg

SEQ ID NO: 8318755 - DNA, 22 bp, Homo sapiens
ttttatattgagtgagagttcc

SEQ ID NO: 8318756 - DNA, 22 bp, Homo sapiens
ttttagtttggatttctaaagc

SEQ ID NO: 8318757 - DNA, 22 bp, Homo sapiens
ttttataaagagagtcagttgg

SEQ ID NO: 8318758 - DNA, 22 bp, Homo sapiens
ttttataagcaagaaagggaaa

SEQ ID NO: 8318759 - DNA, 22 bp, Homo sapiens
ttttatacacatgaacatgcag

SEQ ID NO: 8318760 - DNA, 22 bp, Homo sapiens
tttgttttcaatgtgtcattca

SEQ ID NO: 8318761 - DNA, 22 bp, Homo sapiens
tttgtttagatggtaaatcagt

SEQ ID NO: 8318762 - DNA, 22 bp, Homo sapiens
ttttaaactcccctagttggtg

SEQ ID NO: 8318763 - DNA, 22 bp, Homo sapiens
tttgttttgaactagctcagaa

SEQ ID NO: 8318764 - DNA, 22 bp, Homo sapiens
tttgttttctgtaggcctttcc

SEQ ID NO: 8318765 - DNA, 22 bp, Homo sapiens
tttgttcactgatgtatcccaa

SEQ ID NO: 8318766 - DNA, 22 bp, Homo sapiens
tttgtttacaaaaataagcagt

SEQ ID NO: 8318767 - DNA, 22 bp, Homo sapiens
tttgtttacaaaaataagcagt

SEQ ID NO: 8318768 - DNA, 22 bp, Homo sapiens
tttgtttactcattcattgatg

SEQ ID NO: 8318769 - DNA, 22 bp, Homo sapiens
tttgtttactcattcattgatg

SEQ ID NO: 8318770 - DNA, 22 bp, Homo sapiens
tttgtttactcattcattgatg

SEQ ID NO: 8318771 - DNA, 22 bp, Homo sapiens
tttgtactggaagaacatgcaa

SEQ ID NO: 8318772 - DNA, 22 bp, Homo sapiens
tttgtacttcattggttctact

SEQ ID NO: 8318773 - DNA, 22 bp, Homo sapiens
tttgtagcagcatgatttataa

SEQ ID NO: 8318774 - DNA, 22 bp, Homo sapiens
tttgtattccatatcatgccat

SEQ ID NO: 8318775 - DNA, 20 bp, Homo sapiens
tttttccttctctacaggca

SEQ ID NO: 8318776 - DNA, 22 bp, Homo sapiens
tttttctaatggcttaggatgt

SEQ ID NO: 8318777 - DNA, 22 bp, Homo sapiens
tttttctactgcccacattgta

SEQ ID NO: 8318778 - DNA, 22 bp, Homo sapiens
tttttctagaccttaaaggcca

SEQ ID NO: 8318779 - DNA, 22 bp, Homo sapiens
tttttgatctgagcagttggag

SEQ ID NO: 8318780 - DNA, 22 bp, Homo sapiens
tttttgaaggctgatgtgatta

SEQ ID NO: 8318781 - DNA, 22 bp, Homo sapiens
tttttgcaccaacctaatagaa

SEQ ID NO: 8318782 - DNA, 22 bp, Homo sapiens
ttttttgtcccagagagcctgg

SEQ ID NO: 8318783 - DNA, 22 bp, Homo sapiens
ttttttgtcttgaagaaatggt

SEQ ID NO: 8318784 - DNA, 23 bp, Homo sapiens
ttttttgtcttgctaggctgccc

SEQ ID NO: 8318785 - DNA, 22 bp, Homo sapiens
ttttctaatttagttaccctcc

SEQ ID NO: 8318786 - DNA, 22 bp, Homo sapiens
ttttctaatttagttaccctcc

SEQ ID NO: 8318787 - DNA, 22 bp, Homo sapiens
ttttctaactttacactcgaaa

SEQ ID NO: 8318788 - DNA, 22 bp, Homo sapiens
ttttctaagggaaacgtcctcc

SEQ ID NO: 8318789 - DNA, 22 bp, Homo sapiens
ttttctattaactcattttgca

SEQ ID NO: 8318790 - DNA, 22 bp, Homo sapiens
ttttctttaatctggtggggtg

SEQ ID NO: 8318791 - DNA, 22 bp, Homo sapiens
ttttctaacatctagtaatttg

SEQ ID NO: 8318792 - DNA, 22 bp, Homo sapiens
ttttctaaaatatccaggacag

SEQ ID NO: 8318793 - DNA, 22 bp, Homo sapiens
ttttctaaaatatccaggacag

SEQ ID NO: 8318794 - DNA, 22 bp, Homo sapiens
ttttctaacatctagtaatttg

SEQ ID NO: 8318795 - DNA, 22 bp, Homo sapiens
ttttctaactttacactcgaaa

SEQ ID NO: 8318796 - DNA, 22 bp, Homo sapiens
ttttctaaaagaagtcactgat

SEQ ID NO: 8318797 - DNA, 22 bp, Homo sapiens
ttttctaaaagaagtcactgat

SEQ ID NO: 8318798 - DNA, 22 bp, Homo sapiens
ttttatctgtgacatctggcag

SEQ ID NO: 8318799 - DNA, 22 bp, Homo sapiens
ttttatctgcttcattagttga

SEQ ID NO: 8318800 - DNA, 22 bp, Homo sapiens
ttttatctacctatgctcattt

SEQ ID NO: 8318801 - DNA, 22 bp, Homo sapiens
ttttatgaagataattttctga

SEQ ID NO: 8318802 - DNA, 22 bp, Homo sapiens
ttttccttctgatactccattt

SEQ ID NO: 8318803 - DNA, 22 bp, Homo sapiens
ttttgatatcatgatgaacaga

SEQ ID NO: 8318804 - DNA, 20 bp, Homo sapiens
ttttgcagagaaggcgactg

SEQ ID NO: 8318805 - DNA, 22 bp, Homo sapiens
ttttgcccttgctagatcactg

SEQ ID NO: 8318806 - DNA, 22 bp, Homo sapiens
tttttccacataccctaggcca

SEQ ID NO: 8318807 - DNA, 22 bp, Homo sapiens
tttttcccatatagaaagccaa

SEQ ID NO: 8318808 - DNA, 22 bp, Homo sapiens
tttttcccaaaggcaattgcct

SEQ ID NO: 8318809 - DNA, 22 bp, Homo sapiens
tttttccagggttagatgttta

SEQ ID NO: 8318810 - DNA, 22 bp, Homo sapiens
tttttccagggttagatgttta

SEQ ID NO: 8318811 - DNA, 22 bp, Homo sapiens
cacattcatggagtttgcctgt

SEQ ID NO: 8318812 - DNA, 22 bp, Homo sapiens
cacattcacatttttccctcta

SEQ ID NO: 8318813 - DNA, 22 bp, Homo sapiens
cacatgttcttaacttctgttt

SEQ ID NO: 8318814 - DNA, 22 bp, Homo sapiens
cacatgtgcagttacatgaatt

SEQ ID NO: 8318815 - DNA, 22 bp, Homo sapiens
ggcagaggtgacagtgtctttt

SEQ ID NO: 8318816 - DNA, 22 bp, Homo sapiens
cacatgagtgagaacatgcagt

SEQ ID NO: 8318817 - DNA, 22 bp, Homo sapiens
cacatgagagcccccaagagca

SEQ ID NO: 8318818 - DNA, 19 bp, Homo sapiens
cacatgagggctgagggac

SEQ ID NO: 8318819 - DNA, 22 bp, Homo sapiens
ggcaatgtttcgatgggagctg

SEQ ID NO: 8318820 - DNA, 20 bp, Homo sapiens
ggcaatgccagatgacagga

SEQ ID NO: 8318821 - DNA, 22 bp, Homo sapiens
cacagtgcatgatgggcagaag

SEQ ID NO: 8318822 - DNA, 22 bp, Homo sapiens
ggcaaggggtcaggctgagaca

SEQ ID NO: 8318823 - DNA, 22 bp, Homo sapiens
cacagtgcactaagctccgggg

SEQ ID NO: 8318824 - DNA, 22 bp, Homo sapiens
cacagtaactcctgacccctcg

SEQ ID NO: 8318825 - DNA, 22 bp, Homo sapiens
cacagtaaccccaggactggga

SEQ ID NO: 8318826 - DNA, 22 bp, Homo sapiens
cacagtaagaaatgaagaggta

SEQ ID NO: 8318827 - DNA, 22 bp, Homo sapiens
cacagtaactggcgtgtagtaa

SEQ ID NO: 8318828 - DNA, 22 bp, Homo sapiens
cacagtaaggtatcccagtgaa

SEQ ID NO: 8318829 - DNA, 20 bp, Homo sapiens
cacaggccttgtgagcagac

SEQ ID NO: 8318830 - DNA, 22 bp, Homo sapiens
cacaggggcaaactgtagggga

SEQ ID NO: 8318831 - DNA, 22 bp, Homo sapiens
cacaggtccttcctgccctggg

SEQ ID NO: 8318832 - DNA, 22 bp, Homo sapiens
cacaggtaatagcctaggctat

SEQ ID NO: 8318833 - DNA, 22 bp, Homo sapiens
cactgcactccagcctgggtga

SEQ ID NO: 8318834 - DNA, 22 bp, Homo sapiens
cactgcactccagcctgggtca

SEQ ID NO: 8318835 - DNA, 22 bp, Homo sapiens
ggctctgcttctcacctgttcc

SEQ ID NO: 8318836 - DNA, 22 bp, Homo sapiens
ggctggatgtactttggggctg

SEQ ID NO: 8318837 - DNA, 22 bp, Homo sapiens
ggctggcaagtcagtgctgatg

SEQ ID NO: 8318838 - DNA, 22 bp, Homo sapiens
ggctggcaaaaaccttctctga

SEQ ID NO: 8318839 - DNA, 21 bp, Homo sapiens
cacttgaatggtgttttacaa

SEQ ID NO: 8318840 - DNA, 22 bp, Homo sapiens
cacttgaatgaaagagactcct

SEQ ID NO: 8318841 - DNA, 22 bp, Homo sapiens
cacttgaatgagaatttcctgg

SEQ ID NO: 8318842 - DNA, 22 bp, Homo sapiens
cacttgaatggcattgttcctt

SEQ ID NO: 8318843 - DNA, 22 bp, Homo sapiens
cacttgaaaatcagaggaaatt

SEQ ID NO: 8318844 - DNA, 22 bp, Homo sapiens
cacttgaaagtaatggttgtgc

SEQ ID NO: 8318845 - DNA, 22 bp, Homo sapiens
cacttgaacccgggaggctgag

SEQ ID NO: 8318846 - DNA, 22 bp, Homo sapiens
cacttgaaatattaggggtgat

SEQ ID NO: 8318847 - DNA, 22 bp, Homo sapiens
cacttgaagtgaattgctcacc

SEQ ID NO: 8318848 - DNA, 22 bp, Homo sapiens
cacttgaagtttgggggactct

SEQ ID NO: 8318849 - DNA, 22 bp, Homo sapiens
cacttgaactgtttgaatgaga

SEQ ID NO: 8318850 - DNA, 20 bp, Homo sapiens
ggctctggaatctggtgggc

SEQ ID NO: 8318851 - DNA, 22 bp, Homo sapiens
cactgcactccagcctgggaga

SEQ ID NO: 8318852 - DNA, 22 bp, Homo sapiens
cactgcactccagcctgggaga

SEQ ID NO: 8318853 - DNA, 21 bp, Homo sapiens
cactccacttagaacagggtt

SEQ ID NO: 8318854 - DNA, 22 bp, Homo sapiens
cacctggagtagcaaggtaatt

SEQ ID NO: 8318855 - DNA, 22 bp, Homo sapiens
gctggggagctagacctcagca

SEQ ID NO: 8318856 - DNA, 22 bp, Homo sapiens
caatatagagagaaaattatgt

SEQ ID NO: 8318857 - DNA, 22 bp, Homo sapiens
caatatataatgagtactttcc

SEQ ID NO: 8318858 - DNA, 22 bp, Homo sapiens
caatatataatgagtactttcc

SEQ ID NO: 8318859 - DNA, 22 bp, Homo sapiens
caatatataggaacaacttagg

SEQ ID NO: 8318860 - DNA, 19 bp, Homo sapiens
caatatatagtgagtggat

SEQ ID NO: 8318861 - DNA, 22 bp, Homo sapiens
caatttcatggataaaagatgt

SEQ ID NO: 8318862 - DNA, 22 bp, Homo sapiens
caatttcatcttgtgcttcaat

SEQ ID NO: 8318863 - DNA, 22 bp, Homo sapiens
caatttcaatacaaaatacatt

SEQ ID NO: 8318864 - DNA, 22 bp, Homo sapiens
caattctttgtagaagctctcc

SEQ ID NO: 8318865 - DNA, 22 bp, Homo sapiens
caattgaacagatgagttaaat

SEQ ID NO: 8318866 - DNA, 22 bp, Homo sapiens
ggagagaggctggccgtgatga

SEQ ID NO: 8318867 - DNA, 22 bp, Homo sapiens
ggagagaggagcccactgctgt

SEQ ID NO: 8318868 - DNA, 22 bp, Homo sapiens
ggagaagggacagactcagctt

SEQ ID NO: 8318869 - DNA, 22 bp, Homo sapiens
ggaccagctatcaatgccaggg

SEQ ID NO: 8318870 - DNA, 22 bp, Homo sapiens
gctggacccggcccctcacctc

SEQ ID NO: 8318871 - DNA, 22 bp, Homo sapiens
caagaatcctgttcttgaagat

SEQ ID NO: 8318872 - DNA, 18 bp, Homo sapiens
caagaatctctaaagaag

SEQ ID NO: 8318873 - DNA, 22 bp, Homo sapiens
caagaatcttgcagcttagact

SEQ ID NO: 8318874 - DNA, 22 bp, Homo sapiens
caagaatcaacattatttagtg

SEQ ID NO: 8318875 - DNA, 22 bp, Homo sapiens
caagaatcagacctgtcagggt

SEQ ID NO: 8318876 - DNA, 20 bp, Homo sapiens
gctggaagggctagagggct

SEQ ID NO: 8318877 - DNA, 22 bp, Homo sapiens
gctggaaatgattaaatggtga

SEQ ID NO: 8318878 - DNA, 22 bp, Homo sapiens
gctgctttgtctgtaaaatgga

SEQ ID NO: 8318879 - DNA, 22 bp, Homo sapiens
caagcgtggctgctctgatgga

SEQ ID NO: 8318880 - DNA, 22 bp, Homo sapiens
caagcgtggctgctctgatgga

SEQ ID NO: 8318881 - DNA, 20 bp, Homo sapiens
gctggctgaactgaaagcaa

SEQ ID NO: 8318882 - DNA, 22 bp, Homo sapiens
gctggctgaatcttctgcaata

SEQ ID NO: 8318883 - DNA, 22 bp, Homo sapiens
gctggctgagatctgttttcct

SEQ ID NO: 8318884 - DNA, 22 bp, Homo sapiens
gctggctgagcactggtttata

SEQ ID NO: 8318885 - DNA, 17 bp, Homo sapiens
gctggctgacccatgcc

SEQ ID NO: 8318886 - DNA, 17 bp, Homo sapiens
gctggctgacccatgcc

SEQ ID NO: 8318887 - DNA, 22 bp, Homo sapiens
gctggctgacagagatttaaaa

SEQ ID NO: 8318888 - DNA, 22 bp, Homo sapiens
gctggctgacagatttggggtg

SEQ ID NO: 8318889 - DNA, 22 bp, Homo sapiens
gctggctgaggtctagctcttt

SEQ ID NO: 8318890 - DNA, 22 bp, Homo sapiens
gctggctgaggtctagctcttt

SEQ ID NO: 8318891 - DNA, 22 bp, Homo sapiens
gctggctgagttctgtcgtctg

SEQ ID NO: 8318892 - DNA, 22 bp, Homo sapiens
caacaatatgctgagtttttca

SEQ ID NO: 8318893 - DNA, 22 bp, Homo sapiens
caacacattgaagctatgatga

SEQ ID NO: 8318894 - DNA, 22 bp, Homo sapiens
caaattttgtgtgttctctagt

SEQ ID NO: 8318895 - DNA, 22 bp, Homo sapiens
caacaatatgccagactcaatt

SEQ ID NO: 8318896 - DNA, 22 bp, Homo sapiens
caaattttgtgtgttctctagt

SEQ ID NO: 8318897 - DNA, 22 bp, Homo sapiens
gctgcctgatgtccagcaggac

SEQ ID NO: 8318898 - DNA, 22 bp, Homo sapiens
caagaaatttcttaagaactaa

SEQ ID NO: 8318899 - DNA, 22 bp, Homo sapiens
caagaaatttcttaagaactaa

SEQ ID NO: 8318900 - DNA, 22 bp, Homo sapiens
caaagtgctaggattacaggcg

SEQ ID NO: 8318901 - DNA, 22 bp, Homo sapiens
caaagtgctaggattacaggcc

SEQ ID NO: 8318902 - DNA, 22 bp, Homo sapiens
caaagtgctaggattacaggcc

SEQ ID NO: 8318903 - DNA, 22 bp, Homo sapiens
caaagtgcctgtaccactttgc

SEQ ID NO: 8318904 - DNA, 22 bp, Homo sapiens
caaagtgcagaaggaactgggt

SEQ ID NO: 8318905 - DNA, 22 bp, Homo sapiens
caaagtgctaggattataggtg

SEQ ID NO: 8318906 - DNA, 22 bp, Homo sapiens
caaagtgctaggattacaggcg

SEQ ID NO: 8318907 - DNA, 23 bp, Homo sapiens
gctctggagctgggcctggcagg

SEQ ID NO: 8318908 - DNA, 22 bp, Homo sapiens
gctctggatccggctgggtctg

SEQ ID NO: 8318909 - DNA, 22 bp, Homo sapiens
gctctggaagcatctgagagga

SEQ ID NO: 8318910 - DNA, 22 bp, Homo sapiens
gtagaaatatttatctctgaga

SEQ ID NO: 8318911 - DNA, 22 bp, Homo sapiens
gtagaaatggtgtgtttcttct

SEQ ID NO: 8318912 - DNA, 22 bp, Homo sapiens
gtagaaatagtggttgacagga

SEQ ID NO: 8318913 - DNA, 22 bp, Homo sapiens
gtagaaaattaggatgaggctt

SEQ ID NO: 8318914 - DNA, 22 bp, Homo sapiens
gtagaaaattaggatgaggctt

SEQ ID NO: 8318915 - DNA, 22 bp, Homo sapiens
gtactcagtaatataacatatt

SEQ ID NO: 8318916 - DNA, 22 bp, Homo sapiens
gtccagagtagtcgagtattct

SEQ ID NO: 8318917 - DNA, 22 bp, Homo sapiens
gtccagaggtccaggatcaagg

SEQ ID NO: 8318918 - DNA, 22 bp, Homo sapiens
gtccagagggctgcaggatgct

SEQ ID NO: 8318919 - DNA, 22 bp, Homo sapiens
cagcatctgttcccaacgagat

SEQ ID NO: 8318920 - DNA, 22 bp, Homo sapiens
cagcatctcctgtgcagaggga

SEQ ID NO: 8318921 - DNA, 22 bp, Homo sapiens
cagcatcctttgctggtttccc

SEQ ID NO: 8318922 - DNA, 22 bp, Homo sapiens
gtattttacttacgcatgactt

SEQ ID NO: 8318923 - DNA, 22 bp, Homo sapiens
gtgagagggctgggctcatgat

SEQ ID NO: 8318924 - DNA, 23 bp, Homo sapiens
gtgagcagcaccatgaggctaga

SEQ ID NO: 8318925 - DNA, 22 bp, Homo sapiens
gtgagcaatgttatcaggttga

SEQ ID NO: 8318926 - DNA, 22 bp, Homo sapiens
gggctgtcacgcccctgcacct

SEQ ID NO: 8318927 - DNA, 22 bp, Homo sapiens
gggctgtgagagtggggctgct

SEQ ID NO: 8318928 - DNA, 22 bp, Homo sapiens
gggctgtaggagctggaatggg

SEQ ID NO: 8318929 - DNA, 20 bp, Homo sapiens
gggctggataattctttgct

SEQ ID NO: 8318930 - DNA, 22 bp, Homo sapiens
gggctgtgctgagtaggaggtg

SEQ ID NO: 8318931 - DNA, 20 bp, Homo sapiens
gggctgtgcctcctcgtggt

SEQ ID NO: 8318932 - DNA, 22 bp, Homo sapiens
gggctgtgtaatgtgctctttt

SEQ ID NO: 8318933 - DNA, 22 bp, Homo sapiens
gggctgtgtactatgaggaggg

SEQ ID NO: 8318934 - DNA, 22 bp, Homo sapiens
gggctgtggagccgcgagggct

SEQ ID NO: 8318935 - DNA, 22 bp, Homo sapiens
gggctggaggtgagcaggacag

SEQ ID NO: 8318936 - DNA, 19 bp, Homo sapiens
gggctggagggatagagcc

SEQ ID NO: 8318937 - DNA, 21 bp, Homo sapiens
gggctggaggatgggaagccc

SEQ ID NO: 8318938 - DNA, 22 bp, Homo sapiens
gggctgagtgggcctcttactt

SEQ ID NO: 8318939 - DNA, 22 bp, Homo sapiens
cagagccagcccactgttcccg

SEQ ID NO: 8318940 - DNA, 22 bp, Homo sapiens
ggggcagctaccggaagtaggg

SEQ ID NO: 8318941 - DNA, 21 bp, Homo sapiens
ggggcagagctaggccctgca

SEQ ID NO: 8318942 - DNA, 22 bp, Homo sapiens
ggggccttttctgaatgtggaa

SEQ ID NO: 8318943 - DNA, 22 bp, Homo sapiens
ggggccttggatctgtgccccg

SEQ ID NO: 8318944 - DNA, 22 bp, Homo sapiens
ggggtgaggtttatgttctggg

SEQ ID NO: 8318945 - DNA, 22 bp, Homo sapiens
ggggtgagtgctcagccccgga

SEQ ID NO: 8318946 - DNA, 22 bp, Homo sapiens
ggggtgagctgggcctgtgcct

SEQ ID NO: 8318947 - DNA, 20 bp, Homo sapiens
ggggttggctggcacaggga

SEQ ID NO: 8318948 - DNA, 20 bp, Homo sapiens
ggggttggctggcacaggga

SEQ ID NO: 8318949 - DNA, 22 bp, Homo sapiens
ggtcctggaagtgtaagtggca

SEQ ID NO: 8318950 - DNA, 22 bp, Homo sapiens
ggtcctggcagctctgtgtcca

SEQ ID NO: 8318951 - DNA, 22 bp, Homo sapiens
cagatgttattaacggctgtag

SEQ ID NO: 8318952 - DNA, 22 bp, Homo sapiens
ggtcctcaatcccaacaaggca

SEQ ID NO: 8318953 - DNA, 22 bp, Homo sapiens
cagatgcacattctcatcagca

SEQ ID NO: 8318954 - DNA, 22 bp, Homo sapiens
cagatgcagcaaaatgacaggc

SEQ ID NO: 8318955 - DNA, 18 bp, Homo sapiens
gggttcacctgcctttgg

SEQ ID NO: 8318956 - DNA, 22 bp, Homo sapiens
gggttcagactaaagctatgca

SEQ ID NO: 8318957 - DNA, 22 bp, Homo sapiens
gggttgaggcggatgtcggcgg

SEQ ID NO: 8318958 - DNA, 22 bp, Homo sapiens
ggtagtcggccttgccctgggc

SEQ ID NO: 8318959 - DNA, 22 bp, Homo sapiens
ggtagtgttgagcagtgcaaat

SEQ ID NO: 8318960 - DNA, 22 bp, Homo sapiens
gggtgggatctgtggagcctca

SEQ ID NO: 8318961 - DNA, 20 bp, Homo sapiens
gggtccctccggcctgctat

SEQ ID NO: 8318962 - DNA, 22 bp, Homo sapiens
gggtccctcgcaggcgtcgccg

SEQ ID NO: 8318963 - DNA, 18 bp, Homo sapiens
gggtccccagctgcaggg

SEQ ID NO: 8318964 - DNA, 22 bp, Homo sapiens
gggtccaggtcttcaggcagag

SEQ ID NO: 8318965 - DNA, 22 bp, Homo sapiens
gggtaggaaatccagaggtggc

SEQ ID NO: 8318966 - DNA, 22 bp, Homo sapiens
gggcaggggtcagtggccccaa

SEQ ID NO: 8318967 - DNA, 22 bp, Homo sapiens
gggcaggggtcagtggccccaa

SEQ ID NO: 8318968 - DNA, 22 bp, Homo sapiens
cagagccactgcattttacagc

SEQ ID NO: 8318969 - DNA, 22 bp, Homo sapiens
cagagaggaggctatatgcaaa

SEQ ID NO: 8318970 - DNA, 22 bp, Homo sapiens
gggaggcatgtgttatccactt

SEQ ID NO: 8318971 - DNA, 22 bp, Homo sapiens
ggctggcactgaggagagctct

SEQ ID NO: 8318972 - DNA, 22 bp, Homo sapiens
cagaaaatagagtttctctgag

SEQ ID NO: 8318973 - DNA, 22 bp, Homo sapiens
cagaaaatagagtttctctgag

SEQ ID NO: 8318974 - DNA, 22 bp, Homo sapiens
ggctggcacagagggctggtgt

SEQ ID NO: 8318975 - DNA, 22 bp, Homo sapiens
ggctggcacagagggctggtgt

SEQ ID NO: 8318976 - DNA, 22 bp, Homo sapiens
ggctggcacgaagccctgctgg

SEQ ID NO: 8318977 - DNA, 22 bp, Homo sapiens
ggctggcacccttggggatagg

SEQ ID NO: 8318978 - DNA, 22 bp, Homo sapiens
cagacacacaagcaatctaagt

SEQ ID NO: 8318979 - DNA, 22 bp, Homo sapiens
cagaatttcagtgatgttttct

SEQ ID NO: 8318980 - DNA, 22 bp, Homo sapiens
gggagcatttattttccgttag

SEQ ID NO: 8318981 - DNA, 22 bp, Homo sapiens
gggagcataaactcagatttca

SEQ ID NO: 8318982 - DNA, 22 bp, Homo sapiens
cagacacagatatgcatatggc

SEQ ID NO: 8318983 - DNA, 22 bp, Homo sapiens
cagacacagatatgcatatggc

SEQ ID NO: 8318984 - DNA, 22 bp, Homo sapiens
cagacacagcaattctgtgttg

SEQ ID NO: 8318985 - DNA, 21 bp, Homo sapiens
gggagctggaaactgggtgac

SEQ ID NO: 8318986 - DNA, 22 bp, Homo sapiens
gggaggagggtgctggctaaac

SEQ ID NO: 8318987 - DNA, 22 bp, Homo sapiens
gggagctgctgaacacaagggt

SEQ ID NO: 8318988 - DNA, 22 bp, Homo sapiens
gggagctgccttagaccggagg

SEQ ID NO: 8318989 - DNA, 22 bp, Homo sapiens
gggagctgccaccacccctggg

SEQ ID NO: 8318990 - DNA, 22 bp, Homo sapiens
gggaggcagtgctggaggctgg

SEQ ID NO: 8318991 - DNA, 22 bp, Homo sapiens
gggaggcagtgctggaggctgg

SEQ ID NO: 8318992 - DNA, 22 bp, Homo sapiens
gggaggagtgaagattcacctg

SEQ ID NO: 8318993 - DNA, 22 bp, Homo sapiens
atgttaggcaatctttcttgtt

SEQ ID NO: 8318994 - DNA, 22 bp, Homo sapiens
gaggttgccatgcatcctggtt

SEQ ID NO: 8318995 - DNA, 22 bp, Homo sapiens
gaggttccccattgtactggct

SEQ ID NO: 8318996 - DNA, 22 bp, Homo sapiens
gaggttagaggtcagtgcagtc

SEQ ID NO: 8318997 - DNA, 22 bp, Homo sapiens
atgtgaggtagataggatgcag

SEQ ID NO: 8318998 - DNA, 22 bp, Homo sapiens
atgtgccctcttagagtctctg

SEQ ID NO: 8318999 - DNA, 22 bp, Homo sapiens
atgtgccctttctgctttgcag

SEQ ID NO: 8319000 - DNA, 22 bp, Homo sapiens
gaggctcttttctgctgtgtct

SEQ ID NO: 8319001 - DNA, 22 bp, Homo sapiens
gaggctcttttctgctgtgtct

SEQ ID NO: 8319002 - DNA, 22 bp, Homo sapiens
atgtgctttattaagtaaaaat

SEQ ID NO: 8319003 - DNA, 22 bp, Homo sapiens
atgtgctttgctggaaatgtca

SEQ ID NO: 8319004 - DNA, 22 bp, Homo sapiens
gaggcacagtgtttggtcagtg

SEQ ID NO: 8319005 - DNA, 22 bp, Homo sapiens
gaggcacagagccctaggagct

SEQ ID NO: 8319006 - DNA, 22 bp, Homo sapiens
gaggcacagagtaggtgcacac

SEQ ID NO: 8319007 - DNA, 22 bp, Homo sapiens
gaggaggggacagtacttgtgc

SEQ ID NO: 8319008 - DNA, 22 bp, Homo sapiens
gaggaggggcacttgtctccta

SEQ ID NO: 8319009 - DNA, 22 bp, Homo sapiens
gaggaggggcacttgtctccta

SEQ ID NO: 8319010 - DNA, 22 bp, Homo sapiens
gaggctccctttaggtccagat

SEQ ID NO: 8319011 - DNA, 22 bp, Homo sapiens
gaggctccagcgacacctaggc

SEQ ID NO: 8319012 - DNA, 22 bp, Homo sapiens
gaggcctgggttacctactcgt

SEQ ID NO: 8319013 - DNA, 23 bp, Homo sapiens
atgtatttaaatttcagtgatga

SEQ ID NO: 8319014 - DNA, 22 bp, Homo sapiens
atgtatgtctgatgcacatgca

SEQ ID NO: 8319015 - DNA, 22 bp, Homo sapiens
atggcagacctgggctggagaa

SEQ ID NO: 8319016 - DNA, 22 bp, Homo sapiens
atggcagacgaggcagcagggg

SEQ ID NO: 8319017 - DNA, 22 bp, Homo sapiens
atggctctctccttactgctgc

SEQ ID NO: 8319018 - DNA, 19 bp, Homo sapiens
gagcacagcggcatttggt

SEQ ID NO: 8319019 - DNA, 22 bp, Homo sapiens
gagcacagccaaagtaagaagg

SEQ ID NO: 8319020 - DNA, 22 bp, Homo sapiens
gagcacagcagggctctgggtg

SEQ ID NO: 8319021 - DNA, 22 bp, Homo sapiens
gagcacagctggaggtagcatt

SEQ ID NO: 8319022 - DNA, 22 bp, Homo sapiens
gagcacagctgtcttgcaagct

SEQ ID NO: 8319023 - DNA, 22 bp, Homo sapiens
gagcacaggctttggtggacac

SEQ ID NO: 8319024 - DNA, 22 bp, Homo sapiens
atgggaggaagagaagatgtct

SEQ ID NO: 8319025 - DNA, 22 bp, Homo sapiens
gagcacagggaatagacagata

SEQ ID NO: 8319026 - DNA, 22 bp, Homo sapiens
gagcccagtctgctcctgcgcc

SEQ ID NO: 8319027 - DNA, 22 bp, Homo sapiens
gagcccatcctcgaggggctgc

SEQ ID NO: 8319028 - DNA, 22 bp, Homo sapiens
atgctgtatacatatgaaatta

SEQ ID NO: 8319029 - DNA, 22 bp, Homo sapiens
atgctgtgattgtagaaatatt

SEQ ID NO: 8319030 - DNA, 23 bp, Homo sapiens
gagaacagccacagagagctgtg

SEQ ID NO: 8319031 - DNA, 22 bp, Homo sapiens
gagaatattagagttagtttat

SEQ ID NO: 8319032 - DNA, 22 bp, Homo sapiens
atggagggtgtcagagagcgaa

SEQ ID NO: 8319033 - DNA, 22 bp, Homo sapiens
atggagggtgtcagagagcgaa

SEQ ID NO: 8319034 - DNA, 22 bp, Homo sapiens
atggcagaaaggcatgtgggcc

SEQ ID NO: 8319035 - DNA, 22 bp, Homo sapiens
atggcagacacaggcaggcaga

SEQ ID NO: 8319036 - DNA, 22 bp, Homo sapiens
atctttcagggccatttgtatt

SEQ ID NO: 8319037 - DNA, 22 bp, Homo sapiens
atcttggctgcatttctattcc

SEQ ID NO: 8319038 - DNA, 22 bp, Homo sapiens
atcttggcttatgcacaagtaa

SEQ ID NO: 8319039 - DNA, 18 bp, Homo sapiens
atctttccatagcatgtt

SEQ ID NO: 8319040 - DNA, 22 bp, Homo sapiens
cttctccctggcttctgcacac

SEQ ID NO: 8319041 - DNA, 22 bp, Homo sapiens
atctttgctattgtaaatcacg

SEQ ID NO: 8319042 - DNA, 22 bp, Homo sapiens
atctttggaaagccaagcacag

SEQ ID NO: 8319043 - DNA, 22 bp, Homo sapiens
atctttggacggtcccaactga

SEQ ID NO: 8319044 - DNA, 22 bp, Homo sapiens
atctttgggatatttgtgatta

SEQ ID NO: 8319045 - DNA, 22 bp, Homo sapiens
atctttgggatcctgatttact

SEQ ID NO: 8319046 - DNA, 20 bp, Homo sapiens
atctttggctcagaagcctt

SEQ ID NO: 8319047 - DNA, 20 bp, Homo sapiens
atctttggctcagaagcctt

SEQ ID NO: 8319048 - DNA, 22 bp, Homo sapiens
atctttggccacttgtgctgca

SEQ ID NO: 8319049 - DNA, 22 bp, Homo sapiens
atctttggatcgctcccccttc

SEQ ID NO: 8319050 - DNA, 22 bp, Homo sapiens
ctttacataaggataaacctgg

SEQ ID NO: 8319051 - DNA, 22 bp, Homo sapiens
ctttgctgagctggttgttcaa

SEQ ID NO: 8319052 - DNA, 22 bp, Homo sapiens
ctttgctgttataatgatagct

SEQ ID NO: 8319053 - DNA, 22 bp, Homo sapiens
ctttgcttgacactgtgattgt

SEQ ID NO: 8319054 - DNA, 22 bp, Homo sapiens
ctttggctctttagaattccct

SEQ ID NO: 8319055 - DNA, 22 bp, Homo sapiens
ctttggctgacaggtttctggt

SEQ ID NO: 8319056 - DNA, 22 bp, Homo sapiens
atgacaatggacatagttaaaa

SEQ ID NO: 8319057 - DNA, 22 bp, Homo sapiens
ctttggtaaatgtcaaaaagtt

SEQ ID NO: 8319058 - DNA, 21 bp, Homo sapiens
ctttggtatttcactcacata

SEQ ID NO: 8319059 - DNA, 22 bp, Homo sapiens
ctttggcttttagatatccatt

SEQ ID NO: 8319060 - DNA, 22 bp, Homo sapiens
ctttttatctcttaatgatgtt

SEQ ID NO: 8319061 - DNA, 22 bp, Homo sapiens
ctttttatctcttaatgatgtt

SEQ ID NO: 8319062 - DNA, 22 bp, Homo sapiens
ctttttatctcttaatgatgtt

SEQ ID NO: 8319063 - DNA, 22 bp, Homo sapiens
ctttttatagctatgtcctatg

SEQ ID NO: 8319064 - DNA, 22 bp, Homo sapiens
ctttttatagctatgtcctatg

SEQ ID NO: 8319065 - DNA, 22 bp, Homo sapiens
atgacagaggagtgcaggtgat

SEQ ID NO: 8319066 - DNA, 22 bp, Homo sapiens
ctttttataccgtgccagttga

SEQ ID NO: 8319067 - DNA, 22 bp, Homo sapiens
ctttttatagctatgtcctatg

SEQ ID NO: 8319068 - DNA, 22 bp, Homo sapiens
atgagacaggactgtatgcagg

SEQ ID NO: 8319069 - DNA, 22 bp, Homo sapiens
atgagacacatgtgacttcttt

SEQ ID NO: 8319070 - DNA, 22 bp, Homo sapiens
atgagacacatgtgacttcttt

SEQ ID NO: 8319071 - DNA, 22 bp, Homo sapiens
atgagaaagagttgtatctaga

SEQ ID NO: 8319072 - DNA, 22 bp, Homo sapiens
atgagaaatttattacaagcta

SEQ ID NO: 8319073 - DNA, 22 bp, Homo sapiens
atgagaaagttaatcatcatga

SEQ ID NO: 8319074 - DNA, 22 bp, Homo sapiens
atgagatgtgtctaatggaacc

SEQ ID NO: 8319075 - DNA, 22 bp, Homo sapiens
atgagatgttcaggagtctgag

SEQ ID NO: 8319076 - DNA, 22 bp, Homo sapiens
atgagattttatagtgtcttga

SEQ ID NO: 8319077 - DNA, 19 bp, Homo sapiens
gaatttatctcttcagtcc

SEQ ID NO: 8319078 - DNA, 22 bp, Homo sapiens
atgctcttgaggctaaagacat

SEQ ID NO: 8319079 - DNA, 22 bp, Homo sapiens
gacagcttgcctggtactgcaa

SEQ ID NO: 8319080 - DNA, 22 bp, Homo sapiens
gacagcttagtgaaaatgtaaa

SEQ ID NO: 8319081 - DNA, 22 bp, Homo sapiens
atgctaaactatgatcattttc

SEQ ID NO: 8319082 - DNA, 22 bp, Homo sapiens
atgctaaatgttaatgttacct

SEQ ID NO: 8319083 - DNA, 22 bp, Homo sapiens
gaatttgtgctcaggaagatta

SEQ ID NO: 8319084 - DNA, 22 bp, Homo sapiens
gaatttgtcccttgatataaaa

SEQ ID NO: 8319085 - DNA, 22 bp, Homo sapiens
gaagaaagggaattaacttgag

SEQ ID NO: 8319086 - DNA, 22 bp, Homo sapiens
gaagagagaacattacataaac

SEQ ID NO: 8319087 - DNA, 22 bp, Homo sapiens
gaagagagagccctggggtccg

SEQ ID NO: 8319088 - DNA, 22 bp, Homo sapiens
atgatgtaaatagagcctaggt

SEQ ID NO: 8319089 - DNA, 22 bp, Homo sapiens
gaaggagggagcggcgcggatt

SEQ ID NO: 8319090 - DNA, 22 bp, Homo sapiens
atgcaggagagcatgtttaaga

SEQ ID NO: 8319091 - DNA, 22 bp, Homo sapiens
gaagcctgctgtgcagccaaat

SEQ ID NO: 8319092 - DNA, 22 bp, Homo sapiens
gaagcctgggagggctgggcta

SEQ ID NO: 8319093 - DNA, 22 bp, Homo sapiens
gaagcctggttcgctggccacc

SEQ ID NO: 8319094 - DNA, 22 bp, Homo sapiens
attgcaaaggtcccattcaaga

SEQ ID NO: 8319095 - DNA, 22 bp, Homo sapiens
gcagtaagatgtaagtgctata

SEQ ID NO: 8319096 - DNA, 21 bp, Homo sapiens
attctttgatgtgcaataagt

SEQ ID NO: 8319097 - DNA, 22 bp, Homo sapiens
attcttttaagccccagggatt

SEQ ID NO: 8319098 - DNA, 22 bp, Homo sapiens
attctgagttagagtcagccag

SEQ ID NO: 8319099 - DNA, 21 bp, Homo sapiens
attctgagttgtcagtcttca

SEQ ID NO: 8319100 - DNA, 22 bp, Homo sapiens
attctctgtttccaagatgaaa

SEQ ID NO: 8319101 - DNA, 22 bp, Homo sapiens
attctgagtacaacaagatgtt

SEQ ID NO: 8319102 - DNA, 22 bp, Homo sapiens
attctgagaggcacaatgtgga

SEQ ID NO: 8319103 - DNA, 19 bp, Homo sapiens
gcaggcagctggggtatcc

SEQ ID NO: 8319104 - DNA, 19 bp, Homo sapiens
attcatttttgccttctaa

SEQ ID NO: 8319105 - DNA, 22 bp, Homo sapiens
attcacaactgatccttgctca

SEQ ID NO: 8319106 - DNA, 17 bp, Homo sapiens
attccacagggaatctg

SEQ ID NO: 8319107 - DNA, 22 bp, Homo sapiens
gatgtgggtgtcttcagctggt

SEQ ID NO: 8319108 - DNA, 18 bp, Homo sapiens
gatgtgggccctggatat

SEQ ID NO: 8319109 - DNA, 22 bp, Homo sapiens
gattcattctcagtttctagag

SEQ ID NO: 8319110 - DNA, 22 bp, Homo sapiens
gatggccacatacatggctggg

SEQ ID NO: 8319111 - DNA, 22 bp, Homo sapiens
gatgtcttcagatggcaagaga

SEQ ID NO: 8319112 - DNA, 22 bp, Homo sapiens
gatgtctttagggcaaaatatt

SEQ ID NO: 8319113 - DNA, 22 bp, Homo sapiens
attaacatgagttggagatagg

SEQ ID NO: 8319114 - DNA, 22 bp, Homo sapiens
attaacatgcagccagacacac

SEQ ID NO: 8319115 - DNA, 22 bp, Homo sapiens
gatggccaaggaccacgcatcg

SEQ ID NO: 8319116 - DNA, 22 bp, Homo sapiens
gatggagtctgaagctgggaac

SEQ ID NO: 8319117 - DNA, 22 bp, Homo sapiens
atgttatttctgaaagatcatt

SEQ ID NO: 8319118 - DNA, 22 bp, Homo sapiens
gagtggggcccactgctgggtg

SEQ ID NO: 8319119 - DNA, 23 bp, Homo sapiens
gagtggggagaaattggttaaac

SEQ ID NO: 8319120 - DNA, 22 bp, Homo sapiens
gagtggggaaagccaggacaga

SEQ ID NO: 8319121 - DNA, 22 bp, Homo sapiens
gagtggggcgtggatccagcgt

SEQ ID NO: 8319122 - DNA, 22 bp, Homo sapiens
atgttatgtctgggaaggggta

SEQ ID NO: 8319123 - DNA, 22 bp, Homo sapiens
attatattgagtataaccagag

SEQ ID NO: 8319124 - DNA, 22 bp, Homo sapiens
attatattgagtataaccagag

SEQ ID NO: 8319125 - DNA, 22 bp, Homo sapiens
gcagagagttgggctgcgccag

SEQ ID NO: 8319126 - DNA, 22 bp, Homo sapiens
attcaagtccagcttctctaca

SEQ ID NO: 8319127 - DNA, 22 bp, Homo sapiens
attatctatgtagaatgatttt

SEQ ID NO: 8319128 - DNA, 22 bp, Homo sapiens
gcagagaaggattgaaaccaga

SEQ ID NO: 8319129 - DNA, 22 bp, Homo sapiens
gccctgcctgccggtgtgggtc

SEQ ID NO: 8319130 - DNA, 22 bp, Homo sapiens
atttccctccagggaaagctta

SEQ ID NO: 8319131 - DNA, 23 bp, Homo sapiens
atttcccattgtgtcagcagagc

SEQ ID NO: 8319132 - DNA, 17 bp, Homo sapiens
gccctgcctgctgccct

SEQ ID NO: 8319133 - DNA, 22 bp, Homo sapiens
atttcccagggcctgggatttg

SEQ ID NO: 8319134 - DNA, 22 bp, Homo sapiens
atttcccatgtgaatcaattgg

SEQ ID NO: 8319135 - DNA, 22 bp, Homo sapiens
atttcccagggccctcatagtt

SEQ ID NO: 8319136 - DNA, 22 bp, Homo sapiens
atttcccagctttgatcagttt

SEQ ID NO: 8319137 - DNA, 17 bp, Homo sapiens
atttcccagcagtgcta

SEQ ID NO: 8319138 - DNA, 22 bp, Homo sapiens
atttcccaggactagaaatata

SEQ ID NO: 8319139 - DNA, 22 bp, Homo sapiens
atttcccactcaggccgcggcg

SEQ ID NO: 8319140 - DNA, 22 bp, Homo sapiens
atttcccactctactacatgct

SEQ ID NO: 8319141 - DNA, 22 bp, Homo sapiens
atttcccagataaacagctgga

SEQ ID NO: 8319142 - DNA, 22 bp, Homo sapiens
gcccagtgctgagggtgctgct

SEQ ID NO: 8319143 - DNA, 22 bp, Homo sapiens
atttcccaatacgctaagtgga

SEQ ID NO: 8319144 - DNA, 18 bp, Homo sapiens
gccctggtggagctggtg

SEQ ID NO: 8319145 - DNA, 18 bp, Homo sapiens
gccctggtggagctggtg

SEQ ID NO: 8319146 - DNA, 22 bp, Homo sapiens
gccctggttttagaggagcagg

SEQ ID NO: 8319147 - DNA, 22 bp, Homo sapiens
gccctggtgtgcccagcatggg

SEQ ID NO: 8319148 - DNA, 22 bp, Homo sapiens
gccctggtgtgcccagcatggg

SEQ ID NO: 8319149 - DNA, 22 bp, Homo sapiens
atttcttcaggtcagaaataga

SEQ ID NO: 8319150 - DNA, 22 bp, Homo sapiens
atttcttacataacaaattgtt

SEQ ID NO: 8319151 - DNA, 22 bp, Homo sapiens
gccatgcctgtgtctccaggcc

SEQ ID NO: 8319152 - DNA, 22 bp, Homo sapiens
gcccaggttggagagcagtggc

SEQ ID NO: 8319153 - DNA, 22 bp, Homo sapiens
gcccagggtgaagtgcagttgt

SEQ ID NO: 8319154 - DNA, 22 bp, Homo sapiens
gcccagtctcttctggccctgt

SEQ ID NO: 8319155 - DNA, 22 bp, Homo sapiens
atttcaaggggtccttgcttgg

SEQ ID NO: 8319156 - DNA, 22 bp, Homo sapiens
atttcaagtccaagtcttgggt

SEQ ID NO: 8319157 - DNA, 22 bp, Homo sapiens
atttcaagtgttgagctcataa

SEQ ID NO: 8319158 - DNA, 19 bp, Homo sapiens
gcccaggggcccgatgctg

SEQ ID NO: 8319159 - DNA, 19 bp, Homo sapiens
atttcaagaggtttattgg

SEQ ID NO: 8319160 - DNA, 22 bp, Homo sapiens
atttcaagaaggcagcagtggt

SEQ ID NO: 8319161 - DNA, 22 bp, Homo sapiens
atttcaaggctattaatataaa

SEQ ID NO: 8319162 - DNA, 22 bp, Homo sapiens
atttcaaggctacagaaacctt

SEQ ID NO: 8319163 - DNA, 22 bp, Homo sapiens
atttcaaggactacttttcaat

SEQ ID NO: 8319164 - DNA, 18 bp, Homo sapiens
gccagccaggcgttgctc

SEQ ID NO: 8319165 - DNA, 22 bp, Homo sapiens
atttattaagcatctgctatgt

SEQ ID NO: 8319166 - DNA, 22 bp, Homo sapiens
atttatgattagcctattgttg

SEQ ID NO: 8319167 - DNA, 22 bp, Homo sapiens
gccatcatatcccctgtgacct

SEQ ID NO: 8319168 - DNA, 22 bp, Homo sapiens
atttatctctggaaactaagca

SEQ ID NO: 8319169 - DNA, 22 bp, Homo sapiens
atttatcatcagaccttttaaa

SEQ ID NO: 8319170 - DNA, 22 bp, Homo sapiens
atttatcaccagttagctgact

SEQ ID NO: 8319171 - DNA, 22 bp, Homo sapiens
atttatcaccagttagctgact

SEQ ID NO: 8319172 - DNA, 22 bp, Homo sapiens
gctcagagagaggctcaccatt

SEQ ID NO: 8319173 - DNA, 21 bp, Homo sapiens
caaaagagactgattcttgga

SEQ ID NO: 8319174 - DNA, 22 bp, Homo sapiens
caaaagcagcaagtttatatgt

SEQ ID NO: 8319175 - DNA, 20 bp, Homo sapiens
caaaagcaatgaagttatga

SEQ ID NO: 8319176 - DNA, 22 bp, Homo sapiens
attttgatgctatctaatgaat

SEQ ID NO: 8319177 - DNA, 22 bp, Homo sapiens
attttgataatcatgttagaga

SEQ ID NO: 8319178 - DNA, 22 bp, Homo sapiens
attttgctgtggtacattagga

SEQ ID NO: 8319179 - DNA, 22 bp, Homo sapiens
gctcagacttgttttacaggct

SEQ ID NO: 8319180 - DNA, 22 bp, Homo sapiens
gctcaaatgtcatggggagcct

SEQ ID NO: 8319181 - DNA, 22 bp, Homo sapiens
gctcaaatcccagcgggctcct

SEQ ID NO: 8319182 - DNA, 22 bp, Homo sapiens
gctcccagggaccgcagggcag

SEQ ID NO: 8319183 - DNA, 22 bp, Homo sapiens
gctcccaggcatggaggtaatt

SEQ ID NO: 8319184 - DNA, 22 bp, Homo sapiens
caaaagcagttctatctgagtt

SEQ ID NO: 8319185 - DNA, 22 bp, Homo sapiens
gctcccagtctgatggaggaga

SEQ ID NO: 8319186 - DNA, 22 bp, Homo sapiens
gctcccagggcagcgcagaaga

SEQ ID NO: 8319187 - DNA, 22 bp, Homo sapiens
gctcccaggttcttgggccttg

SEQ ID NO: 8319188 - DNA, 22 bp, Homo sapiens
caaagaatgagtgagtacataa

SEQ ID NO: 8319189 - DNA, 22 bp, Homo sapiens
atttgtaagctagagccatgat

SEQ ID NO: 8319190 - DNA, 22 bp, Homo sapiens
atttgtaaagtgcttaaaagta

SEQ ID NO: 8319191 - DNA, 22 bp, Homo sapiens
atttggtagtgattgaaattat

SEQ ID NO: 8319192 - DNA, 22 bp, Homo sapiens
atttggaatgtgtttgatcacc

SEQ ID NO: 8319193 - DNA, 22 bp, Homo sapiens
atttgtatcttctaatattatc

SEQ ID NO: 8319194 - DNA, 22 bp, Homo sapiens
atttgtcacacatagtttatcc

SEQ ID NO: 8319195 - DNA, 22 bp, Homo sapiens
attttccagcctttctagaact

SEQ ID NO: 8319196 - DNA, 22 bp, Homo sapiens
attttccaaaataattgttact

SEQ ID NO: 8319197 - DNA, 22 bp, Homo sapiens
attttccaaaataattgttact

SEQ ID NO: 8319198 - DNA, 22 bp, Homo sapiens
attttccaaaataattgttact

SEQ ID NO: 8319199 - DNA, 21 bp, Homo sapiens
attttcattaattcagtgtgg

SEQ ID NO: 8319200 - DNA, 21 bp, Homo sapiens
attttcattaattcagtgtgg

SEQ ID NO: 8319201 - DNA, 22 bp, Homo sapiens
attttcagtgtaaatgttttat

SEQ ID NO: 8319202 - DNA, 22 bp, Homo sapiens
attttcatcatgggtttaacat

SEQ ID NO: 8319203 - DNA, 22 bp, Homo sapiens
attttcatgactaccttaaata

SEQ ID NO: 8319204 - DNA, 22 bp, Homo sapiens
attttcatgactaccttaaata

SEQ ID NO: 8319205 - DNA, 22 bp, Homo sapiens
aggctggctgagctgcagcctg

SEQ ID NO: 8319206 - DNA, 22 bp, Homo sapiens
aggcttcttgataaaatgcaga

SEQ ID NO: 8319207 - DNA, 22 bp, Homo sapiens
cccaggagttggaggctacggt

SEQ ID NO: 8319208 - DNA, 22 bp, Homo sapiens
cccaggagttggaggctacggt

SEQ ID NO: 8319209 - DNA, 22 bp, Homo sapiens
cccaggagttggaggctgcagt

SEQ ID NO: 8319210 - DNA, 22 bp, Homo sapiens
cccaggagttggaggctgcagt

SEQ ID NO: 8319211 - DNA, 22 bp, Homo sapiens
cccaggagtttgagttcagcat

SEQ ID NO: 8319212 - DNA, 23 bp, Homo sapiens
cccaggagtttcactgcaaaggt

SEQ ID NO: 8319213 - DNA, 22 bp, Homo sapiens
agggaacagtgaaaggcatcag

SEQ ID NO: 8319214 - DNA, 22 bp, Homo sapiens
cccagggccctggacagctaca

SEQ ID NO: 8319215 - DNA, 22 bp, Homo sapiens
agggatggaagctcgtctgcaa

SEQ ID NO: 8319216 - DNA, 22 bp, Homo sapiens
agggatggagtgcggcccggac

SEQ ID NO: 8319217 - DNA, 22 bp, Homo sapiens
agggatggatcttggccctgga

SEQ ID NO: 8319218 - DNA, 22 bp, Homo sapiens
agggagtgtaaatggtgctcag

SEQ ID NO: 8319219 - DNA, 22 bp, Homo sapiens
agggagtggttaagaaggtgca

SEQ ID NO: 8319220 - DNA, 19 bp, Homo sapiens
ccctggaggagtgttggct

SEQ ID NO: 8319221 - DNA, 22 bp, Homo sapiens
ccctggaggaccccaatgtggc

SEQ ID NO: 8319222 - DNA, 22 bp, Homo sapiens
ccctctcttagaagaaacacag

SEQ ID NO: 8319223 - DNA, 22 bp, Homo sapiens
ccctctctcggttgctgtggtt

SEQ ID NO: 8319224 - DNA, 22 bp, Homo sapiens
ccctctgcctgcgccctggtgt

SEQ ID NO: 8319225 - DNA, 22 bp, Homo sapiens
aggggctgggacagagccaagc

SEQ ID NO: 8319226 - DNA, 22 bp, Homo sapiens
aggggctgggacagagccaagc

SEQ ID NO: 8319227 - DNA, 22 bp, Homo sapiens
aggggctggcttatctgagagt

SEQ ID NO: 8319228 - DNA, 22 bp, Homo sapiens
aggggctggcttatctgagagt

SEQ ID NO: 8319229 - DNA, 22 bp, Homo sapiens
aggggctgctgggtccgcccct

SEQ ID NO: 8319230 - DNA, 22 bp, Homo sapiens
aggggctgcctggcttggcact

SEQ ID NO: 8319231 - DNA, 22 bp, Homo sapiens
agggctgcaggcaagatatggc

SEQ ID NO: 8319232 - DNA, 22 bp, Homo sapiens
agggctgcaccggggcttcgcg

SEQ ID NO: 8319233 - DNA, 18 bp, Homo sapiens
cctctgccatagccagca

SEQ ID NO: 8319234 - DNA, 19 bp, Homo sapiens
cctctgccagcccgcctct

SEQ ID NO: 8319235 - DNA, 22 bp, Homo sapiens
agggctgcaatgggagataact

SEQ ID NO: 8319236 - DNA, 22 bp, Homo sapiens
cctcctggatggatttggtgga

SEQ ID NO: 8319237 - DNA, 22 bp, Homo sapiens
cctcctggaggctctagggaaa

SEQ ID NO: 8319238 - DNA, 22 bp, Homo sapiens
cctcctggaaaaattccctggc

SEQ ID NO: 8319239 - DNA, 22 bp, Homo sapiens
cctcctggagcattggtgagga

SEQ ID NO: 8319240 - DNA, 22 bp, Homo sapiens
cctcctggaggctctaagggag

SEQ ID NO: 8319241 - DNA, 22 bp, Homo sapiens
ccctggaggctggaggcagtag

SEQ ID NO: 8319242 - DNA, 22 bp, Homo sapiens
ccctggaggcggatgttgcagt

SEQ ID NO: 8319243 - DNA, 22 bp, Homo sapiens
ccctggaggcggagcttgcagt

SEQ ID NO: 8319244 - DNA, 22 bp, Homo sapiens
ccctggaggcaaaggttgcagt

SEQ ID NO: 8319245 - DNA, 22 bp, Homo sapiens
ccctggaggcaaaggttgcagt

SEQ ID NO: 8319246 - DNA, 18 bp, Homo sapiens
ccctttgccctatgagta

SEQ ID NO: 8319247 - DNA, 22 bp, Homo sapiens
ccctttctgccttctaaaataa

SEQ ID NO: 8319248 - DNA, 22 bp, Homo sapiens
ccctttccatggctctcctagg

SEQ ID NO: 8319249 - DNA, 22 bp, Homo sapiens
ccgagaacttttcctgaaaagt

SEQ ID NO: 8319250 - DNA, 21 bp, Homo sapiens
ccgccgctgatagctctgggc

SEQ ID NO: 8319251 - DNA, 22 bp, Homo sapiens
ccgccgtgcaggccgcgacgtg

SEQ ID NO: 8319252 - DNA, 22 bp, Homo sapiens
agggccctggggtgcactgaca

SEQ ID NO: 8319253 - DNA, 22 bp, Homo sapiens
agggctccaggggaccatcagt

SEQ ID NO: 8319254 - DNA, 22 bp, Homo sapiens
agggctctgttggggtcagcac

SEQ ID NO: 8319255 - DNA, 22 bp, Homo sapiens
agggctccgggccaccggcctg

SEQ ID NO: 8319256 - DNA, 22 bp, Homo sapiens
ccagagaaagtgaagcaaatgt

SEQ ID NO: 8319257 - DNA, 22 bp, Homo sapiens
ccagagaggggaagggcttgcc

SEQ ID NO: 8319258 - DNA, 22 bp, Homo sapiens
aggcaggggagctggaagggta

SEQ ID NO: 8319259 - DNA, 22 bp, Homo sapiens
ccagcagaggggcggagtgcag

SEQ ID NO: 8319260 - DNA, 22 bp, Homo sapiens
aggccagagaggggaccagcct

SEQ ID NO: 8319261 - DNA, 22 bp, Homo sapiens
ccagcagagcatggggaggaag

SEQ ID NO: 8319262 - DNA, 22 bp, Homo sapiens
ccagcagagctggaagtgtgct

SEQ ID NO: 8319263 - DNA, 22 bp, Homo sapiens
ccagcagagcatggggaggaag

SEQ ID NO: 8319264 - DNA, 22 bp, Homo sapiens
ccagcagaagctcccgctgggt

SEQ ID NO: 8319265 - DNA, 22 bp, Homo sapiens
ccaggagagcagaagcccaggc

SEQ ID NO: 8319266 - DNA, 22 bp, Homo sapiens
aggccctggcactgcctgggag

SEQ ID NO: 8319267 - DNA, 22 bp, Homo sapiens
aggccctggcccccagagattc

SEQ ID NO: 8319268 - DNA, 22 bp, Homo sapiens
aggcccagagagccagttagtg

SEQ ID NO: 8319269 - DNA, 21 bp, Homo sapiens
aggcccagagtcttgggggga

SEQ ID NO: 8319270 - DNA, 22 bp, Homo sapiens
aggcccagagcaggaaagggtt

SEQ ID NO: 8319271 - DNA, 22 bp, Homo sapiens
aggcccagcccgtcctcgtgct

SEQ ID NO: 8319272 - DNA, 19 bp, Homo sapiens
aggcccagcgctgggggct

SEQ ID NO: 8319273 - DNA, 22 bp, Homo sapiens
aggcccagctggacaaactgct

SEQ ID NO: 8319274 - DNA, 22 bp, Homo sapiens
aggctccaaattaccaagctct

SEQ ID NO: 8319275 - DNA, 22 bp, Homo sapiens
aggctcagttctgtggtgagcc

SEQ ID NO: 8319276 - DNA, 22 bp, Homo sapiens
aggctcagtgcaaatcattctg

SEQ ID NO: 8319277 - DNA, 22 bp, Homo sapiens
aggctccaccctacagagctcc

SEQ ID NO: 8319278 - DNA, 23 bp, Homo sapiens
aggctccacatgggcactttgca

SEQ ID NO: 8319279 - DNA, 22 bp, Homo sapiens
aggctccaccagtcaggtgcat

SEQ ID NO: 8319280 - DNA, 22 bp, Homo sapiens
aggctccaccccgccagacctt

SEQ ID NO: 8319281 - DNA, 17 bp, Homo sapiens
ccaggagcgtgggtctc

SEQ ID NO: 8319282 - DNA, 22 bp, Homo sapiens
ccagggagcccacaggacaatg

SEQ ID NO: 8319283 - DNA, 22 bp, Homo sapiens
aggctccgtccagtctcaggcc

SEQ ID NO: 8319284 - DNA, 22 bp, Homo sapiens
ccagggtgagtgtcatgggtta

SEQ ID NO: 8319285 - DNA, 22 bp, Homo sapiens
ccagggtgaggaggctcccacg

SEQ ID NO: 8319286 - DNA, 22 bp, Homo sapiens
ccagggtgaccagctggcctag

SEQ ID NO: 8319287 - DNA, 22 bp, Homo sapiens
ccagggtgaccctcccggtggc

SEQ ID NO: 8319288 - DNA, 21 bp, Homo sapiens
cccagagcctagggagggcac

SEQ ID NO: 8319289 - DNA, 20 bp, Homo sapiens
cccagagccatagccagaca

SEQ ID NO: 8319290 - DNA, 22 bp, Homo sapiens
aggctgcctgttccaatctcct

SEQ ID NO: 8319291 - DNA, 22 bp, Homo sapiens
cccactgctgctctccatggca

SEQ ID NO: 8319292 - DNA, 22 bp, Homo sapiens
aggctctgtgatccacaatgag

SEQ ID NO: 8319293 - DNA, 20 bp, Homo sapiens
aggctgagggtgattgtgtc

SEQ ID NO: 8319294 - DNA, 22 bp, Homo sapiens
aggctgagtcgggaggatcact

SEQ ID NO: 8319295 - DNA, 19 bp, Homo sapiens
ccatgcagcctgggggcag

SEQ ID NO: 8319296 - DNA, 22 bp, Homo sapiens
aggctgaggtaggaggatcgct

SEQ ID NO: 8319297 - DNA, 22 bp, Homo sapiens
aggctgaggtgtgctgtgatcg

SEQ ID NO: 8319298 - DNA, 18 bp, Homo sapiens
agctggggcctctggtcc

SEQ ID NO: 8319299 - DNA, 22 bp, Homo sapiens
caggctccactgtaggcagctc

SEQ ID NO: 8319300 - DNA, 22 bp, Homo sapiens
caggctggagtgcagtggtgcc

SEQ ID NO: 8319301 - DNA, 22 bp, Homo sapiens
caggctggagtgcagtgtcgcc

SEQ ID NO: 8319302 - DNA, 22 bp, Homo sapiens
cagggatgggatggagtcagtt

SEQ ID NO: 8319303 - DNA, 22 bp, Homo sapiens
cagggatgggatggagtcagtt

SEQ ID NO: 8319304 - DNA, 22 bp, Homo sapiens
cagggcctccccggcagtcttt

SEQ ID NO: 8319305 - DNA, 22 bp, Homo sapiens
cagggatgtctctggaagggag

SEQ ID NO: 8319306 - DNA, 22 bp, Homo sapiens
cagggcctgagggctgctctgc

SEQ ID NO: 8319307 - DNA, 22 bp, Homo sapiens
cagggctccccagagagcctct

SEQ ID NO: 8319308 - DNA, 22 bp, Homo sapiens
cagggtgcagtgtcgctgctag

SEQ ID NO: 8319309 - DNA, 22 bp, Homo sapiens
cagggtgagcctctggagccct

SEQ ID NO: 8319310 - DNA, 22 bp, Homo sapiens
cagggtgcctctgctcccacca

SEQ ID NO: 8319311 - DNA, 22 bp, Homo sapiens
cagggtgcctcccgctcgccgg

SEQ ID NO: 8319312 - DNA, 22 bp, Homo sapiens
cagggtgcctgtcctcagcaaa

SEQ ID NO: 8319313 - DNA, 22 bp, Homo sapiens
cagggtgcgccactcagatgta

SEQ ID NO: 8319314 - DNA, 22 bp, Homo sapiens
cagggtgcgggagatgtgcacc

SEQ ID NO: 8319315 - DNA, 22 bp, Homo sapiens
caggtcctttagtgtccagaac

SEQ ID NO: 8319316 - DNA, 22 bp, Homo sapiens
caggcactgtgttaggcactgt

SEQ ID NO: 8319317 - DNA, 22 bp, Homo sapiens
caggagccccaggctgacaata

SEQ ID NO: 8319318 - DNA, 22 bp, Homo sapiens
agctgctgagccatgtcctgct

SEQ ID NO: 8319319 - DNA, 22 bp, Homo sapiens
agctgctgcgcctcaccctggc

SEQ ID NO: 8319320 - DNA, 22 bp, Homo sapiens
cagctgagagtagaaatggagg

SEQ ID NO: 8319321 - DNA, 19 bp, Homo sapiens
agctgcagaccagaagtgc

SEQ ID NO: 8319322 - DNA, 22 bp, Homo sapiens
catggggagacacctagggaaa

SEQ ID NO: 8319323 - DNA, 23 bp, Homo sapiens
catggggagcagtgctcctgacc

SEQ ID NO: 8319324 - DNA, 22 bp, Homo sapiens
catggggatgaggctgagactt

SEQ ID NO: 8319325 - DNA, 22 bp, Homo sapiens
catggggcccatgtgctccaag

SEQ ID NO: 8319326 - DNA, 22 bp, Homo sapiens
catgggggctgaggctgctgta

SEQ ID NO: 8319327 - DNA, 17 bp, Homo sapiens
catgtatttgaaacaga

SEQ ID NO: 8319328 - DNA, 21 bp, Homo sapiens
aggagggcacaaggccaggaa

SEQ ID NO: 8319329 - DNA, 21 bp, Homo sapiens
aggagggcacaaggccaggaa

SEQ ID NO: 8319330 - DNA, 22 bp, Homo sapiens
aggagggcaggctggctgccta

SEQ ID NO: 8319331 - DNA, 22 bp, Homo sapiens
aggagggcaggctggctgccta

SEQ ID NO: 8319332 - DNA, 22 bp, Homo sapiens
aggaggggcaatgatagtctgg

SEQ ID NO: 8319333 - DNA, 16 bp, Homo sapiens
aggaggggaattagga

SEQ ID NO: 8319334 - DNA, 22 bp, Homo sapiens
aggagggctaggaaaaccagga

SEQ ID NO: 8319335 - DNA, 16 bp, Homo sapiens
aggaggggaattagga

SEQ ID NO: 8319336 - DNA, 20 bp, Homo sapiens
aggaggggatagaatcaaag

SEQ ID NO: 8319337 - DNA, 20 bp, Homo sapiens
aggaggggatagaatcaaag

SEQ ID NO: 8319338 - DNA, 20 bp, Homo sapiens
aggaggggatagaatcaaag

SEQ ID NO: 8319339 - DNA, 22 bp, Homo sapiens
ccaaggggcctttagacactat

SEQ ID NO: 8319340 - DNA, 20 bp, Homo sapiens
ccaaggttggaggcagggtg

SEQ ID NO: 8319341 - DNA, 19 bp, Homo sapiens
ccaaggttggcagctgggc

SEQ ID NO: 8319342 - DNA, 20 bp, Homo sapiens
ccaataaagctctataggga

SEQ ID NO: 8319343 - DNA, 22 bp, Homo sapiens
cattaaaatatctcatggtgtt

SEQ ID NO: 8319344 - DNA, 22 bp, Homo sapiens
cattaaaatatctcatggtgtt

SEQ ID NO: 8319345 - DNA, 22 bp, Homo sapiens
cagtttctccaaacgcaggctg

SEQ ID NO: 8319346 - DNA, 22 bp, Homo sapiens
cagtttccttgtttacctactg

SEQ ID NO: 8319347 - DNA, 22 bp, Homo sapiens
cagtttcagctcaagcactcag

SEQ ID NO: 8319348 - DNA, 22 bp, Homo sapiens
cagttttaaattttgaatgtct

SEQ ID NO: 8319349 - DNA, 22 bp, Homo sapiens
cagttttaaattgttagataat

SEQ ID NO: 8319350 - DNA, 22 bp, Homo sapiens
cagttttagggcaatgtgaaga

SEQ ID NO: 8319351 - DNA, 22 bp, Homo sapiens
cagttttaggacatgtggatgt

SEQ ID NO: 8319352 - DNA, 22 bp, Homo sapiens
cagttttagctagagcaaacca

SEQ ID NO: 8319353 - DNA, 22 bp, Homo sapiens
cagttttacccaagcttatttt

SEQ ID NO: 8319354 - DNA, 16 bp, Homo sapiens
cagttttaaggcccaa

SEQ ID NO: 8319355 - DNA, 22 bp, Homo sapiens
cagttttacccaagcttatttt

SEQ ID NO: 8319356 - DNA, 22 bp, Homo sapiens
cagtggtgaagagcaggggctc

SEQ ID NO: 8319357 - DNA, 22 bp, Homo sapiens
cagtggcctttcctgctgctca

SEQ ID NO: 8319358 - DNA, 22 bp, Homo sapiens
cagtggcgtgatctctgctcac

SEQ ID NO: 8319359 - DNA, 23 bp, Homo sapiens
cagtggtcagaacgtgggagggt

SEQ ID NO: 8319360 - DNA, 22 bp, Homo sapiens
catagcaacagcatcaagtcaa

SEQ ID NO: 8319361 - DNA, 22 bp, Homo sapiens
cagttttatgaatgcttattag

SEQ ID NO: 8319362 - DNA, 22 bp, Homo sapiens
cagttttatgtcgaatgtatac

SEQ ID NO: 8319363 - DNA, 22 bp, Homo sapiens
cagttttatgtcgaatgtatac

SEQ ID NO: 8319364 - DNA, 22 bp, Homo sapiens
cagttttatcatctgtgaaatg

SEQ ID NO: 8319365 - DNA, 22 bp, Homo sapiens
cagttttatgaatgcttattag

SEQ ID NO: 8319366 - DNA, 22 bp, Homo sapiens
cagttttatacactgcagctcc

SEQ ID NO: 8319367 - DNA, 22 bp, Homo sapiens
catagtgactcatgcctataat

SEQ ID NO: 8319368 - DNA, 21 bp, Homo sapiens
aggaggctgtctctttcagct

SEQ ID NO: 8319369 - DNA, 22 bp, Homo sapiens
aggagggagcactatatgggga

SEQ ID NO: 8319370 - DNA, 22 bp, Homo sapiens
aggagggagcttaagccaggca

SEQ ID NO: 8319371 - DNA, 22 bp, Homo sapiens
aggagggagcttaagccaggca

SEQ ID NO: 8319372 - DNA, 22 bp, Homo sapiens
aggagaagtaaggctagatgat

SEQ ID NO: 8319373 - DNA, 22 bp, Homo sapiens
aggagaaggaagtgcatcacta

SEQ ID NO: 8319374 - DNA, 19 bp, Homo sapiens
aggagaagtagcagaaatt

SEQ ID NO: 8319375 - DNA, 17 bp, Homo sapiens
cagtggcctatggcttt

SEQ ID NO: 8319376 - DNA, 22 bp, Homo sapiens
aggaccagtatgagagcatctg

SEQ ID NO: 8319377 - DNA, 22 bp, Homo sapiens
caggtggcttctccctaggcca

SEQ ID NO: 8319378 - DNA, 22 bp, Homo sapiens
caggtggcttctctgcagcctt

SEQ ID NO: 8319379 - DNA, 22 bp, Homo sapiens
ctcctcagctgggaggagtccc

SEQ ID NO: 8319380 - DNA, 22 bp, Homo sapiens
ctccagtggtgatggggaagaa

SEQ ID NO: 8319381 - DNA, 22 bp, Homo sapiens
ctccagtggcacaaatgggtgc

SEQ ID NO: 8319382 - DNA, 22 bp, Homo sapiens
ctccagtggcaagtccgggcgg

SEQ ID NO: 8319383 - DNA, 20 bp, Homo sapiens
ctccagtgttcaggggagtg

SEQ ID NO: 8319384 - DNA, 22 bp, Homo sapiens
ctccagtgtctcagagcagatg

SEQ ID NO: 8319385 - DNA, 22 bp, Homo sapiens
ctccagtggtgatggggaagaa

SEQ ID NO: 8319386 - DNA, 20 bp, Homo sapiens
ctccagtgttcaggggagtg

SEQ ID NO: 8319387 - DNA, 22 bp, Homo sapiens
ctccagttggccccagttggtt

SEQ ID NO: 8319388 - DNA, 22 bp, Homo sapiens
ctccagttggccccagttggtt

SEQ ID NO: 8319389 - DNA, 22 bp, Homo sapiens
agtgacgtttattgggtgtgaa

SEQ ID NO: 8319390 - DNA, 22 bp, Homo sapiens
agtctgtctctgctaatcacta

SEQ ID NO: 8319391 - DNA, 22 bp, Homo sapiens
agtctggattagttgggggcaa

SEQ ID NO: 8319392 - DNA, 22 bp, Homo sapiens
agtctgcttcctggagaactca

SEQ ID NO: 8319393 - DNA, 22 bp, Homo sapiens
agtctggaatttggcctgagca

SEQ ID NO: 8319394 - DNA, 22 bp, Homo sapiens
agtccaagattagggtgacagc

SEQ ID NO: 8319395 - DNA, 22 bp, Homo sapiens
agtctgagttagtggaaatgta

SEQ ID NO: 8319396 - DNA, 22 bp, Homo sapiens
agtctgagtatctctgagccag

SEQ ID NO: 8319397 - DNA, 22 bp, Homo sapiens
agtctgaaggcaatctgctgac

SEQ ID NO: 8319398 - DNA, 22 bp, Homo sapiens
agtctgaagtagtctttagtgt

SEQ ID NO: 8319399 - DNA, 22 bp, Homo sapiens
agtctgaagatattcttgcagg

SEQ ID NO: 8319400 - DNA, 21 bp, Homo sapiens
agtctgaggtggggcctagga

SEQ ID NO: 8319401 - DNA, 23 bp, Homo sapiens
agtctgaattgagatgtgctgtg

SEQ ID NO: 8319402 - DNA, 20 bp, Homo sapiens
agtctctcccagaatgagca

SEQ ID NO: 8319403 - DNA, 22 bp, Homo sapiens
agtctgaaagtatgttgtaatg

SEQ ID NO: 8319404 - DNA, 22 bp, Homo sapiens
agtctgaagactcatgtctgaa

SEQ ID NO: 8319405 - DNA, 22 bp, Homo sapiens
agtctgaaccagatggcaaggt

SEQ ID NO: 8319406 - DNA, 23 bp, Homo sapiens
ctctctctaccatgtgaggacac

SEQ ID NO: 8319407 - DNA, 22 bp, Homo sapiens
agtgcaggagcctggccagagc

SEQ ID NO: 8319408 - DNA, 22 bp, Homo sapiens
agtgcaggccccaggccaggcc

SEQ ID NO: 8319409 - DNA, 22 bp, Homo sapiens
ctctctggcttggcacggagat

SEQ ID NO: 8319410 - DNA, 18 bp, Homo sapiens
ctctctgggtgaggacaa

SEQ ID NO: 8319411 - DNA, 22 bp, Homo sapiens
agtgggcccgagccagtggtct

SEQ ID NO: 8319412 - DNA, 22 bp, Homo sapiens
agtgggccaaatggaggcaagt

SEQ ID NO: 8319413 - DNA, 22 bp, Homo sapiens
agtgggccaagtgtatgtgtct

SEQ ID NO: 8319414 - DNA, 21 bp, Homo sapiens
agtgggccatgtgtaatattt

SEQ ID NO: 8319415 - DNA, 22 bp, Homo sapiens
agtgggcctgagtgaccagttc

SEQ ID NO: 8319416 - DNA, 22 bp, Homo sapiens
agtgggccttagaaggttccct

SEQ ID NO: 8319417 - DNA, 22 bp, Homo sapiens
agtgggccggacagcccaggcc

SEQ ID NO: 8319418 - DNA, 22 bp, Homo sapiens
agtgggcccttgtcacactgat

SEQ ID NO: 8319419 - DNA, 22 bp, Homo sapiens
agtggggaagagcatgggccct

SEQ ID NO: 8319420 - DNA, 22 bp, Homo sapiens
ctctgacattctgtgactctga

SEQ ID NO: 8319421 - DNA, 22 bp, Homo sapiens
ctgagaggcggagcttgcagtg

SEQ ID NO: 8319422 - DNA, 22 bp, Homo sapiens
ctgagaggaacatcttatgctt

SEQ ID NO: 8319423 - DNA, 22 bp, Homo sapiens
ctgagaggatgctgcagtggag

SEQ ID NO: 8319424 - DNA, 22 bp, Homo sapiens
ctgagaggatgctgcagtggag

SEQ ID NO: 8319425 - DNA, 22 bp, Homo sapiens
ctgaagccacgatagcttccta

SEQ ID NO: 8319426 - DNA, 22 bp, Homo sapiens
ctgaagcatatcatgccaagtt

SEQ ID NO: 8319427 - DNA, 22 bp, Homo sapiens
ctgagaaaggacctcaaacagg

SEQ ID NO: 8319428 - DNA, 22 bp, Homo sapiens
ctgaagcaaatgaaacagctct

SEQ ID NO: 8319429 - DNA, 22 bp, Homo sapiens
agtgtgttctcaatgaaaagaa

SEQ ID NO: 8319430 - DNA, 22 bp, Homo sapiens
agtgtctgcctatttttcaagc

SEQ ID NO: 8319431 - DNA, 22 bp, Homo sapiens
ctcttaaagaatgttccagctg

SEQ ID NO: 8319432 - DNA, 19 bp, Homo sapiens
ctcttacagaatagacaca

SEQ ID NO: 8319433 - DNA, 19 bp, Homo sapiens
ctcttaaattgtctcttgc

SEQ ID NO: 8319434 - DNA, 20 bp, Homo sapiens
agtggggagtcaggagtgcc

SEQ ID NO: 8319435 - DNA, 22 bp, Homo sapiens
agtggggaagattttgcagtca

SEQ ID NO: 8319436 - DNA, 22 bp, Homo sapiens
agtggggaagattttgcagtca

SEQ ID NO: 8319437 - DNA, 22 bp, Homo sapiens
agtggggacaatgagagcaggt

SEQ ID NO: 8319438 - DNA, 22 bp, Homo sapiens
cctgcctggctgtcagcagagc

SEQ ID NO: 8319439 - DNA, 22 bp, Homo sapiens
cctgcctggatcagccatcctg

SEQ ID NO: 8319440 - DNA, 22 bp, Homo sapiens
cctgcctgctttctgctttgca

SEQ ID NO: 8319441 - DNA, 22 bp, Homo sapiens
cctggagcaggagctgcagagg

SEQ ID NO: 8319442 - DNA, 22 bp, Homo sapiens
aggggctgtggaaaccaactct

SEQ ID NO: 8319443 - DNA, 22 bp, Homo sapiens
aggggctgtggaaaccaactct

SEQ ID NO: 8319444 - DNA, 23 bp, Homo sapiens
agggtgagcaagctatggagacc

SEQ ID NO: 8319445 - DNA, 22 bp, Homo sapiens
agggtggaagatggcactatct

SEQ ID NO: 8319446 - DNA, 22 bp, Homo sapiens
agggtgctctggaaaatgtagt

SEQ ID NO: 8319447 - DNA, 22 bp, Homo sapiens
agggtgctgccggacaggtggg

SEQ ID NO: 8319448 - DNA, 22 bp, Homo sapiens
agggtgctaatctcattcacat

SEQ ID NO: 8319449 - DNA, 19 bp, Homo sapiens
agggtggcaaaggagggtg

SEQ ID NO: 8319450 - DNA, 20 bp, Homo sapiens
cctggagcctggaaggagtc

SEQ ID NO: 8319451 - DNA, 22 bp, Homo sapiens
cctggagctcactgggagccgg

SEQ ID NO: 8319452 - DNA, 22 bp, Homo sapiens
agggtggccatgagggagagat

SEQ ID NO: 8319453 - DNA, 22 bp, Homo sapiens
agggtggccccactttggttgg

SEQ ID NO: 8319454 - DNA, 22 bp, Homo sapiens
agggtggcttaattccaaaggg

SEQ ID NO: 8319455 - DNA, 22 bp, Homo sapiens
cctggccagcagccccttcctc

SEQ ID NO: 8319456 - DNA, 22 bp, Homo sapiens
agggtggctgagtagatggaag

SEQ ID NO: 8319457 - DNA, 21 bp, Homo sapiens
agggtggctctgggtcagaac

SEQ ID NO: 8319458 - DNA, 22 bp, Homo sapiens
cctggctcattatgtgccccca

SEQ ID NO: 8319459 - DNA, 22 bp, Homo sapiens
cctggctcattatgtgccccca

SEQ ID NO: 8319460 - DNA, 22 bp, Homo sapiens
cctggctaggagagctgggctc

SEQ ID NO: 8319461 - DNA, 22 bp, Homo sapiens
cctggctcaaggcgaggactcc

SEQ ID NO: 8319462 - DNA, 23 bp, Homo sapiens
cctggctcaccccttatgtccag

SEQ ID NO: 8319463 - DNA, 22 bp, Homo sapiens
cctggctcagaccccagttctg

SEQ ID NO: 8319464 - DNA, 22 bp, Homo sapiens
cctggctcagaccccagttctg

SEQ ID NO: 8319465 - DNA, 22 bp, Homo sapiens
cctggctcagaccccagttctg

SEQ ID NO: 8319466 - DNA, 19 bp, Homo sapiens
aggtgaggggcaccatgtc

SEQ ID NO: 8319467 - DNA, 22 bp, Homo sapiens
aggtctgagctccttcctctga

SEQ ID NO: 8319468 - DNA, 22 bp, Homo sapiens
aggtctgagctcagggcctggc

SEQ ID NO: 8319469 - DNA, 18 bp, Homo sapiens
aggtctgaggaagagcct

SEQ ID NO: 8319470 - DNA, 22 bp, Homo sapiens
aggtctgagtagagaaaaggca

SEQ ID NO: 8319471 - DNA, 22 bp, Homo sapiens
aggtctgagtatggcctgagaa

SEQ ID NO: 8319472 - DNA, 22 bp, Homo sapiens
aggtctgagtatggcctgagaa

SEQ ID NO: 8319473 - DNA, 20 bp, Homo sapiens
aggtctgaatgtcagggctg

SEQ ID NO: 8319474 - DNA, 22 bp, Homo sapiens
aggtatgtatgtgtgtatattt

SEQ ID NO: 8319475 - DNA, 22 bp, Homo sapiens
cctgggcaggtgtggcttcccc

SEQ ID NO: 8319476 - DNA, 22 bp, Homo sapiens
aggtgctgtttgtcagcagttt

SEQ ID NO: 8319477 - DNA, 22 bp, Homo sapiens
cctgggcaggatgggcccggtg

SEQ ID NO: 8319478 - DNA, 22 bp, Homo sapiens
aggtgcagaaaaaagtccttta

SEQ ID NO: 8319479 - DNA, 23 bp, Homo sapiens
aggtggagctgtgcagccggggc

SEQ ID NO: 8319480 - DNA, 22 bp, Homo sapiens
aggtggagtgaaggaaaggcag

SEQ ID NO: 8319481 - DNA, 22 bp, Homo sapiens
aggtggagtgtgcagggagagc

SEQ ID NO: 8319482 - DNA, 22 bp, Homo sapiens
cctgggttggagagcaatggtg

SEQ ID NO: 8319483 - DNA, 22 bp, Homo sapiens
cctggtcaggtaactgggctga

SEQ ID NO: 8319484 - DNA, 22 bp, Homo sapiens
agtcataattataaacatcagt

SEQ ID NO: 8319485 - DNA, 22 bp, Homo sapiens
ctacaacattatgctttctgtc

SEQ ID NO: 8319486 - DNA, 22 bp, Homo sapiens
cgcgaggtggaggttgcagtga

SEQ ID NO: 8319487 - DNA, 22 bp, Homo sapiens
cgtgagggcatggcagtgagga

SEQ ID NO: 8319488 - DNA, 22 bp, Homo sapiens
cgtgaggggggtaaggcgtccg

SEQ ID NO: 8319489 - DNA, 22 bp, Homo sapiens
ctaaacaagatactaatgaggt

SEQ ID NO: 8319490 - DNA, 22 bp, Homo sapiens
ctaaaattatcaagataattcc

SEQ ID NO: 8319491 - DNA, 22 bp, Homo sapiens
cgtggccagccatttcctggaa

SEQ ID NO: 8319492 - DNA, 19 bp, Homo sapiens
cgtggagctggcaggcagg

SEQ ID NO: 8319493 - DNA, 22 bp, Homo sapiens
ctaaacaatgaacaaagcactg

SEQ ID NO: 8319494 - DNA, 22 bp, Homo sapiens
cctggtgccactagagaatgtc

SEQ ID NO: 8319495 - DNA, 22 bp, Homo sapiens
cctggtccccatcggcccagcg

SEQ ID NO: 8319496 - DNA, 22 bp, Homo sapiens
cctggtgcaccaagtaagggtg

SEQ ID NO: 8319497 - DNA, 22 bp, Homo sapiens
cctggtgcccccaagccagctg

SEQ ID NO: 8319498 - DNA, 22 bp, Homo sapiens
aggttacagtgattataggttt

SEQ ID NO: 8319499 - DNA, 23 bp, Homo sapiens
aggttacagttgttaagttgcaa

SEQ ID NO: 8319500 - DNA, 22 bp, Homo sapiens
aggttacagtcatctcagaatc

SEQ ID NO: 8319501 - DNA, 19 bp, Homo sapiens
aggttacaggtgtcacaga

SEQ ID NO: 8319502 - DNA, 22 bp, Homo sapiens
aggttcacacacacaaaaagat

SEQ ID NO: 8319503 - DNA, 22 bp, Homo sapiens
aggttccaagaaatcatcagtg

SEQ ID NO: 8319504 - DNA, 22 bp, Homo sapiens
agtaatttgttataaagcaata

SEQ ID NO: 8319505 - DNA, 22 bp, Homo sapiens
agtaatcaatttttcggtggat

SEQ ID NO: 8319506 - DNA, 22 bp, Homo sapiens
agtacaaaggcccttgattact

SEQ ID NO: 8319507 - DNA, 22 bp, Homo sapiens
cgcctgctctcactggacagct

SEQ ID NO: 8319508 - DNA, 22 bp, Homo sapiens
aggtttctcctttaaagcatgg

SEQ ID NO: 8319509 - DNA, 22 bp, Homo sapiens
aggtttctactgtgttaagaaa

SEQ ID NO: 8319510 - DNA, 20 bp, Homo sapiens
cctttattatttgtatgatg

SEQ ID NO: 8319511 - DNA, 18 bp, Homo sapiens
atctcccattggccaagg

SEQ ID NO: 8319512 - DNA, 22 bp, Homo sapiens
atctatttctgctaataacaat

SEQ ID NO: 8319513 - DNA, 22 bp, Homo sapiens
atctatttctgctaataacaat

SEQ ID NO: 8319514 - DNA, 22 bp, Homo sapiens
atctcataactcatttgaagac

SEQ ID NO: 8319515 - DNA, 22 bp, Homo sapiens
atctcagtcaggttgaatttgg

SEQ ID NO: 8319516 - DNA, 22 bp, Homo sapiens
cttcagtttatcccatcatcca

SEQ ID NO: 8319517 - DNA, 22 bp, Homo sapiens
cttcatagaacagaaatttaat

SEQ ID NO: 8319518 - DNA, 22 bp, Homo sapiens
cttcatgagggtaatctacaaa

SEQ ID NO: 8319519 - DNA, 22 bp, Homo sapiens
ctgtgtattgaaaaagggttaa

SEQ ID NO: 8319520 - DNA, 22 bp, Homo sapiens
ctgtgtatgactccagagggta

SEQ ID NO: 8319521 - DNA, 22 bp, Homo sapiens
ctgtttatggaggtaaggcatc

SEQ ID NO: 8319522 - DNA, 22 bp, Homo sapiens
ctgtttatggaggtaaggcatc

SEQ ID NO: 8319523 - DNA, 22 bp, Homo sapiens
ctgtttattacactggatagca

SEQ ID NO: 8319524 - DNA, 22 bp, Homo sapiens
ctgtgtcccttgtcccagagcc

SEQ ID NO: 8319525 - DNA, 22 bp, Homo sapiens
ctggtggagagtgggctctgga

SEQ ID NO: 8319526 - DNA, 22 bp, Homo sapiens
ctggtggaatggcagagggaac

SEQ ID NO: 8319527 - DNA, 22 bp, Homo sapiens
ctggtgggagcagcaggcagct

SEQ ID NO: 8319528 - DNA, 22 bp, Homo sapiens
ctggtggcatcttgagatggtt

SEQ ID NO: 8319529 - DNA, 22 bp, Homo sapiens
ctggtggcaatgaggcgtcact

SEQ ID NO: 8319530 - DNA, 22 bp, Homo sapiens
ctggggaggatgctacgacctg

SEQ ID NO: 8319531 - DNA, 22 bp, Homo sapiens
ctggggaggcagggctgcccct

SEQ ID NO: 8319532 - DNA, 22 bp, Homo sapiens
ctggggaggcagggctgcccct

SEQ ID NO: 8319533 - DNA, 22 bp, Homo sapiens
ctggggaggcagggctgcccct

SEQ ID NO: 8319534 - DNA, 22 bp, Homo sapiens
ctggggaggcagggctgcccct

SEQ ID NO: 8319535 - DNA, 22 bp, Homo sapiens
ctggggatcctttttgcatcta

SEQ ID NO: 8319536 - DNA, 22 bp, Homo sapiens
atattttggcaaatgtctagat

SEQ ID NO: 8319537 - DNA, 22 bp, Homo sapiens
ctgtatatgtgcatacacacac

SEQ ID NO: 8319538 - DNA, 22 bp, Homo sapiens
atattttcactgaaccaaagta

SEQ ID NO: 8319539 - DNA, 22 bp, Homo sapiens
atattttccgaacttgaggtag

SEQ ID NO: 8319540 - DNA, 22 bp, Homo sapiens
atattttccgaacttgaggtag

SEQ ID NO: 8319541 - DNA, 22 bp, Homo sapiens
atattttgaagttaataatgtg

SEQ ID NO: 8319542 - DNA, 22 bp, Homo sapiens
ctgtatgtttctatgaatgtga

SEQ ID NO: 8319543 - DNA, 22 bp, Homo sapiens
ctgtccagctgaccagagcagc

SEQ ID NO: 8319544 - DNA, 22 bp, Homo sapiens
ctgggcctggcgttccaggctg

SEQ ID NO: 8319545 - DNA, 22 bp, Homo sapiens
ctgggcctgggaggccaggtct

SEQ ID NO: 8319546 - DNA, 22 bp, Homo sapiens
ctgggctgtaatgtggcactga

SEQ ID NO: 8319547 - DNA, 22 bp, Homo sapiens
ctgggccatctctctgcaagtg

SEQ ID NO: 8319548 - DNA, 22 bp, Homo sapiens
ctgggccatgggccagcgaggc

SEQ ID NO: 8319549 - DNA, 22 bp, Homo sapiens
ctgggcctctcagctcccgcgg

SEQ ID NO: 8319550 - DNA, 17 bp, Homo sapiens
ctgggcctctgcccttt

SEQ ID NO: 8319551 - DNA, 22 bp, Homo sapiens
atatattacaaaagaggaagga

SEQ ID NO: 8319552 - DNA, 22 bp, Homo sapiens
atatattttgcggtcacgtggc

SEQ ID NO: 8319553 - DNA, 22 bp, Homo sapiens
atatattttgcggtcacgtggc

SEQ ID NO: 8319554 - DNA, 22 bp, Homo sapiens
atatattttttgagacagagtc

SEQ ID NO: 8319555 - DNA, 22 bp, Homo sapiens
atatattttttgagacagagtc

SEQ ID NO: 8319556 - DNA, 22 bp, Homo sapiens
atatcacagatgcagaaagaga

SEQ ID NO: 8319557 - DNA, 22 bp, Homo sapiens
atatcagaaatagtaagcagag

SEQ ID NO: 8319558 - DNA, 22 bp, Homo sapiens
ataataaaccaggatgggtctg

SEQ ID NO: 8319559 - DNA, 22 bp, Homo sapiens
ataataatgaaagccactgtgt

SEQ ID NO: 8319560 - DNA, 22 bp, Homo sapiens
ataataaaccaggatgggtctg

SEQ ID NO: 8319561 - DNA, 22 bp, Homo sapiens
ataagtttgtctttgtaaagat

SEQ ID NO: 8319562 - DNA, 22 bp, Homo sapiens
ctgccctgtatcttctcccaat

SEQ ID NO: 8319563 - DNA, 22 bp, Homo sapiens
ctgccctgtctgcagcctggct

SEQ ID NO: 8319564 - DNA, 22 bp, Homo sapiens
ctgccctgacctgcctcagagt

SEQ ID NO: 8319565 - DNA, 18 bp, Homo sapiens
ctgccccttctctgagat

SEQ ID NO: 8319566 - DNA, 22 bp, Homo sapiens
agttttctttcgcaaaggtaca

SEQ ID NO: 8319567 - DNA, 22 bp, Homo sapiens
agttttctgttctacaatttga

SEQ ID NO: 8319568 - DNA, 21 bp, Homo sapiens
agttttctgagttataaaata

SEQ ID NO: 8319569 - DNA, 22 bp, Homo sapiens
agttttcctctcatttatcaat

SEQ ID NO: 8319570 - DNA, 22 bp, Homo sapiens
agttttcagtaaatattagtga

SEQ ID NO: 8319571 - DNA, 22 bp, Homo sapiens
agttttcagtaaatattagtga

SEQ ID NO: 8319572 - DNA, 22 bp, Homo sapiens
agttttattccaatgtgcagca

SEQ ID NO: 8319573 - DNA, 22 bp, Homo sapiens
agtttcatccgatctggtctca

SEQ ID NO: 8319574 - DNA, 22 bp, Homo sapiens
agtttcatattaccatgtcacc

SEQ ID NO: 8319575 - DNA, 22 bp, Homo sapiens
agtttcacatagctcagtgctc

SEQ ID NO: 8319576 - DNA, 22 bp, Homo sapiens
agtttcactaaggtctgtgtgt

SEQ ID NO: 8319577 - DNA, 22 bp, Homo sapiens
agtttctattttcatgtctgtt

SEQ ID NO: 8319578 - DNA, 22 bp, Homo sapiens
agtttctattttcatgtctgtt

SEQ ID NO: 8319579 - DNA, 23 bp, Homo sapiens
agtttctttgagacttgccctgt

SEQ ID NO: 8319580 - DNA, 22 bp, Homo sapiens
agtttcttcatccaaaaaatgg

SEQ ID NO: 8319581 - DNA, 22 bp, Homo sapiens
agttttattaaatccacagaag

SEQ ID NO: 8319582 - DNA, 22 bp, Homo sapiens
agttttattgtcccagaggtga

SEQ ID NO: 8319583 - DNA, 22 bp, Homo sapiens
agttttatgttcacagaaggat

SEQ ID NO: 8319584 - DNA, 22 bp, Homo sapiens
ctgagtttccagataagacctt

SEQ ID NO: 8319585 - DNA, 22 bp, Homo sapiens
agtttacaacagtagctatgga

SEQ ID NO: 8319586 - DNA, 19 bp, Homo sapiens
agtttattataggtgattc

SEQ ID NO: 8319587 - DNA, 22 bp, Homo sapiens
ctgagaggcggaggttgcagtg

SEQ ID NO: 8319588 - DNA, 22 bp, Homo sapiens
agtttattctgcttggccctcc

SEQ ID NO: 8319589 - DNA, 22 bp, Homo sapiens
agtttcaaattactgcccatgg

SEQ ID NO: 8319590 - DNA, 22 bp, Homo sapiens
agtttatttttgataagtcttg

SEQ ID NO: 8319591 - DNA, 22 bp, Homo sapiens
agtttcacagagggttagacgc

SEQ ID NO: 8319592 - DNA, 22 bp, Homo sapiens
ctggccaggcttgggacagaca

SEQ ID NO: 8319593 - DNA, 22 bp, Homo sapiens
ctggccagggtgcgatcgtggt

SEQ ID NO: 8319594 - DNA, 22 bp, Homo sapiens
ctggccaggttttgaacagttg

SEQ ID NO: 8319595 - DNA, 22 bp, Homo sapiens
ctggccagtgactgctcacccg

SEQ ID NO: 8319596 - DNA, 22 bp, Homo sapiens
ctggccaggctctcacgtggtc

SEQ ID NO: 8319597 - DNA, 22 bp, Homo sapiens
ctggccagaggttcctctgccc

SEQ ID NO: 8319598 - DNA, 21 bp, Homo sapiens
ctggagcttggtgagaagtgt

SEQ ID NO: 8319599 - DNA, 22 bp, Homo sapiens
ctggagcttattgggagcagaa

SEQ ID NO: 8319600 - DNA, 22 bp, Homo sapiens
atactttgctacattgtacatt

SEQ ID NO: 8319601 - DNA, 22 bp, Homo sapiens
atactttgggggttagtgtaga

SEQ ID NO: 8319602 - DNA, 22 bp, Homo sapiens
atagaaacagaggtcaggcatt

SEQ ID NO: 8319603 - DNA, 22 bp, Homo sapiens
atagaaaacagatgtccttaaa

SEQ ID NO: 8319604 - DNA, 22 bp, Homo sapiens
atagaaaacagatgtccttaaa

SEQ ID NO: 8319605 - DNA, 22 bp, Homo sapiens
atagaaatggcagctggtgcta

SEQ ID NO: 8319606 - DNA, 22 bp, Homo sapiens
atagaaatgtattttggactag

SEQ ID NO: 8319607 - DNA, 19 bp, Homo sapiens
atagaaagggttaaagaca

SEQ ID NO: 8319608 - DNA, 19 bp, Homo sapiens
atagaaagggttaaagaca

SEQ ID NO: 8319609 - DNA, 20 bp, Homo sapiens
atagtaatgaagtcttgttc

SEQ ID NO: 8319610 - DNA, 22 bp, Homo sapiens
atagaattacagtgtgtttgga

SEQ ID NO: 8319611 - DNA, 22 bp, Homo sapiens
atagaatgtattatagtacaga

SEQ ID NO: 8319612 - DNA, 22 bp, Homo sapiens
atagaatttgtacttgtagaac

SEQ ID NO: 8319613 - DNA, 22 bp, Homo sapiens
atagacatatggctttgtttct

SEQ ID NO: 8319614 - DNA, 22 bp, Homo sapiens
atacagaaaatgatgcagagtt

SEQ ID NO: 8319615 - DNA, 22 bp, Homo sapiens
ataatttaattttcacagtggt

SEQ ID NO: 8319616 - DNA, 22 bp, Homo sapiens
ataatttaattttcacagtggt

SEQ ID NO: 8319617 - DNA, 22 bp, Homo sapiens
ataatgtttttgtataagcatg

SEQ ID NO: 8319618 - DNA, 22 bp, Homo sapiens
ataatcagaattcatgaaagat

SEQ ID NO: 8319619 - DNA, 22 bp, Homo sapiens
atacatgactcacacattctgc

SEQ ID NO: 8319620 - DNA, 22 bp, Homo sapiens
ctggagctggtatagggacaaa

SEQ ID NO: 8319621 - DNA, 22 bp, Homo sapiens
ctggagctggcccaggctggcc

SEQ ID NO: 8319622 - DNA, 22 bp, Homo sapiens
atacatatatggtacttcctgg

SEQ ID NO: 8319623 - DNA, 21 bp, Homo sapiens
atacagaaggtggcaaagtac

SEQ ID NO: 8319624 - DNA, 22 bp, Homo sapiens
acagtttgcactgttcatcaaa

SEQ ID NO: 8319625 - DNA, 22 bp, Homo sapiens
acagtttatggtgttttatata

SEQ ID NO: 8319626 - DNA, 22 bp, Homo sapiens
acagtctgcctctcagagcagc

SEQ ID NO: 8319627 - DNA, 22 bp, Homo sapiens
acagtcatagcagcctttgtta

SEQ ID NO: 8319628 - DNA, 22 bp, Homo sapiens
acagtccagcctagtatgtata

SEQ ID NO: 8319629 - DNA, 19 bp, Homo sapiens
acagtccagctgtttgtac

SEQ ID NO: 8319630 - DNA, 22 bp, Homo sapiens
aggagcaccattgtgctggtgt

SEQ ID NO: 8319631 - DNA, 22 bp, Homo sapiens
acagtatatatagtctaaaagc

SEQ ID NO: 8319632 - DNA, 20 bp, Homo sapiens
acaggttcattctgtgtgac

SEQ ID NO: 8319633 - DNA, 22 bp, Homo sapiens
aggacacaggcaggaggagatc

SEQ ID NO: 8319634 - DNA, 22 bp, Homo sapiens
acagtaaaaagccttagaattt

SEQ ID NO: 8319635 - DNA, 22 bp, Homo sapiens
agctggaggggccagcaggtgt

SEQ ID NO: 8319636 - DNA, 22 bp, Homo sapiens
agctggatgaatttggaacact

SEQ ID NO: 8319637 - DNA, 22 bp, Homo sapiens
acaggctgttggggtccagggt

SEQ ID NO: 8319638 - DNA, 22 bp, Homo sapiens
acaggcagggacctcttgagtt

SEQ ID NO: 8319639 - DNA, 22 bp, Homo sapiens
acagggaaggatttagtgggaa

SEQ ID NO: 8319640 - DNA, 22 bp, Homo sapiens
acagggaatggagggatcagta

SEQ ID NO: 8319641 - DNA, 22 bp, Homo sapiens
acaggcaggagctccccattcc

SEQ ID NO: 8319642 - DNA, 22 bp, Homo sapiens
acaggggcaggcaggacccttt

SEQ ID NO: 8319643 - DNA, 22 bp, Homo sapiens
acaggggcaagggctcacggcc

SEQ ID NO: 8319644 - DNA, 22 bp, Homo sapiens
aggacacacccagctcacgggg

SEQ ID NO: 8319645 - DNA, 22 bp, Homo sapiens
aggacacacagaatacaaatcc

SEQ ID NO: 8319646 - DNA, 19 bp, Homo sapiens
acaggggcctttccagggt

SEQ ID NO: 8319647 - DNA, 22 bp, Homo sapiens
aggacacacaaagagtgagaac

SEQ ID NO: 8319648 - DNA, 22 bp, Homo sapiens
accaggctggagtgcagtggcg

SEQ ID NO: 8319649 - DNA, 22 bp, Homo sapiens
accaggctggagtgcagtggcg

SEQ ID NO: 8319650 - DNA, 22 bp, Homo sapiens
accaggctctgccagtgtttac

SEQ ID NO: 8319651 - DNA, 22 bp, Homo sapiens
accaggctccccttggatcctg

SEQ ID NO: 8319652 - DNA, 22 bp, Homo sapiens
acccagcctacaaagctcacct

SEQ ID NO: 8319653 - DNA, 19 bp, Homo sapiens
acccagcccaggagtggca

SEQ ID NO: 8319654 - DNA, 22 bp, Homo sapiens
acccagcccagaatctggggcc

SEQ ID NO: 8319655 - DNA, 22 bp, Homo sapiens
acccagccatgttcagttctct

SEQ ID NO: 8319656 - DNA, 22 bp, Homo sapiens
acccagccacagcattgaggga

SEQ ID NO: 8319657 - DNA, 22 bp, Homo sapiens
agggctgcccagtgtgagagct

SEQ ID NO: 8319658 - DNA, 22 bp, Homo sapiens
agggctgccatttctggcccaa

SEQ ID NO: 8319659 - DNA, 22 bp, Homo sapiens
acccaggaaaacatggtgcaga

SEQ ID NO: 8319660 - DNA, 19 bp, Homo sapiens
agggctgctctggcctggg

SEQ ID NO: 8319661 - DNA, 22 bp, Homo sapiens
agggctgctaccttaatcagtt

SEQ ID NO: 8319662 - DNA, 22 bp, Homo sapiens
agggctgctatgttgattcaga

SEQ ID NO: 8319663 - DNA, 22 bp, Homo sapiens
agggctgcctgctctgcattga

SEQ ID NO: 8319664 - DNA, 22 bp, Homo sapiens
agggctgcctgactccagagcc

SEQ ID NO: 8319665 - DNA, 22 bp, Homo sapiens
agggctgccccagtccagccgg

SEQ ID NO: 8319666 - DNA, 22 bp, Homo sapiens
agggggaggctgtgctgcgtct

SEQ ID NO: 8319667 - DNA, 22 bp, Homo sapiens
agggggcatcaggtcctggctc

SEQ ID NO: 8319668 - DNA, 22 bp, Homo sapiens
agggggcatcaggtcctggctc

SEQ ID NO: 8319669 - DNA, 22 bp, Homo sapiens
agggggcaggagagacctgctg

SEQ ID NO: 8319670 - DNA, 22 bp, Homo sapiens
agggggcaggagagacctgctg

SEQ ID NO: 8319671 - DNA, 22 bp, Homo sapiens
agggggcattatgaggcttttc

SEQ ID NO: 8319672 - DNA, 22 bp, Homo sapiens
agggggctcagcaggctctgga

SEQ ID NO: 8319673 - DNA, 22 bp, Homo sapiens
agggggctcagcatggatggag

SEQ ID NO: 8319674 - DNA, 22 bp, Homo sapiens
agggggctcagcaggctctgga

SEQ ID NO: 8319675 - DNA, 22 bp, Homo sapiens
agggggctcctccggtgcttcc

SEQ ID NO: 8319676 - DNA, 22 bp, Homo sapiens
agggggctcagtgactgaagtg

SEQ ID NO: 8319677 - DNA, 22 bp, Homo sapiens
accagcagctgccagagtggag

SEQ ID NO: 8319678 - DNA, 22 bp, Homo sapiens
agggagacacatgaggaagtca

SEQ ID NO: 8319679 - DNA, 22 bp, Homo sapiens
agggacagtatccatctcacag

SEQ ID NO: 8319680 - DNA, 17 bp, Homo sapiens
accagcctctcctgggg

SEQ ID NO: 8319681 - DNA, 22 bp, Homo sapiens
agggagagacatttccttcttg

SEQ ID NO: 8319682 - DNA, 22 bp, Homo sapiens
agggagagaagttatacaagat

SEQ ID NO: 8319683 - DNA, 22 bp, Homo sapiens
agggagaggagcgtttcacatc

SEQ ID NO: 8319684 - DNA, 18 bp, Homo sapiens
agggagagaccgcgggtc

SEQ ID NO: 8319685 - DNA, 22 bp, Homo sapiens
agggcagcaatttggttcctgg

SEQ ID NO: 8319686 - DNA, 22 bp, Homo sapiens
agggcagcaatgcagctgctgc

SEQ ID NO: 8319687 - DNA, 22 bp, Homo sapiens
acatgcttccaaattatgttgg

SEQ ID NO: 8319688 - DNA, 22 bp, Homo sapiens
acatgtttaagtttgttatatg

SEQ ID NO: 8319689 - DNA, 22 bp, Homo sapiens
acatgtttaagtttgttatatg

SEQ ID NO: 8319690 - DNA, 22 bp, Homo sapiens
acatgtttgataaatatttggg

SEQ ID NO: 8319691 - DNA, 22 bp, Homo sapiens
acatgtttaagtttaatgaaaa

SEQ ID NO: 8319692 - DNA, 22 bp, Homo sapiens
acatgtttaagtttaatgaaaa

SEQ ID NO: 8319693 - DNA, 22 bp, Homo sapiens
aggccaggcgagacacccggct

SEQ ID NO: 8319694 - DNA, 22 bp, Homo sapiens
acattgtataatgattatcaca

SEQ ID NO: 8319695 - DNA, 22 bp, Homo sapiens
acatttccacagactgaggtca

SEQ ID NO: 8319696 - DNA, 22 bp, Homo sapiens
acattgtagttgttctgcagca

SEQ ID NO: 8319697 - DNA, 22 bp, Homo sapiens
acattgtaaatacctttatcac

SEQ ID NO: 8319698 - DNA, 22 bp, Homo sapiens
acattgtaaatacctttatcac

SEQ ID NO: 8319699 - DNA, 22 bp, Homo sapiens
acatttctagttgttcatctcc

SEQ ID NO: 8319700 - DNA, 22 bp, Homo sapiens
acattgcagatgtgtttaatgt

SEQ ID NO: 8319701 - DNA, 22 bp, Homo sapiens
acattgcaattaggtacctatg

SEQ ID NO: 8319702 - DNA, 22 bp, Homo sapiens
acattgatatttcaaatacagg

SEQ ID NO: 8319703 - DNA, 22 bp, Homo sapiens
acatttctttctattcagtagc

SEQ ID NO: 8319704 - DNA, 22 bp, Homo sapiens
aggctgaggagggatgttgctt

SEQ ID NO: 8319705 - DNA, 21 bp, Homo sapiens
acctgccacattgcagacttg

SEQ ID NO: 8319706 - DNA, 20 bp, Homo sapiens
acctgccacagagaaaggta

SEQ ID NO: 8319707 - DNA, 22 bp, Homo sapiens
accctccaggctgcagctcctg

SEQ ID NO: 8319708 - DNA, 22 bp, Homo sapiens
acctggccagtggggccgcgct

SEQ ID NO: 8319709 - DNA, 22 bp, Homo sapiens
aggtggctcccagtgttgttgt

SEQ ID NO: 8319710 - DNA, 22 bp, Homo sapiens
aggtcgagtttcggggctactt

SEQ ID NO: 8319711 - DNA, 22 bp, Homo sapiens
acgcagtttgtggacatttttt

SEQ ID NO: 8319712 - DNA, 22 bp, Homo sapiens
agtaaaaattgaggtgcaaaat

SEQ ID NO: 8319713 - DNA, 22 bp, Homo sapiens
agtaaaaattgaggtgcaaaat

SEQ ID NO: 8319714 - DNA, 22 bp, Homo sapiens
agtaaaatcaccatctctttgt

SEQ ID NO: 8319715 - DNA, 22 bp, Homo sapiens
agtaaaattgtattggaaaaca

SEQ ID NO: 8319716 - DNA, 22 bp, Homo sapiens
agtaaacactgtctttatatat

SEQ ID NO: 8319717 - DNA, 22 bp, Homo sapiens
agtatatagtggcgctgtatgc

SEQ ID NO: 8319718 - DNA, 22 bp, Homo sapiens
actaggagaaaacttacactga

SEQ ID NO: 8319719 - DNA, 22 bp, Homo sapiens
actaggaggcatataaaacatt

SEQ ID NO: 8319720 - DNA, 22 bp, Homo sapiens
agtattttcaaccatagcctgg

SEQ ID NO: 8319721 - DNA, 22 bp, Homo sapiens
agtcaaataagactgtcataag

SEQ ID NO: 8319722 - DNA, 22 bp, Homo sapiens
actcctgggttgcagtcctcaa

SEQ ID NO: 8319723 - DNA, 20 bp, Homo sapiens
actcctggtaacttttgtga

SEQ ID NO: 8319724 - DNA, 22 bp, Homo sapiens
actcctgggttctaaatttgaa

SEQ ID NO: 8319725 - DNA, 22 bp, Homo sapiens
actcctgggttccggagattct

SEQ ID NO: 8319726 - DNA, 22 bp, Homo sapiens
actcctggtttgtgtcctggct

SEQ ID NO: 8319727 - DNA, 22 bp, Homo sapiens
actcctggttcccagttgagat

SEQ ID NO: 8319728 - DNA, 22 bp, Homo sapiens
actcctggtgctgatgaagaga

SEQ ID NO: 8319729 - DNA, 17 bp, Homo sapiens
actcctggtctgaaggg

SEQ ID NO: 8319730 - DNA, 22 bp, Homo sapiens
agtcttgggagaggctggcagt

SEQ ID NO: 8319731 - DNA, 22 bp, Homo sapiens
agtcttggctgccgccgtctcc

SEQ ID NO: 8319732 - DNA, 22 bp, Homo sapiens
agtcttggctatgcatagagct

SEQ ID NO: 8319733 - DNA, 22 bp, Homo sapiens
agtcttggtgtcagtggtctga

SEQ ID NO: 8319734 - DNA, 22 bp, Homo sapiens
agtcttggtctccctggcagct

SEQ ID NO: 8319735 - DNA, 22 bp, Homo sapiens
agtcttggttttgacagggaaa

SEQ ID NO: 8319736 - DNA, 22 bp, Homo sapiens
agtctttacatgtgttatatat

SEQ ID NO: 8319737 - DNA, 22 bp, Homo sapiens
agtctgtcagtcattctaacaa

SEQ ID NO: 8319738 - DNA, 22 bp, Homo sapiens
agtctgtctaatattattcagg

SEQ ID NO: 8319739 - DNA, 20 bp, Homo sapiens
agtctgtcaatttacagtgg

SEQ ID NO: 8319740 - DNA, 22 bp, Homo sapiens
actgaggcagtgaggtcggtct

SEQ ID NO: 8319741 - DNA, 22 bp, Homo sapiens
actgaggatggataggtcatat

SEQ ID NO: 8319742 - DNA, 22 bp, Homo sapiens
actgaggcccgaggatctcctg

SEQ ID NO: 8319743 - DNA, 22 bp, Homo sapiens
agtgcatatatgaagagtatga

SEQ ID NO: 8319744 - DNA, 22 bp, Homo sapiens
agtgcaggttaaggaactggcc

SEQ ID NO: 8319745 - DNA, 22 bp, Homo sapiens
agtgcacaccttagtacaaagt

SEQ ID NO: 8319746 - DNA, 22 bp, Homo sapiens
actctgtagcctgtaagagagc

SEQ ID NO: 8319747 - DNA, 22 bp, Homo sapiens
actgcagaggtggggtgcagag

SEQ ID NO: 8319748 - DNA, 22 bp, Homo sapiens
actgcagagcttttcagttgag

SEQ ID NO: 8319749 - DNA, 22 bp, Homo sapiens
actgcacttcagcctgggtgtc

SEQ ID NO: 8319750 - DNA, 22 bp, Homo sapiens
agtgtagaaggagaaatggatc

SEQ ID NO: 8319751 - DNA, 22 bp, Homo sapiens
agtgtacatcagaacatatcaa

SEQ ID NO: 8319752 - DNA, 20 bp, Homo sapiens
agtgtacagacactagaaat

SEQ ID NO: 8319753 - DNA, 22 bp, Homo sapiens
agtggcagtagatgagctggtt

SEQ ID NO: 8319754 - DNA, 22 bp, Homo sapiens
actgcacttcagcctgggtgac

SEQ ID NO: 8319755 - DNA, 22 bp, Homo sapiens
actggaaaaccactgaaatgag

SEQ ID NO: 8319756 - DNA, 22 bp, Homo sapiens
atattcttccaaaacatcattt

SEQ ID NO: 8319757 - DNA, 21 bp, Homo sapiens
atatttctcataaggttatgg

SEQ ID NO: 8319758 - DNA, 23 bp, Homo sapiens
atatttccaggttagtgaggtaa

SEQ ID NO: 8319759 - DNA, 22 bp, Homo sapiens
atatttcatggggttccatact

SEQ ID NO: 8319760 - DNA, 22 bp, Homo sapiens
atatttcacgtaggttgttttc

SEQ ID NO: 8319761 - DNA, 22 bp, Homo sapiens
atattcatcgtgtagaaatact

SEQ ID NO: 8319762 - DNA, 22 bp, Homo sapiens
agaaaataaattgatggtggaa

SEQ ID NO: 8319763 - DNA, 21 bp, Homo sapiens
agaaaagtatttgaatcaaga

SEQ ID NO: 8319764 - DNA, 21 bp, Homo sapiens
agaaaagtatttgaatcaaga

SEQ ID NO: 8319765 - DNA, 22 bp, Homo sapiens
agaaaagtttaaatcttggcac

SEQ ID NO: 8319766 - DNA, 22 bp, Homo sapiens
agaaaagtgctctagtgagagc

SEQ ID NO: 8319767 - DNA, 22 bp, Homo sapiens
agaaaaggttgaaagtaggatt

SEQ ID NO: 8319768 - DNA, 22 bp, Homo sapiens
atatgaaagtaagcatgtgtgt

SEQ ID NO: 8319769 - DNA, 22 bp, Homo sapiens
actttcatttgtgaagactgta

SEQ ID NO: 8319770 - DNA, 22 bp, Homo sapiens
actttcaacctgtcccccagag

SEQ ID NO: 8319771 - DNA, 22 bp, Homo sapiens
actttcaagccctctagagaca

SEQ ID NO: 8319772 - DNA, 22 bp, Homo sapiens
actttcaattcactgagatata

SEQ ID NO: 8319773 - DNA, 22 bp, Homo sapiens
actttcatttgtaataaacttc

SEQ ID NO: 8319774 - DNA, 22 bp, Homo sapiens
actttcatgttggtgaagggtt

SEQ ID NO: 8319775 - DNA, 22 bp, Homo sapiens
actttcatggtagttgtattct

SEQ ID NO: 8319776 - DNA, 22 bp, Homo sapiens
actttcatgttcatttggaacc

SEQ ID NO: 8319777 - DNA, 22 bp, Homo sapiens
actttcatgctctgagcactgg

SEQ ID NO: 8319778 - DNA, 22 bp, Homo sapiens
actttcatggatctctgttcag

SEQ ID NO: 8319779 - DNA, 22 bp, Homo sapiens
agaaagtgtgtcatactaagtg

SEQ ID NO: 8319780 - DNA, 22 bp, Homo sapiens
agaaagtgcttccctttggtga

SEQ ID NO: 8319781 - DNA, 22 bp, Homo sapiens
agaaagtgtgtcatactaagtg

SEQ ID NO: 8319782 - DNA, 22 bp, Homo sapiens
agaaagtgcttccctttggact

SEQ ID NO: 8319783 - DNA, 22 bp, Homo sapiens
agaaagtgaacgtgttcagttt

SEQ ID NO: 8319784 - DNA, 22 bp, Homo sapiens
agaaagtgaccttgaaaactgg

SEQ ID NO: 8319785 - DNA, 22 bp, Homo sapiens
agaaagtgcctcccttgggagc

SEQ ID NO: 8319786 - DNA, 22 bp, Homo sapiens
agaaagtacagatgagacactt

SEQ ID NO: 8319787 - DNA, 22 bp, Homo sapiens
atctaattttcactcatttgct

SEQ ID NO: 8319788 - DNA, 22 bp, Homo sapiens
atctcacatcctcagtagtgca

SEQ ID NO: 8319789 - DNA, 22 bp, Homo sapiens
atctcacactgggtttgagggt

SEQ ID NO: 8319790 - DNA, 22 bp, Homo sapiens
atcctgggcaaagtatgctgtc

SEQ ID NO: 8319791 - DNA, 22 bp, Homo sapiens
atcgctttacagcctgcttcct

SEQ ID NO: 8319792 - DNA, 22 bp, Homo sapiens
atcggcaagccccacaccgtcc

SEQ ID NO: 8319793 - DNA, 22 bp, Homo sapiens
atcatcttcatattcctcagct

SEQ ID NO: 8319794 - DNA, 22 bp, Homo sapiens
atcatcttgaaagtctatgttt

SEQ ID NO: 8319795 - DNA, 22 bp, Homo sapiens
atcatcttatctgactcatttt

SEQ ID NO: 8319796 - DNA, 22 bp, Homo sapiens
ataaacagtaaatgtgagcagt

SEQ ID NO: 8319797 - DNA, 22 bp, Homo sapiens
ataaaatttgctactgttaaat

SEQ ID NO: 8319798 - DNA, 22 bp, Homo sapiens
ataaaatgtctccactgggctc

SEQ ID NO: 8319799 - DNA, 22 bp, Homo sapiens
ataaaatttgctactgttaaat

SEQ ID NO: 8319800 - DNA, 22 bp, Homo sapiens
actgtgccacaattcaccaggg

SEQ ID NO: 8319801 - DNA, 22 bp, Homo sapiens
ataatctgacaaagacttaagc

SEQ ID NO: 8319802 - DNA, 22 bp, Homo sapiens
actgtacatgtaaacattgtca

SEQ ID NO: 8319803 - DNA, 22 bp, Homo sapiens
actgggactgtatgtgctggac

SEQ ID NO: 8319804 - DNA, 21 bp, Homo sapiens
acttaaattccttgatattta

SEQ ID NO: 8319805 - DNA, 23 bp, Homo sapiens
acttaaatggttctttatctcag

SEQ ID NO: 8319806 - DNA, 21 bp, Homo sapiens
acttaaattccttgatattta

SEQ ID NO: 8319807 - DNA, 22 bp, Homo sapiens
acttaaatagaactcctcaata

SEQ ID NO: 8319808 - DNA, 22 bp, Homo sapiens
atacagcagtgaataagataaa

SEQ ID NO: 8319809 - DNA, 22 bp, Homo sapiens
atacattagctcatatgattaa

SEQ ID NO: 8319810 - DNA, 22 bp, Homo sapiens
atacattagtgaacaaaagaga

SEQ ID NO: 8319811 - DNA, 22 bp, Homo sapiens
atactgattagttgagaaagca

SEQ ID NO: 8319812 - DNA, 22 bp, Homo sapiens
atactgatgatgtgaagaaaca

SEQ ID NO: 8319813 - DNA, 22 bp, Homo sapiens
atacattattgttaaagaacat

SEQ ID NO: 8319814 - DNA, 22 bp, Homo sapiens
actttcaaatatcatgattcta

SEQ ID NO: 8319815 - DNA, 22 bp, Homo sapiens
actttcaaaagagaagtcatga

SEQ ID NO: 8319816 - DNA, 22 bp, Homo sapiens
agcccagcagtaagattagaga

SEQ ID NO: 8319817 - DNA, 23 bp, Homo sapiens
agcccagcagagaacctaggtcc

SEQ ID NO: 8319818 - DNA, 22 bp, Homo sapiens
agcccagccactattaaatgtt

SEQ ID NO: 8319819 - DNA, 22 bp, Homo sapiens
agcccagcccgggctgcgcttt

SEQ ID NO: 8319820 - DNA, 22 bp, Homo sapiens
agcccagcaaagggaggttcag

SEQ ID NO: 8319821 - DNA, 22 bp, Homo sapiens
agcccagcaaaggggtttgaga

SEQ ID NO: 8319822 - DNA, 22 bp, Homo sapiens
agcccagcagaaagtccagcct

SEQ ID NO: 8319823 - DNA, 22 bp, Homo sapiens
agcccagcactgggggcccagc

SEQ ID NO: 8319824 - DNA, 22 bp, Homo sapiens
agcccaaggcttccctgctggc

SEQ ID NO: 8319825 - DNA, 22 bp, Homo sapiens
cagagaaactcagatagctgat

SEQ ID NO: 8319826 - DNA, 22 bp, Homo sapiens
cagagaaagaagcccattcatt

SEQ ID NO: 8319827 - DNA, 22 bp, Homo sapiens
cagagaaaaaatcctgctctca

SEQ ID NO: 8319828 - DNA, 22 bp, Homo sapiens
cagagaaagaagcccattcatt

SEQ ID NO: 8319829 - DNA, 22 bp, Homo sapiens
cagaggctcttcctcactgccc

SEQ ID NO: 8319830 - DNA, 22 bp, Homo sapiens
cagagggaccagaacatactgt

SEQ ID NO: 8319831 - DNA, 22 bp, Homo sapiens
agcccagccggattcccagttc

SEQ ID NO: 8319832 - DNA, 22 bp, Homo sapiens
cagaggagttcagtacacagcc

SEQ ID NO: 8319833 - DNA, 21 bp, Homo sapiens
cagaggcaggctctgtgtgtg

SEQ ID NO: 8319834 - DNA, 22 bp, Homo sapiens
cagaaatatttattgagtgaca

SEQ ID NO: 8319835 - DNA, 22 bp, Homo sapiens
cagaaatatgtgccatgcctta

SEQ ID NO: 8319836 - DNA, 22 bp, Homo sapiens
agccacagtgcaagagagaaaa

SEQ ID NO: 8319837 - DNA, 22 bp, Homo sapiens
agccacctcacctgctgccgtt

SEQ ID NO: 8319838 - DNA, 20 bp, Homo sapiens
agccacctcatttccctacc

SEQ ID NO: 8319839 - DNA, 22 bp, Homo sapiens
agccacctcctgctctgctcac

SEQ ID NO: 8319840 - DNA, 22 bp, Homo sapiens
agccacaggaaacagagacagc

SEQ ID NO: 8319841 - DNA, 22 bp, Homo sapiens
cagaatgggaaggactgcagtt

SEQ ID NO: 8319842 - DNA, 22 bp, Homo sapiens
cagaatctcgacttctggcccc

SEQ ID NO: 8319843 - DNA, 22 bp, Homo sapiens
agccagacatggctcctgctcc

SEQ ID NO: 8319844 - DNA, 22 bp, Homo sapiens
cagacatatccctgctccctta

SEQ ID NO: 8319845 - DNA, 22 bp, Homo sapiens
cagcgtctcgttgtgggcctcg

SEQ ID NO: 8319846 - DNA, 22 bp, Homo sapiens
cagctcatgacctttgttatct

SEQ ID NO: 8319847 - DNA, 22 bp, Homo sapiens
agctcctgatacatgcaggaat

SEQ ID NO: 8319848 - DNA, 22 bp, Homo sapiens
agctcctgattctcagagatag

SEQ ID NO: 8319849 - DNA, 23 bp, Homo sapiens
agctcctgaggccagcctctcct

SEQ ID NO: 8319850 - DNA, 22 bp, Homo sapiens
cagcagttttgaagtgtggaga

SEQ ID NO: 8319851 - DNA, 22 bp, Homo sapiens
cagcagggtatacagggaattt

SEQ ID NO: 8319852 - DNA, 22 bp, Homo sapiens
cagaggtgcatacaggtcatta

SEQ ID NO: 8319853 - DNA, 22 bp, Homo sapiens
cagagggccccctggccacagt

SEQ ID NO: 8319854 - DNA, 22 bp, Homo sapiens
cagagggccccctggccacagt

SEQ ID NO: 8319855 - DNA, 22 bp, Homo sapiens
cagagggcactcggagtgacat

SEQ ID NO: 8319856 - DNA, 22 bp, Homo sapiens
cagagggcactcggagtgacat

SEQ ID NO: 8319857 - DNA, 22 bp, Homo sapiens
cagagggcacatggtttcctca

SEQ ID NO: 8319858 - DNA, 22 bp, Homo sapiens
agcctctgctggccctggcact

SEQ ID NO: 8319859 - DNA, 22 bp, Homo sapiens
agcctctgctggccctggcact

SEQ ID NO: 8319860 - DNA, 22 bp, Homo sapiens
agcctctggtcctccctcagct

SEQ ID NO: 8319861 - DNA, 22 bp, Homo sapiens
agcctctggccctagactgctt

SEQ ID NO: 8319862 - DNA, 22 bp, Homo sapiens
agcctctgtagaaagcagtgtg

SEQ ID NO: 8319863 - DNA, 22 bp, Homo sapiens
cagcagggcccccgggtgcgcc

SEQ ID NO: 8319864 - DNA, 22 bp, Homo sapiens
agcctggcactgccccatccat

SEQ ID NO: 8319865 - DNA, 22 bp, Homo sapiens
agcctggcactgccccatccat

SEQ ID NO: 8319866 - DNA, 22 bp, Homo sapiens
caaatagtttttcatgtattat

SEQ ID NO: 8319867 - DNA, 22 bp, Homo sapiens
caagagacttatgtggaaacct

SEQ ID NO: 8319868 - DNA, 22 bp, Homo sapiens
caagagacgggcaaggcaagag

SEQ ID NO: 8319869 - DNA, 22 bp, Homo sapiens
caaaataccacgacttgtttta

SEQ ID NO: 8319870 - DNA, 22 bp, Homo sapiens
agcacaggtgaaacagtcaggt

SEQ ID NO: 8319871 - DNA, 22 bp, Homo sapiens
agcacaggtgaaacagtcaggt

SEQ ID NO: 8319872 - DNA, 22 bp, Homo sapiens
caaatagacttcaatctcttga

SEQ ID NO: 8319873 - DNA, 22 bp, Homo sapiens
caaatagacttcaatctcttga

SEQ ID NO: 8319874 - DNA, 22 bp, Homo sapiens
caaatagattgttcaatcctga

SEQ ID NO: 8319875 - DNA, 22 bp, Homo sapiens
agcagccacccagctgctcatt

SEQ ID NO: 8319876 - DNA, 22 bp, Homo sapiens
agcagccaaccttacattcatc

SEQ ID NO: 8319877 - DNA, 22 bp, Homo sapiens
cacaaggcacattccttgtcca

SEQ ID NO: 8319878 - DNA, 22 bp, Homo sapiens
caagagagatgcagctcactca

SEQ ID NO: 8319879 - DNA, 22 bp, Homo sapiens
caccgtggaggagctggagggc

SEQ ID NO: 8319880 - DNA, 22 bp, Homo sapiens
cacctctgctgtccacaggatg

SEQ ID NO: 8319881 - DNA, 22 bp, Homo sapiens
agcagggctggggcacgagcca

SEQ ID NO: 8319882 - DNA, 22 bp, Homo sapiens
agcagggctttgtctctgtgaa

SEQ ID NO: 8319883 - DNA, 22 bp, Homo sapiens
agcaggggtctctgctaatgaa

SEQ ID NO: 8319884 - DNA, 22 bp, Homo sapiens
cacagtttctataggtcagaat

SEQ ID NO: 8319885 - DNA, 22 bp, Homo sapiens
cacagtttgcataggaaaaaca

SEQ ID NO: 8319886 - DNA, 22 bp, Homo sapiens
cacagtttcaataattattctt

SEQ ID NO: 8319887 - DNA, 22 bp, Homo sapiens
agcaggcaggaaggcagcactg

SEQ ID NO: 8319888 - DNA, 22 bp, Homo sapiens
agcaggcactatgccaggatct

SEQ ID NO: 8319889 - DNA, 22 bp, Homo sapiens
agcaggagcccttatcaccagg

SEQ ID NO: 8319890 - DNA, 22 bp, Homo sapiens
cacacaccaatcaaatgtcaga

SEQ ID NO: 8319891 - DNA, 22 bp, Homo sapiens
cacacactgacaccttatcttg

SEQ ID NO: 8319892 - DNA, 22 bp, Homo sapiens
cacacacagttttgtattctgt

SEQ ID NO: 8319893 - DNA, 21 bp, Homo sapiens
agagctgggacttgcctgaga

SEQ ID NO: 8319894 - DNA, 21 bp, Homo sapiens
agagctggtaggtaggtaggt

SEQ ID NO: 8319895 - DNA, 22 bp, Homo sapiens
agagctggtttactcaggaatt

SEQ ID NO: 8319896 - DNA, 22 bp, Homo sapiens
atgtttatggagcaggtattag

SEQ ID NO: 8319897 - DNA, 21 bp, Homo sapiens
atgtttacactgactactgtg

SEQ ID NO: 8319898 - DNA, 22 bp, Homo sapiens
atgtttacagaggaagtgcctc

SEQ ID NO: 8319899 - DNA, 22 bp, Homo sapiens
atgtttatgcaaacatgtgagt

SEQ ID NO: 8319900 - DNA, 22 bp, Homo sapiens
agaggagctgggaggccctcgt

SEQ ID NO: 8319901 - DNA, 22 bp, Homo sapiens
agaggacaggttttccatgggc

SEQ ID NO: 8319902 - DNA, 22 bp, Homo sapiens
agaggaggctctgggatcgtcc

SEQ ID NO: 8319903 - DNA, 21 bp, Homo sapiens
attattatttctgtgtccagc

SEQ ID NO: 8319904 - DNA, 22 bp, Homo sapiens
attattattgttgatgttaggg

SEQ ID NO: 8319905 - DNA, 22 bp, Homo sapiens
attattaaagcttaggtcttat

SEQ ID NO: 8319906 - DNA, 22 bp, Homo sapiens
attattaaagcttaggtcttat

SEQ ID NO: 8319907 - DNA, 22 bp, Homo sapiens
attcccacaatgtgtgcttcat

SEQ ID NO: 8319908 - DNA, 22 bp, Homo sapiens
attgcattgcagctagattttg

SEQ ID NO: 8319909 - DNA, 22 bp, Homo sapiens
attgcagggactcaataagaat

SEQ ID NO: 8319910 - DNA, 22 bp, Homo sapiens
agaggctgtgcagagggagtgc

SEQ ID NO: 8319911 - DNA, 21 bp, Homo sapiens
agagggagagtggcccttcca

SEQ ID NO: 8319912 - DNA, 22 bp, Homo sapiens
agagggagaaaagaatcagttg

SEQ ID NO: 8319913 - DNA, 22 bp, Homo sapiens
agagggagaagctaaaataact

SEQ ID NO: 8319914 - DNA, 22 bp, Homo sapiens
attcattagccactaactagca

SEQ ID NO: 8319915 - DNA, 22 bp, Homo sapiens
agaggcgcagactcttgagtgt

SEQ ID NO: 8319916 - DNA, 22 bp, Homo sapiens
agaggcggagcttgcagtgagc

SEQ ID NO: 8319917 - DNA, 22 bp, Homo sapiens
agaggcggaggttgcagtgagc

SEQ ID NO: 8319918 - DNA, 22 bp, Homo sapiens
agaggctcagaggcctggtcct

SEQ ID NO: 8319919 - DNA, 22 bp, Homo sapiens
attcatttaggtattcacttac

SEQ ID NO: 8319920 - DNA, 22 bp, Homo sapiens
agaggcctgtgtgctccagtgg

SEQ ID NO: 8319921 - DNA, 22 bp, Homo sapiens
agatacattgttctaagcattg

SEQ ID NO: 8319922 - DNA, 22 bp, Homo sapiens
atttctcatctttgtgaatggt

SEQ ID NO: 8319923 - DNA, 22 bp, Homo sapiens
atttctctcattgttagctagg

SEQ ID NO: 8319924 - DNA, 22 bp, Homo sapiens
caaaagtaccttgtgtgctttg

SEQ ID NO: 8319925 - DNA, 21 bp, Homo sapiens
caaaaggataggaaattaggg

SEQ ID NO: 8319926 - DNA, 22 bp, Homo sapiens
atttgtttatcgtcgattgtag

SEQ ID NO: 8319927 - DNA, 22 bp, Homo sapiens
atttgtttatcgtcgattgtag

SEQ ID NO: 8319928 - DNA, 20 bp, Homo sapiens
atttgtttctactctctgac

SEQ ID NO: 8319929 - DNA, 20 bp, Homo sapiens
atttgtttctactctctgac

SEQ ID NO: 8319930 - DNA, 22 bp, Homo sapiens
atttgtttcagggccttggtat

SEQ ID NO: 8319931 - DNA, 22 bp, Homo sapiens
atttgtttcagggccttggtat

SEQ ID NO: 8319932 - DNA, 22 bp, Homo sapiens
atttcacattaatttgatgctc

SEQ ID NO: 8319933 - DNA, 22 bp, Homo sapiens
atttcacagcgtggttgactgc

SEQ ID NO: 8319934 - DNA, 22 bp, Homo sapiens
atttcacaaagaacagatgcag

SEQ ID NO: 8319935 - DNA, 22 bp, Homo sapiens
agataaaatgattttctggatc

SEQ ID NO: 8319936 - DNA, 22 bp, Homo sapiens
agataaaatggttcaaaggcta

SEQ ID NO: 8319937 - DNA, 22 bp, Homo sapiens
agaggtcagagcaggaaaggca

SEQ ID NO: 8319938 - DNA, 22 bp, Homo sapiens
agaggtattagatttgcatagg

SEQ ID NO: 8319939 - DNA, 22 bp, Homo sapiens
attgctgactcaataattgaag

SEQ ID NO: 8319940 - DNA, 22 bp, Homo sapiens
attgctacttcctcaggaaaac

SEQ ID NO: 8319941 - DNA, 22 bp, Homo sapiens
attgcattgtattgtaaatgtt

SEQ ID NO: 8319942 - DNA, 22 bp, Homo sapiens
attgcatttgtcattgttgagg

SEQ ID NO: 8319943 - DNA, 22 bp, Homo sapiens
attgcattgtttgaggcagagg

SEQ ID NO: 8319944 - DNA, 22 bp, Homo sapiens
attgcctgccactctgtgagga

SEQ ID NO: 8319945 - DNA, 22 bp, Homo sapiens
agagttctgaaattatctttac

SEQ ID NO: 8319946 - DNA, 21 bp, Homo sapiens
agagttcttgctgagcaagcc

SEQ ID NO: 8319947 - DNA, 22 bp, Homo sapiens
agaggtgacataggagaggctc

SEQ ID NO: 8319948 - DNA, 22 bp, Homo sapiens
agacagcgaggacagaggggtg

SEQ ID NO: 8319949 - DNA, 22 bp, Homo sapiens
agacagcatgagcctgctgatg

SEQ ID NO: 8319950 - DNA, 22 bp, Homo sapiens
agacagacttgaaaatgttctt

SEQ ID NO: 8319951 - DNA, 22 bp, Homo sapiens
agacagactgtgtttgaatcct

SEQ ID NO: 8319952 - DNA, 22 bp, Homo sapiens
agacagactgtgtttgaatcct

SEQ ID NO: 8319953 - DNA, 22 bp, Homo sapiens
agacagactggtttgaattggt

SEQ ID NO: 8319954 - DNA, 22 bp, Homo sapiens
agacaggcagaggctgcagagg

SEQ ID NO: 8319955 - DNA, 22 bp, Homo sapiens
agacatttcctagacatcaatg

SEQ ID NO: 8319956 - DNA, 22 bp, Homo sapiens
agacagaccatggctattcaga

SEQ ID NO: 8319957 - DNA, 22 bp, Homo sapiens
agacagacatgctagttttctt

SEQ ID NO: 8319958 - DNA, 22 bp, Homo sapiens
agacagacattctagagccacc

SEQ ID NO: 8319959 - DNA, 17 bp, Homo sapiens
agacagacctctgcatc

SEQ ID NO: 8319960 - DNA, 22 bp, Homo sapiens
agacagacggctttatacacag

SEQ ID NO: 8319961 - DNA, 22 bp, Homo sapiens
agacagacgtagtgtgagagta

SEQ ID NO: 8319962 - DNA, 21 bp, Homo sapiens
agacagactgcctgacccacg

SEQ ID NO: 8319963 - DNA, 22 bp, Homo sapiens
atgacaaaagaagacatgaggt

SEQ ID NO: 8319964 - DNA, 22 bp, Homo sapiens
atgacaaacccaggatgtaaca

SEQ ID NO: 8319965 - DNA, 23 bp, Homo sapiens
atgcaacattgccagtatgggca

SEQ ID NO: 8319966 - DNA, 22 bp, Homo sapiens
atgacaaattcagaccatagca

SEQ ID NO: 8319967 - DNA, 22 bp, Homo sapiens
atgacaacctgtgagctggtat

SEQ ID NO: 8319968 - DNA, 22 bp, Homo sapiens
atgcaacatacattctgaagct

SEQ ID NO: 8319969 - DNA, 22 bp, Homo sapiens
atgcaacatccaattccttttg

SEQ ID NO: 8319970 - DNA, 22 bp, Homo sapiens
agacaaaggattaatgatgatg

SEQ ID NO: 8319971 - DNA, 22 bp, Homo sapiens
agacaaataactttttatgtcc

SEQ ID NO: 8319972 - DNA, 22 bp, Homo sapiens
agacaaataactttttatgtcc

SEQ ID NO: 8319973 - DNA, 22 bp, Homo sapiens
agacaaatggagtatgagcaac

SEQ ID NO: 8319974 - DNA, 22 bp, Homo sapiens
agacaaatggtaattatgtcta

SEQ ID NO: 8319975 - DNA, 22 bp, Homo sapiens
agacaaattgggacattgtgtt

SEQ ID NO: 8319976 - DNA, 23 bp, Homo sapiens
atgaaagttcttaaaatgtcatg

SEQ ID NO: 8319977 - DNA, 22 bp, Homo sapiens
atgaaattttaattatacctct

SEQ ID NO: 8319978 - DNA, 22 bp, Homo sapiens
agaagtgtttatttcagcaaca

SEQ ID NO: 8319979 - DNA, 22 bp, Homo sapiens
agaagttaattcctgaaattct

SEQ ID NO: 8319980 - DNA, 19 bp, Homo sapiens
agaagttagacattgcaat

SEQ ID NO: 8319981 - DNA, 22 bp, Homo sapiens
agaagttaccacatacttctct

SEQ ID NO: 8319982 - DNA, 22 bp, Homo sapiens
agaagtttgaaattaggagaaa

SEQ ID NO: 8319983 - DNA, 22 bp, Homo sapiens
agaagtttggtcctataaactc

SEQ ID NO: 8319984 - DNA, 22 bp, Homo sapiens
atctcaccaagttattacgaga

SEQ ID NO: 8319985 - DNA, 22 bp, Homo sapiens
agaaggctggccctgggtggcc

SEQ ID NO: 8319986 - DNA, 22 bp, Homo sapiens
atggccagcaagttcagaattt

SEQ ID NO: 8319987 - DNA, 22 bp, Homo sapiens
atggccagctcagagcactcag

SEQ ID NO: 8319988 - DNA, 22 bp, Homo sapiens
atggccagcccttcccgcagct

SEQ ID NO: 8319989 - DNA, 22 bp, Homo sapiens
atggccagggtggcactgtggt

SEQ ID NO: 8319990 - DNA, 22 bp, Homo sapiens
atggccaggcacctctggctga

SEQ ID NO: 8319991 - DNA, 22 bp, Homo sapiens
agacattttggaaagtattact

SEQ ID NO: 8319992 - DNA, 22 bp, Homo sapiens
agaccagggtcccacagagtct

SEQ ID NO: 8319993 - DNA, 22 bp, Homo sapiens
agacccacactttgagtagcaa

SEQ ID NO: 8319994 - DNA, 22 bp, Homo sapiens
atggcctggggagcatgggaag

SEQ ID NO: 8319995 - DNA, 22 bp, Homo sapiens
atggcctggccagagctctgct

SEQ ID NO: 8319996 - DNA, 20 bp, Homo sapiens
atggcctgctagaagtctgt

SEQ ID NO: 8319997 - DNA, 22 bp, Homo sapiens
atggccgcctgtccttcccgcc

SEQ ID NO: 8319998 - DNA, 22 bp, Homo sapiens
agagatgaaaagtggagactgg

SEQ ID NO: 8319999 - DNA, 22 bp, Homo sapiens
agagatgaaaagtggagactgg

SEQ ID NO: 8320000 - DNA, 22 bp, Homo sapiens
agagacagggttttgtcgtgtt

SEQ ID NO: 8320001 - DNA, 19 bp, Homo sapiens
agagaccacagagctgcct

SEQ ID NO: 8320002 - DNA, 22 bp, Homo sapiens
agagacagggttttgtcgtgtt

SEQ ID NO: 8320003 - DNA, 20 bp, Homo sapiens
atggggtgagtgacgccctc

SEQ ID NO: 8320004 - DNA, 20 bp, Homo sapiens
atggggtgagtgacgccctc

SEQ ID NO: 8320005 - DNA, 22 bp, Homo sapiens
atggggtgaccatgagcattta

SEQ ID NO: 8320006 - DNA, 22 bp, Homo sapiens
atgggggaaagtacgagcatgg

SEQ ID NO: 8320007 - DNA, 22 bp, Homo sapiens
atggggctgttctctgccctgc

SEQ ID NO: 8320008 - DNA, 22 bp, Homo sapiens
agagatggccttaggtgggaat

SEQ ID NO: 8320009 - DNA, 22 bp, Homo sapiens
agagatgaatcttgagactctg

SEQ ID NO: 8320010 - DNA, 22 bp, Homo sapiens
agagatgacatgagggacttaa

SEQ ID NO: 8320011 - DNA, 22 bp, Homo sapiens
agagatgactgatggctgatta

SEQ ID NO: 8320012 - DNA, 22 bp, Homo sapiens
agagatggatgttattatgggt

SEQ ID NO: 8320013 - DNA, 22 bp, Homo sapiens
agagatggagagcactggggct

SEQ ID NO: 8320014 - DNA, 22 bp, Homo sapiens
atggggtggagtccgggcagcg

SEQ ID NO: 8320015 - DNA, 22 bp, Homo sapiens
atggggtggagtccgggcagcg

SEQ ID NO: 8320016 - DNA, 22 bp, Homo sapiens
agagccactgggagacagagca

SEQ ID NO: 8320017 - DNA, 22 bp, Homo sapiens
agagccacagtggataggagcc

SEQ ID NO: 8320018 - DNA, 22 bp, Homo sapiens
agagccaatcttcagagcagag

SEQ ID NO: 8320019 - DNA, 22 bp, Homo sapiens
atgtatttgaaatttgagacat

SEQ ID NO: 8320020 - DNA, 22 bp, Homo sapiens
atgtatttgcgtatggacatac

SEQ ID NO: 8320021 - DNA, 22 bp, Homo sapiens
atgtatttgcttgttatggatt

SEQ ID NO: 8320022 - DNA, 22 bp, Homo sapiens
atgtattttaagatttgcctca

SEQ ID NO: 8320023 - DNA, 22 bp, Homo sapiens
agagcctggggattggcaaggg

SEQ ID NO: 8320024 - DNA, 22 bp, Homo sapiens
atgtattttaagatttgcctca

SEQ ID NO: 8320025 - DNA, 22 bp, Homo sapiens
agagcctgtcaattgtaaagag

SEQ ID NO: 8320026 - DNA, 22 bp, Homo sapiens
atgtggggacaaaatgatggcc

SEQ ID NO: 8320027 - DNA, 22 bp, Homo sapiens
aaaagtattggccaccatttct

SEQ ID NO: 8320028 - DNA, 22 bp, Homo sapiens
aaaagtattggccaccatttct

SEQ ID NO: 8320029 - DNA, 22 bp, Homo sapiens
aaaagtatagggtttggagtca

SEQ ID NO: 8320030 - DNA, 22 bp, Homo sapiens
aaagacatggaactagagatgg

SEQ ID NO: 8320031 - DNA, 22 bp, Homo sapiens
aaaagtatagggtttggagtca

SEQ ID NO: 8320032 - DNA, 22 bp, Homo sapiens
aaaagtactattttaacaaagt

SEQ ID NO: 8320033 - DNA, 22 bp, Homo sapiens
aaaagagagttgccagtctgta

SEQ ID NO: 8320034 - DNA, 21 bp, Homo sapiens
aaaatcaccttaggtcactgg

SEQ ID NO: 8320035 - DNA, 22 bp, Homo sapiens
aaaatcacaagcttgggtcact

SEQ ID NO: 8320036 - DNA, 22 bp, Homo sapiens
aaaatcctgctgactcgagatg

SEQ ID NO: 8320037 - DNA, 22 bp, Homo sapiens
aaaatcctctaattctagaata

SEQ ID NO: 8320038 - DNA, 22 bp, Homo sapiens
aaaatcctctaattctagaata

SEQ ID NO: 8320039 - DNA, 22 bp, Homo sapiens
aaaatccacaacgctcatttca

SEQ ID NO: 8320040 - DNA, 22 bp, Homo sapiens
aaagacattagcttagatgtca

SEQ ID NO: 8320041 - DNA, 22 bp, Homo sapiens
aaacaagtgtaaactagtctgt

SEQ ID NO: 8320042 - DNA, 23 bp, Homo sapiens
aaacaagtctctcaatggcttgc

SEQ ID NO: 8320043 - DNA, 22 bp, Homo sapiens
aaacaatccaggaacctgttta

SEQ ID NO: 8320044 - DNA, 22 bp, Homo sapiens
aaaatctaagtagcgagtaagg

SEQ ID NO: 8320045 - DNA, 22 bp, Homo sapiens
aaaatctaagtagcgagtaagg

SEQ ID NO: 8320046 - DNA, 22 bp, Homo sapiens
aaaaatcacttttataggcagc

SEQ ID NO: 8320047 - DNA, 22 bp, Homo sapiens
aaaaatctatgactgcttctcc

SEQ ID NO: 8320048 - DNA, 22 bp, Homo sapiens
aaaatgaataagttaacccagg

SEQ ID NO: 8320049 - DNA, 22 bp, Homo sapiens
aaaatgacattccagtgatatt

SEQ ID NO: 8320050 - DNA, 22 bp, Homo sapiens
aaaagacatctatttcaggcag

SEQ ID NO: 8320051 - DNA, 22 bp, Homo sapiens
aaacagaagggtaggtaaacat

SEQ ID NO: 8320052 - DNA, 22 bp, Homo sapiens
aaacagaaatttcctcatgctc

SEQ ID NO: 8320053 - DNA, 23 bp, Homo sapiens
aaaaaaccatgtaggcactcagt

SEQ ID NO: 8320054 - DNA, 22 bp, Homo sapiens
aaaaaagattgatggtggatgc

SEQ ID NO: 8320055 - DNA, 22 bp, Homo sapiens
aaaaaatcagatctttggttaa

SEQ ID NO: 8320056 - DNA, 22 bp, Homo sapiens
aaaaaattatcatagttcctga

SEQ ID NO: 8320057 - DNA, 22 bp, Homo sapiens
aaaaaattatcatagttcctga

SEQ ID NO: 8320058 - DNA, 22 bp, Homo sapiens
aaaaaattatcatagttcctga

SEQ ID NO: 8320059 - DNA, 20 bp, Homo sapiens
aaaaacagtaatgctgaaga

SEQ ID NO: 8320060 - DNA, 22 bp, Homo sapiens
aaaaacagaatgtgtctaactc

SEQ ID NO: 8320061 - DNA, 22 bp, Homo sapiens
aaaaacacaactgtctttctct

SEQ ID NO: 8320062 - DNA, 22 bp, Homo sapiens
aaaaaattccattctgtgcctt

SEQ ID NO: 8320063 - DNA, 22 bp, Homo sapiens
aaaaaattccattctgtgcctt

SEQ ID NO: 8320064 - DNA, 22 bp, Homo sapiens
aaaatctggtaatttgaatgtg

SEQ ID NO: 8320065 - DNA, 23 bp, Homo sapiens
aaaatcttctgcctatgaagaaa

SEQ ID NO: 8320066 - DNA, 22 bp, Homo sapiens
aaaatcttgactgtttttagaa

SEQ ID NO: 8320067 - DNA, 22 bp, Homo sapiens
aaaatcttgactgtttttagaa

SEQ ID NO: 8320068 - DNA, 22 bp, Homo sapiens
aaaatgaacagaacaatgggga

SEQ ID NO: 8320069 - DNA, 22 bp, Homo sapiens
aaaatcttgtgacttaggaagg

SEQ ID NO: 8320070 - DNA, 22 bp, Homo sapiens
aaaaacctcaattacttttgca

SEQ ID NO: 8320071 - DNA, 22 bp, Homo sapiens
aaaatagttaacgttcagagta

SEQ ID NO: 8320072 - DNA, 17 bp, Homo sapiens
aaactgaaaaattcact

SEQ ID NO: 8320073 - DNA, 21 bp, Homo sapiens
aaactgaccttgcctgagaca

SEQ ID NO: 8320074 - DNA, 22 bp, Homo sapiens
aaagaatctatatatcaccacc

SEQ ID NO: 8320075 - DNA, 22 bp, Homo sapiens
aaagaatgtctgaacagctggc

SEQ ID NO: 8320076 - DNA, 22 bp, Homo sapiens
aaagacacaaatgtagaccaaa

SEQ ID NO: 8320077 - DNA, 22 bp, Homo sapiens
aaagaatcagaagtctcaaaca

SEQ ID NO: 8320078 - DNA, 22 bp, Homo sapiens
aaagaatcacatccttcagcaa

SEQ ID NO: 8320079 - DNA, 22 bp, Homo sapiens
aaagaatagttaagtttagggc

SEQ ID NO: 8320080 - DNA, 22 bp, Homo sapiens
aaagaatactccttttgccttg

SEQ ID NO: 8320081 - DNA, 22 bp, Homo sapiens
aaagaatagcctttgtccaaat

SEQ ID NO: 8320082 - DNA, 22 bp, Homo sapiens
aaactgcaatgacaggtaggag

SEQ ID NO: 8320083 - DNA, 22 bp, Homo sapiens
aaagaataccctgggtcataaa

SEQ ID NO: 8320084 - DNA, 22 bp, Homo sapiens
aaagaataccctgggtcataaa

SEQ ID NO: 8320085 - DNA, 22 bp, Homo sapiens
aaagaagtgttgaatttgcaag

SEQ ID NO: 8320086 - DNA, 22 bp, Homo sapiens
aaatgcagcagctaattgaaaa

SEQ ID NO: 8320087 - DNA, 22 bp, Homo sapiens
aaatgcagcagctaattgaaaa

SEQ ID NO: 8320088 - DNA, 22 bp, Homo sapiens
aaagagcaccctcaatgtctga

SEQ ID NO: 8320089 - DNA, 22 bp, Homo sapiens
aaatgcagatccctgaatctca

SEQ ID NO: 8320090 - DNA, 22 bp, Homo sapiens
aaacagtgtgtttcagagaggc

SEQ ID NO: 8320091 - DNA, 22 bp, Homo sapiens
aaacagtgcctggcatggagga

SEQ ID NO: 8320092 - DNA, 22 bp, Homo sapiens
aaacagtgtttttatgatttat

SEQ ID NO: 8320093 - DNA, 22 bp, Homo sapiens
aaacagtgactggtacataata

SEQ ID NO: 8320094 - DNA, 22 bp, Homo sapiens
aaacagtgcaggaagttaagca

SEQ ID NO: 8320095 - DNA, 17 bp, Homo sapiens
aaacagtgagtgttatg

SEQ ID NO: 8320096 - DNA, 22 bp, Homo sapiens
aaagttacccaatctctatgaa

SEQ ID NO: 8320097 - DNA, 22 bp, Homo sapiens
aaagttacacgactatttatgt

SEQ ID NO: 8320098 - DNA, 21 bp, Homo sapiens
aaagttacagtcagtgggtgc

SEQ ID NO: 8320099 - DNA, 22 bp, Homo sapiens
aaagttactttgctgtgcttca

SEQ ID NO: 8320100 - DNA, 22 bp, Homo sapiens
aaagttcactatgtagcagcgt

SEQ ID NO: 8320101 - DNA, 22 bp, Homo sapiens
aaagttcagtgccttctataca

SEQ ID NO: 8320102 - DNA, 22 bp, Homo sapiens
aaagttcattgatgactgaggt

SEQ ID NO: 8320103 - DNA, 22 bp, Homo sapiens
aaagttcatggtgttatagaaa

SEQ ID NO: 8320104 - DNA, 22 bp, Homo sapiens
aaagttcatggtgttatagaaa

SEQ ID NO: 8320105 - DNA, 21 bp, Homo sapiens
aaagttcatgctttaatattc

SEQ ID NO: 8320106 - DNA, 22 bp, Homo sapiens
aaactctataggcagaagcaat

SEQ ID NO: 8320107 - DNA, 22 bp, Homo sapiens
aaacctggtggaacggtgaata

SEQ ID NO: 8320108 - DNA, 22 bp, Homo sapiens
aaacctgaagtacgttacataa

SEQ ID NO: 8320109 - DNA, 22 bp, Homo sapiens
aaacctgaatgtatgtcagaag

SEQ ID NO: 8320110 - DNA, 22 bp, Homo sapiens
aaatgtaagtctttgtttctta

SEQ ID NO: 8320111 - DNA, 22 bp, Homo sapiens
aaatgtcaaagacgtgtttttg

SEQ ID NO: 8320112 - DNA, 22 bp, Homo sapiens
aaatgcagctgggcatgagagg

SEQ ID NO: 8320113 - DNA, 20 bp, Homo sapiens
aaatgcagggctgctgcgga

SEQ ID NO: 8320114 - DNA, 22 bp, Homo sapiens
aaatgcaggttcttgagccaag

SEQ ID NO: 8320115 - DNA, 21 bp, Homo sapiens
aaatgcagtctctgagatctg

SEQ ID NO: 8320116 - DNA, 20 bp, Homo sapiens
aaatgcagttctgccttggc

SEQ ID NO: 8320117 - DNA, 22 bp, Homo sapiens
aaatgcagttggtggggatatg

SEQ ID NO: 8320118 - DNA, 22 bp, Homo sapiens
aaataatcaatttttgtagata

SEQ ID NO: 8320119 - DNA, 22 bp, Homo sapiens
aaataagttaaactagaatgat

SEQ ID NO: 8320120 - DNA, 22 bp, Homo sapiens
aaataagtgtgggccagtcaaa

SEQ ID NO: 8320121 - DNA, 22 bp, Homo sapiens
aaataacttggtttcatcagag

SEQ ID NO: 8320122 - DNA, 22 bp, Homo sapiens
aaataacttggtttcatcagag

SEQ ID NO: 8320123 - DNA, 22 bp, Homo sapiens
aaagtgttgaagaaaatgttca

SEQ ID NO: 8320124 - DNA, 22 bp, Homo sapiens
aaagtgtggcacaagtcacatc

SEQ ID NO: 8320125 - DNA, 22 bp, Homo sapiens
aaagtgttatgagaactaagtg

SEQ ID NO: 8320126 - DNA, 22 bp, Homo sapiens
aaagttttatatgctgcagcga

SEQ ID NO: 8320127 - DNA, 23 bp, Homo sapiens
aaataggagtatctggatcatga

SEQ ID NO: 8320128 - DNA, 22 bp, Homo sapiens
aaataattatagcgagtctatc

SEQ ID NO: 8320129 - DNA, 22 bp, Homo sapiens
aaataattatagcgagtctatc

SEQ ID NO: 8320130 - DNA, 22 bp, Homo sapiens
aaataattgagttggtcaatat

SEQ ID NO: 8320131 - DNA, 22 bp, Homo sapiens
aaataattgagttggtcaatat

SEQ ID NO: 8320132 - DNA, 23 bp, Homo sapiens
aaatagagataggccagctttgc

SEQ ID NO: 8320133 - DNA, 22 bp, Homo sapiens
aaatagagctgggttaaacttt

SEQ ID NO: 8320134 - DNA, 22 bp, Homo sapiens
aaatagattgctgaggcattac

SEQ ID NO: 8320135 - DNA, 22 bp, Homo sapiens
aaatagatttcctagcattgga

SEQ ID NO: 8320136 - DNA, 22 bp, Homo sapiens
aaatagcagcctttagttaaca

SEQ ID NO: 8320137 - DNA, 22 bp, Homo sapiens
aaagctgctttaaacatctatg

SEQ ID NO: 8320138 - DNA, 22 bp, Homo sapiens
aaagctgcccttgtgaaacaag

SEQ ID NO: 8320139 - DNA, 22 bp, Homo sapiens
aaagctgcccttgtgaaacaag

SEQ ID NO: 8320140 - DNA, 22 bp, Homo sapiens
aaagctgccaaggagaatacta

SEQ ID NO: 8320141 - DNA, 22 bp, Homo sapiens
aacagattgtaacctgatagcc

SEQ ID NO: 8320142 - DNA, 22 bp, Homo sapiens
aacagatataggcagaactttg

SEQ ID NO: 8320143 - DNA, 22 bp, Homo sapiens
aacagatgagagaattgaggct

SEQ ID NO: 8320144 - DNA, 22 bp, Homo sapiens
aaattgtggcgtctgtaagagt

SEQ ID NO: 8320145 - DNA, 22 bp, Homo sapiens
aaattttagtaaggaagttgag

SEQ ID NO: 8320146 - DNA, 22 bp, Homo sapiens
aaattttgtattctagttctag

SEQ ID NO: 8320147 - DNA, 22 bp, Homo sapiens
aaattttgtattctagttctag

SEQ ID NO: 8320148 - DNA, 21 bp, Homo sapiens
aaattttcttggctgtagtgt

SEQ ID NO: 8320149 - DNA, 22 bp, Homo sapiens
aacaaaacatttgtcttgtttc

SEQ ID NO: 8320150 - DNA, 22 bp, Homo sapiens
aaagccagttcttttatattgg

SEQ ID NO: 8320151 - DNA, 22 bp, Homo sapiens
aaagccagtttctggaagtacc

SEQ ID NO: 8320152 - DNA, 22 bp, Homo sapiens
aaagccagtttgtctctttaaa

SEQ ID NO: 8320153 - DNA, 22 bp, Homo sapiens
aaagccagttcttagagaaagc

SEQ ID NO: 8320154 - DNA, 22 bp, Homo sapiens
aaagccagtggtatgagagaaa

SEQ ID NO: 8320155 - DNA, 22 bp, Homo sapiens
aaagccaggttgtgtgcaggaa

SEQ ID NO: 8320156 - DNA, 22 bp, Homo sapiens
aaagccagggtccaggcctgcc

SEQ ID NO: 8320157 - DNA, 20 bp, Homo sapiens
aaagatactttttgtaatgg

SEQ ID NO: 8320158 - DNA, 22 bp, Homo sapiens
aaagatcaatagataaagctac

SEQ ID NO: 8320159 - DNA, 22 bp, Homo sapiens
aaagatcaatagataaagctac

SEQ ID NO: 8320160 - DNA, 22 bp, Homo sapiens
aaagccaggggagggattccca

SEQ ID NO: 8320161 - DNA, 22 bp, Homo sapiens
aaagatcagaggatagctgagt

SEQ ID NO: 8320162 - DNA, 22 bp, Homo sapiens
aaagtgtaaaagcatgttaggg

SEQ ID NO: 8320163 - DNA, 22 bp, Homo sapiens
aaagtgctgtgattacaggcat

SEQ ID NO: 8320164 - DNA, 22 bp, Homo sapiens
aaagtgctggtattacaggtgt

SEQ ID NO: 8320165 - DNA, 22 bp, Homo sapiens
aaagtcacatagcatcacttct

SEQ ID NO: 8320166 - DNA, 22 bp, Homo sapiens
aaagtgcagcttgtgatcccta

SEQ ID NO: 8320167 - DNA, 22 bp, Homo sapiens
aaagtgcagggtgctctggtat

SEQ ID NO: 8320168 - DNA, 22 bp, Homo sapiens
aaagtgcagtaacttgcccaag

SEQ ID NO: 8320169 - DNA, 22 bp, Homo sapiens
aaagtatatttacttactgtga

SEQ ID NO: 8320170 - DNA, 22 bp, Homo sapiens
aaagtatatatgcactttagaa

SEQ ID NO: 8320171 - DNA, 22 bp, Homo sapiens
aaagtagctttgtaggtacagt

SEQ ID NO: 8320172 - DNA, 22 bp, Homo sapiens
aaagtagcttagttgatatttc

SEQ ID NO: 8320173 - DNA, 22 bp, Homo sapiens
aaagtagcttagttgatatttc

SEQ ID NO: 8320174 - DNA, 22 bp, Homo sapiens
aaagtagctttgtaggtacagt

SEQ ID NO: 8320175 - DNA, 22 bp, Homo sapiens
aaagtagcagtaattatgaaat

SEQ ID NO: 8320176 - DNA, 22 bp, Homo sapiens
aaagtagcccttctggaattta

SEQ ID NO: 8320177 - DNA, 22 bp, Homo sapiens
aaaggaagattgagcttttcca

SEQ ID NO: 8320178 - DNA, 22 bp, Homo sapiens
aaaggaaaataagtagttccat

SEQ ID NO: 8320179 - DNA, 22 bp, Homo sapiens
aaagtactaatgaatattttgc

SEQ ID NO: 8320180 - DNA, 22 bp, Homo sapiens
aaagtacttacagtatgcttgg

SEQ ID NO: 8320181 - DNA, 22 bp, Homo sapiens
aaagtactttgggctatgtttg

SEQ ID NO: 8320182 - DNA, 22 bp, Homo sapiens
aactgcattcagaaagctcact

SEQ ID NO: 8320183 - DNA, 22 bp, Homo sapiens
aactgcaatcacttttgcacca

SEQ ID NO: 8320184 - DNA, 22 bp, Homo sapiens
aactgcaattacttttgcacca

SEQ ID NO: 8320185 - DNA, 22 bp, Homo sapiens
aactgcaattacttttgcacta

SEQ ID NO: 8320186 - DNA, 22 bp, Homo sapiens
aactgcaattacttttgcgcca

SEQ ID NO: 8320187 - DNA, 22 bp, Homo sapiens
aactgaaacgtatttttgagat

SEQ ID NO: 8320188 - DNA, 22 bp, Homo sapiens
aactgcaataacttgtgcacca

SEQ ID NO: 8320189 - DNA, 22 bp, Homo sapiens
aactgcaagtggggcttgtcat

SEQ ID NO: 8320190 - DNA, 23 bp, Homo sapiens
aactgcaaggttgctgggaagta

SEQ ID NO: 8320191 - DNA, 22 bp, Homo sapiens
aactgcaagctctttactgcta

SEQ ID NO: 8320192 - DNA, 22 bp, Homo sapiens
aactgcaacttgtttgattctt

SEQ ID NO: 8320193 - DNA, 22 bp, Homo sapiens
aactgcaacttcgtaaagtgag

SEQ ID NO: 8320194 - DNA, 22 bp, Homo sapiens
aactgcaagagtaaatgtctag

SEQ ID NO: 8320195 - DNA, 22 bp, Homo sapiens
aactacatcaccctatttctgt

SEQ ID NO: 8320196 - DNA, 22 bp, Homo sapiens
aatgatatttattgaatagatg

SEQ ID NO: 8320197 - DNA, 22 bp, Homo sapiens
aatgatatttattgaatagatg

SEQ ID NO: 8320198 - DNA, 22 bp, Homo sapiens
aatgatatagcagacatagcct

SEQ ID NO: 8320199 - DNA, 22 bp, Homo sapiens
aatgatcactgcagttgatgag

SEQ ID NO: 8320200 - DNA, 22 bp, Homo sapiens
aacttaaacccactcatgtaga

SEQ ID NO: 8320201 - DNA, 22 bp, Homo sapiens
aacttacaaggatgatagctgc

SEQ ID NO: 8320202 - DNA, 22 bp, Homo sapiens
aacttacaatgttagagtctca

SEQ ID NO: 8320203 - DNA, 22 bp, Homo sapiens
aataacttttaaaagaccctgg

SEQ ID NO: 8320204 - DNA, 22 bp, Homo sapiens
aataagaacaactaaggtttat

SEQ ID NO: 8320205 - DNA, 22 bp, Homo sapiens
aataagaactccatttactcgt

SEQ ID NO: 8320206 - DNA, 22 bp, Homo sapiens
aataacttcatgtaacatttaa

SEQ ID NO: 8320207 - DNA, 22 bp, Homo sapiens
aataacttgaagatctcttcca

SEQ ID NO: 8320208 - DNA, 22 bp, Homo sapiens
aataacttttaaaagaccctgg

SEQ ID NO: 8320209 - DNA, 22 bp, Homo sapiens
aataacttgtatggttattcca

SEQ ID NO: 8320210 - DNA, 22 bp, Homo sapiens
aataacttcatcttcaggatag

SEQ ID NO: 8320211 - DNA, 22 bp, Homo sapiens
aatagtgcttacattatcatga

SEQ ID NO: 8320212 - DNA, 22 bp, Homo sapiens
aatagtttgaatttatcagatg

SEQ ID NO: 8320213 - DNA, 22 bp, Homo sapiens
aatagtttgaatttatcagatg

SEQ ID NO: 8320214 - DNA, 22 bp, Homo sapiens
aacagtaaaaatcatttagttg

SEQ ID NO: 8320215 - DNA, 22 bp, Homo sapiens
aacagtaaaaatcatttagttg

SEQ ID NO: 8320216 - DNA, 22 bp, Homo sapiens
aacagtaaagacagaatttatc

SEQ ID NO: 8320217 - DNA, 22 bp, Homo sapiens
aacagtaaagacagaatttatc

SEQ ID NO: 8320218 - DNA, 22 bp, Homo sapiens
aacaggcaacagttgactctga

SEQ ID NO: 8320219 - DNA, 20 bp, Homo sapiens
aacagggcagaagcggagac

SEQ ID NO: 8320220 - DNA, 22 bp, Homo sapiens
aacaaagtttcaggaagataga

SEQ ID NO: 8320221 - DNA, 22 bp, Homo sapiens
aaggtccacaactggtaaatgg

SEQ ID NO: 8320222 - DNA, 22 bp, Homo sapiens
aaggtcagagcaggaaggagtc

SEQ ID NO: 8320223 - DNA, 22 bp, Homo sapiens
aaggtatagcttgcatacagaa

SEQ ID NO: 8320224 - DNA, 22 bp, Homo sapiens
aacactgacctctaccctcagt

SEQ ID NO: 8320225 - DNA, 22 bp, Homo sapiens
aacagaggctccctgcacttgt

SEQ ID NO: 8320226 - DNA, 22 bp, Homo sapiens
aacagcatgctgggtaacattg

SEQ ID NO: 8320227 - DNA, 20 bp, Homo sapiens
aacaaactacaaaattatgt

SEQ ID NO: 8320228 - DNA, 22 bp, Homo sapiens
aaattttagactcctgggtcta

SEQ ID NO: 8320229 - DNA, 22 bp, Homo sapiens
aaattttagaccaggcaaaact

SEQ ID NO: 8320230 - DNA, 22 bp, Homo sapiens
aaattgcattgagctgcttatt

SEQ ID NO: 8320231 - DNA, 22 bp, Homo sapiens
aaattctatgtcaatgtttatt

SEQ ID NO: 8320232 - DNA, 22 bp, Homo sapiens
aaattgcaaccaggtctctgtc

SEQ ID NO: 8320233 - DNA, 22 bp, Homo sapiens
aaattgcagatgctaaatgact

SEQ ID NO: 8320234 - DNA, 22 bp, Homo sapiens
aaattctttcatggctaataag

SEQ ID NO: 8320235 - DNA, 22 bp, Homo sapiens
aaattcctgtcatttgcacttt

SEQ ID NO: 8320236 - DNA, 22 bp, Homo sapiens
aaattcacttgcctgcttagct

SEQ ID NO: 8320237 - DNA, 22 bp, Homo sapiens
aaatgttctactttgataatta

SEQ ID NO: 8320238 - DNA, 22 bp, Homo sapiens
aaatgttctaaattacatgtga

SEQ ID NO: 8320239 - DNA, 22 bp, Homo sapiens
aaatgttccattattgtgtaat

SEQ ID NO: 8320240 - DNA, 22 bp, Homo sapiens
aaatgtgctaaagtattaacat

SEQ ID NO: 8320241 - DNA, 22 bp, Homo sapiens
aattgtctttatcacagttcaa

SEQ ID NO: 8320242 - DNA, 22 bp, Homo sapiens
aattgtaactacattgagaaca

SEQ ID NO: 8320243 - DNA, 22 bp, Homo sapiens
aattgtaagtgctgagttaagg

SEQ ID NO: 8320244 - DNA, 22 bp, Homo sapiens
aagacacagcgaaatgttcctg

SEQ ID NO: 8320245 - DNA, 22 bp, Homo sapiens
aagaataagaggatttagaaca

SEQ ID NO: 8320246 - DNA, 22 bp, Homo sapiens
aagaaataagacttctctgtcc

SEQ ID NO: 8320247 - DNA, 22 bp, Homo sapiens
aagaaatacatggtttttgagt

SEQ ID NO: 8320248 - DNA, 22 bp, Homo sapiens
aagaaatattgggccttataaa

SEQ ID NO: 8320249 - DNA, 22 bp, Homo sapiens
aacttattgaacattctcgaat

SEQ ID NO: 8320250 - DNA, 22 bp, Homo sapiens
aacttattccataggctcactg

SEQ ID NO: 8320251 - DNA, 22 bp, Homo sapiens
aatgttttatagctcaagcaat

SEQ ID NO: 8320252 - DNA, 22 bp, Homo sapiens
aatgttttagattactgctggg

SEQ ID NO: 8320253 - DNA, 22 bp, Homo sapiens
acaaagattcatttgcattatt

SEQ ID NO: 8320254 - DNA, 22 bp, Homo sapiens
acaaagatcttgctttcctact

SEQ ID NO: 8320255 - DNA, 22 bp, Homo sapiens
acaaagagggaccagtgacttg

SEQ ID NO: 8320256 - DNA, 22 bp, Homo sapiens
aagagagtcagtctgagcacca

SEQ ID NO: 8320257 - DNA, 22 bp, Homo sapiens
aagagagggacttattaaagtc

SEQ ID NO: 8320258 - DNA, 22 bp, Homo sapiens
aagagagggatttggtttattg

SEQ ID NO: 8320259 - DNA, 17 bp, Homo sapiens
aagagaggctgagctgg

SEQ ID NO: 8320260 - DNA, 17 bp, Homo sapiens
aagagaggctgagctgg

SEQ ID NO: 8320261 - DNA, 22 bp, Homo sapiens
aagcatttgtgaaattcagatg

SEQ ID NO: 8320262 - DNA, 22 bp, Homo sapiens
aagcatttctgtttatctatcg

SEQ ID NO: 8320263 - DNA, 22 bp, Homo sapiens
aagcatttatagataagaattt

SEQ ID NO: 8320264 - DNA, 22 bp, Homo sapiens
aagcatttcaatataatattca

SEQ ID NO: 8320265 - DNA, 22 bp, Homo sapiens
aagcagagtgatataaacatgg

SEQ ID NO: 8320266 - DNA, 22 bp, Homo sapiens
acacagtaggccaccatgtcat

SEQ ID NO: 8320267 - DNA, 22 bp, Homo sapiens
aagcacagtgccaagttctatt

SEQ ID NO: 8320268 - DNA, 22 bp, Homo sapiens
aagcacagtaaaagcagatttt

SEQ ID NO: 8320269 - DNA, 22 bp, Homo sapiens
aagatttctgcttttggaggca

SEQ ID NO: 8320270 - DNA, 22 bp, Homo sapiens
acacaggagaaaagatctccca

SEQ ID NO: 8320271 - DNA, 22 bp, Homo sapiens
agcacctccttagctatgacca

SEQ ID NO: 8320272 - DNA, 20 bp, Homo sapiens
agcacctcccatatgctaga

SEQ ID NO: 8320273 - DNA, 23 bp, Homo sapiens
agcaccattacagtttgattggg

SEQ ID NO: 8320274 - DNA, 22 bp, Homo sapiens
agcacccttcagcccagcctgg

SEQ ID NO: 8320275 - DNA, 22 bp, Homo sapiens
acaatttatccattgtatagtt

SEQ ID NO: 8320276 - DNA, 22 bp, Homo sapiens
acaatttatccattgtatagtt

SEQ ID NO: 8320277 - DNA, 22 bp, Homo sapiens
acacaggcatagccatacatgt

SEQ ID NO: 8320278 - DNA, 18 bp, Homo sapiens
agcagctttgacaggaaa

SEQ ID NO: 8320279 - DNA, 21 bp, Homo sapiens
agcagcttgagtctggagctc

SEQ ID NO: 8320280 - DNA, 22 bp, Homo sapiens
agcagggcccactaggggagat

SEQ ID NO: 8320281 - DNA, 22 bp, Homo sapiens
acaccaaagtagaattaatgta

SEQ ID NO: 8320282 - DNA, 22 bp, Homo sapiens
agcagggcagtgcttcagctct

SEQ ID NO: 8320283 - DNA, 22 bp, Homo sapiens
agcagtgttcaatgatacactg

SEQ ID NO: 8320284 - DNA, 22 bp, Homo sapiens
acagaaattgctaatagctcat

SEQ ID NO: 8320285 - DNA, 22 bp, Homo sapiens
acagaaattgggcaaatggaag

SEQ ID NO: 8320286 - DNA, 17 bp, Homo sapiens
agcctgccccatgctgc

SEQ ID NO: 8320287 - DNA, 22 bp, Homo sapiens
agctaggggaccaaggtggccc

SEQ ID NO: 8320288 - DNA, 17 bp, Homo sapiens
agctagggcctagaatc

SEQ ID NO: 8320289 - DNA, 22 bp, Homo sapiens
agctagggacagataccagcca

SEQ ID NO: 8320290 - DNA, 22 bp, Homo sapiens
agctcctgttctgagagcagga

SEQ ID NO: 8320291 - DNA, 22 bp, Homo sapiens
agctcctgttctgagagcagga

SEQ ID NO: 8320292 - DNA, 22 bp, Homo sapiens
agctctgggggaaagtctgctc

SEQ ID NO: 8320293 - DNA, 22 bp, Homo sapiens
agccccctccctagtgactgga

SEQ ID NO: 8320294 - DNA, 22 bp, Homo sapiens
agcccctgggagtagctgctgc

SEQ ID NO: 8320295 - DNA, 22 bp, Homo sapiens
agcccctgtaccctgagtgctt

SEQ ID NO: 8320296 - DNA, 22 bp, Homo sapiens
agcccctgctgggtgtagctca

SEQ ID NO: 8320297 - DNA, 22 bp, Homo sapiens
acagagtctgacaggtaggcgc

SEQ ID NO: 8320298 - DNA, 22 bp, Homo sapiens
acagataaagaaacaatcacag

SEQ ID NO: 8320299 - DNA, 22 bp, Homo sapiens
agcccagctttcacccctctgg

SEQ ID NO: 8320300 - DNA, 19 bp, Homo sapiens
agcccagcttatttgtcag

SEQ ID NO: 8320301 - DNA, 22 bp, Homo sapiens
agcccagcttccttctgtctct

SEQ ID NO: 8320302 - DNA, 22 bp, Homo sapiens
agcccagcggagcgggcccggg

SEQ ID NO: 8320303 - DNA, 22 bp, Homo sapiens
agcccagctgctatgtacctgg

SEQ ID NO: 8320304 - DNA, 22 bp, Homo sapiens
agcccagctgcctgcctgctgt

SEQ ID NO: 8320305 - DNA, 18 bp, Homo sapiens
agcccagcggagtgaatc

SEQ ID NO: 8320306 - DNA, 22 bp, Homo sapiens
agcccagctcctccacagaata

SEQ ID NO: 8320307 - DNA, 22 bp, Homo sapiens
agccacaggtgttggccagtgt

SEQ ID NO: 8320308 - DNA, 22 bp, Homo sapiens
agccacagtctgatgcctgaga

SEQ ID NO: 8320309 - DNA, 22 bp, Homo sapiens
agccatctctgaaatcaaagct

SEQ ID NO: 8320310 - DNA, 19 bp, Homo sapiens
agatggggaagagtgtgag

SEQ ID NO: 8320311 - DNA, 22 bp, Homo sapiens
agatggggcagaatggagccat

SEQ ID NO: 8320312 - DNA, 22 bp, Homo sapiens
agatggggcagaatggagccat

SEQ ID NO: 8320313 - DNA, 22 bp, Homo sapiens
agatggggctcagtgtggaggc

SEQ ID NO: 8320314 - DNA, 19 bp, Homo sapiens
agatggggaagagtgtgag

SEQ ID NO: 8320315 - DNA, 22 bp, Homo sapiens
acaagttctgggaattaggaca

SEQ ID NO: 8320316 - DNA, 22 bp, Homo sapiens
acaaggttcttagagctgggat

SEQ ID NO: 8320317 - DNA, 22 bp, Homo sapiens
acaaggttgattctggcatctg

SEQ ID NO: 8320318 - DNA, 22 bp, Homo sapiens
acaaggttctatggcgtctgtg

SEQ ID NO: 8320319 - DNA, 22 bp, Homo sapiens
acaagtctttttcatgtcttct

SEQ ID NO: 8320320 - DNA, 22 bp, Homo sapiens
acaagtcagtggaattaatatt

SEQ ID NO: 8320321 - DNA, 23 bp, Homo sapiens
acaagtgtttccaatatggctgg

SEQ ID NO: 8320322 - DNA, 22 bp, Homo sapiens
acaagtgttgcattttgccatt

SEQ ID NO: 8320323 - DNA, 22 bp, Homo sapiens
acaagctttgtgatagtagaga

SEQ ID NO: 8320324 - DNA, 22 bp, Homo sapiens
acaaggaacaagcatgtagttt

SEQ ID NO: 8320325 - DNA, 22 bp, Homo sapiens
acaaattatagaaaattgagct

SEQ ID NO: 8320326 - DNA, 21 bp, Homo sapiens
agcaaggcagcctctcagcct

SEQ ID NO: 8320327 - DNA, 22 bp, Homo sapiens
agatggggtttcatcatgttgg

SEQ ID NO: 8320328 - DNA, 22 bp, Homo sapiens
agatggggctgaaagttccaat

SEQ ID NO: 8320329 - DNA, 22 bp, Homo sapiens
agatggggctgaaagttccaat

SEQ ID NO: 8320330 - DNA, 22 bp, Homo sapiens
agatggggctcagtgtggaggc

SEQ ID NO: 8320331 - DNA, 22 bp, Homo sapiens
agcaagattgaggcttcctcag

SEQ ID NO: 8320332 - DNA, 22 bp, Homo sapiens
acaattagctgtgtgtctatct

SEQ ID NO: 8320333 - DNA, 20 bp, Homo sapiens
agaggccagttaggagtcta

SEQ ID NO: 8320334 - DNA, 22 bp, Homo sapiens
aattttctggtgtgtaatgaag

SEQ ID NO: 8320335 - DNA, 22 bp, Homo sapiens
agaggccccatgggatggcggt

SEQ ID NO: 8320336 - DNA, 22 bp, Homo sapiens
agaggccccaggtgagcatgcc

SEQ ID NO: 8320337 - DNA, 22 bp, Homo sapiens
agagctggggccagagtcaagg

SEQ ID NO: 8320338 - DNA, 22 bp, Homo sapiens
agagctggggccagagtcaagg

SEQ ID NO: 8320339 - DNA, 22 bp, Homo sapiens
agagctgggtgaagtgccatca

SEQ ID NO: 8320340 - DNA, 22 bp, Homo sapiens
agagctggggctctgggtttaa

SEQ ID NO: 8320341 - DNA, 22 bp, Homo sapiens
agagctgggtggtggtgactca

SEQ ID NO: 8320342 - DNA, 22 bp, Homo sapiens
aattttctaaggtgatgatctg

SEQ ID NO: 8320343 - DNA, 22 bp, Homo sapiens
aattttattagaaggcaagggg

SEQ ID NO: 8320344 - DNA, 22 bp, Homo sapiens
aattttattagaaggcaagggg

SEQ ID NO: 8320345 - DNA, 22 bp, Homo sapiens
aattttattaactggatgtagc

SEQ ID NO: 8320346 - DNA, 22 bp, Homo sapiens
aattttattaactggatgtagc

SEQ ID NO: 8320347 - DNA, 22 bp, Homo sapiens
aattttatgccttgcacgttgg

SEQ ID NO: 8320348 - DNA, 22 bp, Homo sapiens
aattttatgccttgcacgttgg

SEQ ID NO: 8320349 - DNA, 22 bp, Homo sapiens
acaaaattacctagttattttc

SEQ ID NO: 8320350 - DNA, 22 bp, Homo sapiens
acaaaattacctagttattttc

SEQ ID NO: 8320351 - DNA, 22 bp, Homo sapiens
acaaaattacctagttattttc

SEQ ID NO: 8320352 - DNA, 22 bp, Homo sapiens
acaaaattatgaagaggccttg

SEQ ID NO: 8320353 - DNA, 22 bp, Homo sapiens
acaaaatcaaaggagtgattca

SEQ ID NO: 8320354 - DNA, 22 bp, Homo sapiens
acaaaattgtgttaaactttat

SEQ ID NO: 8320355 - DNA, 22 bp, Homo sapiens
acaaaattgtgttaaactttat

SEQ ID NO: 8320356 - DNA, 22 bp, Homo sapiens
acaaaatttttagacaaggctt

SEQ ID NO: 8320357 - DNA, 22 bp, Homo sapiens
acaaacagagttgaaaaatagg

SEQ ID NO: 8320358 - DNA, 22 bp, Homo sapiens
acaaactaaaattctttattga

SEQ ID NO: 8320359 - DNA, 22 bp, Homo sapiens
acaaatgactcaaacaccactt

SEQ ID NO: 8320360 - DNA, 22 bp, Homo sapiens
acaaacttcccagacaagctcc

SEQ ID NO: 8320361 - DNA, 22 bp, Homo sapiens
acaaacttcccagacaagctcc

SEQ ID NO: 8320362 - DNA, 22 bp, Homo sapiens
acaaatgattttccaagccagt

SEQ ID NO: 8320363 - DNA, 22 bp, Homo sapiens
agacagggagggagcgcggctg

SEQ ID NO: 8320364 - DNA, 22 bp, Homo sapiens
agacagggccactcatcctcac

SEQ ID NO: 8320365 - DNA, 22 bp, Homo sapiens
aatgtctgctctactcaggagg

SEQ ID NO: 8320366 - DNA, 22 bp, Homo sapiens
aatgtctgtgccttaaaacttc

SEQ ID NO: 8320367 - DNA, 22 bp, Homo sapiens
aatgtcttcagtgtatacatgg

SEQ ID NO: 8320368 - DNA, 22 bp, Homo sapiens
agaaggggagaagctaccagga

SEQ ID NO: 8320369 - DNA, 21 bp, Homo sapiens
agacagagtgcagtctacata

SEQ ID NO: 8320370 - DNA, 22 bp, Homo sapiens
agacaggccactctggtctggt

SEQ ID NO: 8320371 - DNA, 22 bp, Homo sapiens
agacaggctgctgtctgctagg

SEQ ID NO: 8320372 - DNA, 22 bp, Homo sapiens
agacagactttgatctggatgt

SEQ ID NO: 8320373 - DNA, 22 bp, Homo sapiens
agacagagatactatgttgtca

SEQ ID NO: 8320374 - DNA, 22 bp, Homo sapiens
aatgttgatgttttcagtgagc

SEQ ID NO: 8320375 - DNA, 22 bp, Homo sapiens
aatgttgacagtggtgatctca

SEQ ID NO: 8320376 - DNA, 22 bp, Homo sapiens
agagctgggacttggactcaat

SEQ ID NO: 8320377 - DNA, 20 bp, Homo sapiens
aatttactcacagaatgaat

SEQ ID NO: 8320378 - DNA, 22 bp, Homo sapiens
aatttacagttgctgatggtac

SEQ ID NO: 8320379 - DNA, 22 bp, Homo sapiens
aatttacaggtgcactcgccat

SEQ ID NO: 8320380 - DNA, 22 bp, Homo sapiens
aatttacacttcatttggaggg

SEQ ID NO: 8320381 - DNA, 22 bp, Homo sapiens
aattatattgaagttgaatgtc

SEQ ID NO: 8320382 - DNA, 22 bp, Homo sapiens
aattatatgttaatcttcaatt

SEQ ID NO: 8320383 - DNA, 22 bp, Homo sapiens
aattatattgtggtgtgaatgt

SEQ ID NO: 8320384 - DNA, 22 bp, Homo sapiens
aaggcagaaagggatgtgagtg

SEQ ID NO: 8320385 - DNA, 22 bp, Homo sapiens
acagtataccattgtgactttg

SEQ ID NO: 8320386 - DNA, 22 bp, Homo sapiens
acagtataaactcctaaaagcc

SEQ ID NO: 8320387 - DNA, 22 bp, Homo sapiens
acagtagatggctcagagacag

SEQ ID NO: 8320388 - DNA, 22 bp, Homo sapiens
acagtagaaacaggcaggcaga

SEQ ID NO: 8320389 - DNA, 22 bp, Homo sapiens
acaggcagtgggccagatttgt

SEQ ID NO: 8320390 - DNA, 22 bp, Homo sapiens
acaggcattgggatggaggttg

SEQ ID NO: 8320391 - DNA, 22 bp, Homo sapiens
acaggcatatttctagattaca

SEQ ID NO: 8320392 - DNA, 22 bp, Homo sapiens
acagtacagctaatgtcattag

SEQ ID NO: 8320393 - DNA, 22 bp, Homo sapiens
aagggaaatcatatggtgcagt

SEQ ID NO: 8320394 - DNA, 22 bp, Homo sapiens
aaggcatagtctttaagttctg

SEQ ID NO: 8320395 - DNA, 22 bp, Homo sapiens
aaggcatatgctgtgtacagtt

SEQ ID NO: 8320396 - DNA, 22 bp, Homo sapiens
aaggcatatattctaaacagga

SEQ ID NO: 8320397 - DNA, 22 bp, Homo sapiens
acccccacggaaggccgtacgc

SEQ ID NO: 8320398 - DNA, 21 bp, Homo sapiens
acccccacacctccttagttc

SEQ ID NO: 8320399 - DNA, 23 bp, Homo sapiens
accccaggcatcgcattcctctt

SEQ ID NO: 8320400 - DNA, 22 bp, Homo sapiens
accatcttttcctctgcctcct

SEQ ID NO: 8320401 - DNA, 22 bp, Homo sapiens
aagtaacaggcatgtgaatgac

SEQ ID NO: 8320402 - DNA, 22 bp, Homo sapiens
aaggtctgtgaggctgtttgtc

SEQ ID NO: 8320403 - DNA, 22 bp, Homo sapiens
aatgaacaggtgaatgtcagat

SEQ ID NO: 8320404 - DNA, 22 bp, Homo sapiens
agaaatacaaagtactaagata

SEQ ID NO: 8320405 - DNA, 22 bp, Homo sapiens
agaaaacataggagacaggaaa

SEQ ID NO: 8320406 - DNA, 20 bp, Homo sapiens
aatgaggtcccactgaggag

SEQ ID NO: 8320407 - DNA, 22 bp, Homo sapiens
aatgaggtcattaatggtggga

SEQ ID NO: 8320408 - DNA, 22 bp, Homo sapiens
aatgaggttcgcagttgtttta

SEQ ID NO: 8320409 - DNA, 22 bp, Homo sapiens
aatgaggttggcataattaaat

SEQ ID NO: 8320410 - DNA, 22 bp, Homo sapiens
aatgaggttggcataattaaat

SEQ ID NO: 8320411 - DNA, 22 bp, Homo sapiens
aatgaggtgaggaaggcctcag

SEQ ID NO: 8320412 - DNA, 22 bp, Homo sapiens
aatgaggtacagggccttggaa

SEQ ID NO: 8320413 - DNA, 22 bp, Homo sapiens
aatgaggtgttgagaccagcac

SEQ ID NO: 8320414 - DNA, 20 bp, Homo sapiens
aatgagattccttatgatag

SEQ ID NO: 8320415 - DNA, 22 bp, Homo sapiens
aatgagatggaattcccgccta

SEQ ID NO: 8320416 - DNA, 22 bp, Homo sapiens
aatgaggttttttaaagccaga

SEQ ID NO: 8320417 - DNA, 22 bp, Homo sapiens
aatgagaagcctaggtgtactg

SEQ ID NO: 8320418 - DNA, 22 bp, Homo sapiens
aatgactctgctgcagagacac

SEQ ID NO: 8320419 - DNA, 22 bp, Homo sapiens
aatgaatgtttgttgagtgaag

SEQ ID NO: 8320420 - DNA, 22 bp, Homo sapiens
aatacaatcaaattcactagca

SEQ ID NO: 8320421 - DNA, 22 bp, Homo sapiens
aatacaatcaaattcactagca

SEQ ID NO: 8320422 - DNA, 22 bp, Homo sapiens
aatacagagaatgttatttgga

SEQ ID NO: 8320423 - DNA, 22 bp, Homo sapiens
acttgaattatatttctagaga

SEQ ID NO: 8320424 - DNA, 22 bp, Homo sapiens
acttgaattcaaagcgaaagca

SEQ ID NO: 8320425 - DNA, 22 bp, Homo sapiens
acttgaattaggccttgagaga

SEQ ID NO: 8320426 - DNA, 22 bp, Homo sapiens
acttgaataggtgtcaaggcca

SEQ ID NO: 8320427 - DNA, 22 bp, Homo sapiens
acttgaataggaaagccacaaa

SEQ ID NO: 8320428 - DNA, 22 bp, Homo sapiens
acttgaaaagctcagcagtagt

SEQ ID NO: 8320429 - DNA, 22 bp, Homo sapiens
aatatatttgaatcaggaacaa

SEQ ID NO: 8320430 - DNA, 22 bp, Homo sapiens
aatatttgttagtgttttaatg

SEQ ID NO: 8320431 - DNA, 22 bp, Homo sapiens
aatatatgagggagctatttga

SEQ ID NO: 8320432 - DNA, 22 bp, Homo sapiens
acttgaatttagtttttcctaa

SEQ ID NO: 8320433 - DNA, 22 bp, Homo sapiens
acttgaatttagtttttcctaa

SEQ ID NO: 8320434 - DNA, 22 bp, Homo sapiens
aatattttaggctttccaggct

SEQ ID NO: 8320435 - DNA, 22 bp, Homo sapiens
aatcccttcccttctctgggac

SEQ ID NO: 8320436 - DNA, 22 bp, Homo sapiens
aatcctgacctgggcatgcttg

SEQ ID NO: 8320437 - DNA, 22 bp, Homo sapiens
aagttcaaaaatgtaatcagtg

SEQ ID NO: 8320438 - DNA, 22 bp, Homo sapiens
aagttcaagagtgacatattag

SEQ ID NO: 8320439 - DNA, 22 bp, Homo sapiens
aagttacattttggtctaattg

SEQ ID NO: 8320440 - DNA, 22 bp, Homo sapiens
aagtcacagagttggaagtcag

SEQ ID NO: 8320441 - DNA, 22 bp, Homo sapiens
aagtggactaatacaaggacta

SEQ ID NO: 8320442 - DNA, 22 bp, Homo sapiens
aagtgcataataactcccaagt

SEQ ID NO: 8320443 - DNA, 22 bp, Homo sapiens
aagtgcatacactagttaattg

SEQ ID NO: 8320444 - DNA, 22 bp, Homo sapiens
aagtgcatagtaatggagtcaa

SEQ ID NO: 8320445 - DNA, 22 bp, Homo sapiens
aataatgttatgtcattcttct

SEQ ID NO: 8320446 - DNA, 22 bp, Homo sapiens
aataattagtgggacagagaac

SEQ ID NO: 8320447 - DNA, 22 bp, Homo sapiens
aataattagtgggacagagaac

SEQ ID NO: 8320448 - DNA, 22 bp, Homo sapiens
aataattttagctcagagttgt

SEQ ID NO: 8320449 - DNA, 22 bp, Homo sapiens
aataattatttgagagcagacc

SEQ ID NO: 8320450 - DNA, 22 bp, Homo sapiens
aataattatttgagagcagacc

SEQ ID NO: 8320451 - DNA, 22 bp, Homo sapiens
aataagatcctgaagatatgtt

SEQ ID NO: 8320452 - DNA, 22 bp, Homo sapiens
aagtttatgttctttgaaggca

SEQ ID NO: 8320453 - DNA, 22 bp, Homo sapiens
aagtttccactggcagtccgta

SEQ ID NO: 8320454 - DNA, 22 bp, Homo sapiens
aagtttcaagaggttctttgaa

SEQ ID NO: 8320455 - DNA, 22 bp, Homo sapiens
aagtttcaaatataaaattaca

SEQ ID NO: 8320456 - DNA, 22 bp, Homo sapiens
aataagatcctgaagatatgtt

SEQ ID NO: 8320457 - DNA, 22 bp, Homo sapiens
aataacttcagttcttacatta

SEQ ID NO: 8320458 - DNA, 22 bp, Homo sapiens
aataacttaagaaatttcccca

SEQ ID NO: 8320459 - DNA, 22 bp, Homo sapiens
aataagaatttacttgtcaaga

SEQ ID NO: 8320460 - DNA, 22 bp, Homo sapiens
ggctgcagttgtgtgaaggccg

SEQ ID NO: 8320461 - DNA, 22 bp, Homo sapiens
ggctgccacgtcgagggtccaa

SEQ ID NO: 8320462 - DNA, 22 bp, Homo sapiens
ggctgccagcactggtgtagag

SEQ ID NO: 8320463 - DNA, 22 bp, Homo sapiens
ggctgccaggagaagctcagtg

SEQ ID NO: 8320464 - DNA, 22 bp, Homo sapiens
ggctgcctctatttaggatcaa

SEQ ID NO: 8320465 - DNA, 19 bp, Homo sapiens
ggctgcctcctgggagatt

SEQ ID NO: 8320466 - DNA, 22 bp, Homo sapiens
ggctgcctcctgctgggctgga

SEQ ID NO: 8320467 - DNA, 22 bp, Homo sapiens
ggctgcctcagatttgctgact

SEQ ID NO: 8320468 - DNA, 22 bp, Homo sapiens
ggctgcctcctcgagacaggat

SEQ ID NO: 8320469 - DNA, 22 bp, Homo sapiens
ggctgcaggcttccctccagca

SEQ ID NO: 8320470 - DNA, 21 bp, Homo sapiens
ggctgcagggagccctggggt

SEQ ID NO: 8320471 - DNA, 22 bp, Homo sapiens
ggctgcaggcttccctccagca

SEQ ID NO: 8320472 - DNA, 22 bp, Homo sapiens
ggctgcaggcttccctccagca

SEQ ID NO: 8320473 - DNA, 21 bp, Homo sapiens
ggctgcagggagccctggggt

SEQ ID NO: 8320474 - DNA, 17 bp, Homo sapiens
ggctgcagtccaggagg

SEQ ID NO: 8320475 - DNA, 17 bp, Homo sapiens
ggctgcagtccaggagg

SEQ ID NO: 8320476 - DNA, 20 bp, Homo sapiens
ggctgcagtgcacctcatct

SEQ ID NO: 8320477 - DNA, 20 bp, Homo sapiens
ggctgcagtgcacctcatct

SEQ ID NO: 8320478 - DNA, 17 bp, Homo sapiens
ggctgcagtccaggagg

SEQ ID NO: 8320479 - DNA, 22 bp, Homo sapiens
ggctgcagggcagctggtgtgg

SEQ ID NO: 8320480 - DNA, 22 bp, Homo sapiens
ggctgcaggttggttggcagct

SEQ ID NO: 8320481 - DNA, 22 bp, Homo sapiens
ggctggagtgggctccagagtt

SEQ ID NO: 8320482 - DNA, 17 bp, Homo sapiens
ggctggaggggacccgg

SEQ ID NO: 8320483 - DNA, 19 bp, Homo sapiens
ggctggagtggccatctgt

SEQ ID NO: 8320484 - DNA, 22 bp, Homo sapiens
ggctggcagtgtgagagaggga

SEQ ID NO: 8320485 - DNA, 22 bp, Homo sapiens
ggctggcagcttcatcccagat

SEQ ID NO: 8320486 - DNA, 22 bp, Homo sapiens
ggctggcagaagtgtgctggct

SEQ ID NO: 8320487 - DNA, 22 bp, Homo sapiens
ggctggcagaagtgtgctggct

SEQ ID NO: 8320488 - DNA, 22 bp, Homo sapiens
ggctggcagaggggagtctgtg

SEQ ID NO: 8320489 - DNA, 22 bp, Homo sapiens
ggctggcagaggggagtctgtg

SEQ ID NO: 8320490 - DNA, 17 bp, Homo sapiens
ggctggagcagctcccc

SEQ ID NO: 8320491 - DNA, 22 bp, Homo sapiens
ggctgcctgaactttggggaaa

SEQ ID NO: 8320492 - DNA, 22 bp, Homo sapiens
ggctgcctgaggctgaggcccg

SEQ ID NO: 8320493 - DNA, 18 bp, Homo sapiens
ggctgtgcgtggaggctg

SEQ ID NO: 8320494 - DNA, 18 bp, Homo sapiens
ggctgtgcgtggaggctg

SEQ ID NO: 8320495 - DNA, 22 bp, Homo sapiens
ggctgtgctgagggggaagccc

SEQ ID NO: 8320496 - DNA, 22 bp, Homo sapiens
ggctgtggacactgagctcaga

SEQ ID NO: 8320497 - DNA, 22 bp, Homo sapiens
ggctgtggacactgagctcaga

SEQ ID NO: 8320498 - DNA, 22 bp, Homo sapiens
ggctgtggcagctggaagtggt

SEQ ID NO: 8320499 - DNA, 22 bp, Homo sapiens
ggctgtggcagctggaagtggt

SEQ ID NO: 8320500 - DNA, 22 bp, Homo sapiens
ggctgtggcattaggtgaggcc

SEQ ID NO: 8320501 - DNA, 22 bp, Homo sapiens
ggctgtggtcattaggaggttg

SEQ ID NO: 8320502 - DNA, 22 bp, Homo sapiens
ggctgtggccagcggggctgag

SEQ ID NO: 8320503 - DNA, 22 bp, Homo sapiens
ggctgtggccagcggggctgag

SEQ ID NO: 8320504 - DNA, 23 bp, Homo sapiens
gggagccatgggtggtcatggag

SEQ ID NO: 8320505 - DNA, 22 bp, Homo sapiens
gggagccatgctggtcttcttt

SEQ ID NO: 8320506 - DNA, 22 bp, Homo sapiens
gggagccatgctggtcttcttt

SEQ ID NO: 8320507 - DNA, 22 bp, Homo sapiens
gggagccagcctttgcctataa

SEQ ID NO: 8320508 - DNA, 19 bp, Homo sapiens
gggagccagaccctttgct

SEQ ID NO: 8320509 - DNA, 22 bp, Homo sapiens
gggagccagcagggcatggagc

SEQ ID NO: 8320510 - DNA, 22 bp, Homo sapiens
gggagatgactcagtgacctcg

SEQ ID NO: 8320511 - DNA, 22 bp, Homo sapiens
gggaaggccggtccagtcaggt

SEQ ID NO: 8320512 - DNA, 22 bp, Homo sapiens
gggaaggcatacctgagggaga

SEQ ID NO: 8320513 - DNA, 22 bp, Homo sapiens
gggaaggcagtgggaggaactg

SEQ ID NO: 8320514 - DNA, 22 bp, Homo sapiens
gggaaggcagtgggaggaactg

SEQ ID NO: 8320515 - DNA, 22 bp, Homo sapiens
gggaaggcagtgtctggttgaa

SEQ ID NO: 8320516 - DNA, 22 bp, Homo sapiens
gggaaggcaggattctctggtg

SEQ ID NO: 8320517 - DNA, 22 bp, Homo sapiens
gggaaggcaggcctctgttgga

SEQ ID NO: 8320518 - DNA, 22 bp, Homo sapiens
gggaaggcaccatggtgttcca

SEQ ID NO: 8320519 - DNA, 22 bp, Homo sapiens
gggaaggcaccatggtgttcca

SEQ ID NO: 8320520 - DNA, 22 bp, Homo sapiens
gggagtgggtttggcctaggcc

SEQ ID NO: 8320521 - DNA, 20 bp, Homo sapiens
gggagtggtggtagcctgtg

SEQ ID NO: 8320522 - DNA, 20 bp, Homo sapiens
gggagtggtggtagcctgtg

SEQ ID NO: 8320523 - DNA, 22 bp, Homo sapiens
gggataggagattgggagtgtt

SEQ ID NO: 8320524 - DNA, 19 bp, Homo sapiens
gggatcagcccagggctct

SEQ ID NO: 8320525 - DNA, 22 bp, Homo sapiens
gggagtggattatgtggaccca

SEQ ID NO: 8320526 - DNA, 22 bp, Homo sapiens
gggagtggattatgtggaccca

SEQ ID NO: 8320527 - DNA, 22 bp, Homo sapiens
gggagctgaatggcaatggaga

SEQ ID NO: 8320528 - DNA, 22 bp, Homo sapiens
gggagtcagagaggtaatggga

SEQ ID NO: 8320529 - DNA, 22 bp, Homo sapiens
gggagcgggactgcgcaggctt

SEQ ID NO: 8320530 - DNA, 22 bp, Homo sapiens
gggagcgggactgcgcaggctt

SEQ ID NO: 8320531 - DNA, 22 bp, Homo sapiens
gggagctgaaggagccggcggg

SEQ ID NO: 8320532 - DNA, 22 bp, Homo sapiens
gggagctgaaggagccggcggg

SEQ ID NO: 8320533 - DNA, 17 bp, Homo sapiens
gggcagggactcctggg

SEQ ID NO: 8320534 - DNA, 22 bp, Homo sapiens
gggcagaggctctggcccatcc

SEQ ID NO: 8320535 - DNA, 20 bp, Homo sapiens
gggcagagccagccagtccc

SEQ ID NO: 8320536 - DNA, 20 bp, Homo sapiens
gggcagagccagccagtccc

SEQ ID NO: 8320537 - DNA, 22 bp, Homo sapiens
gggcagagagctggaactcctt

SEQ ID NO: 8320538 - DNA, 22 bp, Homo sapiens
gggcccaggcctccttccttcc

SEQ ID NO: 8320539 - DNA, 22 bp, Homo sapiens
gggcccagtaccctctgccaag

SEQ ID NO: 8320540 - DNA, 22 bp, Homo sapiens
gggcccagtaccctctgccaag

SEQ ID NO: 8320541 - DNA, 22 bp, Homo sapiens
gggccccttgctgctctgctgg

SEQ ID NO: 8320542 - DNA, 22 bp, Homo sapiens
gggccctctgcagctgcccagg

SEQ ID NO: 8320543 - DNA, 22 bp, Homo sapiens
gggccctcagtcccaggccttc

SEQ ID NO: 8320544 - DNA, 22 bp, Homo sapiens
gggccctgcctaaggaacacac

SEQ ID NO: 8320545 - DNA, 22 bp, Homo sapiens
gggctcagaggagtggcctggg

SEQ ID NO: 8320546 - DNA, 21 bp, Homo sapiens
gggctcagtggaaaagagtgt

SEQ ID NO: 8320547 - DNA, 22 bp, Homo sapiens
gggctccaactacatcagcctt

SEQ ID NO: 8320548 - DNA, 22 bp, Homo sapiens
ggctctgcatgcaggttgtcag

SEQ ID NO: 8320549 - DNA, 22 bp, Homo sapiens
ggctctgccatttcctagctgc

SEQ ID NO: 8320550 - DNA, 22 bp, Homo sapiens
ggctcagagacctgcgatctga

SEQ ID NO: 8320551 - DNA, 22 bp, Homo sapiens
ggctcagcaatgatgagcccct

SEQ ID NO: 8320552 - DNA, 22 bp, Homo sapiens
ggctcagattccgagtggccct

SEQ ID NO: 8320553 - DNA, 22 bp, Homo sapiens
ggcccatccatgctgctggtct

SEQ ID NO: 8320554 - DNA, 22 bp, Homo sapiens
ggcccagtgtaccccaggcagt

SEQ ID NO: 8320555 - DNA, 22 bp, Homo sapiens
ggcccaggtccagcgagtacct

SEQ ID NO: 8320556 - DNA, 20 bp, Homo sapiens
ggcccagtgaaccaggacgg

SEQ ID NO: 8320557 - DNA, 22 bp, Homo sapiens
ggcccagtgctgttcacccagt

SEQ ID NO: 8320558 - DNA, 22 bp, Homo sapiens
ggcccagctgtgcttccagccc

SEQ ID NO: 8320559 - DNA, 22 bp, Homo sapiens
ggcccagctttcattccttgct

SEQ ID NO: 8320560 - DNA, 22 bp, Homo sapiens
ggcccagctgtatattacagtt

SEQ ID NO: 8320561 - DNA, 22 bp, Homo sapiens
ggcccagctgggcggggacacg

SEQ ID NO: 8320562 - DNA, 22 bp, Homo sapiens
ggcccagctctattgaattaca

SEQ ID NO: 8320563 - DNA, 22 bp, Homo sapiens
ggccacagcagatgcttcagat

SEQ ID NO: 8320564 - DNA, 22 bp, Homo sapiens
ggccaccaaagtcctgtggctt

SEQ ID NO: 8320565 - DNA, 22 bp, Homo sapiens
ggccacatgaattcttggacag

SEQ ID NO: 8320566 - DNA, 21 bp, Homo sapiens
ggccacagttagggctcagga

SEQ ID NO: 8320567 - DNA, 22 bp, Homo sapiens
ggcagctcacctctggtccagg

SEQ ID NO: 8320568 - DNA, 22 bp, Homo sapiens
ggcagctcacgggcatggggtg

SEQ ID NO: 8320569 - DNA, 22 bp, Homo sapiens
ggcaggctttcagcatcaagtc

SEQ ID NO: 8320570 - DNA, 22 bp, Homo sapiens
ggcagggccctgattcctgggg

SEQ ID NO: 8320571 - DNA, 22 bp, Homo sapiens
ggcagggcttgtctctgtgatg

SEQ ID NO: 8320572 - DNA, 22 bp, Homo sapiens
ggaggatgagctacgaggagct

SEQ ID NO: 8320573 - DNA, 22 bp, Homo sapiens
ggaggaggggtgactgaatgct

SEQ ID NO: 8320574 - DNA, 22 bp, Homo sapiens
ggaggaggggtttacattggaa

SEQ ID NO: 8320575 - DNA, 22 bp, Homo sapiens
ggaggaggggtttacattggaa

SEQ ID NO: 8320576 - DNA, 22 bp, Homo sapiens
ggcagcactgcagcttgttggg

SEQ ID NO: 8320577 - DNA, 22 bp, Homo sapiens
gtctttttattatagagtggag

SEQ ID NO: 8320578 - DNA, 22 bp, Homo sapiens
gtctttttgtctggcagaggtc

SEQ ID NO: 8320579 - DNA, 22 bp, Homo sapiens
gtgaaaaatcatcatgacttga

SEQ ID NO: 8320580 - DNA, 22 bp, Homo sapiens
gtgaaaaatgatttgttaactg

SEQ ID NO: 8320581 - DNA, 22 bp, Homo sapiens
gtctttggatgtaagataaagt

SEQ ID NO: 8320582 - DNA, 22 bp, Homo sapiens
gtgagctgggtgaatggtaggg

SEQ ID NO: 8320583 - DNA, 22 bp, Homo sapiens
gtgagctggaatagtggagaaa

SEQ ID NO: 8320584 - DNA, 22 bp, Homo sapiens
gtgagcatatatgtaatcgttt

SEQ ID NO: 8320585 - DNA, 22 bp, Homo sapiens
gtgagctgttttggacccatct

SEQ ID NO: 8320586 - DNA, 22 bp, Homo sapiens
gtcttggccgtgcagatgaaga

SEQ ID NO: 8320587 - DNA, 22 bp, Homo sapiens
gtcttggcatattttcaccaag

SEQ ID NO: 8320588 - DNA, 21 bp, Homo sapiens
gtcttggcaccaggagagaga

SEQ ID NO: 8320589 - DNA, 19 bp, Homo sapiens
gtcttggctctcaaccatc

SEQ ID NO: 8320590 - DNA, 22 bp, Homo sapiens
gtcttgttggagttcttgcagc

SEQ ID NO: 8320591 - DNA, 22 bp, Homo sapiens
gtgccagcctggtgcgcctggg

SEQ ID NO: 8320592 - DNA, 22 bp, Homo sapiens
gtgccagccgcaccccaggaga

SEQ ID NO: 8320593 - DNA, 22 bp, Homo sapiens
gtgccagggagtggaggagctt

SEQ ID NO: 8320594 - DNA, 22 bp, Homo sapiens
gtgccaggcccagggagcgggg

SEQ ID NO: 8320595 - DNA, 22 bp, Homo sapiens
gtgccaggtgctaagctgtgct

SEQ ID NO: 8320596 - DNA, 22 bp, Homo sapiens
gtgcccagcagcagcgtccccg

SEQ ID NO: 8320597 - DNA, 22 bp, Homo sapiens
gtgcccagctccacctcacaga

SEQ ID NO: 8320598 - DNA, 22 bp, Homo sapiens
gtgcccagctccacctcacaga

SEQ ID NO: 8320599 - DNA, 22 bp, Homo sapiens
gtgctgccggcatagcagtgaa

SEQ ID NO: 8320600 - DNA, 22 bp, Homo sapiens
gtgctgcctccatatccgtcag

SEQ ID NO: 8320601 - DNA, 22 bp, Homo sapiens
gtgctggccctgtcctcgagct

SEQ ID NO: 8320602 - DNA, 22 bp, Homo sapiens
gtgctgcagggtcagcaccctc

SEQ ID NO: 8320603 - DNA, 23 bp, Homo sapiens
gtgctgcaaaatcggccactgca

SEQ ID NO: 8320604 - DNA, 22 bp, Homo sapiens
gtgcagggagcccagaaggtcc

SEQ ID NO: 8320605 - DNA, 22 bp, Homo sapiens
gtgcagggagcccagaaggtcc

SEQ ID NO: 8320606 - DNA, 22 bp, Homo sapiens
gtgcaggcattgggctagccat

SEQ ID NO: 8320607 - DNA, 17 bp, Homo sapiens
gtgcagggatgaaggat

SEQ ID NO: 8320608 - DNA, 17 bp, Homo sapiens
gtgcagggatgaaggat

SEQ ID NO: 8320609 - DNA, 22 bp, Homo sapiens
gtgcagggcagccgaatgggct

SEQ ID NO: 8320610 - DNA, 22 bp, Homo sapiens
gtgcagggcagccgaatgggct

SEQ ID NO: 8320611 - DNA, 22 bp, Homo sapiens
gtgcagggcagccgaatgggct

SEQ ID NO: 8320612 - DNA, 22 bp, Homo sapiens
gtgcaggggatcaggttgcagc

SEQ ID NO: 8320613 - DNA, 20 bp, Homo sapiens
gtcagaggaccctagagcga

SEQ ID NO: 8320614 - DNA, 22 bp, Homo sapiens
gtcagaggaatggatgagtgat

SEQ ID NO: 8320615 - DNA, 22 bp, Homo sapiens
gtcagaggaggctgagtaggaa

SEQ ID NO: 8320616 - DNA, 22 bp, Homo sapiens
gtccagcccgggctccgccagc

SEQ ID NO: 8320617 - DNA, 22 bp, Homo sapiens
gtccagcccgggctccgccagc

SEQ ID NO: 8320618 - DNA, 22 bp, Homo sapiens
gtccagccctctgcctccaggt

SEQ ID NO: 8320619 - DNA, 22 bp, Homo sapiens
gtccagcccctgactcccaggc

SEQ ID NO: 8320620 - DNA, 22 bp, Homo sapiens
gtcactgtatccaggttccagc

SEQ ID NO: 8320621 - DNA, 22 bp, Homo sapiens
gtcactgtatccaggttccagc

SEQ ID NO: 8320622 - DNA, 22 bp, Homo sapiens
gtcactgtgctaggtgctgaat

SEQ ID NO: 8320623 - DNA, 18 bp, Homo sapiens
gtcactgtgtttctgagc

SEQ ID NO: 8320624 - DNA, 18 bp, Homo sapiens
gtcactgtgtttctgagc

SEQ ID NO: 8320625 - DNA, 22 bp, Homo sapiens
gtcctctgtagggctgggccac

SEQ ID NO: 8320626 - DNA, 22 bp, Homo sapiens
gtcctgcacatggagggcaatg

SEQ ID NO: 8320627 - DNA, 22 bp, Homo sapiens
gtcctgctctggcccaggtttg

SEQ ID NO: 8320628 - DNA, 22 bp, Homo sapiens
gtcctggcccactggcaggctg

SEQ ID NO: 8320629 - DNA, 22 bp, Homo sapiens
gtcctgggaactggacagctaa

SEQ ID NO: 8320630 - DNA, 22 bp, Homo sapiens
gtattttatggcatgcagtggc

SEQ ID NO: 8320631 - DNA, 22 bp, Homo sapiens
gtattttatggcctggggccta

SEQ ID NO: 8320632 - DNA, 22 bp, Homo sapiens
gtattttatggcctggggccta

SEQ ID NO: 8320633 - DNA, 22 bp, Homo sapiens
gtatttttaggtaaggaaagta

SEQ ID NO: 8320634 - DNA, 22 bp, Homo sapiens
gtatttttaggtaaggaaagta

SEQ ID NO: 8320635 - DNA, 22 bp, Homo sapiens
gtatacagatacttagacgtgc

SEQ ID NO: 8320636 - DNA, 22 bp, Homo sapiens
gtcaaataattttctcaatagt

SEQ ID NO: 8320637 - DNA, 22 bp, Homo sapiens
gtcaaatatatgcaaaactatt

SEQ ID NO: 8320638 - DNA, 22 bp, Homo sapiens
gtcaaatattatgcagcttgga

SEQ ID NO: 8320639 - DNA, 22 bp, Homo sapiens
gtcaaatatactaagaggtaaa

SEQ ID NO: 8320640 - DNA, 22 bp, Homo sapiens
gtatttttagtagagtcggggt

SEQ ID NO: 8320641 - DNA, 22 bp, Homo sapiens
gtagtattttctgtgatgtagg

SEQ ID NO: 8320642 - DNA, 22 bp, Homo sapiens
gtaggtcagacataagaggaca

SEQ ID NO: 8320643 - DNA, 22 bp, Homo sapiens
gtacaataactagtcttatagt

SEQ ID NO: 8320644 - DNA, 22 bp, Homo sapiens
gtacaaaagttattgcggtttt

SEQ ID NO: 8320645 - DNA, 22 bp, Homo sapiens
gtacaaaagttattgcggtttt

SEQ ID NO: 8320646 - DNA, 22 bp, Homo sapiens
gtacaacatgattttactctct

SEQ ID NO: 8320647 - DNA, 22 bp, Homo sapiens
ggtcccagctggtcactgtcag

SEQ ID NO: 8320648 - DNA, 22 bp, Homo sapiens
gggttggatcctggtggctgcc

SEQ ID NO: 8320649 - DNA, 22 bp, Homo sapiens
gggttggattacttagggagaa

SEQ ID NO: 8320650 - DNA, 22 bp, Homo sapiens
ggtcccagtcctctccctgcta

SEQ ID NO: 8320651 - DNA, 23 bp, Homo sapiens
ggtcccagtggagaggcctcacc

SEQ ID NO: 8320652 - DNA, 20 bp, Homo sapiens
ggtccctgccctctgtcatc

SEQ ID NO: 8320653 - DNA, 22 bp, Homo sapiens
ggtccctgcccaaagcccttgg

SEQ ID NO: 8320654 - DNA, 22 bp, Homo sapiens
ggtccccgtggaggctggagcg

SEQ ID NO: 8320655 - DNA, 22 bp, Homo sapiens
ggtccccgtggaggctggagcg

SEQ ID NO: 8320656 - DNA, 18 bp, Homo sapiens
ggtgagggagctggaagc

SEQ ID NO: 8320657 - DNA, 22 bp, Homo sapiens
ggtgagggacatcactcagcca

SEQ ID NO: 8320658 - DNA, 22 bp, Homo sapiens
ggtgaggctaagtgacacaggg

SEQ ID NO: 8320659 - DNA, 22 bp, Homo sapiens
ggtgaggcctgtacaaagctgc

SEQ ID NO: 8320660 - DNA, 22 bp, Homo sapiens
ggtgagggagtggaacgaggtg

SEQ ID NO: 8320661 - DNA, 21 bp, Homo sapiens
ggtgctcgctgatgaggagtg

SEQ ID NO: 8320662 - DNA, 22 bp, Homo sapiens
ggtggacaaatgaatgactgaa

SEQ ID NO: 8320663 - DNA, 22 bp, Homo sapiens
ggtccctggaaggcactagtga

SEQ ID NO: 8320664 - DNA, 22 bp, Homo sapiens
ggtgagcaaagcttcatctgta

SEQ ID NO: 8320665 - DNA, 22 bp, Homo sapiens
ggtgacagcgggtcaagaggag

SEQ ID NO: 8320666 - DNA, 23 bp, Homo sapiens
ggtggtgctcatatctcaggcct

SEQ ID NO: 8320667 - DNA, 21 bp, Homo sapiens
ggttacaacagttaaacagag

SEQ ID NO: 8320668 - DNA, 22 bp, Homo sapiens
ggtggtgggagagctttctgga

SEQ ID NO: 8320669 - DNA, 22 bp, Homo sapiens
ggttcacactttcatgatttca

SEQ ID NO: 8320670 - DNA, 22 bp, Homo sapiens
ggttcacatattgagagtattc

SEQ ID NO: 8320671 - DNA, 22 bp, Homo sapiens
ggttagagggcatgcgatcttt

SEQ ID NO: 8320672 - DNA, 22 bp, Homo sapiens
ggttggggcgagctggaggccc

SEQ ID NO: 8320673 - DNA, 22 bp, Homo sapiens
gtaattgtcttgaattcacaac

SEQ ID NO: 8320674 - DNA, 22 bp, Homo sapiens
gtaattttggagtataacctgg

SEQ ID NO: 8320675 - DNA, 22 bp, Homo sapiens
ggtttaaaagccatgcatgggg

SEQ ID NO: 8320676 - DNA, 22 bp, Homo sapiens
ggtgggccacggcataacgggc

SEQ ID NO: 8320677 - DNA, 22 bp, Homo sapiens
ggtgggccaggaaggccgccag

SEQ ID NO: 8320678 - DNA, 22 bp, Homo sapiens
ggggtggccaaggactctgacc

SEQ ID NO: 8320679 - DNA, 22 bp, Homo sapiens
ggggtggccctaccctctggaa

SEQ ID NO: 8320680 - DNA, 22 bp, Homo sapiens
ggggtggatttcaggcggtgtc

SEQ ID NO: 8320681 - DNA, 22 bp, Homo sapiens
ggggtggagctaaatgtctact

SEQ ID NO: 8320682 - DNA, 22 bp, Homo sapiens
ggggtgctgaagatgtcatggt

SEQ ID NO: 8320683 - DNA, 22 bp, Homo sapiens
ggggtgctagagtggggccact

SEQ ID NO: 8320684 - DNA, 22 bp, Homo sapiens
ggggtgggagtgccatccttga

SEQ ID NO: 8320685 - DNA, 22 bp, Homo sapiens
ggggtggctggcacctcctggt

SEQ ID NO: 8320686 - DNA, 19 bp, Homo sapiens
ggggtggctggggctccag

SEQ ID NO: 8320687 - DNA, 19 bp, Homo sapiens
ggggtggctggggctccag

SEQ ID NO: 8320688 - DNA, 22 bp, Homo sapiens
ggggtggcctgtaggcagcatg

SEQ ID NO: 8320689 - DNA, 22 bp, Homo sapiens
ggggccagtaggagtgatgtac

SEQ ID NO: 8320690 - DNA, 22 bp, Homo sapiens
ggggccaggtccagcttccaaa

SEQ ID NO: 8320691 - DNA, 22 bp, Homo sapiens
ggggccagcaatgttgaggaat

SEQ ID NO: 8320692 - DNA, 22 bp, Homo sapiens
ggggccagcactgtgcctttgt

SEQ ID NO: 8320693 - DNA, 22 bp, Homo sapiens
ggggcccagggcagcagtgcag

SEQ ID NO: 8320694 - DNA, 22 bp, Homo sapiens
ggggcccctgtggcttgatgcc

SEQ ID NO: 8320695 - DNA, 22 bp, Homo sapiens
ggggtagggcgattgctgcttt

SEQ ID NO: 8320696 - DNA, 22 bp, Homo sapiens
ggggtgagttagcgtcggcttg

SEQ ID NO: 8320697 - DNA, 22 bp, Homo sapiens
ggggtgagtgctcagccccgga

SEQ ID NO: 8320698 - DNA, 21 bp, Homo sapiens
gggtgctgtggtcatgcagga

SEQ ID NO: 8320699 - DNA, 22 bp, Homo sapiens
gggtggaagccagagaggtcat

SEQ ID NO: 8320700 - DNA, 22 bp, Homo sapiens
gggtgctgggaggctgacatct

SEQ ID NO: 8320701 - DNA, 22 bp, Homo sapiens
gggtgcaggcagcccaggcagg

SEQ ID NO: 8320702 - DNA, 18 bp, Homo sapiens
gggtgcaggcactgactg

SEQ ID NO: 8320703 - DNA, 22 bp, Homo sapiens
gggtgcagctttgaaagcatgt

SEQ ID NO: 8320704 - DNA, 18 bp, Homo sapiens
gggtgcaggcactgactg

SEQ ID NO: 8320705 - DNA, 22 bp, Homo sapiens
gggtgaggccttgctgccatca

SEQ ID NO: 8320706 - DNA, 22 bp, Homo sapiens
gggtgaggccttgctgccatca

SEQ ID NO: 8320707 - DNA, 22 bp, Homo sapiens
gggtgcagcagagctcctctgt

SEQ ID NO: 8320708 - DNA, 22 bp, Homo sapiens
gggtgaggagctgccagtcatg

SEQ ID NO: 8320709 - DNA, 22 bp, Homo sapiens
gggtggagaggctaagtccagt

SEQ ID NO: 8320710 - DNA, 22 bp, Homo sapiens
gggtggaattgttggcatcgga

SEQ ID NO: 8320711 - DNA, 22 bp, Homo sapiens
gggtggtgagatgtagctgatg

SEQ ID NO: 8320712 - DNA, 22 bp, Homo sapiens
ggggagtgacgcagggccatag

SEQ ID NO: 8320713 - DNA, 22 bp, Homo sapiens
ggggagtgacgcagggccatag

SEQ ID NO: 8320714 - DNA, 21 bp, Homo sapiens
ggggcatcaagacagagttag

SEQ ID NO: 8320715 - DNA, 22 bp, Homo sapiens
ggggaggctgatgtgggcaaag

SEQ ID NO: 8320716 - DNA, 22 bp, Homo sapiens
ggggaggcaagatgaagtgagg

SEQ ID NO: 8320717 - DNA, 22 bp, Homo sapiens
ggggaggccagtggaccgtccc

SEQ ID NO: 8320718 - DNA, 22 bp, Homo sapiens
ggggaggagtgtacaggtttat

SEQ ID NO: 8320719 - DNA, 22 bp, Homo sapiens
gggcttctgtacctacctggaa

SEQ ID NO: 8320720 - DNA, 22 bp, Homo sapiens
gggcttctgttcctttcacttg

SEQ ID NO: 8320721 - DNA, 22 bp, Homo sapiens
gggcttctacttgcaaaggata

SEQ ID NO: 8320722 - DNA, 22 bp, Homo sapiens
gggcttctaagtgaaagtgtaa

SEQ ID NO: 8320723 - DNA, 22 bp, Homo sapiens
gggcttctctttagtgagctga

SEQ ID NO: 8320724 - DNA, 22 bp, Homo sapiens
gggcttctgggcaccactccct

SEQ ID NO: 8320725 - DNA, 22 bp, Homo sapiens
gggcttctctgggagtcctggt

SEQ ID NO: 8320726 - DNA, 22 bp, Homo sapiens
gggcttctctcaggggcatgag

SEQ ID NO: 8320727 - DNA, 22 bp, Homo sapiens
gggcttctctgatcaatatttc

SEQ ID NO: 8320728 - DNA, 22 bp, Homo sapiens
gggcttctctcagaaactatca

SEQ ID NO: 8320729 - DNA, 22 bp, Homo sapiens
gggcttctattctggcacaaga

SEQ ID NO: 8320730 - DNA, 18 bp, Homo sapiens
gggctctggcatctgggt

SEQ ID NO: 8320731 - DNA, 22 bp, Homo sapiens
gggctctgggattcagagcaag

SEQ ID NO: 8320732 - DNA, 18 bp, Homo sapiens
gggctgtgttcatgccca

SEQ ID NO: 8320733 - DNA, 22 bp, Homo sapiens
gggctgtgtgcccacttcccat

SEQ ID NO: 8320734 - DNA, 22 bp, Homo sapiens
gctagcctgcagtggctatggt

SEQ ID NO: 8320735 - DNA, 22 bp, Homo sapiens
gctagaaaatgaaagataattt

SEQ ID NO: 8320736 - DNA, 22 bp, Homo sapiens
gcctggagtggtcctgctgccc

SEQ ID NO: 8320737 - DNA, 22 bp, Homo sapiens
gcctggagtggtcctgctgccc

SEQ ID NO: 8320738 - DNA, 22 bp, Homo sapiens
gctcccagactgaccagaggtg

SEQ ID NO: 8320739 - DNA, 22 bp, Homo sapiens
gctcccagatttcagccttgtg

SEQ ID NO: 8320740 - DNA, 22 bp, Homo sapiens
gctcccagcaattgaggcagcc

SEQ ID NO: 8320741 - DNA, 23 bp, Homo sapiens
gctcatcaggcttagagtcaagg

SEQ ID NO: 8320742 - DNA, 20 bp, Homo sapiens
gctcagtggagaaatgcacc

SEQ ID NO: 8320743 - DNA, 22 bp, Homo sapiens
gctcagtgaatttttgcccatg

SEQ ID NO: 8320744 - DNA, 22 bp, Homo sapiens
gctcagggccatggaccagcag

SEQ ID NO: 8320745 - DNA, 22 bp, Homo sapiens
gctcagggagagagggcagccg

SEQ ID NO: 8320746 - DNA, 22 bp, Homo sapiens
gctctctgggtggtgggcaaca

SEQ ID NO: 8320747 - DNA, 22 bp, Homo sapiens
gctctctgggcgggagctaaga

SEQ ID NO: 8320748 - DNA, 22 bp, Homo sapiens
gctctctggctagtccatcggg

SEQ ID NO: 8320749 - DNA, 22 bp, Homo sapiens
gctctctgggtgtgtctagata

SEQ ID NO: 8320750 - DNA, 22 bp, Homo sapiens
gctctctggttccagtcaggaa

SEQ ID NO: 8320751 - DNA, 22 bp, Homo sapiens
gctctctggaggccatggacag

SEQ ID NO: 8320752 - DNA, 22 bp, Homo sapiens
gctctctggaaggtatcattat

SEQ ID NO: 8320753 - DNA, 22 bp, Homo sapiens
gctctctgcctttctcaatgac

SEQ ID NO: 8320754 - DNA, 22 bp, Homo sapiens
gctctctgccatatgaggatac

SEQ ID NO: 8320755 - DNA, 22 bp, Homo sapiens
gctctctgttattaagatcttt

SEQ ID NO: 8320756 - DNA, 22 bp, Homo sapiens
gctctctgtcgttatgcttcat

SEQ ID NO: 8320757 - DNA, 22 bp, Homo sapiens
gctctgtgaccttaggcaagtt

SEQ ID NO: 8320758 - DNA, 19 bp, Homo sapiens
gctctgtgatgctgagggg

SEQ ID NO: 8320759 - DNA, 22 bp, Homo sapiens
gctctgtgcccctgccgtggac

SEQ ID NO: 8320760 - DNA, 21 bp, Homo sapiens
gctctctgcatggtggctcag

SEQ ID NO: 8320761 - DNA, 22 bp, Homo sapiens
gctctctgcagcctccttggag

SEQ ID NO: 8320762 - DNA, 22 bp, Homo sapiens
gctctctgcaagtcagcagcct

SEQ ID NO: 8320763 - DNA, 22 bp, Homo sapiens
gctctctgaggtgctggcagag

SEQ ID NO: 8320764 - DNA, 22 bp, Homo sapiens
gctccctctgctcaggcacttg

SEQ ID NO: 8320765 - DNA, 22 bp, Homo sapiens
gctcccagcattgctgctgaat

SEQ ID NO: 8320766 - DNA, 22 bp, Homo sapiens
gctcccaggaagagaagggcca

SEQ ID NO: 8320767 - DNA, 22 bp, Homo sapiens
gctcccaggatgaggagccagg

SEQ ID NO: 8320768 - DNA, 22 bp, Homo sapiens
gctccctccatgaggcagaccg

SEQ ID NO: 8320769 - DNA, 22 bp, Homo sapiens
gctccctcccaccagcctgcag

SEQ ID NO: 8320770 - DNA, 22 bp, Homo sapiens
gctgctggtcctcagagctcat

SEQ ID NO: 8320771 - DNA, 22 bp, Homo sapiens
gctgctgggtccctctgtgcca

SEQ ID NO: 8320772 - DNA, 18 bp, Homo sapiens
gctgctggtggagggagc

SEQ ID NO: 8320773 - DNA, 22 bp, Homo sapiens
gctggaggggtaataggatggg

SEQ ID NO: 8320774 - DNA, 22 bp, Homo sapiens
gctggaggggtaataggatggg

SEQ ID NO: 8320775 - DNA, 22 bp, Homo sapiens
gctgctgcttgaaggctcggag

SEQ ID NO: 8320776 - DNA, 22 bp, Homo sapiens
gctgctggaagcatgcgatgaa

SEQ ID NO: 8320777 - DNA, 22 bp, Homo sapiens
gctgctggaagcatgcgatgaa

SEQ ID NO: 8320778 - DNA, 22 bp, Homo sapiens
gctgcctctgtagctttggacc

SEQ ID NO: 8320779 - DNA, 19 bp, Homo sapiens
gctgctggctctggctgga

SEQ ID NO: 8320780 - DNA, 22 bp, Homo sapiens
gctgctgggatcctgggtctca

SEQ ID NO: 8320781 - DNA, 22 bp, Homo sapiens
gctgctggggtcacatggtaag

SEQ ID NO: 8320782 - DNA, 22 bp, Homo sapiens
gctggagtaggaccatgcttga

SEQ ID NO: 8320783 - DNA, 22 bp, Homo sapiens
gctggagtacatctttggcggc

SEQ ID NO: 8320784 - DNA, 22 bp, Homo sapiens
gctggagttaggtgggcttgaa

SEQ ID NO: 8320785 - DNA, 22 bp, Homo sapiens
gctggagttagaactagcctgg

SEQ ID NO: 8320786 - DNA, 22 bp, Homo sapiens
gctggagtccctgcctttcctt

SEQ ID NO: 8320787 - DNA, 22 bp, Homo sapiens
gctggagtctggaggtgtgcca

SEQ ID NO: 8320788 - DNA, 22 bp, Homo sapiens
gctggagtgagtatgtgtagtc

SEQ ID NO: 8320789 - DNA, 22 bp, Homo sapiens
gctggagtgatgcctgtgtctc

SEQ ID NO: 8320790 - DNA, 22 bp, Homo sapiens
gctggagttgtgggtttactaa

SEQ ID NO: 8320791 - DNA, 22 bp, Homo sapiens
gctggcagtcccatcagctggg

SEQ ID NO: 8320792 - DNA, 22 bp, Homo sapiens
gctggcagtaaagggtttggca

SEQ ID NO: 8320793 - DNA, 22 bp, Homo sapiens
gctggcatggagactctgggtc

SEQ ID NO: 8320794 - DNA, 22 bp, Homo sapiens
gctggcatcactggcttcggtg

SEQ ID NO: 8320795 - DNA, 22 bp, Homo sapiens
gctgcctcctgagatttgggca

SEQ ID NO: 8320796 - DNA, 22 bp, Homo sapiens
gctgcctcccccatggctggaa

SEQ ID NO: 8320797 - DNA, 23 bp, Homo sapiens
gctgcctcctacaaaagcccagc

SEQ ID NO: 8320798 - DNA, 22 bp, Homo sapiens
gctgcctccgccggctccacag

SEQ ID NO: 8320799 - DNA, 22 bp, Homo sapiens
gctgcctccactggctcccagt

SEQ ID NO: 8320800 - DNA, 22 bp, Homo sapiens
gctgaggttttctgcctgctca

SEQ ID NO: 8320801 - DNA, 18 bp, Homo sapiens
gctgaggtggtgtcagag

SEQ ID NO: 8320802 - DNA, 22 bp, Homo sapiens
gctctgtggtggggcagagttt

SEQ ID NO: 8320803 - DNA, 22 bp, Homo sapiens
gctctgtggcattcatgggcag

SEQ ID NO: 8320804 - DNA, 18 bp, Homo sapiens
gctgcaggccctccgagg

SEQ ID NO: 8320805 - DNA, 22 bp, Homo sapiens
gctgcaggcagaatctcccaat

SEQ ID NO: 8320806 - DNA, 22 bp, Homo sapiens
gctgtcctctgatctctggagg

SEQ ID NO: 8320807 - DNA, 23 bp, Homo sapiens
gctgtcctcctgggcccagcagc

SEQ ID NO: 8320808 - DNA, 22 bp, Homo sapiens
gctgtcctgggaacaggcacta

SEQ ID NO: 8320809 - DNA, 22 bp, Homo sapiens
gctgtccttcctggctggggtg

SEQ ID NO: 8320810 - DNA, 22 bp, Homo sapiens
gctgtccaggttgtggagcaac

SEQ ID NO: 8320811 - DNA, 22 bp, Homo sapiens
gctgtctggcatggcgtggctg

SEQ ID NO: 8320812 - DNA, 22 bp, Homo sapiens
gctgtctgctgtgcactgagca

SEQ ID NO: 8320813 - DNA, 22 bp, Homo sapiens
gctggccacattgtgccgtcct

SEQ ID NO: 8320814 - DNA, 19 bp, Homo sapiens
gctggccacgccccagttg

SEQ ID NO: 8320815 - DNA, 22 bp, Homo sapiens
gctggccagccctcttcctcca

SEQ ID NO: 8320816 - DNA, 22 bp, Homo sapiens
gctggccacagatccccaggga

SEQ ID NO: 8320817 - DNA, 22 bp, Homo sapiens
gctggccaggaagagtctcaga

SEQ ID NO: 8320818 - DNA, 21 bp, Homo sapiens
gctttttgtatggcccaggaa

SEQ ID NO: 8320819 - DNA, 22 bp, Homo sapiens
gcttttgcctacatcttggtct

SEQ ID NO: 8320820 - DNA, 22 bp, Homo sapiens
gcttttgtcattcaaatgctct

SEQ ID NO: 8320821 - DNA, 22 bp, Homo sapiens
gctttggtacctcctgctgatc

SEQ ID NO: 8320822 - DNA, 22 bp, Homo sapiens
gctttggtcaggtgtccagccc

SEQ ID NO: 8320823 - DNA, 22 bp, Homo sapiens
gctttggttcaaccaggcaatt

SEQ ID NO: 8320824 - DNA, 22 bp, Homo sapiens
gctttggtgatacttgctggct

SEQ ID NO: 8320825 - DNA, 22 bp, Homo sapiens
gctttggtcttctagctgtgag

SEQ ID NO: 8320826 - DNA, 22 bp, Homo sapiens
gctttaatgcaatttcacctca

SEQ ID NO: 8320827 - DNA, 22 bp, Homo sapiens
gcttaaatcccaatgctagacc

SEQ ID NO: 8320828 - DNA, 22 bp, Homo sapiens
gcttaaattgtttgtggatagt

SEQ ID NO: 8320829 - DNA, 22 bp, Homo sapiens
ggagctgggaccctgtcatctg

SEQ ID NO: 8320830 - DNA, 22 bp, Homo sapiens
ggagctgggaactatgtagtat

SEQ ID NO: 8320831 - DNA, 21 bp, Homo sapiens
ggagctggggagctggcccca

SEQ ID NO: 8320832 - DNA, 22 bp, Homo sapiens
ggagctgtgcagtgactacaga

SEQ ID NO: 8320833 - DNA, 22 bp, Homo sapiens
ggagctgttatggcataagcat

SEQ ID NO: 8320834 - DNA, 22 bp, Homo sapiens
ggagctgttgattgtttgagga

SEQ ID NO: 8320835 - DNA, 19 bp, Homo sapiens
ggagcctggcaggggcgtg

SEQ ID NO: 8320836 - DNA, 22 bp, Homo sapiens
ggagccccaattgagcagtacg

SEQ ID NO: 8320837 - DNA, 22 bp, Homo sapiens
ggagccagtatttagtggtctt

SEQ ID NO: 8320838 - DNA, 17 bp, Homo sapiens
ggagccaggagcccacc

SEQ ID NO: 8320839 - DNA, 22 bp, Homo sapiens
ggagccagtatttagtggtctt

SEQ ID NO: 8320840 - DNA, 22 bp, Homo sapiens
ggagaagaggagctggaagcct

SEQ ID NO: 8320841 - DNA, 22 bp, Homo sapiens
ggagaaagtacagcaggcaaca

SEQ ID NO: 8320842 - DNA, 22 bp, Homo sapiens
ggactgggaatcagggagatgc

SEQ ID NO: 8320843 - DNA, 22 bp, Homo sapiens
ggactggtctgagagggattca

SEQ ID NO: 8320844 - DNA, 22 bp, Homo sapiens
ggagaaagaagacgaacattgt

SEQ ID NO: 8320845 - DNA, 22 bp, Homo sapiens
ggagaaagctatgtgggggagt

SEQ ID NO: 8320846 - DNA, 22 bp, Homo sapiens
ggagaaagctgtagtggaatgt

SEQ ID NO: 8320847 - DNA, 22 bp, Homo sapiens
ggagaaaggcatagcagaacct

SEQ ID NO: 8320848 - DNA, 22 bp, Homo sapiens
ggagaaaggcatagcagaacct

SEQ ID NO: 8320849 - DNA, 22 bp, Homo sapiens
ggacagggctcttggcactcct

SEQ ID NO: 8320850 - DNA, 22 bp, Homo sapiens
ggacaggctgcatctgagcatg

SEQ ID NO: 8320851 - DNA, 22 bp, Homo sapiens
ggacaggcccggggagcctgga

SEQ ID NO: 8320852 - DNA, 22 bp, Homo sapiens
ggaaaaatagagtatactttaa

SEQ ID NO: 8320853 - DNA, 18 bp, Homo sapiens
ggacaggagacatgggtg

SEQ ID NO: 8320854 - DNA, 22 bp, Homo sapiens
ggaaggctgtgcagtgtttgca

SEQ ID NO: 8320855 - DNA, 22 bp, Homo sapiens
gcctggagaggaagccggtgga

SEQ ID NO: 8320856 - DNA, 22 bp, Homo sapiens
gcctggagacagcagaggcggc

SEQ ID NO: 8320857 - DNA, 22 bp, Homo sapiens
gcctggagacagcagaggcggc

SEQ ID NO: 8320858 - DNA, 22 bp, Homo sapiens
gcctggagacctgctcctctac

SEQ ID NO: 8320859 - DNA, 22 bp, Homo sapiens
gcctggagcccagtgtggggct

SEQ ID NO: 8320860 - DNA, 22 bp, Homo sapiens
gcctggagtagcatggcaagcc

SEQ ID NO: 8320861 - DNA, 22 bp, Homo sapiens
gcctggagtgcagtggcgtgat

SEQ ID NO: 8320862 - DNA, 22 bp, Homo sapiens
gcctggagaagatggaactagc

SEQ ID NO: 8320863 - DNA, 22 bp, Homo sapiens
gcctggagaaaggaaggtggga

SEQ ID NO: 8320864 - DNA, 21 bp, Homo sapiens
gcctgcagttttgaagccctt

SEQ ID NO: 8320865 - DNA, 19 bp, Homo sapiens
gcctgcagaaaaggcaggg

SEQ ID NO: 8320866 - DNA, 21 bp, Homo sapiens
gcctgcagaccccaccaggct

SEQ ID NO: 8320867 - DNA, 22 bp, Homo sapiens
gcctgcagcctcaagggctgag

SEQ ID NO: 8320868 - DNA, 22 bp, Homo sapiens
gcctccccaggggtgtcatgag

SEQ ID NO: 8320869 - DNA, 22 bp, Homo sapiens
gcccacaggggacctggtggct

SEQ ID NO: 8320870 - DNA, 22 bp, Homo sapiens
gcccacagctcgttcctctcct

SEQ ID NO: 8320871 - DNA, 22 bp, Homo sapiens
gccccaggggaggtgccctgca

SEQ ID NO: 8320872 - DNA, 22 bp, Homo sapiens
gcccctgggagcagagccacca

SEQ ID NO: 8320873 - DNA, 22 bp, Homo sapiens
gccccttccatcatgtgaggac

SEQ ID NO: 8320874 - DNA, 22 bp, Homo sapiens
gcccctgttgtggctttgtcta

SEQ ID NO: 8320875 - DNA, 22 bp, Homo sapiens
gccccttcgtggaagtgcattc

SEQ ID NO: 8320876 - DNA, 22 bp, Homo sapiens
gccccttctctgaggaacctgc

SEQ ID NO: 8320877 - DNA, 22 bp, Homo sapiens
gccccttcttctggagattcaa

SEQ ID NO: 8320878 - DNA, 22 bp, Homo sapiens
gccctagcgccagctcagcacc

SEQ ID NO: 8320879 - DNA, 22 bp, Homo sapiens
gcccggccaggaacagagtata

SEQ ID NO: 8320880 - DNA, 22 bp, Homo sapiens
gccctaggcttttgtgactgcc

SEQ ID NO: 8320881 - DNA, 22 bp, Homo sapiens
gccctgctcttttgcccaccca

SEQ ID NO: 8320882 - DNA, 22 bp, Homo sapiens
gccctgcctgtctgctgggagg

SEQ ID NO: 8320883 - DNA, 22 bp, Homo sapiens
gccaggctaagaaaggtgtgat

SEQ ID NO: 8320884 - DNA, 22 bp, Homo sapiens
gccaggctcagtagcgattcct

SEQ ID NO: 8320885 - DNA, 22 bp, Homo sapiens
gccaggctcagcagtcaacctg

SEQ ID NO: 8320886 - DNA, 22 bp, Homo sapiens
gccaggcgggtctcaaactcct

SEQ ID NO: 8320887 - DNA, 22 bp, Homo sapiens
gccaggctccaggccctcctga

SEQ ID NO: 8320888 - DNA, 19 bp, Homo sapiens
gccaggctccatagccggc

SEQ ID NO: 8320889 - DNA, 22 bp, Homo sapiens
gccaggctccccggatccctgg

SEQ ID NO: 8320890 - DNA, 22 bp, Homo sapiens
gccaggctccccggatccctgg

SEQ ID NO: 8320891 - DNA, 23 bp, Homo sapiens
gccaggctccggtctgtggccac

SEQ ID NO: 8320892 - DNA, 22 bp, Homo sapiens
gccaggctctcagtgactgccc

SEQ ID NO: 8320893 - DNA, 22 bp, Homo sapiens
gccaggctctcagtgactgccc

SEQ ID NO: 8320894 - DNA, 22 bp, Homo sapiens
gcccaagcagcttcccgagctt

SEQ ID NO: 8320895 - DNA, 20 bp, Homo sapiens
gcccaagcgccggccgcaga

SEQ ID NO: 8320896 - DNA, 22 bp, Homo sapiens
gcccaagccgccttccagagac

SEQ ID NO: 8320897 - DNA, 22 bp, Homo sapiens
gcatttcaaaattccaggcaag

SEQ ID NO: 8320898 - DNA, 22 bp, Homo sapiens
gcatttcagaagcatgccctct

SEQ ID NO: 8320899 - DNA, 22 bp, Homo sapiens
gcattgcaggtgtacccagtta

SEQ ID NO: 8320900 - DNA, 22 bp, Homo sapiens
gcattgcaactgacagatcatt

SEQ ID NO: 8320901 - DNA, 22 bp, Homo sapiens
gcattgcaaaaagcagcttgat

SEQ ID NO: 8320902 - DNA, 22 bp, Homo sapiens
gcattgcaaaaagcagcttgat

SEQ ID NO: 8320903 - DNA, 22 bp, Homo sapiens
gcattaaatgctagggacctaa

SEQ ID NO: 8320904 - DNA, 22 bp, Homo sapiens
gcagttttattatgatggaaat

SEQ ID NO: 8320905 - DNA, 22 bp, Homo sapiens
gcattaatgtaagacccactcc

SEQ ID NO: 8320906 - DNA, 21 bp, Homo sapiens
gcagtttatgtaatatgcact

SEQ ID NO: 8320907 - DNA, 22 bp, Homo sapiens
gcagtttcagacatatctccat

SEQ ID NO: 8320908 - DNA, 22 bp, Homo sapiens
gcagttttagagctttaagatg

SEQ ID NO: 8320909 - DNA, 22 bp, Homo sapiens
gcagttttagtggatctggggc

SEQ ID NO: 8320910 - DNA, 22 bp, Homo sapiens
gcagttttagtggatctggggc

SEQ ID NO: 8320911 - DNA, 22 bp, Homo sapiens
gcagtgtttacatattagaaac

SEQ ID NO: 8320912 - DNA, 22 bp, Homo sapiens
gcagcagatgtgggcccagagc

SEQ ID NO: 8320913 - DNA, 22 bp, Homo sapiens
gcagctggctctgggaaaaact

SEQ ID NO: 8320914 - DNA, 22 bp, Homo sapiens
gcagggtgtgtctcatacagtt

SEQ ID NO: 8320915 - DNA, 22 bp, Homo sapiens
gcagggccaggtacaagaagca

SEQ ID NO: 8320916 - DNA, 22 bp, Homo sapiens
gcagggccaggtacaagaagca

SEQ ID NO: 8320917 - DNA, 22 bp, Homo sapiens
gcagggccagtgcagagaggaa

SEQ ID NO: 8320918 - DNA, 22 bp, Homo sapiens
gcagggccagtgcagagaggaa

SEQ ID NO: 8320919 - DNA, 22 bp, Homo sapiens
gcagggccagggctcaggctgt

SEQ ID NO: 8320920 - DNA, 22 bp, Homo sapiens
gcaggtctcaatctgagcaggc

SEQ ID NO: 8320921 - DNA, 22 bp, Homo sapiens
gcaaggagactgtagggccaag

SEQ ID NO: 8320922 - DNA, 22 bp, Homo sapiens
gcaataaataacatggaagaca

SEQ ID NO: 8320923 - DNA, 22 bp, Homo sapiens
gcaataaagtagcagctcatca

SEQ ID NO: 8320924 - DNA, 22 bp, Homo sapiens
gcaataaagattttactgtcag

SEQ ID NO: 8320925 - DNA, 22 bp, Homo sapiens
gcaataaacatgtttgatgcgc

SEQ ID NO: 8320926 - DNA, 22 bp, Homo sapiens
gcaataaacatgtttgatgcgc

SEQ ID NO: 8320927 - DNA, 22 bp, Homo sapiens
gcaataaactctctcaagccac

SEQ ID NO: 8320928 - DNA, 22 bp, Homo sapiens
gcaataaaatgtaatgattggg

SEQ ID NO: 8320929 - DNA, 22 bp, Homo sapiens
gcacagcagctgctcagttgct

SEQ ID NO: 8320930 - DNA, 22 bp, Homo sapiens
gcacagaataacactctgggct

SEQ ID NO: 8320931 - DNA, 22 bp, Homo sapiens
gcacagactcaccttaatttga

SEQ ID NO: 8320932 - DNA, 22 bp, Homo sapiens
gcacagacatatccatatttac

SEQ ID NO: 8320933 - DNA, 22 bp, Homo sapiens
gcacagaaccagacatgaggca

SEQ ID NO: 8320934 - DNA, 20 bp, Homo sapiens
gcacagagatgagcaaagta

SEQ ID NO: 8320935 - DNA, 22 bp, Homo sapiens
gcacagagagcagtgggggaca

SEQ ID NO: 8320936 - DNA, 22 bp, Homo sapiens
gcacagagagcagtgggggaca

SEQ ID NO: 8320937 - DNA, 22 bp, Homo sapiens
gcagcaaacttccacaagtaga

SEQ ID NO: 8320938 - DNA, 22 bp, Homo sapiens
tccagggcttgacagggtgcct

SEQ ID NO: 8320939 - DNA, 22 bp, Homo sapiens
tccagggctgggttggctcagc

SEQ ID NO: 8320940 - DNA, 22 bp, Homo sapiens
tccagggctccccaacatccag

SEQ ID NO: 8320941 - DNA, 23 bp, Homo sapiens
tccaggctgggacttcaactggc

SEQ ID NO: 8320942 - DNA, 22 bp, Homo sapiens
tccacaaggcagctcctccagg

SEQ ID NO: 8320943 - DNA, 22 bp, Homo sapiens
tccaggctaattttgcattgtt

SEQ ID NO: 8320944 - DNA, 22 bp, Homo sapiens
tccaggctacttggattcctgg

SEQ ID NO: 8320945 - DNA, 21 bp, Homo sapiens
tccaggctggaaggggcgttg

SEQ ID NO: 8320946 - DNA, 22 bp, Homo sapiens
tccaggctagcctggtagagaa

SEQ ID NO: 8320947 - DNA, 22 bp, Homo sapiens
tccaggctagagtgcagtggcc

SEQ ID NO: 8320948 - DNA, 22 bp, Homo sapiens
tccaggctagaagtcacaggcc

SEQ ID NO: 8320949 - DNA, 18 bp, Homo sapiens
tccaggctggattgatga

SEQ ID NO: 8320950 - DNA, 22 bp, Homo sapiens
tccaggctggctcttcaaaatt

SEQ ID NO: 8320951 - DNA, 22 bp, Homo sapiens
tccaggctggcctcgcgtgaca

SEQ ID NO: 8320952 - DNA, 22 bp, Homo sapiens
tccaggctggagtgcagtggcg

SEQ ID NO: 8320953 - DNA, 22 bp, Homo sapiens
tccaggctggagtgcagtggca

SEQ ID NO: 8320954 - DNA, 22 bp, Homo sapiens
tccaggctggacatgaggcggg

SEQ ID NO: 8320955 - DNA, 22 bp, Homo sapiens
tcccagagatttcctctccttc

SEQ ID NO: 8320956 - DNA, 22 bp, Homo sapiens
tcccagagacagagcctcctcc

SEQ ID NO: 8320957 - DNA, 22 bp, Homo sapiens
tcccagagcagatgtgctaaag

SEQ ID NO: 8320958 - DNA, 22 bp, Homo sapiens
tcccagagcagtactccaggag

SEQ ID NO: 8320959 - DNA, 22 bp, Homo sapiens
tcccagagccaagctatggatg

SEQ ID NO: 8320960 - DNA, 22 bp, Homo sapiens
tccattgtgattatatacaaaa

SEQ ID NO: 8320961 - DNA, 17 bp, Homo sapiens
tccattcctaaggccct

SEQ ID NO: 8320962 - DNA, 22 bp, Homo sapiens
tccatgtgaccttgagctgctt

SEQ ID NO: 8320963 - DNA, 22 bp, Homo sapiens
tccattaaacctggatggagtt

SEQ ID NO: 8320964 - DNA, 22 bp, Homo sapiens
tccattatacttctgattcaaa

SEQ ID NO: 8320965 - DNA, 22 bp, Homo sapiens
tccattaacacctgtacgtggc

SEQ ID NO: 8320966 - DNA, 19 bp, Homo sapiens
tccattaagctcagagctc

SEQ ID NO: 8320967 - DNA, 22 bp, Homo sapiens
tccattaatgattatttctgtg

SEQ ID NO: 8320968 - DNA, 22 bp, Homo sapiens
tcccagaggtctctgctggttc

SEQ ID NO: 8320969 - DNA, 22 bp, Homo sapiens
tcccagaggttgagtcacttat

SEQ ID NO: 8320970 - DNA, 22 bp, Homo sapiens
tcccagaggctccagtctctat

SEQ ID NO: 8320971 - DNA, 22 bp, Homo sapiens
tcccagccggtgcctgggtccc

SEQ ID NO: 8320972 - DNA, 22 bp, Homo sapiens
tcccagcccaggtatgatgata

SEQ ID NO: 8320973 - DNA, 22 bp, Homo sapiens
tcccagcctcctgacagttttg

SEQ ID NO: 8320974 - DNA, 22 bp, Homo sapiens
tcccagccttccttgtggtgaa

SEQ ID NO: 8320975 - DNA, 22 bp, Homo sapiens
tcccagcctttctttctccagc

SEQ ID NO: 8320976 - DNA, 22 bp, Homo sapiens
tcccagccttccagtctggttt

SEQ ID NO: 8320977 - DNA, 22 bp, Homo sapiens
tcccagccttatctcccctggc

SEQ ID NO: 8320978 - DNA, 22 bp, Homo sapiens
tcccagcctgacagtgcatcaa

SEQ ID NO: 8320979 - DNA, 22 bp, Homo sapiens
tcccagcctggaccctgccagt

SEQ ID NO: 8320980 - DNA, 22 bp, Homo sapiens
tccccttggcttggtcaagagg

SEQ ID NO: 8320981 - DNA, 22 bp, Homo sapiens
tcccgcttcttccgaatcgcga

SEQ ID NO: 8320982 - DNA, 22 bp, Homo sapiens
tccctgaaatttgaagaggaat

SEQ ID NO: 8320983 - DNA, 22 bp, Homo sapiens
tccctgaagccagggaaggaag

SEQ ID NO: 8320984 - DNA, 22 bp, Homo sapiens
tccctccaggcagctgggtact

SEQ ID NO: 8320985 - DNA, 22 bp, Homo sapiens
tcctcaggggtttcaggtgtac

SEQ ID NO: 8320986 - DNA, 19 bp, Homo sapiens
tcctcaggggctcacagac

SEQ ID NO: 8320987 - DNA, 22 bp, Homo sapiens
tcctcagggggccaacccagcc

SEQ ID NO: 8320988 - DNA, 22 bp, Homo sapiens
tcctcaggtcaaagcaggagaa

SEQ ID NO: 8320989 - DNA, 21 bp, Homo sapiens
tcctcagggccccagagcact

SEQ ID NO: 8320990 - DNA, 22 bp, Homo sapiens
tcctcagggcggcctccgtctt

SEQ ID NO: 8320991 - DNA, 22 bp, Homo sapiens
tcctcagagcatagcgctgtct

SEQ ID NO: 8320992 - DNA, 22 bp, Homo sapiens
tcctcagatataaatgagggtg

SEQ ID NO: 8320993 - DNA, 23 bp, Homo sapiens
tcctcagcatgttttgtcatgta

SEQ ID NO: 8320994 - DNA, 22 bp, Homo sapiens
tcctcagcatggaatctggact

SEQ ID NO: 8320995 - DNA, 22 bp, Homo sapiens
tcctcagcatggaatctggact

SEQ ID NO: 8320996 - DNA, 22 bp, Homo sapiens
tcctcagaagaacccctagatt

SEQ ID NO: 8320997 - DNA, 22 bp, Homo sapiens
tcctcagaaacccctgtgaggt

SEQ ID NO: 8320998 - DNA, 22 bp, Homo sapiens
tcctcagaatggatggcagggg

SEQ ID NO: 8320999 - DNA, 22 bp, Homo sapiens
tcctcagaatcacctggcagct

SEQ ID NO: 8321000 - DNA, 22 bp, Homo sapiens
tccctggacaacagacttcact

SEQ ID NO: 8321001 - DNA, 22 bp, Homo sapiens
tccctggacagccttgcctggg

SEQ ID NO: 8321002 - DNA, 23 bp, Homo sapiens
tccctggaggcaggtccagggcc

SEQ ID NO: 8321003 - DNA, 20 bp, Homo sapiens
tccctggaggtggtggcatc

SEQ ID NO: 8321004 - DNA, 22 bp, Homo sapiens
tccctggaggtgtttgctcagg

SEQ ID NO: 8321005 - DNA, 22 bp, Homo sapiens
tcctagaatgcacctctgctgt

SEQ ID NO: 8321006 - DNA, 19 bp, Homo sapiens
tcctgaaaacttctggaat

SEQ ID NO: 8321007 - DNA, 22 bp, Homo sapiens
tcctcttctgtggattccctga

SEQ ID NO: 8321008 - DNA, 22 bp, Homo sapiens
tcctctttctcaacattagtta

SEQ ID NO: 8321009 - DNA, 22 bp, Homo sapiens
tcctctttctcaacattagtta

SEQ ID NO: 8321010 - DNA, 22 bp, Homo sapiens
tcctctgtggaccgggctttgg

SEQ ID NO: 8321011 - DNA, 22 bp, Homo sapiens
tcctctggtacttaaagtgctt

SEQ ID NO: 8321012 - DNA, 22 bp, Homo sapiens
tcctcaggtgactaggtatctt

SEQ ID NO: 8321013 - DNA, 22 bp, Homo sapiens
tcctctggggcgtggtcctgga

SEQ ID NO: 8321014 - DNA, 22 bp, Homo sapiens
tcctgagataaatctcatgtga

SEQ ID NO: 8321015 - DNA, 22 bp, Homo sapiens
tcctgagaggtttataacgcag

SEQ ID NO: 8321016 - DNA, 22 bp, Homo sapiens
tcctgcagctgataaatacagt

SEQ ID NO: 8321017 - DNA, 22 bp, Homo sapiens
tcctgcagctctgagaagcatc

SEQ ID NO: 8321018 - DNA, 22 bp, Homo sapiens
tcctgcagctctgagaagcatc

SEQ ID NO: 8321019 - DNA, 22 bp, Homo sapiens
tcctgcaggcctgttcccagta

SEQ ID NO: 8321020 - DNA, 21 bp, Homo sapiens
tcctgcagggcagcagagtgg

SEQ ID NO: 8321021 - DNA, 22 bp, Homo sapiens
tcctgccgtcctccggggcctc

SEQ ID NO: 8321022 - DNA, 22 bp, Homo sapiens
tcctgcagagccgccctcaggt

SEQ ID NO: 8321023 - DNA, 19 bp, Homo sapiens
tcctgcagaccagacctgt

SEQ ID NO: 8321024 - DNA, 22 bp, Homo sapiens
tccaagttgatgtttcttaaat

SEQ ID NO: 8321025 - DNA, 20 bp, Homo sapiens
tccaatttaagaatttagag

SEQ ID NO: 8321026 - DNA, 20 bp, Homo sapiens
tccaattaaaaattgtatgc

SEQ ID NO: 8321027 - DNA, 19 bp, Homo sapiens
tccaatttctattcatgtt

SEQ ID NO: 8321028 - DNA, 22 bp, Homo sapiens
tccaatttgaaatggtatatgt

SEQ ID NO: 8321029 - DNA, 22 bp, Homo sapiens
tccaatttgtttgatgatggaa

SEQ ID NO: 8321030 - DNA, 22 bp, Homo sapiens
tccaattttacgtctgtataaa

SEQ ID NO: 8321031 - DNA, 22 bp, Homo sapiens
tccaaagtaatttcacttctgt

SEQ ID NO: 8321032 - DNA, 22 bp, Homo sapiens
tccaaatacatttactgtattt

SEQ ID NO: 8321033 - DNA, 22 bp, Homo sapiens
tccaaacgggagccaaatgagc

SEQ ID NO: 8321034 - DNA, 21 bp, Homo sapiens
tcatttttattgctaccttgc

SEQ ID NO: 8321035 - DNA, 18 bp, Homo sapiens
tccaaaatcatgtatttt

SEQ ID NO: 8321036 - DNA, 22 bp, Homo sapiens
tcattttttgcatacctgtgtc

SEQ ID NO: 8321037 - DNA, 22 bp, Homo sapiens
tcatttccctcctacaaagagg

SEQ ID NO: 8321038 - DNA, 22 bp, Homo sapiens
tcatttcagtcctctgtgtgag

SEQ ID NO: 8321039 - DNA, 21 bp, Homo sapiens
tcatttctctatgtatttcac

SEQ ID NO: 8321040 - DNA, 22 bp, Homo sapiens
tcatttcttaactagagtgaac

SEQ ID NO: 8321041 - DNA, 22 bp, Homo sapiens
tcattgtagggcatttagagag

SEQ ID NO: 8321042 - DNA, 22 bp, Homo sapiens
tcattgtatactttatttatga

SEQ ID NO: 8321043 - DNA, 22 bp, Homo sapiens
tcattgtattcagaactgaaga

SEQ ID NO: 8321044 - DNA, 22 bp, Homo sapiens
tcattgtattaaaatattggtt

SEQ ID NO: 8321045 - DNA, 22 bp, Homo sapiens
tcatttataaggatgcaattaa

SEQ ID NO: 8321046 - DNA, 22 bp, Homo sapiens
tcatttacatagaaacaatata

SEQ ID NO: 8321047 - DNA, 22 bp, Homo sapiens
tcatcttgctgccattgcttta

SEQ ID NO: 8321048 - DNA, 22 bp, Homo sapiens
tcatctttcctcaaaagatcca

SEQ ID NO: 8321049 - DNA, 22 bp, Homo sapiens
tcatctttgtatccctaacaca

SEQ ID NO: 8321050 - DNA, 22 bp, Homo sapiens
tcataaattgattatgtgcttt

SEQ ID NO: 8321051 - DNA, 22 bp, Homo sapiens
tcataaatgcagtgtcataaat

SEQ ID NO: 8321052 - DNA, 22 bp, Homo sapiens
tcataaattagctgtctttgaa

SEQ ID NO: 8321053 - DNA, 22 bp, Homo sapiens
tcaggctgtaaatggtgtgggt

SEQ ID NO: 8321054 - DNA, 22 bp, Homo sapiens
tcaggctggtggtcagatggct

SEQ ID NO: 8321055 - DNA, 17 bp, Homo sapiens
tcaggctgggtgcagtg

SEQ ID NO: 8321056 - DNA, 22 bp, Homo sapiens
tcagtaaataactcagatgctc

SEQ ID NO: 8321057 - DNA, 21 bp, Homo sapiens
tcagtaaacctaaagattgta

SEQ ID NO: 8321058 - DNA, 22 bp, Homo sapiens
tcagtagttttgatctgagcag

SEQ ID NO: 8321059 - DNA, 22 bp, Homo sapiens
tcagggctccggaagtggcctc

SEQ ID NO: 8321060 - DNA, 22 bp, Homo sapiens
tcagggctgcagaagaggcagg

SEQ ID NO: 8321061 - DNA, 22 bp, Homo sapiens
tcagagttcctcatagatccag

SEQ ID NO: 8321062 - DNA, 19 bp, Homo sapiens
tcagcatcaatttggtcct

SEQ ID NO: 8321063 - DNA, 22 bp, Homo sapiens
tcagaacactttctctactgac

SEQ ID NO: 8321064 - DNA, 22 bp, Homo sapiens
tcagaacagcgagaatattcac

SEQ ID NO: 8321065 - DNA, 22 bp, Homo sapiens
tcagaacagctctcagatatcc

SEQ ID NO: 8321066 - DNA, 22 bp, Homo sapiens
tcagaacagcagggtgtggctg

SEQ ID NO: 8321067 - DNA, 22 bp, Homo sapiens
tcagaatatattcatgttgtca

SEQ ID NO: 8321068 - DNA, 22 bp, Homo sapiens
tcagaatatgctaatgacattt

SEQ ID NO: 8321069 - DNA, 22 bp, Homo sapiens
tcactgctatattggatactga

SEQ ID NO: 8321070 - DNA, 22 bp, Homo sapiens
tcactgcttcttggagaatgtc

SEQ ID NO: 8321071 - DNA, 22 bp, Homo sapiens
tcactgcaacctccacctcctg

SEQ ID NO: 8321072 - DNA, 22 bp, Homo sapiens
tcactgcaacctccacctcctg

SEQ ID NO: 8321073 - DNA, 22 bp, Homo sapiens
tcactgcaacctccacctcccg

SEQ ID NO: 8321074 - DNA, 22 bp, Homo sapiens
tcactgcaacctccacctcccg

SEQ ID NO: 8321075 - DNA, 22 bp, Homo sapiens
tcacagttttagaaaatagata

SEQ ID NO: 8321076 - DNA, 22 bp, Homo sapiens
tcacagtttcttttctgataaa

SEQ ID NO: 8321077 - DNA, 22 bp, Homo sapiens
tcacagtgtcacaatgcctgga

SEQ ID NO: 8321078 - DNA, 22 bp, Homo sapiens
tcacagtgtgaaggtcagtcac

SEQ ID NO: 8321079 - DNA, 22 bp, Homo sapiens
tcacagtgagccatgtcagaga

SEQ ID NO: 8321080 - DNA, 22 bp, Homo sapiens
tcacagtgaggcagttcttgta

SEQ ID NO: 8321081 - DNA, 22 bp, Homo sapiens
tcacagtgcacagcaggcgtgg

SEQ ID NO: 8321082 - DNA, 22 bp, Homo sapiens
tcacatttatttcaaagttact

SEQ ID NO: 8321083 - DNA, 21 bp, Homo sapiens
tcacatttctcatgggtaaat

SEQ ID NO: 8321084 - DNA, 22 bp, Homo sapiens
tcaagaaactgtgctacagagt

SEQ ID NO: 8321085 - DNA, 22 bp, Homo sapiens
tcaacttggctttttaaagtcc

SEQ ID NO: 8321086 - DNA, 22 bp, Homo sapiens
tcacagtatcacacaaggatta

SEQ ID NO: 8321087 - DNA, 22 bp, Homo sapiens
tcacagtattcatgaacatgga

SEQ ID NO: 8321088 - DNA, 22 bp, Homo sapiens
tcaaatgaggctgatgaatgtg

SEQ ID NO: 8321089 - DNA, 22 bp, Homo sapiens
tcaaatgaggctgatgaatgtg

SEQ ID NO: 8321090 - DNA, 22 bp, Homo sapiens
tcaaatgcacctctcatttgtt

SEQ ID NO: 8321091 - DNA, 22 bp, Homo sapiens
tcaaatgagtgactcacacagg

SEQ ID NO: 8321092 - DNA, 22 bp, Homo sapiens
tcaacactggctacagttatgc

SEQ ID NO: 8321093 - DNA, 22 bp, Homo sapiens
tagatctgatacaattcatctg

SEQ ID NO: 8321094 - DNA, 22 bp, Homo sapiens
tagatctgatacaattcatctg

SEQ ID NO: 8321095 - DNA, 22 bp, Homo sapiens
tagcaaagcgaaagagatttat

SEQ ID NO: 8321096 - DNA, 22 bp, Homo sapiens
tagcaaagctccgtagttattt

SEQ ID NO: 8321097 - DNA, 22 bp, Homo sapiens
tagcaaaatgtggatgtagttg

SEQ ID NO: 8321098 - DNA, 22 bp, Homo sapiens
tagcaaatgcctggttaattag

SEQ ID NO: 8321099 - DNA, 21 bp, Homo sapiens
tagcaaatggagagtaagaga

SEQ ID NO: 8321100 - DNA, 22 bp, Homo sapiens
tagcaaataaaacagtattgaa

SEQ ID NO: 8321101 - DNA, 22 bp, Homo sapiens
tagctggcttatataaaagggc

SEQ ID NO: 8321102 - DNA, 22 bp, Homo sapiens
tagacagatttcttgttagaca

SEQ ID NO: 8321103 - DNA, 18 bp, Homo sapiens
tagactgctttctcagag

SEQ ID NO: 8321104 - DNA, 22 bp, Homo sapiens
tagaagatgccttaaagttgaa

SEQ ID NO: 8321105 - DNA, 22 bp, Homo sapiens
tagaaatgggttacatttagag

SEQ ID NO: 8321106 - DNA, 22 bp, Homo sapiens
tagaaatgggttacatttagag

SEQ ID NO: 8321107 - DNA, 22 bp, Homo sapiens
tagaaatggggaagtagttagg

SEQ ID NO: 8321108 - DNA, 22 bp, Homo sapiens
tagagaaaagcagggatcagga

SEQ ID NO: 8321109 - DNA, 22 bp, Homo sapiens
tagagaggtttgaattggctgc

SEQ ID NO: 8321110 - DNA, 22 bp, Homo sapiens
tagatacctgctggacctcatt

SEQ ID NO: 8321111 - DNA, 22 bp, Homo sapiens
tagatactcagaaatgctttca

SEQ ID NO: 8321112 - DNA, 22 bp, Homo sapiens
tagatacctgctggacctcatt

SEQ ID NO: 8321113 - DNA, 22 bp, Homo sapiens
tagggctggcgtgctcagggaa

SEQ ID NO: 8321114 - DNA, 22 bp, Homo sapiens
tagggctgtggtcagtcctcta

SEQ ID NO: 8321115 - DNA, 22 bp, Homo sapiens
tagggctgggtacactcttgcc

SEQ ID NO: 8321116 - DNA, 22 bp, Homo sapiens
tagggctgtgtctccaggacca

SEQ ID NO: 8321117 - DNA, 22 bp, Homo sapiens
tagggctgtttaaaagtgaggt

SEQ ID NO: 8321118 - DNA, 19 bp, Homo sapiens
tagggctggccgggcggtg

SEQ ID NO: 8321119 - DNA, 22 bp, Homo sapiens
tagggctgaggcaacaagggag

SEQ ID NO: 8321120 - DNA, 22 bp, Homo sapiens
tagggctgcctatggctagata

SEQ ID NO: 8321121 - DNA, 22 bp, Homo sapiens
tagggctgccatttgcttttct

SEQ ID NO: 8321122 - DNA, 22 bp, Homo sapiens
taggggtcttgttggcatcacg

SEQ ID NO: 8321123 - DNA, 22 bp, Homo sapiens
taggggtcccactctcagagtt

SEQ ID NO: 8321124 - DNA, 22 bp, Homo sapiens
taggggagctcgggtgcaatcg

SEQ ID NO: 8321125 - DNA, 22 bp, Homo sapiens
taggggaattgcagtgtgtcca

SEQ ID NO: 8321126 - DNA, 21 bp, Homo sapiens
tagggggcagtgggatgctta

SEQ ID NO: 8321127 - DNA, 22 bp, Homo sapiens
tagggggctgtcctgtgcatta

SEQ ID NO: 8321128 - DNA, 21 bp, Homo sapiens
tagggggcagtgggatgctta

SEQ ID NO: 8321129 - DNA, 22 bp, Homo sapiens
tagggggctttgctgcttgaca

SEQ ID NO: 8321130 - DNA, 22 bp, Homo sapiens
tagggggctttgctgcttgaca

SEQ ID NO: 8321131 - DNA, 22 bp, Homo sapiens
tagggggctgtcctgtgcatta

SEQ ID NO: 8321132 - DNA, 22 bp, Homo sapiens
tagttacaatgggttctgtgac

SEQ ID NO: 8321133 - DNA, 22 bp, Homo sapiens
tagttacaattatgcatggaaa

SEQ ID NO: 8321134 - DNA, 22 bp, Homo sapiens
tagttacaaaccaacaggcagc

SEQ ID NO: 8321135 - DNA, 22 bp, Homo sapiens
tagttacataaagtggactgtt

SEQ ID NO: 8321136 - DNA, 22 bp, Homo sapiens
tagtttaatggtcaactaatga

SEQ ID NO: 8321137 - DNA, 22 bp, Homo sapiens
tagttcttcatgaattcagctt

SEQ ID NO: 8321138 - DNA, 22 bp, Homo sapiens
tagttttatgaattggtataat

SEQ ID NO: 8321139 - DNA, 22 bp, Homo sapiens
tagttttataatgttaacatct

SEQ ID NO: 8321140 - DNA, 22 bp, Homo sapiens
tagtttcatatgcaaaatagta

SEQ ID NO: 8321141 - DNA, 22 bp, Homo sapiens
tatgaaattgccatttttatgg

SEQ ID NO: 8321142 - DNA, 22 bp, Homo sapiens
tatgaattctgttcattgatga

SEQ ID NO: 8321143 - DNA, 20 bp, Homo sapiens
tatgacaacgcagcaaggca

SEQ ID NO: 8321144 - DNA, 22 bp, Homo sapiens
tatgaatgctccagtaactttc

SEQ ID NO: 8321145 - DNA, 22 bp, Homo sapiens
tatcattttactgtgacatttt

SEQ ID NO: 8321146 - DNA, 22 bp, Homo sapiens
tatccaaaggaacaatcacagc

SEQ ID NO: 8321147 - DNA, 22 bp, Homo sapiens
tatccaaagagattcatgttct

SEQ ID NO: 8321148 - DNA, 22 bp, Homo sapiens
tatgaaaatttagctgaagcat

SEQ ID NO: 8321149 - DNA, 22 bp, Homo sapiens
tatcttttgagttctcaagatg

SEQ ID NO: 8321150 - DNA, 22 bp, Homo sapiens
tatgaaaaggtggccaatgtag

SEQ ID NO: 8321151 - DNA, 22 bp, Homo sapiens
tatgaaaaggtggccaatgtag

SEQ ID NO: 8321152 - DNA, 22 bp, Homo sapiens
tataaagagtctcaaagaagtt

SEQ ID NO: 8321153 - DNA, 22 bp, Homo sapiens
tataaagaaatgatttccagaa

SEQ ID NO: 8321154 - DNA, 22 bp, Homo sapiens
tataaagaaggcacagcaagac

SEQ ID NO: 8321155 - DNA, 22 bp, Homo sapiens
tatcagaaatgccttaaattgg

SEQ ID NO: 8321156 - DNA, 22 bp, Homo sapiens
tatgtagacttcattgtttact

SEQ ID NO: 8321157 - DNA, 22 bp, Homo sapiens
tatgtagatgtcatataaattg

SEQ ID NO: 8321158 - DNA, 22 bp, Homo sapiens
tatgtattagagctccatgagg

SEQ ID NO: 8321159 - DNA, 21 bp, Homo sapiens
tattaatatgtctaagctgat

SEQ ID NO: 8321160 - DNA, 22 bp, Homo sapiens
tattaattcttgccaattctcc

SEQ ID NO: 8321161 - DNA, 22 bp, Homo sapiens
tattaattcttgccaattctcc

SEQ ID NO: 8321162 - DNA, 22 bp, Homo sapiens
tatgtttctgggcttgatattt

SEQ ID NO: 8321163 - DNA, 22 bp, Homo sapiens
tatgtttcatcaggcatggagt

SEQ ID NO: 8321164 - DNA, 22 bp, Homo sapiens
tatgtagaaaacaaaagttgaa

SEQ ID NO: 8321165 - DNA, 21 bp, Homo sapiens
tatgtagactcgttagaatgc

SEQ ID NO: 8321166 - DNA, 22 bp, Homo sapiens
tatgtactacactagaacattt

SEQ ID NO: 8321167 - DNA, 22 bp, Homo sapiens
tatgctttgcaattggaaaagg

SEQ ID NO: 8321168 - DNA, 22 bp, Homo sapiens
tatgctttaaccctcttatatt

SEQ ID NO: 8321169 - DNA, 22 bp, Homo sapiens
tatgctttaacattaaacaaca

SEQ ID NO: 8321170 - DNA, 22 bp, Homo sapiens
tatttcttgttattctcgttga

SEQ ID NO: 8321171 - DNA, 22 bp, Homo sapiens
tatttgagcgaagcagtgtttt

SEQ ID NO: 8321172 - DNA, 22 bp, Homo sapiens
tatttgaagggagaaagtgcca

SEQ ID NO: 8321173 - DNA, 22 bp, Homo sapiens
tatttgcaggcttttgtcatgg

SEQ ID NO: 8321174 - DNA, 22 bp, Homo sapiens
tatttgcaggacatagatatgg

SEQ ID NO: 8321175 - DNA, 22 bp, Homo sapiens
tattttgacgattttatgcaaa

SEQ ID NO: 8321176 - DNA, 22 bp, Homo sapiens
tattttctggggagagtgaacc

SEQ ID NO: 8321177 - DNA, 22 bp, Homo sapiens
tattttctggggagagtgaacc

SEQ ID NO: 8321178 - DNA, 22 bp, Homo sapiens
tatttggaaacaattcacatgc

SEQ ID NO: 8321179 - DNA, 22 bp, Homo sapiens
tatttggaatagcttgctaatg

SEQ ID NO: 8321180 - DNA, 22 bp, Homo sapiens
tattgtccaataggatgttcct

SEQ ID NO: 8321181 - DNA, 22 bp, Homo sapiens
tattacaatttacattgcactt

SEQ ID NO: 8321182 - DNA, 23 bp, Homo sapiens
tattacaattggtcttattaaga

SEQ ID NO: 8321183 - DNA, 22 bp, Homo sapiens
tatttaaaataagccccagtgg

SEQ ID NO: 8321184 - DNA, 22 bp, Homo sapiens
tatttaagatgtgtcataaaga

SEQ ID NO: 8321185 - DNA, 22 bp, Homo sapiens
tcaaaaatggtctttgagctgc

SEQ ID NO: 8321186 - DNA, 22 bp, Homo sapiens
tattttgaggtatttttgagct

SEQ ID NO: 8321187 - DNA, 22 bp, Homo sapiens
tattttgtatttatgcaagaaa

SEQ ID NO: 8321188 - DNA, 22 bp, Homo sapiens
tcaaaaataagatattctggac

SEQ ID NO: 8321189 - DNA, 22 bp, Homo sapiens
tcaaaaataagatattctggac

SEQ ID NO: 8321190 - DNA, 22 bp, Homo sapiens
tcaaagtaaaagtatagagttt

SEQ ID NO: 8321191 - DNA, 22 bp, Homo sapiens
tcaaaggctgcttgtcttctgg

SEQ ID NO: 8321192 - DNA, 22 bp, Homo sapiens
tcaaaggcttgtggttctggga

SEQ ID NO: 8321193 - DNA, 22 bp, Homo sapiens
tcaaagtagccggatggaattt

SEQ ID NO: 8321194 - DNA, 22 bp, Homo sapiens
tcaaagtattttaactgtatcc

SEQ ID NO: 8321195 - DNA, 22 bp, Homo sapiens
tcaaataatgccattcatcatc

SEQ ID NO: 8321196 - DNA, 22 bp, Homo sapiens
tcaaataaggagtcatgaccat

SEQ ID NO: 8321197 - DNA, 22 bp, Homo sapiens
tcaaataaggagtcatgaccat

SEQ ID NO: 8321198 - DNA, 22 bp, Homo sapiens
tcaaataatgccattcatcatc

SEQ ID NO: 8321199 - DNA, 22 bp, Homo sapiens
tcaaataggcttgtagtgactg

SEQ ID NO: 8321200 - DNA, 22 bp, Homo sapiens
tcaaatctttaacatgtgcaaa

SEQ ID NO: 8321201 - DNA, 22 bp, Homo sapiens
tcaaatgaagacagttgacttg

SEQ ID NO: 8321202 - DNA, 22 bp, Homo sapiens
tcaaatgacaagcacttttggg

SEQ ID NO: 8321203 - DNA, 22 bp, Homo sapiens
tcaaatgagaggcagggcagct

SEQ ID NO: 8321204 - DNA, 21 bp, Homo sapiens
tcaaatcaggtatcactattg

SEQ ID NO: 8321205 - DNA, 22 bp, Homo sapiens
tcaaatattggctatttcacat

SEQ ID NO: 8321206 - DNA, 22 bp, Homo sapiens
tacttaatgccactgaattgta

SEQ ID NO: 8321207 - DNA, 18 bp, Homo sapiens
tactgtttaattgattac

SEQ ID NO: 8321208 - DNA, 22 bp, Homo sapiens
tactgtttttaaaattgcatcc

SEQ ID NO: 8321209 - DNA, 22 bp, Homo sapiens
tactgtttttgcctctttagaa

SEQ ID NO: 8321210 - DNA, 22 bp, Homo sapiens
tactgaaacttttcttcaactg

SEQ ID NO: 8321211 - DNA, 22 bp, Homo sapiens
tactgaaagaatacataatttc

SEQ ID NO: 8321212 - DNA, 22 bp, Homo sapiens
tactgaaaaagaatccagacct

SEQ ID NO: 8321213 - DNA, 22 bp, Homo sapiens
tactgaaaaagaatccagacct

SEQ ID NO: 8321214 - DNA, 22 bp, Homo sapiens
tactgaaactcttgtaaatatc

SEQ ID NO: 8321215 - DNA, 22 bp, Homo sapiens
tactgaaactcttgtaaatatc

SEQ ID NO: 8321216 - DNA, 22 bp, Homo sapiens
tactgaaactcttgtaaatatc

SEQ ID NO: 8321217 - DNA, 22 bp, Homo sapiens
tactacatacagaatttagaga

SEQ ID NO: 8321218 - DNA, 22 bp, Homo sapiens
tactagaaaaacacatgctctg

SEQ ID NO: 8321219 - DNA, 22 bp, Homo sapiens
tacatgtatgtttatcttgaga

SEQ ID NO: 8321220 - DNA, 22 bp, Homo sapiens
taccaaatgtaatcattctaat

SEQ ID NO: 8321221 - DNA, 22 bp, Homo sapiens
taccaaatgtaatcattctaat

SEQ ID NO: 8321222 - DNA, 19 bp, Homo sapiens
taccaaattgcattatggc

SEQ ID NO: 8321223 - DNA, 22 bp, Homo sapiens
tacatgctccttatgagaatct

SEQ ID NO: 8321224 - DNA, 22 bp, Homo sapiens
tacatgaatttgagtcagagga

SEQ ID NO: 8321225 - DNA, 22 bp, Homo sapiens
tacagtgacctagaataaatac

SEQ ID NO: 8321226 - DNA, 22 bp, Homo sapiens
tacagtcagagtgcctttctaa

SEQ ID NO: 8321227 - DNA, 22 bp, Homo sapiens
tacagagtaatttgcatgggga

SEQ ID NO: 8321228 - DNA, 22 bp, Homo sapiens
tacagaggggacatggaagaca

SEQ ID NO: 8321229 - DNA, 22 bp, Homo sapiens
tacagagggtaattgatcaagg

SEQ ID NO: 8321230 - DNA, 22 bp, Homo sapiens
tacagagggattatctaagggt

SEQ ID NO: 8321231 - DNA, 22 bp, Homo sapiens
tacagaggctgggttttcaggg

SEQ ID NO: 8321232 - DNA, 22 bp, Homo sapiens
tacagagatgccgaagagtgaa

SEQ ID NO: 8321233 - DNA, 22 bp, Homo sapiens
tacagaggagaccaaggctcag

SEQ ID NO: 8321234 - DNA, 22 bp, Homo sapiens
tacagaggaggggattttaata

SEQ ID NO: 8321235 - DNA, 22 bp, Homo sapiens
tacagaggcacatgcaattttc

SEQ ID NO: 8321236 - DNA, 22 bp, Homo sapiens
tacagaggaggtggttgggagt

SEQ ID NO: 8321237 - DNA, 21 bp, Homo sapiens
taatttattcagcacagtgtt

SEQ ID NO: 8321238 - DNA, 22 bp, Homo sapiens
tacaacataacgggcattcagt

SEQ ID NO: 8321239 - DNA, 22 bp, Homo sapiens
tacaacattgtgttgcttcata

SEQ ID NO: 8321240 - DNA, 22 bp, Homo sapiens
tacaagaaatttctgcatatat

SEQ ID NO: 8321241 - DNA, 22 bp, Homo sapiens
tacaagataagaattggcaagg

SEQ ID NO: 8321242 - DNA, 22 bp, Homo sapiens
tacacaatctgtttttccattt

SEQ ID NO: 8321243 - DNA, 22 bp, Homo sapiens
tacaagagacaccagggaggct

SEQ ID NO: 8321244 - DNA, 22 bp, Homo sapiens
tacacagtagagtataatgcgt

SEQ ID NO: 8321245 - DNA, 22 bp, Homo sapiens
tacacacagaggccatgggatt

SEQ ID NO: 8321246 - DNA, 22 bp, Homo sapiens
tacacacatgcatttgccttat

SEQ ID NO: 8321247 - DNA, 22 bp, Homo sapiens
tacagaattagattattagaga

SEQ ID NO: 8321248 - DNA, 22 bp, Homo sapiens
tacagaatgtgtatcattacca

SEQ ID NO: 8321249 - DNA, 22 bp, Homo sapiens
tacagaattagattattagaga

SEQ ID NO: 8321250 - DNA, 22 bp, Homo sapiens
taatttatgatgcaaagaaaag

SEQ ID NO: 8321251 - DNA, 22 bp, Homo sapiens
taattgctattggaatgctttg

SEQ ID NO: 8321252 - DNA, 22 bp, Homo sapiens
taattgaactaacatgcaaaca

SEQ ID NO: 8321253 - DNA, 22 bp, Homo sapiens
taattattatgacaacaattgc

SEQ ID NO: 8321254 - DNA, 22 bp, Homo sapiens
taatctgtttcccaaggtgata

SEQ ID NO: 8321255 - DNA, 22 bp, Homo sapiens
taatctgaagaaacaggacttg

SEQ ID NO: 8321256 - DNA, 22 bp, Homo sapiens
taaggaaagtgccatgatttct

SEQ ID NO: 8321257 - DNA, 22 bp, Homo sapiens
taatataccaaactgtaatttt

SEQ ID NO: 8321258 - DNA, 19 bp, Homo sapiens
taatatacagacccatctg

SEQ ID NO: 8321259 - DNA, 22 bp, Homo sapiens
taatatatacctttgttaggaa

SEQ ID NO: 8321260 - DNA, 22 bp, Homo sapiens
taagacataaataggcttttta

SEQ ID NO: 8321261 - DNA, 22 bp, Homo sapiens
taacatgttaagaaattagata

SEQ ID NO: 8321262 - DNA, 22 bp, Homo sapiens
taagagaactggatagatagga

SEQ ID NO: 8321263 - DNA, 22 bp, Homo sapiens
taagagaaggatctgttccagg

SEQ ID NO: 8321264 - DNA, 22 bp, Homo sapiens
taaatgtgttgtggatgaagtt

SEQ ID NO: 8321265 - DNA, 20 bp, Homo sapiens
taacaggaagcattatttta

SEQ ID NO: 8321266 - DNA, 22 bp, Homo sapiens
taacatcttgcagtagcagaac

SEQ ID NO: 8321267 - DNA, 22 bp, Homo sapiens
taacatctaagggagagaaagt

SEQ ID NO: 8321268 - DNA, 22 bp, Homo sapiens
taacagtgtggacttgagatct

SEQ ID NO: 8321269 - DNA, 22 bp, Homo sapiens
taaaagtggataagctgtagga

SEQ ID NO: 8321270 - DNA, 22 bp, Homo sapiens
taaaagtatactttcaaaggag

SEQ ID NO: 8321271 - DNA, 22 bp, Homo sapiens
taaaagtaggaatgaaacgcat

SEQ ID NO: 8321272 - DNA, 22 bp, Homo sapiens
taaaagctgagatatcctgtac

SEQ ID NO: 8321273 - DNA, 22 bp, Homo sapiens
taaaactgaatacatactgagg

SEQ ID NO: 8321274 - DNA, 22 bp, Homo sapiens
taaaacttctcatttttatggt

SEQ ID NO: 8321275 - DNA, 22 bp, Homo sapiens
taaaagagaatggataacagag

SEQ ID NO: 8321276 - DNA, 22 bp, Homo sapiens
taaaagaagcttcaaggccggc

SEQ ID NO: 8321277 - DNA, 22 bp, Homo sapiens
taaaagaagcttcaaggccggc

SEQ ID NO: 8321278 - DNA, 22 bp, Homo sapiens
taaatgatttatgtatgtgaaa

SEQ ID NO: 8321279 - DNA, 22 bp, Homo sapiens
taaagacatggtgtaggtgaac

SEQ ID NO: 8321280 - DNA, 19 bp, Homo sapiens
taaagcacatagcaaaagt

SEQ ID NO: 8321281 - DNA, 22 bp, Homo sapiens
taaagcacagtatgagcattgg

SEQ ID NO: 8321282 - DNA, 22 bp, Homo sapiens
gtttgcatggaagacagtgagt

SEQ ID NO: 8321283 - DNA, 22 bp, Homo sapiens
gtttgcatgtgtacttaattgg

SEQ ID NO: 8321284 - DNA, 22 bp, Homo sapiens
gtttgcaggaactctggggaga

SEQ ID NO: 8321285 - DNA, 22 bp, Homo sapiens
gtttgcagggagagatgtggtg

SEQ ID NO: 8321286 - DNA, 22 bp, Homo sapiens
gtttgaaacatgcacctggagg

SEQ ID NO: 8321287 - DNA, 22 bp, Homo sapiens
gtttcttttaaaatatgtagac

SEQ ID NO: 8321288 - DNA, 22 bp, Homo sapiens
gtttcaagtagctgctgattat

SEQ ID NO: 8321289 - DNA, 22 bp, Homo sapiens
gtttcaatttcactttccaggc

SEQ ID NO: 8321290 - DNA, 22 bp, Homo sapiens
gtttcaatttgacccaaatctt

SEQ ID NO: 8321291 - DNA, 22 bp, Homo sapiens
gtttcaatttgaatgcgaggct

SEQ ID NO: 8321292 - DNA, 22 bp, Homo sapiens
gtttcaagggaactgttttggt

SEQ ID NO: 8321293 - DNA, 22 bp, Homo sapiens
gtttcaagcagatggcctgagg

SEQ ID NO: 8321294 - DNA, 22 bp, Homo sapiens
gtttcaagagtggctcaaaact

SEQ ID NO: 8321295 - DNA, 22 bp, Homo sapiens
gtttcactgcactatagcacca

SEQ ID NO: 8321296 - DNA, 22 bp, Homo sapiens
gttctttaaactgctgctctgt

SEQ ID NO: 8321297 - DNA, 22 bp, Homo sapiens
gttgaagtttatatgagtgctt

SEQ ID NO: 8321298 - DNA, 23 bp, Homo sapiens
gttgaagtggtcggggaggcaga

SEQ ID NO: 8321299 - DNA, 22 bp, Homo sapiens
gtttatattcaacggagtatct

SEQ ID NO: 8321300 - DNA, 22 bp, Homo sapiens
gttgagagttaagcgggctaat

SEQ ID NO: 8321301 - DNA, 22 bp, Homo sapiens
gtttatgaattgcattcccttt

SEQ ID NO: 8321302 - DNA, 21 bp, Homo sapiens
gtttatgaatcttgtcctgct

SEQ ID NO: 8321303 - DNA, 22 bp, Homo sapiens
gtttcaaagcacagctcacatt

SEQ ID NO: 8321304 - DNA, 22 bp, Homo sapiens
gtttcaaagcacagctcacatt

SEQ ID NO: 8321305 - DNA, 22 bp, Homo sapiens
gttatattcaaaatgaggctgt

SEQ ID NO: 8321306 - DNA, 22 bp, Homo sapiens
gttatataagacaaatcagagt

SEQ ID NO: 8321307 - DNA, 22 bp, Homo sapiens
gttatattggcagaagagaaga

SEQ ID NO: 8321308 - DNA, 22 bp, Homo sapiens
gttatcatgcttcatcatcact

SEQ ID NO: 8321309 - DNA, 22 bp, Homo sapiens
gttaaataacctcatgtccgtt

SEQ ID NO: 8321310 - DNA, 22 bp, Homo sapiens
gttaaataacctcatgtccgtt

SEQ ID NO: 8321311 - DNA, 22 bp, Homo sapiens
gtgtttataggagtgaatgctg

SEQ ID NO: 8321312 - DNA, 18 bp, Homo sapiens
gttaacaattactaacgc

SEQ ID NO: 8321313 - DNA, 23 bp, Homo sapiens
gtgttggcagcagtgctctgggg

SEQ ID NO: 8321314 - DNA, 22 bp, Homo sapiens
gtgttcttttgcttcacagaaa

SEQ ID NO: 8321315 - DNA, 22 bp, Homo sapiens
gtgctggcctcagagggtcatg

SEQ ID NO: 8321316 - DNA, 17 bp, Homo sapiens
gtgctggcctggggctc

SEQ ID NO: 8321317 - DNA, 17 bp, Homo sapiens
gtgctggcctggggctc

SEQ ID NO: 8321318 - DNA, 22 bp, Homo sapiens
gtgctggctgccaggaggctgc

SEQ ID NO: 8321319 - DNA, 22 bp, Homo sapiens
gtgctggctgccaggaggctgc

SEQ ID NO: 8321320 - DNA, 22 bp, Homo sapiens
gtgctggctggacatggagcac

SEQ ID NO: 8321321 - DNA, 21 bp, Homo sapiens
gtgctgggacacagccaggct

SEQ ID NO: 8321322 - DNA, 21 bp, Homo sapiens
gtgctgggacacagccaggct

SEQ ID NO: 8321323 - DNA, 22 bp, Homo sapiens
gagggctgataaatgcgcatgg

SEQ ID NO: 8321324 - DNA, 22 bp, Homo sapiens
gagggctgataaatgcgcatgg

SEQ ID NO: 8321325 - DNA, 22 bp, Homo sapiens
gagggccaggcagcaagaaggc

SEQ ID NO: 8321326 - DNA, 22 bp, Homo sapiens
gagggccagcagcctcagcatg

SEQ ID NO: 8321327 - DNA, 22 bp, Homo sapiens
gagggccagatcccaggaggaa

SEQ ID NO: 8321328 - DNA, 22 bp, Homo sapiens
gagggccagagtcctggggtca

SEQ ID NO: 8321329 - DNA, 22 bp, Homo sapiens
gagggaccccaggctggccctt

SEQ ID NO: 8321330 - DNA, 22 bp, Homo sapiens
gagggccacgttcagggctctc

SEQ ID NO: 8321331 - DNA, 22 bp, Homo sapiens
gaggctgtaacttgggcactgg

SEQ ID NO: 8321332 - DNA, 22 bp, Homo sapiens
gaggcctggtgtgtctcccgct

SEQ ID NO: 8321333 - DNA, 22 bp, Homo sapiens
gaggcctggtgctgtgtccaca

SEQ ID NO: 8321334 - DNA, 22 bp, Homo sapiens
gaggcctgtcgctaggcctctg

SEQ ID NO: 8321335 - DNA, 19 bp, Homo sapiens
gaggcgaggcgtgcaggag

SEQ ID NO: 8321336 - DNA, 22 bp, Homo sapiens
gaggctggtggttagttccatt

SEQ ID NO: 8321337 - DNA, 22 bp, Homo sapiens
gaggctggggtctgcctttctg

SEQ ID NO: 8321338 - DNA, 22 bp, Homo sapiens
gaggcggcggccgagcctggct

SEQ ID NO: 8321339 - DNA, 22 bp, Homo sapiens
gaggtgggagggcagtccctaa

SEQ ID NO: 8321340 - DNA, 23 bp, Homo sapiens
gaggtgtgaattctgggtgctgc

SEQ ID NO: 8321341 - DNA, 21 bp, Homo sapiens
gagtaacatttcctctccaca

SEQ ID NO: 8321342 - DNA, 22 bp, Homo sapiens
gagtaacagcataaatttgtga

SEQ ID NO: 8321343 - DNA, 22 bp, Homo sapiens
gaggtggatgttgcagtgagct

SEQ ID NO: 8321344 - DNA, 22 bp, Homo sapiens
gaggtggctgtcagcttcactt

SEQ ID NO: 8321345 - DNA, 22 bp, Homo sapiens
gagggtgggtacaccagccctc

SEQ ID NO: 8321346 - DNA, 22 bp, Homo sapiens
gagggtggggaatagactgcta

SEQ ID NO: 8321347 - DNA, 22 bp, Homo sapiens
gagggctgataacaggaataca

SEQ ID NO: 8321348 - DNA, 22 bp, Homo sapiens
gagggtgcaggaggatggtagt

SEQ ID NO: 8321349 - DNA, 22 bp, Homo sapiens
gagggtgcagctgggccccacg

SEQ ID NO: 8321350 - DNA, 22 bp, Homo sapiens
gagggtggagctccagaatctg

SEQ ID NO: 8321351 - DNA, 22 bp, Homo sapiens
gaggccagaagtctgagatcag

SEQ ID NO: 8321352 - DNA, 22 bp, Homo sapiens
gaggccacttcctactggagga

SEQ ID NO: 8321353 - DNA, 22 bp, Homo sapiens
gaggccagagttccccgagtca

SEQ ID NO: 8321354 - DNA, 21 bp, Homo sapiens
gaggccactaataggggcaga

SEQ ID NO: 8321355 - DNA, 21 bp, Homo sapiens
gaggccactaataggggcaga

SEQ ID NO: 8321356 - DNA, 22 bp, Homo sapiens
gaggccacggaagggagctgtg

SEQ ID NO: 8321357 - DNA, 22 bp, Homo sapiens
gaggaccacagatgagcctgca

SEQ ID NO: 8321358 - DNA, 22 bp, Homo sapiens
gaggacagtgtgatctgccagc

SEQ ID NO: 8321359 - DNA, 22 bp, Homo sapiens
gaggagacatatttttgaagca

SEQ ID NO: 8321360 - DNA, 22 bp, Homo sapiens
gaggagagaagctaacggtgct

SEQ ID NO: 8321361 - DNA, 22 bp, Homo sapiens
gaggagtgtattccacaccact

SEQ ID NO: 8321362 - DNA, 22 bp, Homo sapiens
gaggaggttgacggcactgtga

SEQ ID NO: 8321363 - DNA, 22 bp, Homo sapiens
gagctcagagcctatagttggt

SEQ ID NO: 8321364 - DNA, 19 bp, Homo sapiens
gagcaggccacacatgtgt

SEQ ID NO: 8321365 - DNA, 22 bp, Homo sapiens
gagctcattcattcattgcctg

SEQ ID NO: 8321366 - DNA, 22 bp, Homo sapiens
gagctcatccccatggtccgtc

SEQ ID NO: 8321367 - DNA, 22 bp, Homo sapiens
gagcaatacatggcatgaaatt

SEQ ID NO: 8321368 - DNA, 22 bp, Homo sapiens
gagcacagaactaaatgctggt

SEQ ID NO: 8321369 - DNA, 22 bp, Homo sapiens
gagcaatggaagatagataaca

SEQ ID NO: 8321370 - DNA, 22 bp, Homo sapiens
gagcaaggatggccggggccgt

SEQ ID NO: 8321371 - DNA, 22 bp, Homo sapiens
gagcaaggtagctctctggggc

SEQ ID NO: 8321372 - DNA, 22 bp, Homo sapiens
gagcaaagcttttagggccttt

SEQ ID NO: 8321373 - DNA, 22 bp, Homo sapiens
gagaggcaggaatcctgggtga

SEQ ID NO: 8321374 - DNA, 22 bp, Homo sapiens
gagcagaacaggccgggtggga

SEQ ID NO: 8321375 - DNA, 22 bp, Homo sapiens
gagcacttcagaattgggcaat

SEQ ID NO: 8321376 - DNA, 22 bp, Homo sapiens
gagcagagcttctcaaagtaaa

SEQ ID NO: 8321377 - DNA, 22 bp, Homo sapiens
gagaggagaagcctgcgcttca

SEQ ID NO: 8321378 - DNA, 22 bp, Homo sapiens
gagagcaggaggcagcgggacg

SEQ ID NO: 8321379 - DNA, 22 bp, Homo sapiens
gagagacagcagaacgtgcagc

SEQ ID NO: 8321380 - DNA, 22 bp, Homo sapiens
gagagacagcacacagtgtggg

SEQ ID NO: 8321381 - DNA, 22 bp, Homo sapiens
gagagagaaggcctgtgggtgt

SEQ ID NO: 8321382 - DNA, 22 bp, Homo sapiens
gagaagccgagtcagctgagcc

SEQ ID NO: 8321383 - DNA, 22 bp, Homo sapiens
gagaagctgttggagaattttt

SEQ ID NO: 8321384 - DNA, 19 bp, Homo sapiens
gactccaactttaagcatg

SEQ ID NO: 8321385 - DNA, 22 bp, Homo sapiens
gacagctgcctctgtgtagatc

SEQ ID NO: 8321386 - DNA, 22 bp, Homo sapiens
gacagcagggacatgtaggaag

SEQ ID NO: 8321387 - DNA, 22 bp, Homo sapiens
gacagcaggtgcttgggaaagg

SEQ ID NO: 8321388 - DNA, 22 bp, Homo sapiens
gacagcagtcctggagttccca

SEQ ID NO: 8321389 - DNA, 22 bp, Homo sapiens
gacagtcctgcaggttgaactc

SEQ ID NO: 8321390 - DNA, 22 bp, Homo sapiens
gacatgcatgaatgcaggtctc

SEQ ID NO: 8321391 - DNA, 22 bp, Homo sapiens
gacatgcagttctcaagggtag

SEQ ID NO: 8321392 - DNA, 22 bp, Homo sapiens
gacatgcattaagacacactga

SEQ ID NO: 8321393 - DNA, 22 bp, Homo sapiens
gacatgggatgagatgaagcat

SEQ ID NO: 8321394 - DNA, 22 bp, Homo sapiens
gacctggggtggaaggaaggca

SEQ ID NO: 8321395 - DNA, 22 bp, Homo sapiens
gacctgggtaaggggctgacaa

SEQ ID NO: 8321396 - DNA, 22 bp, Homo sapiens
gacctggtgctagctggtgtgt

SEQ ID NO: 8321397 - DNA, 22 bp, Homo sapiens
gacctggtgcaggtggacagag

SEQ ID NO: 8321398 - DNA, 22 bp, Homo sapiens
gaccttcttgctgtgtcctaac

SEQ ID NO: 8321399 - DNA, 22 bp, Homo sapiens
gactacaggtgtgtgccaccat

SEQ ID NO: 8321400 - DNA, 22 bp, Homo sapiens
gacagcaggatgtgaggggatg

SEQ ID NO: 8321401 - DNA, 22 bp, Homo sapiens
gacagcagggaaagtccagacc

SEQ ID NO: 8321402 - DNA, 22 bp, Homo sapiens
gacagcagccacagggagaggg

SEQ ID NO: 8321403 - DNA, 22 bp, Homo sapiens
gacaaagagaagtaacagtacc

SEQ ID NO: 8321404 - DNA, 22 bp, Homo sapiens
gaatttatctacgttaagtatg

SEQ ID NO: 8321405 - DNA, 22 bp, Homo sapiens
gaatttacaagttgaataacaa

SEQ ID NO: 8321406 - DNA, 22 bp, Homo sapiens
gaattttattactagtcaactg

SEQ ID NO: 8321407 - DNA, 22 bp, Homo sapiens
gaatgctaagcatgtgggagtt

SEQ ID NO: 8321408 - DNA, 22 bp, Homo sapiens
gaagaaggtgctacacagggca

SEQ ID NO: 8321409 - DNA, 22 bp, Homo sapiens
gaagaatctgaggacagtcatt

SEQ ID NO: 8321410 - DNA, 22 bp, Homo sapiens
gaagaatatataatgattttgt

SEQ ID NO: 8321411 - DNA, 22 bp, Homo sapiens
gaagaatattcttgatcttaga

SEQ ID NO: 8321412 - DNA, 22 bp, Homo sapiens
gaatggaaactgggagatggcc

SEQ ID NO: 8321413 - DNA, 18 bp, Homo sapiens
ctgtgggctggtgcatga

SEQ ID NO: 8321414 - DNA, 22 bp, Homo sapiens
ctgtgggtgaagacaagggaga

SEQ ID NO: 8321415 - DNA, 19 bp, Homo sapiens
ctgtgggtgtgcaagggtg

SEQ ID NO: 8321416 - DNA, 22 bp, Homo sapiens
ctgtggtctgtaggagtgatgg

SEQ ID NO: 8321417 - DNA, 22 bp, Homo sapiens
ctgtggtgagcaactgactgaa

SEQ ID NO: 8321418 - DNA, 20 bp, Homo sapiens
ctgtggtgagcaggagagta

SEQ ID NO: 8321419 - DNA, 22 bp, Homo sapiens
ctgtgggagcactggggaccga

SEQ ID NO: 8321420 - DNA, 22 bp, Homo sapiens
ctgtggctttctctgcctcctt

SEQ ID NO: 8321421 - DNA, 19 bp, Homo sapiens
ctgtgggcggaggaggggc

SEQ ID NO: 8321422 - DNA, 22 bp, Homo sapiens
ctgtggcattgccgaggctggc

SEQ ID NO: 8321423 - DNA, 22 bp, Homo sapiens
ctgtggcagggaagaggccatg

SEQ ID NO: 8321424 - DNA, 20 bp, Homo sapiens
ctgtggcatctgtcatggtg

SEQ ID NO: 8321425 - DNA, 22 bp, Homo sapiens
ctgtggcaggtgtctggggcag

SEQ ID NO: 8321426 - DNA, 22 bp, Homo sapiens
ctgtggagtttgtggcgctgac

SEQ ID NO: 8321427 - DNA, 22 bp, Homo sapiens
ctgtccatggtgctggacggtc

SEQ ID NO: 8321428 - DNA, 22 bp, Homo sapiens
ctgtccatattcaaggggtagg

SEQ ID NO: 8321429 - DNA, 22 bp, Homo sapiens
ctgtcccaggatcctgactcca

SEQ ID NO: 8321430 - DNA, 22 bp, Homo sapiens
ctgtcccaggagctgtaagaca

SEQ ID NO: 8321431 - DNA, 22 bp, Homo sapiens
ctggtttgtcttgggaggatgt

SEQ ID NO: 8321432 - DNA, 22 bp, Homo sapiens
ctgtctgttatctcaccagtcc

SEQ ID NO: 8321433 - DNA, 22 bp, Homo sapiens
ctgtgacagtttctcagaattt

SEQ ID NO: 8321434 - DNA, 22 bp, Homo sapiens
ctgtgacagtttctcagacttt

SEQ ID NO: 8321435 - DNA, 22 bp, Homo sapiens
ctgtgacctccaggaaggggtg

SEQ ID NO: 8321436 - DNA, 22 bp, Homo sapiens
ctgtgagctgggtggccaggac

SEQ ID NO: 8321437 - DNA, 22 bp, Homo sapiens
ctgtgaggccctgggtgctgga

SEQ ID NO: 8321438 - DNA, 22 bp, Homo sapiens
ctgtgaggcggaaaggactctc

SEQ ID NO: 8321439 - DNA, 22 bp, Homo sapiens
ctgtgaggcgggtggagtggag

SEQ ID NO: 8321440 - DNA, 22 bp, Homo sapiens
ctgtggacaggggcgcagaggt

SEQ ID NO: 8321441 - DNA, 22 bp, Homo sapiens
ctgtgactttgaataagaggga

SEQ ID NO: 8321442 - DNA, 22 bp, Homo sapiens
ctgggaggcggaggttgcagtg

SEQ ID NO: 8321443 - DNA, 22 bp, Homo sapiens
ctgggaggcggaggttgcagtg

SEQ ID NO: 8321444 - DNA, 22 bp, Homo sapiens
ctgggagtactgggggatgtca

SEQ ID NO: 8321445 - DNA, 22 bp, Homo sapiens
ctggagctaggaagtccaagat

SEQ ID NO: 8321446 - DNA, 22 bp, Homo sapiens
ctggagctcagcccaggttcca

SEQ ID NO: 8321447 - DNA, 22 bp, Homo sapiens
ctggagccttcaccaggggaaa

SEQ ID NO: 8321448 - DNA, 22 bp, Homo sapiens
ctggagctccagggtctcctct

SEQ ID NO: 8321449 - DNA, 22 bp, Homo sapiens
ctgggatccacgggctcccaag

SEQ ID NO: 8321450 - DNA, 19 bp, Homo sapiens
ctgggagttcactgctgcc

SEQ ID NO: 8321451 - DNA, 22 bp, Homo sapiens
ctgggccagatccagcctcaca

SEQ ID NO: 8321452 - DNA, 22 bp, Homo sapiens
ctgggcccacgagggctctggg

SEQ ID NO: 8321453 - DNA, 22 bp, Homo sapiens
ctgggccagcaactgcaatgga

SEQ ID NO: 8321454 - DNA, 22 bp, Homo sapiens
ctgggccaggaccagggttgaa

SEQ ID NO: 8321455 - DNA, 22 bp, Homo sapiens
ctgggctcagtgtctcactcct

SEQ ID NO: 8321456 - DNA, 22 bp, Homo sapiens
ctgggctcagcaggccaaggcc

SEQ ID NO: 8321457 - DNA, 22 bp, Homo sapiens
ctgggcctccacgggccatcac

SEQ ID NO: 8321458 - DNA, 22 bp, Homo sapiens
ctgggcctcatccagccacaac

SEQ ID NO: 8321459 - DNA, 22 bp, Homo sapiens
ctgggcctcaccctagaccaat

SEQ ID NO: 8321460 - DNA, 22 bp, Homo sapiens
ctgggcctcacacccaccaaat

SEQ ID NO: 8321461 - DNA, 22 bp, Homo sapiens
ctgggcctaacccacagcgttt

SEQ ID NO: 8321462 - DNA, 22 bp, Homo sapiens
ctgggtggaaagtgctgagaat

SEQ ID NO: 8321463 - DNA, 22 bp, Homo sapiens
ctgggtgttcacccgaggcgct

SEQ ID NO: 8321464 - DNA, 22 bp, Homo sapiens
ctgggtgtcaggagacatgatg

SEQ ID NO: 8321465 - DNA, 22 bp, Homo sapiens
ctgggttgcaaagcgctggctg

SEQ ID NO: 8321466 - DNA, 22 bp, Homo sapiens
ctgggttgccctgggcctgtga

SEQ ID NO: 8321467 - DNA, 22 bp, Homo sapiens
ctggtgcctcctccctgtgctt

SEQ ID NO: 8321468 - DNA, 22 bp, Homo sapiens
ctggtgccctgtgtggcaggag

SEQ ID NO: 8321469 - DNA, 22 bp, Homo sapiens
ctggtcacctccttcccagcta

SEQ ID NO: 8321470 - DNA, 22 bp, Homo sapiens
ctggtgggtagagggcatcagg

SEQ ID NO: 8321471 - DNA, 22 bp, Homo sapiens
ctggtcaccaggtagcattgta

SEQ ID NO: 8321472 - DNA, 22 bp, Homo sapiens
ctggtaggggtgactgttatcg

SEQ ID NO: 8321473 - DNA, 22 bp, Homo sapiens
ctggtgtggactccgcgcggag

SEQ ID NO: 8321474 - DNA, 22 bp, Homo sapiens
ctgggctcctaaccatccaggt

SEQ ID NO: 8321475 - DNA, 22 bp, Homo sapiens
ctgggggccttacggaactcca

SEQ ID NO: 8321476 - DNA, 22 bp, Homo sapiens
ctgggggcagcaagaagccatg

SEQ ID NO: 8321477 - DNA, 22 bp, Homo sapiens
ctgggctctagaaaggaaagaa

SEQ ID NO: 8321478 - DNA, 22 bp, Homo sapiens
ctggggctggtgaggcaggctc

SEQ ID NO: 8321479 - DNA, 22 bp, Homo sapiens
ctggggctggtgaggcaggctc

SEQ ID NO: 8321480 - DNA, 22 bp, Homo sapiens
ctggggtggtgcaggcctcatg

SEQ ID NO: 8321481 - DNA, 22 bp, Homo sapiens
ctggggtgtctcgtctgccatt

SEQ ID NO: 8321482 - DNA, 22 bp, Homo sapiens
ctggggtgtctcgtctgccatt

SEQ ID NO: 8321483 - DNA, 22 bp, Homo sapiens
ctggggtgtctcgtctgccatt

SEQ ID NO: 8321484 - DNA, 22 bp, Homo sapiens
ctggggtgagcagaaacagggg

SEQ ID NO: 8321485 - DNA, 22 bp, Homo sapiens
ctggggtggagattggcaatct

SEQ ID NO: 8321486 - DNA, 22 bp, Homo sapiens
ctggggtggatgggtccaagtt

SEQ ID NO: 8321487 - DNA, 22 bp, Homo sapiens
ctgggggtcttgaaagggagag

SEQ ID NO: 8321488 - DNA, 22 bp, Homo sapiens
ctgggggtcgcgcctctgggca

SEQ ID NO: 8321489 - DNA, 22 bp, Homo sapiens
ctggggggctactgacagagga

SEQ ID NO: 8321490 - DNA, 22 bp, Homo sapiens
ctggggtgaaggattacctgag

SEQ ID NO: 8321491 - DNA, 22 bp, Homo sapiens
ctgggggtgagcagcagcgacg

SEQ ID NO: 8321492 - DNA, 22 bp, Homo sapiens
cttggactttccagcttctaaa

SEQ ID NO: 8321493 - DNA, 22 bp, Homo sapiens
ctttctaaatgttccttgatta

SEQ ID NO: 8321494 - DNA, 22 bp, Homo sapiens
ctttctaattctcccatagtct

SEQ ID NO: 8321495 - DNA, 22 bp, Homo sapiens
ctttcctccactccctaggctt

SEQ ID NO: 8321496 - DNA, 22 bp, Homo sapiens
cttggagtgaatgggggcaggt

SEQ ID NO: 8321497 - DNA, 22 bp, Homo sapiens
cttggaggaaggggctcttctg

SEQ ID NO: 8321498 - DNA, 22 bp, Homo sapiens
ctttctaattctcccatagtct

SEQ ID NO: 8321499 - DNA, 22 bp, Homo sapiens
ctttgcatgggtctgaaggctt

SEQ ID NO: 8321500 - DNA, 22 bp, Homo sapiens
cttcacatgttggagtcctttg

SEQ ID NO: 8321501 - DNA, 22 bp, Homo sapiens
cttcacatctccctaaaacagc

SEQ ID NO: 8321502 - DNA, 22 bp, Homo sapiens
cttcacattagtttggatcaaa

SEQ ID NO: 8321503 - DNA, 22 bp, Homo sapiens
cttcacattgggcttgatatga

SEQ ID NO: 8321504 - DNA, 22 bp, Homo sapiens
cttcaaatgtgattttaataac

SEQ ID NO: 8321505 - DNA, 22 bp, Homo sapiens
cttcaaatacaagtagattatg

SEQ ID NO: 8321506 - DNA, 22 bp, Homo sapiens
cttcaaatccccctgagtttga

SEQ ID NO: 8321507 - DNA, 22 bp, Homo sapiens
cttccctttagcatatagtagt

SEQ ID NO: 8321508 - DNA, 22 bp, Homo sapiens
cttccctttctggtgacttctc

SEQ ID NO: 8321509 - DNA, 22 bp, Homo sapiens
cttccctttctggtgacttctc

SEQ ID NO: 8321510 - DNA, 22 bp, Homo sapiens
cttcccttggtgaacagagcat

SEQ ID NO: 8321511 - DNA, 22 bp, Homo sapiens
cttcccttctgtgcagggcaga

SEQ ID NO: 8321512 - DNA, 22 bp, Homo sapiens
cttcccttctgcagatctttgg

SEQ ID NO: 8321513 - DNA, 22 bp, Homo sapiens
cttcttcaagagaatgggagac

SEQ ID NO: 8321514 - DNA, 22 bp, Homo sapiens
cttcttcaatagcaagcgcata

SEQ ID NO: 8321515 - DNA, 22 bp, Homo sapiens
cttcttcagcacaatattgatg

SEQ ID NO: 8321516 - DNA, 22 bp, Homo sapiens
cttcccttcctggggcaattta

SEQ ID NO: 8321517 - DNA, 22 bp, Homo sapiens
cttcccttcccctcacggagac

SEQ ID NO: 8321518 - DNA, 22 bp, Homo sapiens
cttcccagaacaatgtaggctt

SEQ ID NO: 8321519 - DNA, 22 bp, Homo sapiens
ctttggaggtcatagccaagag

SEQ ID NO: 8321520 - DNA, 22 bp, Homo sapiens
ctttttgcaagagtttctcatc

SEQ ID NO: 8321521 - DNA, 22 bp, Homo sapiens
ctttttcctcgtagagcctaat

SEQ ID NO: 8321522 - DNA, 22 bp, Homo sapiens
cttttgttaggagaaaacatca

SEQ ID NO: 8321523 - DNA, 22 bp, Homo sapiens
ctttttcccaggtggagagagg

SEQ ID NO: 8321524 - DNA, 22 bp, Homo sapiens
cttttgttgcccttgtcgcagg

SEQ ID NO: 8321525 - DNA, 22 bp, Homo sapiens
cttttgttctacagctggggaa

SEQ ID NO: 8321526 - DNA, 22 bp, Homo sapiens
gaaagaatgagcatcatgactt

SEQ ID NO: 8321527 - DNA, 22 bp, Homo sapiens
gaaacccaaactaagacagtag

SEQ ID NO: 8321528 - DNA, 22 bp, Homo sapiens
ctttttgttgtccacactagga

SEQ ID NO: 8321529 - DNA, 22 bp, Homo sapiens
gaaaacactttgatctgaaagt

SEQ ID NO: 8321530 - DNA, 22 bp, Homo sapiens
gaaaccagctagaggcagaggg

SEQ ID NO: 8321531 - DNA, 22 bp, Homo sapiens
gaaaaatgctccaaatctgtgg

SEQ ID NO: 8321532 - DNA, 22 bp, Homo sapiens
gaaaaatgctccaaatctgtgg

SEQ ID NO: 8321533 - DNA, 22 bp, Homo sapiens
gaaatacagaaagggctgaatg

SEQ ID NO: 8321534 - DNA, 22 bp, Homo sapiens
gaaatattgtactggagatgtt

SEQ ID NO: 8321535 - DNA, 22 bp, Homo sapiens
gaaattcactgtatttcttggg

SEQ ID NO: 8321536 - DNA, 22 bp, Homo sapiens
gaaattcaccttttacgtggcc

SEQ ID NO: 8321537 - DNA, 22 bp, Homo sapiens
gaaattcaaaatgtcagtatag

SEQ ID NO: 8321538 - DNA, 22 bp, Homo sapiens
gaagaagacatggaacaatagt

SEQ ID NO: 8321539 - DNA, 22 bp, Homo sapiens
gaacttgttgtaagaaaatatg

SEQ ID NO: 8321540 - DNA, 22 bp, Homo sapiens
cgagagttagctaggagtcaca

SEQ ID NO: 8321541 - DNA, 22 bp, Homo sapiens
ttattgcaactcctaaatagag

SEQ ID NO: 8321542 - DNA, 22 bp, Homo sapiens
ttattgagttgtaagagctctt

SEQ ID NO: 8321543 - DNA, 22 bp, Homo sapiens
ttattgagtatctgcttggtgt

SEQ ID NO: 8321544 - DNA, 22 bp, Homo sapiens
cgaaaatagatctgtttcccag

SEQ ID NO: 8321545 - DNA, 22 bp, Homo sapiens
cgagagatgggttggcaggggc

SEQ ID NO: 8321546 - DNA, 22 bp, Homo sapiens
cgagagagacatggtgacctgc

SEQ ID NO: 8321547 - DNA, 22 bp, Homo sapiens
cgagaaatgagaaacccatttt

SEQ ID NO: 8321548 - DNA, 22 bp, Homo sapiens
cgactctgcagggatccgggag

SEQ ID NO: 8321549 - DNA, 22 bp, Homo sapiens
ccttttcttgccactgactcgg

SEQ ID NO: 8321550 - DNA, 22 bp, Homo sapiens
cctttggtaacattccaacctt

SEQ ID NO: 8321551 - DNA, 22 bp, Homo sapiens
cctttggtaattctgtgtagag

SEQ ID NO: 8321552 - DNA, 22 bp, Homo sapiens
ccttttctaggatgctttatag

SEQ ID NO: 8321553 - DNA, 22 bp, Homo sapiens
ccttttctatccttctaggttc

SEQ ID NO: 8321554 - DNA, 22 bp, Homo sapiens
ccttttctaggatgctttatag

SEQ ID NO: 8321555 - DNA, 22 bp, Homo sapiens
cgctgcctctctggggccctgg

SEQ ID NO: 8321556 - DNA, 22 bp, Homo sapiens
cgctggcattagggcagtggcc

SEQ ID NO: 8321557 - DNA, 22 bp, Homo sapiens
cgctggcttcctcctggggcca

SEQ ID NO: 8321558 - DNA, 22 bp, Homo sapiens
cgccgtcccctaggaaagagct

SEQ ID NO: 8321559 - DNA, 22 bp, Homo sapiens
ttatttcatgtaaaatttatgt

SEQ ID NO: 8321560 - DNA, 22 bp, Homo sapiens
ttattgcatagattatgccata

SEQ ID NO: 8321561 - DNA, 22 bp, Homo sapiens
cggcacagccgggcaaggctgg

SEQ ID NO: 8321562 - DNA, 22 bp, Homo sapiens
cggaggttgaggctgcagtgag

SEQ ID NO: 8321563 - DNA, 22 bp, Homo sapiens
cggagtcttgctatgttgccca

SEQ ID NO: 8321564 - DNA, 22 bp, Homo sapiens
cggagaggacctgcaactcgct

SEQ ID NO: 8321565 - DNA, 22 bp, Homo sapiens
cggagaggtgggggcagcatct

SEQ ID NO: 8321566 - DNA, 22 bp, Homo sapiens
ttcaaattaccacatttgctta

SEQ ID NO: 8321567 - DNA, 22 bp, Homo sapiens
ttcaaatggttagactgttagc

SEQ ID NO: 8321568 - DNA, 22 bp, Homo sapiens
ttcaaatacattctttgccact

SEQ ID NO: 8321569 - DNA, 22 bp, Homo sapiens
cgggctggctgcagctgctgga

SEQ ID NO: 8321570 - DNA, 22 bp, Homo sapiens
cggggaggcttcggattaaagc

SEQ ID NO: 8321571 - DNA, 22 bp, Homo sapiens
cggggaggcttcggattaaagc

SEQ ID NO: 8321572 - DNA, 22 bp, Homo sapiens
cggggagggcagaggctccctc

SEQ ID NO: 8321573 - DNA, 22 bp, Homo sapiens
cggggagggcagaggctccctc

SEQ ID NO: 8321574 - DNA, 22 bp, Homo sapiens
cggggcagaaagttgtcttttg

SEQ ID NO: 8321575 - DNA, 22 bp, Homo sapiens
cggggcaccgacctcctgccgc

SEQ ID NO: 8321576 - DNA, 22 bp, Homo sapiens
cggggagggcagaggctccctc

SEQ ID NO: 8321577 - DNA, 22 bp, Homo sapiens
cggggcagagggtcttctccag

SEQ ID NO: 8321578 - DNA, 22 bp, Homo sapiens
cggggcaggagtccctgtagag

SEQ ID NO: 8321579 - DNA, 22 bp, Homo sapiens
cggggctgctcgtcctcctgtg

SEQ ID NO: 8321580 - DNA, 22 bp, Homo sapiens
cggggctgcgctcttcctgccg

SEQ ID NO: 8321581 - DNA, 22 bp, Homo sapiens
cggggccctggggctgaaggtc

SEQ ID NO: 8321582 - DNA, 22 bp, Homo sapiens
cgtgggccccagccactccctc

SEQ ID NO: 8321583 - DNA, 22 bp, Homo sapiens
cgtgggagtggtgggtgctcag

SEQ ID NO: 8321584 - DNA, 22 bp, Homo sapiens
cggggctggcacaggtgaccac

SEQ ID NO: 8321585 - DNA, 21 bp, Homo sapiens
cgtgactgggtccgtctggct

SEQ ID NO: 8321586 - DNA, 23 bp, Homo sapiens
ccttaaatatctaccctgtggca

SEQ ID NO: 8321587 - DNA, 22 bp, Homo sapiens
ccttaaagaataagtcttatct

SEQ ID NO: 8321588 - DNA, 22 bp, Homo sapiens
ccttaaattctccatttgaaag

SEQ ID NO: 8321589 - DNA, 22 bp, Homo sapiens
ccttaaattctccatttgaaag

SEQ ID NO: 8321590 - DNA, 22 bp, Homo sapiens
ccttaaattctccatttgaaag

SEQ ID NO: 8321591 - DNA, 22 bp, Homo sapiens
cctgtgtgtctgtcactgcaca

SEQ ID NO: 8321592 - DNA, 22 bp, Homo sapiens
ttacaaagagtgccagagtgtg

SEQ ID NO: 8321593 - DNA, 22 bp, Homo sapiens
ccttacactgcctggggccacg

SEQ ID NO: 8321594 - DNA, 22 bp, Homo sapiens
ttacaaagattatattcagtta

SEQ ID NO: 8321595 - DNA, 22 bp, Homo sapiens
ttacaaagattatattcagtta

SEQ ID NO: 8321596 - DNA, 21 bp, Homo sapiens
ttacaaagcaagtgctgtgtc

SEQ ID NO: 8321597 - DNA, 22 bp, Homo sapiens
ttacaaagcaggtcagctgaaa

SEQ ID NO: 8321598 - DNA, 22 bp, Homo sapiens
ttacaaagcaggtcagctgaaa

SEQ ID NO: 8321599 - DNA, 22 bp, Homo sapiens
ttacagaagtttcagcgtttta

SEQ ID NO: 8321600 - DNA, 19 bp, Homo sapiens
ttaagagtaggcattgtgc

SEQ ID NO: 8321601 - DNA, 22 bp, Homo sapiens
ttaaattccagcctcataatag

SEQ ID NO: 8321602 - DNA, 22 bp, Homo sapiens
ttaaattatttctagtgaggtg

SEQ ID NO: 8321603 - DNA, 22 bp, Homo sapiens
ttaaattatttctagtgaggtg

SEQ ID NO: 8321604 - DNA, 21 bp, Homo sapiens
tgtcagagcttgtaggacatt

SEQ ID NO: 8321605 - DNA, 22 bp, Homo sapiens
ttaaatagtaggtctattttgg

SEQ ID NO: 8321606 - DNA, 22 bp, Homo sapiens
ttatcataagtaattgaaataa

SEQ ID NO: 8321607 - DNA, 22 bp, Homo sapiens
ttatattgtgtaataagtgaag

SEQ ID NO: 8321608 - DNA, 22 bp, Homo sapiens
ttataacatcaatcagagttaa

SEQ ID NO: 8321609 - DNA, 22 bp, Homo sapiens
ttataaagtgagaagtgctatg

SEQ ID NO: 8321610 - DNA, 22 bp, Homo sapiens
ccttgcatgtgctaacgacaag

SEQ ID NO: 8321611 - DNA, 20 bp, Homo sapiens
ccttgccagtagggctggga

SEQ ID NO: 8321612 - DNA, 22 bp, Homo sapiens
ttagttttcccatctttatggt

SEQ ID NO: 8321613 - DNA, 22 bp, Homo sapiens
ttataaaggtttgtgcatattt

SEQ ID NO: 8321614 - DNA, 22 bp, Homo sapiens
ttataaagattgttatgtatct

SEQ ID NO: 8321615 - DNA, 22 bp, Homo sapiens
ccttgcccgctgcctctgagtt

SEQ ID NO: 8321616 - DNA, 22 bp, Homo sapiens
ttagcaaactctgttagattct

SEQ ID NO: 8321617 - DNA, 22 bp, Homo sapiens
ttagcaaatttccaggtgatgc

SEQ ID NO: 8321618 - DNA, 22 bp, Homo sapiens
ttggctcttctcccagtggcct

SEQ ID NO: 8321619 - DNA, 22 bp, Homo sapiens
ttggctgcattttgggttcgtt

SEQ ID NO: 8321620 - DNA, 22 bp, Homo sapiens
ttggctctggttgccctgtgac

SEQ ID NO: 8321621 - DNA, 20 bp, Homo sapiens
ttggctctgatcagtggagc

SEQ ID NO: 8321622 - DNA, 22 bp, Homo sapiens
ttggaggtttcccaactgtggg

SEQ ID NO: 8321623 - DNA, 22 bp, Homo sapiens
ttggagtcagatgactgtagga

SEQ ID NO: 8321624 - DNA, 22 bp, Homo sapiens
ttggagtcacaggagaagaatg

SEQ ID NO: 8321625 - DNA, 22 bp, Homo sapiens
ttggagtcatatggaattcaca

SEQ ID NO: 8321626 - DNA, 22 bp, Homo sapiens
ttggagtcattggcctgggtga

SEQ ID NO: 8321627 - DNA, 22 bp, Homo sapiens
ttggagtccttgctgcttcact

SEQ ID NO: 8321628 - DNA, 22 bp, Homo sapiens
ctcaggggacctggctccgagt

SEQ ID NO: 8321629 - DNA, 22 bp, Homo sapiens
ctcagggggaatcaggtcacag

SEQ ID NO: 8321630 - DNA, 21 bp, Homo sapiens
ctcaggggattttgagattag

SEQ ID NO: 8321631 - DNA, 22 bp, Homo sapiens
ctcaggtcttagttctgtcatc

SEQ ID NO: 8321632 - DNA, 22 bp, Homo sapiens
ctcagggagtagcacatgtgga

SEQ ID NO: 8321633 - DNA, 22 bp, Homo sapiens
ttgcatcaggtagacaactata

SEQ ID NO: 8321634 - DNA, 22 bp, Homo sapiens
ttgcatctaccatatcaaagat

SEQ ID NO: 8321635 - DNA, 22 bp, Homo sapiens
ttgcccagagtcacccagctca

SEQ ID NO: 8321636 - DNA, 22 bp, Homo sapiens
ttgcccagagtccacagcgtac

SEQ ID NO: 8321637 - DNA, 22 bp, Homo sapiens
ttgcccaggctggagtgcagtg

SEQ ID NO: 8321638 - DNA, 22 bp, Homo sapiens
ttgcccaggctggagtgcagta

SEQ ID NO: 8321639 - DNA, 18 bp, Homo sapiens
ctcaccattctgcccaat

SEQ ID NO: 8321640 - DNA, 22 bp, Homo sapiens
ctcacccagaggctttccccct

SEQ ID NO: 8321641 - DNA, 22 bp, Homo sapiens
ctcacaggttctgcagctcaca

SEQ ID NO: 8321642 - DNA, 22 bp, Homo sapiens
ctatacagtgactagaagtaat

SEQ ID NO: 8321643 - DNA, 22 bp, Homo sapiens
ctatacagcagcttactagtta

SEQ ID NO: 8321644 - DNA, 19 bp, Homo sapiens
ctatacagcctctgaggaa

SEQ ID NO: 8321645 - DNA, 22 bp, Homo sapiens
ctatacagtaaccacagtgatt

SEQ ID NO: 8321646 - DNA, 22 bp, Homo sapiens
ctcacctgtaagatggaagaga

SEQ ID NO: 8321647 - DNA, 22 bp, Homo sapiens
ttctggccaaggctgccagatt

SEQ ID NO: 8321648 - DNA, 22 bp, Homo sapiens
ttctggattatgtgtaagtgaa

SEQ ID NO: 8321649 - DNA, 22 bp, Homo sapiens
ttctggcttagttgttgtatat

SEQ ID NO: 8321650 - DNA, 22 bp, Homo sapiens
ttctggcttagttgttgtatat

SEQ ID NO: 8321651 - DNA, 22 bp, Homo sapiens
ctatacagagcatccttaactt

SEQ ID NO: 8321652 - DNA, 22 bp, Homo sapiens
ctagagctgttctgtgcactca

SEQ ID NO: 8321653 - DNA, 22 bp, Homo sapiens
ctagataaggtggcttggaatt

SEQ ID NO: 8321654 - DNA, 22 bp, Homo sapiens
ctagataaggatttctcaactt

SEQ ID NO: 8321655 - DNA, 22 bp, Homo sapiens
ctagagaagaggctcagccagc

SEQ ID NO: 8321656 - DNA, 22 bp, Homo sapiens
ctaaaaatccacactaggtgaa

SEQ ID NO: 8321657 - DNA, 22 bp, Homo sapiens
cgtttcatcagtgctttaagaa

SEQ ID NO: 8321658 - DNA, 22 bp, Homo sapiens
ttctgaagctcccttttgtagt

SEQ ID NO: 8321659 - DNA, 22 bp, Homo sapiens
ttctgcagtgttaacaatgtca

SEQ ID NO: 8321660 - DNA, 22 bp, Homo sapiens
ttctgcatgatattaaatgtaa

SEQ ID NO: 8321661 - DNA, 22 bp, Homo sapiens
ttctggatgctgttaagatgta

SEQ ID NO: 8321662 - DNA, 23 bp, Homo sapiens
ttctggaagatttacttgagaca

SEQ ID NO: 8321663 - DNA, 20 bp, Homo sapiens
ctcttccggaggggcgctcc

SEQ ID NO: 8321664 - DNA, 19 bp, Homo sapiens
ctgagcagcggcagcactt

SEQ ID NO: 8321665 - DNA, 22 bp, Homo sapiens
ctgagcagtctagccaggtgtt

SEQ ID NO: 8321666 - DNA, 22 bp, Homo sapiens
ctgaggctgcccagggccaggt

SEQ ID NO: 8321667 - DNA, 22 bp, Homo sapiens
ctgaggctggagtgcagtggtg

SEQ ID NO: 8321668 - DNA, 22 bp, Homo sapiens
ctgaggctgaagagggcctacg

SEQ ID NO: 8321669 - DNA, 22 bp, Homo sapiens
ctgaggctccctcgggtctgct

SEQ ID NO: 8321670 - DNA, 22 bp, Homo sapiens
ctgaggctctgggtgtcactgt

SEQ ID NO: 8321671 - DNA, 22 bp, Homo sapiens
ctgaggctctgggtgtcactgt

SEQ ID NO: 8321672 - DNA, 22 bp, Homo sapiens
ctgaggctggagtgcagtggtg

SEQ ID NO: 8321673 - DNA, 23 bp, Homo sapiens
ctgaggggaaaagggcttcaggc

SEQ ID NO: 8321674 - DNA, 18 bp, Homo sapiens
ctgaggctggcaggagcc

SEQ ID NO: 8321675 - DNA, 17 bp, Homo sapiens
ctgaggggagtgctgtg

SEQ ID NO: 8321676 - DNA, 22 bp, Homo sapiens
ctgaggctcaagggcaggtggg

SEQ ID NO: 8321677 - DNA, 22 bp, Homo sapiens
ctgaggctaacctcgagagaca

SEQ ID NO: 8321678 - DNA, 22 bp, Homo sapiens
ctgaggcctggtgaggtggtga

SEQ ID NO: 8321679 - DNA, 22 bp, Homo sapiens
ctgagcatggccggtccatggt

SEQ ID NO: 8321680 - DNA, 22 bp, Homo sapiens
ctgagccaaaaagcagagcttg

SEQ ID NO: 8321681 - DNA, 22 bp, Homo sapiens
ctgagccaaaaagcagagcttg

SEQ ID NO: 8321682 - DNA, 22 bp, Homo sapiens
ctgaggccgtctgggtctgcag

SEQ ID NO: 8321683 - DNA, 22 bp, Homo sapiens
ctgaggtggcatcctagctcta

SEQ ID NO: 8321684 - DNA, 22 bp, Homo sapiens
ctgaggtgggagtttttctcat

SEQ ID NO: 8321685 - DNA, 22 bp, Homo sapiens
ctgaggtgtgagccacttcccc

SEQ ID NO: 8321686 - DNA, 22 bp, Homo sapiens
ctgaggtgagaggaggccatgt

SEQ ID NO: 8321687 - DNA, 20 bp, Homo sapiens
ctgcccagccactgagggat

SEQ ID NO: 8321688 - DNA, 22 bp, Homo sapiens
ctgcccaagtggagtctccgca

SEQ ID NO: 8321689 - DNA, 22 bp, Homo sapiens
ctgcaggcatctaactgtgggc

SEQ ID NO: 8321690 - DNA, 22 bp, Homo sapiens
ctgcccaggctgaaggaacatc

SEQ ID NO: 8321691 - DNA, 22 bp, Homo sapiens
ctgctgtcatagccatccctcc

SEQ ID NO: 8321692 - DNA, 19 bp, Homo sapiens
ctgctgggtgctgagggag

SEQ ID NO: 8321693 - DNA, 22 bp, Homo sapiens
ctgctgaaaacaataatgatga

SEQ ID NO: 8321694 - DNA, 21 bp, Homo sapiens
ctgctctgacagtgaggccag

SEQ ID NO: 8321695 - DNA, 22 bp, Homo sapiens
ctgcctgttagtctagcagtta

SEQ ID NO: 8321696 - DNA, 22 bp, Homo sapiens
ctgcctggggaatgtgaggatt

SEQ ID NO: 8321697 - DNA, 22 bp, Homo sapiens
ctggagccggaccagggacggt

SEQ ID NO: 8321698 - DNA, 22 bp, Homo sapiens
ctggagccgcatggagcaggga

SEQ ID NO: 8321699 - DNA, 22 bp, Homo sapiens
ctggagccctgaatgggcagga

SEQ ID NO: 8321700 - DNA, 22 bp, Homo sapiens
ctggagagggagccctggcagt

SEQ ID NO: 8321701 - DNA, 22 bp, Homo sapiens
ctggagaggctgggaacaggtt

SEQ ID NO: 8321702 - DNA, 22 bp, Homo sapiens
ctggagatgtccgggtgctgtt

SEQ ID NO: 8321703 - DNA, 22 bp, Homo sapiens
ctggaagagtaatataaattag

SEQ ID NO: 8321704 - DNA, 22 bp, Homo sapiens
ctggaagcttgtttgccagtct

SEQ ID NO: 8321705 - DNA, 22 bp, Homo sapiens
tttctcaagttcagatatttga

SEQ ID NO: 8321706 - DNA, 22 bp, Homo sapiens
tttctcaaattgcatgagtagc

SEQ ID NO: 8321707 - DNA, 22 bp, Homo sapiens
tttctcaacctcaacactattt

SEQ ID NO: 8321708 - DNA, 22 bp, Homo sapiens
tttctacatgtcaatccaaacc

SEQ ID NO: 8321709 - DNA, 22 bp, Homo sapiens
ctctctgtggtggctgtcccat

SEQ ID NO: 8321710 - DNA, 22 bp, Homo sapiens
ctctctgtcttggcatttggtc

SEQ ID NO: 8321711 - DNA, 22 bp, Homo sapiens
ctctctgttatgctttcatgaa

SEQ ID NO: 8321712 - DNA, 22 bp, Homo sapiens
ctctctttcattggtcgccttg

SEQ ID NO: 8321713 - DNA, 22 bp, Homo sapiens
tttccaagagcttatttctgaa

SEQ ID NO: 8321714 - DNA, 18 bp, Homo sapiens
tttcattataaagcaggc

SEQ ID NO: 8321715 - DNA, 22 bp, Homo sapiens
tttcattatacagcttcataaa

SEQ ID NO: 8321716 - DNA, 22 bp, Homo sapiens
tttcattacgtgtttgacttgt

SEQ ID NO: 8321717 - DNA, 22 bp, Homo sapiens
tttctacagctggtgcaacttt

SEQ ID NO: 8321718 - DNA, 22 bp, Homo sapiens
tttctacagaagatacactgct

SEQ ID NO: 8321719 - DNA, 22 bp, Homo sapiens
tttccacagctgtataaaataa

SEQ ID NO: 8321720 - DNA, 22 bp, Homo sapiens
tttccacatcaccatgaggtga

SEQ ID NO: 8321721 - DNA, 22 bp, Homo sapiens
tttcctttctagaagcctaaat

SEQ ID NO: 8321722 - DNA, 22 bp, Homo sapiens
tttccactcctattgcatctca

SEQ ID NO: 8321723 - DNA, 22 bp, Homo sapiens
tttccactcctattgcatctca

SEQ ID NO: 8321724 - DNA, 22 bp, Homo sapiens
ctccttaaattacgaacccact

SEQ ID NO: 8321725 - DNA, 22 bp, Homo sapiens
tttattcatcatctgttcatat

SEQ ID NO: 8321726 - DNA, 22 bp, Homo sapiens
tttcacatataggggaagctac

SEQ ID NO: 8321727 - DNA, 22 bp, Homo sapiens
tttcacatatcaactctatcct

SEQ ID NO: 8321728 - DNA, 22 bp, Homo sapiens
tttcagaaccaagagagacatc

SEQ ID NO: 8321729 - DNA, 22 bp, Homo sapiens
tttatgattattttaaagcagc

SEQ ID NO: 8321730 - DNA, 22 bp, Homo sapiens
tttatgattaatccaattctgt

SEQ ID NO: 8321731 - DNA, 23 bp, Homo sapiens
tttatattcctaatgtcttgagc

SEQ ID NO: 8321732 - DNA, 22 bp, Homo sapiens
ctccaggatgttagacgtccag

SEQ ID NO: 8321733 - DNA, 22 bp, Homo sapiens
tttattcactggggtctgcccg

SEQ ID NO: 8321734 - DNA, 22 bp, Homo sapiens
ctctggcctgcagatccatgct

SEQ ID NO: 8321735 - DNA, 22 bp, Homo sapiens
tttgcaaagtccattgaagtta

SEQ ID NO: 8321736 - DNA, 22 bp, Homo sapiens
ctctggagtgggtggccgggag

SEQ ID NO: 8321737 - DNA, 22 bp, Homo sapiens
tttgcaaacacttaagaagaga

SEQ ID NO: 8321738 - DNA, 22 bp, Homo sapiens
tttgcaaaccggagctctgcaa

SEQ ID NO: 8321739 - DNA, 22 bp, Homo sapiens
tttgaaaaaggcctttggtatg

SEQ ID NO: 8321740 - DNA, 22 bp, Homo sapiens
tttcttgtaagatgtttattaa

SEQ ID NO: 8321741 - DNA, 22 bp, Homo sapiens
ctctgcagaatttgagctgctc

SEQ ID NO: 8321742 - DNA, 22 bp, Homo sapiens
ctctgcagaggcccaaggctga

SEQ ID NO: 8321743 - DNA, 22 bp, Homo sapiens
ctctgtgccctactgctcagct

SEQ ID NO: 8321744 - DNA, 22 bp, Homo sapiens
ctctgtgggcctgtgctttagt

SEQ ID NO: 8321745 - DNA, 22 bp, Homo sapiens
ctctgtgggggagaggcagctg

SEQ ID NO: 8321746 - DNA, 22 bp, Homo sapiens
ctctgtgggaggaggagtaggc

SEQ ID NO: 8321747 - DNA, 22 bp, Homo sapiens
ctctgtggcttgcctttctgtc

SEQ ID NO: 8321748 - DNA, 22 bp, Homo sapiens
ctctgtggctacacaaacctcc

SEQ ID NO: 8321749 - DNA, 22 bp, Homo sapiens
ttttgcttatctgagtgcagcc

SEQ ID NO: 8321750 - DNA, 22 bp, Homo sapiens
ctctggctccatttccctatgt

SEQ ID NO: 8321751 - DNA, 20 bp, Homo sapiens
ctctggctccgcgtgaccgc

SEQ ID NO: 8321752 - DNA, 22 bp, Homo sapiens
tttggaagtcctgaaatagagg

SEQ ID NO: 8321753 - DNA, 19 bp, Homo sapiens
ctctgggctgcatcttggt

SEQ ID NO: 8321754 - DNA, 22 bp, Homo sapiens
tttgttcatgcctatattctca

SEQ ID NO: 8321755 - DNA, 22 bp, Homo sapiens
cctgaggcttaatctgtcccaa

SEQ ID NO: 8321756 - DNA, 22 bp, Homo sapiens
cctgaggcttgggagttccgcc

SEQ ID NO: 8321757 - DNA, 22 bp, Homo sapiens
cctgaggggctgcaggccagct

SEQ ID NO: 8321758 - DNA, 22 bp, Homo sapiens
cctgaggctggcccttccatcc

SEQ ID NO: 8321759 - DNA, 22 bp, Homo sapiens
cctgaggctcgcgcgcccctgg

SEQ ID NO: 8321760 - DNA, 22 bp, Homo sapiens
cctgaggctccacctccagaga

SEQ ID NO: 8321761 - DNA, 22 bp, Homo sapiens
cctgactagctgggactacaga

SEQ ID NO: 8321762 - DNA, 22 bp, Homo sapiens
cctgacgaaaggcgtgctggag

SEQ ID NO: 8321763 - DNA, 22 bp, Homo sapiens
cctgacaggagaagcgcagcat

SEQ ID NO: 8321764 - DNA, 22 bp, Homo sapiens
cctgcagaaagggtccccagga

SEQ ID NO: 8321765 - DNA, 22 bp, Homo sapiens
cctgccaggagctggtgctgca

SEQ ID NO: 8321766 - DNA, 22 bp, Homo sapiens
tgggggtgtcctggtgcacaca

SEQ ID NO: 8321767 - DNA, 22 bp, Homo sapiens
tgggggtgtcctggtgcacaca

SEQ ID NO: 8321768 - DNA, 22 bp, Homo sapiens
tgggggtgtcctggtgcacaca

SEQ ID NO: 8321769 - DNA, 22 bp, Homo sapiens
tgggggtggttcttgcctccag

SEQ ID NO: 8321770 - DNA, 22 bp, Homo sapiens
tgggggtggttcttgcctccag

SEQ ID NO: 8321771 - DNA, 22 bp, Homo sapiens
tgggggagagaggcattctttc

SEQ ID NO: 8321772 - DNA, 22 bp, Homo sapiens
tgggggtgtgccagggacctcc

SEQ ID NO: 8321773 - DNA, 22 bp, Homo sapiens
tggggtaggagtcagcgagaga

SEQ ID NO: 8321774 - DNA, 22 bp, Homo sapiens
tgggagcccaagggagctgccg

SEQ ID NO: 8321775 - DNA, 22 bp, Homo sapiens
cctccctgctcctcaactggca

SEQ ID NO: 8321776 - DNA, 22 bp, Homo sapiens
cctccctgctcctcaactggca

SEQ ID NO: 8321777 - DNA, 22 bp, Homo sapiens
tgggccagaagtatgcatgttt

SEQ ID NO: 8321778 - DNA, 22 bp, Homo sapiens
tgggccagagagtaagaaaggt

SEQ ID NO: 8321779 - DNA, 22 bp, Homo sapiens
tgggccagcaattgctgctcag

SEQ ID NO: 8321780 - DNA, 23 bp, Homo sapiens
tggtctgaagcctcaggttcctc

SEQ ID NO: 8321781 - DNA, 22 bp, Homo sapiens
tggtctgataccggattccagt

SEQ ID NO: 8321782 - DNA, 22 bp, Homo sapiens
tggtctgattcttgctccccaa

SEQ ID NO: 8321783 - DNA, 22 bp, Homo sapiens
tggtctgcctggatcacagccc

SEQ ID NO: 8321784 - DNA, 22 bp, Homo sapiens
tggtctggggaccgagggttac

SEQ ID NO: 8321785 - DNA, 22 bp, Homo sapiens
cctgctgtcagcatcctcgcga

SEQ ID NO: 8321786 - DNA, 22 bp, Homo sapiens
cctgctgtccctctgggctcca

SEQ ID NO: 8321787 - DNA, 22 bp, Homo sapiens
cctgctggcggggacccagtga

SEQ ID NO: 8321788 - DNA, 22 bp, Homo sapiens
cctgcctgtccctcagtccaca

SEQ ID NO: 8321789 - DNA, 23 bp, Homo sapiens
cctgcctgttctaactccatttc

SEQ ID NO: 8321790 - DNA, 22 bp, Homo sapiens
cctgcctgtcatcgcctgcgcc

SEQ ID NO: 8321791 - DNA, 22 bp, Homo sapiens
tgggtcaggctgggagtcctga

SEQ ID NO: 8321792 - DNA, 22 bp, Homo sapiens
tgggtcagtttgggggccagcc

SEQ ID NO: 8321793 - DNA, 22 bp, Homo sapiens
cctgccaggcgagtctaggcca

SEQ ID NO: 8321794 - DNA, 22 bp, Homo sapiens
tgggtcagagctgtgctgccca

SEQ ID NO: 8321795 - DNA, 22 bp, Homo sapiens
cctggaggagcgctgaccagct

SEQ ID NO: 8321796 - DNA, 22 bp, Homo sapiens
cctggaggcagaaataggactt

SEQ ID NO: 8321797 - DNA, 22 bp, Homo sapiens
cctggaggctctgggagggcag

SEQ ID NO: 8321798 - DNA, 22 bp, Homo sapiens
cctggagggcgccgcacagtcc

SEQ ID NO: 8321799 - DNA, 22 bp, Homo sapiens
cctggagggaccctggccctgt

SEQ ID NO: 8321800 - DNA, 22 bp, Homo sapiens
tgtcaaatagtagaaagatggc

SEQ ID NO: 8321801 - DNA, 22 bp, Homo sapiens
cctggagggcgccgcacagtcc

SEQ ID NO: 8321802 - DNA, 18 bp, Homo sapiens
cctggaggtcttcggggt

SEQ ID NO: 8321803 - DNA, 19 bp, Homo sapiens
cctggaggtgaaggttctc

SEQ ID NO: 8321804 - DNA, 22 bp, Homo sapiens
cctgcttaacattgccatgaca

SEQ ID NO: 8321805 - DNA, 22 bp, Homo sapiens
cctgctttggcaggcagctcct

SEQ ID NO: 8321806 - DNA, 22 bp, Homo sapiens
tgtacagtgtaaataagtggat

SEQ ID NO: 8321807 - DNA, 22 bp, Homo sapiens
tgtaattcattcaactgaagaa

SEQ ID NO: 8321808 - DNA, 22 bp, Homo sapiens
tgtaatttcctgatgttagaac

SEQ ID NO: 8321809 - DNA, 22 bp, Homo sapiens
tgtaatttgcatggctgaatgc

SEQ ID NO: 8321810 - DNA, 22 bp, Homo sapiens
cctattcagtccttcaaggagg

SEQ ID NO: 8321811 - DNA, 22 bp, Homo sapiens
cctaaatagagtcagatgtaat

SEQ ID NO: 8321812 - DNA, 22 bp, Homo sapiens
cctatttgtaggctgggccagt

SEQ ID NO: 8321813 - DNA, 22 bp, Homo sapiens
cctcacagtttggctaactgtg

SEQ ID NO: 8321814 - DNA, 22 bp, Homo sapiens
cctcacagcttttcaaagtgga

SEQ ID NO: 8321815 - DNA, 22 bp, Homo sapiens
ccggggtgcgaggagcgtcttt

SEQ ID NO: 8321816 - DNA, 22 bp, Homo sapiens
ccggggacttaaagtgaaggaa

SEQ ID NO: 8321817 - DNA, 22 bp, Homo sapiens
ccggtcttcaaatggctgcttc

SEQ ID NO: 8321818 - DNA, 22 bp, Homo sapiens
ccgtggagttgtgctgagtatg

SEQ ID NO: 8321819 - DNA, 22 bp, Homo sapiens
ccgtccccagccacctgctgat

SEQ ID NO: 8321820 - DNA, 21 bp, Homo sapiens
ccgtgctcggctatggaccac

SEQ ID NO: 8321821 - DNA, 22 bp, Homo sapiens
ccgggcctcgggacaccgggta

SEQ ID NO: 8321822 - DNA, 22 bp, Homo sapiens
ccctgtgagcggctggatgcct

SEQ ID NO: 8321823 - DNA, 22 bp, Homo sapiens
ccctgtggaggaggagagcagt

SEQ ID NO: 8321824 - DNA, 22 bp, Homo sapiens
ccgcggggcgtgggctcttacc

SEQ ID NO: 8321825 - DNA, 22 bp, Homo sapiens
ccggagaaactggcaaacccta

SEQ ID NO: 8321826 - DNA, 22 bp, Homo sapiens
ccctgtggatttcagtttgtgt

SEQ ID NO: 8321827 - DNA, 22 bp, Homo sapiens
ccctgtggcaggaggaggagca

SEQ ID NO: 8321828 - DNA, 22 bp, Homo sapiens
ccctgtgggaactcctgagttg

SEQ ID NO: 8321829 - DNA, 22 bp, Homo sapiens
ccctttcatattttataaatgg

SEQ ID NO: 8321830 - DNA, 22 bp, Homo sapiens
ccctttcattggcagagctctc

SEQ ID NO: 8321831 - DNA, 22 bp, Homo sapiens
ccctggaggaaaatctgaggct

SEQ ID NO: 8321832 - DNA, 22 bp, Homo sapiens
ccctggagctgcttgcatgttg

SEQ ID NO: 8321833 - DNA, 22 bp, Homo sapiens
ccctggaggaagaaacaatggc

SEQ ID NO: 8321834 - DNA, 22 bp, Homo sapiens
ccctggtcagggaaggcgcctg

SEQ ID NO: 8321835 - DNA, 22 bp, Homo sapiens
ccctgggatggattggcaggaa

SEQ ID NO: 8321836 - DNA, 22 bp, Homo sapiens
ccctggtggtacggcactggca

SEQ ID NO: 8321837 - DNA, 22 bp, Homo sapiens
ccctggttcaggtttctctgaa

SEQ ID NO: 8321838 - DNA, 22 bp, Homo sapiens
ccctggtgtccactggaggaag

SEQ ID NO: 8321839 - DNA, 22 bp, Homo sapiens
tggcctcaatctgtcctccagc

SEQ ID NO: 8321840 - DNA, 19 bp, Homo sapiens
cctcaccctgcagaggagg

SEQ ID NO: 8321841 - DNA, 22 bp, Homo sapiens
cctcagccttggccccaggcag

SEQ ID NO: 8321842 - DNA, 22 bp, Homo sapiens
cctcagccttggccccaggcag

SEQ ID NO: 8321843 - DNA, 22 bp, Homo sapiens
tggcctggggacctgtgagacc

SEQ ID NO: 8321844 - DNA, 22 bp, Homo sapiens
tggctcagcggtggcagcagac

SEQ ID NO: 8321845 - DNA, 22 bp, Homo sapiens
tggctcagcgcggcctggtctt

SEQ ID NO: 8321846 - DNA, 22 bp, Homo sapiens
tggctcagcgcggcctggtctt

SEQ ID NO: 8321847 - DNA, 22 bp, Homo sapiens
tggctagatttattgctgagca

SEQ ID NO: 8321848 - DNA, 22 bp, Homo sapiens
tggctaaggggaacaggcttag

SEQ ID NO: 8321849 - DNA, 22 bp, Homo sapiens
tggctaagaattggcagctgct

SEQ ID NO: 8321850 - DNA, 20 bp, Homo sapiens
ccctgcagccatgggagtgg

SEQ ID NO: 8321851 - DNA, 22 bp, Homo sapiens
ccctgcagatctagggtccttc

SEQ ID NO: 8321852 - DNA, 22 bp, Homo sapiens
ccctgcagatctagggtccttc

SEQ ID NO: 8321853 - DNA, 22 bp, Homo sapiens
ccctgcagagggatgggggcag

SEQ ID NO: 8321854 - DNA, 22 bp, Homo sapiens
ccctgcagatcagtgagaactt

SEQ ID NO: 8321855 - DNA, 22 bp, Homo sapiens
ccctgcagagaccactgacctt

SEQ ID NO: 8321856 - DNA, 22 bp, Homo sapiens
ccctgcctctgaagctgctcag

SEQ ID NO: 8321857 - DNA, 22 bp, Homo sapiens
ccctgcctctgaagctgctcag

SEQ ID NO: 8321858 - DNA, 22 bp, Homo sapiens
ccctgcagtcctttcttggctc

SEQ ID NO: 8321859 - DNA, 22 bp, Homo sapiens
tggacaggtttgggtgcctgtt

SEQ ID NO: 8321860 - DNA, 22 bp, Homo sapiens
tggacagttactgagcttgagt

SEQ ID NO: 8321861 - DNA, 22 bp, Homo sapiens
ccctgctcttagtgcctgtgtg

SEQ ID NO: 8321862 - DNA, 22 bp, Homo sapiens
tggaggccagaggtactgggac

SEQ ID NO: 8321863 - DNA, 22 bp, Homo sapiens
ccctgctgaatcccatggagtc

SEQ ID NO: 8321864 - DNA, 22 bp, Homo sapiens
tggaggggcaatggagcgcgga

SEQ ID NO: 8321865 - DNA, 23 bp, Homo sapiens
ccctggagctagtctgagcagag

SEQ ID NO: 8321866 - DNA, 22 bp, Homo sapiens
ccctggagctagtctgagcaga

SEQ ID NO: 8321867 - DNA, 23 bp, Homo sapiens
ccctggagctagtctgagcagag

SEQ ID NO: 8321868 - DNA, 23 bp, Homo sapiens
ccctggagctagtctgagcgggg

SEQ ID NO: 8321869 - DNA, 22 bp, Homo sapiens
tggaggtgagtgtggtacagca

SEQ ID NO: 8321870 - DNA, 22 bp, Homo sapiens
tggaggtacataatgagagggt

SEQ ID NO: 8321871 - DNA, 22 bp, Homo sapiens
tggagggtcaccccttgctgag

SEQ ID NO: 8321872 - DNA, 19 bp, Homo sapiens
tggaggggtttgaatgtgg

SEQ ID NO: 8321873 - DNA, 22 bp, Homo sapiens
cccgggaggtggagcttgcagt

SEQ ID NO: 8321874 - DNA, 22 bp, Homo sapiens
cccgggaggtggagactgcagt

SEQ ID NO: 8321875 - DNA, 22 bp, Homo sapiens
cccgggaggtggaggttgcagt

SEQ ID NO: 8321876 - DNA, 22 bp, Homo sapiens
cccgggaggcggaggttgcagt

SEQ ID NO: 8321877 - DNA, 22 bp, Homo sapiens
cccgggaggcagaggttgcagt

SEQ ID NO: 8321878 - DNA, 22 bp, Homo sapiens
cccgtttcagtgttccttgctt

SEQ ID NO: 8321879 - DNA, 22 bp, Homo sapiens
ccctagagagatcagatgggga

SEQ ID NO: 8321880 - DNA, 20 bp, Homo sapiens
tggaaggcatctgcattatt

SEQ ID NO: 8321881 - DNA, 22 bp, Homo sapiens
tggaagggaacaggtgggtgtt

SEQ ID NO: 8321882 - DNA, 17 bp, Homo sapiens
tggaaggcttcaatatt

SEQ ID NO: 8321883 - DNA, 22 bp, Homo sapiens
tggaaggcttggaatacttcca

SEQ ID NO: 8321884 - DNA, 21 bp, Homo sapiens
tggaaggctgctctgccaggg

SEQ ID NO: 8321885 - DNA, 22 bp, Homo sapiens
tgcctgctccagtcctgtccac

SEQ ID NO: 8321886 - DNA, 22 bp, Homo sapiens
tgctttatttataaaatagcaa

SEQ ID NO: 8321887 - DNA, 22 bp, Homo sapiens
tgcctgcctgcatagtcccacg

SEQ ID NO: 8321888 - DNA, 22 bp, Homo sapiens
tgcctgctagatatccaggtga

SEQ ID NO: 8321889 - DNA, 22 bp, Homo sapiens
tgcctgcctctggcagccctgc

SEQ ID NO: 8321890 - DNA, 22 bp, Homo sapiens
tgcctgcctctggagcccatcc

SEQ ID NO: 8321891 - DNA, 18 bp, Homo sapiens
tgcctgccccgtaagggt

SEQ ID NO: 8321892 - DNA, 22 bp, Homo sapiens
tgcctgccctttccacacagcc

SEQ ID NO: 8321893 - DNA, 22 bp, Homo sapiens
ccagggttgcagggagccagca

SEQ ID NO: 8321894 - DNA, 22 bp, Homo sapiens
ccagggtggggcaggcccactg

SEQ ID NO: 8321895 - DNA, 22 bp, Homo sapiens
ccagggtgggaggctgaaggcg

SEQ ID NO: 8321896 - DNA, 19 bp, Homo sapiens
tgagactgggtgcagtact

SEQ ID NO: 8321897 - DNA, 22 bp, Homo sapiens
tgagcacctactgtattccagg

SEQ ID NO: 8321898 - DNA, 22 bp, Homo sapiens
tgaggaagttgtttctcttcta

SEQ ID NO: 8321899 - DNA, 23 bp, Homo sapiens
tgagctgggcctgcaggggtctc

SEQ ID NO: 8321900 - DNA, 22 bp, Homo sapiens
tgaggacattgagactggagac

SEQ ID NO: 8321901 - DNA, 22 bp, Homo sapiens
tgaggacattaggaagtgaagg

SEQ ID NO: 8321902 - DNA, 22 bp, Homo sapiens
tgaggacattggtcaggacatg

SEQ ID NO: 8321903 - DNA, 22 bp, Homo sapiens
tgagcagaaaagaatgctgagc

SEQ ID NO: 8321904 - DNA, 22 bp, Homo sapiens
tgagcagacttgatgaggcagc

SEQ ID NO: 8321905 - DNA, 22 bp, Homo sapiens
ccagggtggaggctggatggag

SEQ ID NO: 8321906 - DNA, 22 bp, Homo sapiens
tgactttgtccctttcaaatcc

SEQ ID NO: 8321907 - DNA, 22 bp, Homo sapiens
tgactttggataagaaaatgag

SEQ ID NO: 8321908 - DNA, 22 bp, Homo sapiens
tgaccaatactgtggatgccag

SEQ ID NO: 8321909 - DNA, 22 bp, Homo sapiens
tgaccacacttgatcactctga

SEQ ID NO: 8321910 - DNA, 22 bp, Homo sapiens
tgaccaggatactgcagggatg

SEQ ID NO: 8321911 - DNA, 22 bp, Homo sapiens
tgaccatttgatctacattcca

SEQ ID NO: 8321912 - DNA, 22 bp, Homo sapiens
ccagggcccacggccagaatag

SEQ ID NO: 8321913 - DNA, 22 bp, Homo sapiens
tgacagagcatgtagtgacagc

SEQ ID NO: 8321914 - DNA, 22 bp, Homo sapiens
tgacagagcatgtagtgacagc

SEQ ID NO: 8321915 - DNA, 22 bp, Homo sapiens
tgacagagagcttttgactgtc

SEQ ID NO: 8321916 - DNA, 22 bp, Homo sapiens
tgacagagaggtaagttatgaa

SEQ ID NO: 8321917 - DNA, 19 bp, Homo sapiens
tgacagagagcagggtggt

SEQ ID NO: 8321918 - DNA, 23 bp, Homo sapiens
tgacagagcacagtgggggagat

SEQ ID NO: 8321919 - DNA, 22 bp, Homo sapiens
tgacagactttacttctcctat

SEQ ID NO: 8321920 - DNA, 21 bp, Homo sapiens
tcttgtattggatctgtgtgt

SEQ ID NO: 8321921 - DNA, 22 bp, Homo sapiens
tcttgtttggattttgggcagt

SEQ ID NO: 8321922 - DNA, 22 bp, Homo sapiens
tctttaaagttggagcttgcaa

SEQ ID NO: 8321923 - DNA, 19 bp, Homo sapiens
tctgcagactatattgtga

SEQ ID NO: 8321924 - DNA, 22 bp, Homo sapiens
tctgcagagcctcaggagaaca

SEQ ID NO: 8321925 - DNA, 19 bp, Homo sapiens
tctgcagaggaattcttca

SEQ ID NO: 8321926 - DNA, 22 bp, Homo sapiens
tctgcagagcattatagcaaaa

SEQ ID NO: 8321927 - DNA, 22 bp, Homo sapiens
ccaggctcaggcctgctcgttg

SEQ ID NO: 8321928 - DNA, 22 bp, Homo sapiens
tctttcaaagctgtagtagatt

SEQ ID NO: 8321929 - DNA, 22 bp, Homo sapiens
tgaaagcagcaccaataccatt

SEQ ID NO: 8321930 - DNA, 22 bp, Homo sapiens
ccaggctgcagtcaaggggcat

SEQ ID NO: 8321931 - DNA, 22 bp, Homo sapiens
tgaaatgattatatggtgtttg

SEQ ID NO: 8321932 - DNA, 22 bp, Homo sapiens
tgaaggaatgagggagtgggtc

SEQ ID NO: 8321933 - DNA, 22 bp, Homo sapiens
tgaagatgtcagcaggggtggt

SEQ ID NO: 8321934 - DNA, 22 bp, Homo sapiens
cccacaggctaggggtagggca

SEQ ID NO: 8321935 - DNA, 22 bp, Homo sapiens
cccacagggctgctgatggcag

SEQ ID NO: 8321936 - DNA, 22 bp, Homo sapiens
cccaagggtgcccagcagagga

SEQ ID NO: 8321937 - DNA, 22 bp, Homo sapiens
tgattcaactttcttgaatgca

SEQ ID NO: 8321938 - DNA, 22 bp, Homo sapiens
cccacaggcaggtgcatgggct

SEQ ID NO: 8321939 - DNA, 22 bp, Homo sapiens
cccacaggccctgctgccttga

SEQ ID NO: 8321940 - DNA, 22 bp, Homo sapiens
cccacccactctgaccagaagc

SEQ ID NO: 8321941 - DNA, 21 bp, Homo sapiens
cccaccccataaggcagaacc

SEQ ID NO: 8321942 - DNA, 22 bp, Homo sapiens
tgcagaggtgaaagactagcaa

SEQ ID NO: 8321943 - DNA, 19 bp, Homo sapiens
cccagagagatctcttgcc

SEQ ID NO: 8321944 - DNA, 22 bp, Homo sapiens
tgcagagtaaaagcagatgcta

SEQ ID NO: 8321945 - DNA, 23 bp, Homo sapiens
cccagcagagatgaggaggggtc

SEQ ID NO: 8321946 - DNA, 22 bp, Homo sapiens
cccagcactttgaatatgtcac

SEQ ID NO: 8321947 - DNA, 22 bp, Homo sapiens
cccagcagaatctgatgagggc

SEQ ID NO: 8321948 - DNA, 22 bp, Homo sapiens
cccagcagccagaatgaggagc

SEQ ID NO: 8321949 - DNA, 22 bp, Homo sapiens
cccagcagccagaatgaggagc

SEQ ID NO: 8321950 - DNA, 23 bp, Homo sapiens
cccagcagattgtaaagtgtcca

SEQ ID NO: 8321951 - DNA, 22 bp, Homo sapiens
ccattgtagtatctgttttagt

SEQ ID NO: 8321952 - DNA, 22 bp, Homo sapiens
cccaagccagaccctgaccctg

SEQ ID NO: 8321953 - DNA, 17 bp, Homo sapiens
tgattcaactagaaact

SEQ ID NO: 8321954 - DNA, 22 bp, Homo sapiens
tgattcaaatattgtgtatgat

SEQ ID NO: 8321955 - DNA, 22 bp, Homo sapiens
tgattcaactttcataacaaaa

SEQ ID NO: 8321956 - DNA, 22 bp, Homo sapiens
tgatgacatgtgggctgtggct

SEQ ID NO: 8321957 - DNA, 22 bp, Homo sapiens
tgatgacagtgttacagctcca

SEQ ID NO: 8321958 - DNA, 22 bp, Homo sapiens
tgatgacaatgttgctgcaata

SEQ ID NO: 8321959 - DNA, 22 bp, Homo sapiens
tgatgacagcaaaaaatgctag

SEQ ID NO: 8321960 - DNA, 22 bp, Homo sapiens
tgatgaggggctcagaggtcag

SEQ ID NO: 8321961 - DNA, 22 bp, Homo sapiens
ccagtgtgggctggtggaggac

SEQ ID NO: 8321962 - DNA, 22 bp, Homo sapiens
tgcagcatctccttgtgccatg

SEQ ID NO: 8321963 - DNA, 22 bp, Homo sapiens
cccagctcatcaggagccgccc

SEQ ID NO: 8321964 - DNA, 22 bp, Homo sapiens
cccagctccagagccagaaaca

SEQ ID NO: 8321965 - DNA, 22 bp, Homo sapiens
cccagctcccatgttctccaat

SEQ ID NO: 8321966 - DNA, 22 bp, Homo sapiens
cccaggaggcagaggttggagc

SEQ ID NO: 8321967 - DNA, 22 bp, Homo sapiens
cccaggaggcagaggttggagc

SEQ ID NO: 8321968 - DNA, 22 bp, Homo sapiens
cccaggaggcgcaggttgcggt

SEQ ID NO: 8321969 - DNA, 22 bp, Homo sapiens
cccaggaggcgcaggttgcggt

SEQ ID NO: 8321970 - DNA, 22 bp, Homo sapiens
cccaggaggcagagcttgcagt

SEQ ID NO: 8321971 - DNA, 22 bp, Homo sapiens
cccaggaggcagagcttgcagt

SEQ ID NO: 8321972 - DNA, 22 bp, Homo sapiens
cccaggaggcagagatagcagt

SEQ ID NO: 8321973 - DNA, 22 bp, Homo sapiens
cccaggaggcagaagttgcagt

SEQ ID NO: 8321974 - DNA, 21 bp, Homo sapiens
cccaggaggagctccggctcc

SEQ ID NO: 8321975 - DNA, 22 bp, Homo sapiens
tgccctggttctgtgggtgagc

SEQ ID NO: 8321976 - DNA, 20 bp, Homo sapiens
cccaggagtgagcagcttta

SEQ ID NO: 8321977 - DNA, 22 bp, Homo sapiens
cccaggagttagaggttgtggt

SEQ ID NO: 8321978 - DNA, 22 bp, Homo sapiens
cccaggagttagaggttgtggt

SEQ ID NO: 8321979 - DNA, 19 bp, Homo sapiens
cccaggagtctggctggtt

SEQ ID NO: 8321980 - DNA, 19 bp, Homo sapiens
cccaggagtctggctggtt

SEQ ID NO: 8321981 - DNA, 22 bp, Homo sapiens
cccaggaggttggggctacagt

SEQ ID NO: 8321982 - DNA, 22 bp, Homo sapiens
cccaggaggttggggctacagt

SEQ ID NO: 8321983 - DNA, 22 bp, Homo sapiens
cccaggaggttgaggctgcagt

SEQ ID NO: 8321984 - DNA, 22 bp, Homo sapiens
cccaggaggcggaggttgtggt

SEQ ID NO: 8321985 - DNA, 22 bp, Homo sapiens
cccaggaggcggaggttgtggt

SEQ ID NO: 8321986 - DNA, 22 bp, Homo sapiens
tgcccaggatctggcgatgctc

SEQ ID NO: 8321987 - DNA, 21 bp, Homo sapiens
cccaggaggctgagaagagca

SEQ ID NO: 8321988 - DNA, 22 bp, Homo sapiens
tgcccagcttcttacttttaaa

SEQ ID NO: 8321989 - DNA, 22 bp, Homo sapiens
tgccctccctgtactgtcagga

SEQ ID NO: 8321990 - DNA, 18 bp, Homo sapiens
tcctttcaccccttctct

SEQ ID NO: 8321991 - DNA, 22 bp, Homo sapiens
tcgctggcctggaggggagcca

SEQ ID NO: 8321992 - DNA, 22 bp, Homo sapiens
tcgggctcgctctcctagcgga

SEQ ID NO: 8321993 - DNA, 22 bp, Homo sapiens
tcggggtctttgacacgctctg

SEQ ID NO: 8321994 - DNA, 22 bp, Homo sapiens
tcctctctgcactggccctgcc

SEQ ID NO: 8321995 - DNA, 22 bp, Homo sapiens
tcctctccatgtctcacgccac

SEQ ID NO: 8321996 - DNA, 22 bp, Homo sapiens
tcctctgaattcgctctgtgat

SEQ ID NO: 8321997 - DNA, 19 bp, Homo sapiens
tcctctgaaggttctttta

SEQ ID NO: 8321998 - DNA, 22 bp, Homo sapiens
tcctctgaagaaaaggagcagg

SEQ ID NO: 8321999 - DNA, 22 bp, Homo sapiens
tcctctgaaatctagattgtga

SEQ ID NO: 8322000 - DNA, 22 bp, Homo sapiens
tcctctgccaaagggagttgcc

SEQ ID NO: 8322001 - DNA, 22 bp, Homo sapiens
tcctctgagcctcagtttctca

SEQ ID NO: 8322002 - DNA, 22 bp, Homo sapiens
tcctctgagtaaagaagattgc

SEQ ID NO: 8322003 - DNA, 22 bp, Homo sapiens
ccacagtgatccctgcctgcga

SEQ ID NO: 8322004 - DNA, 22 bp, Homo sapiens
ccacattgactgtctgtagatt

SEQ ID NO: 8322005 - DNA, 22 bp, Homo sapiens
ccacatggatagatagggacat

SEQ ID NO: 8322006 - DNA, 23 bp, Homo sapiens
ccacatggcaagatgatgcattc

SEQ ID NO: 8322007 - DNA, 22 bp, Homo sapiens
ccacatggagcaggaggtgggg

SEQ ID NO: 8322008 - DNA, 22 bp, Homo sapiens
ccacatggagcaggaggtgggg

SEQ ID NO: 8322009 - DNA, 19 bp, Homo sapiens
ccacatggctggatgacag

SEQ ID NO: 8322010 - DNA, 20 bp, Homo sapiens
tctccctgcccatctcagat

SEQ ID NO: 8322011 - DNA, 22 bp, Homo sapiens
tctcctggccctgtcgccatct

SEQ ID NO: 8322012 - DNA, 22 bp, Homo sapiens
tctccgtgccgtgggaggctcc

SEQ ID NO: 8322013 - DNA, 22 bp, Homo sapiens
tctcccacagtctcccatggct

SEQ ID NO: 8322014 - DNA, 19 bp, Homo sapiens
tctccagctttgggctttt

SEQ ID NO: 8322015 - DNA, 21 bp, Homo sapiens
tctccagagtgggaggaaatc

SEQ ID NO: 8322016 - DNA, 22 bp, Homo sapiens
ccagagagattgcttctaaaga

SEQ ID NO: 8322017 - DNA, 23 bp, Homo sapiens
tctcaagaggaagcagggctcat

SEQ ID NO: 8322018 - DNA, 22 bp, Homo sapiens
tctcaaatttatacagagttca

SEQ ID NO: 8322019 - DNA, 22 bp, Homo sapiens
tctcaaatttgttagataaaat

SEQ ID NO: 8322020 - DNA, 22 bp, Homo sapiens
tctcaaatgtaaagcatgattt

SEQ ID NO: 8322021 - DNA, 22 bp, Homo sapiens
tctcaaattcccttttcctcct

SEQ ID NO: 8322022 - DNA, 22 bp, Homo sapiens
tctatattccagatacagatta

SEQ ID NO: 8322023 - DNA, 22 bp, Homo sapiens
ccactttgaaccactgaggtgg

SEQ ID NO: 8322024 - DNA, 19 bp, Homo sapiens
ccactttgcttctctgggt

SEQ ID NO: 8322025 - DNA, 22 bp, Homo sapiens
ccagcagagtctaggaaggagg

SEQ ID NO: 8322026 - DNA, 22 bp, Homo sapiens
ccagcagagggtcttggccatt

SEQ ID NO: 8322027 - DNA, 22 bp, Homo sapiens
ccagcagctccctcagggtccg

SEQ ID NO: 8322028 - DNA, 22 bp, Homo sapiens
ccagcagctgcaaagcctgggt

SEQ ID NO: 8322029 - DNA, 22 bp, Homo sapiens
tctctgcccatcctcagtccac

SEQ ID NO: 8322030 - DNA, 22 bp, Homo sapiens
tctctgcccatgagcaatctgc

SEQ ID NO: 8322031 - DNA, 22 bp, Homo sapiens
tctctgccacagcttctgcctt

SEQ ID NO: 8322032 - DNA, 22 bp, Homo sapiens
tctctgccaccatgagatgggc

SEQ ID NO: 8322033 - DNA, 22 bp, Homo sapiens
tctctgcccaagtttctcaagt

SEQ ID NO: 8322034 - DNA, 19 bp, Homo sapiens
tctctgcagcgcgcccggc

SEQ ID NO: 8322035 - DNA, 22 bp, Homo sapiens
tctctgatgattggaagcttag

SEQ ID NO: 8322036 - DNA, 22 bp, Homo sapiens
tctctgagttttaaggatgatg

SEQ ID NO: 8322037 - DNA, 22 bp, Homo sapiens
tctcctggcctttaggttaagg

SEQ ID NO: 8322038 - DNA, 22 bp, Homo sapiens
tctcctggccgggctgtcccct

SEQ ID NO: 8322039 - DNA, 22 bp, Homo sapiens
tctcctggctcaccaggctgga

SEQ ID NO: 8322040 - DNA, 22 bp, Homo sapiens
tctcctggctctaaaaggctgt

SEQ ID NO: 8322041 - DNA, 23 bp, Homo sapiens
tctcctggctgcactgtggccac

SEQ ID NO: 8322042 - DNA, 17 bp, Homo sapiens
tctcctggctctatcag

SEQ ID NO: 8322043 - DNA, 22 bp, Homo sapiens
tctgagagtctctgaggcagat

SEQ ID NO: 8322044 - DNA, 22 bp, Homo sapiens
tctgcagaattcgaggaagaaa

SEQ ID NO: 8322045 - DNA, 19 bp, Homo sapiens
tctgcagaaggcatacatg

SEQ ID NO: 8322046 - DNA, 19 bp, Homo sapiens
tctgaagtccagggcatac

SEQ ID NO: 8322047 - DNA, 23 bp, Homo sapiens
tctctgtgtgcctcagtttcttc

SEQ ID NO: 8322048 - DNA, 22 bp, Homo sapiens
tctctgtgtgccttcatctgcc

SEQ ID NO: 8322049 - DNA, 22 bp, Homo sapiens
ccagcatcagcattgtcttagg

SEQ ID NO: 8322050 - DNA, 22 bp, Homo sapiens
tctctgtgtgttggctgtatat

SEQ ID NO: 8322051 - DNA, 22 bp, Homo sapiens
tctctgtgttccctgttttctc

SEQ ID NO: 8322052 - DNA, 22 bp, Homo sapiens
catgttgtattctttggctggt

SEQ ID NO: 8322053 - DNA, 22 bp, Homo sapiens
catgttgtgaaggaaaatgggc

SEQ ID NO: 8322054 - DNA, 22 bp, Homo sapiens
catgtttaattgcgatgtttga

SEQ ID NO: 8322055 - DNA, 22 bp, Homo sapiens
catgttgtagtatcataatggt

SEQ ID NO: 8322056 - DNA, 22 bp, Homo sapiens
tcccaggaattgaagccagtgt

SEQ ID NO: 8322057 - DNA, 22 bp, Homo sapiens
tcccagccattcctttaggtgt

SEQ ID NO: 8322058 - DNA, 22 bp, Homo sapiens
tcccagcccagacttctccagt

SEQ ID NO: 8322059 - DNA, 22 bp, Homo sapiens
tcccagcccagatttgtgtgac

SEQ ID NO: 8322060 - DNA, 22 bp, Homo sapiens
tcccagccaggctctaccactt

SEQ ID NO: 8322061 - DNA, 22 bp, Homo sapiens
tcccagccacagtttccacctg

SEQ ID NO: 8322062 - DNA, 22 bp, Homo sapiens
tcccagagctctgacaccagct

SEQ ID NO: 8322063 - DNA, 22 bp, Homo sapiens
tcccagaggaaatggcagctga

SEQ ID NO: 8322064 - DNA, 22 bp, Homo sapiens
tcccagccacaggtgtagccct

SEQ ID NO: 8322065 - DNA, 22 bp, Homo sapiens
cattcatttatgaaatatctat

SEQ ID NO: 8322066 - DNA, 22 bp, Homo sapiens
catttgtagttaaaaatgtctc

SEQ ID NO: 8322067 - DNA, 22 bp, Homo sapiens
tcctcagggaagatgagcctca

SEQ ID NO: 8322068 - DNA, 22 bp, Homo sapiens
tcctcaggctgcctggaagact

SEQ ID NO: 8322069 - DNA, 22 bp, Homo sapiens
tcctcaggcggtgaggaggggc

SEQ ID NO: 8322070 - DNA, 22 bp, Homo sapiens
tcctcaggatgtggggtagaat

SEQ ID NO: 8322071 - DNA, 22 bp, Homo sapiens
tcctcaggatgtggagtagaat

SEQ ID NO: 8322072 - DNA, 22 bp, Homo sapiens
tcctcaggatctaggagtgctt

SEQ ID NO: 8322073 - DNA, 22 bp, Homo sapiens
tcctcaggagagctcctatgcc

SEQ ID NO: 8322074 - DNA, 22 bp, Homo sapiens
tccctagtcgcatctgtggaga

SEQ ID NO: 8322075 - DNA, 22 bp, Homo sapiens
tcccaggaggtgcttcctagga

SEQ ID NO: 8322076 - DNA, 22 bp, Homo sapiens
cattgaaatatggaaactgatg

SEQ ID NO: 8322077 - DNA, 22 bp, Homo sapiens
cattgcacatctgagaagagat

SEQ ID NO: 8322078 - DNA, 22 bp, Homo sapiens
tccagctgaggtggcctctgtg

SEQ ID NO: 8322079 - DNA, 17 bp, Homo sapiens
tccagcctcctctgctg

SEQ ID NO: 8322080 - DNA, 22 bp, Homo sapiens
tccaggcccatggagcagagct

SEQ ID NO: 8322081 - DNA, 22 bp, Homo sapiens
tccaggctcagtcaagcacttc

SEQ ID NO: 8322082 - DNA, 19 bp, Homo sapiens
tccaggctccattggcaga

SEQ ID NO: 8322083 - DNA, 22 bp, Homo sapiens
tccaggctcccctgcgtgctcc

SEQ ID NO: 8322084 - DNA, 18 bp, Homo sapiens
tccaggctccaggctaac

SEQ ID NO: 8322085 - DNA, 20 bp, Homo sapiens
tccaggctcctccacttagt

SEQ ID NO: 8322086 - DNA, 22 bp, Homo sapiens
tccaggctccctcaggatgcac

SEQ ID NO: 8322087 - DNA, 22 bp, Homo sapiens
tcatttatgcaggaatggcata

SEQ ID NO: 8322088 - DNA, 22 bp, Homo sapiens
tcatttatcgctgccttttaaa

SEQ ID NO: 8322089 - DNA, 22 bp, Homo sapiens
tcatttatgtctttgccatcca

SEQ ID NO: 8322090 - DNA, 22 bp, Homo sapiens
tcatttatttataccattgcct

SEQ ID NO: 8322091 - DNA, 19 bp, Homo sapiens
catctttggtcacctagtc

SEQ ID NO: 8322092 - DNA, 22 bp, Homo sapiens
catctttgtaacttccacataa

SEQ ID NO: 8322093 - DNA, 22 bp, Homo sapiens
catgaaaaatttactgttaaca

SEQ ID NO: 8322094 - DNA, 22 bp, Homo sapiens
gtgaggggagtaaagccatgtt

SEQ ID NO: 8322095 - DNA, 22 bp, Homo sapiens
tactatttggaattttaaattg

SEQ ID NO: 8322096 - DNA, 22 bp, Homo sapiens
tacctgaagtaacaatgaatat

SEQ ID NO: 8322097 - DNA, 22 bp, Homo sapiens
gtgaggtaaaatcggtaagatg

SEQ ID NO: 8322098 - DNA, 22 bp, Homo sapiens
gtgaggggtctggacgcacagt

SEQ ID NO: 8322099 - DNA, 22 bp, Homo sapiens
gtgaggggccaagagtagggca

SEQ ID NO: 8322100 - DNA, 22 bp, Homo sapiens
gtgaggggtctggacgcacagt

SEQ ID NO: 8322101 - DNA, 22 bp, Homo sapiens
gtgaggggtggctgagcagttt

SEQ ID NO: 8322102 - DNA, 22 bp, Homo sapiens
tactcaaactcactaagacaga

SEQ ID NO: 8322103 - DNA, 22 bp, Homo sapiens
tactcaaaaagttatgaatcat

SEQ ID NO: 8322104 - DNA, 23 bp, Homo sapiens
tactgtgctgaatatttgagagg

SEQ ID NO: 8322105 - DNA, 19 bp, Homo sapiens
tagaatagttacacagatt

SEQ ID NO: 8322106 - DNA, 22 bp, Homo sapiens
tagataaaagggcaaagggcat

SEQ ID NO: 8322107 - DNA, 22 bp, Homo sapiens
tagataaattagaaagtttact

SEQ ID NO: 8322108 - DNA, 22 bp, Homo sapiens
tagaggagaacacaaattatag

SEQ ID NO: 8322109 - DNA, 22 bp, Homo sapiens
caggctgggcagcctccccggc

SEQ ID NO: 8322110 - DNA, 22 bp, Homo sapiens
tagataaattagaaagtttact

SEQ ID NO: 8322111 - DNA, 19 bp, Homo sapiens
tagataaggcatttaatct

SEQ ID NO: 8322112 - DNA, 19 bp, Homo sapiens
tagataaggcatttaatct

SEQ ID NO: 8322113 - DNA, 22 bp, Homo sapiens
tagcgttttgtaatcaagtatg

SEQ ID NO: 8322114 - DNA, 22 bp, Homo sapiens
tagggtacatgtgcacaacatg

SEQ ID NO: 8322115 - DNA, 22 bp, Homo sapiens
caggggaagatgccaagggaga

SEQ ID NO: 8322116 - DNA, 22 bp, Homo sapiens
caggggacattaaagctccata

SEQ ID NO: 8322117 - DNA, 22 bp, Homo sapiens
cagggctgtggctttgtgctgt

SEQ ID NO: 8322118 - DNA, 22 bp, Homo sapiens
tagggtggttagaaggagtatg

SEQ ID NO: 8322119 - DNA, 22 bp, Homo sapiens
tagggtggagactggaagcagg

SEQ ID NO: 8322120 - DNA, 22 bp, Homo sapiens
tatcatttaacagaatcattgc

SEQ ID NO: 8322121 - DNA, 22 bp, Homo sapiens
tatcataagttaattaaacagt

SEQ ID NO: 8322122 - DNA, 22 bp, Homo sapiens
tagtgacaggaactgaatctct

SEQ ID NO: 8322123 - DNA, 22 bp, Homo sapiens
caggggagttttatgcaacaga

SEQ ID NO: 8322124 - DNA, 22 bp, Homo sapiens
tagctcaaaggttaagtgtgga

SEQ ID NO: 8322125 - DNA, 22 bp, Homo sapiens
cagggcctcattgtcagtcctg

SEQ ID NO: 8322126 - DNA, 22 bp, Homo sapiens
cagggctcagaagacagacctc

SEQ ID NO: 8322127 - DNA, 22 bp, Homo sapiens
tatttgaaagtgtacaaaaact

SEQ ID NO: 8322128 - DNA, 22 bp, Homo sapiens
tatttcttttcgtgacttattg

SEQ ID NO: 8322129 - DNA, 22 bp, Homo sapiens
tatttcttttcgtgacttattg

SEQ ID NO: 8322130 - DNA, 20 bp, Homo sapiens
tcaatgagatttaaaaggat

SEQ ID NO: 8322131 - DNA, 22 bp, Homo sapiens
cagtgagctcctgtctgtccct

SEQ ID NO: 8322132 - DNA, 22 bp, Homo sapiens
cagtgagctcatggccaagtca

SEQ ID NO: 8322133 - DNA, 22 bp, Homo sapiens
tcacagactcaagggcatagga

SEQ ID NO: 8322134 - DNA, 22 bp, Homo sapiens
tcacagactcttgattgtctaa

SEQ ID NO: 8322135 - DNA, 22 bp, Homo sapiens
tcacacttatcccactcagtca

SEQ ID NO: 8322136 - DNA, 22 bp, Homo sapiens
tcacagttcatctgataaacta

SEQ ID NO: 8322137 - DNA, 22 bp, Homo sapiens
tcacagactggtcagtcaactt

SEQ ID NO: 8322138 - DNA, 22 bp, Homo sapiens
tcacagagaactataatccatc

SEQ ID NO: 8322139 - DNA, 22 bp, Homo sapiens
cagtcccactagtgccaatacc

SEQ ID NO: 8322140 - DNA, 22 bp, Homo sapiens
cagtcccacaagatctccacaa

SEQ ID NO: 8322141 - DNA, 22 bp, Homo sapiens
cagtcccaccaggatcgctctt

SEQ ID NO: 8322142 - DNA, 20 bp, Homo sapiens
cagtcccaatccagggccag

SEQ ID NO: 8322143 - DNA, 22 bp, Homo sapiens
cagtatatgctctttcatcaaa

SEQ ID NO: 8322144 - DNA, 20 bp, Homo sapiens
cagtccactggagttcctac

SEQ ID NO: 8322145 - DNA, 19 bp, Homo sapiens
cagtcccaaattcttgtca

SEQ ID NO: 8322146 - DNA, 22 bp, Homo sapiens
cagtcccaaggaggaagcagtc

SEQ ID NO: 8322147 - DNA, 22 bp, Homo sapiens
tatttctttcaggtatgtgttg

SEQ ID NO: 8322148 - DNA, 21 bp, Homo sapiens
tatttctttgactctctccct

SEQ ID NO: 8322149 - DNA, 22 bp, Homo sapiens
cagtcccagaagagcctgggag

SEQ ID NO: 8322150 - DNA, 22 bp, Homo sapiens
cagtcccagacatagtaaggga

SEQ ID NO: 8322151 - DNA, 22 bp, Homo sapiens
cagtcccagacccagaaggtgg

SEQ ID NO: 8322152 - DNA, 22 bp, Homo sapiens
tatttcttgttccctccaagtt

SEQ ID NO: 8322153 - DNA, 22 bp, Homo sapiens
cagtagggaatgtgggaggctg

SEQ ID NO: 8322154 - DNA, 22 bp, Homo sapiens
cagtagtgttgctgagtgtcag

SEQ ID NO: 8322155 - DNA, 22 bp, Homo sapiens
cagggtggccctgtggtctcat

SEQ ID NO: 8322156 - DNA, 22 bp, Homo sapiens
tatttcatctggaacaaggtaa

SEQ ID NO: 8322157 - DNA, 22 bp, Homo sapiens
tatttcattctttatcaggagc

SEQ ID NO: 8322158 - DNA, 22 bp, Homo sapiens
caggtttctagttctaagaata

SEQ ID NO: 8322159 - DNA, 22 bp, Homo sapiens
caggtttcattggcagcttcat

SEQ ID NO: 8322160 - DNA, 22 bp, Homo sapiens
cagtttatatataagcacattg

SEQ ID NO: 8322161 - DNA, 22 bp, Homo sapiens
cagtttaagtagaactgagaat

SEQ ID NO: 8322162 - DNA, 22 bp, Homo sapiens
cagtttaaggcaggacatggga

SEQ ID NO: 8322163 - DNA, 22 bp, Homo sapiens
cagtttaagtgtgttgaaggta

SEQ ID NO: 8322164 - DNA, 21 bp, Homo sapiens
cagtttaataacaaagaagga

SEQ ID NO: 8322165 - DNA, 22 bp, Homo sapiens
cagtttatatataagcacattg

SEQ ID NO: 8322166 - DNA, 22 bp, Homo sapiens
cagtttatagctctagcagctt

SEQ ID NO: 8322167 - DNA, 21 bp, Homo sapiens
tcaggaaacacctcttaagga

SEQ ID NO: 8322168 - DNA, 22 bp, Homo sapiens
cagtttaaatgagtgactgcag

SEQ ID NO: 8322169 - DNA, 22 bp, Homo sapiens
cagtttaaagaaggatgggagt

SEQ ID NO: 8322170 - DNA, 22 bp, Homo sapiens
cagttgttcccagcaatgaaag

SEQ ID NO: 8322171 - DNA, 19 bp, Homo sapiens
cagtttaactaattttatc

SEQ ID NO: 8322172 - DNA, 22 bp, Homo sapiens
cagtttaacctatccattatgt

SEQ ID NO: 8322173 - DNA, 20 bp, Homo sapiens
cagtttaactttgagcagtt

SEQ ID NO: 8322174 - DNA, 22 bp, Homo sapiens
cagtttaagacaagggggtgta

SEQ ID NO: 8322175 - DNA, 22 bp, Homo sapiens
cagttaactgagctctgtgaga

SEQ ID NO: 8322176 - DNA, 22 bp, Homo sapiens
cagtggggggactgaggcctga

SEQ ID NO: 8322177 - DNA, 22 bp, Homo sapiens
cagtgggggtgaggccgaggta

SEQ ID NO: 8322178 - DNA, 23 bp, Homo sapiens
cagtgggcttctaactgctcctg

SEQ ID NO: 8322179 - DNA, 21 bp, Homo sapiens
cagtgggctgctgcgctccag

SEQ ID NO: 8322180 - DNA, 23 bp, Homo sapiens
cagtgggaggactgagataaaac

SEQ ID NO: 8322181 - DNA, 22 bp, Homo sapiens
cagtgggatatgggggcagcat

SEQ ID NO: 8322182 - DNA, 22 bp, Homo sapiens
cagtgggaagggcagaggcttt

SEQ ID NO: 8322183 - DNA, 22 bp, Homo sapiens
tcagagaaaggccaaaatatca

SEQ ID NO: 8322184 - DNA, 22 bp, Homo sapiens
cagtgtctcagtttcacttgaa

SEQ ID NO: 8322185 - DNA, 22 bp, Homo sapiens
tttttcacacatgtggcttgat

SEQ ID NO: 8322186 - DNA, 22 bp, Homo sapiens
tttttcatctgattgataactc

SEQ ID NO: 8322187 - DNA, 22 bp, Homo sapiens
tttttatatgaaggatagtgcg

SEQ ID NO: 8322188 - DNA, 22 bp, Homo sapiens
tttttatctacagattctcagc

SEQ ID NO: 8322189 - DNA, 22 bp, Homo sapiens
tttttatatgaaggatagtgcg

SEQ ID NO: 8322190 - DNA, 22 bp, Homo sapiens
tttttataggtcagggcaagtc

SEQ ID NO: 8322191 - DNA, 22 bp, Homo sapiens
tttttataggtcagggcaagtc

SEQ ID NO: 8322192 - DNA, 22 bp, Homo sapiens
tttttatactttgctcaagatt

SEQ ID NO: 8322193 - DNA, 22 bp, Homo sapiens
tttttatactttgctcaagatt

SEQ ID NO: 8322194 - DNA, 22 bp, Homo sapiens
ttttgtttgtgtccactgcagt

SEQ ID NO: 8322195 - DNA, 22 bp, Homo sapiens
ttttgtttgtgtccactgcagt

SEQ ID NO: 8322196 - DNA, 22 bp, Homo sapiens
ttttgtttaaaatcctggatgg

SEQ ID NO: 8322197 - DNA, 22 bp, Homo sapiens
tttttacacttagcattgagcg

SEQ ID NO: 8322198 - DNA, 22 bp, Homo sapiens
tttttagaattggctgagaatt

SEQ ID NO: 8322199 - DNA, 22 bp, Homo sapiens
tttttagagtgttaccagtata

SEQ ID NO: 8322200 - DNA, 22 bp, Homo sapiens
tttttataactcttttgtgaca

SEQ ID NO: 8322201 - DNA, 22 bp, Homo sapiens
tttttataactcttttgtgaca

SEQ ID NO: 8322202 - DNA, 22 bp, Homo sapiens
tttttataactcttttgtgaca

SEQ ID NO: 8322203 - DNA, 22 bp, Homo sapiens
tttttataccacctctcactta

SEQ ID NO: 8322204 - DNA, 22 bp, Homo sapiens
tttttataccacctctcactta

SEQ ID NO: 8322205 - DNA, 22 bp, Homo sapiens
tttccctttgcactctacaatt

SEQ ID NO: 8322206 - DNA, 22 bp, Homo sapiens
tttccctttgcactctacaatt

SEQ ID NO: 8322207 - DNA, 22 bp, Homo sapiens
tttccgacagaagctgggcgct

SEQ ID NO: 8322208 - DNA, 22 bp, Homo sapiens
tttcccttctttcctgagtaat

SEQ ID NO: 8322209 - DNA, 22 bp, Homo sapiens
tttcccttgaataaagatatct

SEQ ID NO: 8322210 - DNA, 22 bp, Homo sapiens
tttcccttctttcctgagtaat

SEQ ID NO: 8322211 - DNA, 22 bp, Homo sapiens
tttcccttgaataaagatatct

SEQ ID NO: 8322212 - DNA, 22 bp, Homo sapiens
tttccctttagcctgagaatcc

SEQ ID NO: 8322213 - DNA, 22 bp, Homo sapiens
tttccctttagcctgagaatcc

SEQ ID NO: 8322214 - DNA, 22 bp, Homo sapiens
tttcccttgttccttcctctga

SEQ ID NO: 8322215 - DNA, 22 bp, Homo sapiens
tttcctctccaccaggaggtct

SEQ ID NO: 8322216 - DNA, 22 bp, Homo sapiens
tttcctctgatgctgacttgga

SEQ ID NO: 8322217 - DNA, 22 bp, Homo sapiens
tttctttgttgttatcacatca

SEQ ID NO: 8322218 - DNA, 22 bp, Homo sapiens
tttcttttgctgagaggggcac

SEQ ID NO: 8322219 - DNA, 22 bp, Homo sapiens
tttcttttgaatagtgtgtggt

SEQ ID NO: 8322220 - DNA, 22 bp, Homo sapiens
tttgacagacatttactacatt

SEQ ID NO: 8322221 - DNA, 22 bp, Homo sapiens
tttgacaacagcaaatgtcaca

SEQ ID NO: 8322222 - DNA, 22 bp, Homo sapiens
tttgaatgcaggacatacagaa

SEQ ID NO: 8322223 - DNA, 22 bp, Homo sapiens
tttgaatatgtgcttgttaaat

SEQ ID NO: 8322224 - DNA, 22 bp, Homo sapiens
tttgaagagccacagtgaaatt

SEQ ID NO: 8322225 - DNA, 22 bp, Homo sapiens
tttgaaaaaggcctttggtatg

SEQ ID NO: 8322226 - DNA, 22 bp, Homo sapiens
tttggaaagttgtcactttaga

SEQ ID NO: 8322227 - DNA, 22 bp, Homo sapiens
tttggaaataattccatctcat

SEQ ID NO: 8322228 - DNA, 22 bp, Homo sapiens
tttggaaatttcatcaatagcc

SEQ ID NO: 8322229 - DNA, 22 bp, Homo sapiens
tttggaaacacggtcatcttcc

SEQ ID NO: 8322230 - DNA, 22 bp, Homo sapiens
tttggtgatagtgcagagaaat

SEQ ID NO: 8322231 - DNA, 22 bp, Homo sapiens
tttggtgagctgcgagtgagga

SEQ ID NO: 8322232 - DNA, 22 bp, Homo sapiens
tttggtgttggcttaaccagtt

SEQ ID NO: 8322233 - DNA, 22 bp, Homo sapiens
tttggttaatttaggcttgcat

SEQ ID NO: 8322234 - DNA, 22 bp, Homo sapiens
tttggtaagtatgaatgcagta

SEQ ID NO: 8322235 - DNA, 22 bp, Homo sapiens
tttggtaagtcaggaatgcttc

SEQ ID NO: 8322236 - DNA, 22 bp, Homo sapiens
tttggtcaaatattatcctgag

SEQ ID NO: 8322237 - DNA, 22 bp, Homo sapiens
tttggtcagggtaggacagttg

SEQ ID NO: 8322238 - DNA, 22 bp, Homo sapiens
tttgaggttagctagcagatca

SEQ ID NO: 8322239 - DNA, 22 bp, Homo sapiens
tttgaggttagctagcagatca

SEQ ID NO: 8322240 - DNA, 19 bp, Homo sapiens
tttgatatctgaattatgc

SEQ ID NO: 8322241 - DNA, 22 bp, Homo sapiens
tttgatagttgattaaattcca

SEQ ID NO: 8322242 - DNA, 19 bp, Homo sapiens
tttgatagggcataatata

SEQ ID NO: 8322243 - DNA, 22 bp, Homo sapiens
tttgataattaaaaattgtagt

SEQ ID NO: 8322244 - DNA, 22 bp, Homo sapiens
tttgatgaaagctactatttac

SEQ ID NO: 8322245 - DNA, 22 bp, Homo sapiens
tttgatttactggatattctca

SEQ ID NO: 8322246 - DNA, 22 bp, Homo sapiens
tttgctttgactgtcagcaagt

SEQ ID NO: 8322247 - DNA, 22 bp, Homo sapiens
tttgctttcttgattcagatta

SEQ ID NO: 8322248 - DNA, 22 bp, Homo sapiens
tttgctttctgttgaacagagt

SEQ ID NO: 8322249 - DNA, 22 bp, Homo sapiens
ttttcttactgtctgtgatcct

SEQ ID NO: 8322250 - DNA, 22 bp, Homo sapiens
ttttcttatagagcttaaagtt

SEQ ID NO: 8322251 - DNA, 22 bp, Homo sapiens
ttttcttatagagcttaaagtt

SEQ ID NO: 8322252 - DNA, 22 bp, Homo sapiens
ttttcttaggtgctccaagtag

SEQ ID NO: 8322253 - DNA, 22 bp, Homo sapiens
ttttcttatgtgcagctatatg

SEQ ID NO: 8322254 - DNA, 22 bp, Homo sapiens
ttttcttatgtgcagctatatg

SEQ ID NO: 8322255 - DNA, 22 bp, Homo sapiens
ttttcttatggtgaagcacaaa

SEQ ID NO: 8322256 - DNA, 19 bp, Homo sapiens
ttttccacagaaatatgtt

SEQ ID NO: 8322257 - DNA, 22 bp, Homo sapiens
ttttccaccttctagagattgt

SEQ ID NO: 8322258 - DNA, 22 bp, Homo sapiens
ttttcatttacattagggaaga

SEQ ID NO: 8322259 - DNA, 22 bp, Homo sapiens
ttttcatttacattagggaaga

SEQ ID NO: 8322260 - DNA, 22 bp, Homo sapiens
ttttcatttttgtagatgcaag

SEQ ID NO: 8322261 - DNA, 22 bp, Homo sapiens
ttttcatttttgtagatgcaag

SEQ ID NO: 8322262 - DNA, 22 bp, Homo sapiens
ttttctcttgttaatgtactga

SEQ ID NO: 8322263 - DNA, 22 bp, Homo sapiens
ttttctcttgttaatgtactga

SEQ ID NO: 8322264 - DNA, 22 bp, Homo sapiens
ttttcacattgtcccagcacta

SEQ ID NO: 8322265 - DNA, 22 bp, Homo sapiens
ttttcattgtaaatcaggaaac

SEQ ID NO: 8322266 - DNA, 22 bp, Homo sapiens
ttttcattagaatgactgagaa

SEQ ID NO: 8322267 - DNA, 22 bp, Homo sapiens
ttttcattgttactatgagcta

SEQ ID NO: 8322268 - DNA, 22 bp, Homo sapiens
ttttattagtggctagatgggg

SEQ ID NO: 8322269 - DNA, 22 bp, Homo sapiens
ttttatgtgtgaaatgctgtct

SEQ ID NO: 8322270 - DNA, 22 bp, Homo sapiens
ttttaatcatgcttctatgtcc

SEQ ID NO: 8322271 - DNA, 22 bp, Homo sapiens
ttttaatcctcttggtatctta

SEQ ID NO: 8322272 - DNA, 22 bp, Homo sapiens
ttttaattcaaagtgaatagtg

SEQ ID NO: 8322273 - DNA, 22 bp, Homo sapiens
ttttaattcaaagtgaatagtg

SEQ ID NO: 8322274 - DNA, 22 bp, Homo sapiens
ttttaattgcaattatggtccc

SEQ ID NO: 8322275 - DNA, 22 bp, Homo sapiens
ttttaattcaaagtgaatagtg

SEQ ID NO: 8322276 - DNA, 22 bp, Homo sapiens
ttttatgtgtcaaagcagtggt

SEQ ID NO: 8322277 - DNA, 22 bp, Homo sapiens
ttttatgtcataaggacactca

SEQ ID NO: 8322278 - DNA, 18 bp, Homo sapiens
ttttaatttcaggggtgg

SEQ ID NO: 8322279 - DNA, 22 bp, Homo sapiens
ttttatgattgagctggctaca

SEQ ID NO: 8322280 - DNA, 22 bp, Homo sapiens
ttttaagaaatgtatgactgtc

SEQ ID NO: 8322281 - DNA, 22 bp, Homo sapiens
ttttaaatctccagttgacccc

SEQ ID NO: 8322282 - DNA, 22 bp, Homo sapiens
ttttaaatctccagttgacccc

SEQ ID NO: 8322283 - DNA, 22 bp, Homo sapiens
ttttaaactgcagaatttagaa

SEQ ID NO: 8322284 - DNA, 22 bp, Homo sapiens
ttttaaactgcagaatttagaa

SEQ ID NO: 8322285 - DNA, 22 bp, Homo sapiens
ttttaaaggatactcttgtcta

SEQ ID NO: 8322286 - DNA, 22 bp, Homo sapiens
tttgtaaatagcagtactcatg

SEQ ID NO: 8322287 - DNA, 22 bp, Homo sapiens
tttgtaaatagcagtactcatg

SEQ ID NO: 8322288 - DNA, 22 bp, Homo sapiens
tttgtaaagtctgttctgagtt

SEQ ID NO: 8322289 - DNA, 22 bp, Homo sapiens
tttgtaaaaggaggaagcatgg

SEQ ID NO: 8322290 - DNA, 22 bp, Homo sapiens
tttgtaaaaggaggaagcatgg

SEQ ID NO: 8322291 - DNA, 22 bp, Homo sapiens
tttgtgtggatggaaggcagta

SEQ ID NO: 8322292 - DNA, 22 bp, Homo sapiens
tttgtgtggcgttggccggcgg

SEQ ID NO: 8322293 - DNA, 22 bp, Homo sapiens
tttgtgttttagctggtgaggc

SEQ ID NO: 8322294 - DNA, 22 bp, Homo sapiens
tttgttataacaataaaaagtc

SEQ ID NO: 8322295 - DNA, 22 bp, Homo sapiens
ttgggagatattgttctttaca

SEQ ID NO: 8322296 - DNA, 22 bp, Homo sapiens
ttgggcaggtgtggctctcctt

SEQ ID NO: 8322297 - DNA, 22 bp, Homo sapiens
ttggcccactctcagaatgtgg

SEQ ID NO: 8322298 - DNA, 22 bp, Homo sapiens
ttggcccacagtaccatgctgt

SEQ ID NO: 8322299 - DNA, 22 bp, Homo sapiens
ttggccatctaagcccagccac

SEQ ID NO: 8322300 - DNA, 22 bp, Homo sapiens
ttggagaatgttttcctgcagt

SEQ ID NO: 8322301 - DNA, 21 bp, Homo sapiens
ttggagaagtgctatcagtat

SEQ ID NO: 8322302 - DNA, 22 bp, Homo sapiens
ttgtaagaatatgaatacaaat

SEQ ID NO: 8322303 - DNA, 22 bp, Homo sapiens
ttgtacacaattcttaacatac

SEQ ID NO: 8322304 - DNA, 21 bp, Homo sapiens
ttgtacacccacagatcagcc

SEQ ID NO: 8322305 - DNA, 22 bp, Homo sapiens
ttgtaagatggataggaacagc

SEQ ID NO: 8322306 - DNA, 22 bp, Homo sapiens
ttgtaccagctcatttcagaac

SEQ ID NO: 8322307 - DNA, 22 bp, Homo sapiens
ttgtcccttcagtaagagtgga

SEQ ID NO: 8322308 - DNA, 22 bp, Homo sapiens
ttgtcacacccttttttatacc

SEQ ID NO: 8322309 - DNA, 22 bp, Homo sapiens
ttgtgtctatggtttgagcatc

SEQ ID NO: 8322310 - DNA, 22 bp, Homo sapiens
ttgacaagtaatacttaaatta

SEQ ID NO: 8322311 - DNA, 22 bp, Homo sapiens
ttgacaaagtttagtaataatc

SEQ ID NO: 8322312 - DNA, 22 bp, Homo sapiens
ttgacacagatcaatattcaac

SEQ ID NO: 8322313 - DNA, 22 bp, Homo sapiens
ttgacaaaaacctcatttcacc

SEQ ID NO: 8322314 - DNA, 22 bp, Homo sapiens
ttgacaaaaacctcatttcacc

SEQ ID NO: 8322315 - DNA, 22 bp, Homo sapiens
ttgcagggctggaacatggaat

SEQ ID NO: 8322316 - DNA, 23 bp, Homo sapiens
ttgcatgtagcccatgagtaact

SEQ ID NO: 8322317 - DNA, 22 bp, Homo sapiens
ttgctctgtcagggcctcagtc

SEQ ID NO: 8322318 - DNA, 22 bp, Homo sapiens
ttgcatttactgcaccgtgagt

SEQ ID NO: 8322319 - DNA, 22 bp, Homo sapiens
ttgcattgtaggatgttagaag

SEQ ID NO: 8322320 - DNA, 22 bp, Homo sapiens
ttgcattgtgattacagaggtg

SEQ ID NO: 8322321 - DNA, 19 bp, Homo sapiens
ttgcattgtagttggactg

SEQ ID NO: 8322322 - DNA, 22 bp, Homo sapiens
ttgcattctggtgaggttgcct

SEQ ID NO: 8322323 - DNA, 22 bp, Homo sapiens
ttgcattgatgtctatacgctg

SEQ ID NO: 8322324 - DNA, 22 bp, Homo sapiens
ttgcatgtgtataaaagttgga

SEQ ID NO: 8322325 - DNA, 22 bp, Homo sapiens
ttgcattacatttgctcagtct

SEQ ID NO: 8322326 - DNA, 22 bp, Homo sapiens
ttgcattatttaatgagactct

SEQ ID NO: 8322327 - DNA, 22 bp, Homo sapiens
ttgctgttgatgatgtgataca

SEQ ID NO: 8322328 - DNA, 20 bp, Homo sapiens
ttgctgttgccaagattttg

SEQ ID NO: 8322329 - DNA, 22 bp, Homo sapiens
ttgctgaagttgctcagctcca

SEQ ID NO: 8322330 - DNA, 22 bp, Homo sapiens
ttgctgaaagtggcaagaagta

SEQ ID NO: 8322331 - DNA, 22 bp, Homo sapiens
ttggacagcacagacatagaat

SEQ ID NO: 8322332 - DNA, 22 bp, Homo sapiens
ttggacagtactttaaagcaga

SEQ ID NO: 8322333 - DNA, 22 bp, Homo sapiens
ttggaaattgcaagtgatttgc

SEQ ID NO: 8322334 - DNA, 22 bp, Homo sapiens
ttggaaagtgacgttcaactgt

SEQ ID NO: 8322335 - DNA, 22 bp, Homo sapiens
ttgcttcagaagttctgcttgt

SEQ ID NO: 8322336 - DNA, 22 bp, Homo sapiens
tttcacattttatacttaagcc

SEQ ID NO: 8322337 - DNA, 22 bp, Homo sapiens
tttcacagcttccacttaagga

SEQ ID NO: 8322338 - DNA, 22 bp, Homo sapiens
tttcatgattaacttagtgaat

SEQ ID NO: 8322339 - DNA, 22 bp, Homo sapiens
tttcatcttgattctatatggc

SEQ ID NO: 8322340 - DNA, 22 bp, Homo sapiens
tttcattattcatgctagttat

SEQ ID NO: 8322341 - DNA, 22 bp, Homo sapiens
tttcattgagactatagacatc

SEQ ID NO: 8322342 - DNA, 22 bp, Homo sapiens
tttcattgagactatagacatc

SEQ ID NO: 8322343 - DNA, 22 bp, Homo sapiens
tttcattgatgggtgatagaaa

SEQ ID NO: 8322344 - DNA, 19 bp, Homo sapiens
tttcccagtcccaggagtg

SEQ ID NO: 8322345 - DNA, 22 bp, Homo sapiens
tttcccatggcagaagccctgt

SEQ ID NO: 8322346 - DNA, 22 bp, Homo sapiens
tttcccaggccctcagggctgc

SEQ ID NO: 8322347 - DNA, 22 bp, Homo sapiens
tttcacactgcagcatcagaga

SEQ ID NO: 8322348 - DNA, 22 bp, Homo sapiens
tttcacactagtcagaatacca

SEQ ID NO: 8322349 - DNA, 22 bp, Homo sapiens
tttcacacaacgtgaatatact

SEQ ID NO: 8322350 - DNA, 22 bp, Homo sapiens
tttcacagagaaatataacagg

SEQ ID NO: 8322351 - DNA, 22 bp, Homo sapiens
tttcacagaaaggataacatta

SEQ ID NO: 8322352 - DNA, 22 bp, Homo sapiens
tttcaagacgttaagtcagctt

SEQ ID NO: 8322353 - DNA, 22 bp, Homo sapiens
tttcaacttgtttgcttccata

SEQ ID NO: 8322354 - DNA, 22 bp, Homo sapiens
tttcaagaagcaaattaaagtc

SEQ ID NO: 8322355 - DNA, 22 bp, Homo sapiens
tttattgcatacacaaatgtca

SEQ ID NO: 8322356 - DNA, 22 bp, Homo sapiens
tttattgagtatctactatgtg

SEQ ID NO: 8322357 - DNA, 22 bp, Homo sapiens
tttattgacccaaagcgagagt

SEQ ID NO: 8322358 - DNA, 22 bp, Homo sapiens
tttattgaattgtaaccctatt

SEQ ID NO: 8322359 - DNA, 22 bp, Homo sapiens
tttattgacttcagtgagtctt

SEQ ID NO: 8322360 - DNA, 22 bp, Homo sapiens
tttattgacttcagtgagtctt

SEQ ID NO: 8322361 - DNA, 22 bp, Homo sapiens
tttaaactaacagtacacgttg

SEQ ID NO: 8322362 - DNA, 22 bp, Homo sapiens
tttaaataggactcctgggggt

SEQ ID NO: 8322363 - DNA, 22 bp, Homo sapiens
tttaaatgcagacgttgattca

SEQ ID NO: 8322364 - DNA, 22 bp, Homo sapiens
tttaaatgctttaagcaagggt

SEQ ID NO: 8322365 - DNA, 22 bp, Homo sapiens
tttaaataggactcctgggggt

SEQ ID NO: 8322366 - DNA, 22 bp, Homo sapiens
tttaaatgtgttcttagtagct

SEQ ID NO: 8322367 - DNA, 22 bp, Homo sapiens
tttaaatggcattttcccagat

SEQ ID NO: 8322368 - DNA, 22 bp, Homo sapiens
tttaaatgttcatgatactgaa

SEQ ID NO: 8322369 - DNA, 22 bp, Homo sapiens
tttaaatgtttaaaactcgtga

SEQ ID NO: 8322370 - DNA, 22 bp, Homo sapiens
tttaaatgtttatagagagtac

SEQ ID NO: 8322371 - DNA, 22 bp, Homo sapiens
tttaaatgtttatagagagtac

SEQ ID NO: 8322372 - DNA, 22 bp, Homo sapiens
tttaagattcagtaaggcaaac

SEQ ID NO: 8322373 - DNA, 23 bp, Homo sapiens
tttaatgaccaatagaaggaaca

SEQ ID NO: 8322374 - DNA, 22 bp, Homo sapiens
tttaatgaataattcaaatctg

SEQ ID NO: 8322375 - DNA, 22 bp, Homo sapiens
tttaaggatgtaaaggaagaag

SEQ ID NO: 8322376 - DNA, 22 bp, Homo sapiens
tttaatgtgagtccctttcaag

SEQ ID NO: 8322377 - DNA, 22 bp, Homo sapiens
tttacagcttctatactatgtg

SEQ ID NO: 8322378 - DNA, 22 bp, Homo sapiens
tttaatgatagtcttacgaaaa

SEQ ID NO: 8322379 - DNA, 22 bp, Homo sapiens
tttaatgatagctgtttcacat

SEQ ID NO: 8322380 - DNA, 22 bp, Homo sapiens
tttaatgaggtctctcgctggc

SEQ ID NO: 8322381 - DNA, 22 bp, Homo sapiens
tttaatgatagctgtttcacat

SEQ ID NO: 8322382 - DNA, 22 bp, Homo sapiens
tttaatgatagctgtttcacat

SEQ ID NO: 8322383 - DNA, 23 bp, Homo sapiens
tttaatgaccaatagaaggaaca

SEQ ID NO: 8322384 - DNA, 22 bp, Homo sapiens
tttacagtctatgttgaattaa

SEQ ID NO: 8322385 - DNA, 22 bp, Homo sapiens
tttacagtctctatagtcaaaa

SEQ ID NO: 8322386 - DNA, 22 bp, Homo sapiens
tttacagtctgtctagcaatgt

SEQ ID NO: 8322387 - DNA, 22 bp, Homo sapiens
tttaccacaattttaaacaatg

SEQ ID NO: 8322388 - DNA, 22 bp, Homo sapiens
tttaccacagaaaaaagtaact

SEQ ID NO: 8322389 - DNA, 20 bp, Homo sapiens
tttacattttgaaacagtga

SEQ ID NO: 8322390 - DNA, 20 bp, Homo sapiens
tttacattttgaaacagtga

SEQ ID NO: 8322391 - DNA, 22 bp, Homo sapiens
tttacagtgagagcttagtgag

SEQ ID NO: 8322392 - DNA, 22 bp, Homo sapiens
tttagattgtgacctcccccca

SEQ ID NO: 8322393 - DNA, 22 bp, Homo sapiens
tttagcaaggagaaataatcct

SEQ ID NO: 8322394 - DNA, 22 bp, Homo sapiens
tttagagagcactgtagacact

SEQ ID NO: 8322395 - DNA, 22 bp, Homo sapiens
tttatcaaacaaattatccagc

SEQ ID NO: 8322396 - DNA, 22 bp, Homo sapiens
tttatcagtagcaaagttttaa

SEQ ID NO: 8322397 - DNA, 22 bp, Homo sapiens
tttatctgaggaaagcagacaa

SEQ ID NO: 8322398 - DNA, 22 bp, Homo sapiens
tttatctattgtattgttgatg

SEQ ID NO: 8322399 - DNA, 22 bp, Homo sapiens
tttatatagagatttgtgcatg

SEQ ID NO: 8322400 - DNA, 22 bp, Homo sapiens
tttagcagaaactcattaaatt

SEQ ID NO: 8322401 - DNA, 22 bp, Homo sapiens
tttatatatggctggtctggat

SEQ ID NO: 8322402 - DNA, 22 bp, Homo sapiens
tttatattgggagtcgttttga

SEQ ID NO: 8322403 - DNA, 22 bp, Homo sapiens
tttatattgtaaaaatggttct

SEQ ID NO: 8322404 - DNA, 22 bp, Homo sapiens
tttatatttcccaggattggcc

SEQ ID NO: 8322405 - DNA, 22 bp, Homo sapiens
ttgaaatgcatcatcatttaga

SEQ ID NO: 8322406 - DNA, 22 bp, Homo sapiens
ttgaaatggcagcagctgacct

SEQ ID NO: 8322407 - DNA, 22 bp, Homo sapiens
ttgaaatggaagtgaaaattct

SEQ ID NO: 8322408 - DNA, 22 bp, Homo sapiens
ttgaaatgatctatttcagtag

SEQ ID NO: 8322409 - DNA, 22 bp, Homo sapiens
ttgaaatgagactaattgattg

SEQ ID NO: 8322410 - DNA, 22 bp, Homo sapiens
ttgaaatgagcaaactgtcagc

SEQ ID NO: 8322411 - DNA, 22 bp, Homo sapiens
ttgaaatgagcaaactgtcagc

SEQ ID NO: 8322412 - DNA, 20 bp, Homo sapiens
ttcttttgataagcttgaca

SEQ ID NO: 8322413 - DNA, 22 bp, Homo sapiens
ttgaacattaacttcagtctat

SEQ ID NO: 8322414 - DNA, 22 bp, Homo sapiens
ttgaaatgtagtcctgccttca

SEQ ID NO: 8322415 - DNA, 22 bp, Homo sapiens
ttcttcaaagtaatagagacta

SEQ ID NO: 8322416 - DNA, 22 bp, Homo sapiens
ttcttcagactactgatgattg

SEQ ID NO: 8322417 - DNA, 22 bp, Homo sapiens
ttcttcaaccatctacataaac

SEQ ID NO: 8322418 - DNA, 22 bp, Homo sapiens
ttcttcaaccatctacataaac

SEQ ID NO: 8322419 - DNA, 22 bp, Homo sapiens
ttcttcaaatgctgaaagtcta

SEQ ID NO: 8322420 - DNA, 22 bp, Homo sapiens
ttctttgtggcagtgagctggg

SEQ ID NO: 8322421 - DNA, 19 bp, Homo sapiens
ttctttggtggtggtgacc

SEQ ID NO: 8322422 - DNA, 22 bp, Homo sapiens
ttctttggtgttacccagctca

SEQ ID NO: 8322423 - DNA, 22 bp, Homo sapiens
ttctttgttgtactttcctaca

SEQ ID NO: 8322424 - DNA, 22 bp, Homo sapiens
ttcttttaatgtctggctttca

SEQ ID NO: 8322425 - DNA, 22 bp, Homo sapiens
ttcttagaagaaacatctaaaa

SEQ ID NO: 8322426 - DNA, 22 bp, Homo sapiens
ttcttatagaagcaaccattgt

SEQ ID NO: 8322427 - DNA, 22 bp, Homo sapiens
ttctggagccccaagatctgta

SEQ ID NO: 8322428 - DNA, 22 bp, Homo sapiens
ttctggagctaaagtccactct

SEQ ID NO: 8322429 - DNA, 22 bp, Homo sapiens
ttctggagaggaacagaaaggt

SEQ ID NO: 8322430 - DNA, 22 bp, Homo sapiens
ttctggagattgagaaggcatt

SEQ ID NO: 8322431 - DNA, 22 bp, Homo sapiens
ttctggagattgagaaggcatt

SEQ ID NO: 8322432 - DNA, 22 bp, Homo sapiens
ttctggagacccagcaacaggg

SEQ ID NO: 8322433 - DNA, 23 bp, Homo sapiens
ttctggagaaaggaccatagctt

SEQ ID NO: 8322434 - DNA, 22 bp, Homo sapiens
ttctggaattcttgcagccact

SEQ ID NO: 8322435 - DNA, 22 bp, Homo sapiens
ttctggaatactaagttccttt

SEQ ID NO: 8322436 - DNA, 22 bp, Homo sapiens
ttctggaagtggaatttttgta

SEQ ID NO: 8322437 - DNA, 22 bp, Homo sapiens
ttcctggggcttagcaatggag

SEQ ID NO: 8322438 - DNA, 22 bp, Homo sapiens
ttcctgggttgtgcattgtaca

SEQ ID NO: 8322439 - DNA, 22 bp, Homo sapiens
ttcctgggtttacgtattgggt

SEQ ID NO: 8322440 - DNA, 22 bp, Homo sapiens
ttcctgcccctgagagctccca

SEQ ID NO: 8322441 - DNA, 21 bp, Homo sapiens
ttcctggggacttccgtggga

SEQ ID NO: 8322442 - DNA, 22 bp, Homo sapiens
ttcctgcagcaaggagaagctg

SEQ ID NO: 8322443 - DNA, 22 bp, Homo sapiens
ttcctgagaaatttgtacctgg

SEQ ID NO: 8322444 - DNA, 22 bp, Homo sapiens
ttctctcagttaaactttgtga

SEQ ID NO: 8322445 - DNA, 22 bp, Homo sapiens
ttctctatcttgaatgcgtcaa

SEQ ID NO: 8322446 - DNA, 22 bp, Homo sapiens
ttctctaatacattttgacaaa

SEQ ID NO: 8322447 - DNA, 22 bp, Homo sapiens
ttctctcttttgggtaggaggt

SEQ ID NO: 8322448 - DNA, 21 bp, Homo sapiens
ttcatttgttatagacaaagt

SEQ ID NO: 8322449 - DNA, 22 bp, Homo sapiens
ttcatttgtgtgcctgatgcaa

SEQ ID NO: 8322450 - DNA, 22 bp, Homo sapiens
ttcatttgttgacagagacatg

SEQ ID NO: 8322451 - DNA, 20 bp, Homo sapiens
ttcatttgttgagcaccttc

SEQ ID NO: 8322452 - DNA, 22 bp, Homo sapiens
ttcatttttaccgcgtgtcaaa

SEQ ID NO: 8322453 - DNA, 22 bp, Homo sapiens
ttcatttgggatgagtcagaag

SEQ ID NO: 8322454 - DNA, 19 bp, Homo sapiens
ttcatttgtatctgctcac

SEQ ID NO: 8322455 - DNA, 22 bp, Homo sapiens
ttcatttgtaactctgttaggg

SEQ ID NO: 8322456 - DNA, 20 bp, Homo sapiens
ttcatttgggaaaatctgcg

SEQ ID NO: 8322457 - DNA, 22 bp, Homo sapiens
ttcatttggcctctgcttaaaa

SEQ ID NO: 8322458 - DNA, 22 bp, Homo sapiens
ttcatttggatgcgtgtttaag

SEQ ID NO: 8322459 - DNA, 22 bp, Homo sapiens
ttcatttgtccaaatactatgt

SEQ ID NO: 8322460 - DNA, 23 bp, Homo sapiens
ttcatttgtctacttcacttgtt

SEQ ID NO: 8322461 - DNA, 22 bp, Homo sapiens
ttcatttgtggttatttacaat

SEQ ID NO: 8322462 - DNA, 22 bp, Homo sapiens
ttcatttgtggtgaatgaagtg

SEQ ID NO: 8322463 - DNA, 22 bp, Homo sapiens
ttcatttgtctgctatagatcc

SEQ ID NO: 8322464 - DNA, 22 bp, Homo sapiens
ttcagttttctttagaatgtag

SEQ ID NO: 8322465 - DNA, 22 bp, Homo sapiens
ttcagttttccctcctgcaggt

SEQ ID NO: 8322466 - DNA, 22 bp, Homo sapiens
ttcagttttctttagaatgtag

SEQ ID NO: 8322467 - DNA, 22 bp, Homo sapiens
ttcatttattcagcaggtattt

SEQ ID NO: 8322468 - DNA, 22 bp, Homo sapiens
ttcatttgccatcagtgtaatg

SEQ ID NO: 8322469 - DNA, 22 bp, Homo sapiens
ttcatttgcactggattactgg

SEQ ID NO: 8322470 - DNA, 22 bp, Homo sapiens
ttcatttgagtttatagttgct

SEQ ID NO: 8322471 - DNA, 22 bp, Homo sapiens
ttcatttgatggtgggagagaa

SEQ ID NO: 8322472 - DNA, 23 bp, Homo sapiens
ttcatttaggagttcataagagc

SEQ ID NO: 8322473 - DNA, 22 bp, Homo sapiens
ttcatttaatcagaatctctaa

SEQ ID NO: 8322474 - DNA, 22 bp, Homo sapiens
ttattataatgagggataaaaa

SEQ ID NO: 8322475 - DNA, 22 bp, Homo sapiens
ttattacaatgcagaaaataga

SEQ ID NO: 8322476 - DNA, 22 bp, Homo sapiens
ttattacactgaaagaattgcg

SEQ ID NO: 8322477 - DNA, 22 bp, Homo sapiens
ttattaatgagtacaagttatt

SEQ ID NO: 8322478 - DNA, 22 bp, Homo sapiens
ttattaataaagtggcatagcc

SEQ ID NO: 8322479 - DNA, 22 bp, Homo sapiens
ttattaatacatgcacctgcat

SEQ ID NO: 8322480 - DNA, 22 bp, Homo sapiens
ttattaatcttatctttggaaa

SEQ ID NO: 8322481 - DNA, 22 bp, Homo sapiens
ttatatatatgtagaggtcacg

SEQ ID NO: 8322482 - DNA, 22 bp, Homo sapiens
ttatatatatgtagaggtcacg

SEQ ID NO: 8322483 - DNA, 22 bp, Homo sapiens
ttcaaacactggcttagccaat

SEQ ID NO: 8322484 - DNA, 22 bp, Homo sapiens
ttcaaacattcaaataaaccgg

SEQ ID NO: 8322485 - DNA, 22 bp, Homo sapiens
ttattgaagcaagcttttctga

SEQ ID NO: 8322486 - DNA, 22 bp, Homo sapiens
ttattgagaccgtaagtcaggt

SEQ ID NO: 8322487 - DNA, 22 bp, Homo sapiens
ttattgagcacatagtatgtgg

SEQ ID NO: 8322488 - DNA, 22 bp, Homo sapiens
ttattgagcacctactatgtgt

SEQ ID NO: 8322489 - DNA, 22 bp, Homo sapiens
ttagctcagaaaatttaaactt

SEQ ID NO: 8322490 - DNA, 22 bp, Homo sapiens
ttagctaaactgtaactagaat

SEQ ID NO: 8322491 - DNA, 22 bp, Homo sapiens
ttagccaaacaggtgaaattga

SEQ ID NO: 8322492 - DNA, 22 bp, Homo sapiens
ttatacatgtgttttgagatga

SEQ ID NO: 8322493 - DNA, 22 bp, Homo sapiens
ttatactaaaacgcattgaatt

SEQ ID NO: 8322494 - DNA, 21 bp, Homo sapiens
ttagctttctagaatctttgt

SEQ ID NO: 8322495 - DNA, 22 bp, Homo sapiens
ttataggtccactgcaatttgc

SEQ ID NO: 8322496 - DNA, 22 bp, Homo sapiens
gtgcctggtatgtaggtagcgg

SEQ ID NO: 8322497 - DNA, 22 bp, Homo sapiens
gtgcctggtttggggagtgttc

SEQ ID NO: 8322498 - DNA, 22 bp, Homo sapiens
gtgctgagctgcagatgcgctc

SEQ ID NO: 8322499 - DNA, 22 bp, Homo sapiens
gtgctgagcacaaggcccagag

SEQ ID NO: 8322500 - DNA, 22 bp, Homo sapiens
gtgcattaggctggaatgttga

SEQ ID NO: 8322501 - DNA, 22 bp, Homo sapiens
gtgcattattcttacctttctt

SEQ ID NO: 8322502 - DNA, 22 bp, Homo sapiens
gtgcattaacaacccagaactc

SEQ ID NO: 8322503 - DNA, 22 bp, Homo sapiens
gtgcatgttaatggtgtacaaa

SEQ ID NO: 8322504 - DNA, 22 bp, Homo sapiens
gtgcattacatgtaataaaata

SEQ ID NO: 8322505 - DNA, 22 bp, Homo sapiens
gtgcattagtttcctattgctg

SEQ ID NO: 8322506 - DNA, 22 bp, Homo sapiens
gtgcaggagctcccgcagtggt

SEQ ID NO: 8322507 - DNA, 22 bp, Homo sapiens
gtgcctgggggtaatgtaggat

SEQ ID NO: 8322508 - DNA, 22 bp, Homo sapiens
gtgccctgacacacctggtgtg

SEQ ID NO: 8322509 - DNA, 22 bp, Homo sapiens
cagccctttccttctcagcttt

SEQ ID NO: 8322510 - DNA, 22 bp, Homo sapiens
cagctctgaggaacactccttt

SEQ ID NO: 8322511 - DNA, 22 bp, Homo sapiens
cagctcccctctgtggggcagt

SEQ ID NO: 8322512 - DNA, 22 bp, Homo sapiens
cagctcctagatcggcgaagtg

SEQ ID NO: 8322513 - DNA, 22 bp, Homo sapiens
cagcagtccctgcagtggggaa

SEQ ID NO: 8322514 - DNA, 22 bp, Homo sapiens
gtctcaagggggaactcactgt

SEQ ID NO: 8322515 - DNA, 22 bp, Homo sapiens
gtctcaaactcctaggctaaag

SEQ ID NO: 8322516 - DNA, 22 bp, Homo sapiens
gtgaggtaaactgtagttcaga

SEQ ID NO: 8322517 - DNA, 22 bp, Homo sapiens
gtgaagttgattgttatcgtca

SEQ ID NO: 8322518 - DNA, 22 bp, Homo sapiens
gtgaagttttagtatatgtaga

SEQ ID NO: 8322519 - DNA, 22 bp, Homo sapiens
gtgcaaaagtcattgtggtttt

SEQ ID NO: 8322520 - DNA, 22 bp, Homo sapiens
gtgcaaaagtaattgtggtttt

SEQ ID NO: 8322521 - DNA, 22 bp, Homo sapiens
gtgcaaaagtaattgcggtttt

SEQ ID NO: 8322522 - DNA, 22 bp, Homo sapiens
gtgcaaaagtaattgctgtttt

SEQ ID NO: 8322523 - DNA, 22 bp, Homo sapiens
gtgcaaaagtaattgcagtttt

SEQ ID NO: 8322524 - DNA, 22 bp, Homo sapiens
gtgaggtagcagagacagtgaa

SEQ ID NO: 8322525 - DNA, 22 bp, Homo sapiens
gtgaggtaaagcacagaaatag

SEQ ID NO: 8322526 - DNA, 22 bp, Homo sapiens
gtgaggtacaattttataccct

SEQ ID NO: 8322527 - DNA, 23 bp, Homo sapiens
gtgaggtatattgaaatcatgct

SEQ ID NO: 8322528 - DNA, 21 bp, Homo sapiens
gtgaggtattaggacctacat

SEQ ID NO: 8322529 - DNA, 22 bp, Homo sapiens
gtgcaaaagtaattgaggtttt

SEQ ID NO: 8322530 - DNA, 22 bp, Homo sapiens
gtgcaaaagtaattacagtttt

SEQ ID NO: 8322531 - DNA, 22 bp, Homo sapiens
gtctcagtaagaaaggctcctg

SEQ ID NO: 8322532 - DNA, 22 bp, Homo sapiens
gtctcagttttccaaactgtca

SEQ ID NO: 8322533 - DNA, 22 bp, Homo sapiens
gtctctgtcacaactactcatc

SEQ ID NO: 8322534 - DNA, 22 bp, Homo sapiens
gtctctgtcatttcaccttccc

SEQ ID NO: 8322535 - DNA, 22 bp, Homo sapiens
gtctctgtcttaggccaggcct

SEQ ID NO: 8322536 - DNA, 22 bp, Homo sapiens
gtctctgtcttaggccaggcct

SEQ ID NO: 8322537 - DNA, 22 bp, Homo sapiens
gtctctgtgcccccatttccgt

SEQ ID NO: 8322538 - DNA, 17 bp, Homo sapiens
gtctctgtcttgctttt

SEQ ID NO: 8322539 - DNA, 22 bp, Homo sapiens
gtctctgtggctggctccttcc

SEQ ID NO: 8322540 - DNA, 22 bp, Homo sapiens
gtctctgtggtacgtttcatcc

SEQ ID NO: 8322541 - DNA, 22 bp, Homo sapiens
gtctctgtgtctgagagagccc

SEQ ID NO: 8322542 - DNA, 22 bp, Homo sapiens
gtctcttagaatcgcatattgt

SEQ ID NO: 8322543 - DNA, 19 bp, Homo sapiens
gtcttacaggcaacatgag

SEQ ID NO: 8322544 - DNA, 22 bp, Homo sapiens
gtctttggatgtaagataaagt

SEQ ID NO: 8322545 - DNA, 18 bp, Homo sapiens
gtctttggagtggaggta

SEQ ID NO: 8322546 - DNA, 22 bp, Homo sapiens
gtctttggaaagacaaagttca

SEQ ID NO: 8322547 - DNA, 22 bp, Homo sapiens
gtctttggagaggtgccatttc

SEQ ID NO: 8322548 - DNA, 22 bp, Homo sapiens
gtctttggagaggtgccatttc

SEQ ID NO: 8322549 - DNA, 22 bp, Homo sapiens
gtctttggaggcactgttgagt

SEQ ID NO: 8322550 - DNA, 22 bp, Homo sapiens
cagcagaagtccgactccagtc

SEQ ID NO: 8322551 - DNA, 20 bp, Homo sapiens
cagcagagacccatggggag

SEQ ID NO: 8322552 - DNA, 22 bp, Homo sapiens
gtaacattttgagcagtaggct

SEQ ID NO: 8322553 - DNA, 22 bp, Homo sapiens
ggtgctggttcagggtggctgt

SEQ ID NO: 8322554 - DNA, 22 bp, Homo sapiens
ggtggcaggctggcattggcaa

SEQ ID NO: 8322555 - DNA, 22 bp, Homo sapiens
ggtggcagtagcactgggcctg

SEQ ID NO: 8322556 - DNA, 22 bp, Homo sapiens
ggtggcagtgcttgcgggtcta

SEQ ID NO: 8322557 - DNA, 22 bp, Homo sapiens
cagcactgctgctgtacacaca

SEQ ID NO: 8322558 - DNA, 22 bp, Homo sapiens
ggtgggacaggtaggagtggct

SEQ ID NO: 8322559 - DNA, 22 bp, Homo sapiens
ggtgggaaggccactgaaggtt

SEQ ID NO: 8322560 - DNA, 22 bp, Homo sapiens
ggtgcagcctccccagtgacag

SEQ ID NO: 8322561 - DNA, 22 bp, Homo sapiens
ggtgcagaggagccagctgggg

SEQ ID NO: 8322562 - DNA, 22 bp, Homo sapiens
ggtgcagaaggaagggagctgg

SEQ ID NO: 8322563 - DNA, 22 bp, Homo sapiens
cagataaaggcttactagtagt

SEQ ID NO: 8322564 - DNA, 22 bp, Homo sapiens
cagataaatagacttggtcaga

SEQ ID NO: 8322565 - DNA, 22 bp, Homo sapiens
ggtgagaggcagaggacagctt

SEQ ID NO: 8322566 - DNA, 22 bp, Homo sapiens
ggggtagggtgattgtgaagta

SEQ ID NO: 8322567 - DNA, 22 bp, Homo sapiens
cagaggctgccagccatgtgca

SEQ ID NO: 8322568 - DNA, 22 bp, Homo sapiens
cagaggcctttctacagtgata

SEQ ID NO: 8322569 - DNA, 22 bp, Homo sapiens
cagaggcaggataagaactgcg

SEQ ID NO: 8322570 - DNA, 22 bp, Homo sapiens
cagagtttaaacaaatgaaata

SEQ ID NO: 8322571 - DNA, 22 bp, Homo sapiens
ggggtcggggcatagccactta

SEQ ID NO: 8322572 - DNA, 22 bp, Homo sapiens
ggggtgagatcaaggaagccct

SEQ ID NO: 8322573 - DNA, 22 bp, Homo sapiens
ggggtgagatcaaggaagccct

SEQ ID NO: 8322574 - DNA, 22 bp, Homo sapiens
cagagcagcctccagggggagc

SEQ ID NO: 8322575 - DNA, 18 bp, Homo sapiens
gggccctggcgtccgccc

SEQ ID NO: 8322576 - DNA, 22 bp, Homo sapiens
gggccctggacgtggcggcaga

SEQ ID NO: 8322577 - DNA, 22 bp, Homo sapiens
cagaagcaagtagtgattcttt

SEQ ID NO: 8322578 - DNA, 22 bp, Homo sapiens
cagaagcagaacactagattta

SEQ ID NO: 8322579 - DNA, 22 bp, Homo sapiens
cagagagaatcttggcagctga

SEQ ID NO: 8322580 - DNA, 22 bp, Homo sapiens
cagagagaatcttggcagctga

SEQ ID NO: 8322581 - DNA, 22 bp, Homo sapiens
gggggcagtaacctcaaagtgt

SEQ ID NO: 8322582 - DNA, 22 bp, Homo sapiens
gggggcagtaaggatatggaaa

SEQ ID NO: 8322583 - DNA, 22 bp, Homo sapiens
gggggcagaatgtactcttgtc

SEQ ID NO: 8322584 - DNA, 22 bp, Homo sapiens
gggggcaggtctggaactttga

SEQ ID NO: 8322585 - DNA, 22 bp, Homo sapiens
ggggcggggctctgagaagcat

SEQ ID NO: 8322586 - DNA, 22 bp, Homo sapiens
gggggaggtgaatgcaataagg

SEQ ID NO: 8322587 - DNA, 22 bp, Homo sapiens
gggggaggtgaatgcaataagg

SEQ ID NO: 8322588 - DNA, 22 bp, Homo sapiens
gggggaggtgaatgcaataagg

SEQ ID NO: 8322589 - DNA, 22 bp, Homo sapiens
cagaggaagctgggtgtggagt

SEQ ID NO: 8322590 - DNA, 22 bp, Homo sapiens
cagaggaagcagacacatcttg

SEQ ID NO: 8322591 - DNA, 22 bp, Homo sapiens
cagagctgtcatttgccagtga

SEQ ID NO: 8322592 - DNA, 22 bp, Homo sapiens
ggagggagtttcattcctgccc

SEQ ID NO: 8322593 - DNA, 22 bp, Homo sapiens
cacagctaggaggaaagcagag

SEQ ID NO: 8322594 - DNA, 22 bp, Homo sapiens
cacaggagaaaggggaagctcg

SEQ ID NO: 8322595 - DNA, 18 bp, Homo sapiens
cacaggagatgacctgac

SEQ ID NO: 8322596 - DNA, 18 bp, Homo sapiens
cacaggagatgacctgac

SEQ ID NO: 8322597 - DNA, 22 bp, Homo sapiens
ggaggggccggctgcctgccac

SEQ ID NO: 8322598 - DNA, 22 bp, Homo sapiens
ggaggggccggctgcctgccac

SEQ ID NO: 8322599 - DNA, 22 bp, Homo sapiens
ggaggggcatagttcaccatca

SEQ ID NO: 8322600 - DNA, 22 bp, Homo sapiens
ggagcagcttgcatgctcaggg

SEQ ID NO: 8322601 - DNA, 22 bp, Homo sapiens
cacagcagtctttcactaaata

SEQ ID NO: 8322602 - DNA, 22 bp, Homo sapiens
cacagagaactgtgggagtgtg

SEQ ID NO: 8322603 - DNA, 22 bp, Homo sapiens
cacagagaattcccatatgtga

SEQ ID NO: 8322604 - DNA, 22 bp, Homo sapiens
ggacagcgtggctggtggaggg

SEQ ID NO: 8322605 - DNA, 22 bp, Homo sapiens
ggacagagggttgacagagtat

SEQ ID NO: 8322606 - DNA, 22 bp, Homo sapiens
ggacaaatctcattatttctga

SEQ ID NO: 8322607 - DNA, 22 bp, Homo sapiens
ggaaggggtcacctcctgatga

SEQ ID NO: 8322608 - DNA, 22 bp, Homo sapiens
ggaagagagatcccatagatgt

SEQ ID NO: 8322609 - DNA, 22 bp, Homo sapiens
ggaacaggaaaggagggatgct

SEQ ID NO: 8322610 - DNA, 22 bp, Homo sapiens
ggaacagggatttggcctggtt

SEQ ID NO: 8322611 - DNA, 22 bp, Homo sapiens
ggaagagaaatgagtcaagact

SEQ ID NO: 8322612 - DNA, 22 bp, Homo sapiens
ggaagagaatgatggctatggg

SEQ ID NO: 8322613 - DNA, 22 bp, Homo sapiens
gctgaggtaggaggttgcagtg

SEQ ID NO: 8322614 - DNA, 19 bp, Homo sapiens
gctggcagatgtggccgtg

SEQ ID NO: 8322615 - DNA, 22 bp, Homo sapiens
gctggccagtgtggtgaccacc

SEQ ID NO: 8322616 - DNA, 16 bp, Homo sapiens
gctggagggaggggtt

SEQ ID NO: 8322617 - DNA, 16 bp, Homo sapiens
gctggagggaggggtt

SEQ ID NO: 8322618 - DNA, 22 bp, Homo sapiens
gctggcagagagctggtgagga

SEQ ID NO: 8322619 - DNA, 22 bp, Homo sapiens
gctggcagagctctgggctggg

SEQ ID NO: 8322620 - DNA, 22 bp, Homo sapiens
gctgggagcaaagccatgcata

SEQ ID NO: 8322621 - DNA, 21 bp, Homo sapiens
gctggctgtctcttacacggt

SEQ ID NO: 8322622 - DNA, 22 bp, Homo sapiens
gctggctgtgattttgccaaca

SEQ ID NO: 8322623 - DNA, 22 bp, Homo sapiens
gctggctgtgattttgccaaca

SEQ ID NO: 8322624 - DNA, 22 bp, Homo sapiens
gctgggagccccgagccagcgc

SEQ ID NO: 8322625 - DNA, 22 bp, Homo sapiens
gctggccatggggagtgaggag

SEQ ID NO: 8322626 - DNA, 22 bp, Homo sapiens
gctggccatggggagtgaggag

SEQ ID NO: 8322627 - DNA, 22 bp, Homo sapiens
gctggccatggcctgcgccatc

SEQ ID NO: 8322628 - DNA, 22 bp, Homo sapiens
gctggccatagaagccaaagag

SEQ ID NO: 8322629 - DNA, 22 bp, Homo sapiens
gctgggagccgtacctgtcacg

SEQ ID NO: 8322630 - DNA, 22 bp, Homo sapiens
gctgggaggaatttggggaata

SEQ ID NO: 8322631 - DNA, 22 bp, Homo sapiens
gctgggccagagcagcagcact

SEQ ID NO: 8322632 - DNA, 22 bp, Homo sapiens
gctgggccctgggtgccctagc

SEQ ID NO: 8322633 - DNA, 22 bp, Homo sapiens
gctgggccccatccctcgagca

SEQ ID NO: 8322634 - DNA, 22 bp, Homo sapiens
caatgtatcaaccagaaagttc

SEQ ID NO: 8322635 - DNA, 22 bp, Homo sapiens
ggaaatgtaatcacagagggtt

SEQ ID NO: 8322636 - DNA, 19 bp, Homo sapiens
ggaaatgtggaaacatcct

SEQ ID NO: 8322637 - DNA, 22 bp, Homo sapiens
caagtgtgtaattactgggagc

SEQ ID NO: 8322638 - DNA, 21 bp, Homo sapiens
caagtgtggatgtggaaggta

SEQ ID NO: 8322639 - DNA, 22 bp, Homo sapiens
caagttatttcattggaacaat

SEQ ID NO: 8322640 - DNA, 22 bp, Homo sapiens
caagttcacttgtctacaaggg

SEQ ID NO: 8322641 - DNA, 22 bp, Homo sapiens
gctggtctccgccgctccctga

SEQ ID NO: 8322642 - DNA, 22 bp, Homo sapiens
gctggtgcattagctgcagttc

SEQ ID NO: 8322643 - DNA, 20 bp, Homo sapiens
cactgaggtgcagctcatgc

SEQ ID NO: 8322644 - DNA, 19 bp, Homo sapiens
ggctcctggggctcagccc

SEQ ID NO: 8322645 - DNA, 22 bp, Homo sapiens
cactgaggctgggggagaaggt

SEQ ID NO: 8322646 - DNA, 22 bp, Homo sapiens
cactgagggcggagcccaggga

SEQ ID NO: 8322647 - DNA, 22 bp, Homo sapiens
cactgagggcggagcccaggga

SEQ ID NO: 8322648 - DNA, 22 bp, Homo sapiens
cactgagggggtggtttcagga

SEQ ID NO: 8322649 - DNA, 22 bp, Homo sapiens
cactgaggtatctgtctctcct

SEQ ID NO: 8322650 - DNA, 22 bp, Homo sapiens
cactgaggcttccttaggcaat

SEQ ID NO: 8322651 - DNA, 22 bp, Homo sapiens
cactgagggagggtttcttctg

SEQ ID NO: 8322652 - DNA, 22 bp, Homo sapiens
cactgagggagggtttcttctg

SEQ ID NO: 8322653 - DNA, 19 bp, Homo sapiens
ggctcctgtggctgcagcc

SEQ ID NO: 8322654 - DNA, 19 bp, Homo sapiens
ggctcctgtggctgcagcc

SEQ ID NO: 8322655 - DNA, 22 bp, Homo sapiens
cactgcccttacatgccctgca

SEQ ID NO: 8322656 - DNA, 22 bp, Homo sapiens
ggctgcagattgtagtctgtta

SEQ ID NO: 8322657 - DNA, 22 bp, Homo sapiens
ggctgcagccctcgcctagcca

SEQ ID NO: 8322658 - DNA, 22 bp, Homo sapiens
ggctgcagcggattggggattg

SEQ ID NO: 8322659 - DNA, 22 bp, Homo sapiens
ggctgcagatagccagccacca

SEQ ID NO: 8322660 - DNA, 19 bp, Homo sapiens
ggctgcctttccttaccag

SEQ ID NO: 8322661 - DNA, 22 bp, Homo sapiens
ggctgcctttagaacggatgct

SEQ ID NO: 8322662 - DNA, 23 bp, Homo sapiens
ggctgcgagtgcctgggcctgtg

SEQ ID NO: 8322663 - DNA, 22 bp, Homo sapiens
ggctgctcacgcagccctccct

SEQ ID NO: 8322664 - DNA, 22 bp, Homo sapiens
ggctgccttgaccctggctccg

SEQ ID NO: 8322665 - DNA, 22 bp, Homo sapiens
ggctgctggtaggggtaggaag

SEQ ID NO: 8322666 - DNA, 22 bp, Homo sapiens
ggctgctgggtcatgatgcaga

SEQ ID NO: 8322667 - DNA, 22 bp, Homo sapiens
ggctgctgtactgatgtcagtt

SEQ ID NO: 8322668 - DNA, 22 bp, Homo sapiens
cagaaatgtactgacatgcagt

SEQ ID NO: 8322669 - DNA, 22 bp, Homo sapiens
cagaacacattttcagagtcaa

SEQ ID NO: 8322670 - DNA, 22 bp, Homo sapiens
ggctggctttctctccgcacct

SEQ ID NO: 8322671 - DNA, 23 bp, Homo sapiens
ggctgggagctccgggtgcacgt

SEQ ID NO: 8322672 - DNA, 22 bp, Homo sapiens
ggctgggagccccacagagtca

SEQ ID NO: 8322673 - DNA, 22 bp, Homo sapiens
ggctgggagctggacaggccgg

SEQ ID NO: 8322674 - DNA, 22 bp, Homo sapiens
ggcccagcacagtgcttggggg

SEQ ID NO: 8322675 - DNA, 22 bp, Homo sapiens
ggcccagagctccctggcacct

SEQ ID NO: 8322676 - DNA, 22 bp, Homo sapiens
ggccccagcagaccctcctctg

SEQ ID NO: 8322677 - DNA, 22 bp, Homo sapiens
ggcccagcccgagtcagccttc

SEQ ID NO: 8322678 - DNA, 22 bp, Homo sapiens
ggcccagcatcttgtgaagttt

SEQ ID NO: 8322679 - DNA, 22 bp, Homo sapiens
ggcgccagcggtaagtaagaca

SEQ ID NO: 8322680 - DNA, 22 bp, Homo sapiens
ggcgccagcactgcagcgcctc

SEQ ID NO: 8322681 - DNA, 19 bp, Homo sapiens
cacattttgagtctgagat

SEQ ID NO: 8322682 - DNA, 22 bp, Homo sapiens
cacatttttactgccaacttaa

SEQ ID NO: 8322683 - DNA, 22 bp, Homo sapiens
caccacagcatccactagaagg

SEQ ID NO: 8322684 - DNA, 20 bp, Homo sapiens
caccacagaattggggacag

SEQ ID NO: 8322685 - DNA, 22 bp, Homo sapiens
ggccagcccagtggtcctctct

SEQ ID NO: 8322686 - DNA, 22 bp, Homo sapiens
ggccagcctggggctcccagac

SEQ ID NO: 8322687 - DNA, 22 bp, Homo sapiens
ggccagcctggggctcccagac

SEQ ID NO: 8322688 - DNA, 22 bp, Homo sapiens
ggccagcggcacagcctggccc

SEQ ID NO: 8322689 - DNA, 22 bp, Homo sapiens
ggaggtggaggttgcagtgagc

SEQ ID NO: 8322690 - DNA, 22 bp, Homo sapiens
ggaggtggaggttgcagtgagc

SEQ ID NO: 8322691 - DNA, 22 bp, Homo sapiens
ggagtctgggaattggagagaa

SEQ ID NO: 8322692 - DNA, 22 bp, Homo sapiens
ggatagttctggatattttaag

SEQ ID NO: 8322693 - DNA, 17 bp, Homo sapiens
ggatagtgctgggctgg

SEQ ID NO: 8322694 - DNA, 22 bp, Homo sapiens
ggatcctgatatgtgtttctca

SEQ ID NO: 8322695 - DNA, 22 bp, Homo sapiens
cacatttctaggaaattaaatg

SEQ ID NO: 8322696 - DNA, 22 bp, Homo sapiens
atgcccaatgtcacaatttttg

SEQ ID NO: 8322697 - DNA, 22 bp, Homo sapiens
atgcccacaacactgcactttt

SEQ ID NO: 8322698 - DNA, 22 bp, Homo sapiens
atgcccaccctcagcccaggct

SEQ ID NO: 8322699 - DNA, 22 bp, Homo sapiens
atgcctctgctcttggtcctca

SEQ ID NO: 8322700 - DNA, 22 bp, Homo sapiens
atgcccttatgccagaggcaat

SEQ ID NO: 8322701 - DNA, 22 bp, Homo sapiens
gaagcacatggctgtgagcaac

SEQ ID NO: 8322702 - DNA, 22 bp, Homo sapiens
gacagttaggacaactgacttc

SEQ ID NO: 8322703 - DNA, 22 bp, Homo sapiens
gacagtttaggttcaaatctca

SEQ ID NO: 8322704 - DNA, 22 bp, Homo sapiens
atgctttatacaaaacacttaa

SEQ ID NO: 8322705 - DNA, 22 bp, Homo sapiens
atgctttagttcaaaggactta

SEQ ID NO: 8322706 - DNA, 22 bp, Homo sapiens
atgcttggcagagttctttttc

SEQ ID NO: 8322707 - DNA, 22 bp, Homo sapiens
gacataaaatggaattctgttg

SEQ ID NO: 8322708 - DNA, 22 bp, Homo sapiens
gacagttttgctgaaattgagc

SEQ ID NO: 8322709 - DNA, 22 bp, Homo sapiens
gactttctgagtcaaagaaagg

SEQ ID NO: 8322710 - DNA, 22 bp, Homo sapiens
gactggggtaaggtgaggaggt

SEQ ID NO: 8322711 - DNA, 22 bp, Homo sapiens
gactggggtaaggtgaggaggt

SEQ ID NO: 8322712 - DNA, 22 bp, Homo sapiens
gaccccagaggaaggggcgccg

SEQ ID NO: 8322713 - DNA, 22 bp, Homo sapiens
gacccgtggcaggctgcctgct

SEQ ID NO: 8322714 - DNA, 22 bp, Homo sapiens
atgcttttaactcctttatccc

SEQ ID NO: 8322715 - DNA, 22 bp, Homo sapiens
atgcttttccaggagaaatata

SEQ ID NO: 8322716 - DNA, 22 bp, Homo sapiens
atgctttgaagtttttcctcat

SEQ ID NO: 8322717 - DNA, 22 bp, Homo sapiens
gactttggagcagaaagaaatt

SEQ ID NO: 8322718 - DNA, 22 bp, Homo sapiens
gaagaaagatcaaatagtttcc

SEQ ID NO: 8322719 - DNA, 22 bp, Homo sapiens
gaagaaagattggcatgcttca

SEQ ID NO: 8322720 - DNA, 22 bp, Homo sapiens
atgcaatagtaattctagtctg

SEQ ID NO: 8322721 - DNA, 22 bp, Homo sapiens
atgcaataaatactttccagct

SEQ ID NO: 8322722 - DNA, 22 bp, Homo sapiens
atgcaagtcttaatagtttagg

SEQ ID NO: 8322723 - DNA, 22 bp, Homo sapiens
atgcaagtcttaatagtttagg

SEQ ID NO: 8322724 - DNA, 22 bp, Homo sapiens
atgcaatatgtgtttctgttta

SEQ ID NO: 8322725 - DNA, 22 bp, Homo sapiens
gaacatttgatgatgacattgg

SEQ ID NO: 8322726 - DNA, 17 bp, Homo sapiens
gaacttttattaaattc

SEQ ID NO: 8322727 - DNA, 22 bp, Homo sapiens
gaaatatacatgaagtcggctg

SEQ ID NO: 8322728 - DNA, 22 bp, Homo sapiens
gaaatgaactgattatcattgc

SEQ ID NO: 8322729 - DNA, 20 bp, Homo sapiens
gaaaataggccagccaggta

SEQ ID NO: 8322730 - DNA, 22 bp, Homo sapiens
gaaaacttggatctctagaatg

SEQ ID NO: 8322731 - DNA, 22 bp, Homo sapiens
gaaaagaactgcatgggattaa

SEQ ID NO: 8322732 - DNA, 22 bp, Homo sapiens
ctttttccagcttcagggtggg

SEQ ID NO: 8322733 - DNA, 22 bp, Homo sapiens
atgaatgctatgctctaccagc

SEQ ID NO: 8322734 - DNA, 22 bp, Homo sapiens
atgaatgagaaagctgaaatct

SEQ ID NO: 8322735 - DNA, 22 bp, Homo sapiens
atgaatacgcggtcatacacat

SEQ ID NO: 8322736 - DNA, 18 bp, Homo sapiens
cttgagctaagggacccc

SEQ ID NO: 8322737 - DNA, 22 bp, Homo sapiens
cttgagctaggaaggctgaggc

SEQ ID NO: 8322738 - DNA, 22 bp, Homo sapiens
atgtaagtattcaaaatatttc

SEQ ID NO: 8322739 - DNA, 22 bp, Homo sapiens
atgtaatttatgttatccataa

SEQ ID NO: 8322740 - DNA, 22 bp, Homo sapiens
atgtaacattgaattatatagt

SEQ ID NO: 8322741 - DNA, 22 bp, Homo sapiens
atgtaacaaatggtatacatgt

SEQ ID NO: 8322742 - DNA, 22 bp, Homo sapiens
atgtaacaaatggtatacatgt

SEQ ID NO: 8322743 - DNA, 22 bp, Homo sapiens
atgtacaacctgcatgacagtc

SEQ ID NO: 8322744 - DNA, 22 bp, Homo sapiens
atgtatttgaaatttgagacat

SEQ ID NO: 8322745 - DNA, 22 bp, Homo sapiens
gaggaaggaatgcagtgtatgc

SEQ ID NO: 8322746 - DNA, 22 bp, Homo sapiens
gagctttgatcgctaagcctca

SEQ ID NO: 8322747 - DNA, 22 bp, Homo sapiens
gagctctgcggaaaacgtgccg

SEQ ID NO: 8322748 - DNA, 22 bp, Homo sapiens
gagaggtgtgtttcagataaga

SEQ ID NO: 8322749 - DNA, 22 bp, Homo sapiens
gagaggtgaaggctgccctggg

SEQ ID NO: 8322750 - DNA, 22 bp, Homo sapiens
gagcacagtaaagcagtgtcac

SEQ ID NO: 8322751 - DNA, 22 bp, Homo sapiens
gagaggctgactggctgtcctg

SEQ ID NO: 8322752 - DNA, 22 bp, Homo sapiens
gagaggctctgaggactggggt

SEQ ID NO: 8322753 - DNA, 21 bp, Homo sapiens
atggaaaaacaggtagagcat

SEQ ID NO: 8322754 - DNA, 22 bp, Homo sapiens
gagaggctctgaggactggggt

SEQ ID NO: 8322755 - DNA, 22 bp, Homo sapiens
gagcgcggtccccacggaggat

SEQ ID NO: 8322756 - DNA, 22 bp, Homo sapiens
gagcctgggactgggggtcatg

SEQ ID NO: 8322757 - DNA, 20 bp, Homo sapiens
gagcctgggaagtctaaggt

SEQ ID NO: 8322758 - DNA, 22 bp, Homo sapiens
gagcagggagacaactctggtg

SEQ ID NO: 8322759 - DNA, 22 bp, Homo sapiens
gagggatggtgtgagaggctca

SEQ ID NO: 8322760 - DNA, 22 bp, Homo sapiens
gaggcttctgttcactcacgct

SEQ ID NO: 8322761 - DNA, 22 bp, Homo sapiens
gaggccaatcaatagggcaata

SEQ ID NO: 8322762 - DNA, 22 bp, Homo sapiens
gaggctgctttgatgacaggag

SEQ ID NO: 8322763 - DNA, 22 bp, Homo sapiens
gaggccacagctatcagggaca

SEQ ID NO: 8322764 - DNA, 22 bp, Homo sapiens
gaggccacagtcctgaggcatc

SEQ ID NO: 8322765 - DNA, 22 bp, Homo sapiens
gaggccacagtgtctgggggcc

SEQ ID NO: 8322766 - DNA, 22 bp, Homo sapiens
gaggtaagggcaggagagtgaa

SEQ ID NO: 8322767 - DNA, 22 bp, Homo sapiens
gaggtagacttcttggaagtag

SEQ ID NO: 8322768 - DNA, 22 bp, Homo sapiens
gagggggcgtgcaaggctccgc

SEQ ID NO: 8322769 - DNA, 22 bp, Homo sapiens
gagggggcgtgcaaggctccgc

SEQ ID NO: 8322770 - DNA, 22 bp, Homo sapiens
gagggggcgtgcaaggctccgc

SEQ ID NO: 8322771 - DNA, 22 bp, Homo sapiens
gagggggctctgccaacctgtc

SEQ ID NO: 8322772 - DNA, 22 bp, Homo sapiens
gagggggctctgccaacctgtc

SEQ ID NO: 8322773 - DNA, 22 bp, Homo sapiens
gaggggggcgccctgcagtgca

SEQ ID NO: 8322774 - DNA, 22 bp, Homo sapiens
gagggggtctatgaggtagagc

SEQ ID NO: 8322775 - DNA, 22 bp, Homo sapiens
gagggggctccctgaagccagt

SEQ ID NO: 8322776 - DNA, 22 bp, Homo sapiens
gagggggctccctgaagccagt

SEQ ID NO: 8322777 - DNA, 22 bp, Homo sapiens
gagggggctccctgaagccagt

SEQ ID NO: 8322778 - DNA, 22 bp, Homo sapiens
gagggggctagcgcagtgccca

SEQ ID NO: 8322779 - DNA, 22 bp, Homo sapiens
gagggggctagcgcagtgccca

SEQ ID NO: 8322780 - DNA, 22 bp, Homo sapiens
gagggggctagcgcagtgccca

SEQ ID NO: 8322781 - DNA, 22 bp, Homo sapiens
atgtttattttgcagagtaggg

SEQ ID NO: 8322782 - DNA, 22 bp, Homo sapiens
atgtttcaccagttttataaga

SEQ ID NO: 8322783 - DNA, 22 bp, Homo sapiens
gagtccagtgatgttcctggtc

SEQ ID NO: 8322784 - DNA, 20 bp, Homo sapiens
gagtccaggggcctgtagca

SEQ ID NO: 8322785 - DNA, 22 bp, Homo sapiens
gagtccaggctgttgctcatct

SEQ ID NO: 8322786 - DNA, 17 bp, Homo sapiens
gagtgcagacacaagca

SEQ ID NO: 8322787 - DNA, 23 bp, Homo sapiens
gagtgcagaatagacatgcagtg

SEQ ID NO: 8322788 - DNA, 21 bp, Homo sapiens
gagtgcagcaaggtagagtct

SEQ ID NO: 8322789 - DNA, 22 bp, Homo sapiens
gagtgcaggcctgagcaccatc

SEQ ID NO: 8322790 - DNA, 18 bp, Homo sapiens
gatcgggggcgccccaag

SEQ ID NO: 8322791 - DNA, 22 bp, Homo sapiens
gatctctgaatctgaagccttc

SEQ ID NO: 8322792 - DNA, 22 bp, Homo sapiens
gatctcaaagcagtgtgggttg

SEQ ID NO: 8322793 - DNA, 22 bp, Homo sapiens
atgtttccatcaaatttgatga

SEQ ID NO: 8322794 - DNA, 22 bp, Homo sapiens
atgtttccatcaaatttgatga

SEQ ID NO: 8322795 - DNA, 22 bp, Homo sapiens
atgtttccatagaagtcacagt

SEQ ID NO: 8322796 - DNA, 22 bp, Homo sapiens
atgtttccaggttcttcctatg

SEQ ID NO: 8322797 - DNA, 22 bp, Homo sapiens
atgtttccagatatgtcaccct

SEQ ID NO: 8322798 - DNA, 22 bp, Homo sapiens
atgtttccgtgagcatccttga

SEQ ID NO: 8322799 - DNA, 22 bp, Homo sapiens
atgtttctaaaacttgcatggc

SEQ ID NO: 8322800 - DNA, 22 bp, Homo sapiens
atgtttcccagagcaaatctgg

SEQ ID NO: 8322801 - DNA, 22 bp, Homo sapiens
atgtttccattttcttgtatca

SEQ ID NO: 8322802 - DNA, 17 bp, Homo sapiens
gcagcctcttggtagtg

SEQ ID NO: 8322803 - DNA, 22 bp, Homo sapiens
gcagcctttggaattagagact

SEQ ID NO: 8322804 - DNA, 22 bp, Homo sapiens
gcagccttccgtggacctggac

SEQ ID NO: 8322805 - DNA, 22 bp, Homo sapiens
gcagaggcctgaaggtggcggg

SEQ ID NO: 8322806 - DNA, 22 bp, Homo sapiens
gcagaggctgggtgtcccagtc

SEQ ID NO: 8322807 - DNA, 22 bp, Homo sapiens
gcagaggctgtagggaaggttg

SEQ ID NO: 8322808 - DNA, 22 bp, Homo sapiens
gcagaaggttgtttgggaaagg

SEQ ID NO: 8322809 - DNA, 22 bp, Homo sapiens
gcagaggcctaggtggaaggcc

SEQ ID NO: 8322810 - DNA, 22 bp, Homo sapiens
gcagaatatattactgagcctc

SEQ ID NO: 8322811 - DNA, 22 bp, Homo sapiens
gcagaatattatggaaaaagta

SEQ ID NO: 8322812 - DNA, 22 bp, Homo sapiens
gcagaatactgagagctgattg

SEQ ID NO: 8322813 - DNA, 22 bp, Homo sapiens
gcagaatacatttgggattact

SEQ ID NO: 8322814 - DNA, 22 bp, Homo sapiens
gcagaataatagaaaggcacac

SEQ ID NO: 8322815 - DNA, 22 bp, Homo sapiens
gcacagggcaacaggtctgtta

SEQ ID NO: 8322816 - DNA, 22 bp, Homo sapiens
gcacagggaggctggcctggcc

SEQ ID NO: 8322817 - DNA, 22 bp, Homo sapiens
gcacagggagacagccgtggcc

SEQ ID NO: 8322818 - DNA, 22 bp, Homo sapiens
gcacaggctctcttggggacac

SEQ ID NO: 8322819 - DNA, 22 bp, Homo sapiens
gcacagagcctggtaccgagaa

SEQ ID NO: 8322820 - DNA, 22 bp, Homo sapiens
gcacagagctggccctccaggc

SEQ ID NO: 8322821 - DNA, 23 bp, Homo sapiens
gcacagagcagttaggggaagat

SEQ ID NO: 8322822 - DNA, 18 bp, Homo sapiens
gcacagagcccaggctct

SEQ ID NO: 8322823 - DNA, 23 bp, Homo sapiens
gcacagagcagttaggggaagat

SEQ ID NO: 8322824 - DNA, 22 bp, Homo sapiens
gcaaacaaggacatacatcctg

SEQ ID NO: 8322825 - DNA, 22 bp, Homo sapiens
gcaaatgctctccttggtcagg

SEQ ID NO: 8322826 - DNA, 22 bp, Homo sapiens
gcaaatgctctccagcctgggt

SEQ ID NO: 8322827 - DNA, 22 bp, Homo sapiens
gcaaaatttacactccttcttc

SEQ ID NO: 8322828 - DNA, 22 bp, Homo sapiens
gcagggtcgctctaggagatca

SEQ ID NO: 8322829 - DNA, 21 bp, Homo sapiens
gcagggtcctttccattccta

SEQ ID NO: 8322830 - DNA, 22 bp, Homo sapiens
gcagggtgaaggtcacatagaa

SEQ ID NO: 8322831 - DNA, 22 bp, Homo sapiens
attgtaaatagtgccacaataa

SEQ ID NO: 8322832 - DNA, 22 bp, Homo sapiens
attgtaaaagtattctaagatt

SEQ ID NO: 8322833 - DNA, 22 bp, Homo sapiens
gcagggacgccagggacagcaa

SEQ ID NO: 8322834 - DNA, 22 bp, Homo sapiens
gcaggagcagtcaggggcagct

SEQ ID NO: 8322835 - DNA, 22 bp, Homo sapiens
gcaggagcaatggcctatcaga

SEQ ID NO: 8322836 - DNA, 14 bp, Homo sapiens
gcaggcggatcact

SEQ ID NO: 8322837 - DNA, 22 bp, Homo sapiens
gcattcactgggtgttcatggg

SEQ ID NO: 8322838 - DNA, 22 bp, Homo sapiens
atttaaatgcttaagagggttt

SEQ ID NO: 8322839 - DNA, 22 bp, Homo sapiens
atttaaatgcttaagagggttt

SEQ ID NO: 8322840 - DNA, 22 bp, Homo sapiens
attgttatgaaaataagatgtt

SEQ ID NO: 8322841 - DNA, 22 bp, Homo sapiens
attgttcaatgtaataattttg

SEQ ID NO: 8322842 - DNA, 22 bp, Homo sapiens
attgtaacatgttcagatcact

SEQ ID NO: 8322843 - DNA, 22 bp, Homo sapiens
gcagtgattggctttcacaaaa

SEQ ID NO: 8322844 - DNA, 22 bp, Homo sapiens
gcccagccacagtcactttcat

SEQ ID NO: 8322845 - DNA, 22 bp, Homo sapiens
gcccagccagagctgtgtgatg

SEQ ID NO: 8322846 - DNA, 22 bp, Homo sapiens
gcccagcccagaaaggttcgga

SEQ ID NO: 8322847 - DNA, 22 bp, Homo sapiens
atttacagaccctcccactaag

SEQ ID NO: 8322848 - DNA, 22 bp, Homo sapiens
atttactaatgtcatatcgcgt

SEQ ID NO: 8322849 - DNA, 22 bp, Homo sapiens
gccctcctgcaggggcttctgg

SEQ ID NO: 8322850 - DNA, 22 bp, Homo sapiens
gccctgccctgagccgtagacc

SEQ ID NO: 8322851 - DNA, 22 bp, Homo sapiens
gcccagcccctgggtggacgtg

SEQ ID NO: 8322852 - DNA, 22 bp, Homo sapiens
gcccaggaggtggaggtgcagt

SEQ ID NO: 8322853 - DNA, 22 bp, Homo sapiens
gcccaggagttcaaggctgcag

SEQ ID NO: 8322854 - DNA, 22 bp, Homo sapiens
gcccaggagttgaagggctgac

SEQ ID NO: 8322855 - DNA, 22 bp, Homo sapiens
attttaataagatccatttggt

SEQ ID NO: 8322856 - DNA, 22 bp, Homo sapiens
attttaataagattcccaagta

SEQ ID NO: 8322857 - DNA, 22 bp, Homo sapiens
attttaataagatccatttggt

SEQ ID NO: 8322858 - DNA, 22 bp, Homo sapiens
attttctagatagatgatgcat

SEQ ID NO: 8322859 - DNA, 22 bp, Homo sapiens
gcctgccctgaaagaggtgaag

SEQ ID NO: 8322860 - DNA, 21 bp, Homo sapiens
gcctgccctctgtgatggcca

SEQ ID NO: 8322861 - DNA, 22 bp, Homo sapiens
attttactaagtggatatctgt

SEQ ID NO: 8322862 - DNA, 18 bp, Homo sapiens
gcctgccatccccacagc

SEQ ID NO: 8322863 - DNA, 22 bp, Homo sapiens
attttactactccaattaatga

SEQ ID NO: 8322864 - DNA, 22 bp, Homo sapiens
attttacataaggaaggtttaa

SEQ ID NO: 8322865 - DNA, 22 bp, Homo sapiens
gcctggctcacagagcagcctt

SEQ ID NO: 8322866 - DNA, 22 bp, Homo sapiens
gcgttggggaccccgaagctgg

SEQ ID NO: 8322867 - DNA, 22 bp, Homo sapiens
gcctggctcctaaggactggct

SEQ ID NO: 8322868 - DNA, 22 bp, Homo sapiens
gcctggctctgagggagctcct

SEQ ID NO: 8322869 - DNA, 22 bp, Homo sapiens
gctaatcaatgttaaggctgtg

SEQ ID NO: 8322870 - DNA, 22 bp, Homo sapiens
gctacacaatagcgttcactta

SEQ ID NO: 8322871 - DNA, 22 bp, Homo sapiens
gctcctggatgttcaagtcggc

SEQ ID NO: 8322872 - DNA, 22 bp, Homo sapiens
gctccttctggctcccttttgg

SEQ ID NO: 8322873 - DNA, 22 bp, Homo sapiens
gctcggagaactgggggctccg

SEQ ID NO: 8322874 - DNA, 17 bp, Homo sapiens
gctccaggcgtgagtga

SEQ ID NO: 8322875 - DNA, 22 bp, Homo sapiens
gctgagctgaggcagggctggg

SEQ ID NO: 8322876 - DNA, 22 bp, Homo sapiens
gctgagaacagagctctgagct

SEQ ID NO: 8322877 - DNA, 22 bp, Homo sapiens
caaattaccctcaacatctaga

SEQ ID NO: 8322878 - DNA, 22 bp, Homo sapiens
caaattcaatgaacatgtttaa

SEQ ID NO: 8322879 - DNA, 22 bp, Homo sapiens
caaatgaatagggagtgtgatg

SEQ ID NO: 8322880 - DNA, 17 bp, Homo sapiens
caaatcctaggatgtct

SEQ ID NO: 8322881 - DNA, 22 bp, Homo sapiens
caaatctaggatgcatgtagtg

SEQ ID NO: 8322882 - DNA, 22 bp, Homo sapiens
cccaggagatgcactccattgg

SEQ ID NO: 8322883 - DNA, 22 bp, Homo sapiens
cccaggagatggtgcgtggtct

SEQ ID NO: 8322884 - DNA, 22 bp, Homo sapiens
cccaggagatggtgcgtggtct

SEQ ID NO: 8322885 - DNA, 22 bp, Homo sapiens
cccaggaggtcaaggctgcagt

SEQ ID NO: 8322886 - DNA, 22 bp, Homo sapiens
cccaggagcttctctctgcctc

SEQ ID NO: 8322887 - DNA, 22 bp, Homo sapiens
aggctgtgacagggtcatggag

SEQ ID NO: 8322888 - DNA, 22 bp, Homo sapiens
aggctgtgaactctatgctgaa

SEQ ID NO: 8322889 - DNA, 22 bp, Homo sapiens
cccatccctgattttcactcgt

SEQ ID NO: 8322890 - DNA, 22 bp, Homo sapiens
cccagtttcaactttccagtgg

SEQ ID NO: 8322891 - DNA, 22 bp, Homo sapiens
cccagtttcaactttccagtgg

SEQ ID NO: 8322892 - DNA, 22 bp, Homo sapiens
cccaggcttttaagttagacag

SEQ ID NO: 8322893 - DNA, 22 bp, Homo sapiens
cccagtattgagctacaggcct

SEQ ID NO: 8322894 - DNA, 22 bp, Homo sapiens
cccaggcttttctcttgcccca

SEQ ID NO: 8322895 - DNA, 18 bp, Homo sapiens
cccaggctttgtgggtct

SEQ ID NO: 8322896 - DNA, 18 bp, Homo sapiens
cccaggctttgtgggtct

SEQ ID NO: 8322897 - DNA, 22 bp, Homo sapiens
cccaggcttcccaatcagaagg

SEQ ID NO: 8322898 - DNA, 22 bp, Homo sapiens
cccaggctgtctgtcctttgct

SEQ ID NO: 8322899 - DNA, 22 bp, Homo sapiens
cccaggctgtgcaaacttcaaa

SEQ ID NO: 8322900 - DNA, 22 bp, Homo sapiens
cccaggctggaattccaggcct

SEQ ID NO: 8322901 - DNA, 22 bp, Homo sapiens
cccaggaggtcgaagctgcagt

SEQ ID NO: 8322902 - DNA, 22 bp, Homo sapiens
cccaggaggtcaaggctgcagt

SEQ ID NO: 8322903 - DNA, 22 bp, Homo sapiens
cccaggaggtggagcttgcagt

SEQ ID NO: 8322904 - DNA, 22 bp, Homo sapiens
cccaggaggtggagcttgcagt

SEQ ID NO: 8322905 - DNA, 23 bp, Homo sapiens
cccaggctacaaattatgctctg

SEQ ID NO: 8322906 - DNA, 22 bp, Homo sapiens
cccaggctgatgggatgggcca

SEQ ID NO: 8322907 - DNA, 22 bp, Homo sapiens
cccaggctgatgttcagcgggt

SEQ ID NO: 8322908 - DNA, 22 bp, Homo sapiens
cccaggctgcgtatccacaata

SEQ ID NO: 8322909 - DNA, 22 bp, Homo sapiens
cccaggctgccacgattactgc

SEQ ID NO: 8322910 - DNA, 22 bp, Homo sapiens
cccaggctgccacgattactgc

SEQ ID NO: 8322911 - DNA, 22 bp, Homo sapiens
cccaggctgatgggatgggcca

SEQ ID NO: 8322912 - DNA, 22 bp, Homo sapiens
cccaggctgcatgagtccatgg

SEQ ID NO: 8322913 - DNA, 22 bp, Homo sapiens
cccaggctgcatgagtccatgg

SEQ ID NO: 8322914 - DNA, 22 bp, Homo sapiens
ccctgctgtcaggtgctgggag

SEQ ID NO: 8322915 - DNA, 22 bp, Homo sapiens
ccctgctgcatggcctccacga

SEQ ID NO: 8322916 - DNA, 22 bp, Homo sapiens
ccctgctgtccctcagtcctgc

SEQ ID NO: 8322917 - DNA, 22 bp, Homo sapiens
ccctgctgtgcctgactgccat

SEQ ID NO: 8322918 - DNA, 22 bp, Homo sapiens
ccctgctgtgtcccacctggaa

SEQ ID NO: 8322919 - DNA, 22 bp, Homo sapiens
ccctgctgtgtcccacctggaa

SEQ ID NO: 8322920 - DNA, 22 bp, Homo sapiens
ccccttccacagtgcttcctaa

SEQ ID NO: 8322921 - DNA, 22 bp, Homo sapiens
ccccagcactaccagaagccag

SEQ ID NO: 8322922 - DNA, 22 bp, Homo sapiens
ccctatcctgcaggcctgggct

SEQ ID NO: 8322923 - DNA, 22 bp, Homo sapiens
ccctagggtttggccagagccc

SEQ ID NO: 8322924 - DNA, 22 bp, Homo sapiens
ccctaggggcaatgatggtgct

SEQ ID NO: 8322925 - DNA, 22 bp, Homo sapiens
ccctagggctaagcaggactgc

SEQ ID NO: 8322926 - DNA, 22 bp, Homo sapiens
ccctcaccaggctccaggcatg

SEQ ID NO: 8322927 - DNA, 22 bp, Homo sapiens
cccatggggacaccatgaagga

SEQ ID NO: 8322928 - DNA, 22 bp, Homo sapiens
ccccagaaagcctggcactagg

SEQ ID NO: 8322929 - DNA, 22 bp, Homo sapiens
ccccagaagtttgcacaagaga

SEQ ID NO: 8322930 - DNA, 22 bp, Homo sapiens
ccccagagaaagtcagcagcat

SEQ ID NO: 8322931 - DNA, 20 bp, Homo sapiens
agggcctgctctgtggtgtc

SEQ ID NO: 8322932 - DNA, 23 bp, Homo sapiens
agggcctggcgtggagtgtgtgc

SEQ ID NO: 8322933 - DNA, 20 bp, Homo sapiens
agggcctggagtacagcagg

SEQ ID NO: 8322934 - DNA, 22 bp, Homo sapiens
agggcctgcatcaggagcttgg

SEQ ID NO: 8322935 - DNA, 22 bp, Homo sapiens
agggcctgagctctcctccagt

SEQ ID NO: 8322936 - DNA, 22 bp, Homo sapiens
agggctgcatctgcctggtgaa

SEQ ID NO: 8322937 - DNA, 22 bp, Homo sapiens
agggctggagccacagctggga

SEQ ID NO: 8322938 - DNA, 22 bp, Homo sapiens
agggctgcttacctggaatggc

SEQ ID NO: 8322939 - DNA, 22 bp, Homo sapiens
agggctggagccacagctggga

SEQ ID NO: 8322940 - DNA, 22 bp, Homo sapiens
agggctggagccacagctggga

SEQ ID NO: 8322941 - DNA, 22 bp, Homo sapiens
agggcgcctgctgtggccaccg

SEQ ID NO: 8322942 - DNA, 22 bp, Homo sapiens
agggcgacaatggagagcgttt

SEQ ID NO: 8322943 - DNA, 22 bp, Homo sapiens
agggcgctgaaatactaacatg

SEQ ID NO: 8322944 - DNA, 22 bp, Homo sapiens
agggcgtggtggtgctggagca

SEQ ID NO: 8322945 - DNA, 22 bp, Homo sapiens
aggggaggtgtccccaaatctc

SEQ ID NO: 8322946 - DNA, 22 bp, Homo sapiens
aggggaggtgtccccaaatctc

SEQ ID NO: 8322947 - DNA, 22 bp, Homo sapiens
aggggaggcagcgataaacctg

SEQ ID NO: 8322948 - DNA, 22 bp, Homo sapiens
aggggaggcagcgataaacctg

SEQ ID NO: 8322949 - DNA, 22 bp, Homo sapiens
aggggaggagcttttcttgcct

SEQ ID NO: 8322950 - DNA, 22 bp, Homo sapiens
agggctggcatctctaatgctg

SEQ ID NO: 8322951 - DNA, 22 bp, Homo sapiens
agggctggccacatgatttggt

SEQ ID NO: 8322952 - DNA, 22 bp, Homo sapiens
agggctggctaggtgcgttccc

SEQ ID NO: 8322953 - DNA, 22 bp, Homo sapiens
agggctggctaggtgcgttccc

SEQ ID NO: 8322954 - DNA, 22 bp, Homo sapiens
aggggagcaacatagtcactct

SEQ ID NO: 8322955 - DNA, 22 bp, Homo sapiens
aggggagcaacatagtcactct

SEQ ID NO: 8322956 - DNA, 18 bp, Homo sapiens
aggggcagcttgtgtgga

SEQ ID NO: 8322957 - DNA, 22 bp, Homo sapiens
aggggcagcctcacaatcctct

SEQ ID NO: 8322958 - DNA, 22 bp, Homo sapiens
aggggatggagctggaaggcag

SEQ ID NO: 8322959 - DNA, 22 bp, Homo sapiens
aggggatggagctggaaggcag

SEQ ID NO: 8322960 - DNA, 22 bp, Homo sapiens
aggggtgaaggcccgataggag

SEQ ID NO: 8322961 - DNA, 22 bp, Homo sapiens
aggcgctgtgcttggggctgga

SEQ ID NO: 8322962 - DNA, 22 bp, Homo sapiens
ccagctcttttggctgagtgag

SEQ ID NO: 8322963 - DNA, 22 bp, Homo sapiens
ccagctggaagagtgcagaact

SEQ ID NO: 8322964 - DNA, 22 bp, Homo sapiens
ccagctggagccaaggtggact

SEQ ID NO: 8322965 - DNA, 22 bp, Homo sapiens
aggcctgccttgagcaaccagc

SEQ ID NO: 8322966 - DNA, 22 bp, Homo sapiens
aggccagaaatgtcagggagtg

SEQ ID NO: 8322967 - DNA, 22 bp, Homo sapiens
aggccacagttgaggccagcaa

SEQ ID NO: 8322968 - DNA, 22 bp, Homo sapiens
aggcccagactcagcggggcgg

SEQ ID NO: 8322969 - DNA, 22 bp, Homo sapiens
ccagaacacagtggaagaatat

SEQ ID NO: 8322970 - DNA, 22 bp, Homo sapiens
aggccacaagaaaatgcttcat

SEQ ID NO: 8322971 - DNA, 22 bp, Homo sapiens
aggccacagtcagtgggtgctg

SEQ ID NO: 8322972 - DNA, 22 bp, Homo sapiens
aggccacagttgaggccagcaa

SEQ ID NO: 8322973 - DNA, 22 bp, Homo sapiens
aggccacagtactttgcagacc

SEQ ID NO: 8322974 - DNA, 22 bp, Homo sapiens
aggctgctttattcacaatagc

SEQ ID NO: 8322975 - DNA, 19 bp, Homo sapiens
aggctggagacaccaggcc

SEQ ID NO: 8322976 - DNA, 22 bp, Homo sapiens
ccaggtctgtcttcttagctca

SEQ ID NO: 8322977 - DNA, 21 bp, Homo sapiens
ccaggtcttggtccttggact

SEQ ID NO: 8322978 - DNA, 22 bp, Homo sapiens
ccaggtcttgtttgacatcaat

SEQ ID NO: 8322979 - DNA, 22 bp, Homo sapiens
aggctggctggggatgcgtctt

SEQ ID NO: 8322980 - DNA, 22 bp, Homo sapiens
ccattttattagtgacatttag

SEQ ID NO: 8322981 - DNA, 22 bp, Homo sapiens
ccatttcactcttcctgaagga

SEQ ID NO: 8322982 - DNA, 22 bp, Homo sapiens
ccatttcacccactgctttagg

SEQ ID NO: 8322983 - DNA, 22 bp, Homo sapiens
aggctggcggtgactgctctga

SEQ ID NO: 8322984 - DNA, 22 bp, Homo sapiens
aggctgaggcaggtggatcacc

SEQ ID NO: 8322985 - DNA, 22 bp, Homo sapiens
aggctgaggcaagaggatcact

SEQ ID NO: 8322986 - DNA, 22 bp, Homo sapiens
ccagggctggtggctgcagagg

SEQ ID NO: 8322987 - DNA, 22 bp, Homo sapiens
ccagggcctcgtgttctgagtg

SEQ ID NO: 8322988 - DNA, 19 bp, Homo sapiens
ccagggctccaagctgagt

SEQ ID NO: 8322989 - DNA, 22 bp, Homo sapiens
ccaggctgggctacaagttgag

SEQ ID NO: 8322990 - DNA, 22 bp, Homo sapiens
ccaggctggagtatagtggcgc

SEQ ID NO: 8322991 - DNA, 22 bp, Homo sapiens
ccaggctggagtatagtggcgc

SEQ ID NO: 8322992 - DNA, 22 bp, Homo sapiens
aggctagaggcttctggcttca

SEQ ID NO: 8322993 - DNA, 22 bp, Homo sapiens
aggctacatgttggggtggaag

SEQ ID NO: 8322994 - DNA, 22 bp, Homo sapiens
aggctacagatacagaggctac

SEQ ID NO: 8322995 - DNA, 22 bp, Homo sapiens
aggagtgggggcgagaagttaa

SEQ ID NO: 8322996 - DNA, 22 bp, Homo sapiens
catcatttcacttagatgaagt

SEQ ID NO: 8322997 - DNA, 20 bp, Homo sapiens
aggagggtttctctgacaca

SEQ ID NO: 8322998 - DNA, 22 bp, Homo sapiens
aggagggtggcctcatgtgagt

SEQ ID NO: 8322999 - DNA, 22 bp, Homo sapiens
aggagggtggggtctgcctgtc

SEQ ID NO: 8323000 - DNA, 22 bp, Homo sapiens
aggagggttctctggacagagg

SEQ ID NO: 8323001 - DNA, 22 bp, Homo sapiens
cagttctacttggatgtctgca

SEQ ID NO: 8323002 - DNA, 22 bp, Homo sapiens
aggaggctgggcacagtggcct

SEQ ID NO: 8323003 - DNA, 22 bp, Homo sapiens
aggaggctgggcacagtggcct

SEQ ID NO: 8323004 - DNA, 22 bp, Homo sapiens
aggaggctgggcacagtggcct

SEQ ID NO: 8323005 - DNA, 22 bp, Homo sapiens
aggaggctgcaaccctgaggcc

SEQ ID NO: 8323006 - DNA, 23 bp, Homo sapiens
catcagaggttgccactccctgg

SEQ ID NO: 8323007 - DNA, 22 bp, Homo sapiens
aggagctgggcccaaggatgct

SEQ ID NO: 8323008 - DNA, 22 bp, Homo sapiens
aggagctggcctagaaaggaga

SEQ ID NO: 8323009 - DNA, 22 bp, Homo sapiens
cagtggaatacgagcagatgtc

SEQ ID NO: 8323010 - DNA, 22 bp, Homo sapiens
cagtggaaatcagagtgagagt

SEQ ID NO: 8323011 - DNA, 22 bp, Homo sapiens
aggagctgatagtctatggaga

SEQ ID NO: 8323012 - DNA, 22 bp, Homo sapiens
aggagccaaattttagactctg

SEQ ID NO: 8323013 - DNA, 22 bp, Homo sapiens
aggagcagcccactcctgtcct

SEQ ID NO: 8323014 - DNA, 22 bp, Homo sapiens
cagtgagggcattcagtgctgg

SEQ ID NO: 8323015 - DNA, 22 bp, Homo sapiens
aggacaagacaaggaccagaga

SEQ ID NO: 8323016 - DNA, 22 bp, Homo sapiens
aggcacagtttcatccccgggc

SEQ ID NO: 8323017 - DNA, 20 bp, Homo sapiens
aggcacagttcctagttggg

SEQ ID NO: 8323018 - DNA, 22 bp, Homo sapiens
aggcacagtggccctgtttggg

SEQ ID NO: 8323019 - DNA, 22 bp, Homo sapiens
aggatcctttttctgctgtttg

SEQ ID NO: 8323020 - DNA, 22 bp, Homo sapiens
aggatctgtgcctcaacccaga

SEQ ID NO: 8323021 - DNA, 22 bp, Homo sapiens
aggatcaggccctctagggtag

SEQ ID NO: 8323022 - DNA, 22 bp, Homo sapiens
aggatgaatatttagtgggata

SEQ ID NO: 8323023 - DNA, 22 bp, Homo sapiens
aggcacagggatgcggagccag

SEQ ID NO: 8323024 - DNA, 22 bp, Homo sapiens
ccaaaattaagcctcttatgtt

SEQ ID NO: 8323025 - DNA, 22 bp, Homo sapiens
ccaaaattattacatttgtagg

SEQ ID NO: 8323026 - DNA, 23 bp, Homo sapiens
aggcaggcagttcagctgttgtt

SEQ ID NO: 8323027 - DNA, 22 bp, Homo sapiens
aggcaggctgctatggagtaga

SEQ ID NO: 8323028 - DNA, 22 bp, Homo sapiens
aggcaggctagtcgcttgagcc

SEQ ID NO: 8323029 - DNA, 22 bp, Homo sapiens
agctttcaggataatgaaaaag

SEQ ID NO: 8323030 - DNA, 22 bp, Homo sapiens
agctttcagttactaatgaagg

SEQ ID NO: 8323031 - DNA, 20 bp, Homo sapiens
aggaaaagggtggtggtaga

SEQ ID NO: 8323032 - DNA, 22 bp, Homo sapiens
aggaaaagtgtgaagtatggag

SEQ ID NO: 8323033 - DNA, 20 bp, Homo sapiens
aggaaaaatggaaactggag

SEQ ID NO: 8323034 - DNA, 22 bp, Homo sapiens
aggaaaaataaggcagcagggc

SEQ ID NO: 8323035 - DNA, 22 bp, Homo sapiens
aggaagagggtggcagataatc

SEQ ID NO: 8323036 - DNA, 17 bp, Homo sapiens
aggaaacattttctttc

SEQ ID NO: 8323037 - DNA, 22 bp, Homo sapiens
aggaaacatccttatctattct

SEQ ID NO: 8323038 - DNA, 22 bp, Homo sapiens
cagggtgctgcaccatccctca

SEQ ID NO: 8323039 - DNA, 22 bp, Homo sapiens
cagggtgcttagaaatggacct

SEQ ID NO: 8323040 - DNA, 22 bp, Homo sapiens
cagggtggggctggctatcaaa

SEQ ID NO: 8323041 - DNA, 22 bp, Homo sapiens
agctggagccagtgtgaggctt

SEQ ID NO: 8323042 - DNA, 22 bp, Homo sapiens
agctggagcttcaagcaggtaa

SEQ ID NO: 8323043 - DNA, 22 bp, Homo sapiens
agctggagattctggggacagt

SEQ ID NO: 8323044 - DNA, 19 bp, Homo sapiens
agctggagattggagggca

SEQ ID NO: 8323045 - DNA, 22 bp, Homo sapiens
agctggagaaacctgggagggt

SEQ ID NO: 8323046 - DNA, 22 bp, Homo sapiens
agctggagagtttccaggaagg

SEQ ID NO: 8323047 - DNA, 21 bp, Homo sapiens
agctgggcctcagcctgcagt

SEQ ID NO: 8323048 - DNA, 22 bp, Homo sapiens
agctgggcctgagctggaagct

SEQ ID NO: 8323049 - DNA, 22 bp, Homo sapiens
agctgggcagactgcagtggtt

SEQ ID NO: 8323050 - DNA, 19 bp, Homo sapiens
agctggggcggtgtgtgtt

SEQ ID NO: 8323051 - DNA, 22 bp, Homo sapiens
agctggaagatcctggttttgt

SEQ ID NO: 8323052 - DNA, 22 bp, Homo sapiens
agctgcctctcttgaggttacg

SEQ ID NO: 8323053 - DNA, 22 bp, Homo sapiens
agctgaaattttactgagtata

SEQ ID NO: 8323054 - DNA, 22 bp, Homo sapiens
agctgaaattctttgtcctcag

SEQ ID NO: 8323055 - DNA, 22 bp, Homo sapiens
agctgaaagggtgttggagtgt

SEQ ID NO: 8323056 - DNA, 22 bp, Homo sapiens
agctgaaaattagtgatagttt

SEQ ID NO: 8323057 - DNA, 22 bp, Homo sapiens
agctgaaagcttgactggggct

SEQ ID NO: 8323058 - DNA, 22 bp, Homo sapiens
atccatttcctccactataaag

SEQ ID NO: 8323059 - DNA, 22 bp, Homo sapiens
cttaagagtctttctgtgttta

SEQ ID NO: 8323060 - DNA, 21 bp, Homo sapiens
cttaacattttaaatgaaagg

SEQ ID NO: 8323061 - DNA, 22 bp, Homo sapiens
ctgtttctccacactcttccca

SEQ ID NO: 8323062 - DNA, 22 bp, Homo sapiens
cttcaagtccagctcatgctct

SEQ ID NO: 8323063 - DNA, 22 bp, Homo sapiens
cttcaaattcgaggagtagatg

SEQ ID NO: 8323064 - DNA, 19 bp, Homo sapiens
cttctgcagggtgacagtg

SEQ ID NO: 8323065 - DNA, 22 bp, Homo sapiens
cttctgtgtagaaaggtagccc

SEQ ID NO: 8323066 - DNA, 22 bp, Homo sapiens
cttctgagcagacctcctgggg

SEQ ID NO: 8323067 - DNA, 22 bp, Homo sapiens
cttctgagatgttgttttacag

SEQ ID NO: 8323068 - DNA, 22 bp, Homo sapiens
atctctatctttattgaaatct

SEQ ID NO: 8323069 - DNA, 22 bp, Homo sapiens
atctgtaaagataatcatatgt

SEQ ID NO: 8323070 - DNA, 22 bp, Homo sapiens
atctgtcatcagcaccacaggt

SEQ ID NO: 8323071 - DNA, 22 bp, Homo sapiens
atctgtaattttgaatgcaaat

SEQ ID NO: 8323072 - DNA, 22 bp, Homo sapiens
atctgtcttccaccacacatcc

SEQ ID NO: 8323073 - DNA, 22 bp, Homo sapiens
atctgtctgggtgcagcagtcc

SEQ ID NO: 8323074 - DNA, 22 bp, Homo sapiens
ctgggaggcggaggttgtagtg

SEQ ID NO: 8323075 - DNA, 22 bp, Homo sapiens
ctgggaggcggaggttgtagtg

SEQ ID NO: 8323076 - DNA, 22 bp, Homo sapiens
ctgggaggacaacttggagctc

SEQ ID NO: 8323077 - DNA, 22 bp, Homo sapiens
ctgggagcttgttaggaatgca

SEQ ID NO: 8323078 - DNA, 19 bp, Homo sapiens
ctggggctttggtactgcc

SEQ ID NO: 8323079 - DNA, 19 bp, Homo sapiens
ctggggctttggtactgcc

SEQ ID NO: 8323080 - DNA, 19 bp, Homo sapiens
ctggggctttggtactgcc

SEQ ID NO: 8323081 - DNA, 19 bp, Homo sapiens
ctggggctttggtactgcc

SEQ ID NO: 8323082 - DNA, 22 bp, Homo sapiens
ctgggggcaagcagacagctgt

SEQ ID NO: 8323083 - DNA, 22 bp, Homo sapiens
atattattctagctcttgtgtg

SEQ ID NO: 8323084 - DNA, 22 bp, Homo sapiens
atattattctagtaacagtgat

SEQ ID NO: 8323085 - DNA, 22 bp, Homo sapiens
ctggggcttcaatgcttcggtg

SEQ ID NO: 8323086 - DNA, 22 bp, Homo sapiens
ctggggctgtgggagacaaggc

SEQ ID NO: 8323087 - DNA, 22 bp, Homo sapiens
ctggggctgtgggagacaaggc

SEQ ID NO: 8323088 - DNA, 22 bp, Homo sapiens
ctggggctgtaggaggacttat

SEQ ID NO: 8323089 - DNA, 22 bp, Homo sapiens
ctgggtggagcctggtcatctg

SEQ ID NO: 8323090 - DNA, 22 bp, Homo sapiens
ctgggtggcagagcctgcagtg

SEQ ID NO: 8323091 - DNA, 22 bp, Homo sapiens
atattattttccctggagttgt

SEQ ID NO: 8323092 - DNA, 22 bp, Homo sapiens
atattattctagtaacagtgat

SEQ ID NO: 8323093 - DNA, 22 bp, Homo sapiens
ctgggtggcgtctggggccagt

SEQ ID NO: 8323094 - DNA, 22 bp, Homo sapiens
ctggtcaggggatggggctcag

SEQ ID NO: 8323095 - DNA, 22 bp, Homo sapiens
ctggtcaggaaggtggggacag

SEQ ID NO: 8323096 - DNA, 22 bp, Homo sapiens
ctggtccctgcagtgtgctggg

SEQ ID NO: 8323097 - DNA, 22 bp, Homo sapiens
ctgtctccgccctcttggtagg

SEQ ID NO: 8323098 - DNA, 22 bp, Homo sapiens
atcagtttcacttgcttgcaaa

SEQ ID NO: 8323099 - DNA, 22 bp, Homo sapiens
atcataaaattgcaccatttct

SEQ ID NO: 8323100 - DNA, 22 bp, Homo sapiens
atcataagacccagccagtatt

SEQ ID NO: 8323101 - DNA, 22 bp, Homo sapiens
atcatacactcacataaacaga

SEQ ID NO: 8323102 - DNA, 22 bp, Homo sapiens
ctgtaaatggaactatgtagta

SEQ ID NO: 8323103 - DNA, 22 bp, Homo sapiens
atcagctgaaaaacaggcagca

SEQ ID NO: 8323104 - DNA, 22 bp, Homo sapiens
atcagctgatgaatggatgaat

SEQ ID NO: 8323105 - DNA, 22 bp, Homo sapiens
atcagcattcccaaatgatgtg

SEQ ID NO: 8323106 - DNA, 21 bp, Homo sapiens
atcagcatcacgtcagtgtcc

SEQ ID NO: 8323107 - DNA, 22 bp, Homo sapiens
ctgtaaataatgacagttgact

SEQ ID NO: 8323108 - DNA, 22 bp, Homo sapiens
ctgcaggcttccagggctgtgg

SEQ ID NO: 8323109 - DNA, 22 bp, Homo sapiens
ctgcagggaactgaggcccaga

SEQ ID NO: 8323110 - DNA, 22 bp, Homo sapiens
ctgcagggaactgaggcccaga

SEQ ID NO: 8323111 - DNA, 22 bp, Homo sapiens
ataaaatcaactggctccagtt

SEQ ID NO: 8323112 - DNA, 22 bp, Homo sapiens
ataaaatctttatgtgctctgc

SEQ ID NO: 8323113 - DNA, 22 bp, Homo sapiens
ataaaatctttatgtgctctgc

SEQ ID NO: 8323114 - DNA, 22 bp, Homo sapiens
ataaactgaagggaacactgag

SEQ ID NO: 8323115 - DNA, 22 bp, Homo sapiens
ataaactgaagggaacactgag

SEQ ID NO: 8323116 - DNA, 22 bp, Homo sapiens
ataaactgggtatcaagaggcc

SEQ ID NO: 8323117 - DNA, 21 bp, Homo sapiens
ataaactgcatcaagttggtg

SEQ ID NO: 8323118 - DNA, 22 bp, Homo sapiens
ataaagaggatgtatttacagc

SEQ ID NO: 8323119 - DNA, 22 bp, Homo sapiens
ataaagatttctttttctctac

SEQ ID NO: 8323120 - DNA, 22 bp, Homo sapiens
ataaactgtgctggatgatgag

SEQ ID NO: 8323121 - DNA, 23 bp, Homo sapiens
ataaactgtcaaaagccagccct

SEQ ID NO: 8323122 - DNA, 22 bp, Homo sapiens
ataaactggtaggaaaacagta

SEQ ID NO: 8323123 - DNA, 22 bp, Homo sapiens
ataaagcaagcataccattaag

SEQ ID NO: 8323124 - DNA, 22 bp, Homo sapiens
ataaaacttgggtatgatccct

SEQ ID NO: 8323125 - DNA, 22 bp, Homo sapiens
ataaaagaagttttggtacttg

SEQ ID NO: 8323126 - DNA, 22 bp, Homo sapiens
ataaaagaagttttggtacttg

SEQ ID NO: 8323127 - DNA, 20 bp, Homo sapiens
ataaaactctaatctggcct

SEQ ID NO: 8323128 - DNA, 22 bp, Homo sapiens
ataaaacttattagaattgtgt

SEQ ID NO: 8323129 - DNA, 22 bp, Homo sapiens
ataaaagaagttttggtacttg

SEQ ID NO: 8323130 - DNA, 17 bp, Homo sapiens
agttttgatataatggc

SEQ ID NO: 8323131 - DNA, 22 bp, Homo sapiens
agttctcattgcatgagacaga

SEQ ID NO: 8323132 - DNA, 22 bp, Homo sapiens
agttccttgatgttctatggac

SEQ ID NO: 8323133 - DNA, 22 bp, Homo sapiens
agttccttcctgagctattgct

SEQ ID NO: 8323134 - DNA, 22 bp, Homo sapiens
agttccttgatgttctatggac

SEQ ID NO: 8323135 - DNA, 22 bp, Homo sapiens
agttccttttatctgagtctaa

SEQ ID NO: 8323136 - DNA, 22 bp, Homo sapiens
agttccttttatctgagtctaa

SEQ ID NO: 8323137 - DNA, 22 bp, Homo sapiens
atacaagttctcatgtgtatct

SEQ ID NO: 8323138 - DNA, 22 bp, Homo sapiens
atacaagttgcccaaatgatta

SEQ ID NO: 8323139 - DNA, 22 bp, Homo sapiens
ctgctgcccagtgtgcattggg

SEQ ID NO: 8323140 - DNA, 19 bp, Homo sapiens
ctgctcagagcagctccag

SEQ ID NO: 8323141 - DNA, 20 bp, Homo sapiens
ctgctcagaccaactcttct

SEQ ID NO: 8323142 - DNA, 22 bp, Homo sapiens
ctgctacagtttaaaggggaag

SEQ ID NO: 8323143 - DNA, 22 bp, Homo sapiens
ctgcctgtgcatgcagtcagaa

SEQ ID NO: 8323144 - DNA, 22 bp, Homo sapiens
ctgcctggaaggagcaagggga

SEQ ID NO: 8323145 - DNA, 22 bp, Homo sapiens
ctgcctggaaggagcaagggga

SEQ ID NO: 8323146 - DNA, 22 bp, Homo sapiens
ataaagctttgaaatggagata

SEQ ID NO: 8323147 - DNA, 22 bp, Homo sapiens
ctgcctggtctcaggcatgggg

SEQ ID NO: 8323148 - DNA, 22 bp, Homo sapiens
ctgcctgggttcaagtcctgtt

SEQ ID NO: 8323149 - DNA, 22 bp, Homo sapiens
ctgggagctgtcaggagcgtgt

SEQ ID NO: 8323150 - DNA, 22 bp, Homo sapiens
ctgggagctggaatgggagaag

SEQ ID NO: 8323151 - DNA, 22 bp, Homo sapiens
atatacttgatttaactgagca

SEQ ID NO: 8323152 - DNA, 22 bp, Homo sapiens
ctggctgatctcaatcatggct

SEQ ID NO: 8323153 - DNA, 19 bp, Homo sapiens
ctggctgcaatgccagggt

SEQ ID NO: 8323154 - DNA, 22 bp, Homo sapiens
atatacaggtggtatgtgtaaa

SEQ ID NO: 8323155 - DNA, 22 bp, Homo sapiens
atatacagtatgtactgtggtt

SEQ ID NO: 8323156 - DNA, 22 bp, Homo sapiens
atataaagtgtttagaaagctg

SEQ ID NO: 8323157 - DNA, 22 bp, Homo sapiens
atataaagaagtggaaaatgag

SEQ ID NO: 8323158 - DNA, 22 bp, Homo sapiens
atataaagagcttagtatagtg

SEQ ID NO: 8323159 - DNA, 22 bp, Homo sapiens
atagttttctatgcactgttat

SEQ ID NO: 8323160 - DNA, 22 bp, Homo sapiens
ctggccttggtgcttgcagaca

SEQ ID NO: 8323161 - DNA, 22 bp, Homo sapiens
atacacatgtgtatgtgcatgc

SEQ ID NO: 8323162 - DNA, 20 bp, Homo sapiens
atacacattcatagaaaaat

SEQ ID NO: 8323163 - DNA, 22 bp, Homo sapiens
ctggcaagtactgggccagctc

SEQ ID NO: 8323164 - DNA, 20 bp, Homo sapiens
ctggccagaacgcctacaca

SEQ ID NO: 8323165 - DNA, 22 bp, Homo sapiens
ctggccagactacacatgtgtg

SEQ ID NO: 8323166 - DNA, 22 bp, Homo sapiens
ctggcctaggaatggttttccg

SEQ ID NO: 8323167 - DNA, 22 bp, Homo sapiens
ctggccactgcgggcctctgcc

SEQ ID NO: 8323168 - DNA, 22 bp, Homo sapiens
ctggcaggtttggtgtctggtg

SEQ ID NO: 8323169 - DNA, 22 bp, Homo sapiens
ctggcaggtccagctggactca

SEQ ID NO: 8323170 - DNA, 22 bp, Homo sapiens
ctggcaggtccagctggactca

SEQ ID NO: 8323171 - DNA, 22 bp, Homo sapiens
ctggcaggtggatggggactcc

SEQ ID NO: 8323172 - DNA, 22 bp, Homo sapiens
ctggcaggtggatggggactcc

SEQ ID NO: 8323173 - DNA, 22 bp, Homo sapiens
ctggcaggtggaggttgcagtg

SEQ ID NO: 8323174 - DNA, 22 bp, Homo sapiens
agtctcaagtgttagtattatt

SEQ ID NO: 8323175 - DNA, 22 bp, Homo sapiens
ctcacagtgtaatattgaaccc

SEQ ID NO: 8323176 - DNA, 22 bp, Homo sapiens
agtctcaagcaccgaaagctgt

SEQ ID NO: 8323177 - DNA, 23 bp, Homo sapiens
agtctcaagctggagaattacct

SEQ ID NO: 8323178 - DNA, 22 bp, Homo sapiens
agtctacatttctaacaagctc

SEQ ID NO: 8323179 - DNA, 22 bp, Homo sapiens
agtctatttcagtcttactagt

SEQ ID NO: 8323180 - DNA, 23 bp, Homo sapiens
ctcaccaagcgccgccgctgtgt

SEQ ID NO: 8323181 - DNA, 22 bp, Homo sapiens
ctcacagttggctcattaatga

SEQ ID NO: 8323182 - DNA, 21 bp, Homo sapiens
agtctttgataaagacaaagt

SEQ ID NO: 8323183 - DNA, 22 bp, Homo sapiens
agtctttgaagttctgacagag

SEQ ID NO: 8323184 - DNA, 22 bp, Homo sapiens
agtcttctgctctgtcactaac

SEQ ID NO: 8323185 - DNA, 22 bp, Homo sapiens
agtgagggactccatgactcct

SEQ ID NO: 8323186 - DNA, 22 bp, Homo sapiens
agtgaggggcagctgagtgggc

SEQ ID NO: 8323187 - DNA, 20 bp, Homo sapiens
agtgagttatcagctacagt

SEQ ID NO: 8323188 - DNA, 22 bp, Homo sapiens
agtgaaaacctaatcatgcagt

SEQ ID NO: 8323189 - DNA, 19 bp, Homo sapiens
agtgaaatggagtattcaa

SEQ ID NO: 8323190 - DNA, 22 bp, Homo sapiens
agtgaaatgatagtgtaaatac

SEQ ID NO: 8323191 - DNA, 22 bp, Homo sapiens
agtgaaattcctggtctttgtt

SEQ ID NO: 8323192 - DNA, 22 bp, Homo sapiens
agtggagttgagttgatggatt

SEQ ID NO: 8323193 - DNA, 22 bp, Homo sapiens
agtgcctggaccccatgacata

SEQ ID NO: 8323194 - DNA, 22 bp, Homo sapiens
agtgcctcttgtctacggtttt

SEQ ID NO: 8323195 - DNA, 22 bp, Homo sapiens
agtgctgggtactgttcccatt

SEQ ID NO: 8323196 - DNA, 22 bp, Homo sapiens
agtgccatggaggaacagatgc

SEQ ID NO: 8323197 - DNA, 22 bp, Homo sapiens
agtgcattcagtattcataggc

SEQ ID NO: 8323198 - DNA, 22 bp, Homo sapiens
agtgcattcctggggaagaagc

SEQ ID NO: 8323199 - DNA, 22 bp, Homo sapiens
agtgcattatatgtttcaatgg

SEQ ID NO: 8323200 - DNA, 22 bp, Homo sapiens
agtgcatttggggtagtggaag

SEQ ID NO: 8323201 - DNA, 22 bp, Homo sapiens
agtgcattgcatctctgcttca

SEQ ID NO: 8323202 - DNA, 22 bp, Homo sapiens
agtgcattctgtcatcttggtt

SEQ ID NO: 8323203 - DNA, 22 bp, Homo sapiens
agtgcattctggcagaacaggt

SEQ ID NO: 8323204 - DNA, 22 bp, Homo sapiens
agtgcattctctaattacaggt

SEQ ID NO: 8323205 - DNA, 22 bp, Homo sapiens
agtgcattctccatcatctagg

SEQ ID NO: 8323206 - DNA, 19 bp, Homo sapiens
agtgcattttatgtttcaa

SEQ ID NO: 8323207 - DNA, 21 bp, Homo sapiens
agtgattatgggtttttacat

SEQ ID NO: 8323208 - DNA, 22 bp, Homo sapiens
agtgattagaaagtacacttgg

SEQ ID NO: 8323209 - DNA, 17 bp, Homo sapiens
agtgtttccttatcatt

SEQ ID NO: 8323210 - DNA, 22 bp, Homo sapiens
agttaaatgtcagtagcttaac

SEQ ID NO: 8323211 - DNA, 22 bp, Homo sapiens
ctgagccagctggcatgtgcta

SEQ ID NO: 8323212 - DNA, 22 bp, Homo sapiens
ctgagccagcgggctcactttt

SEQ ID NO: 8323213 - DNA, 22 bp, Homo sapiens
ctgagccagctggcatgtgcta

SEQ ID NO: 8323214 - DNA, 22 bp, Homo sapiens
ctgagccagggccacacatgga

SEQ ID NO: 8323215 - DNA, 22 bp, Homo sapiens
ctgagccactgcttgttcagtg

SEQ ID NO: 8323216 - DNA, 22 bp, Homo sapiens
ctgagccaaggggacagtgaca

SEQ ID NO: 8323217 - DNA, 22 bp, Homo sapiens
ctgagccaccggcagggacatc

SEQ ID NO: 8323218 - DNA, 22 bp, Homo sapiens
agttcatttaaatcaggtactt

SEQ ID NO: 8323219 - DNA, 18 bp, Homo sapiens
agttccttaaattggtgt

SEQ ID NO: 8323220 - DNA, 22 bp, Homo sapiens
agttccttcctgagctattgct

SEQ ID NO: 8323221 - DNA, 22 bp, Homo sapiens
agttccctggatgagctaaaaa

SEQ ID NO: 8323222 - DNA, 22 bp, Homo sapiens
ctgagctgaaacttgagaggct

SEQ ID NO: 8323223 - DNA, 22 bp, Homo sapiens
ctgagctgctcccgctgcagcg

SEQ ID NO: 8323224 - DNA, 22 bp, Homo sapiens
agtgtctttgtcaaattacagg

SEQ ID NO: 8323225 - DNA, 22 bp, Homo sapiens
agtgtctttgacacattcaaag

SEQ ID NO: 8323226 - DNA, 22 bp, Homo sapiens
agtgtgaagagcagcacaaatg

SEQ ID NO: 8323227 - DNA, 22 bp, Homo sapiens
agtgtcatgaatcaaagattat

SEQ ID NO: 8323228 - DNA, 22 bp, Homo sapiens
ctctggagttctcatgaggaac

SEQ ID NO: 8323229 - DNA, 21 bp, Homo sapiens
ctctggagtttgaaggctggg

SEQ ID NO: 8323230 - DNA, 22 bp, Homo sapiens
ctctggagttagtgatctgggc

SEQ ID NO: 8323231 - DNA, 22 bp, Homo sapiens
agtggccctggagtgactcgta

SEQ ID NO: 8323232 - DNA, 22 bp, Homo sapiens
agtggcccctagggaacagcct

SEQ ID NO: 8323233 - DNA, 20 bp, Homo sapiens
agtgggtgatgaaggaatag

SEQ ID NO: 8323234 - DNA, 22 bp, Homo sapiens
agtcagcagtgaaagcacagcc

SEQ ID NO: 8323235 - DNA, 22 bp, Homo sapiens
ctatgaccccagcatgaataag

SEQ ID NO: 8323236 - DNA, 22 bp, Homo sapiens
ctatctttcgattctagcttaa

SEQ ID NO: 8323237 - DNA, 22 bp, Homo sapiens
ctatcttttgttcattttgagt

SEQ ID NO: 8323238 - DNA, 22 bp, Homo sapiens
agtcacagaatgatggctccag

SEQ ID NO: 8323239 - DNA, 22 bp, Homo sapiens
agtaaacatgtaattgttcatt

SEQ ID NO: 8323240 - DNA, 22 bp, Homo sapiens
agtaaacatttcagatttattt

SEQ ID NO: 8323241 - DNA, 22 bp, Homo sapiens
agtaaacattttcatattttct

SEQ ID NO: 8323242 - DNA, 22 bp, Homo sapiens
agtaacaaagaaagcctttgga

SEQ ID NO: 8323243 - DNA, 22 bp, Homo sapiens
agtaaataacagagaaaatggg

SEQ ID NO: 8323244 - DNA, 22 bp, Homo sapiens
agtaaaaatatgcttgtggcta

SEQ ID NO: 8323245 - DNA, 22 bp, Homo sapiens
agtaaacagtatctttagtgtc

SEQ ID NO: 8323246 - DNA, 20 bp, Homo sapiens
agtaggggaatgcaagagca

SEQ ID NO: 8323247 - DNA, 22 bp, Homo sapiens
agtagcagaaggtcttgaaggg

SEQ ID NO: 8323248 - DNA, 22 bp, Homo sapiens
agtagcatgtgcacagtaattt

SEQ ID NO: 8323249 - DNA, 22 bp, Homo sapiens
agtagcacaattttgtccctaa

SEQ ID NO: 8323250 - DNA, 22 bp, Homo sapiens
agtaacaaatagctgcctttaa

SEQ ID NO: 8323251 - DNA, 22 bp, Homo sapiens
agtagaaatgtagtgtagagaa

SEQ ID NO: 8323252 - DNA, 22 bp, Homo sapiens
agtagaaatgtaagaaggatta

SEQ ID NO: 8323253 - DNA, 22 bp, Homo sapiens
ccttccagatgtaagagctgat

SEQ ID NO: 8323254 - DNA, 22 bp, Homo sapiens
cctgtttaccactgaggggcag

SEQ ID NO: 8323255 - DNA, 22 bp, Homo sapiens
cctgtttatctatctagagatg

SEQ ID NO: 8323256 - DNA, 22 bp, Homo sapiens
cctgtgggccctggacagagac

SEQ ID NO: 8323257 - DNA, 22 bp, Homo sapiens
cctgtgggccctggacagagac

SEQ ID NO: 8323258 - DNA, 22 bp, Homo sapiens
cctgtgggcgcagctggagtca

SEQ ID NO: 8323259 - DNA, 22 bp, Homo sapiens
cctgtgggagcccaggcagata

SEQ ID NO: 8323260 - DNA, 22 bp, Homo sapiens
aggtggcagagctggcccagcg

SEQ ID NO: 8323261 - DNA, 20 bp, Homo sapiens
cctggggtacactggcatgt

SEQ ID NO: 8323262 - DNA, 22 bp, Homo sapiens
cctggggtatataggtgaatat

SEQ ID NO: 8323263 - DNA, 20 bp, Homo sapiens
cctggggtacactggcatgt

SEQ ID NO: 8323264 - DNA, 22 bp, Homo sapiens
cctgggctttgagggcaggatg

SEQ ID NO: 8323265 - DNA, 22 bp, Homo sapiens
cctggggctctgcacagagcag

SEQ ID NO: 8323266 - DNA, 22 bp, Homo sapiens
cctgggtccaccctgtgaagta

SEQ ID NO: 8323267 - DNA, 22 bp, Homo sapiens
cctggggtcagggacgctgtgc

SEQ ID NO: 8323268 - DNA, 22 bp, Homo sapiens
cctgtgggagcccaggcagata

SEQ ID NO: 8323269 - DNA, 21 bp, Homo sapiens
cctgtgccagtctatgtgttc

SEQ ID NO: 8323270 - DNA, 22 bp, Homo sapiens
aggtgcagctgacaccatgtgg

SEQ ID NO: 8323271 - DNA, 22 bp, Homo sapiens
aggtgcagcatgagtccaacgg

SEQ ID NO: 8323272 - DNA, 22 bp, Homo sapiens
cctgggaggctgtgggtctgct

SEQ ID NO: 8323273 - DNA, 21 bp, Homo sapiens
cctgggagaattgggtgtggc

SEQ ID NO: 8323274 - DNA, 22 bp, Homo sapiens
aggtcagggtattcacgtctgt

SEQ ID NO: 8323275 - DNA, 22 bp, Homo sapiens
aggtcagaaaaggagagcattg

SEQ ID NO: 8323276 - DNA, 22 bp, Homo sapiens
aggtcagaagtgccagggaatt

SEQ ID NO: 8323277 - DNA, 22 bp, Homo sapiens
aggtcagaaaaggagagcattg

SEQ ID NO: 8323278 - DNA, 22 bp, Homo sapiens
aggtcacccgtttgactatcca

SEQ ID NO: 8323279 - DNA, 22 bp, Homo sapiens
aggtcaccatggcatgctccac

SEQ ID NO: 8323280 - DNA, 22 bp, Homo sapiens
aggtcagatgggagatgggatg

SEQ ID NO: 8323281 - DNA, 22 bp, Homo sapiens
agggtgggctagactcttcccc

SEQ ID NO: 8323282 - DNA, 22 bp, Homo sapiens
agggttgcaggggccatgccca

SEQ ID NO: 8323283 - DNA, 22 bp, Homo sapiens
agggttgcagcagaggcccagt

SEQ ID NO: 8323284 - DNA, 22 bp, Homo sapiens
agggttttggctgaagttcagc

SEQ ID NO: 8323285 - DNA, 22 bp, Homo sapiens
agggttgcttgagcccaggagt

SEQ ID NO: 8323286 - DNA, 22 bp, Homo sapiens
aggtaaaatagatagtatttct

SEQ ID NO: 8323287 - DNA, 22 bp, Homo sapiens
aggtaaaatgagtctccattat

SEQ ID NO: 8323288 - DNA, 22 bp, Homo sapiens
aggtacaaaagagtatatgaga

SEQ ID NO: 8323289 - DNA, 22 bp, Homo sapiens
aggtaactggctaactgaacga

SEQ ID NO: 8323290 - DNA, 22 bp, Homo sapiens
atctgcccatctgtcctgcttc

SEQ ID NO: 8323291 - DNA, 19 bp, Homo sapiens
atctgcccaataaagatga

SEQ ID NO: 8323292 - DNA, 15 bp, Homo sapiens
atctgcccagatgct

SEQ ID NO: 8323293 - DNA, 22 bp, Homo sapiens
atctgccctggggccaaaccca

SEQ ID NO: 8323294 - DNA, 22 bp, Homo sapiens
atctgcccttgattgccctagg

SEQ ID NO: 8323295 - DNA, 22 bp, Homo sapiens
atctgccccagtgatgggccat

SEQ ID NO: 8323296 - DNA, 20 bp, Homo sapiens
agaacctaagttaaaacaca

SEQ ID NO: 8323297 - DNA, 22 bp, Homo sapiens
agaaccagtttaagatttgggt

SEQ ID NO: 8323298 - DNA, 22 bp, Homo sapiens
agaacatggattgtcaaaggta

SEQ ID NO: 8323299 - DNA, 22 bp, Homo sapiens
atcccattcccataagtggaaa

SEQ ID NO: 8323300 - DNA, 22 bp, Homo sapiens
atccccagaaaataggtgccta

SEQ ID NO: 8323301 - DNA, 22 bp, Homo sapiens
agaacatatctgttttctaact

SEQ ID NO: 8323302 - DNA, 22 bp, Homo sapiens
agaacagtgctgataaatcata

SEQ ID NO: 8323303 - DNA, 22 bp, Homo sapiens
agaaagccttatgtacagaggc

SEQ ID NO: 8323304 - DNA, 22 bp, Homo sapiens
atcaaaatgctccagtgatggt

SEQ ID NO: 8323305 - DNA, 22 bp, Homo sapiens
agaaagattttcaacaggaggt

SEQ ID NO: 8323306 - DNA, 22 bp, Homo sapiens
atcaaaacttctttagagttta

SEQ ID NO: 8323307 - DNA, 22 bp, Homo sapiens
atatttctccaaatgttttcaa

SEQ ID NO: 8323308 - DNA, 22 bp, Homo sapiens
agaaaaactaagagtgggtggt

SEQ ID NO: 8323309 - DNA, 21 bp, Homo sapiens
atatttttgtttggactgtca

SEQ ID NO: 8323310 - DNA, 22 bp, Homo sapiens
atatttttccatgtgggactct

SEQ ID NO: 8323311 - DNA, 22 bp, Homo sapiens
actttttacagggtgtatacca

SEQ ID NO: 8323312 - DNA, 22 bp, Homo sapiens
acttttcccttggtagagttgc

SEQ ID NO: 8323313 - DNA, 22 bp, Homo sapiens
actttttctcagaaggattggt

SEQ ID NO: 8323314 - DNA, 21 bp, Homo sapiens
agaaaaacacgatataagccc

SEQ ID NO: 8323315 - DNA, 21 bp, Homo sapiens
agaaaaaccagcatgttttca

SEQ ID NO: 8323316 - DNA, 23 bp, Homo sapiens
agaaaaacaggattgtgttccta

SEQ ID NO: 8323317 - DNA, 18 bp, Homo sapiens
agtttttaggaagaaatg

SEQ ID NO: 8323318 - DNA, 22 bp, Homo sapiens
agttttatgtagacaattcatt

SEQ ID NO: 8323319 - DNA, 23 bp, Homo sapiens
agtttttaatggtcatagctgag

SEQ ID NO: 8323320 - DNA, 22 bp, Homo sapiens
actgttgtcaggctgctttgga

SEQ ID NO: 8323321 - DNA, 22 bp, Homo sapiens
agttttatgcagtgttctgata

SEQ ID NO: 8323322 - DNA, 22 bp, Homo sapiens
agttttatggctcaacctaata

SEQ ID NO: 8323323 - DNA, 22 bp, Homo sapiens
agttttatggctcaacctaata

SEQ ID NO: 8323324 - DNA, 22 bp, Homo sapiens
agttttatctgtaagctgttca

SEQ ID NO: 8323325 - DNA, 22 bp, Homo sapiens
agttttataaaggcacctcagt

SEQ ID NO: 8323326 - DNA, 22 bp, Homo sapiens
agttttatatcttccattggtt

SEQ ID NO: 8323327 - DNA, 21 bp, Homo sapiens
agttttatattataagctaaa

SEQ ID NO: 8323328 - DNA, 21 bp, Homo sapiens
agttttatattataagctaaa

SEQ ID NO: 8323329 - DNA, 22 bp, Homo sapiens
ataaagttctgctggcatatat

SEQ ID NO: 8323330 - DNA, 22 bp, Homo sapiens
ataaagtggaggtagtattcat

SEQ ID NO: 8323331 - DNA, 22 bp, Homo sapiens
ataaagtttaaaagtcaatagt

SEQ ID NO: 8323332 - DNA, 22 bp, Homo sapiens
ataaagtttaaaagtcaatagt

SEQ ID NO: 8323333 - DNA, 22 bp, Homo sapiens
acttaaaaacagatccagcagg

SEQ ID NO: 8323334 - DNA, 22 bp, Homo sapiens
acttaaaaccagacagcgtcat

SEQ ID NO: 8323335 - DNA, 18 bp, Homo sapiens
ataaagtgctaataatgg

SEQ ID NO: 8323336 - DNA, 18 bp, Homo sapiens
ataaagtgctaataatgg

SEQ ID NO: 8323337 - DNA, 22 bp, Homo sapiens
actttgctgcaggtttaaagag

SEQ ID NO: 8323338 - DNA, 22 bp, Homo sapiens
actttgctcatattgagtttct

SEQ ID NO: 8323339 - DNA, 22 bp, Homo sapiens
actttgtgcccaacagaaagaa

SEQ ID NO: 8323340 - DNA, 23 bp, Homo sapiens
acttttcaattagctatgcttaa

SEQ ID NO: 8323341 - DNA, 22 bp, Homo sapiens
atagatatttgagttgtttcca

SEQ ID NO: 8323342 - DNA, 22 bp, Homo sapiens
atacaaaaattagccgggagta

SEQ ID NO: 8323343 - DNA, 22 bp, Homo sapiens
atacaaaaattagccgggagta

SEQ ID NO: 8323344 - DNA, 22 bp, Homo sapiens
atacaaaatatatactggagac

SEQ ID NO: 8323345 - DNA, 22 bp, Homo sapiens
atacaaaatatatactggagac

SEQ ID NO: 8323346 - DNA, 21 bp, Homo sapiens
actttaatatacatgaggagg

SEQ ID NO: 8323347 - DNA, 22 bp, Homo sapiens
agtgtctaaactggcttcctgg

SEQ ID NO: 8323348 - DNA, 21 bp, Homo sapiens
actggctggtggctaagaatc

SEQ ID NO: 8323349 - DNA, 21 bp, Homo sapiens
actggctggtggctaagaatc

SEQ ID NO: 8323350 - DNA, 21 bp, Homo sapiens
actggctgtcttcctactggt

SEQ ID NO: 8323351 - DNA, 22 bp, Homo sapiens
actggctgtgcagagggcagta

SEQ ID NO: 8323352 - DNA, 22 bp, Homo sapiens
actgccctccagcctgggtgac

SEQ ID NO: 8323353 - DNA, 22 bp, Homo sapiens
actgcccttgtcctggcacacc

SEQ ID NO: 8323354 - DNA, 22 bp, Homo sapiens
actgccctgtaactgccaggta

SEQ ID NO: 8323355 - DNA, 20 bp, Homo sapiens
actggctgcctggaatgcgc

SEQ ID NO: 8323356 - DNA, 22 bp, Homo sapiens
actggctggactctgacctctt

SEQ ID NO: 8323357 - DNA, 22 bp, Homo sapiens
actggctgcgttcctgtgagac

SEQ ID NO: 8323358 - DNA, 21 bp, Homo sapiens
actggccaccactggcagggg

SEQ ID NO: 8323359 - DNA, 22 bp, Homo sapiens
actggctgatcacctgcctcag

SEQ ID NO: 8323360 - DNA, 22 bp, Homo sapiens
actggctgcctccaaagtgtgc

SEQ ID NO: 8323361 - DNA, 22 bp, Homo sapiens
actgagcatggctcacagagag

SEQ ID NO: 8323362 - DNA, 23 bp, Homo sapiens
actgagcattagtatttttataa

SEQ ID NO: 8323363 - DNA, 22 bp, Homo sapiens
actgagcataaatatgtgtcca

SEQ ID NO: 8323364 - DNA, 22 bp, Homo sapiens
actgagcaagtgctgctcacgt

SEQ ID NO: 8323365 - DNA, 22 bp, Homo sapiens
actctgccacataaaggtagat

SEQ ID NO: 8323366 - DNA, 21 bp, Homo sapiens
actctgccagtctcctgcact

SEQ ID NO: 8323367 - DNA, 22 bp, Homo sapiens
actctgccatcccaggtgctgt

SEQ ID NO: 8323368 - DNA, 22 bp, Homo sapiens
actctgccccgagttctgggaa

SEQ ID NO: 8323369 - DNA, 22 bp, Homo sapiens
actctgcctgaacctcctgcaa

SEQ ID NO: 8323370 - DNA, 22 bp, Homo sapiens
actctgccctaggcctctgggg

SEQ ID NO: 8323371 - DNA, 22 bp, Homo sapiens
actctgccttggtgtcacaaga

SEQ ID NO: 8323372 - DNA, 22 bp, Homo sapiens
actctgcctttcagcagatgaa

SEQ ID NO: 8323373 - DNA, 22 bp, Homo sapiens
actctgcctgcggtgggcggga

SEQ ID NO: 8323374 - DNA, 22 bp, Homo sapiens
actctgccttagtcctggggct

SEQ ID NO: 8323375 - DNA, 22 bp, Homo sapiens
actctgcctggaggtaacagga

SEQ ID NO: 8323376 - DNA, 22 bp, Homo sapiens
actctgccttagtcctggggct

SEQ ID NO: 8323377 - DNA, 22 bp, Homo sapiens
actctgctaaatgtaagttggt

SEQ ID NO: 8323378 - DNA, 22 bp, Homo sapiens
agtgctctctccccagtgctac

SEQ ID NO: 8323379 - DNA, 22 bp, Homo sapiens
actgcacttcaccctgggtgac

SEQ ID NO: 8323380 - DNA, 20 bp, Homo sapiens
agtgaatagagacattgccc

SEQ ID NO: 8323381 - DNA, 22 bp, Homo sapiens
actgcactccagcctgggtgat

SEQ ID NO: 8323382 - DNA, 22 bp, Homo sapiens
actcctggaaaagaacgcaggg

SEQ ID NO: 8323383 - DNA, 22 bp, Homo sapiens
actcctggggatccattccttt

SEQ ID NO: 8323384 - DNA, 22 bp, Homo sapiens
actcctggggctgccatcacag

SEQ ID NO: 8323385 - DNA, 22 bp, Homo sapiens
actcctgggtgcatttctgatt

SEQ ID NO: 8323386 - DNA, 22 bp, Homo sapiens
actcctgggtgctgaccagcgt

SEQ ID NO: 8323387 - DNA, 22 bp, Homo sapiens
actctctgtgatggaggccagc

SEQ ID NO: 8323388 - DNA, 22 bp, Homo sapiens
actctctgtggttctactttgc

SEQ ID NO: 8323389 - DNA, 22 bp, Homo sapiens
actctctgtctaaatgcagttt

SEQ ID NO: 8323390 - DNA, 22 bp, Homo sapiens
actctctggtattggcaagttt

SEQ ID NO: 8323391 - DNA, 22 bp, Homo sapiens
actctctgggcatgccccacca

SEQ ID NO: 8323392 - DNA, 22 bp, Homo sapiens
actctctggtgtagaaagacct

SEQ ID NO: 8323393 - DNA, 22 bp, Homo sapiens
actctctgagctaccaggtgag

SEQ ID NO: 8323394 - DNA, 22 bp, Homo sapiens
agtaataatagctgtaaagtgc

SEQ ID NO: 8323395 - DNA, 22 bp, Homo sapiens
agtagaaagaaggcactgggcc

SEQ ID NO: 8323396 - DNA, 22 bp, Homo sapiens
agtagtgtacatctgttgattt

SEQ ID NO: 8323397 - DNA, 22 bp, Homo sapiens
agtagaaagttgcaggaggaat

SEQ ID NO: 8323398 - DNA, 20 bp, Homo sapiens
agtaccttttgtatgttacc

SEQ ID NO: 8323399 - DNA, 22 bp, Homo sapiens
agtagtgtgacaattaatattt

SEQ ID NO: 8323400 - DNA, 22 bp, Homo sapiens
agtagtttgggcagtgacagat

SEQ ID NO: 8323401 - DNA, 22 bp, Homo sapiens
actactagtggctacaataatg

SEQ ID NO: 8323402 - DNA, 22 bp, Homo sapiens
accttttatgtaaatatatgtt

SEQ ID NO: 8323403 - DNA, 22 bp, Homo sapiens
acgaataaatctatttcacaca

SEQ ID NO: 8323404 - DNA, 22 bp, Homo sapiens
aggtcttggtaggccagagtct

SEQ ID NO: 8323405 - DNA, 22 bp, Homo sapiens
aggtatttcaaagcccacttcc

SEQ ID NO: 8323406 - DNA, 22 bp, Homo sapiens
acctttcagtgccctttctgtc

SEQ ID NO: 8323407 - DNA, 22 bp, Homo sapiens
acctttcattaaagtctgtagt

SEQ ID NO: 8323408 - DNA, 22 bp, Homo sapiens
acctttcaggtagtggtgagga

SEQ ID NO: 8323409 - DNA, 20 bp, Homo sapiens
acctttcaaatgattcagca

SEQ ID NO: 8323410 - DNA, 22 bp, Homo sapiens
acctttcacctcccatcctgtt

SEQ ID NO: 8323411 - DNA, 22 bp, Homo sapiens
acctttcacggtatcagacatc

SEQ ID NO: 8323412 - DNA, 22 bp, Homo sapiens
acctttcacggtatcagacatc

SEQ ID NO: 8323413 - DNA, 22 bp, Homo sapiens
acctttcaaagtggctatcact

SEQ ID NO: 8323414 - DNA, 22 bp, Homo sapiens
acctttatgtttgattacaatt

SEQ ID NO: 8323415 - DNA, 21 bp, Homo sapiens
accttctgaattacctaccaa

SEQ ID NO: 8323416 - DNA, 22 bp, Homo sapiens
aggtccaggatttgtggggtct

SEQ ID NO: 8323417 - DNA, 22 bp, Homo sapiens
aggtccaggcatttgggttggg

SEQ ID NO: 8323418 - DNA, 22 bp, Homo sapiens
aggtccaggcctcatgatggcc

SEQ ID NO: 8323419 - DNA, 22 bp, Homo sapiens
aggtccagagttgagatacaga

SEQ ID NO: 8323420 - DNA, 18 bp, Homo sapiens
acccattatatttgtagc

SEQ ID NO: 8323421 - DNA, 22 bp, Homo sapiens
acccagggtagagtgcagtggc

SEQ ID NO: 8323422 - DNA, 22 bp, Homo sapiens
acccagagcacagatgcaacgt

SEQ ID NO: 8323423 - DNA, 22 bp, Homo sapiens
acccagggttcctgggtcccag

SEQ ID NO: 8323424 - DNA, 22 bp, Homo sapiens
acccagggtttgagctctgcag

SEQ ID NO: 8323425 - DNA, 22 bp, Homo sapiens
acccagagaactgaggcatgaa

SEQ ID NO: 8323426 - DNA, 22 bp, Homo sapiens
acccacagccgctgtgcgtccc

SEQ ID NO: 8323427 - DNA, 22 bp, Homo sapiens
acccaccctactagcagtgtcc

SEQ ID NO: 8323428 - DNA, 22 bp, Homo sapiens
accagttttttatacatcttct

SEQ ID NO: 8323429 - DNA, 21 bp, Homo sapiens
accagtttggggggcttcctg

SEQ ID NO: 8323430 - DNA, 22 bp, Homo sapiens
accagtttgtaacctgttttca

SEQ ID NO: 8323431 - DNA, 22 bp, Homo sapiens
accagtttaataactgctcaag

SEQ ID NO: 8323432 - DNA, 22 bp, Homo sapiens
accagtttatagcgatctgtca

SEQ ID NO: 8323433 - DNA, 22 bp, Homo sapiens
accagtttctgggggaggttgg

SEQ ID NO: 8323434 - DNA, 22 bp, Homo sapiens
accagggcttacagcagtagct

SEQ ID NO: 8323435 - DNA, 22 bp, Homo sapiens
accaggctgtgaagtgagacta

SEQ ID NO: 8323436 - DNA, 22 bp, Homo sapiens
accaggctgttgggcccagtgt

SEQ ID NO: 8323437 - DNA, 22 bp, Homo sapiens
accaggagtaacagtgagtggt

SEQ ID NO: 8323438 - DNA, 22 bp, Homo sapiens
accaggagggaccctggtggcc

SEQ ID NO: 8323439 - DNA, 22 bp, Homo sapiens
accaggaggaagtgttaatgat

SEQ ID NO: 8323440 - DNA, 20 bp, Homo sapiens
accaggagatggaggcaggg

SEQ ID NO: 8323441 - DNA, 22 bp, Homo sapiens
accaggagccacaggaggagcc

SEQ ID NO: 8323442 - DNA, 22 bp, Homo sapiens
aggccagcattctctctccagg

SEQ ID NO: 8323443 - DNA, 22 bp, Homo sapiens
aggccagcagacgtgggactga

SEQ ID NO: 8323444 - DNA, 22 bp, Homo sapiens
aggcccagggctgctctctgaa

SEQ ID NO: 8323445 - DNA, 23 bp, Homo sapiens
aggcccaggtatgtttgttttgg

SEQ ID NO: 8323446 - DNA, 21 bp, Homo sapiens
aggcccaggaatatgcatttt

SEQ ID NO: 8323447 - DNA, 21 bp, Homo sapiens
aggcccagctttcctcttgct

SEQ ID NO: 8323448 - DNA, 22 bp, Homo sapiens
aggcccagcttgaagtgggaag

SEQ ID NO: 8323449 - DNA, 22 bp, Homo sapiens
aggcccagcttgaagtgggaag

SEQ ID NO: 8323450 - DNA, 22 bp, Homo sapiens
aggccacaggattgcacagcat

SEQ ID NO: 8323451 - DNA, 22 bp, Homo sapiens
acatacatgggattaaaaaatt

SEQ ID NO: 8323452 - DNA, 22 bp, Homo sapiens
acatacatgggattaaaaaatt

SEQ ID NO: 8323453 - DNA, 22 bp, Homo sapiens
aggctccaggcaaaatttcgga

SEQ ID NO: 8323454 - DNA, 22 bp, Homo sapiens
aggctgtgcaattagggtaaga

SEQ ID NO: 8323455 - DNA, 19 bp, Homo sapiens
acattgaattttcttcttt

SEQ ID NO: 8323456 - DNA, 22 bp, Homo sapiens
aggccctgcaggaagcaggatg

SEQ ID NO: 8323457 - DNA, 21 bp, Homo sapiens
aggattttgttgaagtttctg

SEQ ID NO: 8323458 - DNA, 21 bp, Homo sapiens
aggaggggtctttcccactga

SEQ ID NO: 8323459 - DNA, 22 bp, Homo sapiens
aggaggggttctcgggtgctga

SEQ ID NO: 8323460 - DNA, 22 bp, Homo sapiens
aggaggggttctcgggtgctga

SEQ ID NO: 8323461 - DNA, 22 bp, Homo sapiens
aggaggggttctcgggtgctga

SEQ ID NO: 8323462 - DNA, 22 bp, Homo sapiens
aggaggggttctcgggtgctga

SEQ ID NO: 8323463 - DNA, 22 bp, Homo sapiens
aggaggctgtggagcactccat

SEQ ID NO: 8323464 - DNA, 22 bp, Homo sapiens
aggaggccgatttcagaggtcg

SEQ ID NO: 8323465 - DNA, 22 bp, Homo sapiens
aggaggcttttgcaggtgccac

SEQ ID NO: 8323466 - DNA, 22 bp, Homo sapiens
aggaggcttttgcaggtgccac

SEQ ID NO: 8323467 - DNA, 20 bp, Homo sapiens
aggagggacctggattggcg

SEQ ID NO: 8323468 - DNA, 22 bp, Homo sapiens
aggagggagatgcccatcctgg

SEQ ID NO: 8323469 - DNA, 22 bp, Homo sapiens
aggaggggcatagaaatgtaat

SEQ ID NO: 8323470 - DNA, 22 bp, Homo sapiens
aggaggggcatagaaatgtaat

SEQ ID NO: 8323471 - DNA, 22 bp, Homo sapiens
aggcacagatttggggaaagca

SEQ ID NO: 8323472 - DNA, 22 bp, Homo sapiens
aggcacaagaaactgctcccca

SEQ ID NO: 8323473 - DNA, 22 bp, Homo sapiens
acagggggtcccatggcctgga

SEQ ID NO: 8323474 - DNA, 22 bp, Homo sapiens
acagggtggggatggtgagctt

SEQ ID NO: 8323475 - DNA, 22 bp, Homo sapiens
acagggtgaatgtgacattatc

SEQ ID NO: 8323476 - DNA, 22 bp, Homo sapiens
acagggtgactttgtgacagat

SEQ ID NO: 8323477 - DNA, 23 bp, Homo sapiens
aggagccatgagttggatatgtt

SEQ ID NO: 8323478 - DNA, 22 bp, Homo sapiens
aggagcccctcttcagtcctgg

SEQ ID NO: 8323479 - DNA, 22 bp, Homo sapiens
aggagctgcaaaaccggccgct

SEQ ID NO: 8323480 - DNA, 22 bp, Homo sapiens
aggagacagccaggggcctgag

SEQ ID NO: 8323481 - DNA, 20 bp, Homo sapiens
aggaaggctgttggccttgc

SEQ ID NO: 8323482 - DNA, 22 bp, Homo sapiens
aggaaaaaagtctgtgattata

SEQ ID NO: 8323483 - DNA, 23 bp, Homo sapiens
agcttcatcttgctgtgtctcag

SEQ ID NO: 8323484 - DNA, 22 bp, Homo sapiens
agcttcatgcctaaagacagcg

SEQ ID NO: 8323485 - DNA, 23 bp, Homo sapiens
agcttcattattttccatgatct

SEQ ID NO: 8323486 - DNA, 22 bp, Homo sapiens
agctttggtgctgtcacacaaa

SEQ ID NO: 8323487 - DNA, 22 bp, Homo sapiens
aggaagagcattcacatggtag

SEQ ID NO: 8323488 - DNA, 22 bp, Homo sapiens
agctggttcactaagcataata

SEQ ID NO: 8323489 - DNA, 21 bp, Homo sapiens
agctggctctctctggagaga

SEQ ID NO: 8323490 - DNA, 22 bp, Homo sapiens
agctggctcagccgggtggtct

SEQ ID NO: 8323491 - DNA, 21 bp, Homo sapiens
agctggctatagttagtgatg

SEQ ID NO: 8323492 - DNA, 22 bp, Homo sapiens
agctggcagctctcaggggtac

SEQ ID NO: 8323493 - DNA, 22 bp, Homo sapiens
agctgctgtggccacatctggc

SEQ ID NO: 8323494 - DNA, 22 bp, Homo sapiens
acagcccagctctttctctgca

SEQ ID NO: 8323495 - DNA, 22 bp, Homo sapiens
agctccaggtgcaagtcatggt

SEQ ID NO: 8323496 - DNA, 22 bp, Homo sapiens
agctccagttacttacctagag

SEQ ID NO: 8323497 - DNA, 22 bp, Homo sapiens
atgcctggtcccacctctaggt

SEQ ID NO: 8323498 - DNA, 22 bp, Homo sapiens
agactctgattccctcatgtca

SEQ ID NO: 8323499 - DNA, 19 bp, Homo sapiens
agactctgccactcttctc

SEQ ID NO: 8323500 - DNA, 22 bp, Homo sapiens
agactctgcatttctaataagc

SEQ ID NO: 8323501 - DNA, 22 bp, Homo sapiens
agacctggagtgaagagttccc

SEQ ID NO: 8323502 - DNA, 22 bp, Homo sapiens
atgccacataaccagttcactt

SEQ ID NO: 8323503 - DNA, 22 bp, Homo sapiens
atgccaaatttctttctgttct

SEQ ID NO: 8323504 - DNA, 22 bp, Homo sapiens
atgccaaattctactttcagca

SEQ ID NO: 8323505 - DNA, 22 bp, Homo sapiens
atgatacatttacctatggtct

SEQ ID NO: 8323506 - DNA, 22 bp, Homo sapiens
agacagacagagaatttaaata

SEQ ID NO: 8323507 - DNA, 18 bp, Homo sapiens
agacagacaggtttgtgc

SEQ ID NO: 8323508 - DNA, 22 bp, Homo sapiens
agacagacatagaaattagtaa

SEQ ID NO: 8323509 - DNA, 15 bp, Homo sapiens
agacagacagtggga

SEQ ID NO: 8323510 - DNA, 22 bp, Homo sapiens
agacagacaaaattcctgcctg

SEQ ID NO: 8323511 - DNA, 22 bp, Homo sapiens
agacagacacatggtaacagat

SEQ ID NO: 8323512 - DNA, 22 bp, Homo sapiens
atgccaaaatgttacatttctt

SEQ ID NO: 8323513 - DNA, 22 bp, Homo sapiens
atgccaaagatgtttgatagaa

SEQ ID NO: 8323514 - DNA, 21 bp, Homo sapiens
atgccaaacttcttctgccct

SEQ ID NO: 8323515 - DNA, 22 bp, Homo sapiens
atgccaaagcccaagttcatca

SEQ ID NO: 8323516 - DNA, 22 bp, Homo sapiens
atgccaaagggagcactttggg

SEQ ID NO: 8323517 - DNA, 22 bp, Homo sapiens
atgccaaattctcagcctcttt

SEQ ID NO: 8323518 - DNA, 22 bp, Homo sapiens
agacaaatttcctgcaatgaag

SEQ ID NO: 8323519 - DNA, 22 bp, Homo sapiens
agacaaggaatgtagcttactc

SEQ ID NO: 8323520 - DNA, 22 bp, Homo sapiens
agacaaggcaaggcggccagat

SEQ ID NO: 8323521 - DNA, 22 bp, Homo sapiens
agacaaggcccccttgggctct

SEQ ID NO: 8323522 - DNA, 22 bp, Homo sapiens
atgagggaggcaaggagatgct

SEQ ID NO: 8323523 - DNA, 22 bp, Homo sapiens
atgaggcctatcttggcagagg

SEQ ID NO: 8323524 - DNA, 22 bp, Homo sapiens
atgaggcccaggaatctgtatt

SEQ ID NO: 8323525 - DNA, 22 bp, Homo sapiens
atgaggcccaaacattacaaat

SEQ ID NO: 8323526 - DNA, 22 bp, Homo sapiens
atgaggccatggctgtcactaa

SEQ ID NO: 8323527 - DNA, 22 bp, Homo sapiens
agaatattgaaagttcttgaca

SEQ ID NO: 8323528 - DNA, 22 bp, Homo sapiens
atgaggccagaccactctgcat

SEQ ID NO: 8323529 - DNA, 20 bp, Homo sapiens
atgaggccagcagggctcag

SEQ ID NO: 8323530 - DNA, 20 bp, Homo sapiens
atgaggccagcagggctcag

SEQ ID NO: 8323531 - DNA, 22 bp, Homo sapiens
atgaggccagggtgccatgaaa

SEQ ID NO: 8323532 - DNA, 22 bp, Homo sapiens
atgaaggacaacaggggagcag

SEQ ID NO: 8323533 - DNA, 22 bp, Homo sapiens
atgaagttccagtatatgcagt

SEQ ID NO: 8323534 - DNA, 22 bp, Homo sapiens
atgaagttctagtgagaaatgc

SEQ ID NO: 8323535 - DNA, 22 bp, Homo sapiens
atgaagttctcaataatcatgt

SEQ ID NO: 8323536 - DNA, 22 bp, Homo sapiens
agaatatagttaccaaattctg

SEQ ID NO: 8323537 - DNA, 22 bp, Homo sapiens
atctgcttagaattcattgtcc

SEQ ID NO: 8323538 - DNA, 22 bp, Homo sapiens
agagagggaatatttggggtat

SEQ ID NO: 8323539 - DNA, 22 bp, Homo sapiens
agagagggaatatttggggtat

SEQ ID NO: 8323540 - DNA, 19 bp, Homo sapiens
agagaggctgtgtgaggga

SEQ ID NO: 8323541 - DNA, 21 bp, Homo sapiens
agagagggagatgaaacatcc

SEQ ID NO: 8323542 - DNA, 22 bp, Homo sapiens
agagaggctgctggactatatg

SEQ ID NO: 8323543 - DNA, 22 bp, Homo sapiens
agagaggcattcggtgatccca

SEQ ID NO: 8323544 - DNA, 22 bp, Homo sapiens
agagagcagtggatcacctagc

SEQ ID NO: 8323545 - DNA, 22 bp, Homo sapiens
agagacagacacatcgggctgc

SEQ ID NO: 8323546 - DNA, 22 bp, Homo sapiens
agagaagggtgtagcctgggcc

SEQ ID NO: 8323547 - DNA, 22 bp, Homo sapiens
agagaatacaaagaagatatgt

SEQ ID NO: 8323548 - DNA, 22 bp, Homo sapiens
agagaatacagggtaacaggaa

SEQ ID NO: 8323549 - DNA, 22 bp, Homo sapiens
agagctggccagggatcactct

SEQ ID NO: 8323550 - DNA, 21 bp, Homo sapiens
agagctggcctgccaggccct

SEQ ID NO: 8323551 - DNA, 21 bp, Homo sapiens
agagctggcctgccaggccct

SEQ ID NO: 8323552 - DNA, 22 bp, Homo sapiens
agagctggctgctgcggtgctt

SEQ ID NO: 8323553 - DNA, 22 bp, Homo sapiens
agagctggatggtcaagatggc

SEQ ID NO: 8323554 - DNA, 22 bp, Homo sapiens
agagctggcagcagcttctcct

SEQ ID NO: 8323555 - DNA, 22 bp, Homo sapiens
agagccctgtggttctggtaag

SEQ ID NO: 8323556 - DNA, 22 bp, Homo sapiens
agagcctgaggccctgagaggg

SEQ ID NO: 8323557 - DNA, 22 bp, Homo sapiens
agagcctgagcctgaaagccct

SEQ ID NO: 8323558 - DNA, 21 bp, Homo sapiens
agagcctgagatcttccagca

SEQ ID NO: 8323559 - DNA, 22 bp, Homo sapiens
agagattgtgctactcacccaa

SEQ ID NO: 8323560 - DNA, 22 bp, Homo sapiens
agagcacagggttttgtgccgg

SEQ ID NO: 8323561 - DNA, 22 bp, Homo sapiens
agaggccagcagtgcctatctg

SEQ ID NO: 8323562 - DNA, 23 bp, Homo sapiens
agaggccagcctttggagacacc

SEQ ID NO: 8323563 - DNA, 22 bp, Homo sapiens
agaggccagcaaccacagtaaa

SEQ ID NO: 8323564 - DNA, 22 bp, Homo sapiens
agaggccacaccagcctcccgt

SEQ ID NO: 8323565 - DNA, 23 bp, Homo sapiens
agaggcaggagtggcttgcccgg

SEQ ID NO: 8323566 - DNA, 22 bp, Homo sapiens
agaggctggattgagcatagac

SEQ ID NO: 8323567 - DNA, 18 bp, Homo sapiens
agaggctggacaggggat

SEQ ID NO: 8323568 - DNA, 18 bp, Homo sapiens
agaggctggacaggggat

SEQ ID NO: 8323569 - DNA, 22 bp, Homo sapiens
agaggctgcacttgctcatgat

SEQ ID NO: 8323570 - DNA, 22 bp, Homo sapiens
agaggctgcacttgctcatgat

SEQ ID NO: 8323571 - DNA, 22 bp, Homo sapiens
agagctggctgtgggtgacttt

SEQ ID NO: 8323572 - DNA, 22 bp, Homo sapiens
agaggcacaacagtcccattgt

SEQ ID NO: 8323573 - DNA, 22 bp, Homo sapiens
attacacaggctggctctttga

SEQ ID NO: 8323574 - DNA, 22 bp, Homo sapiens
attacacatagacattcgttca

SEQ ID NO: 8323575 - DNA, 22 bp, Homo sapiens
agaggctgggcaggacccacag

SEQ ID NO: 8323576 - DNA, 22 bp, Homo sapiens
agaggctgggtacgggccacct

SEQ ID NO: 8323577 - DNA, 22 bp, Homo sapiens
agaggctgggtacgggccacct

SEQ ID NO: 8323578 - DNA, 22 bp, Homo sapiens
agaggctgggtacgggccacct

SEQ ID NO: 8323579 - DNA, 22 bp, Homo sapiens
agaggctgggtacgggccacct

SEQ ID NO: 8323580 - DNA, 22 bp, Homo sapiens
agagggctgggatgtgctgtgt

SEQ ID NO: 8323581 - DNA, 22 bp, Homo sapiens
agagggctggacgcaggttgga

SEQ ID NO: 8323582 - DNA, 22 bp, Homo sapiens
agagggcttccctaggagtgag

SEQ ID NO: 8323583 - DNA, 22 bp, Homo sapiens
agagggcttccctaggagtgag

SEQ ID NO: 8323584 - DNA, 22 bp, Homo sapiens
agaggggaggcgaaccagagtc

SEQ ID NO: 8323585 - DNA, 23 bp, Homo sapiens
agaggggagcatctgctggctga

SEQ ID NO: 8323586 - DNA, 23 bp, Homo sapiens
agaggggagcatctgctggctga

SEQ ID NO: 8323587 - DNA, 23 bp, Homo sapiens
agaggggagcatctgctggctga

SEQ ID NO: 8323588 - DNA, 22 bp, Homo sapiens
agaggggacagccacctgcccg

SEQ ID NO: 8323589 - DNA, 22 bp, Homo sapiens
agaggggcaagtaaagagtctt

SEQ ID NO: 8323590 - DNA, 22 bp, Homo sapiens
agaggggcgggaactcaacctc

SEQ ID NO: 8323591 - DNA, 22 bp, Homo sapiens
agaggggcccggttctccgtct

SEQ ID NO: 8323592 - DNA, 22 bp, Homo sapiens
agaggggctcaagcagtggtct

SEQ ID NO: 8323593 - DNA, 18 bp, Homo sapiens
agagtccagggtgaggtg

SEQ ID NO: 8323594 - DNA, 22 bp, Homo sapiens
agagtccatgaagacagctgag

SEQ ID NO: 8323595 - DNA, 22 bp, Homo sapiens
agagtatgcatctattgtacct

SEQ ID NO: 8323596 - DNA, 22 bp, Homo sapiens
agagtccaccctggggtcaggc

SEQ ID NO: 8323597 - DNA, 22 bp, Homo sapiens
agagtccaaatgtgcagttatg

SEQ ID NO: 8323598 - DNA, 22 bp, Homo sapiens
caaagataatcacagaataccc

SEQ ID NO: 8323599 - DNA, 22 bp, Homo sapiens
caaagcaagggctgaagactcc

SEQ ID NO: 8323600 - DNA, 22 bp, Homo sapiens
attttatccccactggattaca

SEQ ID NO: 8323601 - DNA, 22 bp, Homo sapiens
agatgggccttcgagcatgccc

SEQ ID NO: 8323602 - DNA, 22 bp, Homo sapiens
agatcactttgatgctacctgg

SEQ ID NO: 8323603 - DNA, 22 bp, Homo sapiens
agatcactggttacttaatgaa

SEQ ID NO: 8323604 - DNA, 22 bp, Homo sapiens
agatcatttggcagaagcaacg

SEQ ID NO: 8323605 - DNA, 22 bp, Homo sapiens
agatcactgaattgaaagtaat

SEQ ID NO: 8323606 - DNA, 22 bp, Homo sapiens
agatatttaaatcagacaaaga

SEQ ID NO: 8323607 - DNA, 22 bp, Homo sapiens
attggtagttttgtatttctct

SEQ ID NO: 8323608 - DNA, 21 bp, Homo sapiens
agatagttgggcatgcagctg

SEQ ID NO: 8323609 - DNA, 22 bp, Homo sapiens
attggccatttgcatgtattat

SEQ ID NO: 8323610 - DNA, 22 bp, Homo sapiens
agcagggcagctgatgcgcacg

SEQ ID NO: 8323611 - DNA, 22 bp, Homo sapiens
agcagggcactggaaggcactg

SEQ ID NO: 8323612 - DNA, 22 bp, Homo sapiens
agcagggcaaagtcaggctaac

SEQ ID NO: 8323613 - DNA, 22 bp, Homo sapiens
agcagggcagtgatcagaaagg

SEQ ID NO: 8323614 - DNA, 23 bp, Homo sapiens
caccactttctccttctccttgg

SEQ ID NO: 8323615 - DNA, 22 bp, Homo sapiens
agcagggctctgccatgggccc

SEQ ID NO: 8323616 - DNA, 22 bp, Homo sapiens
agcaggaactgacaccaagcca

SEQ ID NO: 8323617 - DNA, 22 bp, Homo sapiens
agcaggaagtcctctcaggaga

SEQ ID NO: 8323618 - DNA, 22 bp, Homo sapiens
cacagcagacagggaggcggct

SEQ ID NO: 8323619 - DNA, 22 bp, Homo sapiens
agcagggaggtctagcacgtgg

SEQ ID NO: 8323620 - DNA, 22 bp, Homo sapiens
agcagggaggcccagggcactg

SEQ ID NO: 8323621 - DNA, 21 bp, Homo sapiens
agcagtgctcctgggatgagg

SEQ ID NO: 8323622 - DNA, 22 bp, Homo sapiens
agcatattgtatgtctatatgt

SEQ ID NO: 8323623 - DNA, 23 bp, Homo sapiens
agcagtaacttcagaaacatcag

SEQ ID NO: 8323624 - DNA, 22 bp, Homo sapiens
agcagggctggatttggcaaga

SEQ ID NO: 8323625 - DNA, 22 bp, Homo sapiens
agcattaataagaaatggctcc

SEQ ID NO: 8323626 - DNA, 22 bp, Homo sapiens
agcattaataagaaatggctcc

SEQ ID NO: 8323627 - DNA, 22 bp, Homo sapiens
cactgttttacatgttatttaa

SEQ ID NO: 8323628 - DNA, 22 bp, Homo sapiens
cactgttcacattttagtctat

SEQ ID NO: 8323629 - DNA, 22 bp, Homo sapiens
agcatggggcaatgcatgtgct

SEQ ID NO: 8323630 - DNA, 22 bp, Homo sapiens
agcattaagcctggctcagagg

SEQ ID NO: 8323631 - DNA, 22 bp, Homo sapiens
agcattaagagagactgaactg

SEQ ID NO: 8323632 - DNA, 22 bp, Homo sapiens
cacagagcaggtgctgggaaga

SEQ ID NO: 8323633 - DNA, 22 bp, Homo sapiens
cacagaacatttttagatgcag

SEQ ID NO: 8323634 - DNA, 21 bp, Homo sapiens
cacagagatattggtgagcct

SEQ ID NO: 8323635 - DNA, 22 bp, Homo sapiens
agcagccagagaatgatgcagt

SEQ ID NO: 8323636 - DNA, 22 bp, Homo sapiens
agcagcctcccagggagcagcc

SEQ ID NO: 8323637 - DNA, 22 bp, Homo sapiens
agcagccttaggtattgtgatt

SEQ ID NO: 8323638 - DNA, 22 bp, Homo sapiens
agcagccttgcaggggtcgcac

SEQ ID NO: 8323639 - DNA, 21 bp, Homo sapiens
agcagaggcagaatgtatgca

SEQ ID NO: 8323640 - DNA, 22 bp, Homo sapiens
agcagagctttttggactcaga

SEQ ID NO: 8323641 - DNA, 22 bp, Homo sapiens
caataatatcctgtgctgtttg

SEQ ID NO: 8323642 - DNA, 22 bp, Homo sapiens
caagtgacaagacctgtgggcc

SEQ ID NO: 8323643 - DNA, 20 bp, Homo sapiens
caataatttacttccctatt

SEQ ID NO: 8323644 - DNA, 22 bp, Homo sapiens
caataatttacattggatacca

SEQ ID NO: 8323645 - DNA, 22 bp, Homo sapiens
caataattgctttccagagtta

SEQ ID NO: 8323646 - DNA, 22 bp, Homo sapiens
agccccaggatgggccgcagga

SEQ ID NO: 8323647 - DNA, 22 bp, Homo sapiens
agccccagtaagggagggcctg

SEQ ID NO: 8323648 - DNA, 22 bp, Homo sapiens
agccccacactctctctgagaa

SEQ ID NO: 8323649 - DNA, 22 bp, Homo sapiens
agcccatgcaacaggcctagcg

SEQ ID NO: 8323650 - DNA, 22 bp, Homo sapiens
agcccaggttgaggctgcagtg

SEQ ID NO: 8323651 - DNA, 22 bp, Homo sapiens
cagagctctgacagctacagcc

SEQ ID NO: 8323652 - DNA, 22 bp, Homo sapiens
agccctggcccggctgtgcttt

SEQ ID NO: 8323653 - DNA, 22 bp, Homo sapiens
agccccagtccgctgcgggcgg

SEQ ID NO: 8323654 - DNA, 22 bp, Homo sapiens
agccagctaccggggctcctgg

SEQ ID NO: 8323655 - DNA, 18 bp, Homo sapiens
cagagctcctggatgcag

SEQ ID NO: 8323656 - DNA, 22 bp, Homo sapiens
cagagctcagagctgccaggca

SEQ ID NO: 8323657 - DNA, 22 bp, Homo sapiens
cagagccttcctagcagactct

SEQ ID NO: 8323658 - DNA, 22 bp, Homo sapiens
agccaggccttagggagaggca

SEQ ID NO: 8323659 - DNA, 22 bp, Homo sapiens
cagagaccctaggcaggtgaca

SEQ ID NO: 8323660 - DNA, 23 bp, Homo sapiens
agctccagaacatagcacaggaa

SEQ ID NO: 8323661 - DNA, 22 bp, Homo sapiens
agctccagaagcctgcaaggta

SEQ ID NO: 8323662 - DNA, 22 bp, Homo sapiens
agctccagagccacatccatca

SEQ ID NO: 8323663 - DNA, 22 bp, Homo sapiens
agctccagcccatctgctcgtg

SEQ ID NO: 8323664 - DNA, 22 bp, Homo sapiens
agctccagggaaagagtggatc

SEQ ID NO: 8323665 - DNA, 22 bp, Homo sapiens
agctcctggacgaacagggagt

SEQ ID NO: 8323666 - DNA, 20 bp, Homo sapiens
agctcctggactagagagtg

SEQ ID NO: 8323667 - DNA, 20 bp, Homo sapiens
agctcctggactagagagtg

SEQ ID NO: 8323668 - DNA, 23 bp, Homo sapiens
agctccagctgacgtgggcagcc

SEQ ID NO: 8323669 - DNA, 22 bp, Homo sapiens
agctccaggataagacaggtgc

SEQ ID NO: 8323670 - DNA, 22 bp, Homo sapiens
agctcctgggccatcacaacca

SEQ ID NO: 8323671 - DNA, 22 bp, Homo sapiens
agctcctggcaaggtcatggtg

SEQ ID NO: 8323672 - DNA, 22 bp, Homo sapiens
agctcctggctttcctctcacc

SEQ ID NO: 8323673 - DNA, 22 bp, Homo sapiens
agctcctgggggttccaagcag

SEQ ID NO: 8323674 - DNA, 20 bp, Homo sapiens
agctcctggtataggtgcct

SEQ ID NO: 8323675 - DNA, 22 bp, Homo sapiens
agctcctgtctcaagggagcct

SEQ ID NO: 8323676 - DNA, 22 bp, Homo sapiens
agctcctgtctcaagggagcct

SEQ ID NO: 8323677 - DNA, 22 bp, Homo sapiens
agctcctggtctttgtccagag

SEQ ID NO: 8323678 - DNA, 22 bp, Homo sapiens
agctctgttactgattttcctg

SEQ ID NO: 8323679 - DNA, 22 bp, Homo sapiens
agctcctgtgtgaagcctccct

SEQ ID NO: 8323680 - DNA, 22 bp, Homo sapiens
agctcctgtggctgaaagagga

SEQ ID NO: 8323681 - DNA, 20 bp, Homo sapiens
agctcttactttgcagcagc

SEQ ID NO: 8323682 - DNA, 22 bp, Homo sapiens
agcctgggtgggggttcggaga

SEQ ID NO: 8323683 - DNA, 22 bp, Homo sapiens
agcctggtttaagcattttata

SEQ ID NO: 8323684 - DNA, 22 bp, Homo sapiens
agcctggcttagctctctcact

SEQ ID NO: 8323685 - DNA, 21 bp, Homo sapiens
agcctgggaggcggaggttgc

SEQ ID NO: 8323686 - DNA, 22 bp, Homo sapiens
agcctgggcatgggacgggagg

SEQ ID NO: 8323687 - DNA, 20 bp, Homo sapiens
cagcaactttggactgagtt

SEQ ID NO: 8323688 - DNA, 20 bp, Homo sapiens
aactttagacataatctctt

SEQ ID NO: 8323689 - DNA, 21 bp, Homo sapiens
aactttagaaagactgggaag

SEQ ID NO: 8323690 - DNA, 22 bp, Homo sapiens
aattactgggtctgagattaat

SEQ ID NO: 8323691 - DNA, 22 bp, Homo sapiens
aactttctgaaaagcttgatca

SEQ ID NO: 8323692 - DNA, 22 bp, Homo sapiens
aatgtgaactttgtcatgtaac

SEQ ID NO: 8323693 - DNA, 22 bp, Homo sapiens
aatgtcttttgatacaagttac

SEQ ID NO: 8323694 - DNA, 22 bp, Homo sapiens
aatgttacgatcaacaacacat

SEQ ID NO: 8323695 - DNA, 22 bp, Homo sapiens
aatgttacagttttaattctga

SEQ ID NO: 8323696 - DNA, 22 bp, Homo sapiens
aatgttacacaggtataatcag

SEQ ID NO: 8323697 - DNA, 22 bp, Homo sapiens
aatgttaattcacagccaaata

SEQ ID NO: 8323698 - DNA, 22 bp, Homo sapiens
aactgaaacggtgatcttttaa

SEQ ID NO: 8323699 - DNA, 20 bp, Homo sapiens
aatgtattgttttgtttcag

SEQ ID NO: 8323700 - DNA, 20 bp, Homo sapiens
aatgtattgttttgtttcag

SEQ ID NO: 8323701 - DNA, 22 bp, Homo sapiens
aatgtattttgggagtttcttt

SEQ ID NO: 8323702 - DNA, 22 bp, Homo sapiens
aatgtctttctcataacagata

SEQ ID NO: 8323703 - DNA, 17 bp, Homo sapiens
aagacaagacaaatgca

SEQ ID NO: 8323704 - DNA, 22 bp, Homo sapiens
aagacaatattgctgtgaacgt

SEQ ID NO: 8323705 - DNA, 22 bp, Homo sapiens
aagacaatcctggacagtcagc

SEQ ID NO: 8323706 - DNA, 22 bp, Homo sapiens
aagacaaaggggtccttggatg

SEQ ID NO: 8323707 - DNA, 17 bp, Homo sapiens
aagacaagacaaatgca

SEQ ID NO: 8323708 - DNA, 22 bp, Homo sapiens
aagaatcttaatccagaaacct

SEQ ID NO: 8323709 - DNA, 22 bp, Homo sapiens
aattagaagctgttagcaaaat

SEQ ID NO: 8323710 - DNA, 20 bp, Homo sapiens
aattagatgtttaatcaata

SEQ ID NO: 8323711 - DNA, 22 bp, Homo sapiens
aattcaaagactagaattttgc

SEQ ID NO: 8323712 - DNA, 22 bp, Homo sapiens
aagacacacacatatgctgagt

SEQ ID NO: 8323713 - DNA, 22 bp, Homo sapiens
aagacacagcgaaatgttcctg

SEQ ID NO: 8323714 - DNA, 22 bp, Homo sapiens
aagacacaatgtagcccagcac

SEQ ID NO: 8323715 - DNA, 22 bp, Homo sapiens
aagacacaaagcttcccttttc

SEQ ID NO: 8323716 - DNA, 22 bp, Homo sapiens
aagacaattttgagtatgcaca

SEQ ID NO: 8323717 - DNA, 22 bp, Homo sapiens
aagacaatttgatactagttgc

SEQ ID NO: 8323718 - DNA, 22 bp, Homo sapiens
aagacaatgtttctgatagata

SEQ ID NO: 8323719 - DNA, 22 bp, Homo sapiens
aagacaatgcattactaagaag

SEQ ID NO: 8323720 - DNA, 22 bp, Homo sapiens
aagacattgtcattttataatt

SEQ ID NO: 8323721 - DNA, 22 bp, Homo sapiens
aagacattgctgcttttaattg

SEQ ID NO: 8323722 - DNA, 22 bp, Homo sapiens
acacgcatgatgatgcacgtac

SEQ ID NO: 8323723 - DNA, 22 bp, Homo sapiens
acacatttctctttttgtaagt

SEQ ID NO: 8323724 - DNA, 22 bp, Homo sapiens
acactaaatgagtctacagtac

SEQ ID NO: 8323725 - DNA, 22 bp, Homo sapiens
acactacaatctcagaactata

SEQ ID NO: 8323726 - DNA, 22 bp, Homo sapiens
acactacagggagaagactcac

SEQ ID NO: 8323727 - DNA, 22 bp, Homo sapiens
acactacagggccgggatggaa

SEQ ID NO: 8323728 - DNA, 22 bp, Homo sapiens
acactacaacagcagaggtgag

SEQ ID NO: 8323729 - DNA, 22 bp, Homo sapiens
acacacaggtaaaggagcctgg

SEQ ID NO: 8323730 - DNA, 22 bp, Homo sapiens
acagaggacaactaggcgctca

SEQ ID NO: 8323731 - DNA, 18 bp, Homo sapiens
acagaggcagacatgtat

SEQ ID NO: 8323732 - DNA, 22 bp, Homo sapiens
acagatgaaaaagcttgtggat

SEQ ID NO: 8323733 - DNA, 22 bp, Homo sapiens
acagatgagactccaggacctt

SEQ ID NO: 8323734 - DNA, 22 bp, Homo sapiens
aagcacatctcaaacttcatct

SEQ ID NO: 8323735 - DNA, 20 bp, Homo sapiens
aagatagaatcctaactttg

SEQ ID NO: 8323736 - DNA, 19 bp, Homo sapiens
acagaaatgtaagtgagac

SEQ ID NO: 8323737 - DNA, 22 bp, Homo sapiens
aagatatagataaaactatgca

SEQ ID NO: 8323738 - DNA, 22 bp, Homo sapiens
aagatttggtatcagaagacct

SEQ ID NO: 8323739 - DNA, 22 bp, Homo sapiens
aagattttcagtgcctaaaaca

SEQ ID NO: 8323740 - DNA, 22 bp, Homo sapiens
aagattttctcaactgtatttg

SEQ ID NO: 8323741 - DNA, 22 bp, Homo sapiens
aaggggaagtagcaccagaggt

SEQ ID NO: 8323742 - DNA, 22 bp, Homo sapiens
aaggggaatagagtgggttgtg

SEQ ID NO: 8323743 - DNA, 22 bp, Homo sapiens
aaggggcatgcttttgccagga

SEQ ID NO: 8323744 - DNA, 22 bp, Homo sapiens
aagggggcacagtcactgtaat

SEQ ID NO: 8323745 - DNA, 22 bp, Homo sapiens
aagggggagaggtgtttggatg

SEQ ID NO: 8323746 - DNA, 22 bp, Homo sapiens
aagggggaaatcctagcgccgc

SEQ ID NO: 8323747 - DNA, 22 bp, Homo sapiens
aacaatctgttcgatagaaaat

SEQ ID NO: 8323748 - DNA, 22 bp, Homo sapiens
aacaatgaggatctgttctgag

SEQ ID NO: 8323749 - DNA, 22 bp, Homo sapiens
aacaatctccaagaccaatgtg

SEQ ID NO: 8323750 - DNA, 22 bp, Homo sapiens
aacaatgccaacagcatgctgg

SEQ ID NO: 8323751 - DNA, 22 bp, Homo sapiens
aacaataattgcggttctctat

SEQ ID NO: 8323752 - DNA, 22 bp, Homo sapiens
aacaataactagacatgccatg

SEQ ID NO: 8323753 - DNA, 22 bp, Homo sapiens
aacaagtgatgctcatgattca

SEQ ID NO: 8323754 - DNA, 22 bp, Homo sapiens
aacaagtgatgctcatgattca

SEQ ID NO: 8323755 - DNA, 22 bp, Homo sapiens
aacaagtgatatataatggaag

SEQ ID NO: 8323756 - DNA, 22 bp, Homo sapiens
aacaagttactcttaaagtata

SEQ ID NO: 8323757 - DNA, 22 bp, Homo sapiens
aacaagtgtattaatggaaata

SEQ ID NO: 8323758 - DNA, 22 bp, Homo sapiens
aaggccaccaccagcgaggggg

SEQ ID NO: 8323759 - DNA, 22 bp, Homo sapiens
aaatttcagttggaatgagctc

SEQ ID NO: 8323760 - DNA, 22 bp, Homo sapiens
aaatttcagttacctttacgtt

SEQ ID NO: 8323761 - DNA, 22 bp, Homo sapiens
aaggactctccagctagcaaat

SEQ ID NO: 8323762 - DNA, 22 bp, Homo sapiens
aaattattacaagctagttggc

SEQ ID NO: 8323763 - DNA, 22 bp, Homo sapiens
aaattagtacattgcaaagtcc

SEQ ID NO: 8323764 - DNA, 22 bp, Homo sapiens
aaattagtcggtttaggaattt

SEQ ID NO: 8323765 - DNA, 22 bp, Homo sapiens
aaattagtcatgttgtattact

SEQ ID NO: 8323766 - DNA, 21 bp, Homo sapiens
aaggaaaagcttggtctctga

SEQ ID NO: 8323767 - DNA, 22 bp, Homo sapiens
aagctttggaagggcagggttg

SEQ ID NO: 8323768 - DNA, 22 bp, Homo sapiens
aagctttgactactgcctcttg

SEQ ID NO: 8323769 - DNA, 22 bp, Homo sapiens
aagctgtatgacctaaatcttg

SEQ ID NO: 8323770 - DNA, 22 bp, Homo sapiens
aagctggcaaacaagcatcatt

SEQ ID NO: 8323771 - DNA, 22 bp, Homo sapiens
aagcccagatgagatccctgga

SEQ ID NO: 8323772 - DNA, 22 bp, Homo sapiens
aagctggcatgtcacctgagaa

SEQ ID NO: 8323773 - DNA, 22 bp, Homo sapiens
aagctggcctgtacctgctgag

SEQ ID NO: 8323774 - DNA, 22 bp, Homo sapiens
aagccagtattcaatggggcta

SEQ ID NO: 8323775 - DNA, 22 bp, Homo sapiens
aagccagtaagtttttgtcatt

SEQ ID NO: 8323776 - DNA, 22 bp, Homo sapiens
aagccagtgtccagaatgggca

SEQ ID NO: 8323777 - DNA, 22 bp, Homo sapiens
aagccagtggtgagaagatagc

SEQ ID NO: 8323778 - DNA, 22 bp, Homo sapiens
aagccagtgggcatagcagttg

SEQ ID NO: 8323779 - DNA, 22 bp, Homo sapiens
aagccagtggcttctccctgct

SEQ ID NO: 8323780 - DNA, 22 bp, Homo sapiens
aagccagtcctctactgggcac

SEQ ID NO: 8323781 - DNA, 22 bp, Homo sapiens
aagccagttagcacatcattgc

SEQ ID NO: 8323782 - DNA, 16 bp, Homo sapiens
aagccagttcagcatt

SEQ ID NO: 8323783 - DNA, 22 bp, Homo sapiens
aagccagtgtgacaggaaactt

SEQ ID NO: 8323784 - DNA, 22 bp, Homo sapiens
aagccagtgtggtctgcccatt

SEQ ID NO: 8323785 - DNA, 22 bp, Homo sapiens
aagccagtgtttttgagagttg

SEQ ID NO: 8323786 - DNA, 22 bp, Homo sapiens
aataaactgctcaattgcatca

SEQ ID NO: 8323787 - DNA, 22 bp, Homo sapiens
aataaactgctcaattgcatca

SEQ ID NO: 8323788 - DNA, 20 bp, Homo sapiens
aataaactactgagagatgt

SEQ ID NO: 8323789 - DNA, 22 bp, Homo sapiens
aataaacaaatccttccttccc

SEQ ID NO: 8323790 - DNA, 22 bp, Homo sapiens
aataaacaaatctttcctgtgg

SEQ ID NO: 8323791 - DNA, 22 bp, Homo sapiens
aacagtttcagttactgatgag

SEQ ID NO: 8323792 - DNA, 22 bp, Homo sapiens
aacagtttgcctgaaatgtatt

SEQ ID NO: 8323793 - DNA, 22 bp, Homo sapiens
aacagtttgcctgaaatgtatt

SEQ ID NO: 8323794 - DNA, 22 bp, Homo sapiens
aagtttgatgagtttctggagg

SEQ ID NO: 8323795 - DNA, 21 bp, Homo sapiens
aagtttgggattcagtttcca

SEQ ID NO: 8323796 - DNA, 20 bp, Homo sapiens
aagttacattgtattgtacc

SEQ ID NO: 8323797 - DNA, 20 bp, Homo sapiens
aagttacattgtattgtacc

SEQ ID NO: 8323798 - DNA, 22 bp, Homo sapiens
aacactgtaacagcatcatttt

SEQ ID NO: 8323799 - DNA, 22 bp, Homo sapiens
aagtcaaagctttcagaggaaa

SEQ ID NO: 8323800 - DNA, 21 bp, Homo sapiens
aagtcaatacagataagtctt

SEQ ID NO: 8323801 - DNA, 22 bp, Homo sapiens
aacactgatggaaagtatgttt

SEQ ID NO: 8323802 - DNA, 22 bp, Homo sapiens
aacactgctgctgggttctgtg

SEQ ID NO: 8323803 - DNA, 22 bp, Homo sapiens
aagtatttcgttctgaaaaagt

SEQ ID NO: 8323804 - DNA, 22 bp, Homo sapiens
aaccagttgtatgtcctccagc

SEQ ID NO: 8323805 - DNA, 22 bp, Homo sapiens
aaccagtttaagcaaataactg

SEQ ID NO: 8323806 - DNA, 22 bp, Homo sapiens
aaccagttggcaaccagcagtt

SEQ ID NO: 8323807 - DNA, 22 bp, Homo sapiens
aaccagtttcaaagaaaattgc

SEQ ID NO: 8323808 - DNA, 22 bp, Homo sapiens
aaccagtttagtcatgctgtaa

SEQ ID NO: 8323809 - DNA, 22 bp, Homo sapiens
aaccaggtgactcatggtgagc

SEQ ID NO: 8323810 - DNA, 22 bp, Homo sapiens
aatcacattagtgaaacactga

SEQ ID NO: 8323811 - DNA, 22 bp, Homo sapiens
aatcacttagaacccaggaagt

SEQ ID NO: 8323812 - DNA, 22 bp, Homo sapiens
aatcacattaagccctgttcag

SEQ ID NO: 8323813 - DNA, 22 bp, Homo sapiens
aacattgttttccctatatcca

SEQ ID NO: 8323814 - DNA, 22 bp, Homo sapiens
aacattgttttgcacaactctt

SEQ ID NO: 8323815 - DNA, 22 bp, Homo sapiens
aacattgttttccctatatcca

SEQ ID NO: 8323816 - DNA, 22 bp, Homo sapiens
aacagtttgtggatagcttgta

SEQ ID NO: 8323817 - DNA, 22 bp, Homo sapiens
aaatagaattggaagcagagtt

SEQ ID NO: 8323818 - DNA, 22 bp, Homo sapiens
aaatagaattggaagcagagtt

SEQ ID NO: 8323819 - DNA, 22 bp, Homo sapiens
aaatagaattaactagctactg

SEQ ID NO: 8323820 - DNA, 22 bp, Homo sapiens
aaatatgttttccagttgtcat

SEQ ID NO: 8323821 - DNA, 22 bp, Homo sapiens
aaatcatgtgcagagatcagga

SEQ ID NO: 8323822 - DNA, 20 bp, Homo sapiens
aaatgccagtgattctgctt

SEQ ID NO: 8323823 - DNA, 22 bp, Homo sapiens
aaatgcctcattttctctcact

SEQ ID NO: 8323824 - DNA, 18 bp, Homo sapiens
aaatgctaggctacatga

SEQ ID NO: 8323825 - DNA, 22 bp, Homo sapiens
aaatgctctggggataagactg

SEQ ID NO: 8323826 - DNA, 22 bp, Homo sapiens
aaagcaatgcccgttcattatc

SEQ ID NO: 8323827 - DNA, 22 bp, Homo sapiens
aaaggcatgtgcaactacaaat

SEQ ID NO: 8323828 - DNA, 22 bp, Homo sapiens
aaaggaggaatggagagatgct

SEQ ID NO: 8323829 - DNA, 22 bp, Homo sapiens
aaagtgcagtccatgaaattaa

SEQ ID NO: 8323830 - DNA, 23 bp, Homo sapiens
aaagtgcagttgaggaatcatag

SEQ ID NO: 8323831 - DNA, 23 bp, Homo sapiens
aaagtgcagttgaggaatcatag

SEQ ID NO: 8323832 - DNA, 22 bp, Homo sapiens
aaagtgcatagagtagtgccta

SEQ ID NO: 8323833 - DNA, 22 bp, Homo sapiens
aaagtgcattcgaaagtccatc

SEQ ID NO: 8323834 - DNA, 22 bp, Homo sapiens
aaagtgcatcaaatgacttccc

SEQ ID NO: 8323835 - DNA, 22 bp, Homo sapiens
aaagtgccacaactggacaacc

SEQ ID NO: 8323836 - DNA, 22 bp, Homo sapiens
aaagtgcattgtttgtgttcct

SEQ ID NO: 8323837 - DNA, 22 bp, Homo sapiens
aaagtgctgggattacaggtgt

SEQ ID NO: 8323838 - DNA, 22 bp, Homo sapiens
aaagtgctgggattacaggctt

SEQ ID NO: 8323839 - DNA, 22 bp, Homo sapiens
aaagtgctgggattacaggcgt

SEQ ID NO: 8323840 - DNA, 22 bp, Homo sapiens
aaagtgctgggattacaggcct

SEQ ID NO: 8323841 - DNA, 22 bp, Homo sapiens
aaagtgctgggattacaggcat

SEQ ID NO: 8323842 - DNA, 22 bp, Homo sapiens
aaagtgctgagattacaagcgt

SEQ ID NO: 8323843 - DNA, 22 bp, Homo sapiens
aaagtgctgggattacaagcgt

SEQ ID NO: 8323844 - DNA, 22 bp, Homo sapiens
aaagtgctgggattacaagtgt

SEQ ID NO: 8323845 - DNA, 22 bp, Homo sapiens
aaagtgctcggattacaggtat

SEQ ID NO: 8323846 - DNA, 22 bp, Homo sapiens
aaagtgctaggattacaagcgt

SEQ ID NO: 8323847 - DNA, 22 bp, Homo sapiens
aaagtgctgaaattacaggtgt

SEQ ID NO: 8323848 - DNA, 22 bp, Homo sapiens
aaagtgctgaaattacaggggt

SEQ ID NO: 8323849 - DNA, 22 bp, Homo sapiens
aaacatagataatagatagatg

SEQ ID NO: 8323850 - DNA, 22 bp, Homo sapiens
aaaagtgtccagattatgaaga

SEQ ID NO: 8323851 - DNA, 22 bp, Homo sapiens
aaaatagatgaaaggaagtctg

SEQ ID NO: 8323852 - DNA, 22 bp, Homo sapiens
aaaatagattctaggatgtctt

SEQ ID NO: 8323853 - DNA, 22 bp, Homo sapiens
aaaatagattctaggatgtctt

SEQ ID NO: 8323854 - DNA, 22 bp, Homo sapiens
aaaatagctatggaatgtcact

SEQ ID NO: 8323855 - DNA, 22 bp, Homo sapiens
aaacacacagaaatgaatgagg

SEQ ID NO: 8323856 - DNA, 22 bp, Homo sapiens
aaacaaatttcaagctgtgaca

SEQ ID NO: 8323857 - DNA, 22 bp, Homo sapiens
aaacaaatttcaagctgtgaca

SEQ ID NO: 8323858 - DNA, 22 bp, Homo sapiens
aaaagtctacaagcttcaacaa

SEQ ID NO: 8323859 - DNA, 22 bp, Homo sapiens
aaaagtattttggatctcagat

SEQ ID NO: 8323860 - DNA, 22 bp, Homo sapiens
aaaagtattttgagcactttat

SEQ ID NO: 8323861 - DNA, 22 bp, Homo sapiens
aaaagtctgctttctattatca

SEQ ID NO: 8323862 - DNA, 22 bp, Homo sapiens
aaaagtctgctctcatttcaga

SEQ ID NO: 8323863 - DNA, 22 bp, Homo sapiens
aaaagtctctctgagtaaaagt

SEQ ID NO: 8323864 - DNA, 19 bp, Homo sapiens
aaaagtctattcaattaca

SEQ ID NO: 8323865 - DNA, 19 bp, Homo sapiens
aaaagtctattcaattaca

SEQ ID NO: 8323866 - DNA, 22 bp, Homo sapiens
aaaaatgcttggacttaataaa

SEQ ID NO: 8323867 - DNA, 22 bp, Homo sapiens
aaaaagactagtcgagtgcagt

SEQ ID NO: 8323868 - DNA, 22 bp, Homo sapiens
aaaaagagaaatgctctagtcc

SEQ ID NO: 8323869 - DNA, 19 bp, Homo sapiens
aaaaagaggctataatatt

SEQ ID NO: 8323870 - DNA, 19 bp, Homo sapiens
aaaaagaggctataatatt

SEQ ID NO: 8323871 - DNA, 21 bp, Homo sapiens
aaaaatgaagttgttcaggaa

SEQ ID NO: 8323872 - DNA, 22 bp, Homo sapiens
aaaaatgaattcttcagtggca

SEQ ID NO: 8323873 - DNA, 22 bp, Homo sapiens
aaagaaggacctggaggaggat

SEQ ID NO: 8323874 - DNA, 22 bp, Homo sapiens
aaagaagagctggaaggagtct

SEQ ID NO: 8323875 - DNA, 22 bp, Homo sapiens
aaagaagacagacatttctttc

SEQ ID NO: 8323876 - DNA, 22 bp, Homo sapiens
aaagatgagtccggcagacata

SEQ ID NO: 8323877 - DNA, 22 bp, Homo sapiens
aaagatctccccttcaaagagt

SEQ ID NO: 8323878 - DNA, 22 bp, Homo sapiens
aaagatctgtgttaactcaagg

SEQ ID NO: 8323879 - DNA, 22 bp, Homo sapiens
aaacttgtgagctaaataaatg

SEQ ID NO: 8323880 - DNA, 22 bp, Homo sapiens
aaagaacttatcctagaatttg

SEQ ID NO: 8323881 - DNA, 22 bp, Homo sapiens
aaacttgagtcacttctcttcc

SEQ ID NO: 8323882 - DNA, 22 bp, Homo sapiens
aaacttgagccaagggcttggg

SEQ ID NO: 8323883 - DNA, 22 bp, Homo sapiens
aaacatgaatagatattaaaca

SEQ ID NO: 8323884 - DNA, 22 bp, Homo sapiens
aaacagtcgtcttaatagtatt

SEQ ID NO: 8323885 - DNA, 20 bp, Homo sapiens
aaacacagcctctctttaca

SEQ ID NO: 8323886 - DNA, 22 bp, Homo sapiens
aacaacagctgctaaagagttg

SEQ ID NO: 8323887 - DNA, 22 bp, Homo sapiens
aacaaattagttgcaagactgg

SEQ ID NO: 8323888 - DNA, 22 bp, Homo sapiens
aacaaatttagctctgagtgct

SEQ ID NO: 8323889 - DNA, 22 bp, Homo sapiens
aaagcacattacaagctcagtc

SEQ ID NO: 8323890 - DNA, 23 bp, Homo sapiens
aacacaaagctgattccagtggc

SEQ ID NO: 8323891 - DNA, 22 bp, Homo sapiens
aacacaaaaattctcaggggca

SEQ ID NO: 8323892 - DNA, 22 bp, Homo sapiens
aacaagaacacctacagttcta

SEQ ID NO: 8323893 - DNA, 22 bp, Homo sapiens
aacaagaacacctacagttcta

SEQ ID NO: 8323894 - DNA, 22 bp, Homo sapiens
aacacatatttatatatgcaca

SEQ ID NO: 8323895 - DNA, 22 bp, Homo sapiens
aacacattgccagagatcagca

SEQ ID NO: 8323896 - DNA, 22 bp, Homo sapiens
aacagtaatgtggtgttgggtt

SEQ ID NO: 8323897 - DNA, 22 bp, Homo sapiens
aacagtaatggcattgccatga

SEQ ID NO: 8323898 - DNA, 22 bp, Homo sapiens
aacagtaatggcattgccatga

SEQ ID NO: 8323899 - DNA, 22 bp, Homo sapiens
aacaggaatgaggagaaaaggt

SEQ ID NO: 8323900 - DNA, 22 bp, Homo sapiens
aacagtaatttgcggtttttgc

SEQ ID NO: 8323901 - DNA, 22 bp, Homo sapiens
aacagtgagaaggtggacagga

SEQ ID NO: 8323902 - DNA, 20 bp, Homo sapiens
aacagtgaatgaggccagag

SEQ ID NO: 8323903 - DNA, 22 bp, Homo sapiens
aacagtcacattgttcaacttt

SEQ ID NO: 8323904 - DNA, 20 bp, Homo sapiens
aacagtcaaatgttgattgc

SEQ ID NO: 8323905 - DNA, 22 bp, Homo sapiens
aacatttccggccttttgttct

SEQ ID NO: 8323906 - DNA, 22 bp, Homo sapiens
aactcactttgtggcttctgaa

SEQ ID NO: 8323907 - DNA, 21 bp, Homo sapiens
aactgagaccagctaaagtgg

SEQ ID NO: 8323908 - DNA, 22 bp, Homo sapiens
aactgagacacgaactatgatt

SEQ ID NO: 8323909 - DNA, 20 bp, Homo sapiens
aactgagagttcaggaggag

SEQ ID NO: 8323910 - DNA, 22 bp, Homo sapiens
aactgagattacaagagacatt

SEQ ID NO: 8323911 - DNA, 22 bp, Homo sapiens
aactgcaaaaatggtagtctta

SEQ ID NO: 8323912 - DNA, 22 bp, Homo sapiens
aactaatacattaatacatgtg

SEQ ID NO: 8323913 - DNA, 22 bp, Homo sapiens
aacatttgtactaaagaagttc

SEQ ID NO: 8323914 - DNA, 22 bp, Homo sapiens
aactatgttaataagtttcatt

SEQ ID NO: 8323915 - DNA, 22 bp, Homo sapiens
aactatttttggagctaactct

SEQ ID NO: 8323916 - DNA, 22 bp, Homo sapiens
aaatatgaatgataagagttat

SEQ ID NO: 8323917 - DNA, 22 bp, Homo sapiens
aaatatcttaggagtatatgag

SEQ ID NO: 8323918 - DNA, 22 bp, Homo sapiens
aagcagcaagtttatttctatc

SEQ ID NO: 8323919 - DNA, 22 bp, Homo sapiens
aagcactttatgtcaatgtcct

SEQ ID NO: 8323920 - DNA, 22 bp, Homo sapiens
aagcagaactgggaagtagtgg

SEQ ID NO: 8323921 - DNA, 22 bp, Homo sapiens
aagaagttggaaatgattgaga

SEQ ID NO: 8323922 - DNA, 22 bp, Homo sapiens
aagaagttaggtgtaacaatat

SEQ ID NO: 8323923 - DNA, 22 bp, Homo sapiens
aagagcccttgttcataattat

SEQ ID NO: 8323924 - DNA, 20 bp, Homo sapiens
aagagaggaagttatactag

SEQ ID NO: 8323925 - DNA, 22 bp, Homo sapiens
aagacagaagtgatttgatgtg

SEQ ID NO: 8323926 - DNA, 22 bp, Homo sapiens
aagacagaccacgtgacagggc

SEQ ID NO: 8323927 - DNA, 22 bp, Homo sapiens
aagacagaccacgtgacagggc

SEQ ID NO: 8323928 - DNA, 22 bp, Homo sapiens
aagacactttctaaatagaagt

SEQ ID NO: 8323929 - DNA, 22 bp, Homo sapiens
agaatttttgattatctactcg

SEQ ID NO: 8323930 - DNA, 22 bp, Homo sapiens
aatgtaaacagcaagagaaggg

SEQ ID NO: 8323931 - DNA, 22 bp, Homo sapiens
aatgtataaagtgttaataact

SEQ ID NO: 8323932 - DNA, 22 bp, Homo sapiens
aatggaatacctaggtggccca

SEQ ID NO: 8323933 - DNA, 22 bp, Homo sapiens
aatgcttttgctgtcattgctt

SEQ ID NO: 8323934 - DNA, 22 bp, Homo sapiens
aatgctttgactatatctataa

SEQ ID NO: 8323935 - DNA, 22 bp, Homo sapiens
agaataaatgctacctatcaca

SEQ ID NO: 8323936 - DNA, 22 bp, Homo sapiens
agaagttttgggaaatactgat

SEQ ID NO: 8323937 - DNA, 22 bp, Homo sapiens
agaataatcactgaagttcaaa

SEQ ID NO: 8323938 - DNA, 21 bp, Homo sapiens
agaataatggtatcatttgct

SEQ ID NO: 8323939 - DNA, 22 bp, Homo sapiens
agaatcagtgagcagttgtgat

SEQ ID NO: 8323940 - DNA, 22 bp, Homo sapiens
agagaaagtaaagattctacct

SEQ ID NO: 8323941 - DNA, 17 bp, Homo sapiens
agagagagcatgccacc

SEQ ID NO: 8323942 - DNA, 22 bp, Homo sapiens
agagagacgggggctgctgctt

SEQ ID NO: 8323943 - DNA, 22 bp, Homo sapiens
agagagagaaatgaaatgtgct

SEQ ID NO: 8323944 - DNA, 17 bp, Homo sapiens
agagagagcatgccacc

SEQ ID NO: 8323945 - DNA, 22 bp, Homo sapiens
agagagaggcagcagtgctcac

SEQ ID NO: 8323946 - DNA, 22 bp, Homo sapiens
agagagagggaaactgctaaac

SEQ ID NO: 8323947 - DNA, 22 bp, Homo sapiens
agagagagggaaactgctaaac

SEQ ID NO: 8323948 - DNA, 22 bp, Homo sapiens
agagagaggggcgagcaaacac

SEQ ID NO: 8323949 - DNA, 20 bp, Homo sapiens
agagagaggtaaattgagca

SEQ ID NO: 8323950 - DNA, 21 bp, Homo sapiens
agagatagactagaattgatg

SEQ ID NO: 8323951 - DNA, 23 bp, Homo sapiens
agagagagtttgtgtcaggtacc

SEQ ID NO: 8323952 - DNA, 22 bp, Homo sapiens
agagatctctgaagctgctgct

SEQ ID NO: 8323953 - DNA, 22 bp, Homo sapiens
agagatattatttaccaagtta

SEQ ID NO: 8323954 - DNA, 22 bp, Homo sapiens
agagatcaaagcttgccaagta

SEQ ID NO: 8323955 - DNA, 22 bp, Homo sapiens
agactctgctaagaatataatt

SEQ ID NO: 8323956 - DNA, 22 bp, Homo sapiens
agactctggagtcagctaggat

SEQ ID NO: 8323957 - DNA, 22 bp, Homo sapiens
agactctggaggggctggtcct

SEQ ID NO: 8323958 - DNA, 21 bp, Homo sapiens
agactctggggatctctgtcc

SEQ ID NO: 8323959 - DNA, 22 bp, Homo sapiens
agactctggcatgctaactagt

SEQ ID NO: 8323960 - DNA, 22 bp, Homo sapiens
agactctggccacccccgcagt

SEQ ID NO: 8323961 - DNA, 22 bp, Homo sapiens
agactctgggattttgaaagca

SEQ ID NO: 8323962 - DNA, 22 bp, Homo sapiens
agactctggggctccctccacc

SEQ ID NO: 8323963 - DNA, 22 bp, Homo sapiens
agactctggtcctcttgaattt

SEQ ID NO: 8323964 - DNA, 17 bp, Homo sapiens
agactctgtcccatgta

SEQ ID NO: 8323965 - DNA, 22 bp, Homo sapiens
agactctgtgctccttgctttc

SEQ ID NO: 8323966 - DNA, 18 bp, Homo sapiens
agactctgtgtgaaagta

SEQ ID NO: 8323967 - DNA, 22 bp, Homo sapiens
agactgatattaactttagtgt

SEQ ID NO: 8323968 - DNA, 23 bp, Homo sapiens
agactgaggctgccagggtcaga

SEQ ID NO: 8323969 - DNA, 22 bp, Homo sapiens
agactgggccatttccccagct

SEQ ID NO: 8323970 - DNA, 22 bp, Homo sapiens
agactgaataggaaagagggaa

SEQ ID NO: 8323971 - DNA, 19 bp, Homo sapiens
agactctgtgtgagacttt

SEQ ID NO: 8323972 - DNA, 22 bp, Homo sapiens
agactctgttgaactattttgg

SEQ ID NO: 8323973 - DNA, 22 bp, Homo sapiens
agactggggttctggcaaggag

SEQ ID NO: 8323974 - DNA, 23 bp, Homo sapiens
agactggggcataagaagatggc

SEQ ID NO: 8323975 - DNA, 22 bp, Homo sapiens
agactggggttctggcaaggag

SEQ ID NO: 8323976 - DNA, 22 bp, Homo sapiens
agatatcttacactttgaagtt

SEQ ID NO: 8323977 - DNA, 22 bp, Homo sapiens
agatatgtttgtatatatttgt

SEQ ID NO: 8323978 - DNA, 22 bp, Homo sapiens
agatctggaactgaggtttatt

SEQ ID NO: 8323979 - DNA, 22 bp, Homo sapiens
agatctggccctcagcttgatt

SEQ ID NO: 8323980 - DNA, 22 bp, Homo sapiens
agatctggttggagtcctgaca

SEQ ID NO: 8323981 - DNA, 22 bp, Homo sapiens
agatgttttggagacactaacc

SEQ ID NO: 8323982 - DNA, 22 bp, Homo sapiens
agataattatgtcaatttcttg

SEQ ID NO: 8323983 - DNA, 22 bp, Homo sapiens
agatataataatttacaagtgt

SEQ ID NO: 8323984 - DNA, 22 bp, Homo sapiens
acaaaaaccgtggattcagcat

SEQ ID NO: 8323985 - DNA, 22 bp, Homo sapiens
acaaaaagctccattactgtcc

SEQ ID NO: 8323986 - DNA, 22 bp, Homo sapiens
aatttcaatgcactcatggttg

SEQ ID NO: 8323987 - DNA, 22 bp, Homo sapiens
agaggccaatagtaggtggcat

SEQ ID NO: 8323988 - DNA, 22 bp, Homo sapiens
agaggccaatagtaggtggcat

SEQ ID NO: 8323989 - DNA, 22 bp, Homo sapiens
agagggctaactgggaagcagg

SEQ ID NO: 8323990 - DNA, 22 bp, Homo sapiens
agagggctaactgggaagcagg

SEQ ID NO: 8323991 - DNA, 22 bp, Homo sapiens
agagggctaactgggaagcagg

SEQ ID NO: 8323992 - DNA, 22 bp, Homo sapiens
aattttgtgtgggatcaaagga

SEQ ID NO: 8323993 - DNA, 22 bp, Homo sapiens
aattttgttcttggaaatcagg

SEQ ID NO: 8323994 - DNA, 22 bp, Homo sapiens
aattttgttcttggaaatcagg

SEQ ID NO: 8323995 - DNA, 22 bp, Homo sapiens
agagggctgcctcagtcagcta

SEQ ID NO: 8323996 - DNA, 22 bp, Homo sapiens
agagggctgctgcacagtgctc

SEQ ID NO: 8323997 - DNA, 22 bp, Homo sapiens
agagggctgcctcagtcagcta

SEQ ID NO: 8323998 - DNA, 22 bp, Homo sapiens
agagggctgcctcagtcagcta

SEQ ID NO: 8323999 - DNA, 17 bp, Homo sapiens
agagggctcaaggcatc

SEQ ID NO: 8324000 - DNA, 17 bp, Homo sapiens
agagggctcaaggcatc

SEQ ID NO: 8324001 - DNA, 22 bp, Homo sapiens
agaggccaagccagactgtgca

SEQ ID NO: 8324002 - DNA, 22 bp, Homo sapiens
agcaggaggagagcctggcggt

SEQ ID NO: 8324003 - DNA, 22 bp, Homo sapiens
agcagggctttgcagacttggg

SEQ ID NO: 8324004 - DNA, 22 bp, Homo sapiens
agcagggcttctgtgcctgtgc

SEQ ID NO: 8324005 - DNA, 22 bp, Homo sapiens
agcagggctgtgtaggtaatga

SEQ ID NO: 8324006 - DNA, 22 bp, Homo sapiens
agcagccaggaatctgcagagc

SEQ ID NO: 8324007 - DNA, 22 bp, Homo sapiens
acacacttcacccttgagctaa

SEQ ID NO: 8324008 - DNA, 22 bp, Homo sapiens
agatttccatctttttcatgtg

SEQ ID NO: 8324009 - DNA, 22 bp, Homo sapiens
agatttccgttctctcttcagt

SEQ ID NO: 8324010 - DNA, 22 bp, Homo sapiens
acacacatggtattgttcagaa

SEQ ID NO: 8324011 - DNA, 22 bp, Homo sapiens
agcagaaagcttattttgactg

SEQ ID NO: 8324012 - DNA, 21 bp, Homo sapiens
acacactacacattcctagtt

SEQ ID NO: 8324013 - DNA, 22 bp, Homo sapiens
agcctggccaggcctgcccagg

SEQ ID NO: 8324014 - DNA, 22 bp, Homo sapiens
acagacatgggccgctcttgag

SEQ ID NO: 8324015 - DNA, 22 bp, Homo sapiens
agccctggggctggtcttggaa

SEQ ID NO: 8324016 - DNA, 22 bp, Homo sapiens
agcctggctaaattctcccatg

SEQ ID NO: 8324017 - DNA, 22 bp, Homo sapiens
agcatctggtgagggcctagtt

SEQ ID NO: 8324018 - DNA, 22 bp, Homo sapiens
agcatctggtcatgagtgagaa

SEQ ID NO: 8324019 - DNA, 22 bp, Homo sapiens
agcatcctgcttgctgtctgtg

SEQ ID NO: 8324020 - DNA, 22 bp, Homo sapiens
agcattccacactgaagtctgc

SEQ ID NO: 8324021 - DNA, 22 bp, Homo sapiens
agcattgaggtgggtttctctt

SEQ ID NO: 8324022 - DNA, 22 bp, Homo sapiens
agcattccacactgaagtctgc

SEQ ID NO: 8324023 - DNA, 22 bp, Homo sapiens
agcattgctaaagctaattttt

SEQ ID NO: 8324024 - DNA, 22 bp, Homo sapiens
agcattgcctgcctattgctaa

SEQ ID NO: 8324025 - DNA, 22 bp, Homo sapiens
acagaacagagggttttagaat

SEQ ID NO: 8324026 - DNA, 22 bp, Homo sapiens
acagacagtaaatagtgtggct

SEQ ID NO: 8324027 - DNA, 22 bp, Homo sapiens
acagacagtaaatagtgtggct

SEQ ID NO: 8324028 - DNA, 22 bp, Homo sapiens
agcccaggtctcaaagtacagg

SEQ ID NO: 8324029 - DNA, 22 bp, Homo sapiens
acagaacatggatttttgaagt

SEQ ID NO: 8324030 - DNA, 22 bp, Homo sapiens
agcccagctttgaaccatatca

SEQ ID NO: 8324031 - DNA, 22 bp, Homo sapiens
agcccagggagttgattagcat

SEQ ID NO: 8324032 - DNA, 21 bp, Homo sapiens
acattacagggtgatgtgtct

SEQ ID NO: 8324033 - DNA, 22 bp, Homo sapiens
acattctgaaaaacagtgtttt

SEQ ID NO: 8324034 - DNA, 21 bp, Homo sapiens
acattataattcatattccac

SEQ ID NO: 8324035 - DNA, 22 bp, Homo sapiens
acattacctggcatttgatctt

SEQ ID NO: 8324036 - DNA, 23 bp, Homo sapiens
acatagaacagaatatatttgtg

SEQ ID NO: 8324037 - DNA, 23 bp, Homo sapiens
acatagaacagaatatatttgtg

SEQ ID NO: 8324038 - DNA, 22 bp, Homo sapiens
acatacttaacattaaagtcat

SEQ ID NO: 8324039 - DNA, 22 bp, Homo sapiens
acatgggatcaatgaggcaggc

SEQ ID NO: 8324040 - DNA, 22 bp, Homo sapiens
acatggggcccaaagagaggtc

SEQ ID NO: 8324041 - DNA, 23 bp, Homo sapiens
acatgggagggacatggaggctg

SEQ ID NO: 8324042 - DNA, 22 bp, Homo sapiens
acataatggacaataatgcatc

SEQ ID NO: 8324043 - DNA, 22 bp, Homo sapiens
acataatagcatttctaatttg

SEQ ID NO: 8324044 - DNA, 22 bp, Homo sapiens
acataataaaaataacagctca

SEQ ID NO: 8324045 - DNA, 22 bp, Homo sapiens
aagtaaaagcaggtgtgctggg

SEQ ID NO: 8324046 - DNA, 22 bp, Homo sapiens
aaggtttttttccagtatctct

SEQ ID NO: 8324047 - DNA, 22 bp, Homo sapiens
aagtaaaagctttaccatgcgc

SEQ ID NO: 8324048 - DNA, 22 bp, Homo sapiens
aagggcagcttaaattggtagc

SEQ ID NO: 8324049 - DNA, 22 bp, Homo sapiens
aagggcagctattatcgtcatc

SEQ ID NO: 8324050 - DNA, 22 bp, Homo sapiens
acattctgtcaacagtgagcag

SEQ ID NO: 8324051 - DNA, 22 bp, Homo sapiens
acattctgtgagtcatgtttta

SEQ ID NO: 8324052 - DNA, 22 bp, Homo sapiens
acattctgtttccccaaagaga

SEQ ID NO: 8324053 - DNA, 22 bp, Homo sapiens
accacccccttgggtgtggaag

SEQ ID NO: 8324054 - DNA, 22 bp, Homo sapiens
accaccccagaatttttcaagg

SEQ ID NO: 8324055 - DNA, 22 bp, Homo sapiens
accacccacctcacagcatagt

SEQ ID NO: 8324056 - DNA, 22 bp, Homo sapiens
accaccccaaatgaacctctgt

SEQ ID NO: 8324057 - DNA, 22 bp, Homo sapiens
acagtgtccccagctctgtgag

SEQ ID NO: 8324058 - DNA, 19 bp, Homo sapiens
acagtgcatgggacctggt

SEQ ID NO: 8324059 - DNA, 22 bp, Homo sapiens
acaggtctccagagtgagagga

SEQ ID NO: 8324060 - DNA, 22 bp, Homo sapiens
acaggcttggggctcagacaga

SEQ ID NO: 8324061 - DNA, 22 bp, Homo sapiens
acagatgaggaatttatttggt

SEQ ID NO: 8324062 - DNA, 22 bp, Homo sapiens
acagatgaggaagagtcagcca

SEQ ID NO: 8324063 - DNA, 22 bp, Homo sapiens
acttcctagatacgagattgaa

SEQ ID NO: 8324064 - DNA, 22 bp, Homo sapiens
aatatgagtttgcctttcctgc

SEQ ID NO: 8324065 - DNA, 22 bp, Homo sapiens
aatatgacatagaattgagatg

SEQ ID NO: 8324066 - DNA, 22 bp, Homo sapiens
acttatttcatggatcataatg

SEQ ID NO: 8324067 - DNA, 22 bp, Homo sapiens
aataacctttatttcaaagtgt

SEQ ID NO: 8324068 - DNA, 22 bp, Homo sapiens
aataacagggttgatttgcaat

SEQ ID NO: 8324069 - DNA, 22 bp, Homo sapiens
aatacttttgaactgaaaggca

SEQ ID NO: 8324070 - DNA, 22 bp, Homo sapiens
aatagaaaggaggggctcttgt

SEQ ID NO: 8324071 - DNA, 22 bp, Homo sapiens
aatactttcctatataaggtgc

SEQ ID NO: 8324072 - DNA, 22 bp, Homo sapiens
aatactttcctatataaggtgc

SEQ ID NO: 8324073 - DNA, 22 bp, Homo sapiens
actgtgggagcgcagtggcagc

SEQ ID NO: 8324074 - DNA, 22 bp, Homo sapiens
aatgaaaattggaccctagaac

SEQ ID NO: 8324075 - DNA, 22 bp, Homo sapiens
aatctttttcacaagaaagcac

SEQ ID NO: 8324076 - DNA, 22 bp, Homo sapiens
aatctttaaggactcagtctct

SEQ ID NO: 8324077 - DNA, 22 bp, Homo sapiens
aatcttaagctgaattctctcc

SEQ ID NO: 8324078 - DNA, 22 bp, Homo sapiens
agaaactaacctggtagggttc

SEQ ID NO: 8324079 - DNA, 22 bp, Homo sapiens
agaaactacttggaggaaagat

SEQ ID NO: 8324080 - DNA, 22 bp, Homo sapiens
agaaactaagtcataactcttt

SEQ ID NO: 8324081 - DNA, 22 bp, Homo sapiens
agaaactacttggaggaaagat

SEQ ID NO: 8324082 - DNA, 22 bp, Homo sapiens
agaaactatcctgagtagcaaa

SEQ ID NO: 8324083 - DNA, 22 bp, Homo sapiens
agaaactatcctgagtagcaaa

SEQ ID NO: 8324084 - DNA, 22 bp, Homo sapiens
agaaactattatggtaaacaaa

SEQ ID NO: 8324085 - DNA, 22 bp, Homo sapiens
agaaactcatcctggagatgac

SEQ ID NO: 8324086 - DNA, 22 bp, Homo sapiens
aatctatatgcttttcacatac

SEQ ID NO: 8324087 - DNA, 21 bp, Homo sapiens
agaaaatggcgttttagattt

SEQ ID NO: 8324088 - DNA, 21 bp, Homo sapiens
agaaaatggcgttttagattt

SEQ ID NO: 8324089 - DNA, 22 bp, Homo sapiens
agaaaatattcattgagaggct

SEQ ID NO: 8324090 - DNA, 22 bp, Homo sapiens
agaaaatattcattgagaggct

SEQ ID NO: 8324091 - DNA, 22 bp, Homo sapiens
agaaaatattcattgagaggct

SEQ ID NO: 8324092 - DNA, 22 bp, Homo sapiens
agaaaataatttcttggctggt

SEQ ID NO: 8324093 - DNA, 22 bp, Homo sapiens
agaaaataatttcttggctggt

SEQ ID NO: 8324094 - DNA, 22 bp, Homo sapiens
agaaaatgtgaacttgtgaatt

SEQ ID NO: 8324095 - DNA, 20 bp, Homo sapiens
agaaaatgttttcagctgga

SEQ ID NO: 8324096 - DNA, 22 bp, Homo sapiens
aatatgatccttaaccttcatg

SEQ ID NO: 8324097 - DNA, 22 bp, Homo sapiens
aatatgttcaaaatagatcact

SEQ ID NO: 8324098 - DNA, 22 bp, Homo sapiens
aatattatcaaaagctttttca

SEQ ID NO: 8324099 - DNA, 22 bp, Homo sapiens
aagtgaatgtagcaaacttgaa

SEQ ID NO: 8324100 - DNA, 22 bp, Homo sapiens
aagtgaatctcctttctttatt

SEQ ID NO: 8324101 - DNA, 22 bp, Homo sapiens
accttgttgtaggtacaaaaga

SEQ ID NO: 8324102 - DNA, 22 bp, Homo sapiens
accttgtcttttatagaacaag

SEQ ID NO: 8324103 - DNA, 22 bp, Homo sapiens
aagtgacttaatctcctctcag

SEQ ID NO: 8324104 - DNA, 22 bp, Homo sapiens
aagtgactccattgcgggcaca

SEQ ID NO: 8324105 - DNA, 22 bp, Homo sapiens
aagtgactatttgagtacatca

SEQ ID NO: 8324106 - DNA, 22 bp, Homo sapiens
aagtgagttcagcattcactcg

SEQ ID NO: 8324107 - DNA, 22 bp, Homo sapiens
aagtgatgctacgactttgaca

SEQ ID NO: 8324108 - DNA, 22 bp, Homo sapiens
aagtgcagagagctgacgaact

SEQ ID NO: 8324109 - DNA, 21 bp, Homo sapiens
aagtaaatcagagaaataacc

SEQ ID NO: 8324110 - DNA, 22 bp, Homo sapiens
aagtaaatatctgtagtcttta

SEQ ID NO: 8324111 - DNA, 18 bp, Homo sapiens
aagtaacagaagagcaca

SEQ ID NO: 8324112 - DNA, 22 bp, Homo sapiens
aagtaacagagggggtgttgct

SEQ ID NO: 8324113 - DNA, 22 bp, Homo sapiens
aagtaacaatgctgttgaattg

SEQ ID NO: 8324114 - DNA, 22 bp, Homo sapiens
aagtaacacatgttacttctgc

SEQ ID NO: 8324115 - DNA, 22 bp, Homo sapiens
aagtaacacggaacttgaagca

SEQ ID NO: 8324116 - DNA, 21 bp, Homo sapiens
aagtaacaccactcctggagt

SEQ ID NO: 8324117 - DNA, 22 bp, Homo sapiens
acctgggaagatctttgaagct

SEQ ID NO: 8324118 - DNA, 22 bp, Homo sapiens
aataaatgaacaaagcaggttg

SEQ ID NO: 8324119 - DNA, 22 bp, Homo sapiens
aataaatcaatcctattggtag

SEQ ID NO: 8324120 - DNA, 22 bp, Homo sapiens
aataaatgttaagattgtctca

SEQ ID NO: 8324121 - DNA, 22 bp, Homo sapiens
aataacagagtcttcaagatag

SEQ ID NO: 8324122 - DNA, 22 bp, Homo sapiens
aataacagagtcttcaagatag

SEQ ID NO: 8324123 - DNA, 22 bp, Homo sapiens
aataacagaaacttgagcatca

SEQ ID NO: 8324124 - DNA, 22 bp, Homo sapiens
aataaagaatggatgagatcgt

SEQ ID NO: 8324125 - DNA, 22 bp, Homo sapiens
aataaaatggtcagttttctca

SEQ ID NO: 8324126 - DNA, 22 bp, Homo sapiens
actgagactgagaatgtttctt

SEQ ID NO: 8324127 - DNA, 22 bp, Homo sapiens
actgagacaactgtgtttctaa

SEQ ID NO: 8324128 - DNA, 22 bp, Homo sapiens
actgagaagctcgcagtgatgc

SEQ ID NO: 8324129 - DNA, 22 bp, Homo sapiens
aagttttattggctatagcact

SEQ ID NO: 8324130 - DNA, 22 bp, Homo sapiens
aagttttattggaacatagcca

SEQ ID NO: 8324131 - DNA, 21 bp, Homo sapiens
aagttttatgttgccatttgt

SEQ ID NO: 8324132 - DNA, 22 bp, Homo sapiens
aagttttatgggaagatgtgca

SEQ ID NO: 8324133 - DNA, 22 bp, Homo sapiens
aagttttactgaggacacatgt

SEQ ID NO: 8324134 - DNA, 22 bp, Homo sapiens
aagttttaacaagtacttacta

SEQ ID NO: 8324135 - DNA, 22 bp, Homo sapiens
aagtttgtggttatacttgatt

SEQ ID NO: 8324136 - DNA, 22 bp, Homo sapiens
aagtttgtcgaaattatcagca

SEQ ID NO: 8324137 - DNA, 22 bp, Homo sapiens
aagtttctgaatttgaaaggat

SEQ ID NO: 8324138 - DNA, 22 bp, Homo sapiens
aagtttggggagaatttcattt

SEQ ID NO: 8324139 - DNA, 22 bp, Homo sapiens
aagtggagtccctacaaccagc

SEQ ID NO: 8324140 - DNA, 22 bp, Homo sapiens
aagtgcataagtatgattattt

SEQ ID NO: 8324141 - DNA, 22 bp, Homo sapiens
tccactgtggtcccttgctgcc

SEQ ID NO: 8324142 - DNA, 22 bp, Homo sapiens
tccacttttcttccatcatcat

SEQ ID NO: 8324143 - DNA, 22 bp, Homo sapiens
tccacgtgacctttgtggtgga

SEQ ID NO: 8324144 - DNA, 22 bp, Homo sapiens
tccacgctgtgtgaccttgggc

SEQ ID NO: 8324145 - DNA, 23 bp, Homo sapiens
tccaccccagctgaggcttagcc

SEQ ID NO: 8324146 - DNA, 23 bp, Homo sapiens
tccaccccagctgaggcttagcc

SEQ ID NO: 8324147 - DNA, 22 bp, Homo sapiens
tccacccctgggaatgtcaata

SEQ ID NO: 8324148 - DNA, 22 bp, Homo sapiens
tccacccccagacagctggtga

SEQ ID NO: 8324149 - DNA, 19 bp, Homo sapiens
tccaccccagccagctctg

SEQ ID NO: 8324150 - DNA, 22 bp, Homo sapiens
tccacagaatgtaagatccaca

SEQ ID NO: 8324151 - DNA, 22 bp, Homo sapiens
tcattaaaatgcagattctgac

SEQ ID NO: 8324152 - DNA, 22 bp, Homo sapiens
tcattaaaatgcagattctgac

SEQ ID NO: 8324153 - DNA, 22 bp, Homo sapiens
tcattaaatgtttgttgtgcca

SEQ ID NO: 8324154 - DNA, 22 bp, Homo sapiens
tccacaggaaagcacctcccat

SEQ ID NO: 8324155 - DNA, 22 bp, Homo sapiens
tcatgttttagtaaagtgaagg

SEQ ID NO: 8324156 - DNA, 20 bp, Homo sapiens
tccagcccaggtcctgcctg

SEQ ID NO: 8324157 - DNA, 22 bp, Homo sapiens
tccagccctgcttcctgcctca

SEQ ID NO: 8324158 - DNA, 22 bp, Homo sapiens
tccaggagctcatccacgtcaa

SEQ ID NO: 8324159 - DNA, 21 bp, Homo sapiens
tccagcctttccctcacttcc

SEQ ID NO: 8324160 - DNA, 19 bp, Homo sapiens
tccagcctgctgtttctct

SEQ ID NO: 8324161 - DNA, 20 bp, Homo sapiens
tccagggcaaactcatcacc

SEQ ID NO: 8324162 - DNA, 20 bp, Homo sapiens
tccagggcaactagagtgtg

SEQ ID NO: 8324163 - DNA, 22 bp, Homo sapiens
tccagtgcctcactgaggattc

SEQ ID NO: 8324164 - DNA, 22 bp, Homo sapiens
tccagtcctagaaactggagag

SEQ ID NO: 8324165 - DNA, 22 bp, Homo sapiens
tccagtgatgctgcaagagtga

SEQ ID NO: 8324166 - DNA, 22 bp, Homo sapiens
tcccacagtgaagttcatgata

SEQ ID NO: 8324167 - DNA, 22 bp, Homo sapiens
tcccacagtggtacagccctga

SEQ ID NO: 8324168 - DNA, 22 bp, Homo sapiens
tcccacatgtgaatcctcaggt

SEQ ID NO: 8324169 - DNA, 19 bp, Homo sapiens
tcccagagtctagaggttg

SEQ ID NO: 8324170 - DNA, 22 bp, Homo sapiens
tcccagagaaagtcaaggtctt

SEQ ID NO: 8324171 - DNA, 22 bp, Homo sapiens
tcccagaatctttggaagagca

SEQ ID NO: 8324172 - DNA, 22 bp, Homo sapiens
tcccagattcctgctcttatat

SEQ ID NO: 8324173 - DNA, 22 bp, Homo sapiens
tcccagagtttcctgtgtccca

SEQ ID NO: 8324174 - DNA, 22 bp, Homo sapiens
tcccagcagggccgaccagcct

SEQ ID NO: 8324175 - DNA, 22 bp, Homo sapiens
tcccagcagcatagctcagaat

SEQ ID NO: 8324176 - DNA, 22 bp, Homo sapiens
tcccagcctttcttttctgctg

SEQ ID NO: 8324177 - DNA, 17 bp, Homo sapiens
tcccaggaacagggaat

SEQ ID NO: 8324178 - DNA, 22 bp, Homo sapiens
tcccagctgctgagatagtgct

SEQ ID NO: 8324179 - DNA, 22 bp, Homo sapiens
tcccaggattttaggctctcag

SEQ ID NO: 8324180 - DNA, 22 bp, Homo sapiens
tccctgtgaatcagaagcaggt

SEQ ID NO: 8324181 - DNA, 22 bp, Homo sapiens
tcccttgtgagaacatgtgttg

SEQ ID NO: 8324182 - DNA, 22 bp, Homo sapiens
tcccttgtcacctcacactatg

SEQ ID NO: 8324183 - DNA, 22 bp, Homo sapiens
tccctgtgtccatgccaggagg

SEQ ID NO: 8324184 - DNA, 22 bp, Homo sapiens
tccctgtgtccatgccaggagg

SEQ ID NO: 8324185 - DNA, 22 bp, Homo sapiens
tccctgtgggatgaggactctg

SEQ ID NO: 8324186 - DNA, 22 bp, Homo sapiens
tccctgtgggcagaggctgcct

SEQ ID NO: 8324187 - DNA, 22 bp, Homo sapiens
tccctgttcaaagtcacatagc

SEQ ID NO: 8324188 - DNA, 22 bp, Homo sapiens
tcccttcaataattcaacatta

SEQ ID NO: 8324189 - DNA, 22 bp, Homo sapiens
tcctccagtggcccagtccttc

SEQ ID NO: 8324190 - DNA, 23 bp, Homo sapiens
tcctcctgagtgagagtgccagc

SEQ ID NO: 8324191 - DNA, 23 bp, Homo sapiens
tcctcctgacacagcctgagtga

SEQ ID NO: 8324192 - DNA, 22 bp, Homo sapiens
tcctccagctactaggcaaata

SEQ ID NO: 8324193 - DNA, 22 bp, Homo sapiens
tccgccaggactgagggcccat

SEQ ID NO: 8324194 - DNA, 22 bp, Homo sapiens
tccctttcacttaactagccca

SEQ ID NO: 8324195 - DNA, 22 bp, Homo sapiens
tccctttcactactgtgttggt

SEQ ID NO: 8324196 - DNA, 22 bp, Homo sapiens
tccctttggatccaagcttatg

SEQ ID NO: 8324197 - DNA, 22 bp, Homo sapiens
tcctcagtgctagccaactgcc

SEQ ID NO: 8324198 - DNA, 22 bp, Homo sapiens
tcctcagtcgtttgagccaaaa

SEQ ID NO: 8324199 - DNA, 22 bp, Homo sapiens
tcaggggaggttgaatcgtctc

SEQ ID NO: 8324200 - DNA, 22 bp, Homo sapiens
tcaggggacagccagctggagg

SEQ ID NO: 8324201 - DNA, 22 bp, Homo sapiens
tcaggggacttaggagagaagt

SEQ ID NO: 8324202 - DNA, 22 bp, Homo sapiens
tcaggggaaatctctcagcgaa

SEQ ID NO: 8324203 - DNA, 20 bp, Homo sapiens
tcaggtagatctttgaggtc

SEQ ID NO: 8324204 - DNA, 22 bp, Homo sapiens
tcaggtagtggttaagttctgt

SEQ ID NO: 8324205 - DNA, 19 bp, Homo sapiens
tcagtggagaaaggggaag

SEQ ID NO: 8324206 - DNA, 22 bp, Homo sapiens
tcagttttgtatgttgtaagtc

SEQ ID NO: 8324207 - DNA, 23 bp, Homo sapiens
tcagttttggctgttcagtgttg

SEQ ID NO: 8324208 - DNA, 22 bp, Homo sapiens
tcagtttttacggtcacaggga

SEQ ID NO: 8324209 - DNA, 22 bp, Homo sapiens
tcagtttttaagagttatgcga

SEQ ID NO: 8324210 - DNA, 22 bp, Homo sapiens
tcagtttttaaatgatataatt

SEQ ID NO: 8324211 - DNA, 22 bp, Homo sapiens
tcagttttctcatttatgagat

SEQ ID NO: 8324212 - DNA, 22 bp, Homo sapiens
tcagttttgattcctggttctc

SEQ ID NO: 8324213 - DNA, 22 bp, Homo sapiens
tcagttttgaaaacattgaatg

SEQ ID NO: 8324214 - DNA, 22 bp, Homo sapiens
tcagttttctcatctgtgaaat

SEQ ID NO: 8324215 - DNA, 22 bp, Homo sapiens
tcagttttctcatctgtaattt

SEQ ID NO: 8324216 - DNA, 22 bp, Homo sapiens
tcagttttcatttcatgagcag

SEQ ID NO: 8324217 - DNA, 22 bp, Homo sapiens
tcagtttttctatactttgtag

SEQ ID NO: 8324218 - DNA, 22 bp, Homo sapiens
tcagtttttgtttgccagatag

SEQ ID NO: 8324219 - DNA, 22 bp, Homo sapiens
tcataaaaatagactctaaagt

SEQ ID NO: 8324220 - DNA, 22 bp, Homo sapiens
tcagttttcaatttcatcagag

SEQ ID NO: 8324221 - DNA, 19 bp, Homo sapiens
tcagttttagtcatcagtt

SEQ ID NO: 8324222 - DNA, 22 bp, Homo sapiens
tcagttttcaatttcatcagag

SEQ ID NO: 8324223 - DNA, 19 bp, Homo sapiens
tcagttttagtcatcagtt

SEQ ID NO: 8324224 - DNA, 22 bp, Homo sapiens
tcagttttaaggtttgagaatt

SEQ ID NO: 8324225 - DNA, 22 bp, Homo sapiens
tcagtttcttcatctccctaac

SEQ ID NO: 8324226 - DNA, 22 bp, Homo sapiens
tcatctaagagtcttacattta

SEQ ID NO: 8324227 - DNA, 22 bp, Homo sapiens
tcatctaagagtcttacattta

SEQ ID NO: 8324228 - DNA, 22 bp, Homo sapiens
tcataaaatgctcctgatattg

SEQ ID NO: 8324229 - DNA, 22 bp, Homo sapiens
tcataaaatgctcctgatattg

SEQ ID NO: 8324230 - DNA, 22 bp, Homo sapiens
tcaggaaatggacatctttgct

SEQ ID NO: 8324231 - DNA, 22 bp, Homo sapiens
tcaggaaagtgttctcagagga

SEQ ID NO: 8324232 - DNA, 22 bp, Homo sapiens
tcagagtcctcaccctgaggat

SEQ ID NO: 8324233 - DNA, 22 bp, Homo sapiens
tcagaggttcttctcagtggcc

SEQ ID NO: 8324234 - DNA, 21 bp, Homo sapiens
tcagagggccctggaggctca

SEQ ID NO: 8324235 - DNA, 22 bp, Homo sapiens
tcagaggcttgaagcccaagcc

SEQ ID NO: 8324236 - DNA, 22 bp, Homo sapiens
tcagaggcttctggccagtctg

SEQ ID NO: 8324237 - DNA, 22 bp, Homo sapiens
tcagaggcttccttcctcggag

SEQ ID NO: 8324238 - DNA, 21 bp, Homo sapiens
tcagaggctgggggaatgccc

SEQ ID NO: 8324239 - DNA, 20 bp, Homo sapiens
tcagaggctgccagctgggg

SEQ ID NO: 8324240 - DNA, 22 bp, Homo sapiens
tcagaggtggagatagttggga

SEQ ID NO: 8324241 - DNA, 22 bp, Homo sapiens
tcaccgaggctggagtgcagtg

SEQ ID NO: 8324242 - DNA, 22 bp, Homo sapiens
tcacccatgtgtctcccttata

SEQ ID NO: 8324243 - DNA, 22 bp, Homo sapiens
tcaccccctgtattagtagcta

SEQ ID NO: 8324244 - DNA, 20 bp, Homo sapiens
tcacatctggcagctgatga

SEQ ID NO: 8324245 - DNA, 22 bp, Homo sapiens
tcacatcttggattacaatttt

SEQ ID NO: 8324246 - DNA, 22 bp, Homo sapiens
tcacatctgttgatacagcatc

SEQ ID NO: 8324247 - DNA, 22 bp, Homo sapiens
tcacatctgtgtgattgtcatt

SEQ ID NO: 8324248 - DNA, 22 bp, Homo sapiens
tcacatcttgtgatgttttcat

SEQ ID NO: 8324249 - DNA, 22 bp, Homo sapiens
tcacatctttaggcttacaggt

SEQ ID NO: 8324250 - DNA, 22 bp, Homo sapiens
tcactaagtgccgagtttagtt

SEQ ID NO: 8324251 - DNA, 22 bp, Homo sapiens
tcacgttttactgagtgagata

SEQ ID NO: 8324252 - DNA, 22 bp, Homo sapiens
tcactaagttacatttagtatt

SEQ ID NO: 8324253 - DNA, 22 bp, Homo sapiens
tcactacaaaagtctccctttc

SEQ ID NO: 8324254 - DNA, 20 bp, Homo sapiens
tcactgtaacatttgggggg

SEQ ID NO: 8324255 - DNA, 22 bp, Homo sapiens
tcactggtgtgagaggagcaaa

SEQ ID NO: 8324256 - DNA, 22 bp, Homo sapiens
tcactgtgaatgttatcatctt

SEQ ID NO: 8324257 - DNA, 22 bp, Homo sapiens
tcagaacatatattttgtgatg

SEQ ID NO: 8324258 - DNA, 22 bp, Homo sapiens
tcagaacatcctggtttaaaat

SEQ ID NO: 8324259 - DNA, 21 bp, Homo sapiens
tcagaactggtgcagatgaat

SEQ ID NO: 8324260 - DNA, 22 bp, Homo sapiens
tcagaacatttaaaaagtggtt

SEQ ID NO: 8324261 - DNA, 22 bp, Homo sapiens
tcagaacatttgggactttggg

SEQ ID NO: 8324262 - DNA, 22 bp, Homo sapiens
tcagaacattgacattcttatt

SEQ ID NO: 8324263 - DNA, 22 bp, Homo sapiens
tcagaacattaaggatttgaag

SEQ ID NO: 8324264 - DNA, 22 bp, Homo sapiens
tcagaacatggcatgttccatc

SEQ ID NO: 8324265 - DNA, 22 bp, Homo sapiens
tcagaacattacattttgagct

SEQ ID NO: 8324266 - DNA, 22 bp, Homo sapiens
tcagaacattctcattgactgc

SEQ ID NO: 8324267 - DNA, 22 bp, Homo sapiens
tcagaggacagcagctaaataa

SEQ ID NO: 8324268 - DNA, 22 bp, Homo sapiens
tcagaggcctgaaagaatttgg

SEQ ID NO: 8324269 - DNA, 22 bp, Homo sapiens
tcagaggctacagtctgggagt

SEQ ID NO: 8324270 - DNA, 22 bp, Homo sapiens
tcagaggcatcattcatagtta

SEQ ID NO: 8324271 - DNA, 21 bp, Homo sapiens
tcagaggcactgagagcaatg

SEQ ID NO: 8324272 - DNA, 22 bp, Homo sapiens
tcacatctatacccaataattt

SEQ ID NO: 8324273 - DNA, 22 bp, Homo sapiens
tcacatctaattccatttctgc

SEQ ID NO: 8324274 - DNA, 22 bp, Homo sapiens
tcacatctgaaaaaatattgag

SEQ ID NO: 8324275 - DNA, 23 bp, Homo sapiens
tcacatctgccgtagtgtattct

SEQ ID NO: 8324276 - DNA, 21 bp, Homo sapiens
tcacatctatgttaagcaaac

SEQ ID NO: 8324277 - DNA, 22 bp, Homo sapiens
tcacagctattctcatgtattt

SEQ ID NO: 8324278 - DNA, 21 bp, Homo sapiens
tcacagagccacagaattggt

SEQ ID NO: 8324279 - DNA, 22 bp, Homo sapiens
tcacagacacattaaacatgtg

SEQ ID NO: 8324280 - DNA, 22 bp, Homo sapiens
tcacagacaccttggccacagt

SEQ ID NO: 8324281 - DNA, 19 bp, Homo sapiens
tcacagacagagcaatcac

SEQ ID NO: 8324282 - DNA, 22 bp, Homo sapiens
tcacagacatggtgaggtaaca

SEQ ID NO: 8324283 - DNA, 22 bp, Homo sapiens
tcacagagaggttaagcagttg

SEQ ID NO: 8324284 - DNA, 22 bp, Homo sapiens
tcacagacacagggagaagcat

SEQ ID NO: 8324285 - DNA, 22 bp, Homo sapiens
tcaatttaaggtactactttgg

SEQ ID NO: 8324286 - DNA, 22 bp, Homo sapiens
tcaaaagtggcctgtaaaatct

SEQ ID NO: 8324287 - DNA, 20 bp, Homo sapiens
tcaaaataggtgtgggcgga

SEQ ID NO: 8324288 - DNA, 22 bp, Homo sapiens
tcaaaattctagggagaatggt

SEQ ID NO: 8324289 - DNA, 22 bp, Homo sapiens
tcaaaatttcagcactagccct

SEQ ID NO: 8324290 - DNA, 22 bp, Homo sapiens
tcaaaattttatttctcaagga

SEQ ID NO: 8324291 - DNA, 22 bp, Homo sapiens
tcaaaattagtgaccaaaggca

SEQ ID NO: 8324292 - DNA, 22 bp, Homo sapiens
tcaaaattaaaccaacgtccag

SEQ ID NO: 8324293 - DNA, 18 bp, Homo sapiens
tcaaaatatttctgtgga

SEQ ID NO: 8324294 - DNA, 22 bp, Homo sapiens
tcaaacatatctgattttccat

SEQ ID NO: 8324295 - DNA, 22 bp, Homo sapiens
taagttacctgttttgtcatca

SEQ ID NO: 8324296 - DNA, 22 bp, Homo sapiens
taagttacacttaacttactag

SEQ ID NO: 8324297 - DNA, 22 bp, Homo sapiens
taataaatgaaagtgctggcat

SEQ ID NO: 8324298 - DNA, 22 bp, Homo sapiens
taataacaattgtaggacatga

SEQ ID NO: 8324299 - DNA, 22 bp, Homo sapiens
taataacaattgtaggacatga

SEQ ID NO: 8324300 - DNA, 22 bp, Homo sapiens
taagtttggggaaaatgttaag

SEQ ID NO: 8324301 - DNA, 22 bp, Homo sapiens
taagtttgtgtctctgttactt

SEQ ID NO: 8324302 - DNA, 22 bp, Homo sapiens
taatgactaagcaatcatgaat

SEQ ID NO: 8324303 - DNA, 22 bp, Homo sapiens
taatgactaagcatcattaaac

SEQ ID NO: 8324304 - DNA, 22 bp, Homo sapiens
taatgactgccgtctctcttca

SEQ ID NO: 8324305 - DNA, 23 bp, Homo sapiens
taatgagaagctttgtttcctga

SEQ ID NO: 8324306 - DNA, 22 bp, Homo sapiens
taatgactgtaccaaggcttca

SEQ ID NO: 8324307 - DNA, 22 bp, Homo sapiens
taatgacttgaaggacccatgg

SEQ ID NO: 8324308 - DNA, 22 bp, Homo sapiens
taatgaggaaggagactttcac

SEQ ID NO: 8324309 - DNA, 22 bp, Homo sapiens
taatgctttgttttgatctaac

SEQ ID NO: 8324310 - DNA, 22 bp, Homo sapiens
taatgcttcaatttccttgatt

SEQ ID NO: 8324311 - DNA, 22 bp, Homo sapiens
taatttcactgatatgaagtca

SEQ ID NO: 8324312 - DNA, 21 bp, Homo sapiens
tacacaaagcgtggtccagag

SEQ ID NO: 8324313 - DNA, 22 bp, Homo sapiens
tacaatgagctgtacatctcca

SEQ ID NO: 8324314 - DNA, 22 bp, Homo sapiens
taatttttccacgtacactggg

SEQ ID NO: 8324315 - DNA, 22 bp, Homo sapiens
taatttttccacgtacactggg

SEQ ID NO: 8324316 - DNA, 22 bp, Homo sapiens
tacaatatgtggccttttgtga

SEQ ID NO: 8324317 - DNA, 20 bp, Homo sapiens
tacaatattcccactttgct

SEQ ID NO: 8324318 - DNA, 20 bp, Homo sapiens
tacaatattcccactttgct

SEQ ID NO: 8324319 - DNA, 22 bp, Homo sapiens
taattttgtccccctgcacata

SEQ ID NO: 8324320 - DNA, 22 bp, Homo sapiens
taattttccactctgtttatct

SEQ ID NO: 8324321 - DNA, 22 bp, Homo sapiens
taattttatgacagtgtatttt

SEQ ID NO: 8324322 - DNA, 22 bp, Homo sapiens
tactgaaagtggtcaacagtgg

SEQ ID NO: 8324323 - DNA, 22 bp, Homo sapiens
tactgaaagtggtcaacagtgg

SEQ ID NO: 8324324 - DNA, 22 bp, Homo sapiens
tacccagcaatccctagaggtt

SEQ ID NO: 8324325 - DNA, 22 bp, Homo sapiens
tactgcagatggccttgttctt

SEQ ID NO: 8324326 - DNA, 17 bp, Homo sapiens
tactgaggggtctggag

SEQ ID NO: 8324327 - DNA, 22 bp, Homo sapiens
tactgaggctgaattcttagca

SEQ ID NO: 8324328 - DNA, 19 bp, Homo sapiens
tacttattagaaatatggg

SEQ ID NO: 8324329 - DNA, 22 bp, Homo sapiens
tacttgagtatagtcgcttcac

SEQ ID NO: 8324330 - DNA, 22 bp, Homo sapiens
tacattcaacatgtcactatgt

SEQ ID NO: 8324331 - DNA, 22 bp, Homo sapiens
tacattatcttgttatctttca

SEQ ID NO: 8324332 - DNA, 22 bp, Homo sapiens
tacaggaagttacagactatga

SEQ ID NO: 8324333 - DNA, 20 bp, Homo sapiens
tacaggaatcaagactgcat

SEQ ID NO: 8324334 - DNA, 17 bp, Homo sapiens
tacaggagagcaggaac

SEQ ID NO: 8324335 - DNA, 22 bp, Homo sapiens
tacataattaatctttaagttc

SEQ ID NO: 8324336 - DNA, 22 bp, Homo sapiens
tacataattaatctttaagttc

SEQ ID NO: 8324337 - DNA, 22 bp, Homo sapiens
tacataattaatctttaagttc

SEQ ID NO: 8324338 - DNA, 18 bp, Homo sapiens
tacaggaaaagtgttaca

SEQ ID NO: 8324339 - DNA, 22 bp, Homo sapiens
tacagcacttaattaccttgag

SEQ ID NO: 8324340 - DNA, 22 bp, Homo sapiens
tacagcactgtgcatagtggtt

SEQ ID NO: 8324341 - DNA, 21 bp, Homo sapiens
taaataataagttgctgagat

SEQ ID NO: 8324342 - DNA, 21 bp, Homo sapiens
taaataataagttgctgagat

SEQ ID NO: 8324343 - DNA, 22 bp, Homo sapiens
taaataagttcttcattgtttg

SEQ ID NO: 8324344 - DNA, 22 bp, Homo sapiens
taaagttcttagaacaaggcct

SEQ ID NO: 8324345 - DNA, 22 bp, Homo sapiens
taaactgcttctctcagtctgt

SEQ ID NO: 8324346 - DNA, 22 bp, Homo sapiens
taaagacaaacccactagggtt

SEQ ID NO: 8324347 - DNA, 22 bp, Homo sapiens
taaagacaatttcgagctgtag

SEQ ID NO: 8324348 - DNA, 22 bp, Homo sapiens
taaagttataaattacctgtca

SEQ ID NO: 8324349 - DNA, 22 bp, Homo sapiens
taaacagagtgctagttcacgg

SEQ ID NO: 8324350 - DNA, 22 bp, Homo sapiens
gttttataggtgaaatattact

SEQ ID NO: 8324351 - DNA, 22 bp, Homo sapiens
gttttataggtgaaatattact

SEQ ID NO: 8324352 - DNA, 22 bp, Homo sapiens
gttttataggtgaaatattact

SEQ ID NO: 8324353 - DNA, 22 bp, Homo sapiens
gttttatatgtctctgctgaca

SEQ ID NO: 8324354 - DNA, 22 bp, Homo sapiens
gttttatagttcgggacctgtt

SEQ ID NO: 8324355 - DNA, 22 bp, Homo sapiens
gttttataattgcttcataaga

SEQ ID NO: 8324356 - DNA, 22 bp, Homo sapiens
gttttataattgcttcataaga

SEQ ID NO: 8324357 - DNA, 22 bp, Homo sapiens
gttttataggctgttgctatat

SEQ ID NO: 8324358 - DNA, 22 bp, Homo sapiens
gttttataggctgttgctatat

SEQ ID NO: 8324359 - DNA, 22 bp, Homo sapiens
gttttatttccatgagagaccg

SEQ ID NO: 8324360 - DNA, 22 bp, Homo sapiens
gttttattggaacacagccatg

SEQ ID NO: 8324361 - DNA, 22 bp, Homo sapiens
taagagttactggtttagaacc

SEQ ID NO: 8324362 - DNA, 22 bp, Homo sapiens
taagataaggaacattctgtga

SEQ ID NO: 8324363 - DNA, 22 bp, Homo sapiens
taactgtttttgaaatatatct

SEQ ID NO: 8324364 - DNA, 21 bp, Homo sapiens
taacaatctctacttctcatt

SEQ ID NO: 8324365 - DNA, 21 bp, Homo sapiens
taacaatctctacttctcatt

SEQ ID NO: 8324366 - DNA, 22 bp, Homo sapiens
taacaaactggaaattgacatt

SEQ ID NO: 8324367 - DNA, 22 bp, Homo sapiens
taacaaactggaaattgacatt

SEQ ID NO: 8324368 - DNA, 22 bp, Homo sapiens
taacaatagtgtttgctagtca

SEQ ID NO: 8324369 - DNA, 22 bp, Homo sapiens
taactggtatatcagtgtacac

SEQ ID NO: 8324370 - DNA, 22 bp, Homo sapiens
gtttacattgctgtttgtgtct

SEQ ID NO: 8324371 - DNA, 22 bp, Homo sapiens
gtttacaaatattttaaatggt

SEQ ID NO: 8324372 - DNA, 22 bp, Homo sapiens
gtttactgttaaccaacgaatg

SEQ ID NO: 8324373 - DNA, 22 bp, Homo sapiens
gtttactgtcttgcacagtgca

SEQ ID NO: 8324374 - DNA, 22 bp, Homo sapiens
gtttactggagaagatgacctg

SEQ ID NO: 8324375 - DNA, 22 bp, Homo sapiens
gtttactggagaagatgacctg

SEQ ID NO: 8324376 - DNA, 22 bp, Homo sapiens
gtttactgctctaggttgcaca

SEQ ID NO: 8324377 - DNA, 22 bp, Homo sapiens
gtttacttgtgccttggcttaa

SEQ ID NO: 8324378 - DNA, 22 bp, Homo sapiens
gtttagaatggcaaaattaagt

SEQ ID NO: 8324379 - DNA, 22 bp, Homo sapiens
gtttagtgtttcaagactcttt

SEQ ID NO: 8324380 - DNA, 22 bp, Homo sapiens
gtttctctttgaagcctggctg

SEQ ID NO: 8324381 - DNA, 22 bp, Homo sapiens
gtttctcagtttggtctgcaga

SEQ ID NO: 8324382 - DNA, 22 bp, Homo sapiens
gtttctctgtctgttacattgg

SEQ ID NO: 8324383 - DNA, 22 bp, Homo sapiens
gtttctaattggaactttgagg

SEQ ID NO: 8324384 - DNA, 22 bp, Homo sapiens
gtttctaattggaactttgagg

SEQ ID NO: 8324385 - DNA, 22 bp, Homo sapiens
gtttctaagcacatgtgagtgt

SEQ ID NO: 8324386 - DNA, 22 bp, Homo sapiens
gtttctaagggagagctgccag

SEQ ID NO: 8324387 - DNA, 22 bp, Homo sapiens
gtttctaaatgttctgagtttt

SEQ ID NO: 8324388 - DNA, 22 bp, Homo sapiens
gtttctaagcacatgtgagtgt

SEQ ID NO: 8324389 - DNA, 22 bp, Homo sapiens
gtttctcaagcttgaatgcaca

SEQ ID NO: 8324390 - DNA, 23 bp, Homo sapiens
gtttctatgtcttgtgccttcat

SEQ ID NO: 8324391 - DNA, 22 bp, Homo sapiens
gtttataaggcccaatatttct

SEQ ID NO: 8324392 - DNA, 22 bp, Homo sapiens
gtttataaggcccaatatttct

SEQ ID NO: 8324393 - DNA, 22 bp, Homo sapiens
gtttcccatatctagggagagg

SEQ ID NO: 8324394 - DNA, 23 bp, Homo sapiens
gttcattttattgtctgattgct

SEQ ID NO: 8324395 - DNA, 23 bp, Homo sapiens
gttcattttattgtctgattgct

SEQ ID NO: 8324396 - DNA, 23 bp, Homo sapiens
gttcattttattgtctgattgct

SEQ ID NO: 8324397 - DNA, 22 bp, Homo sapiens
gttcatttttactttgatctac

SEQ ID NO: 8324398 - DNA, 22 bp, Homo sapiens
gttccaattccaaattccaagg

SEQ ID NO: 8324399 - DNA, 22 bp, Homo sapiens
gttcattttactgtaaatagca

SEQ ID NO: 8324400 - DNA, 22 bp, Homo sapiens
gttactcttgagaggctgaggt

SEQ ID NO: 8324401 - DNA, 22 bp, Homo sapiens
gttactcttccccggggtctgg

SEQ ID NO: 8324402 - DNA, 22 bp, Homo sapiens
gttacaaaggtcataaaagtgt

SEQ ID NO: 8324403 - DNA, 22 bp, Homo sapiens
gttagagggctgccttttgttt

SEQ ID NO: 8324404 - DNA, 22 bp, Homo sapiens
gttagagggaaaaatcatttgc

SEQ ID NO: 8324405 - DNA, 22 bp, Homo sapiens
gtgctttgttaagtctgaaatt

SEQ ID NO: 8324406 - DNA, 22 bp, Homo sapiens
gtgttacagtaccttgtcacaa

SEQ ID NO: 8324407 - DNA, 18 bp, Homo sapiens
gtgttacaggagtgcagc

SEQ ID NO: 8324408 - DNA, 22 bp, Homo sapiens
gtgttactgcttttatctacca

SEQ ID NO: 8324409 - DNA, 22 bp, Homo sapiens
gtgtgttcgtatcaacagagga

SEQ ID NO: 8324410 - DNA, 22 bp, Homo sapiens
gtgtgttcagcaagaggtaagg

SEQ ID NO: 8324411 - DNA, 22 bp, Homo sapiens
tagtccttgctgggcacagagt

SEQ ID NO: 8324412 - DNA, 22 bp, Homo sapiens
tagtcctttaatagttaatgtg

SEQ ID NO: 8324413 - DNA, 18 bp, Homo sapiens
tagtattggattggggac

SEQ ID NO: 8324414 - DNA, 22 bp, Homo sapiens
tagtattttagaaaaccatgaa

SEQ ID NO: 8324415 - DNA, 20 bp, Homo sapiens
tagtatttgcataaggatag

SEQ ID NO: 8324416 - DNA, 22 bp, Homo sapiens
tagtaaaagtttagttgaaagt

SEQ ID NO: 8324417 - DNA, 22 bp, Homo sapiens
tagtaaaaggtcttcctttgtt

SEQ ID NO: 8324418 - DNA, 22 bp, Homo sapiens
tagtaaagtgtcttaacacata

SEQ ID NO: 8324419 - DNA, 22 bp, Homo sapiens
tagtaaaaagcaatggtgagta

SEQ ID NO: 8324420 - DNA, 22 bp, Homo sapiens
tagtaaaaggtcttcctttgtt

SEQ ID NO: 8324421 - DNA, 22 bp, Homo sapiens
taggacaggtgaggggctgtgg

SEQ ID NO: 8324422 - DNA, 22 bp, Homo sapiens
taggcccagttccgcctcccgg

SEQ ID NO: 8324423 - DNA, 22 bp, Homo sapiens
taggcctcaggaccccagggct

SEQ ID NO: 8324424 - DNA, 22 bp, Homo sapiens
taggaaggaggccatcttggcg

SEQ ID NO: 8324425 - DNA, 22 bp, Homo sapiens
taggaaggtgtttttaaggagc

SEQ ID NO: 8324426 - DNA, 22 bp, Homo sapiens
taggaagtctgtgatgttgttt

SEQ ID NO: 8324427 - DNA, 22 bp, Homo sapiens
taggaagtgcattgttttccta

SEQ ID NO: 8324428 - DNA, 22 bp, Homo sapiens
taggaagtccaagaccaaagtg

SEQ ID NO: 8324429 - DNA, 22 bp, Homo sapiens
tagcccagatgattgaaccatg

SEQ ID NO: 8324430 - DNA, 22 bp, Homo sapiens
taggaaagaaatgagtagtgat

SEQ ID NO: 8324431 - DNA, 19 bp, Homo sapiens
tagcccagagcctggctac

SEQ ID NO: 8324432 - DNA, 22 bp, Homo sapiens
taggaaataattcactctggct

SEQ ID NO: 8324433 - DNA, 22 bp, Homo sapiens
tagatgatggaaaaaagcaata

SEQ ID NO: 8324434 - DNA, 22 bp, Homo sapiens
tagatgattttcagtcaaagca

SEQ ID NO: 8324435 - DNA, 22 bp, Homo sapiens
tagatggaggctagatgcaggg

SEQ ID NO: 8324436 - DNA, 22 bp, Homo sapiens
tagagatgaattctgcagtctt

SEQ ID NO: 8324437 - DNA, 22 bp, Homo sapiens
tagagctgataatgaggccaag

SEQ ID NO: 8324438 - DNA, 18 bp, Homo sapiens
tagaagtgtgctatacaa

SEQ ID NO: 8324439 - DNA, 22 bp, Homo sapiens
tagaagtggcaacactcagaaa

SEQ ID NO: 8324440 - DNA, 22 bp, Homo sapiens
tagaataagttgatgatatatg

SEQ ID NO: 8324441 - DNA, 22 bp, Homo sapiens
tagaagtttcaaaagacttcat

SEQ ID NO: 8324442 - DNA, 22 bp, Homo sapiens
tactttcatgggttttctttat

SEQ ID NO: 8324443 - DNA, 22 bp, Homo sapiens
tagcacccatggaatctgctgg

SEQ ID NO: 8324444 - DNA, 22 bp, Homo sapiens
tagcacccacctcgtggggttt

SEQ ID NO: 8324445 - DNA, 22 bp, Homo sapiens
tagcatttattccagatttgga

SEQ ID NO: 8324446 - DNA, 22 bp, Homo sapiens
tagcatttatggtcatgtgtcc

SEQ ID NO: 8324447 - DNA, 22 bp, Homo sapiens
tagcatttggcaccagttattt

SEQ ID NO: 8324448 - DNA, 22 bp, Homo sapiens
tagcatttcccaaatgcatttg

SEQ ID NO: 8324449 - DNA, 22 bp, Homo sapiens
tagccagtttctttaacagcaa

SEQ ID NO: 8324450 - DNA, 22 bp, Homo sapiens
tagccagtgaatgtttccagtg

SEQ ID NO: 8324451 - DNA, 22 bp, Homo sapiens
tagccagtgagacccagaaata

SEQ ID NO: 8324452 - DNA, 22 bp, Homo sapiens
tagcaaaaactgcagttacttt

SEQ ID NO: 8324453 - DNA, 17 bp, Homo sapiens
tagcacaaagcaggatt

SEQ ID NO: 8324454 - DNA, 22 bp, Homo sapiens
tagattttaggagattttactg

SEQ ID NO: 8324455 - DNA, 22 bp, Homo sapiens
tagattttgcatttctaacaag

SEQ ID NO: 8324456 - DNA, 22 bp, Homo sapiens
tagattttaggagattttactg

SEQ ID NO: 8324457 - DNA, 22 bp, Homo sapiens
tagattttacttctgtcattac

SEQ ID NO: 8324458 - DNA, 22 bp, Homo sapiens
tagattttacttctgtcattac

SEQ ID NO: 8324459 - DNA, 22 bp, Homo sapiens
tatagacttggcatgcatgttc

SEQ ID NO: 8324460 - DNA, 22 bp, Homo sapiens
tatagactagcagcagaattta

SEQ ID NO: 8324461 - DNA, 22 bp, Homo sapiens
tatatgtagattgtaccaatgt

SEQ ID NO: 8324462 - DNA, 22 bp, Homo sapiens
tatattaaatgaccagttttaa

SEQ ID NO: 8324463 - DNA, 22 bp, Homo sapiens
tatattaaagtgctttgcagtg

SEQ ID NO: 8324464 - DNA, 22 bp, Homo sapiens
tatattatcataaaaccattca

SEQ ID NO: 8324465 - DNA, 22 bp, Homo sapiens
tatattataagccctttcagaa

SEQ ID NO: 8324466 - DNA, 22 bp, Homo sapiens
tatattacctgcctgatctata

SEQ ID NO: 8324467 - DNA, 22 bp, Homo sapiens
tatacagaaccgcctgaagtct

SEQ ID NO: 8324468 - DNA, 22 bp, Homo sapiens
tagttaatgctaattaacaaat

SEQ ID NO: 8324469 - DNA, 22 bp, Homo sapiens
tagttaaagattctgttaagag

SEQ ID NO: 8324470 - DNA, 22 bp, Homo sapiens
tatacagatatctaagatgtaa

SEQ ID NO: 8324471 - DNA, 22 bp, Homo sapiens
tatacagataatgaagaccaag

SEQ ID NO: 8324472 - DNA, 21 bp, Homo sapiens
tatacagaggggaacaggaga

SEQ ID NO: 8324473 - DNA, 20 bp, Homo sapiens
tatactaacatatatctgtt

SEQ ID NO: 8324474 - DNA, 22 bp, Homo sapiens
tataccttccacaaaacagctt

SEQ ID NO: 8324475 - DNA, 22 bp, Homo sapiens
tatacctttaccttgaccaaat

SEQ ID NO: 8324476 - DNA, 22 bp, Homo sapiens
tataccttgagcagggcggccc

SEQ ID NO: 8324477 - DNA, 22 bp, Homo sapiens
tatcaactgagattaaatattt

SEQ ID NO: 8324478 - DNA, 22 bp, Homo sapiens
tatctgtcttgacatgttggtt

SEQ ID NO: 8324479 - DNA, 22 bp, Homo sapiens
tatctttagaggaagagaatct

SEQ ID NO: 8324480 - DNA, 22 bp, Homo sapiens
tatctttagaggaagagaatct

SEQ ID NO: 8324481 - DNA, 22 bp, Homo sapiens
tatctttattatgtctatctgc

SEQ ID NO: 8324482 - DNA, 22 bp, Homo sapiens
tatctttgcaaatatctctaag

SEQ ID NO: 8324483 - DNA, 20 bp, Homo sapiens
tatgataattacaaaatagt

SEQ ID NO: 8324484 - DNA, 22 bp, Homo sapiens
tattttcaccttctctggatat

SEQ ID NO: 8324485 - DNA, 22 bp, Homo sapiens
tatttgttgcgggaattgctat

SEQ ID NO: 8324486 - DNA, 22 bp, Homo sapiens
tatttgttgcgggaattgctat

SEQ ID NO: 8324487 - DNA, 18 bp, Homo sapiens
tatttcccaatggaaaca

SEQ ID NO: 8324488 - DNA, 22 bp, Homo sapiens
tatttgtatgtgtgtacatata

SEQ ID NO: 8324489 - DNA, 22 bp, Homo sapiens
tattgcatattattctagtggc

SEQ ID NO: 8324490 - DNA, 22 bp, Homo sapiens
tattgattctgtcccaagttga

SEQ ID NO: 8324491 - DNA, 22 bp, Homo sapiens
tattgattcctgctttctgctc

SEQ ID NO: 8324492 - DNA, 22 bp, Homo sapiens
tatttcactattctctgtaact

SEQ ID NO: 8324493 - DNA, 22 bp, Homo sapiens
tatttcactcagtataccatag

SEQ ID NO: 8324494 - DNA, 22 bp, Homo sapiens
tatgttaagtgggataatcaaa

SEQ ID NO: 8324495 - DNA, 22 bp, Homo sapiens
tatgtttaaatgtatgtgtatg

SEQ ID NO: 8324496 - DNA, 22 bp, Homo sapiens
tatgttgagcattcagtgatct

SEQ ID NO: 8324497 - DNA, 22 bp, Homo sapiens
tatgttgcaccaacctaataat

SEQ ID NO: 8324498 - DNA, 21 bp, Homo sapiens
tatgttagtgatgtttgtagg

SEQ ID NO: 8324499 - DNA, 22 bp, Homo sapiens
tattcacatgtacatatgctca

SEQ ID NO: 8324500 - DNA, 22 bp, Homo sapiens
tattcacattaataagtcttca

SEQ ID NO: 8324501 - DNA, 22 bp, Homo sapiens
tattgaggtgcttagctggggg

SEQ ID NO: 8324502 - DNA, 21 bp, Homo sapiens
tattgattcaatttcttgagt

SEQ ID NO: 8324503 - DNA, 21 bp, Homo sapiens
tattgattcaatttcttgagt

SEQ ID NO: 8324504 - DNA, 22 bp, Homo sapiens
gctgcaggagctggagctgtgg

SEQ ID NO: 8324505 - DNA, 22 bp, Homo sapiens
gctgcaggatgaggctctgctc

SEQ ID NO: 8324506 - DNA, 22 bp, Homo sapiens
gctgcagggggtgggcgtctcc

SEQ ID NO: 8324507 - DNA, 22 bp, Homo sapiens
gctgccagtagttggagctcca

SEQ ID NO: 8324508 - DNA, 22 bp, Homo sapiens
gctgccagggaggtggtggagg

SEQ ID NO: 8324509 - DNA, 22 bp, Homo sapiens
gctgccaggggcagctgtctca

SEQ ID NO: 8324510 - DNA, 21 bp, Homo sapiens
gctgccaggattttgcaggaa

SEQ ID NO: 8324511 - DNA, 22 bp, Homo sapiens
gctgccaggacggagaggagcg

SEQ ID NO: 8324512 - DNA, 22 bp, Homo sapiens
gctgatccttttatgtctagct

SEQ ID NO: 8324513 - DNA, 23 bp, Homo sapiens
gctgatggagacttgtggcctcc

SEQ ID NO: 8324514 - DNA, 22 bp, Homo sapiens
gctgatgggagctggctcaccc

SEQ ID NO: 8324515 - DNA, 22 bp, Homo sapiens
gctgatgtatatagtgattgag

SEQ ID NO: 8324516 - DNA, 22 bp, Homo sapiens
gctgaagctgcagcaggaggaa

SEQ ID NO: 8324517 - DNA, 22 bp, Homo sapiens
gctgaagataagtgaagaggct

SEQ ID NO: 8324518 - DNA, 22 bp, Homo sapiens
gctgaagtgtggagtgacagtt

SEQ ID NO: 8324519 - DNA, 22 bp, Homo sapiens
gctctgctctaacattcctgac

SEQ ID NO: 8324520 - DNA, 22 bp, Homo sapiens
gctctgcctggtcgcgtgctgg

SEQ ID NO: 8324521 - DNA, 22 bp, Homo sapiens
gctctgctaatattgtagtacc

SEQ ID NO: 8324522 - DNA, 22 bp, Homo sapiens
gctctgccttctcactgggttc

SEQ ID NO: 8324523 - DNA, 22 bp, Homo sapiens
gctctgcctttgtcttacacgg

SEQ ID NO: 8324524 - DNA, 17 bp, Homo sapiens
gctctgcctctcccacc

SEQ ID NO: 8324525 - DNA, 22 bp, Homo sapiens
gctctgcctctttgctgcgtca

SEQ ID NO: 8324526 - DNA, 22 bp, Homo sapiens
gctctgccccaggaactcagcc

SEQ ID NO: 8324527 - DNA, 22 bp, Homo sapiens
gctctgccctgggccgttgtaa

SEQ ID NO: 8324528 - DNA, 22 bp, Homo sapiens
gctctgcctcccctagtgttac

SEQ ID NO: 8324529 - DNA, 18 bp, Homo sapiens
gctctgcccaggctgccc

SEQ ID NO: 8324530 - DNA, 22 bp, Homo sapiens
gctctgcccagtgccctgagac

SEQ ID NO: 8324531 - DNA, 17 bp, Homo sapiens
gctctgccccagcctct

SEQ ID NO: 8324532 - DNA, 22 bp, Homo sapiens
gctctgctgacagctgggacag

SEQ ID NO: 8324533 - DNA, 22 bp, Homo sapiens
gctctgctgagatatctgggag

SEQ ID NO: 8324534 - DNA, 22 bp, Homo sapiens
gctcagggaaagagctcctgtc

SEQ ID NO: 8324535 - DNA, 22 bp, Homo sapiens
gctcctggtctggagcttcaag

SEQ ID NO: 8324536 - DNA, 22 bp, Homo sapiens
gctcctggtgcaaagtttcttc

SEQ ID NO: 8324537 - DNA, 22 bp, Homo sapiens
gctcagggaaagagctcctgtc

SEQ ID NO: 8324538 - DNA, 22 bp, Homo sapiens
gctcctgtcttggggcactggc

SEQ ID NO: 8324539 - DNA, 18 bp, Homo sapiens
gctcctggttggaaagaa

SEQ ID NO: 8324540 - DNA, 21 bp, Homo sapiens
gctcctggtgctgcgtggcgc

SEQ ID NO: 8324541 - DNA, 22 bp, Homo sapiens
gctcctggtgctgtagagattt

SEQ ID NO: 8324542 - DNA, 22 bp, Homo sapiens
gctctcactttaggttggaccg

SEQ ID NO: 8324543 - DNA, 22 bp, Homo sapiens
gctcctgttttcttccagaaat

SEQ ID NO: 8324544 - DNA, 22 bp, Homo sapiens
gctcacagccggctggcagggg

SEQ ID NO: 8324545 - DNA, 22 bp, Homo sapiens
gctcaaatttcagactcatgaa

SEQ ID NO: 8324546 - DNA, 22 bp, Homo sapiens
gctcaaatttcagactcatgaa

SEQ ID NO: 8324547 - DNA, 22 bp, Homo sapiens
gctcaagccttctgcccacctc

SEQ ID NO: 8324548 - DNA, 22 bp, Homo sapiens
gcggggggaggaacatcttgca

SEQ ID NO: 8324549 - DNA, 22 bp, Homo sapiens
gctatctttctgcaccataatt

SEQ ID NO: 8324550 - DNA, 22 bp, Homo sapiens
gctatcttcatggaaatacagg

SEQ ID NO: 8324551 - DNA, 22 bp, Homo sapiens
gcgccccatctacagtactttt

SEQ ID NO: 8324552 - DNA, 22 bp, Homo sapiens
gcgcctggcacacagcaagggc

SEQ ID NO: 8324553 - DNA, 22 bp, Homo sapiens
gcggcaggagtaaaggaggaag

SEQ ID NO: 8324554 - DNA, 22 bp, Homo sapiens
gcggcggagacagcaggaagcc

SEQ ID NO: 8324555 - DNA, 22 bp, Homo sapiens
gcgggccaccttggagagcgct

SEQ ID NO: 8324556 - DNA, 22 bp, Homo sapiens
gcctggctgaggtggggaggca

SEQ ID NO: 8324557 - DNA, 22 bp, Homo sapiens
gcctggctagttagtgtcaggt

SEQ ID NO: 8324558 - DNA, 22 bp, Homo sapiens
gcctcagctgttgcaggggccc

SEQ ID NO: 8324559 - DNA, 21 bp, Homo sapiens
gcctggcttcacaggcactga

SEQ ID NO: 8324560 - DNA, 23 bp, Homo sapiens
gcctggcttccaaggtaggggag

SEQ ID NO: 8324561 - DNA, 22 bp, Homo sapiens
gcctggcttcccttggagcatt

SEQ ID NO: 8324562 - DNA, 22 bp, Homo sapiens
gcctggctggtagagggggctc

SEQ ID NO: 8324563 - DNA, 19 bp, Homo sapiens
gcctggctgggatgagccc

SEQ ID NO: 8324564 - DNA, 22 bp, Homo sapiens
gcctggtctctggggttgggta

SEQ ID NO: 8324565 - DNA, 22 bp, Homo sapiens
gcctggggcatgcagctgatac

SEQ ID NO: 8324566 - DNA, 22 bp, Homo sapiens
gcctggggcatgcagctgatac

SEQ ID NO: 8324567 - DNA, 22 bp, Homo sapiens
gcctggggccagcttgggctga

SEQ ID NO: 8324568 - DNA, 22 bp, Homo sapiens
gcctggggggcatgtcataata

SEQ ID NO: 8324569 - DNA, 22 bp, Homo sapiens
gcctggggtcccttgttggcac

SEQ ID NO: 8324570 - DNA, 22 bp, Homo sapiens
gcctggggtctctgactcacag

SEQ ID NO: 8324571 - DNA, 22 bp, Homo sapiens
ggacagagccctggtggcctaa

SEQ ID NO: 8324572 - DNA, 19 bp, Homo sapiens
ggacagacgcagagatctg

SEQ ID NO: 8324573 - DNA, 22 bp, Homo sapiens
ggacactagatggagaagggaa

SEQ ID NO: 8324574 - DNA, 22 bp, Homo sapiens
ggacactacaatctgcctgcat

SEQ ID NO: 8324575 - DNA, 22 bp, Homo sapiens
ggacactaaatggaagtgtctg

SEQ ID NO: 8324576 - DNA, 22 bp, Homo sapiens
ggacccaccaggccgggctcca

SEQ ID NO: 8324577 - DNA, 22 bp, Homo sapiens
ggacagagggcaggagcccaga

SEQ ID NO: 8324578 - DNA, 18 bp, Homo sapiens
ggacccagggcctcaccc

SEQ ID NO: 8324579 - DNA, 22 bp, Homo sapiens
ggacccaggtagggaggaagat

SEQ ID NO: 8324580 - DNA, 22 bp, Homo sapiens
ggactctgttttcctgatcact

SEQ ID NO: 8324581 - DNA, 22 bp, Homo sapiens
ggagagagatgccgccttgctc

SEQ ID NO: 8324582 - DNA, 22 bp, Homo sapiens
ggagaggagctattgggggctc

SEQ ID NO: 8324583 - DNA, 22 bp, Homo sapiens
ggagaggcttccagagtcgtgc

SEQ ID NO: 8324584 - DNA, 22 bp, Homo sapiens
ggagaggcttccagagtcgtgc

SEQ ID NO: 8324585 - DNA, 19 bp, Homo sapiens
ggagaggctggagggatgc

SEQ ID NO: 8324586 - DNA, 19 bp, Homo sapiens
ggagaggctggagggatgc

SEQ ID NO: 8324587 - DNA, 22 bp, Homo sapiens
ggagaggacatggctcccacag

SEQ ID NO: 8324588 - DNA, 22 bp, Homo sapiens
ggagaggaaatgccagcacttc

SEQ ID NO: 8324589 - DNA, 22 bp, Homo sapiens
ggagaggaaatgccagcacttc

SEQ ID NO: 8324590 - DNA, 22 bp, Homo sapiens
ggaaggaacaaaccctgtgtgg

SEQ ID NO: 8324591 - DNA, 22 bp, Homo sapiens
gcttccgcgatgtcctaggtgg

SEQ ID NO: 8324592 - DNA, 22 bp, Homo sapiens
gctgggaggaatttggggaata

SEQ ID NO: 8324593 - DNA, 22 bp, Homo sapiens
gctgggactgagacagtgacct

SEQ ID NO: 8324594 - DNA, 22 bp, Homo sapiens
gctgggacggctcagtaagaag

SEQ ID NO: 8324595 - DNA, 22 bp, Homo sapiens
gctggctcgggaagcaggggat

SEQ ID NO: 8324596 - DNA, 18 bp, Homo sapiens
gctggctgcacttctgct

SEQ ID NO: 8324597 - DNA, 22 bp, Homo sapiens
gctggctgagttctgtcgtctg

SEQ ID NO: 8324598 - DNA, 22 bp, Homo sapiens
gctggctgcacaggggctcact

SEQ ID NO: 8324599 - DNA, 22 bp, Homo sapiens
gctggctgccttactttgtgga

SEQ ID NO: 8324600 - DNA, 22 bp, Homo sapiens
gctggctgcctggttatgcctt

SEQ ID NO: 8324601 - DNA, 22 bp, Homo sapiens
gctggctgcagattttagaggt

SEQ ID NO: 8324602 - DNA, 22 bp, Homo sapiens
gctggctgccaatttcagagct

SEQ ID NO: 8324603 - DNA, 22 bp, Homo sapiens
gctggcagctggaagttgggct

SEQ ID NO: 8324604 - DNA, 22 bp, Homo sapiens
gctggcaggagaaacggggtgc

SEQ ID NO: 8324605 - DNA, 22 bp, Homo sapiens
gctggcagggacagctgcgtgt

SEQ ID NO: 8324606 - DNA, 22 bp, Homo sapiens
gctggctccaaaagcaggggct

SEQ ID NO: 8324607 - DNA, 22 bp, Homo sapiens
gctggcagactgggggcagaac

SEQ ID NO: 8324608 - DNA, 22 bp, Homo sapiens
gctggcaatggtgtggtctggt

SEQ ID NO: 8324609 - DNA, 22 bp, Homo sapiens
gctggcaaggtgctggagggcc

SEQ ID NO: 8324610 - DNA, 22 bp, Homo sapiens
gctgtgcagtctttggtgtgcc

SEQ ID NO: 8324611 - DNA, 22 bp, Homo sapiens
gctgtgcaggtccccactgcct

SEQ ID NO: 8324612 - DNA, 21 bp, Homo sapiens
gctgtgcaggtgcccctgctc

SEQ ID NO: 8324613 - DNA, 22 bp, Homo sapiens
gctgtgcccagctccagctctg

SEQ ID NO: 8324614 - DNA, 21 bp, Homo sapiens
gcttccaagatggcaccttga

SEQ ID NO: 8324615 - DNA, 22 bp, Homo sapiens
gctgtgattgtcagtcttcaat

SEQ ID NO: 8324616 - DNA, 22 bp, Homo sapiens
gctgtgatgtggagggtgctga

SEQ ID NO: 8324617 - DNA, 22 bp, Homo sapiens
gctgtgatgtggagggtgctga

SEQ ID NO: 8324618 - DNA, 22 bp, Homo sapiens
gctgggtctggatgctcaggtg

SEQ ID NO: 8324619 - DNA, 22 bp, Homo sapiens
gctgggttttcttccgggccta

SEQ ID NO: 8324620 - DNA, 22 bp, Homo sapiens
gctggggtctgtgaggagggct

SEQ ID NO: 8324621 - DNA, 22 bp, Homo sapiens
gctggggtctgtgaggagggct

SEQ ID NO: 8324622 - DNA, 22 bp, Homo sapiens
gctggggtctgtgaggagggct

SEQ ID NO: 8324623 - DNA, 22 bp, Homo sapiens
gctggggtgtggtggataagct

SEQ ID NO: 8324624 - DNA, 20 bp, Homo sapiens
gctgggggtgtgctgagtga

SEQ ID NO: 8324625 - DNA, 20 bp, Homo sapiens
gctgggggtgtgctgagtga

SEQ ID NO: 8324626 - DNA, 22 bp, Homo sapiens
gccaggagttcagatgcatgtt

SEQ ID NO: 8324627 - DNA, 22 bp, Homo sapiens
gccaggtcccctcatggctcct

SEQ ID NO: 8324628 - DNA, 22 bp, Homo sapiens
gccaggagagctccttcaggtt

SEQ ID NO: 8324629 - DNA, 22 bp, Homo sapiens
gccaggagagctccttcaggtt

SEQ ID NO: 8324630 - DNA, 22 bp, Homo sapiens
gccaggagaatgctagcagagg

SEQ ID NO: 8324631 - DNA, 22 bp, Homo sapiens
gccaggagtgtgtggctatgtt

SEQ ID NO: 8324632 - DNA, 22 bp, Homo sapiens
gccaggagccctgggcaagttc

SEQ ID NO: 8324633 - DNA, 23 bp, Homo sapiens
gcccagagaggctcaccaggaat

SEQ ID NO: 8324634 - DNA, 22 bp, Homo sapiens
gcccagagagatgctgtagacc

SEQ ID NO: 8324635 - DNA, 22 bp, Homo sapiens
gccagtgcctgctgctcagggc

SEQ ID NO: 8324636 - DNA, 22 bp, Homo sapiens
gcccacagtacgaggctcaggc

SEQ ID NO: 8324637 - DNA, 22 bp, Homo sapiens
gcccataattcaaatataacac

SEQ ID NO: 8324638 - DNA, 22 bp, Homo sapiens
gcccagtttcagctctgccttt

SEQ ID NO: 8324639 - DNA, 22 bp, Homo sapiens
gcccagggcttcaaagagagaa

SEQ ID NO: 8324640 - DNA, 22 bp, Homo sapiens
gcccaggggagtagtcaattta

SEQ ID NO: 8324641 - DNA, 22 bp, Homo sapiens
gcccaggggcagcgcatagtgg

SEQ ID NO: 8324642 - DNA, 22 bp, Homo sapiens
gcccatgctctcaggcgggcct

SEQ ID NO: 8324643 - DNA, 23 bp, Homo sapiens
gcccatgctgttgggcccgagca

SEQ ID NO: 8324644 - DNA, 22 bp, Homo sapiens
gcccagcaaggaccaagggccg

SEQ ID NO: 8324645 - DNA, 23 bp, Homo sapiens
gcccagggactgggaatcagtgg

SEQ ID NO: 8324646 - DNA, 22 bp, Homo sapiens
gcccagggcgatggtcggggcc

SEQ ID NO: 8324647 - DNA, 22 bp, Homo sapiens
gcccagggctgcaagtggacgc

SEQ ID NO: 8324648 - DNA, 22 bp, Homo sapiens
gcctcagctcccagcccaggct

SEQ ID NO: 8324649 - DNA, 22 bp, Homo sapiens
gcctcagctcccagcccaggct

SEQ ID NO: 8324650 - DNA, 22 bp, Homo sapiens
gcctcagctcccagcccaggct

SEQ ID NO: 8324651 - DNA, 22 bp, Homo sapiens
gcctcagccggcggacgccagg

SEQ ID NO: 8324652 - DNA, 22 bp, Homo sapiens
gcctcagccggcggacgccagg

SEQ ID NO: 8324653 - DNA, 20 bp, Homo sapiens
gcctcagccaacccatgggg

SEQ ID NO: 8324654 - DNA, 20 bp, Homo sapiens
gcctcagccaacccatgggg

SEQ ID NO: 8324655 - DNA, 22 bp, Homo sapiens
gcctaatacatgatgataggta

SEQ ID NO: 8324656 - DNA, 22 bp, Homo sapiens
gcattttaataagattcatagg

SEQ ID NO: 8324657 - DNA, 22 bp, Homo sapiens
gcatttgtttgggctaatctta

SEQ ID NO: 8324658 - DNA, 22 bp, Homo sapiens
gcatttttctaatcattggcat

SEQ ID NO: 8324659 - DNA, 22 bp, Homo sapiens
gccaagcctgtagacacaagct

SEQ ID NO: 8324660 - DNA, 21 bp, Homo sapiens
gcatgaaaacagcctgtgctc

SEQ ID NO: 8324661 - DNA, 19 bp, Homo sapiens
gcatttctctttacagcca

SEQ ID NO: 8324662 - DNA, 22 bp, Homo sapiens
gcatttctgtgcatacacatga

SEQ ID NO: 8324663 - DNA, 22 bp, Homo sapiens
gcatccagaggtagccactgtg

SEQ ID NO: 8324664 - DNA, 22 bp, Homo sapiens
gcatccagtcttggctcctgga

SEQ ID NO: 8324665 - DNA, 22 bp, Homo sapiens
gcatctaaataaacgtgggagt

SEQ ID NO: 8324666 - DNA, 22 bp, Homo sapiens
gcagggctcagccgctcccacc

SEQ ID NO: 8324667 - DNA, 22 bp, Homo sapiens
gcagggctcattgccaggcatt

SEQ ID NO: 8324668 - DNA, 22 bp, Homo sapiens
gcagggctcattgccaggcatt

SEQ ID NO: 8324669 - DNA, 22 bp, Homo sapiens
gcagtcagacaggaggagctcc

SEQ ID NO: 8324670 - DNA, 22 bp, Homo sapiens
gcagtcagtgttgactacatgc

SEQ ID NO: 8324671 - DNA, 22 bp, Homo sapiens
gcagtcctctcattggcctcct

SEQ ID NO: 8324672 - DNA, 22 bp, Homo sapiens
gcagtcctcatcctttagcagt

SEQ ID NO: 8324673 - DNA, 22 bp, Homo sapiens
gcagtccttaggagaggaagta

SEQ ID NO: 8324674 - DNA, 22 bp, Homo sapiens
gcagtcctagggtgctctgcag

SEQ ID NO: 8324675 - DNA, 22 bp, Homo sapiens
gcagcatccccaggcagcaggg

SEQ ID NO: 8324676 - DNA, 22 bp, Homo sapiens
gcagctggagccagccagacac

SEQ ID NO: 8324677 - DNA, 22 bp, Homo sapiens
gcaggctgaaactcggggtcta

SEQ ID NO: 8324678 - DNA, 22 bp, Homo sapiens
gcagggccttagcagcggctgc

SEQ ID NO: 8324679 - DNA, 22 bp, Homo sapiens
gaggggctgggtagggcaaccc

SEQ ID NO: 8324680 - DNA, 22 bp, Homo sapiens
gagggggacgtatcctggtatg

SEQ ID NO: 8324681 - DNA, 22 bp, Homo sapiens
gagggggagatgtgcacacact

SEQ ID NO: 8324682 - DNA, 22 bp, Homo sapiens
gagggggaaagtccctggagtc

SEQ ID NO: 8324683 - DNA, 22 bp, Homo sapiens
gagggggacgtatcctggtatg

SEQ ID NO: 8324684 - DNA, 22 bp, Homo sapiens
gaggggtgtggagccatcagtt

SEQ ID NO: 8324685 - DNA, 22 bp, Homo sapiens
gagggggagatgtgcacacact

SEQ ID NO: 8324686 - DNA, 22 bp, Homo sapiens
gaggggtcacatgggctggctt

SEQ ID NO: 8324687 - DNA, 22 bp, Homo sapiens
gagggggcgaacagaagcaagg

SEQ ID NO: 8324688 - DNA, 22 bp, Homo sapiens
gagggggcgaacagaagcaagg

SEQ ID NO: 8324689 - DNA, 22 bp, Homo sapiens
gaggggtcttttgttgtcaggg

SEQ ID NO: 8324690 - DNA, 22 bp, Homo sapiens
gagggtcccgagccctgtcaga

SEQ ID NO: 8324691 - DNA, 22 bp, Homo sapiens
gcaaatgcactgcatttagatt

SEQ ID NO: 8324692 - DNA, 22 bp, Homo sapiens
gcaaatgatggcttgctggctg

SEQ ID NO: 8324693 - DNA, 22 bp, Homo sapiens
gcaaatgctaaagtgtagagac

SEQ ID NO: 8324694 - DNA, 22 bp, Homo sapiens
gcacagccttgccctgtgccct

SEQ ID NO: 8324695 - DNA, 17 bp, Homo sapiens
gcactgagccacagttt

SEQ ID NO: 8324696 - DNA, 22 bp, Homo sapiens
gcactgagcaccagccacagat

SEQ ID NO: 8324697 - DNA, 18 bp, Homo sapiens
gcactgaggaaaacctct

SEQ ID NO: 8324698 - DNA, 22 bp, Homo sapiens
gcactggagatggggttgtcgg

SEQ ID NO: 8324699 - DNA, 22 bp, Homo sapiens
gcagagctgcagcgaggcctgg

SEQ ID NO: 8324700 - DNA, 22 bp, Homo sapiens
gcactgttctaggtgcagagct

SEQ ID NO: 8324701 - DNA, 22 bp, Homo sapiens
gcacttgaagaattgaactgga

SEQ ID NO: 8324702 - DNA, 22 bp, Homo sapiens
ggctcctgaggaccaggcacag

SEQ ID NO: 8324703 - DNA, 22 bp, Homo sapiens
ggctcctgagaatgggccatca

SEQ ID NO: 8324704 - DNA, 22 bp, Homo sapiens
ggctgagccatgggcactgcag

SEQ ID NO: 8324705 - DNA, 22 bp, Homo sapiens
ggcggtggttgagaggacggcg

SEQ ID NO: 8324706 - DNA, 22 bp, Homo sapiens
ggctacagactgcataagggca

SEQ ID NO: 8324707 - DNA, 22 bp, Homo sapiens
ggctacagtggctcagtgctgg

SEQ ID NO: 8324708 - DNA, 23 bp, Homo sapiens
ggctagagtggaggggaactgca

SEQ ID NO: 8324709 - DNA, 22 bp, Homo sapiens
ggctagagtggaactggagcgg

SEQ ID NO: 8324710 - DNA, 22 bp, Homo sapiens
ggctccctgggggtcggagagt

SEQ ID NO: 8324711 - DNA, 17 bp, Homo sapiens
ggctccctgactatgga

SEQ ID NO: 8324712 - DNA, 22 bp, Homo sapiens
ggctccagtttgtgccttcagc

SEQ ID NO: 8324713 - DNA, 22 bp, Homo sapiens
ggctccagtttgtgccttcagc

SEQ ID NO: 8324714 - DNA, 22 bp, Homo sapiens
ggctccagggagtggagagaag

SEQ ID NO: 8324715 - DNA, 20 bp, Homo sapiens
ggctggaagtgtgggtttgg

SEQ ID NO: 8324716 - DNA, 22 bp, Homo sapiens
ggctggaaactcaggtagggtt

SEQ ID NO: 8324717 - DNA, 20 bp, Homo sapiens
ggctgctgtgggcagagagg

SEQ ID NO: 8324718 - DNA, 22 bp, Homo sapiens
ggctgctggggacgtgggagag

SEQ ID NO: 8324719 - DNA, 19 bp, Homo sapiens
ggctgggtctggcaggttc

SEQ ID NO: 8324720 - DNA, 21 bp, Homo sapiens
ggctgggtcatgcagctggcc

SEQ ID NO: 8324721 - DNA, 22 bp, Homo sapiens
ggctgggtacagggcagtgtgc

SEQ ID NO: 8324722 - DNA, 19 bp, Homo sapiens
ggctggagaaaggaatcag

SEQ ID NO: 8324723 - DNA, 22 bp, Homo sapiens
ggctggactttctgctgggctc

SEQ ID NO: 8324724 - DNA, 22 bp, Homo sapiens
ggctggactgcctcccagagtc

SEQ ID NO: 8324725 - DNA, 23 bp, Homo sapiens
ggctggtgcccttggccagtcgg

SEQ ID NO: 8324726 - DNA, 22 bp, Homo sapiens
ggctgtgacaaggctgcgggaa

SEQ ID NO: 8324727 - DNA, 22 bp, Homo sapiens
ggctggtggggaaagaggacca

SEQ ID NO: 8324728 - DNA, 22 bp, Homo sapiens
gggagggacacaaagagttccc

SEQ ID NO: 8324729 - DNA, 22 bp, Homo sapiens
gggagggaggtgctggttcacg

SEQ ID NO: 8324730 - DNA, 22 bp, Homo sapiens
gggagggattagttctgcctgg

SEQ ID NO: 8324731 - DNA, 22 bp, Homo sapiens
gggaggtgattaggaccatgta

SEQ ID NO: 8324732 - DNA, 22 bp, Homo sapiens
gggaggtgttccagtgttggta

SEQ ID NO: 8324733 - DNA, 22 bp, Homo sapiens
gggcacaggagaaggatctggc

SEQ ID NO: 8324734 - DNA, 22 bp, Homo sapiens
gggaggttgaggctgcagtgag

SEQ ID NO: 8324735 - DNA, 22 bp, Homo sapiens
gggcaccagcggccgcactgcc

SEQ ID NO: 8324736 - DNA, 22 bp, Homo sapiens
gggaagggagggacctcagtct

SEQ ID NO: 8324737 - DNA, 22 bp, Homo sapiens
gggaaggctgcctgagggatgg

SEQ ID NO: 8324738 - DNA, 22 bp, Homo sapiens
gggaaggctgcctgagggatgg

SEQ ID NO: 8324739 - DNA, 22 bp, Homo sapiens
gggagctgagctggaagagaat

SEQ ID NO: 8324740 - DNA, 22 bp, Homo sapiens
gggagctgagctctgagccacg

SEQ ID NO: 8324741 - DNA, 22 bp, Homo sapiens
gggagctgagctctgagccacg

SEQ ID NO: 8324742 - DNA, 21 bp, Homo sapiens
gggagctgacagcagcacggc

SEQ ID NO: 8324743 - DNA, 22 bp, Homo sapiens
gggagctggagctggaagactc

SEQ ID NO: 8324744 - DNA, 22 bp, Homo sapiens
gggaaggtatttagctgctgaa

SEQ ID NO: 8324745 - DNA, 22 bp, Homo sapiens
gggaagggagggcctccagtca

SEQ ID NO: 8324746 - DNA, 23 bp, Homo sapiens
gggaagtgaggagcccctctgcc

SEQ ID NO: 8324747 - DNA, 22 bp, Homo sapiens
gggaagtgatggagccaggatt

SEQ ID NO: 8324748 - DNA, 23 bp, Homo sapiens
gggaagtgaggagcccctcagcc

SEQ ID NO: 8324749 - DNA, 22 bp, Homo sapiens
ggcctggaagaggacagagaaa

SEQ ID NO: 8324750 - DNA, 22 bp, Homo sapiens
ggcctggcctccagatgtgggc

SEQ ID NO: 8324751 - DNA, 22 bp, Homo sapiens
ggcctggagcagagactaggga

SEQ ID NO: 8324752 - DNA, 22 bp, Homo sapiens
ggcctggagaaggcccagggag

SEQ ID NO: 8324753 - DNA, 22 bp, Homo sapiens
ggcggtctcagcaccctcttgg

SEQ ID NO: 8324754 - DNA, 22 bp, Homo sapiens
ggccaggaagggaagatcagca

SEQ ID NO: 8324755 - DNA, 22 bp, Homo sapiens
ggccaggagaggagggcactga

SEQ ID NO: 8324756 - DNA, 22 bp, Homo sapiens
ggccaggagcaagccaggctct

SEQ ID NO: 8324757 - DNA, 22 bp, Homo sapiens
ggccaggagcaagccaggctct

SEQ ID NO: 8324758 - DNA, 22 bp, Homo sapiens
ggccctggcagccacgaaagcc

SEQ ID NO: 8324759 - DNA, 22 bp, Homo sapiens
ggccctggtcctaggggtggaa

SEQ ID NO: 8324760 - DNA, 22 bp, Homo sapiens
ggccctgggcagaggagtgggc

SEQ ID NO: 8324761 - DNA, 22 bp, Homo sapiens
ggccctgggatgctcagcagtg

SEQ ID NO: 8324762 - DNA, 21 bp, Homo sapiens
ggccctggttacgcctcctct

SEQ ID NO: 8324763 - DNA, 21 bp, Homo sapiens
ggccctggttacgcctcctct

SEQ ID NO: 8324764 - DNA, 22 bp, Homo sapiens
ggcctagggagtggccatgcct

SEQ ID NO: 8324765 - DNA, 18 bp, Homo sapiens
ggcaggggtgaaccacag

SEQ ID NO: 8324766 - DNA, 22 bp, Homo sapiens
ggcagggtggcagaggctcaga

SEQ ID NO: 8324767 - DNA, 22 bp, Homo sapiens
ggcatcttgttgctcaaatcta

SEQ ID NO: 8324768 - DNA, 22 bp, Homo sapiens
ggccaggaacttttgggatggg

SEQ ID NO: 8324769 - DNA, 19 bp, Homo sapiens
ggcagaaggtgtaggggga

SEQ ID NO: 8324770 - DNA, 22 bp, Homo sapiens
ggcagaaggcaattagagactg

SEQ ID NO: 8324771 - DNA, 22 bp, Homo sapiens
ggcactgtgtacacacagagac

SEQ ID NO: 8324772 - DNA, 22 bp, Homo sapiens
ggcactgtttttgtattcagtt

SEQ ID NO: 8324773 - DNA, 22 bp, Homo sapiens
ggcagctgtgaagtgcctcaca

SEQ ID NO: 8324774 - DNA, 22 bp, Homo sapiens
ggatctgttttgcctctgaggg

SEQ ID NO: 8324775 - DNA, 22 bp, Homo sapiens
ggatgcaggaggtcggggagca

SEQ ID NO: 8324776 - DNA, 22 bp, Homo sapiens
ggatgcacgaaggcgcctcgga

SEQ ID NO: 8324777 - DNA, 22 bp, Homo sapiens
ggatgctgtctaagctgaggac

SEQ ID NO: 8324778 - DNA, 22 bp, Homo sapiens
ggatgctgtgcactactctggc

SEQ ID NO: 8324779 - DNA, 18 bp, Homo sapiens
ggatgctgtgtgctcctt

SEQ ID NO: 8324780 - DNA, 22 bp, Homo sapiens
ggatgctgattccagtctccag

SEQ ID NO: 8324781 - DNA, 22 bp, Homo sapiens
ggatgctgggagacagcaggca

SEQ ID NO: 8324782 - DNA, 22 bp, Homo sapiens
ggatggaggttctcagatgctc

SEQ ID NO: 8324783 - DNA, 22 bp, Homo sapiens
ggatgtttggcgtttgaattgc

SEQ ID NO: 8324784 - DNA, 22 bp, Homo sapiens
ggatggccttcttgctcaggaa

SEQ ID NO: 8324785 - DNA, 22 bp, Homo sapiens
ggatggctgtaaaaggtgggaa

SEQ ID NO: 8324786 - DNA, 22 bp, Homo sapiens
ggatgggaacttggtagggcat

SEQ ID NO: 8324787 - DNA, 22 bp, Homo sapiens
ggtgccaggctcccagctcagg

SEQ ID NO: 8324788 - DNA, 22 bp, Homo sapiens
ggtgccagtgggtctcaggata

SEQ ID NO: 8324789 - DNA, 22 bp, Homo sapiens
ggtgccagatgaggcccgcgat

SEQ ID NO: 8324790 - DNA, 22 bp, Homo sapiens
ggtgccagatgaggcccgcgat

SEQ ID NO: 8324791 - DNA, 22 bp, Homo sapiens
ggtgccagagtggcccaggggc

SEQ ID NO: 8324792 - DNA, 22 bp, Homo sapiens
ggtgggcaacatttggcctgag

SEQ ID NO: 8324793 - DNA, 22 bp, Homo sapiens
ggtgggagtgggcacagttacg

SEQ ID NO: 8324794 - DNA, 16 bp, Homo sapiens
ggtgggaggtgaggtg

SEQ ID NO: 8324795 - DNA, 22 bp, Homo sapiens
ggtgggaggcaggctgctccca

SEQ ID NO: 8324796 - DNA, 22 bp, Homo sapiens
ggtctggcctcgggcaccccca

SEQ ID NO: 8324797 - DNA, 22 bp, Homo sapiens
ggtctgtgctctggagcctctg

SEQ ID NO: 8324798 - DNA, 21 bp, Homo sapiens
ggtcttgggaggtgccctggg

SEQ ID NO: 8324799 - DNA, 17 bp, Homo sapiens
ggtctgtgtctagggaa

SEQ ID NO: 8324800 - DNA, 20 bp, Homo sapiens
ggtgcaggtaacgctgtgct

SEQ ID NO: 8324801 - DNA, 22 bp, Homo sapiens
ggtgcagggagaggcaggcccc

SEQ ID NO: 8324802 - DNA, 22 bp, Homo sapiens
gggtccagaatgagaatgggct

SEQ ID NO: 8324803 - DNA, 22 bp, Homo sapiens
gggtccagacactccagaggaa

SEQ ID NO: 8324804 - DNA, 23 bp, Homo sapiens
gggtccagagaagccattagggc

SEQ ID NO: 8324805 - DNA, 23 bp, Homo sapiens
gggtccagagacaggcatgggtg

SEQ ID NO: 8324806 - DNA, 22 bp, Homo sapiens
gggtccagagttgaagaggtta

SEQ ID NO: 8324807 - DNA, 22 bp, Homo sapiens
gggtcagggctgcctgggctca

SEQ ID NO: 8324808 - DNA, 22 bp, Homo sapiens
gggtcaggcctcaaggtgggct

SEQ ID NO: 8324809 - DNA, 22 bp, Homo sapiens
gggtcaggcctcaaggtgggct

SEQ ID NO: 8324810 - DNA, 22 bp, Homo sapiens
ggtacaaagttagatttaactt

SEQ ID NO: 8324811 - DNA, 22 bp, Homo sapiens
ggtaccaccaattcagctgcca

SEQ ID NO: 8324812 - DNA, 22 bp, Homo sapiens
ggtaccaccaattcagctgcca

SEQ ID NO: 8324813 - DNA, 22 bp, Homo sapiens
ggtagaaagatggaacgttgaa

SEQ ID NO: 8324814 - DNA, 22 bp, Homo sapiens
ggtagaaagcccaagtccccct

SEQ ID NO: 8324815 - DNA, 22 bp, Homo sapiens
ggtagaaataatcttcaggctg

SEQ ID NO: 8324816 - DNA, 22 bp, Homo sapiens
gggtccagatggtgagagttaa

SEQ ID NO: 8324817 - DNA, 22 bp, Homo sapiens
ggtaaaatgcagattcttagcc

SEQ ID NO: 8324818 - DNA, 22 bp, Homo sapiens
ggtcagccttggatttggtagc

SEQ ID NO: 8324819 - DNA, 22 bp, Homo sapiens
ggtagggaaggctctgcgggga

SEQ ID NO: 8324820 - DNA, 22 bp, Homo sapiens
ggtccaggtatgtggtgtgaat

SEQ ID NO: 8324821 - DNA, 22 bp, Homo sapiens
gggctccagcagaggcagccgg

SEQ ID NO: 8324822 - DNA, 22 bp, Homo sapiens
gggctccagtttggccaggaag

SEQ ID NO: 8324823 - DNA, 22 bp, Homo sapiens
gggctccatcacaggctccatc

SEQ ID NO: 8324824 - DNA, 22 bp, Homo sapiens
gggctctcaaggcagggcccca

SEQ ID NO: 8324825 - DNA, 21 bp, Homo sapiens
gggctctcctgaggccatgaa

SEQ ID NO: 8324826 - DNA, 22 bp, Homo sapiens
gggctggctcccaggtgttgaa

SEQ ID NO: 8324827 - DNA, 22 bp, Homo sapiens
gggctggcgggaaaggcaattc

SEQ ID NO: 8324828 - DNA, 22 bp, Homo sapiens
gggctctctttttggcctgccc

SEQ ID NO: 8324829 - DNA, 22 bp, Homo sapiens
gggctccaaggaggccagcctg

SEQ ID NO: 8324830 - DNA, 22 bp, Homo sapiens
gggcctgccattgctgccccag

SEQ ID NO: 8324831 - DNA, 22 bp, Homo sapiens
gggcctgccaggctttcagcat

SEQ ID NO: 8324832 - DNA, 22 bp, Homo sapiens
gggcctcagctgccaacaggat

SEQ ID NO: 8324833 - DNA, 22 bp, Homo sapiens
gggcatgcctgagcctgccact

SEQ ID NO: 8324834 - DNA, 22 bp, Homo sapiens
gggcatgacttttggagtggga

SEQ ID NO: 8324835 - DNA, 23 bp, Homo sapiens
gggggcgtgtcatggagggccac

SEQ ID NO: 8324836 - DNA, 22 bp, Homo sapiens
gggggcggagcacgtgaccacg

SEQ ID NO: 8324837 - DNA, 18 bp, Homo sapiens
gggtatccagaactggtc

SEQ ID NO: 8324838 - DNA, 22 bp, Homo sapiens
gggggctaccgtctctggagct

SEQ ID NO: 8324839 - DNA, 22 bp, Homo sapiens
gggggcggagcacgtgaccacg

SEQ ID NO: 8324840 - DNA, 22 bp, Homo sapiens
ggggcaggagcccttcttcagc

SEQ ID NO: 8324841 - DNA, 22 bp, Homo sapiens
gggggaaagctcaggagcctgt

SEQ ID NO: 8324842 - DNA, 22 bp, Homo sapiens
ggggcttccagcgcccgccggt

SEQ ID NO: 8324843 - DNA, 22 bp, Homo sapiens
ggggcttctttctgccaccgac

SEQ ID NO: 8324844 - DNA, 22 bp, Homo sapiens
gggggaaagtggaggttcgtga

SEQ ID NO: 8324845 - DNA, 22 bp, Homo sapiens
gggggaagaaagaacatggcat

SEQ ID NO: 8324846 - DNA, 22 bp, Homo sapiens
gggggaagactgggctagtgat

SEQ ID NO: 8324847 - DNA, 22 bp, Homo sapiens
gggctgggcatggtgttccctc

SEQ ID NO: 8324848 - DNA, 22 bp, Homo sapiens
gggctggctgattttcctctct

SEQ ID NO: 8324849 - DNA, 22 bp, Homo sapiens
gggctggctcccaggtgttgaa

SEQ ID NO: 8324850 - DNA, 22 bp, Homo sapiens
gggctgggatggcttgaagatt

SEQ ID NO: 8324851 - DNA, 22 bp, Homo sapiens
ggggatggtagaccggtgacgt

SEQ ID NO: 8324852 - DNA, 22 bp, Homo sapiens
ggggatggattccgggtccctg

SEQ ID NO: 8324853 - DNA, 22 bp, Homo sapiens
ggggcacacttttggtagatat

SEQ ID NO: 8324854 - DNA, 22 bp, Homo sapiens
ggggatggtgggaaggcaatct

SEQ ID NO: 8324855 - DNA, 22 bp, Homo sapiens
gtgcaaaaatctatcaccagca

SEQ ID NO: 8324856 - DNA, 22 bp, Homo sapiens
gtgcaaaaataattgtggtttt

SEQ ID NO: 8324857 - DNA, 22 bp, Homo sapiens
gtgcaaaagtaactgtggtttt

SEQ ID NO: 8324858 - DNA, 22 bp, Homo sapiens
gtgcaaaagtaaatgtggtttt

SEQ ID NO: 8324859 - DNA, 22 bp, Homo sapiens
gtgcaaaaggcattgtggtttt

SEQ ID NO: 8324860 - DNA, 22 bp, Homo sapiens
gtgcaaaagcagttgtggtttt

SEQ ID NO: 8324861 - DNA, 22 bp, Homo sapiens
gtgcaaaagcaattgcagtttt

SEQ ID NO: 8324862 - DNA, 22 bp, Homo sapiens
gtgccctgagtgggtaggagag

SEQ ID NO: 8324863 - DNA, 22 bp, Homo sapiens
gtgccctgcatgccccgggtat

SEQ ID NO: 8324864 - DNA, 22 bp, Homo sapiens
gtgcccaggtgtccctgagaag

SEQ ID NO: 8324865 - DNA, 22 bp, Homo sapiens
gtgcccaggggccagctgccgg

SEQ ID NO: 8324866 - DNA, 22 bp, Homo sapiens
gtgcccaggggccagctgccgg

SEQ ID NO: 8324867 - DNA, 22 bp, Homo sapiens
gtgcaatattgccatgttcttg

SEQ ID NO: 8324868 - DNA, 22 bp, Homo sapiens
gtgctgtctcaagaaggattct

SEQ ID NO: 8324869 - DNA, 22 bp, Homo sapiens
gtgctgtcactggtaaatgcgg

SEQ ID NO: 8324870 - DNA, 22 bp, Homo sapiens
gtgctgtcattagcatctagag

SEQ ID NO: 8324871 - DNA, 22 bp, Homo sapiens
gtgctgggtgctgcagacaggt

SEQ ID NO: 8324872 - DNA, 22 bp, Homo sapiens
gtgctgggggtttctgtaggtc

SEQ ID NO: 8324873 - DNA, 22 bp, Homo sapiens
gtgctgggtgctgcagacaggt

SEQ ID NO: 8324874 - DNA, 22 bp, Homo sapiens
gtgctgggattacaggtgtgag

SEQ ID NO: 8324875 - DNA, 22 bp, Homo sapiens
gtgctgggccctgagaccaggg

SEQ ID NO: 8324876 - DNA, 22 bp, Homo sapiens
gtgctgggccctgagaccaggg

SEQ ID NO: 8324877 - DNA, 22 bp, Homo sapiens
gtgctggggagataggaagaga

SEQ ID NO: 8324878 - DNA, 22 bp, Homo sapiens
gtgctggggagataggaagaga

SEQ ID NO: 8324879 - DNA, 22 bp, Homo sapiens
gtgccctgggccttcagggcca

SEQ ID NO: 8324880 - DNA, 21 bp, Homo sapiens
gtgccctgttcccacatgccc

SEQ ID NO: 8324881 - DNA, 22 bp, Homo sapiens
gtgaggccgcacgccccggagt

SEQ ID NO: 8324882 - DNA, 16 bp, Homo sapiens
gtgagggacatagctt

SEQ ID NO: 8324883 - DNA, 22 bp, Homo sapiens
gtgaggctactcagctgtccga

SEQ ID NO: 8324884 - DNA, 22 bp, Homo sapiens
gtgataaaattcaaatagctct

SEQ ID NO: 8324885 - DNA, 22 bp, Homo sapiens
gtgattaactgcagttagagct

SEQ ID NO: 8324886 - DNA, 22 bp, Homo sapiens
gtctcgtcaatggcaggttccc

SEQ ID NO: 8324887 - DNA, 22 bp, Homo sapiens
gtctcgctgagcccccattcta

SEQ ID NO: 8324888 - DNA, 22 bp, Homo sapiens
gtcttagatttcaccgataatg

SEQ ID NO: 8324889 - DNA, 22 bp, Homo sapiens
gtctggtgggattccaagtggc

SEQ ID NO: 8324890 - DNA, 22 bp, Homo sapiens
gtcctctgactcagccttggga

SEQ ID NO: 8324891 - DNA, 22 bp, Homo sapiens
gtcctctgcccaggtcaaggtt

SEQ ID NO: 8324892 - DNA, 22 bp, Homo sapiens
gtcctctccaggaggctctgat

SEQ ID NO: 8324893 - DNA, 20 bp, Homo sapiens
gtctcctctttgcattccta

SEQ ID NO: 8324894 - DNA, 22 bp, Homo sapiens
gtctcctccagtaggaagtggc

SEQ ID NO: 8324895 - DNA, 22 bp, Homo sapiens
gtcctcaggaaggctttctgac

SEQ ID NO: 8324896 - DNA, 22 bp, Homo sapiens
gtcctcagggagtcccagtcat

SEQ ID NO: 8324897 - DNA, 21 bp, Homo sapiens
gtcctcagctgatgggagctg

SEQ ID NO: 8324898 - DNA, 22 bp, Homo sapiens
gtcctcagcaccagaactaggg

SEQ ID NO: 8324899 - DNA, 22 bp, Homo sapiens
gtaacaaaggataacttggttt

SEQ ID NO: 8324900 - DNA, 22 bp, Homo sapiens
gtaacaaagtttctaggtgctg

SEQ ID NO: 8324901 - DNA, 22 bp, Homo sapiens
gtaagtgttgaattagtgctcc

SEQ ID NO: 8324902 - DNA, 22 bp, Homo sapiens
gtaataatttgctacctggtgg

SEQ ID NO: 8324903 - DNA, 22 bp, Homo sapiens
gtagcacatgattttgatatgt

SEQ ID NO: 8324904 - DNA, 22 bp, Homo sapiens
gtagaggctgaaatctgagggc

SEQ ID NO: 8324905 - DNA, 22 bp, Homo sapiens
gtagaggggtgattctgtgaga

SEQ ID NO: 8324906 - DNA, 22 bp, Homo sapiens
gtagatattaaaaatggcagtg

SEQ ID NO: 8324907 - DNA, 22 bp, Homo sapiens
gtagatgagctcacatgacctt

SEQ ID NO: 8324908 - DNA, 22 bp, Homo sapiens
gtcaacttatctctttatctgt

SEQ ID NO: 8324909 - DNA, 22 bp, Homo sapiens
gtcaacttgcaagatgctgggc

SEQ ID NO: 8324910 - DNA, 22 bp, Homo sapiens
gtcaactttttcatagctctgc

SEQ ID NO: 8324911 - DNA, 22 bp, Homo sapiens
gtcaactttaagatgatctttt

SEQ ID NO: 8324912 - DNA, 22 bp, Homo sapiens
gtaggaaatcaggggtttaagc

SEQ ID NO: 8324913 - DNA, 22 bp, Homo sapiens
gtaggaaagtaaatgaaataca

SEQ ID NO: 8324914 - DNA, 22 bp, Homo sapiens
gtagctgtgtataattgagaat

SEQ ID NO: 8324915 - DNA, 22 bp, Homo sapiens
ctcagccatggggtggatcagc

SEQ ID NO: 8324916 - DNA, 22 bp, Homo sapiens
ctcaggccattcttccagctgc

SEQ ID NO: 8324917 - DNA, 22 bp, Homo sapiens
ctcagcagtgacaagagagtat

SEQ ID NO: 8324918 - DNA, 22 bp, Homo sapiens
ttgcaaaatcatttctcaggat

SEQ ID NO: 8324919 - DNA, 22 bp, Homo sapiens
ttgcaaaagcaattgcagtttt

SEQ ID NO: 8324920 - DNA, 22 bp, Homo sapiens
ttgcaaaagcaattgcagtttt

SEQ ID NO: 8324921 - DNA, 22 bp, Homo sapiens
ttgcaaaaccatcctaagtaaa

SEQ ID NO: 8324922 - DNA, 22 bp, Homo sapiens
ttgatttttccagcttctagag

SEQ ID NO: 8324923 - DNA, 22 bp, Homo sapiens
ttgcaaaaactgcaattacttt

SEQ ID NO: 8324924 - DNA, 22 bp, Homo sapiens
ttgcaaaaaccacaattacttt

SEQ ID NO: 8324925 - DNA, 22 bp, Homo sapiens
ttgcacagagtggatattcagt

SEQ ID NO: 8324926 - DNA, 18 bp, Homo sapiens
ctcaggcctttccctgtg

SEQ ID NO: 8324927 - DNA, 22 bp, Homo sapiens
ttgcacatgttggttcttgaaa

SEQ ID NO: 8324928 - DNA, 22 bp, Homo sapiens
ttgcccttggctgaaggcactg

SEQ ID NO: 8324929 - DNA, 22 bp, Homo sapiens
ttcttaaagaggcaaaacacag

SEQ ID NO: 8324930 - DNA, 20 bp, Homo sapiens
ttcttaaagacctcactttg

SEQ ID NO: 8324931 - DNA, 20 bp, Homo sapiens
ttcttaaagacctcactttg

SEQ ID NO: 8324932 - DNA, 22 bp, Homo sapiens
ttcttaatcccacaaatcttca

SEQ ID NO: 8324933 - DNA, 21 bp, Homo sapiens
ttcttcaggccaatgctcatt

SEQ ID NO: 8324934 - DNA, 22 bp, Homo sapiens
ctataaatctacccagcattgg

SEQ ID NO: 8324935 - DNA, 22 bp, Homo sapiens
ttctgaaataggagatagctgt

SEQ ID NO: 8324936 - DNA, 22 bp, Homo sapiens
ctcactggcaagactacaggtg

SEQ ID NO: 8324937 - DNA, 22 bp, Homo sapiens
ctcactgtccaacaggctttac

SEQ ID NO: 8324938 - DNA, 22 bp, Homo sapiens
ttgaatgaaattgctgtgttat

SEQ ID NO: 8324939 - DNA, 22 bp, Homo sapiens
ttgaatgaagggatgaccgaag

SEQ ID NO: 8324940 - DNA, 22 bp, Homo sapiens
ttgaatgaagtccctttttact

SEQ ID NO: 8324941 - DNA, 22 bp, Homo sapiens
ttgaataatgtgtatgttgtta

SEQ ID NO: 8324942 - DNA, 22 bp, Homo sapiens
ttgaataatatgcttcgttctc

SEQ ID NO: 8324943 - DNA, 22 bp, Homo sapiens
ttgaagttctgcatttctaata

SEQ ID NO: 8324944 - DNA, 22 bp, Homo sapiens
ttgaagttctaagccccagtac

SEQ ID NO: 8324945 - DNA, 22 bp, Homo sapiens
ttgaagttgcacattataattt

SEQ ID NO: 8324946 - DNA, 22 bp, Homo sapiens
ttcttcagtttggtaaatgtaa

SEQ ID NO: 8324947 - DNA, 22 bp, Homo sapiens
ttcttcattcccttacttccga

SEQ ID NO: 8324948 - DNA, 22 bp, Homo sapiens
ctacatctcaccttccaggaca

SEQ ID NO: 8324949 - DNA, 22 bp, Homo sapiens
ctacattcaacagcagagtttt

SEQ ID NO: 8324950 - DNA, 22 bp, Homo sapiens
ttctacagaataaatgtttaca

SEQ ID NO: 8324951 - DNA, 22 bp, Homo sapiens
ttctacatatatttttctcact

SEQ ID NO: 8324952 - DNA, 22 bp, Homo sapiens
ttctacaggtactgaagtacat

SEQ ID NO: 8324953 - DNA, 22 bp, Homo sapiens
ctaaatgcctttcctacctaac

SEQ ID NO: 8324954 - DNA, 22 bp, Homo sapiens
ctaaatgtcatggagttgtaga

SEQ ID NO: 8324955 - DNA, 22 bp, Homo sapiens
ttctatttttgtggaactgtag

SEQ ID NO: 8324956 - DNA, 22 bp, Homo sapiens
ctacattctgggaaatcagatg

SEQ ID NO: 8324957 - DNA, 18 bp, Homo sapiens
ctacattcataggaaagg

SEQ ID NO: 8324958 - DNA, 22 bp, Homo sapiens
ctagtttaaagcagctgaaagg

SEQ ID NO: 8324959 - DNA, 22 bp, Homo sapiens
ctagttctagatccctgaggaa

SEQ ID NO: 8324960 - DNA, 22 bp, Homo sapiens
ctagttctagatccctgaggaa

SEQ ID NO: 8324961 - DNA, 22 bp, Homo sapiens
ctagttctagatccctgaggaa

SEQ ID NO: 8324962 - DNA, 21 bp, Homo sapiens
ttctccttcttgatccaagca

SEQ ID NO: 8324963 - DNA, 22 bp, Homo sapiens
ttctccttggtttatgggacat

SEQ ID NO: 8324964 - DNA, 22 bp, Homo sapiens
ttcctctgaaatggcttggaaa

SEQ ID NO: 8324965 - DNA, 22 bp, Homo sapiens
ttcctccttcccattcctgggg

SEQ ID NO: 8324966 - DNA, 22 bp, Homo sapiens
ttcctccttcccattcctgggg

SEQ ID NO: 8324967 - DNA, 22 bp, Homo sapiens
ttccactttgggtctgtgcagg

SEQ ID NO: 8324968 - DNA, 19 bp, Homo sapiens
ttccacttgggttagaatt

SEQ ID NO: 8324969 - DNA, 22 bp, Homo sapiens
ttccacttagtggaagggcatg

SEQ ID NO: 8324970 - DNA, 22 bp, Homo sapiens
cgtcattgtcctggacttgcaa

SEQ ID NO: 8324971 - DNA, 22 bp, Homo sapiens
cgtctctccgcaggggccttca

SEQ ID NO: 8324972 - DNA, 22 bp, Homo sapiens
cgtcctgggtctgggaaggcat

SEQ ID NO: 8324973 - DNA, 22 bp, Homo sapiens
ttcagtttccacttacatttaa

SEQ ID NO: 8324974 - DNA, 22 bp, Homo sapiens
cggctggtgtcgggcacagcaa

SEQ ID NO: 8324975 - DNA, 22 bp, Homo sapiens
ttatttttaaaagttcacacag

SEQ ID NO: 8324976 - DNA, 22 bp, Homo sapiens
ttatttcattgatttctaagac

SEQ ID NO: 8324977 - DNA, 22 bp, Homo sapiens
ttattattttgtgtacagcaaa

SEQ ID NO: 8324978 - DNA, 22 bp, Homo sapiens
ttatttttaaaagttcacacag

SEQ ID NO: 8324979 - DNA, 17 bp, Homo sapiens
ttattttttgggctgag

SEQ ID NO: 8324980 - DNA, 22 bp, Homo sapiens
cctttgcaacagaaagacctga

SEQ ID NO: 8324981 - DNA, 22 bp, Homo sapiens
cgatgggggcagtgttacattg

SEQ ID NO: 8324982 - DNA, 22 bp, Homo sapiens
cgaggtagtggcggccgcggcc

SEQ ID NO: 8324983 - DNA, 17 bp, Homo sapiens
cgagggcttgctggctc

SEQ ID NO: 8324984 - DNA, 22 bp, Homo sapiens
cgagggctgtgttgctctcctt

SEQ ID NO: 8324985 - DNA, 22 bp, Homo sapiens
ccttgtttctctcccagataag

SEQ ID NO: 8324986 - DNA, 22 bp, Homo sapiens
ccttgggttccaagtcactgaa

SEQ ID NO: 8324987 - DNA, 22 bp, Homo sapiens
ccttgggtctaggccagggagt

SEQ ID NO: 8324988 - DNA, 21 bp, Homo sapiens
ttactaaacaaaacatgcagg

SEQ ID NO: 8324989 - DNA, 22 bp, Homo sapiens
ttaccttttaggcaagcatctt

SEQ ID NO: 8324990 - DNA, 22 bp, Homo sapiens
ttacagaaggaacactactcag

SEQ ID NO: 8324991 - DNA, 20 bp, Homo sapiens
ttacagaaatgatgttattt

SEQ ID NO: 8324992 - DNA, 22 bp, Homo sapiens
ttacagaaagtttcccatgccg

SEQ ID NO: 8324993 - DNA, 22 bp, Homo sapiens
ttaccatagaaacttccttttt

SEQ ID NO: 8324994 - DNA, 22 bp, Homo sapiens
ttacctaaaatagctcaattta

SEQ ID NO: 8324995 - DNA, 22 bp, Homo sapiens
ttacccagggaccaagagaaac

SEQ ID NO: 8324996 - DNA, 22 bp, Homo sapiens
cctgtggagttcccatctgaat

SEQ ID NO: 8324997 - DNA, 20 bp, Homo sapiens
cctgtggagctgcctcctcc

SEQ ID NO: 8324998 - DNA, 22 bp, Homo sapiens
cctgtggaggctgctcagctgg

SEQ ID NO: 8324999 - DNA, 22 bp, Homo sapiens
cctgtgcttcagctggaggagg

SEQ ID NO: 8325000 - DNA, 22 bp, Homo sapiens
cctgtgcttggccagagaggtt

SEQ ID NO: 8325001 - DNA, 22 bp, Homo sapiens
cctgtggaatagaatcttccct

SEQ ID NO: 8325002 - DNA, 22 bp, Homo sapiens
ttaatgacctggaagaagtgat

SEQ ID NO: 8325003 - DNA, 22 bp, Homo sapiens
ttaatgacttatatttaaagca

SEQ ID NO: 8325004 - DNA, 22 bp, Homo sapiens
ttaatgacaggataggctctga

SEQ ID NO: 8325005 - DNA, 22 bp, Homo sapiens
ttaatgacatcataggtgaagt

SEQ ID NO: 8325006 - DNA, 22 bp, Homo sapiens
ttaatgacctagagcagtaatt

SEQ ID NO: 8325007 - DNA, 21 bp, Homo sapiens
ttaatcagtctccctgtctcc

SEQ ID NO: 8325008 - DNA, 21 bp, Homo sapiens
ttacaaagctacagatgttgc

SEQ ID NO: 8325009 - DNA, 22 bp, Homo sapiens
ttacaataccacatcacctcat

SEQ ID NO: 8325010 - DNA, 22 bp, Homo sapiens
ttacaatagttccttcttttgt

SEQ ID NO: 8325011 - DNA, 23 bp, Homo sapiens
ttacaagttctgaaatttccttc

SEQ ID NO: 8325012 - DNA, 22 bp, Homo sapiens
ttacaagtttctggcttcatcc

SEQ ID NO: 8325013 - DNA, 22 bp, Homo sapiens
ttaaaatctaaagcagttgtct

SEQ ID NO: 8325014 - DNA, 22 bp, Homo sapiens
ttaaaatcgctgttgcttctgt

SEQ ID NO: 8325015 - DNA, 22 bp, Homo sapiens
ttaaaatgaatattgattagca

SEQ ID NO: 8325016 - DNA, 22 bp, Homo sapiens
ttaaaatagccagtgcccctct

SEQ ID NO: 8325017 - DNA, 22 bp, Homo sapiens
ttaaaagtctgatgatttacat

SEQ ID NO: 8325018 - DNA, 22 bp, Homo sapiens
ttaaaagagcagcccagcatat

SEQ ID NO: 8325019 - DNA, 22 bp, Homo sapiens
tgttttctattacctgagattg

SEQ ID NO: 8325020 - DNA, 22 bp, Homo sapiens
cctggggagccgcctgagcccc

SEQ ID NO: 8325021 - DNA, 23 bp, Homo sapiens
cctggggagctgtatccagagtg

SEQ ID NO: 8325022 - DNA, 22 bp, Homo sapiens
cctggggccccgagccagaagc

SEQ ID NO: 8325023 - DNA, 22 bp, Homo sapiens
cctggggctcaagatggcgccg

SEQ ID NO: 8325024 - DNA, 22 bp, Homo sapiens
tgtttctaggtcaataattttt

SEQ ID NO: 8325025 - DNA, 20 bp, Homo sapiens
tgtttctgacggtaggagag

SEQ ID NO: 8325026 - DNA, 22 bp, Homo sapiens
tgtttcttatccaagtggtctg

SEQ ID NO: 8325027 - DNA, 22 bp, Homo sapiens
tgtttcttacgtttttagaggc

SEQ ID NO: 8325028 - DNA, 22 bp, Homo sapiens
tgtttcttctcacacaaactca

SEQ ID NO: 8325029 - DNA, 22 bp, Homo sapiens
tgtttcttctcacacaaactca

SEQ ID NO: 8325030 - DNA, 22 bp, Homo sapiens
tgttttcatttgatgtaacaaa

SEQ ID NO: 8325031 - DNA, 21 bp, Homo sapiens
tgttttccaccttgaggcaag

SEQ ID NO: 8325032 - DNA, 22 bp, Homo sapiens
tgttgctcttttttaggtgagt

SEQ ID NO: 8325033 - DNA, 22 bp, Homo sapiens
tgttgcccaggttctctcctgc

SEQ ID NO: 8325034 - DNA, 22 bp, Homo sapiens
tgttggcttgaccttcgctgtt

SEQ ID NO: 8325035 - DNA, 19 bp, Homo sapiens
tgttggctgttctagctca

SEQ ID NO: 8325036 - DNA, 22 bp, Homo sapiens
tgttccatgtctttgtaggact

SEQ ID NO: 8325037 - DNA, 22 bp, Homo sapiens
tgttgattagtgtttagactta

SEQ ID NO: 8325038 - DNA, 22 bp, Homo sapiens
cctgcgggctgtgctgaagcct

SEQ ID NO: 8325039 - DNA, 22 bp, Homo sapiens
cctgcgtctggccttgctccaa

SEQ ID NO: 8325040 - DNA, 22 bp, Homo sapiens
tggttcctcaagcgctggcggc

SEQ ID NO: 8325041 - DNA, 22 bp, Homo sapiens
tggttagactcaccttatagtt

SEQ ID NO: 8325042 - DNA, 22 bp, Homo sapiens
tggttagaggcttcttgcttgg

SEQ ID NO: 8325043 - DNA, 22 bp, Homo sapiens
tggttagatgaggctggtttca

SEQ ID NO: 8325044 - DNA, 22 bp, Homo sapiens
tttttctagctcaaagattcta

SEQ ID NO: 8325045 - DNA, 19 bp, Homo sapiens
tttttacaagtaggtgtga

SEQ ID NO: 8325046 - DNA, 22 bp, Homo sapiens
tttttctcttctgtaaagtggt

SEQ ID NO: 8325047 - DNA, 22 bp, Homo sapiens
ttttctcctttcaagatagcat

SEQ ID NO: 8325048 - DNA, 22 bp, Homo sapiens
ttttctctatattgtctgtgaa

SEQ ID NO: 8325049 - DNA, 22 bp, Homo sapiens
ttttcctctgtatttgaaatgc

SEQ ID NO: 8325050 - DNA, 22 bp, Homo sapiens
ttttctccaactcaaaggaaag

SEQ ID NO: 8325051 - DNA, 22 bp, Homo sapiens
ttttctcaggtgcttatctaag

SEQ ID NO: 8325052 - DNA, 22 bp, Homo sapiens
ctgaagcaaaggatcgagctaa

SEQ ID NO: 8325053 - DNA, 22 bp, Homo sapiens
ctgaaggcaccaggggtgccag

SEQ ID NO: 8325054 - DNA, 22 bp, Homo sapiens
tttttctggataactgtatctc

SEQ ID NO: 8325055 - DNA, 22 bp, Homo sapiens
ttttttgttgggtagaacggaa

SEQ ID NO: 8325056 - DNA, 22 bp, Homo sapiens
ctgaaaagctttgaaccgttaa

SEQ ID NO: 8325057 - DNA, 22 bp, Homo sapiens
ctgaaaaatatgttttggagaa

SEQ ID NO: 8325058 - DNA, 22 bp, Homo sapiens
ctgaaaagtgtctgttgagtta

SEQ ID NO: 8325059 - DNA, 22 bp, Homo sapiens
ctgaaaatgttacacaggaaga

SEQ ID NO: 8325060 - DNA, 21 bp, Homo sapiens
ctgagctggggtgaaggttgc

SEQ ID NO: 8325061 - DNA, 22 bp, Homo sapiens
ctgagctggtgtttcagggtca

SEQ ID NO: 8325062 - DNA, 22 bp, Homo sapiens
ctgagctgtcaggaatggaaag

SEQ ID NO: 8325063 - DNA, 22 bp, Homo sapiens
ctgagctgtgctaagtgaaatg

SEQ ID NO: 8325064 - DNA, 22 bp, Homo sapiens
ctgagctgtggaataaacactg

SEQ ID NO: 8325065 - DNA, 22 bp, Homo sapiens
ctgaggaaagtattgcctggtg

SEQ ID NO: 8325066 - DNA, 22 bp, Homo sapiens
ctgagggcagtgatgaaggtga

SEQ ID NO: 8325067 - DNA, 22 bp, Homo sapiens
ctgagggcaccgacagagtgga

SEQ ID NO: 8325068 - DNA, 22 bp, Homo sapiens
ctgagggatgtggattttggtc

SEQ ID NO: 8325069 - DNA, 22 bp, Homo sapiens
ctgaggctgggcatggggtcca

SEQ ID NO: 8325070 - DNA, 22 bp, Homo sapiens
ctgagggaggagaattgcttga

SEQ ID NO: 8325071 - DNA, 22 bp, Homo sapiens
ctgagggagagaatggggcaaa

SEQ ID NO: 8325072 - DNA, 22 bp, Homo sapiens
ctgagggagagaatggggcaaa

SEQ ID NO: 8325073 - DNA, 22 bp, Homo sapiens
ctgagaggtgacagcgtgctgg

SEQ ID NO: 8325074 - DNA, 22 bp, Homo sapiens
ctgagaggtaagcagcgcagtg

SEQ ID NO: 8325075 - DNA, 22 bp, Homo sapiens
ctgagaggggaccagggtgttt

SEQ ID NO: 8325076 - DNA, 22 bp, Homo sapiens
ctgagaggggaccagggtgttt

SEQ ID NO: 8325077 - DNA, 22 bp, Homo sapiens
ctgaataatattccattatgag

SEQ ID NO: 8325078 - DNA, 22 bp, Homo sapiens
ctgagctgggagtagagactct

SEQ ID NO: 8325079 - DNA, 22 bp, Homo sapiens
ctgagctgggcaactcttagat

SEQ ID NO: 8325080 - DNA, 22 bp, Homo sapiens
ctgagccttattcaccagccct

SEQ ID NO: 8325081 - DNA, 22 bp, Homo sapiens
ctgagcaccccaggacctgcgc

SEQ ID NO: 8325082 - DNA, 22 bp, Homo sapiens
ctgagagttaagagatggggct

SEQ ID NO: 8325083 - DNA, 22 bp, Homo sapiens
ctgcagtgttctggaatgcatt

SEQ ID NO: 8325084 - DNA, 22 bp, Homo sapiens
ctgcagtttcagcctttctggc

SEQ ID NO: 8325085 - DNA, 22 bp, Homo sapiens
ctgcaggtttattttcttacct

SEQ ID NO: 8325086 - DNA, 21 bp, Homo sapiens
ctgagggccgcagctgggctc

SEQ ID NO: 8325087 - DNA, 21 bp, Homo sapiens
ctgagggccgcagctgggctc

SEQ ID NO: 8325088 - DNA, 22 bp, Homo sapiens
ctgagggccttctatgctgagc

SEQ ID NO: 8325089 - DNA, 23 bp, Homo sapiens
ctgagggctggtctgaagtctgc

SEQ ID NO: 8325090 - DNA, 22 bp, Homo sapiens
ctgccctgggatggtctgtgcg

SEQ ID NO: 8325091 - DNA, 22 bp, Homo sapiens
ctgccctgggagtacctgtcct

SEQ ID NO: 8325092 - DNA, 22 bp, Homo sapiens
ctgcctctggttttggtccctg

SEQ ID NO: 8325093 - DNA, 22 bp, Homo sapiens
ctgcctctggcctcaggcccag

SEQ ID NO: 8325094 - DNA, 22 bp, Homo sapiens
ctgctggaggttggagcatgca

SEQ ID NO: 8325095 - DNA, 22 bp, Homo sapiens
ctgctggcaagcccagttggag

SEQ ID NO: 8325096 - DNA, 17 bp, Homo sapiens
ctgctggctggggcttg

SEQ ID NO: 8325097 - DNA, 22 bp, Homo sapiens
ctgctgctgagagctcagcctg

SEQ ID NO: 8325098 - DNA, 22 bp, Homo sapiens
ctgctgcttttgcgggagaaca

SEQ ID NO: 8325099 - DNA, 22 bp, Homo sapiens
ctgctgcttttgcgggagaaca

SEQ ID NO: 8325100 - DNA, 22 bp, Homo sapiens
ctgctctgaagccaggattctg

SEQ ID NO: 8325101 - DNA, 22 bp, Homo sapiens
ctgctctctttcagagacaggt

SEQ ID NO: 8325102 - DNA, 22 bp, Homo sapiens
ctgctctctttcagagacaggt

SEQ ID NO: 8325103 - DNA, 22 bp, Homo sapiens
ctgctccaagccagccctgcag

SEQ ID NO: 8325104 - DNA, 19 bp, Homo sapiens
ctgctccaggagctgggga

SEQ ID NO: 8325105 - DNA, 22 bp, Homo sapiens
ctgcctctgttgggcatggtct

SEQ ID NO: 8325106 - DNA, 22 bp, Homo sapiens
ctgcctcttgacagatcgtggc

SEQ ID NO: 8325107 - DNA, 18 bp, Homo sapiens
ctcggggacaagggcggc

SEQ ID NO: 8325108 - DNA, 22 bp, Homo sapiens
ctctaatactgaccaagtcacc

SEQ ID NO: 8325109 - DNA, 22 bp, Homo sapiens
ctctaaatccaaataagtgtcc

SEQ ID NO: 8325110 - DNA, 22 bp, Homo sapiens
ctctaaatccaaataagtgtcc

SEQ ID NO: 8325111 - DNA, 22 bp, Homo sapiens
ctctaaatccacggtatagttg

SEQ ID NO: 8325112 - DNA, 22 bp, Homo sapiens
tttcaaagtggagaattagaca

SEQ ID NO: 8325113 - DNA, 22 bp, Homo sapiens
tttcaaataccataaacctaat

SEQ ID NO: 8325114 - DNA, 22 bp, Homo sapiens
tttatattacctggaatagctt

SEQ ID NO: 8325115 - DNA, 22 bp, Homo sapiens
tttatattacctggaatagctt

SEQ ID NO: 8325116 - DNA, 22 bp, Homo sapiens
ctcctgtcagaagcatcctgag

SEQ ID NO: 8325117 - DNA, 22 bp, Homo sapiens
ctcctgtggtactcccagggcc

SEQ ID NO: 8325118 - DNA, 22 bp, Homo sapiens
ctcctgtggtactcccagggcc

SEQ ID NO: 8325119 - DNA, 22 bp, Homo sapiens
ctcctgtgcacctccagcggca

SEQ ID NO: 8325120 - DNA, 22 bp, Homo sapiens
ctcctgtgcacctccagcggca

SEQ ID NO: 8325121 - DNA, 22 bp, Homo sapiens
ctcctgtcccggggaccgccga

SEQ ID NO: 8325122 - DNA, 22 bp, Homo sapiens
ctcctggacatggagcggagga

SEQ ID NO: 8325123 - DNA, 22 bp, Homo sapiens
ctcctggagcagcaggcgcagg

SEQ ID NO: 8325124 - DNA, 22 bp, Homo sapiens
ctcctggaggctccaagggaga

SEQ ID NO: 8325125 - DNA, 22 bp, Homo sapiens
ctcctggaggatagtgactggg

SEQ ID NO: 8325126 - DNA, 22 bp, Homo sapiens
ctcctggatcttagccagattc

SEQ ID NO: 8325127 - DNA, 22 bp, Homo sapiens
tttatatgtttgtacaattaag

SEQ ID NO: 8325128 - DNA, 22 bp, Homo sapiens
tttatatgtttgtacaattaag

SEQ ID NO: 8325129 - DNA, 22 bp, Homo sapiens
ctcctgcctgtgggactgagga

SEQ ID NO: 8325130 - DNA, 22 bp, Homo sapiens
ctcctgcctgtgggactgagga

SEQ ID NO: 8325131 - DNA, 22 bp, Homo sapiens
tttacacaaaagatagcacacc

SEQ ID NO: 8325132 - DNA, 22 bp, Homo sapiens
tttacaagtttacagaatgatg

SEQ ID NO: 8325133 - DNA, 22 bp, Homo sapiens
ctcccattgcttcaaagatcct

SEQ ID NO: 8325134 - DNA, 22 bp, Homo sapiens
ttgtttaatgcctcatacatct

SEQ ID NO: 8325135 - DNA, 22 bp, Homo sapiens
ttgtttattagcaattatcctg

SEQ ID NO: 8325136 - DNA, 22 bp, Homo sapiens
ttgtttatcgcttgctcacata

SEQ ID NO: 8325137 - DNA, 23 bp, Homo sapiens
ttgtttaccgtaggacttttaac

SEQ ID NO: 8325138 - DNA, 22 bp, Homo sapiens
ctcccttcaggagaggctcaca

SEQ ID NO: 8325139 - DNA, 22 bp, Homo sapiens
ctccgagactcgagtgtcctca

SEQ ID NO: 8325140 - DNA, 22 bp, Homo sapiens
ctcccttttggatatggggaga

SEQ ID NO: 8325141 - DNA, 20 bp, Homo sapiens
ctcctcagttccatgggagg

SEQ ID NO: 8325142 - DNA, 19 bp, Homo sapiens
ctcctcagtcccagaggtc

SEQ ID NO: 8325143 - DNA, 19 bp, Homo sapiens
ctcctcagtcccagaggtc

SEQ ID NO: 8325144 - DNA, 23 bp, Homo sapiens
ctccctggcccttgggagacctg

SEQ ID NO: 8325145 - DNA, 23 bp, Homo sapiens
ctccctggagtttctggaagatg

SEQ ID NO: 8325146 - DNA, 23 bp, Homo sapiens
ctccctggagtttctggaagatg

SEQ ID NO: 8325147 - DNA, 22 bp, Homo sapiens
ctccctggcagccgcactcctg

SEQ ID NO: 8325148 - DNA, 22 bp, Homo sapiens
ctccctggcacagcgagaggtt

SEQ ID NO: 8325149 - DNA, 22 bp, Homo sapiens
ctctctggaattaaagcccaat

SEQ ID NO: 8325150 - DNA, 22 bp, Homo sapiens
ctctcaaagtaaggtgtataca

SEQ ID NO: 8325151 - DNA, 22 bp, Homo sapiens
ctctgagctgaaacatgagcat

SEQ ID NO: 8325152 - DNA, 22 bp, Homo sapiens
ctctctggcacttcattgctgt

SEQ ID NO: 8325153 - DNA, 22 bp, Homo sapiens
ctctgaggtcctacagtgaccc

SEQ ID NO: 8325154 - DNA, 22 bp, Homo sapiens
ctctgagggtctaaggagtcac

SEQ ID NO: 8325155 - DNA, 22 bp, Homo sapiens
ctctgaggctccatgcaggctt

SEQ ID NO: 8325156 - DNA, 22 bp, Homo sapiens
ctctgagggctcgagggacgcg

SEQ ID NO: 8325157 - DNA, 22 bp, Homo sapiens
tttctgcaaacttccacgtctc

SEQ ID NO: 8325158 - DNA, 22 bp, Homo sapiens
tttctgcacatttctaaagttg

SEQ ID NO: 8325159 - DNA, 22 bp, Homo sapiens
tttcttatattctgtcattgtt

SEQ ID NO: 8325160 - DNA, 22 bp, Homo sapiens
tttcttatattctgtcattgtt

SEQ ID NO: 8325161 - DNA, 20 bp, Homo sapiens
ctctgctgcgcatcccactt

SEQ ID NO: 8325162 - DNA, 22 bp, Homo sapiens
ctctgctgctttgccagtggaa

SEQ ID NO: 8325163 - DNA, 22 bp, Homo sapiens
ctctgctgctttgccagtggaa

SEQ ID NO: 8325164 - DNA, 22 bp, Homo sapiens
ctctgctgctttgccagtggaa

SEQ ID NO: 8325165 - DNA, 22 bp, Homo sapiens
ctctgctggcagcccccgggcc

SEQ ID NO: 8325166 - DNA, 22 bp, Homo sapiens
ctctgctgtctcagatgggcca

SEQ ID NO: 8325167 - DNA, 21 bp, Homo sapiens
ctctgctgtctaccagctgtt

SEQ ID NO: 8325168 - DNA, 21 bp, Homo sapiens
ctctgctgtctaccagctgtt

SEQ ID NO: 8325169 - DNA, 22 bp, Homo sapiens
ctctgctggtgaccactgggcc

SEQ ID NO: 8325170 - DNA, 22 bp, Homo sapiens
ctctggagtaagagctatgaaa

SEQ ID NO: 8325171 - DNA, 22 bp, Homo sapiens
ctctggaggtggaggttgcagt

SEQ ID NO: 8325172 - DNA, 22 bp, Homo sapiens
ctctggagggaggctgagctgg

SEQ ID NO: 8325173 - DNA, 22 bp, Homo sapiens
ctctggaggcctaaggaagtgg

SEQ ID NO: 8325174 - DNA, 21 bp, Homo sapiens
ctctggaggcaagggagagtg

SEQ ID NO: 8325175 - DNA, 19 bp, Homo sapiens
ctctggagcagacactgga

SEQ ID NO: 8325176 - DNA, 22 bp, Homo sapiens
tttgaagttggagatgggagat

SEQ ID NO: 8325177 - DNA, 22 bp, Homo sapiens
tttgaagtgtatgaaaatacag

SEQ ID NO: 8325178 - DNA, 22 bp, Homo sapiens
tttgaagtgcctcttgtggatt

SEQ ID NO: 8325179 - DNA, 22 bp, Homo sapiens
tttgaagtgctctggtgatctg

SEQ ID NO: 8325180 - DNA, 22 bp, Homo sapiens
tttgaagtgcaatgaggattct

SEQ ID NO: 8325181 - DNA, 22 bp, Homo sapiens
gagacagatgctgctggagcat

SEQ ID NO: 8325182 - DNA, 22 bp, Homo sapiens
gagaaagatggaatcttacagg

SEQ ID NO: 8325183 - DNA, 22 bp, Homo sapiens
gagaaacactgttagtttatta

SEQ ID NO: 8325184 - DNA, 22 bp, Homo sapiens
gactgaggtgcccagaggtgac

SEQ ID NO: 8325185 - DNA, 22 bp, Homo sapiens
gactgaggtgacctaggactac

SEQ ID NO: 8325186 - DNA, 22 bp, Homo sapiens
gagagaaaggcttgcaggctgt

SEQ ID NO: 8325187 - DNA, 22 bp, Homo sapiens
gagagggccgggggccagctcc

SEQ ID NO: 8325188 - DNA, 22 bp, Homo sapiens
gagagggccagggtgagaacta

SEQ ID NO: 8325189 - DNA, 22 bp, Homo sapiens
gagagggccgggggccagctcc

SEQ ID NO: 8325190 - DNA, 22 bp, Homo sapiens
gagagggcaaggtagatgctac

SEQ ID NO: 8325191 - DNA, 22 bp, Homo sapiens
gagagggccagggtgagaacta

SEQ ID NO: 8325192 - DNA, 22 bp, Homo sapiens
gagagggcaaacttgtagctaa

SEQ ID NO: 8325193 - DNA, 22 bp, Homo sapiens
gacagcagcataatacatgaac

SEQ ID NO: 8325194 - DNA, 22 bp, Homo sapiens
gacagcagcatgtttacaggcc

SEQ ID NO: 8325195 - DNA, 22 bp, Homo sapiens
gacagaggcaagaccagaagcc

SEQ ID NO: 8325196 - DNA, 22 bp, Homo sapiens
gacagaggagaagatgctgtgg

SEQ ID NO: 8325197 - DNA, 22 bp, Homo sapiens
gacagactaaatggctgtagga

SEQ ID NO: 8325198 - DNA, 22 bp, Homo sapiens
gacagactaaatggctgtagga

SEQ ID NO: 8325199 - DNA, 22 bp, Homo sapiens
gacagacttcatatccttcctc

SEQ ID NO: 8325200 - DNA, 22 bp, Homo sapiens
gacagactgcgtagtccccaaa

SEQ ID NO: 8325201 - DNA, 22 bp, Homo sapiens
gactctgctgactagttgacta

SEQ ID NO: 8325202 - DNA, 21 bp, Homo sapiens
gactctgcaccaaattaagcc

SEQ ID NO: 8325203 - DNA, 22 bp, Homo sapiens
gactctgctaggaaaatctcag

SEQ ID NO: 8325204 - DNA, 22 bp, Homo sapiens
gactctgctacaggccgaggtt

SEQ ID NO: 8325205 - DNA, 22 bp, Homo sapiens
gactgaggtattaagatggctt

SEQ ID NO: 8325206 - DNA, 22 bp, Homo sapiens
gactgaggtattaagatggctt

SEQ ID NO: 8325207 - DNA, 22 bp, Homo sapiens
gactgagaaacagtacattacc

SEQ ID NO: 8325208 - DNA, 22 bp, Homo sapiens
gactgaggcctttattgagaca

SEQ ID NO: 8325209 - DNA, 22 bp, Homo sapiens
gactgagaatcatagaaggcaa

SEQ ID NO: 8325210 - DNA, 17 bp, Homo sapiens
gaccaggagaaaccagg

SEQ ID NO: 8325211 - DNA, 22 bp, Homo sapiens
gacagaattttccatcatgtgg

SEQ ID NO: 8325212 - DNA, 22 bp, Homo sapiens
gaatgatattatttcgtgctgg

SEQ ID NO: 8325213 - DNA, 22 bp, Homo sapiens
gaatgataaatggaagcagcat

SEQ ID NO: 8325214 - DNA, 22 bp, Homo sapiens
gaatgatagagctgccttcgga

SEQ ID NO: 8325215 - DNA, 22 bp, Homo sapiens
gaatgatatattagcagatttt

SEQ ID NO: 8325216 - DNA, 22 bp, Homo sapiens
gaatgagactatgcgagtgtga

SEQ ID NO: 8325217 - DNA, 22 bp, Homo sapiens
gaatgaataggtgtccagatgg

SEQ ID NO: 8325218 - DNA, 22 bp, Homo sapiens
gaagggtgtgatttgcctgaga

SEQ ID NO: 8325219 - DNA, 22 bp, Homo sapiens
gaaggggaaagttgagcaaata

SEQ ID NO: 8325220 - DNA, 22 bp, Homo sapiens
gaagcaaagagctagtgccgct

SEQ ID NO: 8325221 - DNA, 22 bp, Homo sapiens
gaagcaaaatgtctgcacatat

SEQ ID NO: 8325222 - DNA, 22 bp, Homo sapiens
gaaaggaagaaaggtcatttta

SEQ ID NO: 8325223 - DNA, 22 bp, Homo sapiens
gaaaggaacttgtgagtgggag

SEQ ID NO: 8325224 - DNA, 22 bp, Homo sapiens
gaaaggaaatattctaagcact

SEQ ID NO: 8325225 - DNA, 22 bp, Homo sapiens
gaaggccatttttaggtagaat

SEQ ID NO: 8325226 - DNA, 22 bp, Homo sapiens
gaaggcccagcttgaatgctgc

SEQ ID NO: 8325227 - DNA, 22 bp, Homo sapiens
gaaggcagggaatgtggtgcta

SEQ ID NO: 8325228 - DNA, 22 bp, Homo sapiens
gagggctgcaatgagacagaga

SEQ ID NO: 8325229 - DNA, 22 bp, Homo sapiens
gagggctgatgttgccacctca

SEQ ID NO: 8325230 - DNA, 22 bp, Homo sapiens
gagggctgccacgttgggcgag

SEQ ID NO: 8325231 - DNA, 22 bp, Homo sapiens
gagggctgccacgttgggcgag

SEQ ID NO: 8325232 - DNA, 22 bp, Homo sapiens
gagggagtgctttctgatagtt

SEQ ID NO: 8325233 - DNA, 22 bp, Homo sapiens
gagggctgatgttgccacctca

SEQ ID NO: 8325234 - DNA, 22 bp, Homo sapiens
gagggaggtgatactgaacgta

SEQ ID NO: 8325235 - DNA, 22 bp, Homo sapiens
gaggggctgccctggtgtcagg

SEQ ID NO: 8325236 - DNA, 22 bp, Homo sapiens
gaggggctggcacgatggctgc

SEQ ID NO: 8325237 - DNA, 22 bp, Homo sapiens
gaggggctggcacgatggctgc

SEQ ID NO: 8325238 - DNA, 22 bp, Homo sapiens
gaggggctggctgtggtcccat

SEQ ID NO: 8325239 - DNA, 22 bp, Homo sapiens
gagggctgtggggcatgaccag

SEQ ID NO: 8325240 - DNA, 22 bp, Homo sapiens
gagggctgtggggcatgaccag

SEQ ID NO: 8325241 - DNA, 22 bp, Homo sapiens
gagggctgtgaaggagcgggtt

SEQ ID NO: 8325242 - DNA, 22 bp, Homo sapiens
gagggctgtgaaggagcgggtt

SEQ ID NO: 8325243 - DNA, 22 bp, Homo sapiens
gagggctgtgaaggagcgggtt

SEQ ID NO: 8325244 - DNA, 22 bp, Homo sapiens
gagggagagtgatggaccattg

SEQ ID NO: 8325245 - DNA, 22 bp, Homo sapiens
gagggagctggagcagacgccg

SEQ ID NO: 8325246 - DNA, 22 bp, Homo sapiens
gagggaggcatcatgaatccag

SEQ ID NO: 8325247 - DNA, 22 bp, Homo sapiens
gagggagggccaggtcccaacc

SEQ ID NO: 8325248 - DNA, 22 bp, Homo sapiens
gagggagggccaggtcccaacc

SEQ ID NO: 8325249 - DNA, 22 bp, Homo sapiens
gagggaggggagctccaccctc

SEQ ID NO: 8325250 - DNA, 22 bp, Homo sapiens
gagggagggactagcattctct

SEQ ID NO: 8325251 - DNA, 22 bp, Homo sapiens
gagggagggaaagtttaacact

SEQ ID NO: 8325252 - DNA, 22 bp, Homo sapiens
gaggctgcagctatcagacatt

SEQ ID NO: 8325253 - DNA, 22 bp, Homo sapiens
gaggctgcaggcaatgctgccc

SEQ ID NO: 8325254 - DNA, 22 bp, Homo sapiens
gaggctgccaatgtgtgcatgt

SEQ ID NO: 8325255 - DNA, 22 bp, Homo sapiens
gaggctgcattcttcccactgc

SEQ ID NO: 8325256 - DNA, 22 bp, Homo sapiens
gaggagcatgggaaggctctgg

SEQ ID NO: 8325257 - DNA, 22 bp, Homo sapiens
gaggctcacctagggagcactg

SEQ ID NO: 8325258 - DNA, 22 bp, Homo sapiens
gaggctcagagaagtcatggta

SEQ ID NO: 8325259 - DNA, 22 bp, Homo sapiens
gaggctcaacccacaggggttg

SEQ ID NO: 8325260 - DNA, 22 bp, Homo sapiens
gaggcataaatcacagtgttca

SEQ ID NO: 8325261 - DNA, 22 bp, Homo sapiens
gaggctcagagggagcatggtc

SEQ ID NO: 8325262 - DNA, 22 bp, Homo sapiens
gaggctcagagaggtccacata

SEQ ID NO: 8325263 - DNA, 22 bp, Homo sapiens
gagctgagcttaactccttgaa

SEQ ID NO: 8325264 - DNA, 22 bp, Homo sapiens
gagctgaggctcaggctggcgt

SEQ ID NO: 8325265 - DNA, 22 bp, Homo sapiens
gaggagagagggactgtctgca

SEQ ID NO: 8325266 - DNA, 22 bp, Homo sapiens
gagcccaggttctgcttccagc

SEQ ID NO: 8325267 - DNA, 22 bp, Homo sapiens
gagcccagctgcggccctcagc

SEQ ID NO: 8325268 - DNA, 22 bp, Homo sapiens
gagcccagctctacctcagact

SEQ ID NO: 8325269 - DNA, 22 bp, Homo sapiens
gagcccaggaagtggaggctga

SEQ ID NO: 8325270 - DNA, 22 bp, Homo sapiens
gagaggggtttgccatcctatg

SEQ ID NO: 8325271 - DNA, 22 bp, Homo sapiens
gagaggggcccaagccacatag

SEQ ID NO: 8325272 - DNA, 22 bp, Homo sapiens
gagaggggcccaagccacatag

SEQ ID NO: 8325273 - DNA, 22 bp, Homo sapiens
gagaggggcgcgcagctcgcga

SEQ ID NO: 8325274 - DNA, 22 bp, Homo sapiens
gagaggggcgcgcagctcgcga

SEQ ID NO: 8325275 - DNA, 22 bp, Homo sapiens
gagaggggcgcgcagctcgcga

SEQ ID NO: 8325276 - DNA, 22 bp, Homo sapiens
gagaggggacctgtgtgtctag

SEQ ID NO: 8325277 - DNA, 22 bp, Homo sapiens
gagagggctggaaacttcctgg

SEQ ID NO: 8325278 - DNA, 18 bp, Homo sapiens
gagcatgggcagtgggga

SEQ ID NO: 8325279 - DNA, 22 bp, Homo sapiens
ctgtataacatcttttgtttcc

SEQ ID NO: 8325280 - DNA, 22 bp, Homo sapiens
ctgtatttgaaagaaaagattt

SEQ ID NO: 8325281 - DNA, 22 bp, Homo sapiens
ctgtcaccatttgagccctgga

SEQ ID NO: 8325282 - DNA, 22 bp, Homo sapiens
ctgtcacccacccagcctgtca

SEQ ID NO: 8325283 - DNA, 22 bp, Homo sapiens
ctgtcacctgttcactgcagca

SEQ ID NO: 8325284 - DNA, 22 bp, Homo sapiens
ctgtcctgtggtgacaggtaca

SEQ ID NO: 8325285 - DNA, 22 bp, Homo sapiens
ctgtctgaatcctaagcttcct

SEQ ID NO: 8325286 - DNA, 22 bp, Homo sapiens
ctgtgctggcagacctggagtt

SEQ ID NO: 8325287 - DNA, 22 bp, Homo sapiens
ctgtctgtgacctctgcatgtc

SEQ ID NO: 8325288 - DNA, 22 bp, Homo sapiens
ctggggagaagcgactcggctg

SEQ ID NO: 8325289 - DNA, 22 bp, Homo sapiens
ctggggagacgatcgatgttct

SEQ ID NO: 8325290 - DNA, 22 bp, Homo sapiens
ctggggacgtcgggcagtgttc

SEQ ID NO: 8325291 - DNA, 22 bp, Homo sapiens
ctggtctgcgggaaggcgtggg

SEQ ID NO: 8325292 - DNA, 22 bp, Homo sapiens
ctggtcactggtctcatccagc

SEQ ID NO: 8325293 - DNA, 22 bp, Homo sapiens
ctggtcagctgaagccccacac

SEQ ID NO: 8325294 - DNA, 20 bp, Homo sapiens
ctggggagcctcgcggtggc

SEQ ID NO: 8325295 - DNA, 20 bp, Homo sapiens
ctggggagcctcgcggtggc

SEQ ID NO: 8325296 - DNA, 20 bp, Homo sapiens
ctggggagcctcgcggtggc

SEQ ID NO: 8325297 - DNA, 22 bp, Homo sapiens
ctggtgagacggttgacaggag

SEQ ID NO: 8325298 - DNA, 22 bp, Homo sapiens
ctggtgcaaggctttggaatcc

SEQ ID NO: 8325299 - DNA, 22 bp, Homo sapiens
ctggtgcaggaaggagctggca

SEQ ID NO: 8325300 - DNA, 22 bp, Homo sapiens
ctggtgcacattcgctctcata

SEQ ID NO: 8325301 - DNA, 22 bp, Homo sapiens
ctggtgccattctgtggcctag

SEQ ID NO: 8325302 - DNA, 22 bp, Homo sapiens
ctggtgccctgtgtggcaggag

SEQ ID NO: 8325303 - DNA, 22 bp, Homo sapiens
ctgctgttcagaggacctcact

SEQ ID NO: 8325304 - DNA, 23 bp, Homo sapiens
ctgctgttttctgtacctgaagc

SEQ ID NO: 8325305 - DNA, 22 bp, Homo sapiens
ctgggacatagatcagcctttt

SEQ ID NO: 8325306 - DNA, 23 bp, Homo sapiens
ctgggacatggtaggggcacaac

SEQ ID NO: 8325307 - DNA, 18 bp, Homo sapiens
ctgggactcaatgctact

SEQ ID NO: 8325308 - DNA, 22 bp, Homo sapiens
ctgggacctgtgtgcctgggcc

SEQ ID NO: 8325309 - DNA, 22 bp, Homo sapiens
ctgggactcagaccagttctgt

SEQ ID NO: 8325310 - DNA, 19 bp, Homo sapiens
ctgggactcctgatacctt

SEQ ID NO: 8325311 - DNA, 22 bp, Homo sapiens
ctgggactggacctctgcctgg

SEQ ID NO: 8325312 - DNA, 22 bp, Homo sapiens
ctgggactgccattcacagcca

SEQ ID NO: 8325313 - DNA, 22 bp, Homo sapiens
ctgggacccccactgcgtagct

SEQ ID NO: 8325314 - DNA, 22 bp, Homo sapiens
ctgggaccagtgaagcaactca

SEQ ID NO: 8325315 - DNA, 22 bp, Homo sapiens
ctgggaccatctgtgtctactt

SEQ ID NO: 8325316 - DNA, 22 bp, Homo sapiens
ctgggacctcctgaggtggagc

SEQ ID NO: 8325317 - DNA, 22 bp, Homo sapiens
ctgggacctcctcactgttcta

SEQ ID NO: 8325318 - DNA, 22 bp, Homo sapiens
ctgggaccctgccctgtggcct

SEQ ID NO: 8325319 - DNA, 22 bp, Homo sapiens
ctgggacttgcagagcaggagg

SEQ ID NO: 8325320 - DNA, 22 bp, Homo sapiens
ctgggacttgggctatgctctg

SEQ ID NO: 8325321 - DNA, 22 bp, Homo sapiens
ctgggactgggtcctcaggaca

SEQ ID NO: 8325322 - DNA, 22 bp, Homo sapiens
ctgggacttgatgaaatgactg

SEQ ID NO: 8325323 - DNA, 22 bp, Homo sapiens
ctgggcctccagctctgccagc

SEQ ID NO: 8325324 - DNA, 22 bp, Homo sapiens
ctgggagcaagtcaggaaaggt

SEQ ID NO: 8325325 - DNA, 22 bp, Homo sapiens
ctgggatgtgaggagcgcctct

SEQ ID NO: 8325326 - DNA, 22 bp, Homo sapiens
ctgggcctgtgactcccatcct

SEQ ID NO: 8325327 - DNA, 22 bp, Homo sapiens
ctgggccttagggcactccctt

SEQ ID NO: 8325328 - DNA, 17 bp, Homo sapiens
ctgggcctcccctgtcc

SEQ ID NO: 8325329 - DNA, 22 bp, Homo sapiens
ctgggcctcctctgcccaagct

SEQ ID NO: 8325330 - DNA, 22 bp, Homo sapiens
ctgggccttgccttgcccacag

SEQ ID NO: 8325331 - DNA, 22 bp, Homo sapiens
ctgggccttcattgctctccca

SEQ ID NO: 8325332 - DNA, 22 bp, Homo sapiens
ctgggccttgagaatcatgttt

SEQ ID NO: 8325333 - DNA, 22 bp, Homo sapiens
ctgggccttatgagtacctgga

SEQ ID NO: 8325334 - DNA, 22 bp, Homo sapiens
ctgggctggagtgcaatggcgc

SEQ ID NO: 8325335 - DNA, 22 bp, Homo sapiens
cttacagtacttctaatatgat

SEQ ID NO: 8325336 - DNA, 22 bp, Homo sapiens
cttaaatccatcatttctaatc

SEQ ID NO: 8325337 - DNA, 22 bp, Homo sapiens
cttacaaaggagaggagatagg

SEQ ID NO: 8325338 - DNA, 22 bp, Homo sapiens
cttacaaaggagaggagatagg

SEQ ID NO: 8325339 - DNA, 22 bp, Homo sapiens
cttacaaatacacttaggagag

SEQ ID NO: 8325340 - DNA, 22 bp, Homo sapiens
cttacaaatacacttaggagag

SEQ ID NO: 8325341 - DNA, 22 bp, Homo sapiens
ctgtgcttgacagtgggaagca

SEQ ID NO: 8325342 - DNA, 22 bp, Homo sapiens
ctgtgcttgcgggtgtggagcc

SEQ ID NO: 8325343 - DNA, 19 bp, Homo sapiens
ctgtttctgagcttgcttt

SEQ ID NO: 8325344 - DNA, 22 bp, Homo sapiens
ctgtttataaatagaggggagt

SEQ ID NO: 8325345 - DNA, 22 bp, Homo sapiens
ctgtttatacgacaggtggagg

SEQ ID NO: 8325346 - DNA, 22 bp, Homo sapiens
ctgtttatccctttggtcagca

SEQ ID NO: 8325347 - DNA, 22 bp, Homo sapiens
cttaaaagagatgacggcaggg

SEQ ID NO: 8325348 - DNA, 22 bp, Homo sapiens
cttaaaatctggcagttagcta

SEQ ID NO: 8325349 - DNA, 22 bp, Homo sapiens
cttaaaatctggcagttagcta

SEQ ID NO: 8325350 - DNA, 22 bp, Homo sapiens
cttaaaagttgcttccctaact

SEQ ID NO: 8325351 - DNA, 20 bp, Homo sapiens
cttaaacacagagatagatt

SEQ ID NO: 8325352 - DNA, 22 bp, Homo sapiens
cttaaagaaattgaggagagga

SEQ ID NO: 8325353 - DNA, 22 bp, Homo sapiens
ctgttttataaagtccaaaagt

SEQ ID NO: 8325354 - DNA, 22 bp, Homo sapiens
ctgtttgtctctctcctgaccc

SEQ ID NO: 8325355 - DNA, 22 bp, Homo sapiens
ctgtttgtgatttctacgattt

SEQ ID NO: 8325356 - DNA, 22 bp, Homo sapiens
cttctagctatagtgttttctt

SEQ ID NO: 8325357 - DNA, 22 bp, Homo sapiens
cttctcaaactgagactgtcta

SEQ ID NO: 8325358 - DNA, 23 bp, Homo sapiens
cttctcagtagtacacacactat

SEQ ID NO: 8325359 - DNA, 22 bp, Homo sapiens
cttatatttgtcaactttacaa

SEQ ID NO: 8325360 - DNA, 22 bp, Homo sapiens
cttccaaatgtaaataagtttc

SEQ ID NO: 8325361 - DNA, 18 bp, Homo sapiens
cttcatttgtagagttcc

SEQ ID NO: 8325362 - DNA, 22 bp, Homo sapiens
cttcatttggcaggctggcctc

SEQ ID NO: 8325363 - DNA, 22 bp, Homo sapiens
cttcatttccatccaactggga

SEQ ID NO: 8325364 - DNA, 22 bp, Homo sapiens
cttagtgagaaggagcccatgc

SEQ ID NO: 8325365 - DNA, 22 bp, Homo sapiens
cttataaagtccatctgaacaa

SEQ ID NO: 8325366 - DNA, 22 bp, Homo sapiens
ctttgaaacctgctctgcagaa

SEQ ID NO: 8325367 - DNA, 22 bp, Homo sapiens
ctttacaaagcaattttgtctc

SEQ ID NO: 8325368 - DNA, 22 bp, Homo sapiens
cttctggaggacactggcccca

SEQ ID NO: 8325369 - DNA, 22 bp, Homo sapiens
cttctggagctcaccaacttcc

SEQ ID NO: 8325370 - DNA, 22 bp, Homo sapiens
ctttaaataatacaaggtccag

SEQ ID NO: 8325371 - DNA, 22 bp, Homo sapiens
cttgttttggctagtatgatgt

SEQ ID NO: 8325372 - DNA, 22 bp, Homo sapiens
cttgttttcttctgcagtctat

SEQ ID NO: 8325373 - DNA, 22 bp, Homo sapiens
cttgttttgaaagcagtggcca

SEQ ID NO: 8325374 - DNA, 22 bp, Homo sapiens
cttgttttggaacagagtgaat

SEQ ID NO: 8325375 - DNA, 21 bp, Homo sapiens
cttttacattcagtcatgatg

SEQ ID NO: 8325376 - DNA, 22 bp, Homo sapiens
cttttcattgtttgtacatgca

SEQ ID NO: 8325377 - DNA, 18 bp, Homo sapiens
cttttcccctttggactc

SEQ ID NO: 8325378 - DNA, 22 bp, Homo sapiens
cttttcctattgattctgttac

SEQ ID NO: 8325379 - DNA, 22 bp, Homo sapiens
cttttctagagccgcagcccta

SEQ ID NO: 8325380 - DNA, 22 bp, Homo sapiens
cttttctcttacattccactgg

SEQ ID NO: 8325381 - DNA, 22 bp, Homo sapiens
gaaagataatcaattactcctt

SEQ ID NO: 8325382 - DNA, 22 bp, Homo sapiens
gaaagagaggggctgagatgca

SEQ ID NO: 8325383 - DNA, 22 bp, Homo sapiens
gaaacacatatgaacagttgat

SEQ ID NO: 8325384 - DNA, 22 bp, Homo sapiens
gaaacagattaacagcatattt

SEQ ID NO: 8325385 - DNA, 22 bp, Homo sapiens
gaaaattattgaaaatggctct

SEQ ID NO: 8325386 - DNA, 22 bp, Homo sapiens
gaaaatacttcagtgttctggc

SEQ ID NO: 8325387 - DNA, 22 bp, Homo sapiens
gaaaatacttcagtgttctggc

SEQ ID NO: 8325388 - DNA, 22 bp, Homo sapiens
gaaaatttagaactgaacttct

SEQ ID NO: 8325389 - DNA, 22 bp, Homo sapiens
gaaaatttaattctcttctgtg

SEQ ID NO: 8325390 - DNA, 22 bp, Homo sapiens
gaaaattattgaaaatggctct

SEQ ID NO: 8325391 - DNA, 22 bp, Homo sapiens
gaaaatttctgccacatgtgtg

SEQ ID NO: 8325392 - DNA, 22 bp, Homo sapiens
tgctgccttagcagccaggcaa

SEQ ID NO: 8325393 - DNA, 22 bp, Homo sapiens
tgctgcaggcaatagaaaacct

SEQ ID NO: 8325394 - DNA, 20 bp, Homo sapiens
tgctctggaaatggtctgag

SEQ ID NO: 8325395 - DNA, 22 bp, Homo sapiens
tgctctgaaggggaagggatgg

SEQ ID NO: 8325396 - DNA, 22 bp, Homo sapiens
cccagtggcaaagcagcttaga

SEQ ID NO: 8325397 - DNA, 22 bp, Homo sapiens
cccagtggcccagcatgtggtg

SEQ ID NO: 8325398 - DNA, 22 bp, Homo sapiens
cccagtccagaccatgacctca

SEQ ID NO: 8325399 - DNA, 22 bp, Homo sapiens
cccagtgccaggcacaggcagc

SEQ ID NO: 8325400 - DNA, 19 bp, Homo sapiens
cccagtctaggtcctagga

SEQ ID NO: 8325401 - DNA, 22 bp, Homo sapiens
tgctagccaagcccatcccttt

SEQ ID NO: 8325402 - DNA, 22 bp, Homo sapiens
tgctagctcacccttgcctccc

SEQ ID NO: 8325403 - DNA, 22 bp, Homo sapiens
tgcagggctaagtcagagcctg

SEQ ID NO: 8325404 - DNA, 22 bp, Homo sapiens
tgctacacttaaatcagtcacc

SEQ ID NO: 8325405 - DNA, 22 bp, Homo sapiens
tgctgtttgccaagatcacttt

SEQ ID NO: 8325406 - DNA, 22 bp, Homo sapiens
tgctgtttcattttcctcatcc

SEQ ID NO: 8325407 - DNA, 22 bp, Homo sapiens
ccccaggacacatggaccaagt

SEQ ID NO: 8325408 - DNA, 22 bp, Homo sapiens
ccccaggagatttgggagcaca

SEQ ID NO: 8325409 - DNA, 22 bp, Homo sapiens
tgcttggctttctgagcttctg

SEQ ID NO: 8325410 - DNA, 22 bp, Homo sapiens
tgcttgctgtaaagcttggtca

SEQ ID NO: 8325411 - DNA, 22 bp, Homo sapiens
ccctccagtgtcccagtgggga

SEQ ID NO: 8325412 - DNA, 22 bp, Homo sapiens
tgctgggggctttctggatacc

SEQ ID NO: 8325413 - DNA, 22 bp, Homo sapiens
tgctgggggctttctggatacc

SEQ ID NO: 8325414 - DNA, 22 bp, Homo sapiens
tgctgggggtagctctgcgtag

SEQ ID NO: 8325415 - DNA, 22 bp, Homo sapiens
tgctgggggttcagatgagtaa

SEQ ID NO: 8325416 - DNA, 22 bp, Homo sapiens
ccccagctcagtgcagggacat

SEQ ID NO: 8325417 - DNA, 22 bp, Homo sapiens
cccagtggtttgcagaaccaag

SEQ ID NO: 8325418 - DNA, 19 bp, Homo sapiens
tggcagggagagtttgaag

SEQ ID NO: 8325419 - DNA, 22 bp, Homo sapiens
ccctttcaacattctgccttgt

SEQ ID NO: 8325420 - DNA, 22 bp, Homo sapiens
tggcaggctgagttggcctggt

SEQ ID NO: 8325421 - DNA, 22 bp, Homo sapiens
ccctgggagaagttgagggctg

SEQ ID NO: 8325422 - DNA, 22 bp, Homo sapiens
ccctgggagctgcctggctgac

SEQ ID NO: 8325423 - DNA, 22 bp, Homo sapiens
ccctggctgcttgtagtctggc

SEQ ID NO: 8325424 - DNA, 22 bp, Homo sapiens
ccctggagtcctggcagttgat

SEQ ID NO: 8325425 - DNA, 22 bp, Homo sapiens
ccctggagtagcactgggtcgc

SEQ ID NO: 8325426 - DNA, 22 bp, Homo sapiens
ccctggaggtcagaggcctggg

SEQ ID NO: 8325427 - DNA, 22 bp, Homo sapiens
ccctggagggcagacagatgcc

SEQ ID NO: 8325428 - DNA, 22 bp, Homo sapiens
ccctggaggttgaggctgcagt

SEQ ID NO: 8325429 - DNA, 22 bp, Homo sapiens
ccctggaggttgaggctgcagt

SEQ ID NO: 8325430 - DNA, 22 bp, Homo sapiens
ccctggaggtggaggttgcagg

SEQ ID NO: 8325431 - DNA, 22 bp, Homo sapiens
ccctggaggtggaggttgcagg

SEQ ID NO: 8325432 - DNA, 22 bp, Homo sapiens
tggcagaatgaagactggggcc

SEQ ID NO: 8325433 - DNA, 22 bp, Homo sapiens
ccctggagtgtgacgaggcatt

SEQ ID NO: 8325434 - DNA, 22 bp, Homo sapiens
tggagacagagatagccaattg

SEQ ID NO: 8325435 - DNA, 21 bp, Homo sapiens
tggagactctggttctttgtg

SEQ ID NO: 8325436 - DNA, 22 bp, Homo sapiens
tggaaactatcctcacaactag

SEQ ID NO: 8325437 - DNA, 22 bp, Homo sapiens
tggaaactatagtcacaataga

SEQ ID NO: 8325438 - DNA, 22 bp, Homo sapiens
tggaggaatcagggcttaggct

SEQ ID NO: 8325439 - DNA, 22 bp, Homo sapiens
tggaggacaggactggacagcc

SEQ ID NO: 8325440 - DNA, 22 bp, Homo sapiens
tggaggaagtggctggccagaa

SEQ ID NO: 8325441 - DNA, 22 bp, Homo sapiens
tggaggaagttgctggaagtca

SEQ ID NO: 8325442 - DNA, 22 bp, Homo sapiens
tggagatgcacgagcaggtgga

SEQ ID NO: 8325443 - DNA, 22 bp, Homo sapiens
tggagctgaggggaatgctgag

SEQ ID NO: 8325444 - DNA, 22 bp, Homo sapiens
tggaggagaactccctggctac

SEQ ID NO: 8325445 - DNA, 22 bp, Homo sapiens
ccctggagggatttctcaatca

SEQ ID NO: 8325446 - DNA, 22 bp, Homo sapiens
tggaggccaactttcctcatct

SEQ ID NO: 8325447 - DNA, 22 bp, Homo sapiens
ccctggaggaccccaatgtggc

SEQ ID NO: 8325448 - DNA, 22 bp, Homo sapiens
tggaggcatgacagtgtctgga

SEQ ID NO: 8325449 - DNA, 22 bp, Homo sapiens
tggaggcattgtgactgctgaa

SEQ ID NO: 8325450 - DNA, 22 bp, Homo sapiens
tggtgggagtccgctgtgctgc

SEQ ID NO: 8325451 - DNA, 22 bp, Homo sapiens
tggttagacacatgcatgtcat

SEQ ID NO: 8325452 - DNA, 22 bp, Homo sapiens
cctgcctgattccaggatggct

SEQ ID NO: 8325453 - DNA, 22 bp, Homo sapiens
cctgcctcccagaggtcctcta

SEQ ID NO: 8325454 - DNA, 22 bp, Homo sapiens
cctgcctcaggactctgcatat

SEQ ID NO: 8325455 - DNA, 22 bp, Homo sapiens
cctgcctcaggactctgcatat

SEQ ID NO: 8325456 - DNA, 22 bp, Homo sapiens
cctgcccttctttccccagcat

SEQ ID NO: 8325457 - DNA, 17 bp, Homo sapiens
tggtacaggctgaggga

SEQ ID NO: 8325458 - DNA, 22 bp, Homo sapiens
cctgcaggtccccggatgcgca

SEQ ID NO: 8325459 - DNA, 22 bp, Homo sapiens
cctgcagggtgctgccacagat

SEQ ID NO: 8325460 - DNA, 19 bp, Homo sapiens
cctgcagggatgagaggtt

SEQ ID NO: 8325461 - DNA, 22 bp, Homo sapiens
cctgcaggttgcagaggcggaa

SEQ ID NO: 8325462 - DNA, 22 bp, Homo sapiens
cctgcaggttgcagaggcggaa

SEQ ID NO: 8325463 - DNA, 22 bp, Homo sapiens
cctgcaggtttcccccggacgg

SEQ ID NO: 8325464 - DNA, 22 bp, Homo sapiens
tgggtggagctccacaacctgt

SEQ ID NO: 8325465 - DNA, 22 bp, Homo sapiens
tgggtggaataaatcagttctg

SEQ ID NO: 8325466 - DNA, 22 bp, Homo sapiens
tggtacaattaaaataattttg

SEQ ID NO: 8325467 - DNA, 22 bp, Homo sapiens
tggtacaagcagactcagcaga

SEQ ID NO: 8325468 - DNA, 22 bp, Homo sapiens
cctgcagctgtaggagaaggcg

SEQ ID NO: 8325469 - DNA, 22 bp, Homo sapiens
cctgcagctttgcctcctgaac

SEQ ID NO: 8325470 - DNA, 22 bp, Homo sapiens
cctgcagggaatcgaggcagaa

SEQ ID NO: 8325471 - DNA, 22 bp, Homo sapiens
tgggcctggagtttgtccagag

SEQ ID NO: 8325472 - DNA, 22 bp, Homo sapiens
tgggcctggagccctggagagt

SEQ ID NO: 8325473 - DNA, 22 bp, Homo sapiens
tgggcaggcaagtgaatacctt

SEQ ID NO: 8325474 - DNA, 22 bp, Homo sapiens
tgggcaggataatatctcatgt

SEQ ID NO: 8325475 - DNA, 22 bp, Homo sapiens
tgggcaggagagaagctaaaga

SEQ ID NO: 8325476 - DNA, 23 bp, Homo sapiens
tgggcctggcctcccagtccagc

SEQ ID NO: 8325477 - DNA, 22 bp, Homo sapiens
tgggcctgggagggcagacgct

SEQ ID NO: 8325478 - DNA, 22 bp, Homo sapiens
tgggctcctcgtcactcgctgt

SEQ ID NO: 8325479 - DNA, 22 bp, Homo sapiens
tgggctccggcggcctcaggct

SEQ ID NO: 8325480 - DNA, 20 bp, Homo sapiens
tggccaagtatccaactgga

SEQ ID NO: 8325481 - DNA, 22 bp, Homo sapiens
tggcattttgtagctgtgtatc

SEQ ID NO: 8325482 - DNA, 23 bp, Homo sapiens
tggcattttagttagcttcagtg

SEQ ID NO: 8325483 - DNA, 22 bp, Homo sapiens
tggcattttgttcagtatatgg

SEQ ID NO: 8325484 - DNA, 21 bp, Homo sapiens
tggccaaggaatagaagctct

SEQ ID NO: 8325485 - DNA, 22 bp, Homo sapiens
cctccatctccagcttctgcct

SEQ ID NO: 8325486 - DNA, 22 bp, Homo sapiens
cctcccacatcctagctctgct

SEQ ID NO: 8325487 - DNA, 22 bp, Homo sapiens
cctcccaccatttagagagagc

SEQ ID NO: 8325488 - DNA, 22 bp, Homo sapiens
cctcctctggtgctgccaaccc

SEQ ID NO: 8325489 - DNA, 22 bp, Homo sapiens
cctcctggcttttcccattgaa

SEQ ID NO: 8325490 - DNA, 22 bp, Homo sapiens
cctcctggcttttcccattgaa

SEQ ID NO: 8325491 - DNA, 22 bp, Homo sapiens
cctcctgggacaggctggcaca

SEQ ID NO: 8325492 - DNA, 22 bp, Homo sapiens
cctcctggcctgtgcagagccc

SEQ ID NO: 8325493 - DNA, 22 bp, Homo sapiens
cctcctggcctgtgcagagccc

SEQ ID NO: 8325494 - DNA, 22 bp, Homo sapiens
cctcctggccctgggcctggaa

SEQ ID NO: 8325495 - DNA, 23 bp, Homo sapiens
cctcctgggcacaggcctgatgg

SEQ ID NO: 8325496 - DNA, 22 bp, Homo sapiens
cctcctgggagagcacggaggg

SEQ ID NO: 8325497 - DNA, 22 bp, Homo sapiens
cctcctgggactcattagcacc

SEQ ID NO: 8325498 - DNA, 22 bp, Homo sapiens
cctcctgggctcctgtctgcac

SEQ ID NO: 8325499 - DNA, 22 bp, Homo sapiens
cctcctgggccttgctctgtga

SEQ ID NO: 8325500 - DNA, 22 bp, Homo sapiens
tgggacaggatgaccagaaggt

SEQ ID NO: 8325501 - DNA, 22 bp, Homo sapiens
tgggagagaattctggtgactg

SEQ ID NO: 8325502 - DNA, 22 bp, Homo sapiens
tgggagagcactgcagccccgg

SEQ ID NO: 8325503 - DNA, 22 bp, Homo sapiens
tgggcagactaaggtcaaagct

SEQ ID NO: 8325504 - DNA, 22 bp, Homo sapiens
tgggagagcagagaaccctctt

SEQ ID NO: 8325505 - DNA, 22 bp, Homo sapiens
cctcctggtaattagcgaaagg

SEQ ID NO: 8325506 - DNA, 20 bp, Homo sapiens
cctcctggtcaggtgtgcag

SEQ ID NO: 8325507 - DNA, 22 bp, Homo sapiens
cctcctgggttcaagcgattct

SEQ ID NO: 8325508 - DNA, 22 bp, Homo sapiens
cctcctggggtgaaggatggga

SEQ ID NO: 8325509 - DNA, 22 bp, Homo sapiens
cctcctggtccagcatctcttt

SEQ ID NO: 8325510 - DNA, 22 bp, Homo sapiens
tgcagggccgctggaggtcatg

SEQ ID NO: 8325511 - DNA, 22 bp, Homo sapiens
cccagcagggtctctgtgtcta

SEQ ID NO: 8325512 - DNA, 22 bp, Homo sapiens
cccagcaggcatgttgggagga

SEQ ID NO: 8325513 - DNA, 22 bp, Homo sapiens
cccagcagcttgcacagtgctg

SEQ ID NO: 8325514 - DNA, 22 bp, Homo sapiens
tgcagctgcaagtccaggtcag

SEQ ID NO: 8325515 - DNA, 22 bp, Homo sapiens
cccagagggaagggaatgaggt

SEQ ID NO: 8325516 - DNA, 22 bp, Homo sapiens
tgcagctgcctccttcccttgt

SEQ ID NO: 8325517 - DNA, 20 bp, Homo sapiens
tgcaggaatttgcattcctt

SEQ ID NO: 8325518 - DNA, 17 bp, Homo sapiens
cccagagatgctgcctt

SEQ ID NO: 8325519 - DNA, 23 bp, Homo sapiens
cccagaggagcagggcgtgagat

SEQ ID NO: 8325520 - DNA, 22 bp, Homo sapiens
tgcactccaggctgggtgacag

SEQ ID NO: 8325521 - DNA, 22 bp, Homo sapiens
tgcagagagacccctgggccag

SEQ ID NO: 8325522 - DNA, 22 bp, Homo sapiens
tgcagagacttgtgtgcatttg

SEQ ID NO: 8325523 - DNA, 22 bp, Homo sapiens
tgcaataaggagtaatagtaaa

SEQ ID NO: 8325524 - DNA, 22 bp, Homo sapiens
tgcaataacccatgagatagaa

SEQ ID NO: 8325525 - DNA, 22 bp, Homo sapiens
tgcaataactactttaatgttg

SEQ ID NO: 8325526 - DNA, 22 bp, Homo sapiens
tgcaataagttgtgttatcact

SEQ ID NO: 8325527 - DNA, 22 bp, Homo sapiens
tgcaataagtattgcttacatg

SEQ ID NO: 8325528 - DNA, 23 bp, Homo sapiens
tgcaatatgtcagtgcaaagtgg

SEQ ID NO: 8325529 - DNA, 22 bp, Homo sapiens
tgcaatatcagattcaacacat

SEQ ID NO: 8325530 - DNA, 22 bp, Homo sapiens
tgcaataatgtatgtcactccc

SEQ ID NO: 8325531 - DNA, 22 bp, Homo sapiens
tgcaataaagtgctataaatcc

SEQ ID NO: 8325532 - DNA, 22 bp, Homo sapiens
tgcaataacccagtatctgtga

SEQ ID NO: 8325533 - DNA, 22 bp, Homo sapiens
tgataaatccatgtaaatggta

SEQ ID NO: 8325534 - DNA, 22 bp, Homo sapiens
cccaagggatgcttgagtagtt

SEQ ID NO: 8325535 - DNA, 22 bp, Homo sapiens
cccaaggggtgttgatggagga

SEQ ID NO: 8325536 - DNA, 22 bp, Homo sapiens
tgagcccagaagcccactcggc

SEQ ID NO: 8325537 - DNA, 22 bp, Homo sapiens
tgagccagttcttcagatccat

SEQ ID NO: 8325538 - DNA, 22 bp, Homo sapiens
ccagtgcctatctcctctggga

SEQ ID NO: 8325539 - DNA, 22 bp, Homo sapiens
ccagtccatatttatactgccg

SEQ ID NO: 8325540 - DNA, 22 bp, Homo sapiens
ccagtccagtgccatgcatggc

SEQ ID NO: 8325541 - DNA, 20 bp, Homo sapiens
ccagtccacctgagacatgt

SEQ ID NO: 8325542 - DNA, 22 bp, Homo sapiens
ccagtccacgtcaagaagaggt

SEQ ID NO: 8325543 - DNA, 22 bp, Homo sapiens
ccagtcagggcaggagcctggt

SEQ ID NO: 8325544 - DNA, 22 bp, Homo sapiens
ccagtcagtcagttgctggcat

SEQ ID NO: 8325545 - DNA, 23 bp, Homo sapiens
ccatcaggcctccgtgtccagcc

SEQ ID NO: 8325546 - DNA, 22 bp, Homo sapiens
ccatcagattagcaaaatccag

SEQ ID NO: 8325547 - DNA, 22 bp, Homo sapiens
ccatatatgattgcctctttca

SEQ ID NO: 8325548 - DNA, 22 bp, Homo sapiens
tgaggccatggtcttcccagtc

SEQ ID NO: 8325549 - DNA, 17 bp, Homo sapiens
tgaggccatggcaccat

SEQ ID NO: 8325550 - DNA, 22 bp, Homo sapiens
tgataaacagctgatgaagacc

SEQ ID NO: 8325551 - DNA, 22 bp, Homo sapiens
tgataaacttagaaagaatgtt

SEQ ID NO: 8325552 - DNA, 22 bp, Homo sapiens
tgataaactggagaggtggagg

SEQ ID NO: 8325553 - DNA, 22 bp, Homo sapiens
tgataaacattttaggaactaa

SEQ ID NO: 8325554 - DNA, 22 bp, Homo sapiens
tgagttgaaagactgacttctg

SEQ ID NO: 8325555 - DNA, 19 bp, Homo sapiens
tgagttctgtggttctcaa

SEQ ID NO: 8325556 - DNA, 19 bp, Homo sapiens
tgagtttaatgcaaaactg

SEQ ID NO: 8325557 - DNA, 22 bp, Homo sapiens
tgagtttagtgtgagacttatc

SEQ ID NO: 8325558 - DNA, 22 bp, Homo sapiens
tgagtttaattggagcctgaat

SEQ ID NO: 8325559 - DNA, 22 bp, Homo sapiens
tgagttgccctgccctgtgctt

SEQ ID NO: 8325560 - DNA, 22 bp, Homo sapiens
tgagtttaatgatatttatatg

SEQ ID NO: 8325561 - DNA, 22 bp, Homo sapiens
tgagtctgctcctggtagcaga

SEQ ID NO: 8325562 - DNA, 22 bp, Homo sapiens
ccatcctgaatggtctcagcca

SEQ ID NO: 8325563 - DNA, 22 bp, Homo sapiens
tctgggccggagccgacggcag

SEQ ID NO: 8325564 - DNA, 22 bp, Homo sapiens
tctgggcctcacctgctgctca

SEQ ID NO: 8325565 - DNA, 22 bp, Homo sapiens
tctgggcctcagtttcttcatc

SEQ ID NO: 8325566 - DNA, 22 bp, Homo sapiens
tctggggagtgcctaagtggaa

SEQ ID NO: 8325567 - DNA, 22 bp, Homo sapiens
tctggggaccatggcatctaaa

SEQ ID NO: 8325568 - DNA, 22 bp, Homo sapiens
tctggggagcagccctggtgag

SEQ ID NO: 8325569 - DNA, 22 bp, Homo sapiens
ccaggagcagagtaggtgttca

SEQ ID NO: 8325570 - DNA, 23 bp, Homo sapiens
tctgtggctccttcaggctgctg

SEQ ID NO: 8325571 - DNA, 22 bp, Homo sapiens
ccaggcaggcgatggtgcagtg

SEQ ID NO: 8325572 - DNA, 22 bp, Homo sapiens
ccaggcaggcgatggtgcagtg

SEQ ID NO: 8325573 - DNA, 22 bp, Homo sapiens
ccaggcaggcgatggtgcagtg

SEQ ID NO: 8325574 - DNA, 22 bp, Homo sapiens
ccaggcaggcagcgttctcagg

SEQ ID NO: 8325575 - DNA, 22 bp, Homo sapiens
ccaggaggctctgactggaccc

SEQ ID NO: 8325576 - DNA, 22 bp, Homo sapiens
ccaggaggctctgactggaccc

SEQ ID NO: 8325577 - DNA, 22 bp, Homo sapiens
tcttacaccattcaaatatttt

SEQ ID NO: 8325578 - DNA, 20 bp, Homo sapiens
tcttacaatcgttacatcca

SEQ ID NO: 8325579 - DNA, 22 bp, Homo sapiens
ccaggcagagtgctccagaaag

SEQ ID NO: 8325580 - DNA, 22 bp, Homo sapiens
tcttgcatgatattctgtattt

SEQ ID NO: 8325581 - DNA, 22 bp, Homo sapiens
tctttggtttctgtctctgtaa

SEQ ID NO: 8325582 - DNA, 22 bp, Homo sapiens
tctttggttgcactgcaggtgt

SEQ ID NO: 8325583 - DNA, 22 bp, Homo sapiens
tcttttgtcatagagcatggta

SEQ ID NO: 8325584 - DNA, 22 bp, Homo sapiens
tcttttgtgaggacaaggtacg

SEQ ID NO: 8325585 - DNA, 22 bp, Homo sapiens
tcttttcttgcattattgcact

SEQ ID NO: 8325586 - DNA, 22 bp, Homo sapiens
tcttttgtgattctttagttac

SEQ ID NO: 8325587 - DNA, 22 bp, Homo sapiens
tgaaacaattagaatgtaatga

SEQ ID NO: 8325588 - DNA, 22 bp, Homo sapiens
tgaaacaatgtgaagttgctga

SEQ ID NO: 8325589 - DNA, 22 bp, Homo sapiens
ccaggctgtggtttagatagag

SEQ ID NO: 8325590 - DNA, 21 bp, Homo sapiens
tgaaatgagaatgctgagcac

SEQ ID NO: 8325591 - DNA, 22 bp, Homo sapiens
tgaaatgacaaaggtttttctt

SEQ ID NO: 8325592 - DNA, 22 bp, Homo sapiens
tgaaatgaagggcttgttctgg

SEQ ID NO: 8325593 - DNA, 22 bp, Homo sapiens
tgaagtaggcagcatgctgaga

SEQ ID NO: 8325594 - DNA, 22 bp, Homo sapiens
tgaagtagcaggctgatggttt

SEQ ID NO: 8325595 - DNA, 22 bp, Homo sapiens
ccagggctgagctgtgaccatg

SEQ ID NO: 8325596 - DNA, 22 bp, Homo sapiens
ccagggctccattgctcatcct

SEQ ID NO: 8325597 - DNA, 22 bp, Homo sapiens
tgaaatgagcatttattcttta

SEQ ID NO: 8325598 - DNA, 22 bp, Homo sapiens
tgaaatgatcagtttggttact

SEQ ID NO: 8325599 - DNA, 22 bp, Homo sapiens
tctatacatgtgcacacacatc

SEQ ID NO: 8325600 - DNA, 22 bp, Homo sapiens
tctcagagacctgaactccctg

SEQ ID NO: 8325601 - DNA, 22 bp, Homo sapiens
tctagaatttgcgtaggttaga

SEQ ID NO: 8325602 - DNA, 22 bp, Homo sapiens
tctcaggatctaatacatggta

SEQ ID NO: 8325603 - DNA, 22 bp, Homo sapiens
tctcagtgtttaaaaagatttc

SEQ ID NO: 8325604 - DNA, 22 bp, Homo sapiens
tctcagtgttgttctgcagatg

SEQ ID NO: 8325605 - DNA, 22 bp, Homo sapiens
tctcagtgttatctatctgcct

SEQ ID NO: 8325606 - DNA, 22 bp, Homo sapiens
tctcagtggcttcctcactttt

SEQ ID NO: 8325607 - DNA, 22 bp, Homo sapiens
tctcagtgtggtgcttaggata

SEQ ID NO: 8325608 - DNA, 22 bp, Homo sapiens
tctcagtgtgttttctctcaga

SEQ ID NO: 8325609 - DNA, 21 bp, Homo sapiens
tctagaatcctgtataagact

SEQ ID NO: 8325610 - DNA, 22 bp, Homo sapiens
tcctgttgttcgcctgcgatgg

SEQ ID NO: 8325611 - DNA, 20 bp, Homo sapiens
ccaccctgctaagaatacac

SEQ ID NO: 8325612 - DNA, 19 bp, Homo sapiens
ccacccctttgctgggccc

SEQ ID NO: 8325613 - DNA, 22 bp, Homo sapiens
ccagagggaactgggcctcatt

SEQ ID NO: 8325614 - DNA, 22 bp, Homo sapiens
ccagagggagccaccagggtgt

SEQ ID NO: 8325615 - DNA, 22 bp, Homo sapiens
ccagagccagagaggtgcctgc

SEQ ID NO: 8325616 - DNA, 18 bp, Homo sapiens
ccagagggtgcgtcagct

SEQ ID NO: 8325617 - DNA, 22 bp, Homo sapiens
ccagaggggctgagcaggtcac

SEQ ID NO: 8325618 - DNA, 20 bp, Homo sapiens
ccagagggtagggccgcccc

SEQ ID NO: 8325619 - DNA, 22 bp, Homo sapiens
ccagagggccctggtctcagct

SEQ ID NO: 8325620 - DNA, 20 bp, Homo sapiens
ccagatgtttacattcatac

SEQ ID NO: 8325621 - DNA, 22 bp, Homo sapiens
ccagatgttcccctggaggcct

SEQ ID NO: 8325622 - DNA, 22 bp, Homo sapiens
ccagatgtctgagccacactcc

SEQ ID NO: 8325623 - DNA, 17 bp, Homo sapiens
ccagatgtgtaggtcgt

SEQ ID NO: 8325624 - DNA, 22 bp, Homo sapiens
tctctgtaaggaagaattagat

SEQ ID NO: 8325625 - DNA, 22 bp, Homo sapiens
tctctgtagacctgaccagcac

SEQ ID NO: 8325626 - DNA, 22 bp, Homo sapiens
tctctgtacagtacatgccgtg

SEQ ID NO: 8325627 - DNA, 22 bp, Homo sapiens
tccagtttgggtgtgagctgcg

SEQ ID NO: 8325628 - DNA, 22 bp, Homo sapiens
catttcacgcacactcattact

SEQ ID NO: 8325629 - DNA, 22 bp, Homo sapiens
catttccccctcatgttgcagc

SEQ ID NO: 8325630 - DNA, 22 bp, Homo sapiens
catttctaccaaatgtgactgg

SEQ ID NO: 8325631 - DNA, 22 bp, Homo sapiens
catttgtgcttttataaaatag

SEQ ID NO: 8325632 - DNA, 22 bp, Homo sapiens
cattttatgtttatggagtgct

SEQ ID NO: 8325633 - DNA, 22 bp, Homo sapiens
cattttatcctctgggaagcta

SEQ ID NO: 8325634 - DNA, 22 bp, Homo sapiens
cattttatcctctgggaagcta

SEQ ID NO: 8325635 - DNA, 22 bp, Homo sapiens
tcctggagcttccttcatggta

SEQ ID NO: 8325636 - DNA, 22 bp, Homo sapiens
ccacaggcggagtggcgggcag

SEQ ID NO: 8325637 - DNA, 22 bp, Homo sapiens
ccacagggactgttaaaaccct

SEQ ID NO: 8325638 - DNA, 22 bp, Homo sapiens
ccacagggaacatgacagcctt

SEQ ID NO: 8325639 - DNA, 22 bp, Homo sapiens
ccacagggctctaggcgcttcc

SEQ ID NO: 8325640 - DNA, 22 bp, Homo sapiens
ccacagggcctttcctgctggc

SEQ ID NO: 8325641 - DNA, 22 bp, Homo sapiens
ccacaggggcccacgagccgct

SEQ ID NO: 8325642 - DNA, 21 bp, Homo sapiens
ccacaggggctcccctgtcag

SEQ ID NO: 8325643 - DNA, 17 bp, Homo sapiens
tcctggcctggtgtgtg

SEQ ID NO: 8325644 - DNA, 22 bp, Homo sapiens
tcctggccttagcgaggcggtc

SEQ ID NO: 8325645 - DNA, 22 bp, Homo sapiens
tcctggccttagcgaggcggtc

SEQ ID NO: 8325646 - DNA, 22 bp, Homo sapiens
tcctggcctgtctggagtagct

SEQ ID NO: 8325647 - DNA, 22 bp, Homo sapiens
tcctggctccactgagcaggcc

SEQ ID NO: 8325648 - DNA, 19 bp, Homo sapiens
tcctgcccaccagccaggg

SEQ ID NO: 8325649 - DNA, 22 bp, Homo sapiens
tcctggagccacggagctttca

SEQ ID NO: 8325650 - DNA, 23 bp, Homo sapiens
tcctgctgaaagctccagctggc

SEQ ID NO: 8325651 - DNA, 23 bp, Homo sapiens
ccaagactgttaggagtggggag

SEQ ID NO: 8325652 - DNA, 23 bp, Homo sapiens
ccaagactgttaggagtggggag

SEQ ID NO: 8325653 - DNA, 21 bp, Homo sapiens
ccaagactcccatctagtggt

SEQ ID NO: 8325654 - DNA, 22 bp, Homo sapiens
ccaacaggttgagagtctgaat

SEQ ID NO: 8325655 - DNA, 22 bp, Homo sapiens
ccaaattaaatcatacagacag

SEQ ID NO: 8325656 - DNA, 22 bp, Homo sapiens
tcatcagtccttttcattatga

SEQ ID NO: 8325657 - DNA, 22 bp, Homo sapiens
catgctgtactctgtgtcagaa

SEQ ID NO: 8325658 - DNA, 22 bp, Homo sapiens
catgctggtcagccagtggatg

SEQ ID NO: 8325659 - DNA, 22 bp, Homo sapiens
tccaagatctacagcagtttag

SEQ ID NO: 8325660 - DNA, 22 bp, Homo sapiens
tccaagagaatactggagagta

SEQ ID NO: 8325661 - DNA, 22 bp, Homo sapiens
catgtaaaaaattaggtcatct

SEQ ID NO: 8325662 - DNA, 22 bp, Homo sapiens
catgctgttgaatatgacattg

SEQ ID NO: 8325663 - DNA, 22 bp, Homo sapiens
tccagggcatgctcagactcag

SEQ ID NO: 8325664 - DNA, 22 bp, Homo sapiens
tccagggccaagtcatggaacc

SEQ ID NO: 8325665 - DNA, 22 bp, Homo sapiens
tccagggcagggtgcgcatggg

SEQ ID NO: 8325666 - DNA, 22 bp, Homo sapiens
tccagggcagtgactacagcgg

SEQ ID NO: 8325667 - DNA, 22 bp, Homo sapiens
cattaatattgttcttctttag

SEQ ID NO: 8325668 - DNA, 22 bp, Homo sapiens
cattacaaacatgttaagattt

SEQ ID NO: 8325669 - DNA, 22 bp, Homo sapiens
cattacaaagttataaacagtt

SEQ ID NO: 8325670 - DNA, 22 bp, Homo sapiens
cattacaaccccaaattacaaa

SEQ ID NO: 8325671 - DNA, 22 bp, Homo sapiens
catgttttgtgtacagaatatt

SEQ ID NO: 8325672 - DNA, 22 bp, Homo sapiens
cattaataaacatttcagaaga

SEQ ID NO: 8325673 - DNA, 22 bp, Homo sapiens
tccaggctttggggcaggagcg

SEQ ID NO: 8325674 - DNA, 22 bp, Homo sapiens
tccaggcttgagaccaggctct

SEQ ID NO: 8325675 - DNA, 22 bp, Homo sapiens
tccaggctttttcatgctgtct

SEQ ID NO: 8325676 - DNA, 22 bp, Homo sapiens
catgtggagaattaaaaaatac

SEQ ID NO: 8325677 - DNA, 22 bp, Homo sapiens
tccaggctgtgcatgagtttag

SEQ ID NO: 8325678 - DNA, 22 bp, Homo sapiens
tccaggctgggctgaagggtgc

SEQ ID NO: 8325679 - DNA, 22 bp, Homo sapiens
tccaggctcctgactttttggg

SEQ ID NO: 8325680 - DNA, 22 bp, Homo sapiens
tccaggctgtgcgcaccgtgtg

SEQ ID NO: 8325681 - DNA, 22 bp, Homo sapiens
tccaggcttcacgtctgccctc

SEQ ID NO: 8325682 - DNA, 22 bp, Homo sapiens
tccaggcttcacgtctgccctc

SEQ ID NO: 8325683 - DNA, 22 bp, Homo sapiens
tcataagctagctgcaccatat

SEQ ID NO: 8325684 - DNA, 19 bp, Homo sapiens
tcagtgtgtgggaggtggt

SEQ ID NO: 8325685 - DNA, 19 bp, Homo sapiens
tcatcacccctcctctcta

SEQ ID NO: 8325686 - DNA, 22 bp, Homo sapiens
catcagtgttgatccaccagca

SEQ ID NO: 8325687 - DNA, 22 bp, Homo sapiens
cagtgtaagctctagactagaa

SEQ ID NO: 8325688 - DNA, 22 bp, Homo sapiens
tcaggctgcccgttcagggctc

SEQ ID NO: 8325689 - DNA, 22 bp, Homo sapiens
tcaggctgcatctgtaagggtg

SEQ ID NO: 8325690 - DNA, 22 bp, Homo sapiens
catcaaatgccatatatggttg

SEQ ID NO: 8325691 - DNA, 22 bp, Homo sapiens
caggctcccgaaatcacccatg

SEQ ID NO: 8325692 - DNA, 22 bp, Homo sapiens
caggctcccgctccactgggca

SEQ ID NO: 8325693 - DNA, 22 bp, Homo sapiens
caggctccctaagtcagcagcc

SEQ ID NO: 8325694 - DNA, 22 bp, Homo sapiens
caggctccctgggcagtggcag

SEQ ID NO: 8325695 - DNA, 22 bp, Homo sapiens
caggctccttatcttacaactt

SEQ ID NO: 8325696 - DNA, 17 bp, Homo sapiens
caggctccttccagatt

SEQ ID NO: 8325697 - DNA, 20 bp, Homo sapiens
caggctccgcaggactaggg

SEQ ID NO: 8325698 - DNA, 22 bp, Homo sapiens
caggctccttcccagggatggt

SEQ ID NO: 8325699 - DNA, 22 bp, Homo sapiens
tacagagactttatggcacaaa

SEQ ID NO: 8325700 - DNA, 22 bp, Homo sapiens
tacagagactttatggcacaaa

SEQ ID NO: 8325701 - DNA, 22 bp, Homo sapiens
tacagagagctccggacattca

SEQ ID NO: 8325702 - DNA, 22 bp, Homo sapiens
tacagagagtacagcatccaca

SEQ ID NO: 8325703 - DNA, 20 bp, Homo sapiens
tacagcccctgcttctgttg

SEQ ID NO: 8325704 - DNA, 22 bp, Homo sapiens
tacagcctcttccctggagtgg

SEQ ID NO: 8325705 - DNA, 22 bp, Homo sapiens
gtggagcacggaggaggcccct

SEQ ID NO: 8325706 - DNA, 21 bp, Homo sapiens
gtggagagtgattttgatgca

SEQ ID NO: 8325707 - DNA, 22 bp, Homo sapiens
tacaatatgtgaactttggtgt

SEQ ID NO: 8325708 - DNA, 22 bp, Homo sapiens
tacacagactcttcaattcaga

SEQ ID NO: 8325709 - DNA, 22 bp, Homo sapiens
tacacagagactcaaaagggca

SEQ ID NO: 8325710 - DNA, 22 bp, Homo sapiens
tacacagatttaaaagcaggga

SEQ ID NO: 8325711 - DNA, 22 bp, Homo sapiens
tacagagaactcatagaaagaa

SEQ ID NO: 8325712 - DNA, 22 bp, Homo sapiens
tacagagaactcatagaaagaa

SEQ ID NO: 8325713 - DNA, 22 bp, Homo sapiens
tacacttgttcaaacagcaaaa

SEQ ID NO: 8325714 - DNA, 22 bp, Homo sapiens
cagggagcctgaatgttccagg

SEQ ID NO: 8325715 - DNA, 22 bp, Homo sapiens
cagggagctttcccaggaccct

SEQ ID NO: 8325716 - DNA, 22 bp, Homo sapiens
cagggatgagagatggcacaga

SEQ ID NO: 8325717 - DNA, 22 bp, Homo sapiens
cagggatgagcagatggagcaa

SEQ ID NO: 8325718 - DNA, 22 bp, Homo sapiens
cagggatgctgcttaggcagtt

SEQ ID NO: 8325719 - DNA, 22 bp, Homo sapiens
cagggatggcctggcgggccac

SEQ ID NO: 8325720 - DNA, 22 bp, Homo sapiens
caggctgatcagggctgggatg

SEQ ID NO: 8325721 - DNA, 19 bp, Homo sapiens
tagaaagatgatgggtggg

SEQ ID NO: 8325722 - DNA, 22 bp, Homo sapiens
tagacatttgtcaagaatgact

SEQ ID NO: 8325723 - DNA, 22 bp, Homo sapiens
tagaaatgttagatgtattgag

SEQ ID NO: 8325724 - DNA, 22 bp, Homo sapiens
tagaacaatgaatttctggagg

SEQ ID NO: 8325725 - DNA, 22 bp, Homo sapiens
tagaaatgtcgtctccacattt

SEQ ID NO: 8325726 - DNA, 22 bp, Homo sapiens
tagaaatgtgataatagcttaa

SEQ ID NO: 8325727 - DNA, 22 bp, Homo sapiens
cagggagaaatctccaggaggt

SEQ ID NO: 8325728 - DNA, 22 bp, Homo sapiens
tcactgcaagctccgccttccg

SEQ ID NO: 8325729 - DNA, 22 bp, Homo sapiens
tcactgcaacctctgccttccg

SEQ ID NO: 8325730 - DNA, 22 bp, Homo sapiens
tcactgcaagctctgccttccg

SEQ ID NO: 8325731 - DNA, 22 bp, Homo sapiens
tcactgcaagctcctcctcctg

SEQ ID NO: 8325732 - DNA, 22 bp, Homo sapiens
tcactgcaaggaggcttctcaa

SEQ ID NO: 8325733 - DNA, 18 bp, Homo sapiens
tcacattataatgtaaca

SEQ ID NO: 8325734 - DNA, 22 bp, Homo sapiens
tcacatgtcagtcttaaacaga

SEQ ID NO: 8325735 - DNA, 22 bp, Homo sapiens
tcacatgtcaaaaactacataa

SEQ ID NO: 8325736 - DNA, 22 bp, Homo sapiens
tcacatgtcaagaagataattt

SEQ ID NO: 8325737 - DNA, 22 bp, Homo sapiens
tcactgcaatctctgccttcca

SEQ ID NO: 8325738 - DNA, 22 bp, Homo sapiens
tcacactgtgaagagacaagca

SEQ ID NO: 8325739 - DNA, 22 bp, Homo sapiens
cagtcccatgagcccagaacat

SEQ ID NO: 8325740 - DNA, 22 bp, Homo sapiens
cagtcccatctcccaggtggct

SEQ ID NO: 8325741 - DNA, 22 bp, Homo sapiens
cagtcccagggttggttcagct

SEQ ID NO: 8325742 - DNA, 22 bp, Homo sapiens
cagtcccagtttgagactctgg

SEQ ID NO: 8325743 - DNA, 22 bp, Homo sapiens
cagtcccagctgctcagaaggc

SEQ ID NO: 8325744 - DNA, 15 bp, Homo sapiens
cagtcccagggaccc

SEQ ID NO: 8325745 - DNA, 22 bp, Homo sapiens
tcaaattagtggaataataatg

SEQ ID NO: 8325746 - DNA, 22 bp, Homo sapiens
tcaaattagtggaataataatg

SEQ ID NO: 8325747 - DNA, 22 bp, Homo sapiens
tcaaattttaacatgcattaga

SEQ ID NO: 8325748 - DNA, 22 bp, Homo sapiens
tcaacaaatacttaaagcagag

SEQ ID NO: 8325749 - DNA, 22 bp, Homo sapiens
tcaaattgtcatcttgataatg

SEQ ID NO: 8325750 - DNA, 22 bp, Homo sapiens
tcaaattctattctatactcag

SEQ ID NO: 8325751 - DNA, 22 bp, Homo sapiens
tcaaatgccagtggtgtggatc

SEQ ID NO: 8325752 - DNA, 22 bp, Homo sapiens
cagtagaattattataaaacat

SEQ ID NO: 8325753 - DNA, 22 bp, Homo sapiens
tattcccacagttgtctaccta

SEQ ID NO: 8325754 - DNA, 22 bp, Homo sapiens
tcaaagcaatttcaccagtgcc

SEQ ID NO: 8325755 - DNA, 20 bp, Homo sapiens
tcaaaggcaaaggtgggtgt

SEQ ID NO: 8325756 - DNA, 22 bp, Homo sapiens
tagtgtctcttcctgtttgaaa

SEQ ID NO: 8325757 - DNA, 22 bp, Homo sapiens
tagtgattttcatattacatta

SEQ ID NO: 8325758 - DNA, 22 bp, Homo sapiens
tagtgattgctgatattccatt

SEQ ID NO: 8325759 - DNA, 22 bp, Homo sapiens
cagggctgaggacacaagtaaa

SEQ ID NO: 8325760 - DNA, 22 bp, Homo sapiens
cagggctgagaatttagagaca

SEQ ID NO: 8325761 - DNA, 22 bp, Homo sapiens
tagtacagaaaacctcagggtc

SEQ ID NO: 8325762 - DNA, 22 bp, Homo sapiens
tagtaacacactggtatttgga

SEQ ID NO: 8325763 - DNA, 22 bp, Homo sapiens
tagtaacagcagcttccctgtg

SEQ ID NO: 8325764 - DNA, 22 bp, Homo sapiens
tagtaatcagaggtaaacttta

SEQ ID NO: 8325765 - DNA, 22 bp, Homo sapiens
tagtaagtagctaatatttact

SEQ ID NO: 8325766 - DNA, 22 bp, Homo sapiens
tagtaagttctcgcattgttat

SEQ ID NO: 8325767 - DNA, 22 bp, Homo sapiens
taggtatacagagatttctggg

SEQ ID NO: 8325768 - DNA, 22 bp, Homo sapiens
tagtaacaacaactagcatttt

SEQ ID NO: 8325769 - DNA, 22 bp, Homo sapiens
tagttttagtcccattttacag

SEQ ID NO: 8325770 - DNA, 22 bp, Homo sapiens
tagttttagcagcaatgggatg

SEQ ID NO: 8325771 - DNA, 22 bp, Homo sapiens
tatataattttctgccatatcc

SEQ ID NO: 8325772 - DNA, 22 bp, Homo sapiens
tagttttacatcagccattgtt

SEQ ID NO: 8325773 - DNA, 22 bp, Homo sapiens
tagttttacttgcgatgataat

SEQ ID NO: 8325774 - DNA, 22 bp, Homo sapiens
tagttttacttgcgatgataat

SEQ ID NO: 8325775 - DNA, 22 bp, Homo sapiens
tagtttctagacagtaagaatt

SEQ ID NO: 8325776 - DNA, 22 bp, Homo sapiens
tagtgtctgttgcttttgttca

SEQ ID NO: 8325777 - DNA, 22 bp, Homo sapiens
tagtgtctgttgcttttgttca

SEQ ID NO: 8325778 - DNA, 22 bp, Homo sapiens
tagtgtctgaatgcacctgttt

SEQ ID NO: 8325779 - DNA, 22 bp, Homo sapiens
tagtgtctcttcctgtttgaaa

SEQ ID NO: 8325780 - DNA, 22 bp, Homo sapiens
tagtgtctgatccgtagttaca

SEQ ID NO: 8325781 - DNA, 22 bp, Homo sapiens
tatgcaacagcattattacaat

SEQ ID NO: 8325782 - DNA, 22 bp, Homo sapiens
tatgcaacatctggtagaaatc

SEQ ID NO: 8325783 - DNA, 22 bp, Homo sapiens
tatgcaaatgactggtatgttt

SEQ ID NO: 8325784 - DNA, 22 bp, Homo sapiens
tatgcaaatcattagatttcct

SEQ ID NO: 8325785 - DNA, 22 bp, Homo sapiens
tatgcaaactaagttgtttcct

SEQ ID NO: 8325786 - DNA, 22 bp, Homo sapiens
caggtgggctgcctctccagct

SEQ ID NO: 8325787 - DNA, 22 bp, Homo sapiens
ttgtattaattgaaatgaatgc

SEQ ID NO: 8325788 - DNA, 22 bp, Homo sapiens
ttgtatttatattgaatagctt

SEQ ID NO: 8325789 - DNA, 22 bp, Homo sapiens
ttgtatacaggtcttgtccatt

SEQ ID NO: 8325790 - DNA, 22 bp, Homo sapiens
ttgtatacattatcctgtttca

SEQ ID NO: 8325791 - DNA, 22 bp, Homo sapiens
ttgtataagaagttggcagata

SEQ ID NO: 8325792 - DNA, 22 bp, Homo sapiens
ttgtatatattcttaaagatgt

SEQ ID NO: 8325793 - DNA, 22 bp, Homo sapiens
ttgtatcagtgcctataaaatg

SEQ ID NO: 8325794 - DNA, 22 bp, Homo sapiens
ttgtactttggggaaatgttga

SEQ ID NO: 8325795 - DNA, 22 bp, Homo sapiens
ttgtagaacatgcagcacaatg

SEQ ID NO: 8325796 - DNA, 18 bp, Homo sapiens
ttggggtgaggccaggaa

SEQ ID NO: 8325797 - DNA, 18 bp, Homo sapiens
ttggggtgaggccaggaa

SEQ ID NO: 8325798 - DNA, 19 bp, Homo sapiens
ttggggtgaatgccagaca

SEQ ID NO: 8325799 - DNA, 22 bp, Homo sapiens
ttgtgcttaagcaagctttctt

SEQ ID NO: 8325800 - DNA, 22 bp, Homo sapiens
ttgtgctttggaacagaatcct

SEQ ID NO: 8325801 - DNA, 22 bp, Homo sapiens
ttgtgctctgtgttatttaagg

SEQ ID NO: 8325802 - DNA, 22 bp, Homo sapiens
ttgtgagagccaaacatgtaag

SEQ ID NO: 8325803 - DNA, 21 bp, Homo sapiens
ttgggccttttctggtagctt

SEQ ID NO: 8325804 - DNA, 22 bp, Homo sapiens
ttgggctgaagtagagggcaga

SEQ ID NO: 8325805 - DNA, 22 bp, Homo sapiens
ttggggagttaatgccaaagat

SEQ ID NO: 8325806 - DNA, 22 bp, Homo sapiens
ttggctgttttatctcctggtg

SEQ ID NO: 8325807 - DNA, 18 bp, Homo sapiens
ttggcttctttccttcct

SEQ ID NO: 8325808 - DNA, 22 bp, Homo sapiens
ttggcttttatgcagcttaggt

SEQ ID NO: 8325809 - DNA, 22 bp, Homo sapiens
ttggccttgtctggtcttctcc

SEQ ID NO: 8325810 - DNA, 22 bp, Homo sapiens
ttggcccagggtcagcggcgct

SEQ ID NO: 8325811 - DNA, 22 bp, Homo sapiens
ttggcccagactcggggactga

SEQ ID NO: 8325812 - DNA, 22 bp, Homo sapiens
ttggcccagcatgcgggtctgt

SEQ ID NO: 8325813 - DNA, 19 bp, Homo sapiens
ttggccttgtttcatatct

SEQ ID NO: 8325814 - DNA, 22 bp, Homo sapiens
ttggcctttgctgggctgttga

SEQ ID NO: 8325815 - DNA, 22 bp, Homo sapiens
ttggctgtatgtacatctgtta

SEQ ID NO: 8325816 - DNA, 22 bp, Homo sapiens
ttggctgtcactgtcagttcag

SEQ ID NO: 8325817 - DNA, 22 bp, Homo sapiens
ttggctgtgaaagcttctcaaa

SEQ ID NO: 8325818 - DNA, 22 bp, Homo sapiens
ttggctgctttactctgacggg

SEQ ID NO: 8325819 - DNA, 22 bp, Homo sapiens
ttggctcctgttcctctgtctg

SEQ ID NO: 8325820 - DNA, 22 bp, Homo sapiens
ttggctcccactaactccagca

SEQ ID NO: 8325821 - DNA, 22 bp, Homo sapiens
ttgcttcctggatgtgactttg

SEQ ID NO: 8325822 - DNA, 22 bp, Homo sapiens
ttgctttacaaaaattgatggt

SEQ ID NO: 8325823 - DNA, 22 bp, Homo sapiens
ttggaacatgccggggtccagg

SEQ ID NO: 8325824 - DNA, 22 bp, Homo sapiens
ttggaacatgccggggtccagg

SEQ ID NO: 8325825 - DNA, 22 bp, Homo sapiens
ttgctttattcacatctatatt

SEQ ID NO: 8325826 - DNA, 22 bp, Homo sapiens
ttgctttatgtgtatgacttga

SEQ ID NO: 8325827 - DNA, 22 bp, Homo sapiens
ttggaagttgatttaaaaagga

SEQ ID NO: 8325828 - DNA, 22 bp, Homo sapiens
ttggcacacagtaagccctaag

SEQ ID NO: 8325829 - DNA, 22 bp, Homo sapiens
ttgccagggaacagggagaggc

SEQ ID NO: 8325830 - DNA, 22 bp, Homo sapiens
ttgcatttgtttgagtagaatg

SEQ ID NO: 8325831 - DNA, 22 bp, Homo sapiens
ttgcattttggttgtaaatatg

SEQ ID NO: 8325832 - DNA, 22 bp, Homo sapiens
ttgcatttcccattgagtaatg

SEQ ID NO: 8325833 - DNA, 22 bp, Homo sapiens
ttgaggtattgataaaacattt

SEQ ID NO: 8325834 - DNA, 22 bp, Homo sapiens
ttgaggtatattcacatatatc

SEQ ID NO: 8325835 - DNA, 22 bp, Homo sapiens
ttgaggtatctgtctttaattg

SEQ ID NO: 8325836 - DNA, 22 bp, Homo sapiens
ttgaggtattgatattttatga

SEQ ID NO: 8325837 - DNA, 22 bp, Homo sapiens
ttgcccagagctgcctgttaca

SEQ ID NO: 8325838 - DNA, 22 bp, Homo sapiens
ttgcccagagtcacccagctca

SEQ ID NO: 8325839 - DNA, 22 bp, Homo sapiens
ttgcttcagtagctctttaaag

SEQ ID NO: 8325840 - DNA, 22 bp, Homo sapiens
ttgcttcatatttgtggcttgc

SEQ ID NO: 8325841 - DNA, 22 bp, Homo sapiens
ttgctaaaaatggaattatagg

SEQ ID NO: 8325842 - DNA, 22 bp, Homo sapiens
ttgctaccattgataccagcac

SEQ ID NO: 8325843 - DNA, 22 bp, Homo sapiens
ttgctaatgccctagaagtatt

SEQ ID NO: 8325844 - DNA, 22 bp, Homo sapiens
tttatctttaggactttgcaga

SEQ ID NO: 8325845 - DNA, 22 bp, Homo sapiens
tttatctgtatatctcaagtgt

SEQ ID NO: 8325846 - DNA, 22 bp, Homo sapiens
tttaggaagatctgaaggaaga

SEQ ID NO: 8325847 - DNA, 22 bp, Homo sapiens
tttatgtacatatccacaagga

SEQ ID NO: 8325848 - DNA, 22 bp, Homo sapiens
tttatgagcctcaaatctgagt

SEQ ID NO: 8325849 - DNA, 22 bp, Homo sapiens
tttatgagcaccttggcccaga

SEQ ID NO: 8325850 - DNA, 22 bp, Homo sapiens
tttatctttggatcttcagaaa

SEQ ID NO: 8325851 - DNA, 21 bp, Homo sapiens
tttatgtacttcatagagtag

SEQ ID NO: 8325852 - DNA, 22 bp, Homo sapiens
tttattggatggatggatggat

SEQ ID NO: 8325853 - DNA, 22 bp, Homo sapiens
tttattggatatttacaagata

SEQ ID NO: 8325854 - DNA, 20 bp, Homo sapiens
tttattggcctttcaggaac

SEQ ID NO: 8325855 - DNA, 22 bp, Homo sapiens
tttattggatgggtcagctcta

SEQ ID NO: 8325856 - DNA, 22 bp, Homo sapiens
tttattggaacacagccatgac

SEQ ID NO: 8325857 - DNA, 22 bp, Homo sapiens
tttattgggcctggaggatcta

SEQ ID NO: 8325858 - DNA, 22 bp, Homo sapiens
tttattgggtgcagtgcccaca

SEQ ID NO: 8325859 - DNA, 22 bp, Homo sapiens
tttaacatgttcaagaaacata

SEQ ID NO: 8325860 - DNA, 22 bp, Homo sapiens
tttaaattatagttaatgtctg

SEQ ID NO: 8325861 - DNA, 23 bp, Homo sapiens
tttaactttccaataattcattg

SEQ ID NO: 8325862 - DNA, 22 bp, Homo sapiens
tttaagaagttatgttataaat

SEQ ID NO: 8325863 - DNA, 22 bp, Homo sapiens
tttaacttagaagagatatcct

SEQ ID NO: 8325864 - DNA, 22 bp, Homo sapiens
tttaacttgatcagtagagcat

SEQ ID NO: 8325865 - DNA, 23 bp, Homo sapiens
tttaacatttgaacatgtggcca

SEQ ID NO: 8325866 - DNA, 22 bp, Homo sapiens
ttgttgtcattgtagaggattt

SEQ ID NO: 8325867 - DNA, 22 bp, Homo sapiens
ttgtttaaaagaaatcatagaa

SEQ ID NO: 8325868 - DNA, 22 bp, Homo sapiens
tttacacttgaggaaactgagg

SEQ ID NO: 8325869 - DNA, 22 bp, Homo sapiens
tttacagaagagaaggatgctt

SEQ ID NO: 8325870 - DNA, 22 bp, Homo sapiens
tttacacttgaggaaactgagg

SEQ ID NO: 8325871 - DNA, 22 bp, Homo sapiens
tttacagatgtggaaagtgagc

SEQ ID NO: 8325872 - DNA, 22 bp, Homo sapiens
tttacagatgtggaaagtgagc

SEQ ID NO: 8325873 - DNA, 22 bp, Homo sapiens
tttacagctagacatacctgag

SEQ ID NO: 8325874 - DNA, 22 bp, Homo sapiens
tttacagatgaggatactgagg

SEQ ID NO: 8325875 - DNA, 22 bp, Homo sapiens
tttacactcctggaaatgatat

SEQ ID NO: 8325876 - DNA, 22 bp, Homo sapiens
tttacactgcttgaacaatctc

SEQ ID NO: 8325877 - DNA, 22 bp, Homo sapiens
tttacaagtttacagaatgatg

SEQ ID NO: 8325878 - DNA, 20 bp, Homo sapiens
tttaagaagtttctgaggaa

SEQ ID NO: 8325879 - DNA, 22 bp, Homo sapiens
tttcaagtaagatacatttcag

SEQ ID NO: 8325880 - DNA, 22 bp, Homo sapiens
tttcaagtcattctataatatc

SEQ ID NO: 8325881 - DNA, 22 bp, Homo sapiens
tttcaagtcagtagctaatcat

SEQ ID NO: 8325882 - DNA, 22 bp, Homo sapiens
tttcaagtcattctataatatc

SEQ ID NO: 8325883 - DNA, 20 bp, Homo sapiens
tttcaagtcggtagagtcta

SEQ ID NO: 8325884 - DNA, 22 bp, Homo sapiens
tttcaagtactgtaaacatgct

SEQ ID NO: 8325885 - DNA, 22 bp, Homo sapiens
tttatttatccttctggattgc

SEQ ID NO: 8325886 - DNA, 23 bp, Homo sapiens
tttatttatttaggctgagggat

SEQ ID NO: 8325887 - DNA, 22 bp, Homo sapiens
tttatttataagccacttgctg

SEQ ID NO: 8325888 - DNA, 21 bp, Homo sapiens
tttatttatataggacacatg

SEQ ID NO: 8325889 - DNA, 20 bp, Homo sapiens
tttcaagttgtaaggtatca

SEQ ID NO: 8325890 - DNA, 20 bp, Homo sapiens
tttcaagttgtaaggtatca

SEQ ID NO: 8325891 - DNA, 22 bp, Homo sapiens
tttcaagttgtttatatccaga

SEQ ID NO: 8325892 - DNA, 22 bp, Homo sapiens
tttcaagttgttgcattaaatg

SEQ ID NO: 8325893 - DNA, 22 bp, Homo sapiens
tttcaagttctgttcctaaact

SEQ ID NO: 8325894 - DNA, 22 bp, Homo sapiens
tttcaagttctgttctagggta

SEQ ID NO: 8325895 - DNA, 22 bp, Homo sapiens
tttcaagtggggacatttgaga

SEQ ID NO: 8325896 - DNA, 19 bp, Homo sapiens
tttcaatggcttagagaaa

SEQ ID NO: 8325897 - DNA, 19 bp, Homo sapiens
tttcaatggcttagagaaa

SEQ ID NO: 8325898 - DNA, 22 bp, Homo sapiens
tttcaatgacacaaaagagaaa

SEQ ID NO: 8325899 - DNA, 22 bp, Homo sapiens
tttcacaactgcttatttgaga

SEQ ID NO: 8325900 - DNA, 22 bp, Homo sapiens
tttcacatggtactgcctgttt

SEQ ID NO: 8325901 - DNA, 22 bp, Homo sapiens
tttcacatgtatataggcatta

SEQ ID NO: 8325902 - DNA, 22 bp, Homo sapiens
tttcacatggactttttgttct

SEQ ID NO: 8325903 - DNA, 20 bp, Homo sapiens
tttcacatctgtccctttaa

SEQ ID NO: 8325904 - DNA, 22 bp, Homo sapiens
tttcacatcagaggtagattag

SEQ ID NO: 8325905 - DNA, 22 bp, Homo sapiens
tttcacatatggttgttgattg

SEQ ID NO: 8325906 - DNA, 22 bp, Homo sapiens
tttcacaggggcaacctccatg

SEQ ID NO: 8325907 - DNA, 22 bp, Homo sapiens
tttcacaggagttgtaccattt

SEQ ID NO: 8325908 - DNA, 22 bp, Homo sapiens
tttcacatttgttttaagaagt

SEQ ID NO: 8325909 - DNA, 22 bp, Homo sapiens
tttcataaacagtagaagacta

SEQ ID NO: 8325910 - DNA, 22 bp, Homo sapiens
tttcataaacagtagaagacta

SEQ ID NO: 8325911 - DNA, 23 bp, Homo sapiens
tttcacattaatgtttagcagga

SEQ ID NO: 8325912 - DNA, 22 bp, Homo sapiens
tttcacattcagatatagactt

SEQ ID NO: 8325913 - DNA, 22 bp, Homo sapiens
tttcacattagatatgtcattt

SEQ ID NO: 8325914 - DNA, 23 bp, Homo sapiens
tttcacatttactgttagatggc

SEQ ID NO: 8325915 - DNA, 22 bp, Homo sapiens
tttcacattggcttctatttct

SEQ ID NO: 8325916 - DNA, 22 bp, Homo sapiens
tttcacattctctggttatcga

SEQ ID NO: 8325917 - DNA, 22 bp, Homo sapiens
tttcacattcttctgaatctac

SEQ ID NO: 8325918 - DNA, 23 bp, Homo sapiens
tttcccaccctctctcattgctg

SEQ ID NO: 8325919 - DNA, 22 bp, Homo sapiens
tttcctttgggagcatgaattt

SEQ ID NO: 8325920 - DNA, 22 bp, Homo sapiens
tttcctttgcccaatacatgtc

SEQ ID NO: 8325921 - DNA, 22 bp, Homo sapiens
tttctaagaatattgctcttaa

SEQ ID NO: 8325922 - DNA, 22 bp, Homo sapiens
tttctaagaaagtaatggttat

SEQ ID NO: 8325923 - DNA, 22 bp, Homo sapiens
tttctaagaaagtaatggttat

SEQ ID NO: 8325924 - DNA, 19 bp, Homo sapiens
tttctaagctaaatgcttc

SEQ ID NO: 8325925 - DNA, 19 bp, Homo sapiens
tttctaagctaaatgcttc

SEQ ID NO: 8325926 - DNA, 22 bp, Homo sapiens
tttctaagatgtggtttcaagg

SEQ ID NO: 8325927 - DNA, 22 bp, Homo sapiens
tttctaaggtgaggtagaaaat

SEQ ID NO: 8325928 - DNA, 22 bp, Homo sapiens
tttctaaggctaggtcttaagg

SEQ ID NO: 8325929 - DNA, 22 bp, Homo sapiens
tttctaaggctaggtcttaagg

SEQ ID NO: 8325930 - DNA, 21 bp, Homo sapiens
tttctaaggaggaagaaaaga

SEQ ID NO: 8325931 - DNA, 21 bp, Homo sapiens
tttctaaggaggaagaaaaga

SEQ ID NO: 8325932 - DNA, 22 bp, Homo sapiens
tttctaaactggattcagcctg

SEQ ID NO: 8325933 - DNA, 22 bp, Homo sapiens
tttccttttggctaggtgtgaa

SEQ ID NO: 8325934 - DNA, 22 bp, Homo sapiens
tttccttttataaggcttgagg

SEQ ID NO: 8325935 - DNA, 22 bp, Homo sapiens
tttcctttgtgcaggccttggg

SEQ ID NO: 8325936 - DNA, 22 bp, Homo sapiens
tttcatattgtccagtcagcgc

SEQ ID NO: 8325937 - DNA, 22 bp, Homo sapiens
tttcatctctctaaaagacagt

SEQ ID NO: 8325938 - DNA, 22 bp, Homo sapiens
tttcatctctctaaaagacagt

SEQ ID NO: 8325939 - DNA, 22 bp, Homo sapiens
tttcatctctctaaaagacagt

SEQ ID NO: 8325940 - DNA, 22 bp, Homo sapiens
tttcataatactgtacatgaaa

SEQ ID NO: 8325941 - DNA, 22 bp, Homo sapiens
tttcataatgtcacagtcaaaa

SEQ ID NO: 8325942 - DNA, 22 bp, Homo sapiens
tttccaaataaggtcacattct

SEQ ID NO: 8325943 - DNA, 22 bp, Homo sapiens
ttcaaaattgttctaagctctg

SEQ ID NO: 8325944 - DNA, 22 bp, Homo sapiens
ttattttgagagaatgtgtgct

SEQ ID NO: 8325945 - DNA, 22 bp, Homo sapiens
ttattttaccttcctctgagct

SEQ ID NO: 8325946 - DNA, 22 bp, Homo sapiens
ttcaaaatccgggaggcgcccc

SEQ ID NO: 8325947 - DNA, 22 bp, Homo sapiens
ttcaaaagtaatcagtattaga

SEQ ID NO: 8325948 - DNA, 21 bp, Homo sapiens
ttcaaaatggtgtgtttgtct

SEQ ID NO: 8325949 - DNA, 22 bp, Homo sapiens
ttcaaaatgcacaaagggctag

SEQ ID NO: 8325950 - DNA, 22 bp, Homo sapiens
ttcaaaatgcacaaagggctag

SEQ ID NO: 8325951 - DNA, 22 bp, Homo sapiens
ttatttaatgtgatctgaagag

SEQ ID NO: 8325952 - DNA, 22 bp, Homo sapiens
ttatttaattttctcactcaga

SEQ ID NO: 8325953 - DNA, 22 bp, Homo sapiens
ttatttaggaggaaactgaggt

SEQ ID NO: 8325954 - DNA, 22 bp, Homo sapiens
ttatttagtctagatgaatttt

SEQ ID NO: 8325955 - DNA, 22 bp, Homo sapiens
ttatttaggagaaggaaccctg

SEQ ID NO: 8325956 - DNA, 22 bp, Homo sapiens
ttatttatatctctgcagttta

SEQ ID NO: 8325957 - DNA, 22 bp, Homo sapiens
ttatttatatctctgcagttta

SEQ ID NO: 8325958 - DNA, 22 bp, Homo sapiens
ttattgtttactagtttgcaga

SEQ ID NO: 8325959 - DNA, 22 bp, Homo sapiens
ttattaaaatgcggatttggct

SEQ ID NO: 8325960 - DNA, 22 bp, Homo sapiens
ttattgtttgggtataatttga

SEQ ID NO: 8325961 - DNA, 22 bp, Homo sapiens
tcctcctgtttctcaggcctgg

SEQ ID NO: 8325962 - DNA, 19 bp, Homo sapiens
tcctccttacttcctcttg

SEQ ID NO: 8325963 - DNA, 21 bp, Homo sapiens
tcctcctggccaggcggcccc

SEQ ID NO: 8325964 - DNA, 21 bp, Homo sapiens
tcctcctgtagagggtcctgg

SEQ ID NO: 8325965 - DNA, 22 bp, Homo sapiens
tcctctggctctttccctagga

SEQ ID NO: 8325966 - DNA, 21 bp, Homo sapiens
tcctctgctctcataccacaa

SEQ ID NO: 8325967 - DNA, 22 bp, Homo sapiens
ttatggaaaatacaattataag

SEQ ID NO: 8325968 - DNA, 22 bp, Homo sapiens
ttatacaggagattccttactt

SEQ ID NO: 8325969 - DNA, 22 bp, Homo sapiens
ttatacagggagtttccctgca

SEQ ID NO: 8325970 - DNA, 22 bp, Homo sapiens
ttatacagtttatacttagaat

SEQ ID NO: 8325971 - DNA, 23 bp, Homo sapiens
ttataagaagcatcacaggaaga

SEQ ID NO: 8325972 - DNA, 22 bp, Homo sapiens
ttccaatgactagtggcatcct

SEQ ID NO: 8325973 - DNA, 22 bp, Homo sapiens
ttccaagtgcccatatttcatc

SEQ ID NO: 8325974 - DNA, 21 bp, Homo sapiens
ttcatcagccagaaatcaagc

SEQ ID NO: 8325975 - DNA, 22 bp, Homo sapiens
ttccaactttaaaattcattct

SEQ ID NO: 8325976 - DNA, 20 bp, Homo sapiens
ttccaactcacatctctaca

SEQ ID NO: 8325977 - DNA, 22 bp, Homo sapiens
ttccaactttgaaaatgttatg

SEQ ID NO: 8325978 - DNA, 22 bp, Homo sapiens
ttccaactttgtcatatattat

SEQ ID NO: 8325979 - DNA, 22 bp, Homo sapiens
ttcccctgtcacagtggttctc

SEQ ID NO: 8325980 - DNA, 22 bp, Homo sapiens
ttcatacatttttactaacagc

SEQ ID NO: 8325981 - DNA, 22 bp, Homo sapiens
ttcatactcactccaataactg

SEQ ID NO: 8325982 - DNA, 22 bp, Homo sapiens
ttcaatatgatattagctgtgg

SEQ ID NO: 8325983 - DNA, 22 bp, Homo sapiens
ttcaatcattagaatctcaggc

SEQ ID NO: 8325984 - DNA, 22 bp, Homo sapiens
ttcaatatctctaagaatgagg

SEQ ID NO: 8325985 - DNA, 22 bp, Homo sapiens
ttctaaagtgcaatctgacaga

SEQ ID NO: 8325986 - DNA, 22 bp, Homo sapiens
ttcgttttctaggaccaacaga

SEQ ID NO: 8325987 - DNA, 22 bp, Homo sapiens
ttctaaaaccaattctgcttct

SEQ ID NO: 8325988 - DNA, 22 bp, Homo sapiens
ttctaaagactcatggaagtgg

SEQ ID NO: 8325989 - DNA, 22 bp, Homo sapiens
ttctaaaataagtttatctggt

SEQ ID NO: 8325990 - DNA, 22 bp, Homo sapiens
ttctaaaataagtttatctggt

SEQ ID NO: 8325991 - DNA, 22 bp, Homo sapiens
ttctaaaataagtttatctggt

SEQ ID NO: 8325992 - DNA, 22 bp, Homo sapiens
ttccctctgcgcattgaatttc

SEQ ID NO: 8325993 - DNA, 22 bp, Homo sapiens
ttccctctttcactgtgatttt

SEQ ID NO: 8325994 - DNA, 22 bp, Homo sapiens
ttctatcatttagttgtcttct

SEQ ID NO: 8325995 - DNA, 22 bp, Homo sapiens
ttctcaactctcaagagaagct

SEQ ID NO: 8325996 - DNA, 21 bp, Homo sapiens
ttctccaggcaaccatttcag

SEQ ID NO: 8325997 - DNA, 22 bp, Homo sapiens
ttctccagtttctcccttcagt

SEQ ID NO: 8325998 - DNA, 22 bp, Homo sapiens
ttctgccctttggtaggtaaag

SEQ ID NO: 8325999 - DNA, 20 bp, Homo sapiens
ttctggaggctacaagtctg

SEQ ID NO: 8326000 - DNA, 22 bp, Homo sapiens
ttctgccctgccagtgggctca

SEQ ID NO: 8326001 - DNA, 19 bp, Homo sapiens
ttctgccctctcttctagc

SEQ ID NO: 8326002 - DNA, 22 bp, Homo sapiens
ttctgcccaccacactttatct

SEQ ID NO: 8326003 - DNA, 23 bp, Homo sapiens
ttctgccctccatagatgttccc

SEQ ID NO: 8326004 - DNA, 23 bp, Homo sapiens
ttctgcccatgtgggatggtttg

SEQ ID NO: 8326005 - DNA, 22 bp, Homo sapiens
ttctgcccttgccagacaagta

SEQ ID NO: 8326006 - DNA, 20 bp, Homo sapiens
ttctctttgggtccagagaa

SEQ ID NO: 8326007 - DNA, 22 bp, Homo sapiens
ttctgagctgcaacactaacat

SEQ ID NO: 8326008 - DNA, 22 bp, Homo sapiens
ttctgaggcactggctctccca

SEQ ID NO: 8326009 - DNA, 22 bp, Homo sapiens
ttctttgggctcagagagggag

SEQ ID NO: 8326010 - DNA, 22 bp, Homo sapiens
ttctttggggaatattctggtt

SEQ ID NO: 8326011 - DNA, 22 bp, Homo sapiens
ttctttggtgggagattgaggt

SEQ ID NO: 8326012 - DNA, 22 bp, Homo sapiens
ttctttggggtctccagcatag

SEQ ID NO: 8326013 - DNA, 22 bp, Homo sapiens
ttctttgggattgtagctgtct

SEQ ID NO: 8326014 - DNA, 22 bp, Homo sapiens
ttctttgggcaattgctggccc

SEQ ID NO: 8326015 - DNA, 22 bp, Homo sapiens
ttctttggcttacgtctggcct

SEQ ID NO: 8326016 - DNA, 22 bp, Homo sapiens
ttctttggctgccagtctggag

SEQ ID NO: 8326017 - DNA, 23 bp, Homo sapiens
ttctttggaattgggctgcaagg

SEQ ID NO: 8326018 - DNA, 22 bp, Homo sapiens
ttctttggcatttcctgtatgt

SEQ ID NO: 8326019 - DNA, 22 bp, Homo sapiens
ttctttggcatttcctgtatgt

SEQ ID NO: 8326020 - DNA, 22 bp, Homo sapiens
ttctttggaataagtcaagctg

SEQ ID NO: 8326021 - DNA, 22 bp, Homo sapiens
ttcttcagagagtagaagcaag

SEQ ID NO: 8326022 - DNA, 22 bp, Homo sapiens
ttgaggtaaagctactagttag

SEQ ID NO: 8326023 - DNA, 22 bp, Homo sapiens
ttgaggtacaatgggtcagtta

SEQ ID NO: 8326024 - DNA, 22 bp, Homo sapiens
ttgagggtctggatctgctgct

SEQ ID NO: 8326025 - DNA, 22 bp, Homo sapiens
ttgaggtaataaacagccattc

SEQ ID NO: 8326026 - DNA, 22 bp, Homo sapiens
ttgaggtacaaacatgaggttt

SEQ ID NO: 8326027 - DNA, 22 bp, Homo sapiens
ttgaggtagtacttattattgg

SEQ ID NO: 8326028 - DNA, 22 bp, Homo sapiens
ttgaggtagtggcctccaaatg

SEQ ID NO: 8326029 - DNA, 22 bp, Homo sapiens
ttgaggtaggcggactcctcca

SEQ ID NO: 8326030 - DNA, 22 bp, Homo sapiens
ttgaggtagagaaaggaaatga

SEQ ID NO: 8326031 - DNA, 22 bp, Homo sapiens
ttgaggtaggcattgttcaaaa

SEQ ID NO: 8326032 - DNA, 22 bp, Homo sapiens
ttgaggtatagttgacaattta

SEQ ID NO: 8326033 - DNA, 22 bp, Homo sapiens
ttgaggtagttctattgtgagt

SEQ ID NO: 8326034 - DNA, 22 bp, Homo sapiens
ttgagaggctgttgacattctg

SEQ ID NO: 8326035 - DNA, 22 bp, Homo sapiens
ttgaggcccggcaggccgagcg

SEQ ID NO: 8326036 - DNA, 22 bp, Homo sapiens
ttgagggaacatgagaatcatc

SEQ ID NO: 8326037 - DNA, 22 bp, Homo sapiens
ttgaggctgcacagtacaggct

SEQ ID NO: 8326038 - DNA, 22 bp, Homo sapiens
ttgagaaatgttttttaagctg

SEQ ID NO: 8326039 - DNA, 19 bp, Homo sapiens
ttgagaaatgggaaaagca

SEQ ID NO: 8326040 - DNA, 22 bp, Homo sapiens
ttgagaaatgttttttaagctg

SEQ ID NO: 8326041 - DNA, 16 bp, Homo sapiens
ttgagaaatgaagttt

SEQ ID NO: 8326042 - DNA, 22 bp, Homo sapiens
ttgagaaataagcatgtctaga

SEQ ID NO: 8326043 - DNA, 18 bp, Homo sapiens
ttgagaaataagcactaa

SEQ ID NO: 8326044 - DNA, 18 bp, Homo sapiens
ttgagaaataagcactaa

SEQ ID NO: 8326045 - DNA, 22 bp, Homo sapiens
ttgagacagtatctttgttggc

SEQ ID NO: 8326046 - DNA, 22 bp, Homo sapiens
ttgagacaccaaactttcctaa

SEQ ID NO: 8326047 - DNA, 22 bp, Homo sapiens
ttgagacacagtttcactctgt

SEQ ID NO: 8326048 - DNA, 22 bp, Homo sapiens
ttgagacacagtttcactctgt

SEQ ID NO: 8326049 - DNA, 22 bp, Homo sapiens
ttgaaaaaattggtagaggatg

SEQ ID NO: 8326050 - DNA, 23 bp, Homo sapiens
ttgaaaaatatagtcccattgtc

SEQ ID NO: 8326051 - DNA, 22 bp, Homo sapiens
ttgagaaacctggcagtagaga

SEQ ID NO: 8326052 - DNA, 22 bp, Homo sapiens
ttgaccactgaatggttctgaa

SEQ ID NO: 8326053 - DNA, 22 bp, Homo sapiens
ttttttgcacactctgctaaat

SEQ ID NO: 8326054 - DNA, 22 bp, Homo sapiens
ttttttgtagcaagcgcagata

SEQ ID NO: 8326055 - DNA, 22 bp, Homo sapiens
ttttttccaggaagccactgga

SEQ ID NO: 8326056 - DNA, 22 bp, Homo sapiens
ttttttcctctgtgatggcaaa

SEQ ID NO: 8326057 - DNA, 22 bp, Homo sapiens
ttttttccagcttctagaggcc

SEQ ID NO: 8326058 - DNA, 22 bp, Homo sapiens
ttttttccagcttctagaggcc

SEQ ID NO: 8326059 - DNA, 22 bp, Homo sapiens
ttttttccttcatgacttaaga

SEQ ID NO: 8326060 - DNA, 22 bp, Homo sapiens
ttttttcctgagccttgtggtc

SEQ ID NO: 8326061 - DNA, 22 bp, Homo sapiens
ttttcaagagagtgttctatgt

SEQ ID NO: 8326062 - DNA, 22 bp, Homo sapiens
ttttcaagggcagggaaatcat

SEQ ID NO: 8326063 - DNA, 16 bp, Homo sapiens
ttttcaagagcggaga

SEQ ID NO: 8326064 - DNA, 22 bp, Homo sapiens
ttttcaattttgaggcagtggt

SEQ ID NO: 8326065 - DNA, 22 bp, Homo sapiens
ttttattgtctgtattgcctat

SEQ ID NO: 8326066 - DNA, 23 bp, Homo sapiens
ttttaatttggacataagaagat

SEQ ID NO: 8326067 - DNA, 22 bp, Homo sapiens
tttgtgtaccttgtacatttgt

SEQ ID NO: 8326068 - DNA, 22 bp, Homo sapiens
ttttaattttgcaaatctggtg

SEQ ID NO: 8326069 - DNA, 22 bp, Homo sapiens
ttttaattttagcccttctggt

SEQ ID NO: 8326070 - DNA, 22 bp, Homo sapiens
ttttacaggtgaaaaatgaaga

SEQ ID NO: 8326071 - DNA, 22 bp, Homo sapiens
tttgtggcaggagcggagaccg

SEQ ID NO: 8326072 - DNA, 22 bp, Homo sapiens
tttgtcttaaatcttgttactg

SEQ ID NO: 8326073 - DNA, 19 bp, Homo sapiens
tttgtctctgaataatatt

SEQ ID NO: 8326074 - DNA, 22 bp, Homo sapiens
ttttgtaagaaactgccaagcc

SEQ ID NO: 8326075 - DNA, 19 bp, Homo sapiens
ttttccttctatatgtttc

SEQ ID NO: 8326076 - DNA, 22 bp, Homo sapiens
ttttcctctgagctttgaataa

SEQ ID NO: 8326077 - DNA, 22 bp, Homo sapiens
ttttcctctgcaataaaagcag

SEQ ID NO: 8326078 - DNA, 22 bp, Homo sapiens
ttttcccatctacaaagcaggg

SEQ ID NO: 8326079 - DNA, 22 bp, Homo sapiens
ttttcccatctacaaagcaggg

SEQ ID NO: 8326080 - DNA, 22 bp, Homo sapiens
ttttcctatatgcaaagaatgc

SEQ ID NO: 8326081 - DNA, 22 bp, Homo sapiens
ttttcccagagctgtcctcaag

SEQ ID NO: 8326082 - DNA, 21 bp, Homo sapiens
ttttcccactgaaagctccca

SEQ ID NO: 8326083 - DNA, 19 bp, Homo sapiens
ttttcccaccctttagaat

SEQ ID NO: 8326084 - DNA, 22 bp, Homo sapiens
ttttgtcagtgagaacagagtt

SEQ ID NO: 8326085 - DNA, 22 bp, Homo sapiens
tttttgtatagaaatgaactaa

SEQ ID NO: 8326086 - DNA, 22 bp, Homo sapiens
ttttgtgttgtaatgtcagcta

SEQ ID NO: 8326087 - DNA, 22 bp, Homo sapiens
ttttttcagcctgtctgtgcca

SEQ ID NO: 8326088 - DNA, 22 bp, Homo sapiens
ttttttcagcctgtctgtgcca

SEQ ID NO: 8326089 - DNA, 22 bp, Homo sapiens
ttttttccaacttaagacttca

SEQ ID NO: 8326090 - DNA, 22 bp, Homo sapiens
ttttttatctatggtagtacca

SEQ ID NO: 8326091 - DNA, 22 bp, Homo sapiens
ttttttatctatggtagtacca

SEQ ID NO: 8326092 - DNA, 22 bp, Homo sapiens
ttttttatatcaactgaagtct

SEQ ID NO: 8326093 - DNA, 22 bp, Homo sapiens
ttttttatagcaatgaacccac

SEQ ID NO: 8326094 - DNA, 22 bp, Homo sapiens
tttttgttcccagagaatttgt

SEQ ID NO: 8326095 - DNA, 22 bp, Homo sapiens
tttttgttcccagagaatttgt

SEQ ID NO: 8326096 - DNA, 22 bp, Homo sapiens
tttttgtctagcgtctctagtt

SEQ ID NO: 8326097 - DNA, 22 bp, Homo sapiens
tttctagtctcgatctcttaat

SEQ ID NO: 8326098 - DNA, 22 bp, Homo sapiens
tttctattgatctaataaacat

SEQ ID NO: 8326099 - DNA, 22 bp, Homo sapiens
tttctattgatctaataaacat

SEQ ID NO: 8326100 - DNA, 22 bp, Homo sapiens
tttctattctggatctgtggca

SEQ ID NO: 8326101 - DNA, 22 bp, Homo sapiens
tttgacagcataatcctacacc

SEQ ID NO: 8326102 - DNA, 22 bp, Homo sapiens
tttgaagactactgggagtgaa

SEQ ID NO: 8326103 - DNA, 22 bp, Homo sapiens
tttgacagcttgttacaaagtt

SEQ ID NO: 8326104 - DNA, 22 bp, Homo sapiens
tttgacagtgctattaagaaac

SEQ ID NO: 8326105 - DNA, 22 bp, Homo sapiens
tttgacagtgctgctaaaatgc

SEQ ID NO: 8326106 - DNA, 22 bp, Homo sapiens
tttgggaaagtgtcttttgtat

SEQ ID NO: 8326107 - DNA, 22 bp, Homo sapiens
tttgggcatatagctgttccct

SEQ ID NO: 8326108 - DNA, 22 bp, Homo sapiens
tttggtaaccttgcattcttta

SEQ ID NO: 8326109 - DNA, 22 bp, Homo sapiens
tttggtaaatgcaggttcttct

SEQ ID NO: 8326110 - DNA, 22 bp, Homo sapiens
tttggctgaagaccagattaaa

SEQ ID NO: 8326111 - DNA, 22 bp, Homo sapiens
tttgcattgcctctgacttatg

SEQ ID NO: 8326112 - DNA, 22 bp, Homo sapiens
tttgcattgtaatatttagttc

SEQ ID NO: 8326113 - DNA, 22 bp, Homo sapiens
tttgcattgcatacaaggaact

SEQ ID NO: 8326114 - DNA, 22 bp, Homo sapiens
tttgcattgcattaagtattct

SEQ ID NO: 8326115 - DNA, 22 bp, Homo sapiens
tttgcatttgttcaagtattga

SEQ ID NO: 8326116 - DNA, 22 bp, Homo sapiens
tttgcatttgcaaataatgaaa

SEQ ID NO: 8326117 - DNA, 22 bp, Homo sapiens
tttgcatttccagagtagcaga

SEQ ID NO: 8326118 - DNA, 22 bp, Homo sapiens
tttgcatttctcgtaaggaaac

SEQ ID NO: 8326119 - DNA, 18 bp, Homo sapiens
tttgctgatgagcatcat

SEQ ID NO: 8326120 - DNA, 22 bp, Homo sapiens
tttgcttaactggtagaatgcg

SEQ ID NO: 8326121 - DNA, 22 bp, Homo sapiens
tttgcattacttgactttagtt

SEQ ID NO: 8326122 - DNA, 22 bp, Homo sapiens
tttgcattcctgcctgcattca

SEQ ID NO: 8326123 - DNA, 22 bp, Homo sapiens
tttgcattatctcacttatata

SEQ ID NO: 8326124 - DNA, 22 bp, Homo sapiens
tttgcattatatttatagaaga

SEQ ID NO: 8326125 - DNA, 20 bp, Homo sapiens
tttgagaccagtctgcccaa

SEQ ID NO: 8326126 - DNA, 20 bp, Homo sapiens
attcctcagccccagcctca

SEQ ID NO: 8326127 - DNA, 20 bp, Homo sapiens
attcccttctccctgtttga

SEQ ID NO: 8326128 - DNA, 22 bp, Homo sapiens
attccctttgacgatccctagg

SEQ ID NO: 8326129 - DNA, 21 bp, Homo sapiens
gcagagctggaaccaggaccc

SEQ ID NO: 8326130 - DNA, 22 bp, Homo sapiens
attattgtactttcaataaggt

SEQ ID NO: 8326131 - DNA, 22 bp, Homo sapiens
attcagagattgttattcagac

SEQ ID NO: 8326132 - DNA, 22 bp, Homo sapiens
attatttcagtcagacactggc

SEQ ID NO: 8326133 - DNA, 22 bp, Homo sapiens
attgacaagaaagatattttta

SEQ ID NO: 8326134 - DNA, 22 bp, Homo sapiens
attgaatgcttgctaacacttt

SEQ ID NO: 8326135 - DNA, 22 bp, Homo sapiens
attgaatgtctactatgtgcaa

SEQ ID NO: 8326136 - DNA, 22 bp, Homo sapiens
attgaaaaatgactattgctta

SEQ ID NO: 8326137 - DNA, 22 bp, Homo sapiens
attcttcacactaaccctgtga

SEQ ID NO: 8326138 - DNA, 22 bp, Homo sapiens
attcttaattgccatgctgtat

SEQ ID NO: 8326139 - DNA, 22 bp, Homo sapiens
attcttattatagtaaaacagt

SEQ ID NO: 8326140 - DNA, 18 bp, Homo sapiens
gcaagtgtctgtcccctt

SEQ ID NO: 8326141 - DNA, 22 bp, Homo sapiens
attagaatgacagaaatgaggc

SEQ ID NO: 8326142 - DNA, 22 bp, Homo sapiens
gcaataaaatgtaatgattggg

SEQ ID NO: 8326143 - DNA, 22 bp, Homo sapiens
attattcaatcatattaaaagt

SEQ ID NO: 8326144 - DNA, 22 bp, Homo sapiens
attacaataatacatgctcatt

SEQ ID NO: 8326145 - DNA, 22 bp, Homo sapiens
attacaaaagaagggagaaggt

SEQ ID NO: 8326146 - DNA, 22 bp, Homo sapiens
attaattttacctttgtaaaca

SEQ ID NO: 8326147 - DNA, 22 bp, Homo sapiens
attaatttccaggcactgtgct

SEQ ID NO: 8326148 - DNA, 22 bp, Homo sapiens
attaaaagagataatgtgtgtt

SEQ ID NO: 8326149 - DNA, 22 bp, Homo sapiens
atgtttttaaatagacttacag

SEQ ID NO: 8326150 - DNA, 22 bp, Homo sapiens
atgtttttgagatacaaacaga

SEQ ID NO: 8326151 - DNA, 22 bp, Homo sapiens
attaaatgttccttaaattata

SEQ ID NO: 8326152 - DNA, 22 bp, Homo sapiens
attaaaattccaaggtatgcca

SEQ ID NO: 8326153 - DNA, 22 bp, Homo sapiens
attaaaagcttcccaagagtta

SEQ ID NO: 8326154 - DNA, 22 bp, Homo sapiens
gatgagttctttctattctatt

SEQ ID NO: 8326155 - DNA, 22 bp, Homo sapiens
attaaattaagtggctaattta

SEQ ID NO: 8326156 - DNA, 22 bp, Homo sapiens
atgttttctagagtttaaaatc

SEQ ID NO: 8326157 - DNA, 22 bp, Homo sapiens
atgttaaaaaccagtacagttg

SEQ ID NO: 8326158 - DNA, 22 bp, Homo sapiens
atttctaaagagggtggtttgg

SEQ ID NO: 8326159 - DNA, 22 bp, Homo sapiens
atttctacattgagttttagca

SEQ ID NO: 8326160 - DNA, 22 bp, Homo sapiens
atttctataggaggacagtatt

SEQ ID NO: 8326161 - DNA, 21 bp, Homo sapiens
atttcatggtgcttttaagaa

SEQ ID NO: 8326162 - DNA, 22 bp, Homo sapiens
atttcatgagttattatagtgg

SEQ ID NO: 8326163 - DNA, 22 bp, Homo sapiens
atttcatctctggaacataact

SEQ ID NO: 8326164 - DNA, 21 bp, Homo sapiens
atttcagagcacacaagtaaa

SEQ ID NO: 8326165 - DNA, 22 bp, Homo sapiens
atttcagattcagaaatgtagg

SEQ ID NO: 8326166 - DNA, 22 bp, Homo sapiens
gccaggagggaaaggacaattt

SEQ ID NO: 8326167 - DNA, 22 bp, Homo sapiens
gccaggaggcttaactggacag

SEQ ID NO: 8326168 - DNA, 22 bp, Homo sapiens
atttacaccttcttcgattctc

SEQ ID NO: 8326169 - DNA, 22 bp, Homo sapiens
atttacactggttctcagagct

SEQ ID NO: 8326170 - DNA, 22 bp, Homo sapiens
atttacactggttctcagagct

SEQ ID NO: 8326171 - DNA, 22 bp, Homo sapiens
atttacacttggtttactagag

SEQ ID NO: 8326172 - DNA, 22 bp, Homo sapiens
atttacacttggtttactagag

SEQ ID NO: 8326173 - DNA, 22 bp, Homo sapiens
atttagaaattccaaaagtatt

SEQ ID NO: 8326174 - DNA, 22 bp, Homo sapiens
atttagaaattccaaaagtatt

SEQ ID NO: 8326175 - DNA, 22 bp, Homo sapiens
atttactcgtgtctccagtgct

SEQ ID NO: 8326176 - DNA, 22 bp, Homo sapiens
gccaggaggtcagcccctcaac

SEQ ID NO: 8326177 - DNA, 22 bp, Homo sapiens
atttaaattttctgatggagag

SEQ ID NO: 8326178 - DNA, 22 bp, Homo sapiens
atttaattttctcaacagtgct

SEQ ID NO: 8326179 - DNA, 22 bp, Homo sapiens
atttaattttctcaacagtgct

SEQ ID NO: 8326180 - DNA, 21 bp, Homo sapiens
atttacaaaacagtcccttcc

SEQ ID NO: 8326181 - DNA, 22 bp, Homo sapiens
attgctttagaaagaaaaatat

SEQ ID NO: 8326182 - DNA, 22 bp, Homo sapiens
atttctcagtgaaatgacaggc

SEQ ID NO: 8326183 - DNA, 22 bp, Homo sapiens
atttctcacaaagttgcttatc

SEQ ID NO: 8326184 - DNA, 22 bp, Homo sapiens
atttctcactgagcagataaaa

SEQ ID NO: 8326185 - DNA, 22 bp, Homo sapiens
gcctctctcgggcttgtagcgg

SEQ ID NO: 8326186 - DNA, 22 bp, Homo sapiens
gcctccagctggggcatttcag

SEQ ID NO: 8326187 - DNA, 22 bp, Homo sapiens
gcctccccaagcagcagggatt

SEQ ID NO: 8326188 - DNA, 22 bp, Homo sapiens
gcctgctgaacctcatgcagtc

SEQ ID NO: 8326189 - DNA, 22 bp, Homo sapiens
gcctgctgaacctcatgcagtc

SEQ ID NO: 8326190 - DNA, 22 bp, Homo sapiens
gcctgctggctgtccattgcag

SEQ ID NO: 8326191 - DNA, 22 bp, Homo sapiens
gcctgctggatgtggccaggcc

SEQ ID NO: 8326192 - DNA, 22 bp, Homo sapiens
gcctgctggaggagcctcaggg

SEQ ID NO: 8326193 - DNA, 22 bp, Homo sapiens
gcctgctgccaccctggctccg

SEQ ID NO: 8326194 - DNA, 21 bp, Homo sapiens
gcctgctgcctgtggccggtc

SEQ ID NO: 8326195 - DNA, 22 bp, Homo sapiens
gcctgctggacattggccggcc

SEQ ID NO: 8326196 - DNA, 22 bp, Homo sapiens
gcctggagctctccacttgggg

SEQ ID NO: 8326197 - DNA, 22 bp, Homo sapiens
gcctggagctcggctgagggcg

SEQ ID NO: 8326198 - DNA, 22 bp, Homo sapiens
gcctggagctactggacactga

SEQ ID NO: 8326199 - DNA, 22 bp, Homo sapiens
gcctggagctcatgtgggcatt

SEQ ID NO: 8326200 - DNA, 22 bp, Homo sapiens
caaaccattaagcatgttgagt

SEQ ID NO: 8326201 - DNA, 22 bp, Homo sapiens
caaaccatgacatgaagcgtga

SEQ ID NO: 8326202 - DNA, 22 bp, Homo sapiens
gcgagtgccgagagggcagggc

SEQ ID NO: 8326203 - DNA, 22 bp, Homo sapiens
gctcaggaaatagtttagtgtt

SEQ ID NO: 8326204 - DNA, 22 bp, Homo sapiens
caaacttttgaggagttcagga

SEQ ID NO: 8326205 - DNA, 22 bp, Homo sapiens
gctcaggagctgacagcctcaa

SEQ ID NO: 8326206 - DNA, 22 bp, Homo sapiens
gcctgtgacccagggcccagga

SEQ ID NO: 8326207 - DNA, 23 bp, Homo sapiens
gcctgtgcctatgcccagctctg

SEQ ID NO: 8326208 - DNA, 22 bp, Homo sapiens
gcctgtgcctcagcctgcagcc

SEQ ID NO: 8326209 - DNA, 22 bp, Homo sapiens
gcctgtctgcagggctgtcatt

SEQ ID NO: 8326210 - DNA, 22 bp, Homo sapiens
caaaaactgcaattacttttac

SEQ ID NO: 8326211 - DNA, 22 bp, Homo sapiens
caaaaactgcaattacttttac

SEQ ID NO: 8326212 - DNA, 22 bp, Homo sapiens
caaaaaacacagatgtctgtgt

SEQ ID NO: 8326213 - DNA, 22 bp, Homo sapiens
caaaagaagctcttggggctag

SEQ ID NO: 8326214 - DNA, 22 bp, Homo sapiens
atgattcaagaaaataggatgg

SEQ ID NO: 8326215 - DNA, 20 bp, Homo sapiens
atgagtttaaacattcagag

SEQ ID NO: 8326216 - DNA, 22 bp, Homo sapiens
atgagttttgggggatgttaga

SEQ ID NO: 8326217 - DNA, 22 bp, Homo sapiens
atgagttgaagctacaagaggc

SEQ ID NO: 8326218 - DNA, 22 bp, Homo sapiens
atgattcagcccaatttttcta

SEQ ID NO: 8326219 - DNA, 22 bp, Homo sapiens
atgcaaaagactatttgttgct

SEQ ID NO: 8326220 - DNA, 22 bp, Homo sapiens
atgcaaaagtaactgtgatttt

SEQ ID NO: 8326221 - DNA, 22 bp, Homo sapiens
atgcaaaagtaattgcaatttt

SEQ ID NO: 8326222 - DNA, 22 bp, Homo sapiens
atgcaaaaactgcacttacgct

SEQ ID NO: 8326223 - DNA, 22 bp, Homo sapiens
atgaggtatgaagtgtgggata

SEQ ID NO: 8326224 - DNA, 22 bp, Homo sapiens
atgaggtattagcagtaactga

SEQ ID NO: 8326225 - DNA, 22 bp, Homo sapiens
atgaggtattcgtaatatttcc

SEQ ID NO: 8326226 - DNA, 22 bp, Homo sapiens
atgaggtagtattagaaggaga

SEQ ID NO: 8326227 - DNA, 22 bp, Homo sapiens
atgaggtagtttggagaagagc

SEQ ID NO: 8326228 - DNA, 22 bp, Homo sapiens
atgaggtatctcatttcctgaa

SEQ ID NO: 8326229 - DNA, 19 bp, Homo sapiens
atgaggtagcagctggtgc

SEQ ID NO: 8326230 - DNA, 22 bp, Homo sapiens
atgaggtagcttggcccagggg

SEQ ID NO: 8326231 - DNA, 22 bp, Homo sapiens
atgaggtaggacatcaggaaat

SEQ ID NO: 8326232 - DNA, 22 bp, Homo sapiens
atgaggtagctgtggctggctg

SEQ ID NO: 8326233 - DNA, 22 bp, Homo sapiens
atgaggtactagtatatacgta

SEQ ID NO: 8326234 - DNA, 22 bp, Homo sapiens
atgaggtacttacattgagctt

SEQ ID NO: 8326235 - DNA, 21 bp, Homo sapiens
atgaggtaattcactaagcag

SEQ ID NO: 8326236 - DNA, 22 bp, Homo sapiens
atgaggtaatagggcagtgggg

SEQ ID NO: 8326237 - DNA, 22 bp, Homo sapiens
atgaggtaatactttcagtcct

SEQ ID NO: 8326238 - DNA, 22 bp, Homo sapiens
atgaggtaaggtattcagggaa

SEQ ID NO: 8326239 - DNA, 22 bp, Homo sapiens
atgaggtaagcactgggcccaa

SEQ ID NO: 8326240 - DNA, 22 bp, Homo sapiens
atgaggtaacagcttatcaaca

SEQ ID NO: 8326241 - DNA, 23 bp, Homo sapiens
atgaggtaaagatcagctttaaa

SEQ ID NO: 8326242 - DNA, 22 bp, Homo sapiens
atgaggtaaagtttaagctaag

SEQ ID NO: 8326243 - DNA, 22 bp, Homo sapiens
atgaggccaccttctacatttc

SEQ ID NO: 8326244 - DNA, 19 bp, Homo sapiens
atgaagattggtaaattca

SEQ ID NO: 8326245 - DNA, 22 bp, Homo sapiens
gaaagcacccaagatttccttc

SEQ ID NO: 8326246 - DNA, 22 bp, Homo sapiens
gaaagcactaaaagagaatcct

SEQ ID NO: 8326247 - DNA, 22 bp, Homo sapiens
gaaagcacagttcatgagacaa

SEQ ID NO: 8326248 - DNA, 22 bp, Homo sapiens
gaaagcacagttctgaccatgt

SEQ ID NO: 8326249 - DNA, 21 bp, Homo sapiens
gaaagcacagaaaggactctt

SEQ ID NO: 8326250 - DNA, 22 bp, Homo sapiens
atgcagatttctttgctgcacc

SEQ ID NO: 8326251 - DNA, 22 bp, Homo sapiens
atgcagatctgtgaaaggaata

SEQ ID NO: 8326252 - DNA, 22 bp, Homo sapiens
atgcacttaaataacataactt

SEQ ID NO: 8326253 - DNA, 22 bp, Homo sapiens
atgcagaacgtttgtgaaactt

SEQ ID NO: 8326254 - DNA, 22 bp, Homo sapiens
atgcagaattgctaagtatctg

SEQ ID NO: 8326255 - DNA, 22 bp, Homo sapiens
atgcagaatcttgagaaaaatt

SEQ ID NO: 8326256 - DNA, 22 bp, Homo sapiens
atgcagaagactgaaaagctga

SEQ ID NO: 8326257 - DNA, 22 bp, Homo sapiens
atgcagaagactgaaaagctga

SEQ ID NO: 8326258 - DNA, 22 bp, Homo sapiens
atgcagaaggagccatgcttgc

SEQ ID NO: 8326259 - DNA, 22 bp, Homo sapiens
atgcaaaattaccattctgttc

SEQ ID NO: 8326260 - DNA, 22 bp, Homo sapiens
atgcaaaagtagttgcagtttt

SEQ ID NO: 8326261 - DNA, 22 bp, Homo sapiens
atgcaaataaagcaactataca

SEQ ID NO: 8326262 - DNA, 22 bp, Homo sapiens
atgcagctgctcttcctctatt

SEQ ID NO: 8326263 - DNA, 21 bp, Homo sapiens
atgcatgttccataaagtggg

SEQ ID NO: 8326264 - DNA, 22 bp, Homo sapiens
atgcattgtctggtttcatttt

SEQ ID NO: 8326265 - DNA, 22 bp, Homo sapiens
atgcattgtcaggcaatttcat

SEQ ID NO: 8326266 - DNA, 22 bp, Homo sapiens
atgaaatatcttgaagaaattc

SEQ ID NO: 8326267 - DNA, 22 bp, Homo sapiens
atgaaatatcttgaagaaattc

SEQ ID NO: 8326268 - DNA, 22 bp, Homo sapiens
atgaaatatcttgaagaaattc

SEQ ID NO: 8326269 - DNA, 23 bp, Homo sapiens
atgaaatgatactttattcactg

SEQ ID NO: 8326270 - DNA, 22 bp, Homo sapiens
atgaaatgagtcaatgcgacta

SEQ ID NO: 8326271 - DNA, 22 bp, Homo sapiens
atgaaatgaagttggcctggct

SEQ ID NO: 8326272 - DNA, 22 bp, Homo sapiens
atgaaatgctgagaggtgcttc

SEQ ID NO: 8326273 - DNA, 22 bp, Homo sapiens
atgaaatgctgagaggtgcttc

SEQ ID NO: 8326274 - DNA, 22 bp, Homo sapiens
atgaaatgctattttggctaga

SEQ ID NO: 8326275 - DNA, 22 bp, Homo sapiens
atgaaatgattgaaatctttac

SEQ ID NO: 8326276 - DNA, 23 bp, Homo sapiens
atgaaatgctggctcagggaggt

SEQ ID NO: 8326277 - DNA, 22 bp, Homo sapiens
atgaaatggtggttttccattt

SEQ ID NO: 8326278 - DNA, 22 bp, Homo sapiens
atgaaatgtattcagatatgta

SEQ ID NO: 8326279 - DNA, 22 bp, Homo sapiens
atgaaatgtgaatgcttttcat

SEQ ID NO: 8326280 - DNA, 22 bp, Homo sapiens
atgaaatgtgaatgcttttcat

SEQ ID NO: 8326281 - DNA, 22 bp, Homo sapiens
atgaaatgtctggatctttttc

SEQ ID NO: 8326282 - DNA, 22 bp, Homo sapiens
atgaaatgtatgagtctgggtt

SEQ ID NO: 8326283 - DNA, 22 bp, Homo sapiens
atgaaatgtaagtagagagttt

SEQ ID NO: 8326284 - DNA, 19 bp, Homo sapiens
cttttcaagccatcagttt

SEQ ID NO: 8326285 - DNA, 19 bp, Homo sapiens
cttttcatcaacagccaat

SEQ ID NO: 8326286 - DNA, 22 bp, Homo sapiens
cttttcatgagtctgttatggg

SEQ ID NO: 8326287 - DNA, 22 bp, Homo sapiens
cttttcatgagtctgttatggg

SEQ ID NO: 8326288 - DNA, 22 bp, Homo sapiens
atgaaattaatcaacacataca

SEQ ID NO: 8326289 - DNA, 22 bp, Homo sapiens
ctttggtgtcatgtttctgcgg

SEQ ID NO: 8326290 - DNA, 22 bp, Homo sapiens
cttttattttgaattaagggct

SEQ ID NO: 8326291 - DNA, 22 bp, Homo sapiens
atgaaacagtgtgtatagcaaa

SEQ ID NO: 8326292 - DNA, 18 bp, Homo sapiens
cttgttcttctcttggcg

SEQ ID NO: 8326293 - DNA, 22 bp, Homo sapiens
cttgtttaataataccttagca

SEQ ID NO: 8326294 - DNA, 22 bp, Homo sapiens
atctttttatctgtttggaaca

SEQ ID NO: 8326295 - DNA, 22 bp, Homo sapiens
atctttgggcaatgatgaggga

SEQ ID NO: 8326296 - DNA, 19 bp, Homo sapiens
cttgtaaagggctgtttct

SEQ ID NO: 8326297 - DNA, 22 bp, Homo sapiens
cttggtgccacagcagcttgcg

SEQ ID NO: 8326298 - DNA, 22 bp, Homo sapiens
cttggtgagactcccacccacc

SEQ ID NO: 8326299 - DNA, 22 bp, Homo sapiens
atcttctcatgtgtaatgaggt

SEQ ID NO: 8326300 - DNA, 22 bp, Homo sapiens
cttggcccagttgccaaggaaa

SEQ ID NO: 8326301 - DNA, 22 bp, Homo sapiens
cttggcccggagccccatgaag

SEQ ID NO: 8326302 - DNA, 22 bp, Homo sapiens
cttggctccttcacagggagat

SEQ ID NO: 8326303 - DNA, 22 bp, Homo sapiens
cttggctccaatcccagctctg

SEQ ID NO: 8326304 - DNA, 22 bp, Homo sapiens
atctacaggatagtttaatatt

SEQ ID NO: 8326305 - DNA, 22 bp, Homo sapiens
cttgatctacatagtgaaaccc

SEQ ID NO: 8326306 - DNA, 22 bp, Homo sapiens
atctatacccatcatgatttaa

SEQ ID NO: 8326307 - DNA, 22 bp, Homo sapiens
atctatgtgcctttgtatagaa

SEQ ID NO: 8326308 - DNA, 22 bp, Homo sapiens
gaggctgctttgatgacaggag

SEQ ID NO: 8326309 - DNA, 22 bp, Homo sapiens
gaggctgctgttagccctgggc

SEQ ID NO: 8326310 - DNA, 22 bp, Homo sapiens
gaggggaagacttctggacagt

SEQ ID NO: 8326311 - DNA, 22 bp, Homo sapiens
gaggggagaggcttatggatca

SEQ ID NO: 8326312 - DNA, 20 bp, Homo sapiens
gaggctgcggactgctggac

SEQ ID NO: 8326313 - DNA, 22 bp, Homo sapiens
gaggctgcggggaggagcctgc

SEQ ID NO: 8326314 - DNA, 22 bp, Homo sapiens
gaggctgcggggaggagcctgc

SEQ ID NO: 8326315 - DNA, 20 bp, Homo sapiens
gaggctgcggactgctggac

SEQ ID NO: 8326316 - DNA, 22 bp, Homo sapiens
gaggctgccccttcctcagctg

SEQ ID NO: 8326317 - DNA, 22 bp, Homo sapiens
atgtctttctagttaagagcta

SEQ ID NO: 8326318 - DNA, 22 bp, Homo sapiens
atgtctttctcatacaagccca

SEQ ID NO: 8326319 - DNA, 22 bp, Homo sapiens
atgtctttgccatagttcatat

SEQ ID NO: 8326320 - DNA, 22 bp, Homo sapiens
atgtcttttatggagatgtcat

SEQ ID NO: 8326321 - DNA, 22 bp, Homo sapiens
atgtctttataaatgtataatg

SEQ ID NO: 8326322 - DNA, 22 bp, Homo sapiens
gaggcctgggcaagggggtctg

SEQ ID NO: 8326323 - DNA, 22 bp, Homo sapiens
gaggcctggctctgccctcctg

SEQ ID NO: 8326324 - DNA, 22 bp, Homo sapiens
gaggcctggctgtcagtcccca

SEQ ID NO: 8326325 - DNA, 22 bp, Homo sapiens
gaggccaccctatgggtcccag

SEQ ID NO: 8326326 - DNA, 22 bp, Homo sapiens
gaggccaggaggatctctctaa

SEQ ID NO: 8326327 - DNA, 22 bp, Homo sapiens
gaggccaggggcctggagatga

SEQ ID NO: 8326328 - DNA, 22 bp, Homo sapiens
atggggctgggattctcctcgg

SEQ ID NO: 8326329 - DNA, 22 bp, Homo sapiens
atgggtttataggtggactttt

SEQ ID NO: 8326330 - DNA, 22 bp, Homo sapiens
atggggctctgcggctgctccc

SEQ ID NO: 8326331 - DNA, 22 bp, Homo sapiens
gagctgggctggcttcctccct

SEQ ID NO: 8326332 - DNA, 22 bp, Homo sapiens
gagctgggcctgcgagtgctgc

SEQ ID NO: 8326333 - DNA, 22 bp, Homo sapiens
gagctgggcctgcgagtgctgc

SEQ ID NO: 8326334 - DNA, 22 bp, Homo sapiens
atggagagagaaggcttgctgt

SEQ ID NO: 8326335 - DNA, 22 bp, Homo sapiens
gagaaatagattcatggtagat

SEQ ID NO: 8326336 - DNA, 22 bp, Homo sapiens
gagaacacgaggaggcccagcg

SEQ ID NO: 8326337 - DNA, 22 bp, Homo sapiens
gagaacaaggaagagtcggcag

SEQ ID NO: 8326338 - DNA, 23 bp, Homo sapiens
gacagagtgagaccttgtcttac

SEQ ID NO: 8326339 - DNA, 22 bp, Homo sapiens
gacagaggtgtccttgagtcca

SEQ ID NO: 8326340 - DNA, 23 bp, Homo sapiens
gacagagtgagaccttgtcttac

SEQ ID NO: 8326341 - DNA, 22 bp, Homo sapiens
gacagatgtgggtgacagcagc

SEQ ID NO: 8326342 - DNA, 22 bp, Homo sapiens
atggaaatggagtgtgcttgct

SEQ ID NO: 8326343 - DNA, 22 bp, Homo sapiens
atggccagtgtttccctcagtt

SEQ ID NO: 8326344 - DNA, 22 bp, Homo sapiens
atggccagtctgttggacagca

SEQ ID NO: 8326345 - DNA, 22 bp, Homo sapiens
atggccagtgttgagatcaggc

SEQ ID NO: 8326346 - DNA, 22 bp, Homo sapiens
atggcccagactcagactggtg

SEQ ID NO: 8326347 - DNA, 22 bp, Homo sapiens
atggcccactctggtcccggca

SEQ ID NO: 8326348 - DNA, 22 bp, Homo sapiens
atggcccagaagtttggaaagg

SEQ ID NO: 8326349 - DNA, 22 bp, Homo sapiens
atggcccaggcaggctggtact

SEQ ID NO: 8326350 - DNA, 22 bp, Homo sapiens
atggcccaggccaggatccagc

SEQ ID NO: 8326351 - DNA, 22 bp, Homo sapiens
atggcccaggcctcctgtggct

SEQ ID NO: 8326352 - DNA, 22 bp, Homo sapiens
atggcccaaactgcaattactt

SEQ ID NO: 8326353 - DNA, 22 bp, Homo sapiens
atggcccaagtgccctgacctg

SEQ ID NO: 8326354 - DNA, 22 bp, Homo sapiens
atggcccaaaacctcctccctc

SEQ ID NO: 8326355 - DNA, 22 bp, Homo sapiens
gagagctgtttatcttcttcaa

SEQ ID NO: 8326356 - DNA, 22 bp, Homo sapiens
atggccagcaaggtagggcaat

SEQ ID NO: 8326357 - DNA, 22 bp, Homo sapiens
atggccagtcaagcctctggct

SEQ ID NO: 8326358 - DNA, 22 bp, Homo sapiens
atggcagggcccttggctccca

SEQ ID NO: 8326359 - DNA, 22 bp, Homo sapiens
gagaacagatttttctgctgtc

SEQ ID NO: 8326360 - DNA, 22 bp, Homo sapiens
cagcaataatgtctacaaatct

SEQ ID NO: 8326361 - DNA, 22 bp, Homo sapiens
ggttcctgtgcctctagctggc

SEQ ID NO: 8326362 - DNA, 21 bp, Homo sapiens
ggttcccttgatcattgctaa

SEQ ID NO: 8326363 - DNA, 22 bp, Homo sapiens
ggttcccggatctccgagtccc

SEQ ID NO: 8326364 - DNA, 22 bp, Homo sapiens
ggttgcatttctcagtggaata

SEQ ID NO: 8326365 - DNA, 22 bp, Homo sapiens
gtaaaatcatttagttacttaa

SEQ ID NO: 8326366 - DNA, 22 bp, Homo sapiens
gtaaacactacaaatcaaggct

SEQ ID NO: 8326367 - DNA, 22 bp, Homo sapiens
cagcagagctgtgtgggaaggg

SEQ ID NO: 8326368 - DNA, 22 bp, Homo sapiens
gtaaacaacacaaatcatttga

SEQ ID NO: 8326369 - DNA, 22 bp, Homo sapiens
gtaaaattctagcatctgaaag

SEQ ID NO: 8326370 - DNA, 22 bp, Homo sapiens
gtaaaatctttattgctggtga

SEQ ID NO: 8326371 - DNA, 22 bp, Homo sapiens
gtaaaatctttcctatttgcct

SEQ ID NO: 8326372 - DNA, 22 bp, Homo sapiens
gtaaaattgcaattacttttgc

SEQ ID NO: 8326373 - DNA, 22 bp, Homo sapiens
cagagtcagctagtcttgggat

SEQ ID NO: 8326374 - DNA, 22 bp, Homo sapiens
cagagtcagagcacctgggatt

SEQ ID NO: 8326375 - DNA, 22 bp, Homo sapiens
ggtgggagagctctgtctccag

SEQ ID NO: 8326376 - DNA, 22 bp, Homo sapiens
ggtgggagagctctgtctccag

SEQ ID NO: 8326377 - DNA, 22 bp, Homo sapiens
ggtggggctaggacctcaggat

SEQ ID NO: 8326378 - DNA, 22 bp, Homo sapiens
ggtgggtgaaatctaggtgtgt

SEQ ID NO: 8326379 - DNA, 22 bp, Homo sapiens
gtatgaaaattgtaaagttctt

SEQ ID NO: 8326380 - DNA, 22 bp, Homo sapiens
gtatcctccccgctggccttca

SEQ ID NO: 8326381 - DNA, 20 bp, Homo sapiens
gtatccccgcgtggggaagg

SEQ ID NO: 8326382 - DNA, 22 bp, Homo sapiens
gtatattttgatcaccctctat

SEQ ID NO: 8326383 - DNA, 19 bp, Homo sapiens
gtatatggcttctacctac

SEQ ID NO: 8326384 - DNA, 19 bp, Homo sapiens
gtatatttatatggctgta

SEQ ID NO: 8326385 - DNA, 22 bp, Homo sapiens
cagcagcagattcagcgtctgg

SEQ ID NO: 8326386 - DNA, 22 bp, Homo sapiens
cagcagcaaatctagaagagga

SEQ ID NO: 8326387 - DNA, 22 bp, Homo sapiens
cagcagcaacaatagcggtcac

SEQ ID NO: 8326388 - DNA, 22 bp, Homo sapiens
gtattttaagtgactactaggt

SEQ ID NO: 8326389 - DNA, 22 bp, Homo sapiens
gtattttaagtgactactaggt

SEQ ID NO: 8326390 - DNA, 22 bp, Homo sapiens
gtattttactgctcaaagctct

SEQ ID NO: 8326391 - DNA, 22 bp, Homo sapiens
gtattttactgctcaaagctct

SEQ ID NO: 8326392 - DNA, 22 bp, Homo sapiens
cagcattgccctttttctcaga

SEQ ID NO: 8326393 - DNA, 22 bp, Homo sapiens
cagcatttggtgatcatcttaa

SEQ ID NO: 8326394 - DNA, 22 bp, Homo sapiens
gggcagaatttgtagatgacat

SEQ ID NO: 8326395 - DNA, 22 bp, Homo sapiens
gggcgagggcgaaagcgagagc

SEQ ID NO: 8326396 - DNA, 22 bp, Homo sapiens
gggcgcagccaatcctggccct

SEQ ID NO: 8326397 - DNA, 22 bp, Homo sapiens
cagagctgagtcttcaaggttg

SEQ ID NO: 8326398 - DNA, 22 bp, Homo sapiens
cagagctgctcatggtggccag

SEQ ID NO: 8326399 - DNA, 19 bp, Homo sapiens
cagagctgctggcctcgtc

SEQ ID NO: 8326400 - DNA, 18 bp, Homo sapiens
ggggaaaagccaggtgtc

SEQ ID NO: 8326401 - DNA, 20 bp, Homo sapiens
ggggaagaaaaggatgtgat

SEQ ID NO: 8326402 - DNA, 22 bp, Homo sapiens
cagaggcctatccagtgtccat

SEQ ID NO: 8326403 - DNA, 22 bp, Homo sapiens
cagaggcccagtgagagggctg

SEQ ID NO: 8326404 - DNA, 22 bp, Homo sapiens
cagaggccagggggctcacaaa

SEQ ID NO: 8326405 - DNA, 22 bp, Homo sapiens
cagaggccagtggacaagggcc

SEQ ID NO: 8326406 - DNA, 22 bp, Homo sapiens
cagaggccaggctgcctgactg

SEQ ID NO: 8326407 - DNA, 19 bp, Homo sapiens
cagaggccagaagcacagg

SEQ ID NO: 8326408 - DNA, 22 bp, Homo sapiens
cagaggtgtacagagggaggcc

SEQ ID NO: 8326409 - DNA, 23 bp, Homo sapiens
cagaggtgtcagtgcccagtgtc

SEQ ID NO: 8326410 - DNA, 22 bp, Homo sapiens
cagagtaaggagctgtcaaacg

SEQ ID NO: 8326411 - DNA, 22 bp, Homo sapiens
cagaggttgagcaaaaatgata

SEQ ID NO: 8326412 - DNA, 22 bp, Homo sapiens
cagaggttacctagagcaagaa

SEQ ID NO: 8326413 - DNA, 22 bp, Homo sapiens
gggtgctgactggggcctgaaa

SEQ ID NO: 8326414 - DNA, 22 bp, Homo sapiens
gggtgctgaggaagacagcagg

SEQ ID NO: 8326415 - DNA, 23 bp, Homo sapiens
gggtgctgcctgtagtcatgctg

SEQ ID NO: 8326416 - DNA, 22 bp, Homo sapiens
gggtgcagtggttcacgcctgt

SEQ ID NO: 8326417 - DNA, 22 bp, Homo sapiens
gggtgcatggtgtatgactgga

SEQ ID NO: 8326418 - DNA, 22 bp, Homo sapiens
cagaggcctggcttggacacct

SEQ ID NO: 8326419 - DNA, 22 bp, Homo sapiens
cagaggcctggcttggacacct

SEQ ID NO: 8326420 - DNA, 22 bp, Homo sapiens
gggtgcagggtctccagcagct

SEQ ID NO: 8326421 - DNA, 22 bp, Homo sapiens
gggaaagagaggtggacgcagg

SEQ ID NO: 8326422 - DNA, 22 bp, Homo sapiens
cactggcccataaaggcctggg

SEQ ID NO: 8326423 - DNA, 22 bp, Homo sapiens
cactggcccagccaggcctgtt

SEQ ID NO: 8326424 - DNA, 22 bp, Homo sapiens
gggactggcacagggctgggag

SEQ ID NO: 8326425 - DNA, 22 bp, Homo sapiens
gggacactggacccagtgtcca

SEQ ID NO: 8326426 - DNA, 22 bp, Homo sapiens
gggacagacccatgggccaggt

SEQ ID NO: 8326427 - DNA, 22 bp, Homo sapiens
gggacagacccatgggccaggt

SEQ ID NO: 8326428 - DNA, 22 bp, Homo sapiens
gggcacaccttgtctgagcaca

SEQ ID NO: 8326429 - DNA, 22 bp, Homo sapiens
gggcaatggatgtgatgactcc

SEQ ID NO: 8326430 - DNA, 22 bp, Homo sapiens
gggcaatgctatgaagagctaa

SEQ ID NO: 8326431 - DNA, 22 bp, Homo sapiens
gggcaatgggcttttctgtaag

SEQ ID NO: 8326432 - DNA, 22 bp, Homo sapiens
gggcaatggatgtgatgactcc

SEQ ID NO: 8326433 - DNA, 22 bp, Homo sapiens
gggaggtcagggtgcctgctgg

SEQ ID NO: 8326434 - DNA, 22 bp, Homo sapiens
gggaggtcagggtgcctgctgg

SEQ ID NO: 8326435 - DNA, 22 bp, Homo sapiens
gggaggtgaaaggtcatgtgtg

SEQ ID NO: 8326436 - DNA, 22 bp, Homo sapiens
gggagggtctgagagctgcacc

SEQ ID NO: 8326437 - DNA, 22 bp, Homo sapiens
gggagggccaggctcacccagg

SEQ ID NO: 8326438 - DNA, 22 bp, Homo sapiens
gggaggggttgcatgtttgagt

SEQ ID NO: 8326439 - DNA, 22 bp, Homo sapiens
gggaggggttgcatgtttgagt

SEQ ID NO: 8326440 - DNA, 22 bp, Homo sapiens
cagacagaaggctccttgaggt

SEQ ID NO: 8326441 - DNA, 22 bp, Homo sapiens
cagaataaaagtcccaaggcat

SEQ ID NO: 8326442 - DNA, 22 bp, Homo sapiens
gctgtctgagaacatggtggaa

SEQ ID NO: 8326443 - DNA, 19 bp, Homo sapiens
gctgtctgatgctgaggtc

SEQ ID NO: 8326444 - DNA, 19 bp, Homo sapiens
gctgtctgatgctgaggtc

SEQ ID NO: 8326445 - DNA, 20 bp, Homo sapiens
gctgtggcaagtgctcactg

SEQ ID NO: 8326446 - DNA, 20 bp, Homo sapiens
gctgtggcaaagctttgtgt

SEQ ID NO: 8326447 - DNA, 22 bp, Homo sapiens
gctgtgctggaaggggacctgc

SEQ ID NO: 8326448 - DNA, 20 bp, Homo sapiens
caaggcagaccagagtgagt

SEQ ID NO: 8326449 - DNA, 22 bp, Homo sapiens
gctgtggcccttggcatctgcg

SEQ ID NO: 8326450 - DNA, 22 bp, Homo sapiens
gcttggcttgggctcagaggcc

SEQ ID NO: 8326451 - DNA, 22 bp, Homo sapiens
gcttggctgtgttcaagggcgg

SEQ ID NO: 8326452 - DNA, 22 bp, Homo sapiens
gcttggctgtgagctttgctgt

SEQ ID NO: 8326453 - DNA, 22 bp, Homo sapiens
gcttggctcctggctcacaggt

SEQ ID NO: 8326454 - DNA, 18 bp, Homo sapiens
gcttggctgcagagagag

SEQ ID NO: 8326455 - DNA, 22 bp, Homo sapiens
gcttggctctaagacacctatt

SEQ ID NO: 8326456 - DNA, 23 bp, Homo sapiens
cacacctgttaagaagagtgcct

SEQ ID NO: 8326457 - DNA, 22 bp, Homo sapiens
cacaattccatggcattctttg

SEQ ID NO: 8326458 - DNA, 22 bp, Homo sapiens
cacaataaatgtttgctgatga

SEQ ID NO: 8326459 - DNA, 22 bp, Homo sapiens
cacaatattggccgggctggtc

SEQ ID NO: 8326460 - DNA, 22 bp, Homo sapiens
ggaaaaggccacagggacacat

SEQ ID NO: 8326461 - DNA, 22 bp, Homo sapiens
ggaaaatactgattcatgccat

SEQ ID NO: 8326462 - DNA, 22 bp, Homo sapiens
cacaaagttggacaacgcaccc

SEQ ID NO: 8326463 - DNA, 22 bp, Homo sapiens
cacaaaatatcaagcactttta

SEQ ID NO: 8326464 - DNA, 22 bp, Homo sapiens
cacaaaatatcaagcactttta

SEQ ID NO: 8326465 - DNA, 22 bp, Homo sapiens
cacaaaatctttctcgattatt

SEQ ID NO: 8326466 - DNA, 22 bp, Homo sapiens
cacaaaatctttctcgattatt

SEQ ID NO: 8326467 - DNA, 22 bp, Homo sapiens
gctgcagccttcttgccattaa

SEQ ID NO: 8326468 - DNA, 22 bp, Homo sapiens
gctgcagtgagccaagatcgtg

SEQ ID NO: 8326469 - DNA, 22 bp, Homo sapiens
gctgccacattttcaggactaa

SEQ ID NO: 8326470 - DNA, 23 bp, Homo sapiens
gctgccacagggctcaggcaggt

SEQ ID NO: 8326471 - DNA, 22 bp, Homo sapiens
caacatatgattttgtatataa

SEQ ID NO: 8326472 - DNA, 22 bp, Homo sapiens
caacatattgtgggatgagaga

SEQ ID NO: 8326473 - DNA, 22 bp, Homo sapiens
caacatatgctttcatgaggta

SEQ ID NO: 8326474 - DNA, 22 bp, Homo sapiens
caacatataatatttgagttct

SEQ ID NO: 8326475 - DNA, 22 bp, Homo sapiens
gctgcagagtgatgaagtgggg

SEQ ID NO: 8326476 - DNA, 22 bp, Homo sapiens
gctgcagatcccacccattccc

SEQ ID NO: 8326477 - DNA, 19 bp, Homo sapiens
gctcctggatgacctgtgg

SEQ ID NO: 8326478 - DNA, 18 bp, Homo sapiens
gctcctggagtctgactc

SEQ ID NO: 8326479 - DNA, 22 bp, Homo sapiens
gctcctggagagattgagaaag

SEQ ID NO: 8326480 - DNA, 18 bp, Homo sapiens
gctcctggaccaggtcac

SEQ ID NO: 8326481 - DNA, 19 bp, Homo sapiens
caaagtacctggcacagtg

SEQ ID NO: 8326482 - DNA, 22 bp, Homo sapiens
caaagtacagtgcttcctggga

SEQ ID NO: 8326483 - DNA, 22 bp, Homo sapiens
caaagtaatttggagatatata

SEQ ID NO: 8326484 - DNA, 22 bp, Homo sapiens
caaagtaactgcctttccaatt

SEQ ID NO: 8326485 - DNA, 22 bp, Homo sapiens
gctgcctgccttgcctggagga

SEQ ID NO: 8326486 - DNA, 22 bp, Homo sapiens
gctgctggaagcatgcgatgaa

SEQ ID NO: 8326487 - DNA, 22 bp, Homo sapiens
gctgctggagagcgagactgtt

SEQ ID NO: 8326488 - DNA, 22 bp, Homo sapiens
gctgctggagctttgcagaagg

SEQ ID NO: 8326489 - DNA, 22 bp, Homo sapiens
gctgctggatgcgcttgatggt

SEQ ID NO: 8326490 - DNA, 22 bp, Homo sapiens
gctgctggcactggagtgagcc

SEQ ID NO: 8326491 - DNA, 22 bp, Homo sapiens
gctgctggcatctagggggtgg

SEQ ID NO: 8326492 - DNA, 22 bp, Homo sapiens
caagattactatccactgctgg

SEQ ID NO: 8326493 - DNA, 22 bp, Homo sapiens
cacagcttccattagaatgaga

SEQ ID NO: 8326494 - DNA, 22 bp, Homo sapiens
cacagctgtgagaagggagcct

SEQ ID NO: 8326495 - DNA, 22 bp, Homo sapiens
ggaggcgcggctcggctgtgcc

SEQ ID NO: 8326496 - DNA, 19 bp, Homo sapiens
cacagggagaccacatgtc

SEQ ID NO: 8326497 - DNA, 22 bp, Homo sapiens
cacagggaggacatcaacagtg

SEQ ID NO: 8326498 - DNA, 22 bp, Homo sapiens
ggatgttctggggttctcttgt

SEQ ID NO: 8326499 - DNA, 22 bp, Homo sapiens
ggatgtggaccttgcctggtga

SEQ ID NO: 8326500 - DNA, 22 bp, Homo sapiens
ggatgtggaccttgcctggtga

SEQ ID NO: 8326501 - DNA, 22 bp, Homo sapiens
ggatgtcgaggatggggtagca

SEQ ID NO: 8326502 - DNA, 22 bp, Homo sapiens
ggatgtgaatctgggctgagac

SEQ ID NO: 8326503 - DNA, 22 bp, Homo sapiens
ggagggagcagagaacccaacc

SEQ ID NO: 8326504 - DNA, 22 bp, Homo sapiens
ggagggaggttagattcaagct

SEQ ID NO: 8326505 - DNA, 22 bp, Homo sapiens
ggagggagggctagaccaaaga

SEQ ID NO: 8326506 - DNA, 22 bp, Homo sapiens
ggatgggagcagaggacgacca

SEQ ID NO: 8326507 - DNA, 22 bp, Homo sapiens
ggcacagggggctgaggactag

SEQ ID NO: 8326508 - DNA, 22 bp, Homo sapiens
ggcacagttttctacatatgct

SEQ ID NO: 8326509 - DNA, 22 bp, Homo sapiens
ggcacagggagccgcagttgca

SEQ ID NO: 8326510 - DNA, 22 bp, Homo sapiens
ggcacaagtttgatgtgagtta

SEQ ID NO: 8326511 - DNA, 22 bp, Homo sapiens
cactgcagttccccagtgcgca

SEQ ID NO: 8326512 - DNA, 22 bp, Homo sapiens
cactgcccactccttcgtccaa

SEQ ID NO: 8326513 - DNA, 22 bp, Homo sapiens
ggctatgtggtcatataagata

SEQ ID NO: 8326514 - DNA, 22 bp, Homo sapiens
cactggcatgtgaggcggtggc

SEQ ID NO: 8326515 - DNA, 22 bp, Homo sapiens
cactggcatctagtgggttgag

SEQ ID NO: 8326516 - DNA, 22 bp, Homo sapiens
cactggcattagtcacgaggca

SEQ ID NO: 8326517 - DNA, 22 bp, Homo sapiens
cactggcaaagcctgttcctta

SEQ ID NO: 8326518 - DNA, 22 bp, Homo sapiens
cactggcaaatggagagaatgt

SEQ ID NO: 8326519 - DNA, 22 bp, Homo sapiens
cactggcatctaagggtggtag

SEQ ID NO: 8326520 - DNA, 22 bp, Homo sapiens
cactggcagatttgggatctgg

SEQ ID NO: 8326521 - DNA, 22 bp, Homo sapiens
ggcctctctagcatccagcctg

SEQ ID NO: 8326522 - DNA, 22 bp, Homo sapiens
cactgcaggtctgagatggggg

SEQ ID NO: 8326523 - DNA, 22 bp, Homo sapiens
cactgcagcaccatgcagggct

SEQ ID NO: 8326524 - DNA, 22 bp, Homo sapiens
cactgcagcctcgctctcctga

SEQ ID NO: 8326525 - DNA, 22 bp, Homo sapiens
cactgaagcctgggagtaagac

SEQ ID NO: 8326526 - DNA, 22 bp, Homo sapiens
cactgagaaagtgacctgccaa

SEQ ID NO: 8326527 - DNA, 22 bp, Homo sapiens
cactgagagatgtgtcacagca

SEQ ID NO: 8326528 - DNA, 22 bp, Homo sapiens
cactgagaggtctcatttccaa

SEQ ID NO: 8326529 - DNA, 22 bp, Homo sapiens
cactgagagtagggcacaagtg

SEQ ID NO: 8326530 - DNA, 22 bp, Homo sapiens
ggcctcctcaccctgctcaggc

SEQ ID NO: 8326531 - DNA, 22 bp, Homo sapiens
cacccctcgccactgcccttgt

SEQ ID NO: 8326532 - DNA, 22 bp, Homo sapiens
cacccctgggctgggcacacag

SEQ ID NO: 8326533 - DNA, 22 bp, Homo sapiens
caccccttccgccactgccttc

SEQ ID NO: 8326534 - DNA, 20 bp, Homo sapiens
caccctcccagcacctatgc

SEQ ID NO: 8326535 - DNA, 22 bp, Homo sapiens
cacccagtaagcatgaggccct

SEQ ID NO: 8326536 - DNA, 22 bp, Homo sapiens
ggcatatgtagcgtgtgttctg

SEQ ID NO: 8326537 - DNA, 22 bp, Homo sapiens
caccataaccaacatgtcagtt

SEQ ID NO: 8326538 - DNA, 22 bp, Homo sapiens
atatgacagaatgtgtgtgtat

SEQ ID NO: 8326539 - DNA, 22 bp, Homo sapiens
atatgagaattggaaaatatca

SEQ ID NO: 8326540 - DNA, 22 bp, Homo sapiens
atatatattgcccaggctggtt

SEQ ID NO: 8326541 - DNA, 22 bp, Homo sapiens
atatatcatgagtaaaacttga

SEQ ID NO: 8326542 - DNA, 22 bp, Homo sapiens
atatgattgtccttagcaaatt

SEQ ID NO: 8326543 - DNA, 22 bp, Homo sapiens
atatggtaagagtatatttact

SEQ ID NO: 8326544 - DNA, 22 bp, Homo sapiens
atatttctctcagacatggaag

SEQ ID NO: 8326545 - DNA, 22 bp, Homo sapiens
atatgtttttggaaagaacaca

SEQ ID NO: 8326546 - DNA, 22 bp, Homo sapiens
ctgggactttaccctgtggccc

SEQ ID NO: 8326547 - DNA, 22 bp, Homo sapiens
ctgggactttgtaggccagttg

SEQ ID NO: 8326548 - DNA, 22 bp, Homo sapiens
ctgggacttgtagtctcggcgc

SEQ ID NO: 8326549 - DNA, 22 bp, Homo sapiens
atatatactttgacacattctg

SEQ ID NO: 8326550 - DNA, 22 bp, Homo sapiens
ctgggagacaagagagggctga

SEQ ID NO: 8326551 - DNA, 22 bp, Homo sapiens
atataacatacatacagaaaag

SEQ ID NO: 8326552 - DNA, 22 bp, Homo sapiens
atatataagctgatgagccaca

SEQ ID NO: 8326553 - DNA, 22 bp, Homo sapiens
atatataacctggataaggctt

SEQ ID NO: 8326554 - DNA, 22 bp, Homo sapiens
atatatacaactagattaaaag

SEQ ID NO: 8326555 - DNA, 22 bp, Homo sapiens
atatacttttcactaatggcta

SEQ ID NO: 8326556 - DNA, 22 bp, Homo sapiens
atataatacaacctgctaagtg

SEQ ID NO: 8326557 - DNA, 22 bp, Homo sapiens
ctggcagcttagcactctggtt

SEQ ID NO: 8326558 - DNA, 22 bp, Homo sapiens
ctgggaaggggaaggtcctctc

SEQ ID NO: 8326559 - DNA, 22 bp, Homo sapiens
ctgggaagtggtgagggcctga

SEQ ID NO: 8326560 - DNA, 22 bp, Homo sapiens
ctgggaagtagaatcagatgag

SEQ ID NO: 8326561 - DNA, 22 bp, Homo sapiens
ctgggaagcttcgagcaggaaa

SEQ ID NO: 8326562 - DNA, 21 bp, Homo sapiens
ctgtgatgttgccggggtagg

SEQ ID NO: 8326563 - DNA, 22 bp, Homo sapiens
ctgtgatgttagctctgtgtta

SEQ ID NO: 8326564 - DNA, 22 bp, Homo sapiens
atcatgctgacacagtttatct

SEQ ID NO: 8326565 - DNA, 22 bp, Homo sapiens
atcacattatgtagtgaaaagg

SEQ ID NO: 8326566 - DNA, 22 bp, Homo sapiens
ctgtctttagtacaaaaaatgt

SEQ ID NO: 8326567 - DNA, 18 bp, Homo sapiens
ctgtcttttttctctcca

SEQ ID NO: 8326568 - DNA, 22 bp, Homo sapiens
ctgggtcccctcagtgacactg

SEQ ID NO: 8326569 - DNA, 22 bp, Homo sapiens
atatttgtcaattcactgttca

SEQ ID NO: 8326570 - DNA, 22 bp, Homo sapiens
atcacagttactcaaataatga

SEQ ID NO: 8326571 - DNA, 22 bp, Homo sapiens
atcacatcacaggttgagctag

SEQ ID NO: 8326572 - DNA, 22 bp, Homo sapiens
atcacatctcaccactgcaacc

SEQ ID NO: 8326573 - DNA, 22 bp, Homo sapiens
ctgtcctccagacgacagtccc

SEQ ID NO: 8326574 - DNA, 22 bp, Homo sapiens
ctgtcctccggccacctacagt

SEQ ID NO: 8326575 - DNA, 22 bp, Homo sapiens
ctgtcctcaccttggcaggggg

SEQ ID NO: 8326576 - DNA, 22 bp, Homo sapiens
ctgtcctcaacccatccttctc

SEQ ID NO: 8326577 - DNA, 22 bp, Homo sapiens
atcatttttaagagactcttct

SEQ ID NO: 8326578 - DNA, 22 bp, Homo sapiens
atcattttgtgacaatgcctgt

SEQ ID NO: 8326579 - DNA, 22 bp, Homo sapiens
atccaatggggagtgagttctt

SEQ ID NO: 8326580 - DNA, 22 bp, Homo sapiens
atcctaaaattgttcaatttct

SEQ ID NO: 8326581 - DNA, 22 bp, Homo sapiens
atcctaaagaaatatttattaa

SEQ ID NO: 8326582 - DNA, 22 bp, Homo sapiens
atcctcagacctcagcaaagcc

SEQ ID NO: 8326583 - DNA, 22 bp, Homo sapiens
atcctcagtgtttctgacatct

SEQ ID NO: 8326584 - DNA, 22 bp, Homo sapiens
atcctcagcatctagcatgaag

SEQ ID NO: 8326585 - DNA, 22 bp, Homo sapiens
atcctttaagttaataaaattc

SEQ ID NO: 8326586 - DNA, 22 bp, Homo sapiens
atccccagggaggcctgacctg

SEQ ID NO: 8326587 - DNA, 22 bp, Homo sapiens
ataaatctattggacatgtgtg

SEQ ID NO: 8326588 - DNA, 22 bp, Homo sapiens
atacaagtcaatccatgtgatt

SEQ ID NO: 8326589 - DNA, 22 bp, Homo sapiens
atacaagtgagaaaactgaaga

SEQ ID NO: 8326590 - DNA, 22 bp, Homo sapiens
atacaagtgatataattgtttc

SEQ ID NO: 8326591 - DNA, 22 bp, Homo sapiens
ataatattgagtcaggacctga

SEQ ID NO: 8326592 - DNA, 22 bp, Homo sapiens
ataatatttgcattactgtgat

SEQ ID NO: 8326593 - DNA, 22 bp, Homo sapiens
ataatatttgcattactgtgat

SEQ ID NO: 8326594 - DNA, 22 bp, Homo sapiens
ataatcaaagtcctatgacatc

SEQ ID NO: 8326595 - DNA, 22 bp, Homo sapiens
ctggagccccagacagggagag

SEQ ID NO: 8326596 - DNA, 17 bp, Homo sapiens
ctggagccaagagggcc

SEQ ID NO: 8326597 - DNA, 22 bp, Homo sapiens
atacaagttaatgagaatgaca

SEQ ID NO: 8326598 - DNA, 22 bp, Homo sapiens
atacaagtgttgtgcctcatca

SEQ ID NO: 8326599 - DNA, 22 bp, Homo sapiens
atacaagttaaatgcagtgccc

SEQ ID NO: 8326600 - DNA, 22 bp, Homo sapiens
atacaagtggccacttgaattc

SEQ ID NO: 8326601 - DNA, 22 bp, Homo sapiens
atacaagtgctgaccctgggat

SEQ ID NO: 8326602 - DNA, 22 bp, Homo sapiens
ctggagggaggaggctgctatt

SEQ ID NO: 8326603 - DNA, 22 bp, Homo sapiens
ctggagggaggaggctgctatt

SEQ ID NO: 8326604 - DNA, 22 bp, Homo sapiens
ctggagggagttaggacccgga

SEQ ID NO: 8326605 - DNA, 22 bp, Homo sapiens
ctggagggatgtagggtgtatt

SEQ ID NO: 8326606 - DNA, 22 bp, Homo sapiens
ctggagggatgtagggtgtatt

SEQ ID NO: 8326607 - DNA, 22 bp, Homo sapiens
ctggagggatgtagggtgtatt

SEQ ID NO: 8326608 - DNA, 22 bp, Homo sapiens
ctggagggagttaggacccgga

SEQ ID NO: 8326609 - DNA, 22 bp, Homo sapiens
ctggagggagattcaaaggagg

SEQ ID NO: 8326610 - DNA, 22 bp, Homo sapiens
ctggagggagattcaaaggagg

SEQ ID NO: 8326611 - DNA, 22 bp, Homo sapiens
ctggaggaaaacaactgcagac

SEQ ID NO: 8326612 - DNA, 22 bp, Homo sapiens
atacagatcccacagcatgtga

SEQ ID NO: 8326613 - DNA, 22 bp, Homo sapiens
atacagatgcttgctcgtgact

SEQ ID NO: 8326614 - DNA, 22 bp, Homo sapiens
atacagatgagatcaggcataa

SEQ ID NO: 8326615 - DNA, 22 bp, Homo sapiens
ctggcagctctactcagagcct

SEQ ID NO: 8326616 - DNA, 22 bp, Homo sapiens
atactttagagctagattgcct

SEQ ID NO: 8326617 - DNA, 22 bp, Homo sapiens
atacttgaggttgtataaatat

SEQ ID NO: 8326618 - DNA, 22 bp, Homo sapiens
ctggagtgaggtctgggagcct

SEQ ID NO: 8326619 - DNA, 22 bp, Homo sapiens
ctggagggctgcagcgaggctg

SEQ ID NO: 8326620 - DNA, 22 bp, Homo sapiens
ctggagggctgcagcgaggctg

SEQ ID NO: 8326621 - DNA, 21 bp, Homo sapiens
ctggagtctgggggtggcagt

SEQ ID NO: 8326622 - DNA, 22 bp, Homo sapiens
ctggagtcttcagcttgctgcc

SEQ ID NO: 8326623 - DNA, 22 bp, Homo sapiens
ataaaagtaggaccaacttaca

SEQ ID NO: 8326624 - DNA, 22 bp, Homo sapiens
ataaaagtaggaccaacttaca

SEQ ID NO: 8326625 - DNA, 22 bp, Homo sapiens
ctgccaggcctcatcccagcca

SEQ ID NO: 8326626 - DNA, 22 bp, Homo sapiens
ctgccaggcagggagatggctg

SEQ ID NO: 8326627 - DNA, 22 bp, Homo sapiens
ctgccaggactgacgtcttcag

SEQ ID NO: 8326628 - DNA, 22 bp, Homo sapiens
ctgccaaaaggtgcacctgctg

SEQ ID NO: 8326629 - DNA, 22 bp, Homo sapiens
ctgccaggcacgtgcagcatca

SEQ ID NO: 8326630 - DNA, 22 bp, Homo sapiens
ctgccaggcactgggctctgca

SEQ ID NO: 8326631 - DNA, 22 bp, Homo sapiens
ctgccaggattctgtgaacccc

SEQ ID NO: 8326632 - DNA, 20 bp, Homo sapiens
ataaaataactgccacaaga

SEQ ID NO: 8326633 - DNA, 20 bp, Homo sapiens
ataaaataactgccacaaga

SEQ ID NO: 8326634 - DNA, 22 bp, Homo sapiens
ataaaagtttccaatcatgcct

SEQ ID NO: 8326635 - DNA, 22 bp, Homo sapiens
ataaaagttcaagagagtacag

SEQ ID NO: 8326636 - DNA, 20 bp, Homo sapiens
ataaaataactgccacaaga

SEQ ID NO: 8326637 - DNA, 22 bp, Homo sapiens
ataaatagtgtgtcataaagtc

SEQ ID NO: 8326638 - DNA, 22 bp, Homo sapiens
ataaatatcactgttgtccctc

SEQ ID NO: 8326639 - DNA, 22 bp, Homo sapiens
ataaatagtgtgtcataaagtc

SEQ ID NO: 8326640 - DNA, 22 bp, Homo sapiens
agtttgatttgtctatcttcat

SEQ ID NO: 8326641 - DNA, 22 bp, Homo sapiens
agtttaaatcatgttttgtaac

SEQ ID NO: 8326642 - DNA, 22 bp, Homo sapiens
agtttaattggaggcgtggctc

SEQ ID NO: 8326643 - DNA, 22 bp, Homo sapiens
agtttaatatccttcaactttc

SEQ ID NO: 8326644 - DNA, 22 bp, Homo sapiens
agtttaatcctccagcccaact

SEQ ID NO: 8326645 - DNA, 22 bp, Homo sapiens
agtttaatcctccagcccaact

SEQ ID NO: 8326646 - DNA, 22 bp, Homo sapiens
ctgaggcctctgttcaccagaa

SEQ ID NO: 8326647 - DNA, 22 bp, Homo sapiens
ctgaggctgggctgagggtata

SEQ ID NO: 8326648 - DNA, 22 bp, Homo sapiens
ctgaggcttggaggggtctggt

SEQ ID NO: 8326649 - DNA, 22 bp, Homo sapiens
ctgaggcttgtcctctcagctt

SEQ ID NO: 8326650 - DNA, 22 bp, Homo sapiens
ctgaggcttgtcctctcagctt

SEQ ID NO: 8326651 - DNA, 22 bp, Homo sapiens
ctgaggctttgtgtgcatgcct

SEQ ID NO: 8326652 - DNA, 22 bp, Homo sapiens
ctgaggggtatccaaggggtaa

SEQ ID NO: 8326653 - DNA, 22 bp, Homo sapiens
ctgagggtcaacttgattgtat

SEQ ID NO: 8326654 - DNA, 22 bp, Homo sapiens
ctgaggtattttattgggctag

SEQ ID NO: 8326655 - DNA, 22 bp, Homo sapiens
ctgaggtattgggaagtggact

SEQ ID NO: 8326656 - DNA, 20 bp, Homo sapiens
ctgaggtagggcagatcacc

SEQ ID NO: 8326657 - DNA, 22 bp, Homo sapiens
ctgaggtagggacgtgccgtag

SEQ ID NO: 8326658 - DNA, 22 bp, Homo sapiens
ctgaggtagctgtgaatgttct

SEQ ID NO: 8326659 - DNA, 22 bp, Homo sapiens
ctgaggtagccatggcccaagt

SEQ ID NO: 8326660 - DNA, 22 bp, Homo sapiens
ctgaggtagtcattttctactc

SEQ ID NO: 8326661 - DNA, 22 bp, Homo sapiens
ctgaggtatgtgggactagcct

SEQ ID NO: 8326662 - DNA, 22 bp, Homo sapiens
ctgaggtattgaagtatcttct

SEQ ID NO: 8326663 - DNA, 22 bp, Homo sapiens
ctgaggtagaggaaatgtagct

SEQ ID NO: 8326664 - DNA, 22 bp, Homo sapiens
ctgaggtacgctggctccctgg

SEQ ID NO: 8326665 - DNA, 22 bp, Homo sapiens
ctgaggtacctggagcaggtcc

SEQ ID NO: 8326666 - DNA, 22 bp, Homo sapiens
ctgaggtacaagaaaggcacct

SEQ ID NO: 8326667 - DNA, 22 bp, Homo sapiens
ctgaggtaaaatttctattttg

SEQ ID NO: 8326668 - DNA, 22 bp, Homo sapiens
ctgaggtaattttccagataat

SEQ ID NO: 8326669 - DNA, 23 bp, Homo sapiens
ctgaggtaaaatattctgaagga

SEQ ID NO: 8326670 - DNA, 22 bp, Homo sapiens
agttgtaagaggcacaaggaag

SEQ ID NO: 8326671 - DNA, 22 bp, Homo sapiens
agttgtaataacaataccaaaa

SEQ ID NO: 8326672 - DNA, 22 bp, Homo sapiens
agttgtaagagacagatataaa

SEQ ID NO: 8326673 - DNA, 22 bp, Homo sapiens
ctgaggcatcatggagaacagt

SEQ ID NO: 8326674 - DNA, 22 bp, Homo sapiens
ctgaggcctaagacatgaatga

SEQ ID NO: 8326675 - DNA, 22 bp, Homo sapiens
agttctttaacgagtaagattt

SEQ ID NO: 8326676 - DNA, 21 bp, Homo sapiens
ctctttgggatctttggaaag

SEQ ID NO: 8326677 - DNA, 16 bp, Homo sapiens
ctctttgggcttccag

SEQ ID NO: 8326678 - DNA, 22 bp, Homo sapiens
ctctttgggatgggctctgctg

SEQ ID NO: 8326679 - DNA, 22 bp, Homo sapiens
ctctttggtcgcatcatccatt

SEQ ID NO: 8326680 - DNA, 22 bp, Homo sapiens
ctctttggggtgccccactggt

SEQ ID NO: 8326681 - DNA, 22 bp, Homo sapiens
ctctttggggctggaagcctag

SEQ ID NO: 8326682 - DNA, 22 bp, Homo sapiens
ctcagtgttaaagactttccag

SEQ ID NO: 8326683 - DNA, 20 bp, Homo sapiens
ctcagtgtggcctgagtgtt

SEQ ID NO: 8326684 - DNA, 22 bp, Homo sapiens
ctcagtgtcttatttgagttct

SEQ ID NO: 8326685 - DNA, 22 bp, Homo sapiens
ctcagtggttgagagcctgggc

SEQ ID NO: 8326686 - DNA, 22 bp, Homo sapiens
ctcagtgtcacgttttgcctta

SEQ ID NO: 8326687 - DNA, 22 bp, Homo sapiens
ctcaggccaataagctccagcc

SEQ ID NO: 8326688 - DNA, 22 bp, Homo sapiens
ctcagggacgttagaggacagg

SEQ ID NO: 8326689 - DNA, 22 bp, Homo sapiens
ctcagggacttggatcctggcc

SEQ ID NO: 8326690 - DNA, 22 bp, Homo sapiens
ctcagggaggccctgggaccct

SEQ ID NO: 8326691 - DNA, 22 bp, Homo sapiens
ctcagggaggagcttctgggcc

SEQ ID NO: 8326692 - DNA, 22 bp, Homo sapiens
agtctcagagtacctgagggac

SEQ ID NO: 8326693 - DNA, 22 bp, Homo sapiens
agtctcagcaagcatggctagt

SEQ ID NO: 8326694 - DNA, 22 bp, Homo sapiens
ctcaaatatgtggtcagaaagc

SEQ ID NO: 8326695 - DNA, 22 bp, Homo sapiens
ctcaaatacctctccatgtgac

SEQ ID NO: 8326696 - DNA, 22 bp, Homo sapiens
ctcaaatatgtggtcagaaagc

SEQ ID NO: 8326697 - DNA, 22 bp, Homo sapiens
ctcaaatagaactgatctataa

SEQ ID NO: 8326698 - DNA, 22 bp, Homo sapiens
ctcaaatagaactgatctataa

SEQ ID NO: 8326699 - DNA, 22 bp, Homo sapiens
ctcaaatataagctaaatgtgg

SEQ ID NO: 8326700 - DNA, 22 bp, Homo sapiens
ctcaaactgtgcttgtaaattc

SEQ ID NO: 8326701 - DNA, 22 bp, Homo sapiens
ctcaaaatggttaattttaata

SEQ ID NO: 8326702 - DNA, 22 bp, Homo sapiens
cggggtgggaatagacctgtct

SEQ ID NO: 8326703 - DNA, 22 bp, Homo sapiens
cggggtgggaatagacctgtct

SEQ ID NO: 8326704 - DNA, 22 bp, Homo sapiens
cggggttcatccatgctgtggc

SEQ ID NO: 8326705 - DNA, 22 bp, Homo sapiens
cggggttcatccatgctgtggc

SEQ ID NO: 8326706 - DNA, 22 bp, Homo sapiens
cgggttcacgccattctcctgc

SEQ ID NO: 8326707 - DNA, 22 bp, Homo sapiens
cgggttcacgccattctcctgc

SEQ ID NO: 8326708 - DNA, 22 bp, Homo sapiens
cgggggcacccacaaatgagga

SEQ ID NO: 8326709 - DNA, 22 bp, Homo sapiens
ctcagacacagccccacgaagt

SEQ ID NO: 8326710 - DNA, 22 bp, Homo sapiens
ctcttggccagacacagaggca

SEQ ID NO: 8326711 - DNA, 20 bp, Homo sapiens
ctcttggcagattacctgtc

SEQ ID NO: 8326712 - DNA, 22 bp, Homo sapiens
ctctttggcgttggcagagcca

SEQ ID NO: 8326713 - DNA, 22 bp, Homo sapiens
ctctttggctttgactcccatt

SEQ ID NO: 8326714 - DNA, 16 bp, Homo sapiens
ctctttggcttccaag

SEQ ID NO: 8326715 - DNA, 19 bp, Homo sapiens
ctcttgggtggcagaggcc

SEQ ID NO: 8326716 - DNA, 22 bp, Homo sapiens
agtggtgctgcgcgcggagctc

SEQ ID NO: 8326717 - DNA, 22 bp, Homo sapiens
agtggtgcaaactggggcagct

SEQ ID NO: 8326718 - DNA, 22 bp, Homo sapiens
agtggtgtcgtgggagtggaag

SEQ ID NO: 8326719 - DNA, 22 bp, Homo sapiens
agtgtaagtgatcattgatagt

SEQ ID NO: 8326720 - DNA, 22 bp, Homo sapiens
ctctggagaacgctatggatct

SEQ ID NO: 8326721 - DNA, 19 bp, Homo sapiens
ctctggagaacaatagtgc

SEQ ID NO: 8326722 - DNA, 22 bp, Homo sapiens
agtgggaaactggagagacttc

SEQ ID NO: 8326723 - DNA, 18 bp, Homo sapiens
ctccttggagaagaggcc

SEQ ID NO: 8326724 - DNA, 23 bp, Homo sapiens
ctccttggtatgccatgcccagc

SEQ ID NO: 8326725 - DNA, 22 bp, Homo sapiens
ctcctgaggggacaggactcat

SEQ ID NO: 8326726 - DNA, 22 bp, Homo sapiens
ctcctggtgctggggctgccgc

SEQ ID NO: 8326727 - DNA, 22 bp, Homo sapiens
agtgctggaaagggacggagga

SEQ ID NO: 8326728 - DNA, 22 bp, Homo sapiens
agtgctggaaagggacggagga

SEQ ID NO: 8326729 - DNA, 22 bp, Homo sapiens
agtgctggattacaggcgtgag

SEQ ID NO: 8326730 - DNA, 22 bp, Homo sapiens
agtgctggattacaggcgtgag

SEQ ID NO: 8326731 - DNA, 22 bp, Homo sapiens
agtgctggagggaggcaggttc

SEQ ID NO: 8326732 - DNA, 22 bp, Homo sapiens
agtgctggagggaggcaggttc

SEQ ID NO: 8326733 - DNA, 22 bp, Homo sapiens
agtgctggagggaggcaggttc

SEQ ID NO: 8326734 - DNA, 22 bp, Homo sapiens
agtgctgggattacaggcataa

SEQ ID NO: 8326735 - DNA, 22 bp, Homo sapiens
ctctccattccctacagttttc

SEQ ID NO: 8326736 - DNA, 23 bp, Homo sapiens
ctctccaccttcccacccaggga

SEQ ID NO: 8326737 - DNA, 22 bp, Homo sapiens
agtgctgggattgcaggcatga

SEQ ID NO: 8326738 - DNA, 21 bp, Homo sapiens
cctggccaatctgatagggtt

SEQ ID NO: 8326739 - DNA, 20 bp, Homo sapiens
cctggccaatgagataggaa

SEQ ID NO: 8326740 - DNA, 22 bp, Homo sapiens
cctggctctgtcctcgcgcaaa

SEQ ID NO: 8326741 - DNA, 19 bp, Homo sapiens
cctggctgctgtgggatgc

SEQ ID NO: 8326742 - DNA, 22 bp, Homo sapiens
cctggctggttgtctgattcta

SEQ ID NO: 8326743 - DNA, 23 bp, Homo sapiens
cctggctggattctctgcattca

SEQ ID NO: 8326744 - DNA, 17 bp, Homo sapiens
cctggctgggaatctga

SEQ ID NO: 8326745 - DNA, 22 bp, Homo sapiens
cctggctgggcctgatttctca

SEQ ID NO: 8326746 - DNA, 22 bp, Homo sapiens
cctgctctgccaagtcctcttt

SEQ ID NO: 8326747 - DNA, 22 bp, Homo sapiens
cctgcctggcttccagaagaga

SEQ ID NO: 8326748 - DNA, 22 bp, Homo sapiens
cctgcctggcttccagaagaga

SEQ ID NO: 8326749 - DNA, 22 bp, Homo sapiens
cctgctgctatgaaggtgacag

SEQ ID NO: 8326750 - DNA, 22 bp, Homo sapiens
cctctctctcctgcacacacac

SEQ ID NO: 8326751 - DNA, 22 bp, Homo sapiens
cctctctccttcctttgccaaa

SEQ ID NO: 8326752 - DNA, 22 bp, Homo sapiens
cctctctccaattttcacctca

SEQ ID NO: 8326753 - DNA, 22 bp, Homo sapiens
cctctgccacctcccacgaggc

SEQ ID NO: 8326754 - DNA, 22 bp, Homo sapiens
cctctgccacctcccacgaggc

SEQ ID NO: 8326755 - DNA, 22 bp, Homo sapiens
cctgcccagcttcacctcaggc

SEQ ID NO: 8326756 - DNA, 22 bp, Homo sapiens
cctgcccagcttcccgagtgca

SEQ ID NO: 8326757 - DNA, 22 bp, Homo sapiens
cctgccctatgaccagcttcac

SEQ ID NO: 8326758 - DNA, 22 bp, Homo sapiens
cctgcccagggtcaccacagag

SEQ ID NO: 8326759 - DNA, 22 bp, Homo sapiens
cctgcccccgtcagaggtgatg

SEQ ID NO: 8326760 - DNA, 20 bp, Homo sapiens
agggtcagtagcacagagct

SEQ ID NO: 8326761 - DNA, 22 bp, Homo sapiens
agggtctcagagcctgagaacc

SEQ ID NO: 8326762 - DNA, 22 bp, Homo sapiens
agggtctctacgcactagaggg

SEQ ID NO: 8326763 - DNA, 21 bp, Homo sapiens
agggtcaggaaccagggtacc

SEQ ID NO: 8326764 - DNA, 20 bp, Homo sapiens
agggtcagagagcgtgagtg

SEQ ID NO: 8326765 - DNA, 22 bp, Homo sapiens
agggtctctggagagctgagga

SEQ ID NO: 8326766 - DNA, 22 bp, Homo sapiens
agggtctctgggagtagggcac

SEQ ID NO: 8326767 - DNA, 22 bp, Homo sapiens
agggtctgttgtttgttctgga

SEQ ID NO: 8326768 - DNA, 22 bp, Homo sapiens
cctgggagaactgctgggttgg

SEQ ID NO: 8326769 - DNA, 22 bp, Homo sapiens
aggtgctggcgccccaggagac

SEQ ID NO: 8326770 - DNA, 22 bp, Homo sapiens
aggtgctggagtctgggcagga

SEQ ID NO: 8326771 - DNA, 22 bp, Homo sapiens
aggtgctgaactggtgaggtct

SEQ ID NO: 8326772 - DNA, 22 bp, Homo sapiens
aggtggcagttgtggaaccatc

SEQ ID NO: 8326773 - DNA, 22 bp, Homo sapiens
aggtgctgtttgtcagcagttt

SEQ ID NO: 8326774 - DNA, 22 bp, Homo sapiens
aggtgctgttggcagcgggcag

SEQ ID NO: 8326775 - DNA, 22 bp, Homo sapiens
aggtgctgggcagcagtcattg

SEQ ID NO: 8326776 - DNA, 22 bp, Homo sapiens
aggtggctttactgtttcttac

SEQ ID NO: 8326777 - DNA, 21 bp, Homo sapiens
aggtggctgcatcctcagaag

SEQ ID NO: 8326778 - DNA, 22 bp, Homo sapiens
ccttgctcaagctagtgacggg

SEQ ID NO: 8326779 - DNA, 22 bp, Homo sapiens
agtatatttgttaagattattc

SEQ ID NO: 8326780 - DNA, 22 bp, Homo sapiens
agtatattggtgttattcctca

SEQ ID NO: 8326781 - DNA, 22 bp, Homo sapiens
agtatattgctcttaatcatag

SEQ ID NO: 8326782 - DNA, 19 bp, Homo sapiens
cggcccctcctctcgcgcc

SEQ ID NO: 8326783 - DNA, 22 bp, Homo sapiens
agtaggtatgatggtgacttga

SEQ ID NO: 8326784 - DNA, 22 bp, Homo sapiens
cggagaggtgggggcagcatct

SEQ ID NO: 8326785 - DNA, 22 bp, Homo sapiens
cggagctgcctgccaagcctgc

SEQ ID NO: 8326786 - DNA, 22 bp, Homo sapiens
cggagctgcgccgggacacggg

SEQ ID NO: 8326787 - DNA, 22 bp, Homo sapiens
cggagctggcgtctgtgtggac

SEQ ID NO: 8326788 - DNA, 21 bp, Homo sapiens
cggagctgggcagggcatccc

SEQ ID NO: 8326789 - DNA, 22 bp, Homo sapiens
cggccaagccggggccccgaag

SEQ ID NO: 8326790 - DNA, 22 bp, Homo sapiens
cggaggggtttgaacagaggag

SEQ ID NO: 8326791 - DNA, 22 bp, Homo sapiens
cggaggggtttgaacagaggag

SEQ ID NO: 8326792 - DNA, 22 bp, Homo sapiens
cggaggggatacattttctgaa

SEQ ID NO: 8326793 - DNA, 22 bp, Homo sapiens
aggtgggggctgtgtccttgac

SEQ ID NO: 8326794 - DNA, 19 bp, Homo sapiens
cctttggtttccatgacat

SEQ ID NO: 8326795 - DNA, 19 bp, Homo sapiens
cctttggtttttggttcat

SEQ ID NO: 8326796 - DNA, 22 bp, Homo sapiens
cctttgttcactggagagtgga

SEQ ID NO: 8326797 - DNA, 22 bp, Homo sapiens
cctttggtgttattgggagaca

SEQ ID NO: 8326798 - DNA, 22 bp, Homo sapiens
cctttggttgagtgaaagtaag

SEQ ID NO: 8326799 - DNA, 22 bp, Homo sapiens
cctttggtggttttcagagatc

SEQ ID NO: 8326800 - DNA, 22 bp, Homo sapiens
cctttggtcttgatgaactgtt

SEQ ID NO: 8326801 - DNA, 22 bp, Homo sapiens
cctttggtggcttcaaaatggc

SEQ ID NO: 8326802 - DNA, 22 bp, Homo sapiens
cctttggtcacctccactctta

SEQ ID NO: 8326803 - DNA, 22 bp, Homo sapiens
ccttttatagatcagtgtgtta

SEQ ID NO: 8326804 - DNA, 22 bp, Homo sapiens
ccttttatgaacttgagcaggt

SEQ ID NO: 8326805 - DNA, 22 bp, Homo sapiens
cctcccagtgcctccagagcag

SEQ ID NO: 8326806 - DNA, 22 bp, Homo sapiens
cctcccagtgccggggccggct

SEQ ID NO: 8326807 - DNA, 22 bp, Homo sapiens
cctcccagtgcctccagagcag

SEQ ID NO: 8326808 - DNA, 23 bp, Homo sapiens
cctcccaggctgcgagtcccgag

SEQ ID NO: 8326809 - DNA, 22 bp, Homo sapiens
cctccaggaacttgagagacac

SEQ ID NO: 8326810 - DNA, 22 bp, Homo sapiens
cctcaagttggaaataaaatgt

SEQ ID NO: 8326811 - DNA, 22 bp, Homo sapiens
cctcaaattgtcaaataagaat

SEQ ID NO: 8326812 - DNA, 22 bp, Homo sapiens
cctcaaattggcattaattaag

SEQ ID NO: 8326813 - DNA, 22 bp, Homo sapiens
cctcaaatctttagagttattt

SEQ ID NO: 8326814 - DNA, 22 bp, Homo sapiens
cctcaaattgctcagcgtctag

SEQ ID NO: 8326815 - DNA, 23 bp, Homo sapiens
cctcaaatgtagcctttttccca

SEQ ID NO: 8326816 - DNA, 22 bp, Homo sapiens
ccctgtggttgctagggcacag

SEQ ID NO: 8326817 - DNA, 22 bp, Homo sapiens
ccctgtttatttttggagagaa

SEQ ID NO: 8326818 - DNA, 22 bp, Homo sapiens
cccttacatcagctccttcacc

SEQ ID NO: 8326819 - DNA, 22 bp, Homo sapiens
cctagacattaagcttgggttt

SEQ ID NO: 8326820 - DNA, 22 bp, Homo sapiens
cctcaaatagcccccagtctag

SEQ ID NO: 8326821 - DNA, 20 bp, Homo sapiens
cctcaaataagtgccagcat

SEQ ID NO: 8326822 - DNA, 22 bp, Homo sapiens
ccctggggagcaggcgaaggag

SEQ ID NO: 8326823 - DNA, 22 bp, Homo sapiens
ccctggggctgagggatggccg

SEQ ID NO: 8326824 - DNA, 22 bp, Homo sapiens
ccctggggctgagggatggccg

SEQ ID NO: 8326825 - DNA, 22 bp, Homo sapiens
agggcagccattgagggattct

SEQ ID NO: 8326826 - DNA, 22 bp, Homo sapiens
agggcagcattgcctttctcca

SEQ ID NO: 8326827 - DNA, 22 bp, Homo sapiens
agggcagcagctgtccctgaga

SEQ ID NO: 8326828 - DNA, 22 bp, Homo sapiens
agggcagcagctcctcctagct

SEQ ID NO: 8326829 - DNA, 22 bp, Homo sapiens
agggcagcggtgcttgtgttat

SEQ ID NO: 8326830 - DNA, 22 bp, Homo sapiens
agggcagcctctcagcctaggt

SEQ ID NO: 8326831 - DNA, 22 bp, Homo sapiens
agggcagctgtgagccactgtg

SEQ ID NO: 8326832 - DNA, 22 bp, Homo sapiens
agggcagctctcacctctggcc

SEQ ID NO: 8326833 - DNA, 22 bp, Homo sapiens
ccccagcacttggagtggggag

SEQ ID NO: 8326834 - DNA, 22 bp, Homo sapiens
agggagagtttgatgtttcctc

SEQ ID NO: 8326835 - DNA, 18 bp, Homo sapiens
agggagcatctggttgcc

SEQ ID NO: 8326836 - DNA, 22 bp, Homo sapiens
agggagcagggctcctttgggt

SEQ ID NO: 8326837 - DNA, 22 bp, Homo sapiens
ccccatgaagtagggtctctga

SEQ ID NO: 8326838 - DNA, 22 bp, Homo sapiens
ccccatgaagtagggtctctga

SEQ ID NO: 8326839 - DNA, 22 bp, Homo sapiens
ccccagggtcagtgtgtggagg

SEQ ID NO: 8326840 - DNA, 22 bp, Homo sapiens
ccccagcagactcagggcaggt

SEQ ID NO: 8326841 - DNA, 22 bp, Homo sapiens
ccccagggaagctttgcttact

SEQ ID NO: 8326842 - DNA, 22 bp, Homo sapiens
ccccagcacttggagtggggag

SEQ ID NO: 8326843 - DNA, 22 bp, Homo sapiens
ccccagggactggtttcatgga

SEQ ID NO: 8326844 - DNA, 22 bp, Homo sapiens
agggaaggaggccatgtgtccc

SEQ ID NO: 8326845 - DNA, 22 bp, Homo sapiens
agggaaggtagaggtcaccggc

SEQ ID NO: 8326846 - DNA, 22 bp, Homo sapiens
aggctgtgtggtcatggtggct

SEQ ID NO: 8326847 - DNA, 22 bp, Homo sapiens
aggctgttttgtataaactgga

SEQ ID NO: 8326848 - DNA, 18 bp, Homo sapiens
cccagcctctcctttcta

SEQ ID NO: 8326849 - DNA, 22 bp, Homo sapiens
ccatctccaaataccatcacat

SEQ ID NO: 8326850 - DNA, 22 bp, Homo sapiens
ccagtttttccagtgctttctg

SEQ ID NO: 8326851 - DNA, 22 bp, Homo sapiens
ccagttttgccatggtaacact

SEQ ID NO: 8326852 - DNA, 22 bp, Homo sapiens
ccataatcgtgtgttaaataat

SEQ ID NO: 8326853 - DNA, 22 bp, Homo sapiens
ccataatctggctttgagagag

SEQ ID NO: 8326854 - DNA, 22 bp, Homo sapiens
ccatctggatctgtccactgac

SEQ ID NO: 8326855 - DNA, 22 bp, Homo sapiens
cccagcagtaaccagtggaaat

SEQ ID NO: 8326856 - DNA, 22 bp, Homo sapiens
cccagcagtgacccagtgatac

SEQ ID NO: 8326857 - DNA, 22 bp, Homo sapiens
cccagcagttgttggtgcacat

SEQ ID NO: 8326858 - DNA, 22 bp, Homo sapiens
aggctgaggcaggtggatcatt

SEQ ID NO: 8326859 - DNA, 22 bp, Homo sapiens
aggctgaggcaggtggatcact

SEQ ID NO: 8326860 - DNA, 22 bp, Homo sapiens
ccagtttaagacttatctcaat

SEQ ID NO: 8326861 - DNA, 22 bp, Homo sapiens
ccagtttaggacacatgcccac

SEQ ID NO: 8326862 - DNA, 22 bp, Homo sapiens
ccagtttaggtactaggctcta

SEQ ID NO: 8326863 - DNA, 23 bp, Homo sapiens
ccagtttatctttagtgtagatc

SEQ ID NO: 8326864 - DNA, 22 bp, Homo sapiens
ccagtttataagaaagaaaacc

SEQ ID NO: 8326865 - DNA, 22 bp, Homo sapiens
aggctgaggcgggaggatcact

SEQ ID NO: 8326866 - DNA, 23 bp, Homo sapiens
ccagtgattgcctggaaggaggt

SEQ ID NO: 8326867 - DNA, 22 bp, Homo sapiens
ccagtctgtactttgctctgtt

SEQ ID NO: 8326868 - DNA, 22 bp, Homo sapiens
aggctgagataggtggatcatt

SEQ ID NO: 8326869 - DNA, 22 bp, Homo sapiens
aggctgagagcaacgtgtcaga

SEQ ID NO: 8326870 - DNA, 22 bp, Homo sapiens
aggctctgatcaggtggctgtg

SEQ ID NO: 8326871 - DNA, 22 bp, Homo sapiens
aggctccataccatctccggag

SEQ ID NO: 8326872 - DNA, 22 bp, Homo sapiens
aggctccattcatgtgaaggca

SEQ ID NO: 8326873 - DNA, 22 bp, Homo sapiens
aggcctcagttcttgccaggtg

SEQ ID NO: 8326874 - DNA, 22 bp, Homo sapiens
aggcctcagctcagtgtgacag

SEQ ID NO: 8326875 - DNA, 22 bp, Homo sapiens
aggcctcagtttgtcatctgta

SEQ ID NO: 8326876 - DNA, 22 bp, Homo sapiens
ccactggcttttcctaggtctc

SEQ ID NO: 8326877 - DNA, 22 bp, Homo sapiens
ccactggcatccagctgccatc

SEQ ID NO: 8326878 - DNA, 22 bp, Homo sapiens
ccactggctgtcagcaggactc

SEQ ID NO: 8326879 - DNA, 22 bp, Homo sapiens
ccactggcagttggctagcctt

SEQ ID NO: 8326880 - DNA, 22 bp, Homo sapiens
ccactggcaaccccgcctcata

SEQ ID NO: 8326881 - DNA, 22 bp, Homo sapiens
ccactggagactggtctctgtg

SEQ ID NO: 8326882 - DNA, 22 bp, Homo sapiens
aggccaagtgaacaatgctagt

SEQ ID NO: 8326883 - DNA, 22 bp, Homo sapiens
aggccaagggcaaagcggagag

SEQ ID NO: 8326884 - DNA, 22 bp, Homo sapiens
aggccaagtagccgctgtccta

SEQ ID NO: 8326885 - DNA, 22 bp, Homo sapiens
aggccaagtgaacaatgctagt

SEQ ID NO: 8326886 - DNA, 22 bp, Homo sapiens
aggccaagttacttgggaaagc

SEQ ID NO: 8326887 - DNA, 22 bp, Homo sapiens
aggccaagattttggatcagct

SEQ ID NO: 8326888 - DNA, 22 bp, Homo sapiens
aggccaagattttggatcagct

SEQ ID NO: 8326889 - DNA, 22 bp, Homo sapiens
aggccaagctcccagagaagct

SEQ ID NO: 8326890 - DNA, 22 bp, Homo sapiens
aggccagctcaccctggctcct

SEQ ID NO: 8326891 - DNA, 22 bp, Homo sapiens
aggccagatgtcgggctagaag

SEQ ID NO: 8326892 - DNA, 22 bp, Homo sapiens
aggccctggtcaggtctggctg

SEQ ID NO: 8326893 - DNA, 22 bp, Homo sapiens
aggcccagtgtggcttcctgga

SEQ ID NO: 8326894 - DNA, 22 bp, Homo sapiens
aggcccagttatcctacttgtt

SEQ ID NO: 8326895 - DNA, 20 bp, Homo sapiens
aggccccaggaaactctcag

SEQ ID NO: 8326896 - DNA, 22 bp, Homo sapiens
aggccccaaagcagtgcaagta

SEQ ID NO: 8326897 - DNA, 22 bp, Homo sapiens
aggcccagtagtgctgccttta

SEQ ID NO: 8326898 - DNA, 22 bp, Homo sapiens
aggcccagtcctctgccgtctg

SEQ ID NO: 8326899 - DNA, 20 bp, Homo sapiens
aggcccagtgaatatattgc

SEQ ID NO: 8326900 - DNA, 22 bp, Homo sapiens
aggcccagtgccattagttttg

SEQ ID NO: 8326901 - DNA, 22 bp, Homo sapiens
aggcccagctgggccaggaaca

SEQ ID NO: 8326902 - DNA, 22 bp, Homo sapiens
aggcccagtagtcgacggcgct

SEQ ID NO: 8326903 - DNA, 22 bp, Homo sapiens
aggagctgataaaagggggtca

SEQ ID NO: 8326904 - DNA, 22 bp, Homo sapiens
aggagctgagtcagcccgacag

SEQ ID NO: 8326905 - DNA, 20 bp, Homo sapiens
aggagctgaattagagggtt

SEQ ID NO: 8326906 - DNA, 22 bp, Homo sapiens
aggaggaggtaagaaaagcata

SEQ ID NO: 8326907 - DNA, 22 bp, Homo sapiens
cagtctctcttgtagtgcagct

SEQ ID NO: 8326908 - DNA, 18 bp, Homo sapiens
cagtcccaaaccttagga

SEQ ID NO: 8326909 - DNA, 22 bp, Homo sapiens
cagtcctgagccaatcatgatg

SEQ ID NO: 8326910 - DNA, 20 bp, Homo sapiens
cagtcctgcaggcgggagaa

SEQ ID NO: 8326911 - DNA, 22 bp, Homo sapiens
cagtcctgcccaggctgacaga

SEQ ID NO: 8326912 - DNA, 22 bp, Homo sapiens
cagtcctgctagtgtgaaaagc

SEQ ID NO: 8326913 - DNA, 22 bp, Homo sapiens
cattcctaaccacatgtgggct

SEQ ID NO: 8326914 - DNA, 21 bp, Homo sapiens
cattcctcggctcatagagga

SEQ ID NO: 8326915 - DNA, 22 bp, Homo sapiens
cattccacactgcaggaaatat

SEQ ID NO: 8326916 - DNA, 22 bp, Homo sapiens
catggccccaaatcccatgcat

SEQ ID NO: 8326917 - DNA, 22 bp, Homo sapiens
catggcggtcaggatgtaggtg

SEQ ID NO: 8326918 - DNA, 22 bp, Homo sapiens
catttacagtgagagtttttac

SEQ ID NO: 8326919 - DNA, 22 bp, Homo sapiens
catttacataacagtaacgctg

SEQ ID NO: 8326920 - DNA, 22 bp, Homo sapiens
catttacagtgagagtttttac

SEQ ID NO: 8326921 - DNA, 22 bp, Homo sapiens
catttacagcagactgatgaaa

SEQ ID NO: 8326922 - DNA, 21 bp, Homo sapiens
catttacatgacagattggtt

SEQ ID NO: 8326923 - DNA, 22 bp, Homo sapiens
catttacatttaaggttaatat

SEQ ID NO: 8326924 - DNA, 22 bp, Homo sapiens
aggaggtgttgatagaaggttt

SEQ ID NO: 8326925 - DNA, 22 bp, Homo sapiens
catgaaattcagcaggtgagta

SEQ ID NO: 8326926 - DNA, 22 bp, Homo sapiens
aggaggtgcgtggtgatcccct

SEQ ID NO: 8326927 - DNA, 22 bp, Homo sapiens
catgaaatcacaagctgaggac

SEQ ID NO: 8326928 - DNA, 22 bp, Homo sapiens
catgaaatggccaaccttcggc

SEQ ID NO: 8326929 - DNA, 22 bp, Homo sapiens
catgaaatgatatttgggtggg

SEQ ID NO: 8326930 - DNA, 17 bp, Homo sapiens
catctttaaaatcctga

SEQ ID NO: 8326931 - DNA, 22 bp, Homo sapiens
catgaaatatgctacctgtctt

SEQ ID NO: 8326932 - DNA, 22 bp, Homo sapiens
catgaaaatgtcaagttctgct

SEQ ID NO: 8326933 - DNA, 22 bp, Homo sapiens
catgcctgtaatcccagctctt

SEQ ID NO: 8326934 - DNA, 22 bp, Homo sapiens
catgcagatctgagttctagct

SEQ ID NO: 8326935 - DNA, 22 bp, Homo sapiens
catgcaggaggaaaaagcagct

SEQ ID NO: 8326936 - DNA, 22 bp, Homo sapiens
aggcacagcctcccccaactcc

SEQ ID NO: 8326937 - DNA, 22 bp, Homo sapiens
catggccaggcccagggcccag

SEQ ID NO: 8326938 - DNA, 22 bp, Homo sapiens
catggccagggcagatggcagg

SEQ ID NO: 8326939 - DNA, 22 bp, Homo sapiens
catggccaggcacgcgcatagc

SEQ ID NO: 8326940 - DNA, 22 bp, Homo sapiens
aggaaataggaccagacaaagc

SEQ ID NO: 8326941 - DNA, 22 bp, Homo sapiens
aggaacaactgattcagtcaac

SEQ ID NO: 8326942 - DNA, 22 bp, Homo sapiens
aggaacaattgataaactcaca

SEQ ID NO: 8326943 - DNA, 23 bp, Homo sapiens
aggaactgaggcctagggaggta

SEQ ID NO: 8326944 - DNA, 22 bp, Homo sapiens
aggaactgatttataactttag

SEQ ID NO: 8326945 - DNA, 21 bp, Homo sapiens
aggaaaggaagtccccagggt

SEQ ID NO: 8326946 - DNA, 22 bp, Homo sapiens
aggaaagcaatggctgagaaca

SEQ ID NO: 8326947 - DNA, 22 bp, Homo sapiens
agcttgttggggaaggagaaag

SEQ ID NO: 8326948 - DNA, 22 bp, Homo sapiens
agcttgttataaatgcagaatg

SEQ ID NO: 8326949 - DNA, 22 bp, Homo sapiens
agctgttttactcagaaacata

SEQ ID NO: 8326950 - DNA, 22 bp, Homo sapiens
agctggcttttgtgaaggtttt

SEQ ID NO: 8326951 - DNA, 22 bp, Homo sapiens
caggagtctctcttgagcccag

SEQ ID NO: 8326952 - DNA, 22 bp, Homo sapiens
caggagtccatctggcctggtg

SEQ ID NO: 8326953 - DNA, 22 bp, Homo sapiens
caggagtccctctggccagcat

SEQ ID NO: 8326954 - DNA, 19 bp, Homo sapiens
agctggctcttctttgtct

SEQ ID NO: 8326955 - DNA, 22 bp, Homo sapiens
agctggctggccccttcctgcc

SEQ ID NO: 8326956 - DNA, 22 bp, Homo sapiens
agctggctggccccttcctgcc

SEQ ID NO: 8326957 - DNA, 22 bp, Homo sapiens
agctggctttatggttggctaa

SEQ ID NO: 8326958 - DNA, 22 bp, Homo sapiens
agctggcttgcatgctaaggag

SEQ ID NO: 8326959 - DNA, 22 bp, Homo sapiens
agctggctttgagctgggaggt

SEQ ID NO: 8326960 - DNA, 22 bp, Homo sapiens
agctggcttcacaggcagtgtg

SEQ ID NO: 8326961 - DNA, 22 bp, Homo sapiens
agctggcttctctgcagacatt

SEQ ID NO: 8326962 - DNA, 22 bp, Homo sapiens
agctggcattgcagggagctgc

SEQ ID NO: 8326963 - DNA, 22 bp, Homo sapiens
caggaggttgtaagagcaggcc

SEQ ID NO: 8326964 - DNA, 22 bp, Homo sapiens
caggaggtgacttccaggggtt

SEQ ID NO: 8326965 - DNA, 22 bp, Homo sapiens
caggaggtgacttccaggggtt

SEQ ID NO: 8326966 - DNA, 21 bp, Homo sapiens
caggaaaagcggaagtctagc

SEQ ID NO: 8326967 - DNA, 22 bp, Homo sapiens
caggacagagcccagactgtgt

SEQ ID NO: 8326968 - DNA, 22 bp, Homo sapiens
caggacagacagaatgcctaac

SEQ ID NO: 8326969 - DNA, 22 bp, Homo sapiens
caggacacttgttcttctctgc

SEQ ID NO: 8326970 - DNA, 22 bp, Homo sapiens
cagctcctgggccatctcctag

SEQ ID NO: 8326971 - DNA, 21 bp, Homo sapiens
cagcttcttctgtgacctggt

SEQ ID NO: 8326972 - DNA, 22 bp, Homo sapiens
cagcttctgtttctagcccctg

SEQ ID NO: 8326973 - DNA, 22 bp, Homo sapiens
cagcttctggcgtggagcctga

SEQ ID NO: 8326974 - DNA, 21 bp, Homo sapiens
agctgcagtcaagccagaggt

SEQ ID NO: 8326975 - DNA, 22 bp, Homo sapiens
cagctttgcaggctggtcagtg

SEQ ID NO: 8326976 - DNA, 22 bp, Homo sapiens
atgtttatgttgggctatattt

SEQ ID NO: 8326977 - DNA, 22 bp, Homo sapiens
atgtttctgagtgtatatacat

SEQ ID NO: 8326978 - DNA, 22 bp, Homo sapiens
atgttaaatggtttattattaa

SEQ ID NO: 8326979 - DNA, 20 bp, Homo sapiens
attagctcaggtgaggtcat

SEQ ID NO: 8326980 - DNA, 22 bp, Homo sapiens
attaaatactgcaggctaagca

SEQ ID NO: 8326981 - DNA, 22 bp, Homo sapiens
atgtttgtgttacactctgcag

SEQ ID NO: 8326982 - DNA, 22 bp, Homo sapiens
attctggacaaggcaagctcct

SEQ ID NO: 8326983 - DNA, 22 bp, Homo sapiens
attctgggaactttgtctctca

SEQ ID NO: 8326984 - DNA, 22 bp, Homo sapiens
attctctgtgcagatttaagac

SEQ ID NO: 8326985 - DNA, 22 bp, Homo sapiens
attcagctgactttgattcatt

SEQ ID NO: 8326986 - DNA, 21 bp, Homo sapiens
agagggagagtggcccttcca

SEQ ID NO: 8326987 - DNA, 22 bp, Homo sapiens
attctgtaattgaactgtgttg

SEQ ID NO: 8326988 - DNA, 22 bp, Homo sapiens
agagggagtgaaatggaataga

SEQ ID NO: 8326989 - DNA, 22 bp, Homo sapiens
agagggatcaccctgtttctgg

SEQ ID NO: 8326990 - DNA, 22 bp, Homo sapiens
agagggagcccagtcatagctg

SEQ ID NO: 8326991 - DNA, 23 bp, Homo sapiens
agagggagatgtttttctcaaga

SEQ ID NO: 8326992 - DNA, 22 bp, Homo sapiens
agagggagctttatttttctgt

SEQ ID NO: 8326993 - DNA, 22 bp, Homo sapiens
agaggggctcatatcctgtcat

SEQ ID NO: 8326994 - DNA, 22 bp, Homo sapiens
agaggggctcatatcctgtcat

SEQ ID NO: 8326995 - DNA, 22 bp, Homo sapiens
attataaagaacatgtgtgtgg

SEQ ID NO: 8326996 - DNA, 22 bp, Homo sapiens
attataaacctttgagggtggg

SEQ ID NO: 8326997 - DNA, 22 bp, Homo sapiens
attataaatattttctaggggt

SEQ ID NO: 8326998 - DNA, 22 bp, Homo sapiens
attcacaattagaagtagataa

SEQ ID NO: 8326999 - DNA, 22 bp, Homo sapiens
attcacactgtatacacaggat

SEQ ID NO: 8327000 - DNA, 22 bp, Homo sapiens
attcagcaaacatttattatct

SEQ ID NO: 8327001 - DNA, 22 bp, Homo sapiens
attcagcaaacatttattgtgt

SEQ ID NO: 8327002 - DNA, 17 bp, Homo sapiens
atttagcaagtagacag

SEQ ID NO: 8327003 - DNA, 22 bp, Homo sapiens
agagtgggcctctgagtcccag

SEQ ID NO: 8327004 - DNA, 22 bp, Homo sapiens
agaggtagaggttgcagtgagc

SEQ ID NO: 8327005 - DNA, 22 bp, Homo sapiens
agaggtagaaaataatggagag

SEQ ID NO: 8327006 - DNA, 16 bp, Homo sapiens
agcaaaagtaggtgtt

SEQ ID NO: 8327007 - DNA, 17 bp, Homo sapiens
agcaaaagtatcaaagc

SEQ ID NO: 8327008 - DNA, 22 bp, Homo sapiens
agcaaacagtgtgctaagaaat

SEQ ID NO: 8327009 - DNA, 22 bp, Homo sapiens
atttgcttctgctaaacaactt

SEQ ID NO: 8327010 - DNA, 22 bp, Homo sapiens
agatgaaaagataagcagcaat

SEQ ID NO: 8327011 - DNA, 18 bp, Homo sapiens
agatgaaagcaaatgaca

SEQ ID NO: 8327012 - DNA, 18 bp, Homo sapiens
agatgaaagcaaatgaca

SEQ ID NO: 8327013 - DNA, 22 bp, Homo sapiens
agatgaaaatacgtgactttaa

SEQ ID NO: 8327014 - DNA, 22 bp, Homo sapiens
atttccaatctctgcatatggg

SEQ ID NO: 8327015 - DNA, 22 bp, Homo sapiens
agacaatacatttattcccttt

SEQ ID NO: 8327016 - DNA, 22 bp, Homo sapiens
agaattctcttccattgaaaca

SEQ ID NO: 8327017 - DNA, 22 bp, Homo sapiens
agaattcagaatgcatttctaa

SEQ ID NO: 8327018 - DNA, 19 bp, Homo sapiens
agacacacttacgtggaat

SEQ ID NO: 8327019 - DNA, 22 bp, Homo sapiens
agacacagtttgggatgggttg

SEQ ID NO: 8327020 - DNA, 22 bp, Homo sapiens
agacacagtgctgggtgctgag

SEQ ID NO: 8327021 - DNA, 22 bp, Homo sapiens
agacacagtctgtctggaggag

SEQ ID NO: 8327022 - DNA, 22 bp, Homo sapiens
agacacagctgcaggaggtggg

SEQ ID NO: 8327023 - DNA, 22 bp, Homo sapiens
agacaggcatgaggctggattg

SEQ ID NO: 8327024 - DNA, 22 bp, Homo sapiens
agacagtgagaatgagttgaaa

SEQ ID NO: 8327025 - DNA, 22 bp, Homo sapiens
agaagcacacctgacctctagc

SEQ ID NO: 8327026 - DNA, 22 bp, Homo sapiens
atcttatgttgtattcaaaatc

SEQ ID NO: 8327027 - DNA, 22 bp, Homo sapiens
atctttactttcagtgctgagc

SEQ ID NO: 8327028 - DNA, 22 bp, Homo sapiens
atctttaggaacctaacctatt

SEQ ID NO: 8327029 - DNA, 20 bp, Homo sapiens
agaagaggatacaaccaggc

SEQ ID NO: 8327030 - DNA, 22 bp, Homo sapiens
agaagaatacttgatgttcatg

SEQ ID NO: 8327031 - DNA, 22 bp, Homo sapiens
agaagaatacttgatgttcatg

SEQ ID NO: 8327032 - DNA, 22 bp, Homo sapiens
atctttggtactattcttatca

SEQ ID NO: 8327033 - DNA, 22 bp, Homo sapiens
atctttggtactattcttatca

SEQ ID NO: 8327034 - DNA, 22 bp, Homo sapiens
atctttggtcttgagtgcatct

SEQ ID NO: 8327035 - DNA, 22 bp, Homo sapiens
atctttggtgcatgatactttg

SEQ ID NO: 8327036 - DNA, 22 bp, Homo sapiens
atctttggggcatccaggaaaa

SEQ ID NO: 8327037 - DNA, 22 bp, Homo sapiens
atctttgggtacaaacttgcct

SEQ ID NO: 8327038 - DNA, 19 bp, Homo sapiens
atctttgggtcctgaaggg

SEQ ID NO: 8327039 - DNA, 22 bp, Homo sapiens
atctttggtgcatgatactttg

SEQ ID NO: 8327040 - DNA, 22 bp, Homo sapiens
atctttggtgcttggtgctccc

SEQ ID NO: 8327041 - DNA, 22 bp, Homo sapiens
agaaggcctaacttgggggcaa

SEQ ID NO: 8327042 - DNA, 22 bp, Homo sapiens
agaaggctcactaagagtgact

SEQ ID NO: 8327043 - DNA, 22 bp, Homo sapiens
agaaggctaaagaaacagattg

SEQ ID NO: 8327044 - DNA, 22 bp, Homo sapiens
atctttagtagaggaatatatt

SEQ ID NO: 8327045 - DNA, 22 bp, Homo sapiens
agaaggccaagaagaagcctat

SEQ ID NO: 8327046 - DNA, 22 bp, Homo sapiens
agaaggccagatggacggggct

SEQ ID NO: 8327047 - DNA, 22 bp, Homo sapiens
agaaggccaatagggtgcactg

SEQ ID NO: 8327048 - DNA, 22 bp, Homo sapiens
agaatacaattgttcagtaata

SEQ ID NO: 8327049 - DNA, 23 bp, Homo sapiens
agaatacaggctttgtataggca

SEQ ID NO: 8327050 - DNA, 22 bp, Homo sapiens
agaaggctggccatggtgccct

SEQ ID NO: 8327051 - DNA, 22 bp, Homo sapiens
agaaggctcatttgactgcatt

SEQ ID NO: 8327052 - DNA, 20 bp, Homo sapiens
atgtaaaagacagggagtag

SEQ ID NO: 8327053 - DNA, 20 bp, Homo sapiens
atgtaaaagacagggagtag

SEQ ID NO: 8327054 - DNA, 22 bp, Homo sapiens
atgggtgtgaaaatggtcatct

SEQ ID NO: 8327055 - DNA, 22 bp, Homo sapiens
atgtaaaagattattttcctgt

SEQ ID NO: 8327056 - DNA, 22 bp, Homo sapiens
atgtaaaagattattttcctgt

SEQ ID NO: 8327057 - DNA, 20 bp, Homo sapiens
atgtaaaattataaggctga

SEQ ID NO: 8327058 - DNA, 20 bp, Homo sapiens
atgtaaaattataaggctga

SEQ ID NO: 8327059 - DNA, 22 bp, Homo sapiens
atgtccagaggcttggtcccca

SEQ ID NO: 8327060 - DNA, 22 bp, Homo sapiens
atgtccagaggcttggtcccca

SEQ ID NO: 8327061 - DNA, 20 bp, Homo sapiens
atgtccagtgactggaccat

SEQ ID NO: 8327062 - DNA, 23 bp, Homo sapiens
atgtccagtttacttcaggatga

SEQ ID NO: 8327063 - DNA, 19 bp, Homo sapiens
atggaaaattgtactcaat

SEQ ID NO: 8327064 - DNA, 22 bp, Homo sapiens
agactctgaagtcattgcatga

SEQ ID NO: 8327065 - DNA, 22 bp, Homo sapiens
agactctgaaatctaggtgcaa

SEQ ID NO: 8327066 - DNA, 23 bp, Homo sapiens
agactctgagagtgtgctttgca

SEQ ID NO: 8327067 - DNA, 22 bp, Homo sapiens
agactctgaggagccctgagac

SEQ ID NO: 8327068 - DNA, 22 bp, Homo sapiens
agactctgagacatgaaccatc

SEQ ID NO: 8327069 - DNA, 22 bp, Homo sapiens
agactctgataagcaactcttg

SEQ ID NO: 8327070 - DNA, 22 bp, Homo sapiens
atggcagatggctggagcaggt

SEQ ID NO: 8327071 - DNA, 22 bp, Homo sapiens
atggagtgcctgtggcagtggg

SEQ ID NO: 8327072 - DNA, 22 bp, Homo sapiens
atggagtgtcaccttcctggtt

SEQ ID NO: 8327073 - DNA, 22 bp, Homo sapiens
atggagtggtacttacttggct

SEQ ID NO: 8327074 - DNA, 22 bp, Homo sapiens
atggacagtactgagtggacta

SEQ ID NO: 8327075 - DNA, 22 bp, Homo sapiens
atggagtctacaaagtgttgga

SEQ ID NO: 8327076 - DNA, 22 bp, Homo sapiens
agccaggatggtctcgatcggc

SEQ ID NO: 8327077 - DNA, 22 bp, Homo sapiens
cagaagaaatcattatctggac

SEQ ID NO: 8327078 - DNA, 22 bp, Homo sapiens
agccaaggaaagccctttgctg

SEQ ID NO: 8327079 - DNA, 22 bp, Homo sapiens
cactctgtgattgcagcattcc

SEQ ID NO: 8327080 - DNA, 22 bp, Homo sapiens
cactgaaatattaatatcttat

SEQ ID NO: 8327081 - DNA, 22 bp, Homo sapiens
agccacagagagggagctgcaa

SEQ ID NO: 8327082 - DNA, 22 bp, Homo sapiens
agccacagaggttgatgtggtt

SEQ ID NO: 8327083 - DNA, 22 bp, Homo sapiens
agcccaggagtccttaaggacc

SEQ ID NO: 8327084 - DNA, 22 bp, Homo sapiens
agcccagcctgattctacaccc

SEQ ID NO: 8327085 - DNA, 19 bp, Homo sapiens
agcccccagacagcaggcc

SEQ ID NO: 8327086 - DNA, 22 bp, Homo sapiens
agccccttgctgccctctagag

SEQ ID NO: 8327087 - DNA, 22 bp, Homo sapiens
agccccttgcacttccccacgc

SEQ ID NO: 8327088 - DNA, 20 bp, Homo sapiens
agccagggttctggatgcac

SEQ ID NO: 8327089 - DNA, 22 bp, Homo sapiens
cagagagggcggccctggcttc

SEQ ID NO: 8327090 - DNA, 22 bp, Homo sapiens
cagagcacagagcttgggacaa

SEQ ID NO: 8327091 - DNA, 22 bp, Homo sapiens
cagagatgaggtcgttactcag

SEQ ID NO: 8327092 - DNA, 22 bp, Homo sapiens
cagagatggcggctgttgtgtt

SEQ ID NO: 8327093 - DNA, 22 bp, Homo sapiens
cagagagggcggccctggcttc

SEQ ID NO: 8327094 - DNA, 22 bp, Homo sapiens
agctcctgtgtgaagcctccct

SEQ ID NO: 8327095 - DNA, 22 bp, Homo sapiens
agctcctactctatgccagaca

SEQ ID NO: 8327096 - DNA, 21 bp, Homo sapiens
agctccctgtttcctcactct

SEQ ID NO: 8327097 - DNA, 22 bp, Homo sapiens
agctccctgagatgccacagca

SEQ ID NO: 8327098 - DNA, 22 bp, Homo sapiens
agctcacagcctagcactgtga

SEQ ID NO: 8327099 - DNA, 21 bp, Homo sapiens
agctcacagttctgtcctgtc

SEQ ID NO: 8327100 - DNA, 22 bp, Homo sapiens
cagcagaggcacgtctgtgaat

SEQ ID NO: 8327101 - DNA, 22 bp, Homo sapiens
cagcagaggtggttcacattgt

SEQ ID NO: 8327102 - DNA, 22 bp, Homo sapiens
cagcagcatgaattcgagccac

SEQ ID NO: 8327103 - DNA, 22 bp, Homo sapiens
cagcagcagtggctgcagaaca

SEQ ID NO: 8327104 - DNA, 22 bp, Homo sapiens
cagaggctcagatggccctggc

SEQ ID NO: 8327105 - DNA, 22 bp, Homo sapiens
cagcacagctgaggggctgtct

SEQ ID NO: 8327106 - DNA, 22 bp, Homo sapiens
cagaggctaagatgagtgggtg

SEQ ID NO: 8327107 - DNA, 22 bp, Homo sapiens
cagcacaggcctgtctttgtct

SEQ ID NO: 8327108 - DNA, 22 bp, Homo sapiens
cagcacaggcctgtctttgtct

SEQ ID NO: 8327109 - DNA, 22 bp, Homo sapiens
cagcacaggcccctctctccca

SEQ ID NO: 8327110 - DNA, 22 bp, Homo sapiens
cagcacagtacaaggcacggat

SEQ ID NO: 8327111 - DNA, 22 bp, Homo sapiens
agcaggagaacactgtggctct

SEQ ID NO: 8327112 - DNA, 22 bp, Homo sapiens
agcaggagagcagtgcgtggtc

SEQ ID NO: 8327113 - DNA, 22 bp, Homo sapiens
cacaggaagcaagcctggggcc

SEQ ID NO: 8327114 - DNA, 22 bp, Homo sapiens
agcagcttatcttggagaggca

SEQ ID NO: 8327115 - DNA, 18 bp, Homo sapiens
agcagctgtcagaatgcc

SEQ ID NO: 8327116 - DNA, 22 bp, Homo sapiens
caatgacatctccctgctctaa

SEQ ID NO: 8327117 - DNA, 22 bp, Homo sapiens
caatgacatggataatcatatt

SEQ ID NO: 8327118 - DNA, 22 bp, Homo sapiens
agcagggcctgagtgacctaac

SEQ ID NO: 8327119 - DNA, 22 bp, Homo sapiens
agcagggcctggcactcctggg

SEQ ID NO: 8327120 - DNA, 22 bp, Homo sapiens
agcagggctcctgaaagccgcg

SEQ ID NO: 8327121 - DNA, 22 bp, Homo sapiens
agcagggctcctgaaagccgcg

SEQ ID NO: 8327122 - DNA, 22 bp, Homo sapiens
agcagggctccatttcactgcc

SEQ ID NO: 8327123 - DNA, 22 bp, Homo sapiens
agcagggcctctggcactggtc

SEQ ID NO: 8327124 - DNA, 22 bp, Homo sapiens
agcagggcctctggcactggtc

SEQ ID NO: 8327125 - DNA, 22 bp, Homo sapiens
cacagtcacatatctatgtgtg

SEQ ID NO: 8327126 - DNA, 22 bp, Homo sapiens
agcagtttagctatactgcttg

SEQ ID NO: 8327127 - DNA, 22 bp, Homo sapiens
agcagtttctcttgtatcttca

SEQ ID NO: 8327128 - DNA, 22 bp, Homo sapiens
agcataaaggcactagaaagag

SEQ ID NO: 8327129 - DNA, 22 bp, Homo sapiens
agcagtttttataacactggaa

SEQ ID NO: 8327130 - DNA, 22 bp, Homo sapiens
caaggcatactcctttctcagc

SEQ ID NO: 8327131 - DNA, 22 bp, Homo sapiens
agcagcatccccggcctccacc

SEQ ID NO: 8327132 - DNA, 22 bp, Homo sapiens
caatgaaattgagatccagaga

SEQ ID NO: 8327133 - DNA, 22 bp, Homo sapiens
agcagaatctgggagcagcagt

SEQ ID NO: 8327134 - DNA, 22 bp, Homo sapiens
agcagcaatggaaagcaacaca

SEQ ID NO: 8327135 - DNA, 22 bp, Homo sapiens
agcacagagaaactaagacatt

SEQ ID NO: 8327136 - DNA, 22 bp, Homo sapiens
agcaaacattcagcagattggc

SEQ ID NO: 8327137 - DNA, 22 bp, Homo sapiens
attttctctttgtatatgctag

SEQ ID NO: 8327138 - DNA, 21 bp, Homo sapiens
attttctctggatgatggtca

SEQ ID NO: 8327139 - DNA, 22 bp, Homo sapiens
attttctcacaatgcagaagga

SEQ ID NO: 8327140 - DNA, 22 bp, Homo sapiens
caaatgcagattcaggagttct

SEQ ID NO: 8327141 - DNA, 22 bp, Homo sapiens
caaatgcaggtcagcaggtgtc

SEQ ID NO: 8327142 - DNA, 18 bp, Homo sapiens
actcacagcagaagaagg

SEQ ID NO: 8327143 - DNA, 22 bp, Homo sapiens
actcatgttttctctagctgga

SEQ ID NO: 8327144 - DNA, 22 bp, Homo sapiens
actcattgaaacttaagatcta

SEQ ID NO: 8327145 - DNA, 22 bp, Homo sapiens
actaaatagttttgacagaaca

SEQ ID NO: 8327146 - DNA, 22 bp, Homo sapiens
actagtttattacagttccact

SEQ ID NO: 8327147 - DNA, 22 bp, Homo sapiens
actaaagtcctgttgtagcata

SEQ ID NO: 8327148 - DNA, 22 bp, Homo sapiens
actaaagtgttggagaatgagg

SEQ ID NO: 8327149 - DNA, 22 bp, Homo sapiens
actaaagtgttggagaatgagg

SEQ ID NO: 8327150 - DNA, 22 bp, Homo sapiens
actatgctcactacctggggga

SEQ ID NO: 8327151 - DNA, 22 bp, Homo sapiens
actatgatgtattttgcatcta

SEQ ID NO: 8327152 - DNA, 22 bp, Homo sapiens
actatgaatagccagatagtga

SEQ ID NO: 8327153 - DNA, 22 bp, Homo sapiens
acgggctgggacggggaagctc

SEQ ID NO: 8327154 - DNA, 19 bp, Homo sapiens
actaaaaatgatgtttgag

SEQ ID NO: 8327155 - DNA, 22 bp, Homo sapiens
actaaaaactactgccaatagc

SEQ ID NO: 8327156 - DNA, 22 bp, Homo sapiens
actaaagtcagactgcattgat

SEQ ID NO: 8327157 - DNA, 22 bp, Homo sapiens
actaaaacatagccagtcagtg

SEQ ID NO: 8327158 - DNA, 19 bp, Homo sapiens
actaaaaatgatgtttgag

SEQ ID NO: 8327159 - DNA, 22 bp, Homo sapiens
accttaaaggccgaagtaaaga

SEQ ID NO: 8327160 - DNA, 22 bp, Homo sapiens
accttaaatgtgacatagtcta

SEQ ID NO: 8327161 - DNA, 22 bp, Homo sapiens
aggtactgaaaaaatgtttgca

SEQ ID NO: 8327162 - DNA, 22 bp, Homo sapiens
acctggttcctcctcactgctg

SEQ ID NO: 8327163 - DNA, 19 bp, Homo sapiens
agggttacccgctgccacc

SEQ ID NO: 8327164 - DNA, 22 bp, Homo sapiens
agggtgtgttctcctatgagaa

SEQ ID NO: 8327165 - DNA, 22 bp, Homo sapiens
agggtgcctggaagccactcac

SEQ ID NO: 8327166 - DNA, 22 bp, Homo sapiens
agggctggtatgtccatgaaag

SEQ ID NO: 8327167 - DNA, 22 bp, Homo sapiens
agggctgtcagactgaggaggc

SEQ ID NO: 8327168 - DNA, 22 bp, Homo sapiens
agtctacaacgcaagcaacatg

SEQ ID NO: 8327169 - DNA, 22 bp, Homo sapiens
agtctacaaagggaagcccttt

SEQ ID NO: 8327170 - DNA, 21 bp, Homo sapiens
agtctacaactagggaagctg

SEQ ID NO: 8327171 - DNA, 22 bp, Homo sapiens
agtctctctcctcgtggtaacc

SEQ ID NO: 8327172 - DNA, 22 bp, Homo sapiens
agtctctgggcatggttgtgac

SEQ ID NO: 8327173 - DNA, 22 bp, Homo sapiens
actgaaatactgctcttggatt

SEQ ID NO: 8327174 - DNA, 22 bp, Homo sapiens
actgaaaatgaattagaaacag

SEQ ID NO: 8327175 - DNA, 22 bp, Homo sapiens
actgaaatggggacagtcctta

SEQ ID NO: 8327176 - DNA, 22 bp, Homo sapiens
actgaaatttatattttgggca

SEQ ID NO: 8327177 - DNA, 22 bp, Homo sapiens
actgaaatatttagaagtgaag

SEQ ID NO: 8327178 - DNA, 22 bp, Homo sapiens
actgctgattattgaagtagag

SEQ ID NO: 8327179 - DNA, 22 bp, Homo sapiens
actgctgatataagaaaagatt

SEQ ID NO: 8327180 - DNA, 22 bp, Homo sapiens
actggcagccacaactggcagg

SEQ ID NO: 8327181 - DNA, 22 bp, Homo sapiens
actggcagcagcagcccttggg

SEQ ID NO: 8327182 - DNA, 22 bp, Homo sapiens
actggcagaggttggacaccat

SEQ ID NO: 8327183 - DNA, 22 bp, Homo sapiens
actggcagagggaaaaccattc

SEQ ID NO: 8327184 - DNA, 22 bp, Homo sapiens
actggcagaggatagcactaat

SEQ ID NO: 8327185 - DNA, 22 bp, Homo sapiens
actggcagaacgtgatgcgggt

SEQ ID NO: 8327186 - DNA, 22 bp, Homo sapiens
actggcagagaccctgatggcc

SEQ ID NO: 8327187 - DNA, 22 bp, Homo sapiens
actggcagaattgaatagttgt

SEQ ID NO: 8327188 - DNA, 22 bp, Homo sapiens
actggcagaactggtgattgtc

SEQ ID NO: 8327189 - DNA, 22 bp, Homo sapiens
actgcaatctggatcctagaag

SEQ ID NO: 8327190 - DNA, 22 bp, Homo sapiens
actgcaattatttgttcaccaa

SEQ ID NO: 8327191 - DNA, 22 bp, Homo sapiens
actgatgaaaactaataaatta

SEQ ID NO: 8327192 - DNA, 22 bp, Homo sapiens
actgatccccaggaatgaaatt

SEQ ID NO: 8327193 - DNA, 22 bp, Homo sapiens
actttgtataagacaataaaga

SEQ ID NO: 8327194 - DNA, 22 bp, Homo sapiens
actttggtttccctgttcgtaa

SEQ ID NO: 8327195 - DNA, 20 bp, Homo sapiens
actttggttattgggaccat

SEQ ID NO: 8327196 - DNA, 22 bp, Homo sapiens
actttggttcacagctgttcat

SEQ ID NO: 8327197 - DNA, 22 bp, Homo sapiens
actttggtgcgaagtcacttta

SEQ ID NO: 8327198 - DNA, 22 bp, Homo sapiens
actttggttataggagccaaaa

SEQ ID NO: 8327199 - DNA, 22 bp, Homo sapiens
actttggtcccatgtgtgtaaa

SEQ ID NO: 8327200 - DNA, 22 bp, Homo sapiens
actttggtctctgcccctggtg

SEQ ID NO: 8327201 - DNA, 17 bp, Homo sapiens
actttggtcctgtgctc

SEQ ID NO: 8327202 - DNA, 19 bp, Homo sapiens
actttggtgattagaggga

SEQ ID NO: 8327203 - DNA, 22 bp, Homo sapiens
actttggtgatacagatacggc

SEQ ID NO: 8327204 - DNA, 22 bp, Homo sapiens
actttggtcttagaggaggaat

SEQ ID NO: 8327205 - DNA, 22 bp, Homo sapiens
actttggtgaatcagttttgtt

SEQ ID NO: 8327206 - DNA, 22 bp, Homo sapiens
atataatagtttcataaaggct

SEQ ID NO: 8327207 - DNA, 22 bp, Homo sapiens
atataatagtttcataaaggct

SEQ ID NO: 8327208 - DNA, 22 bp, Homo sapiens
atatacaaagggcaacctcgct

SEQ ID NO: 8327209 - DNA, 22 bp, Homo sapiens
agaaaattagattttactgtgt

SEQ ID NO: 8327210 - DNA, 22 bp, Homo sapiens
agaaaataaattgatggtggaa

SEQ ID NO: 8327211 - DNA, 22 bp, Homo sapiens
agaaaatttattcatgttagtt

SEQ ID NO: 8327212 - DNA, 22 bp, Homo sapiens
agaaaatttattcatgttagtt

SEQ ID NO: 8327213 - DNA, 22 bp, Homo sapiens
agaaacaacttgtttctcttgc

SEQ ID NO: 8327214 - DNA, 22 bp, Homo sapiens
agaaacaaggtgtaggttgacc

SEQ ID NO: 8327215 - DNA, 22 bp, Homo sapiens
atatatttgagaatattcatga

SEQ ID NO: 8327216 - DNA, 22 bp, Homo sapiens
atatatttgagaatattcatga

SEQ ID NO: 8327217 - DNA, 22 bp, Homo sapiens
atatatttgagaatattcatga

SEQ ID NO: 8327218 - DNA, 22 bp, Homo sapiens
atatatttactctcctgttgca

SEQ ID NO: 8327219 - DNA, 22 bp, Homo sapiens
atatatttactctcctgttgca

SEQ ID NO: 8327220 - DNA, 22 bp, Homo sapiens
atatatttgagaatattcatga

SEQ ID NO: 8327221 - DNA, 22 bp, Homo sapiens
atatattttgaatagcctctgt

SEQ ID NO: 8327222 - DNA, 22 bp, Homo sapiens
atatctttcaaagccaaaagta

SEQ ID NO: 8327223 - DNA, 22 bp, Homo sapiens
atatctgtggagggcttacaaa

SEQ ID NO: 8327224 - DNA, 22 bp, Homo sapiens
atatcctttactgtgtcacaga

SEQ ID NO: 8327225 - DNA, 22 bp, Homo sapiens
agaaacatttagattatatgtc

SEQ ID NO: 8327226 - DNA, 22 bp, Homo sapiens
agaaacagcattagcatcaatt

SEQ ID NO: 8327227 - DNA, 22 bp, Homo sapiens
atcaccattgaaaaacaggttt

SEQ ID NO: 8327228 - DNA, 22 bp, Homo sapiens
atcactatgggcattatattta

SEQ ID NO: 8327229 - DNA, 22 bp, Homo sapiens
actgttaaagtaattaattgtc

SEQ ID NO: 8327230 - DNA, 22 bp, Homo sapiens
acttcaaacaattaacagagaa

SEQ ID NO: 8327231 - DNA, 22 bp, Homo sapiens
acttgatttttataataaatgg

SEQ ID NO: 8327232 - DNA, 21 bp, Homo sapiens
acttggccaggcccccacctg

SEQ ID NO: 8327233 - DNA, 22 bp, Homo sapiens
acttggccttatttccacagaa

SEQ ID NO: 8327234 - DNA, 22 bp, Homo sapiens
acttggctgcagagaacgtgtg

SEQ ID NO: 8327235 - DNA, 22 bp, Homo sapiens
acttggctagagccaggaggct

SEQ ID NO: 8327236 - DNA, 22 bp, Homo sapiens
acttggctcagataccatgccc

SEQ ID NO: 8327237 - DNA, 22 bp, Homo sapiens
actggcagctgtaggatgcatg

SEQ ID NO: 8327238 - DNA, 20 bp, Homo sapiens
actggcagcctgcctgctgt

SEQ ID NO: 8327239 - DNA, 19 bp, Homo sapiens
actggcagctgtagtctgt

SEQ ID NO: 8327240 - DNA, 22 bp, Homo sapiens
actggcaggctgctggccggcg

SEQ ID NO: 8327241 - DNA, 22 bp, Homo sapiens
actggcagtggcagcagaaaga

SEQ ID NO: 8327242 - DNA, 22 bp, Homo sapiens
actggcagtagagggagcgcat

SEQ ID NO: 8327243 - DNA, 19 bp, Homo sapiens
actggcagggctgcggtgg

SEQ ID NO: 8327244 - DNA, 22 bp, Homo sapiens
actggcaggtccatcgcccttt

SEQ ID NO: 8327245 - DNA, 22 bp, Homo sapiens
actggcagggggagccccgaga

SEQ ID NO: 8327246 - DNA, 22 bp, Homo sapiens
actggcagtttgagaatgcatt

SEQ ID NO: 8327247 - DNA, 22 bp, Homo sapiens
actggcagtgtcgtttacatga

SEQ ID NO: 8327248 - DNA, 19 bp, Homo sapiens
actggcagtttctgcatgg

SEQ ID NO: 8327249 - DNA, 22 bp, Homo sapiens
agtttacagttctcatcgcaac

SEQ ID NO: 8327250 - DNA, 22 bp, Homo sapiens
agtttacacttttgattcttat

SEQ ID NO: 8327251 - DNA, 21 bp, Homo sapiens
agtttacaactgtccagcccc

SEQ ID NO: 8327252 - DNA, 22 bp, Homo sapiens
agtttacatgacgtgtatttca

SEQ ID NO: 8327253 - DNA, 22 bp, Homo sapiens
actgtaaagaagtaagtatggg

SEQ ID NO: 8327254 - DNA, 22 bp, Homo sapiens
actgtaaaatgagatatgtata

SEQ ID NO: 8327255 - DNA, 22 bp, Homo sapiens
actgtaaaatacataagtattg

SEQ ID NO: 8327256 - DNA, 22 bp, Homo sapiens
actgtaaaatgagatatgtata

SEQ ID NO: 8327257 - DNA, 22 bp, Homo sapiens
agtttctaacatatagcattgg

SEQ ID NO: 8327258 - DNA, 22 bp, Homo sapiens
actgtgccttcttattgggtcc

SEQ ID NO: 8327259 - DNA, 22 bp, Homo sapiens
actgtgcctttcacttgcactt

SEQ ID NO: 8327260 - DNA, 22 bp, Homo sapiens
agtttcccccttcacagcttaa

SEQ ID NO: 8327261 - DNA, 22 bp, Homo sapiens
agtttcccaagcagatatcatc

SEQ ID NO: 8327262 - DNA, 19 bp, Homo sapiens
agtttccctggagacatca

SEQ ID NO: 8327263 - DNA, 22 bp, Homo sapiens
agtttcccttgcaaacccattt

SEQ ID NO: 8327264 - DNA, 22 bp, Homo sapiens
acaggctgctgggctccgtgct

SEQ ID NO: 8327265 - DNA, 22 bp, Homo sapiens
agctggggctgtggttgtgatt

SEQ ID NO: 8327266 - DNA, 22 bp, Homo sapiens
agctgggggttggataagggta

SEQ ID NO: 8327267 - DNA, 22 bp, Homo sapiens
acagctatagacgatgtataga

SEQ ID NO: 8327268 - DNA, 22 bp, Homo sapiens
acagctcttcttcaagcctggc

SEQ ID NO: 8327269 - DNA, 22 bp, Homo sapiens
acagctcctaacaaaggctctc

SEQ ID NO: 8327270 - DNA, 22 bp, Homo sapiens
acagcacaggagttgaatgggc

SEQ ID NO: 8327271 - DNA, 22 bp, Homo sapiens
acagtacaagcaatgcattttt

SEQ ID NO: 8327272 - DNA, 22 bp, Homo sapiens
aggagtgcaaatagtccagaga

SEQ ID NO: 8327273 - DNA, 21 bp, Homo sapiens
acagtaaattccctgcaaaga

SEQ ID NO: 8327274 - DNA, 22 bp, Homo sapiens
acaggtggaaacatggtgttgg

SEQ ID NO: 8327275 - DNA, 22 bp, Homo sapiens
aggagctggagtccaggcaagt

SEQ ID NO: 8327276 - DNA, 22 bp, Homo sapiens
acagttcaagtcttagacaaca

SEQ ID NO: 8327277 - DNA, 22 bp, Homo sapiens
acagttaccacttagcagttac

SEQ ID NO: 8327278 - DNA, 22 bp, Homo sapiens
acagtgatgagggaattttgtg

SEQ ID NO: 8327279 - DNA, 18 bp, Homo sapiens
acagtgattgttctatgc

SEQ ID NO: 8327280 - DNA, 21 bp, Homo sapiens
acagttttaaggagcacatgg

SEQ ID NO: 8327281 - DNA, 22 bp, Homo sapiens
acagttttttcaacattggaat

SEQ ID NO: 8327282 - DNA, 22 bp, Homo sapiens
agggcctggtgacctgggtcct

SEQ ID NO: 8327283 - DNA, 22 bp, Homo sapiens
acccgatgttggtgctctagta

SEQ ID NO: 8327284 - DNA, 22 bp, Homo sapiens
acccggagtcggaggttgcagt

SEQ ID NO: 8327285 - DNA, 22 bp, Homo sapiens
acccgccgcacgtccaggctga

SEQ ID NO: 8327286 - DNA, 22 bp, Homo sapiens
accctaataatcacagactagt

SEQ ID NO: 8327287 - DNA, 22 bp, Homo sapiens
acccgtggttttatactacttc

SEQ ID NO: 8327288 - DNA, 22 bp, Homo sapiens
agggcctgggccagcacccttt

SEQ ID NO: 8327289 - DNA, 22 bp, Homo sapiens
agggcctgggaagaggaaccct

SEQ ID NO: 8327290 - DNA, 22 bp, Homo sapiens
accattttgggtattttcagag

SEQ ID NO: 8327291 - DNA, 22 bp, Homo sapiens
accatttaaggaaaatgtatca

SEQ ID NO: 8327292 - DNA, 20 bp, Homo sapiens
accattaatgtaagctttgt

SEQ ID NO: 8327293 - DNA, 22 bp, Homo sapiens
accattaatctcacaaggataa

SEQ ID NO: 8327294 - DNA, 22 bp, Homo sapiens
accattaagaatctggtttcct

SEQ ID NO: 8327295 - DNA, 22 bp, Homo sapiens
accattaacatgattttgggga

SEQ ID NO: 8327296 - DNA, 22 bp, Homo sapiens
accattaaagagatcctgggga

SEQ ID NO: 8327297 - DNA, 21 bp, Homo sapiens
accattaacacccaggtttct

SEQ ID NO: 8327298 - DNA, 22 bp, Homo sapiens
accaggagttttgaccaggggc

SEQ ID NO: 8327299 - DNA, 17 bp, Homo sapiens
agggacagcagtttagg

SEQ ID NO: 8327300 - DNA, 20 bp, Homo sapiens
agggacacaatatttctgtg

SEQ ID NO: 8327301 - DNA, 22 bp, Homo sapiens
aggctggcagccacctcagcag

SEQ ID NO: 8327302 - DNA, 22 bp, Homo sapiens
agggaagaatcactgggatgtt

SEQ ID NO: 8327303 - DNA, 22 bp, Homo sapiens
aggctgcagaacagtcaggtgc

SEQ ID NO: 8327304 - DNA, 22 bp, Homo sapiens
acatttttcacatttgtagggt

SEQ ID NO: 8327305 - DNA, 22 bp, Homo sapiens
acatttttattcatcaaagcag

SEQ ID NO: 8327306 - DNA, 22 bp, Homo sapiens
acatgattaaaagattttaaag

SEQ ID NO: 8327307 - DNA, 22 bp, Homo sapiens
acatgagattagctcacccact

SEQ ID NO: 8327308 - DNA, 22 bp, Homo sapiens
acatgagaggctgtggagtaca

SEQ ID NO: 8327309 - DNA, 22 bp, Homo sapiens
acatgagatttgggtggtgata

SEQ ID NO: 8327310 - DNA, 22 bp, Homo sapiens
acatgaggaactcaggagtcac

SEQ ID NO: 8327311 - DNA, 22 bp, Homo sapiens
aggccctgtccatggtgctgaa

SEQ ID NO: 8327312 - DNA, 22 bp, Homo sapiens
aggcccttaggacccctgcgtg

SEQ ID NO: 8327313 - DNA, 22 bp, Homo sapiens
aggcccttgggtcctctccaca

SEQ ID NO: 8327314 - DNA, 19 bp, Homo sapiens
aggctgcaaggtggtgggc

SEQ ID NO: 8327315 - DNA, 22 bp, Homo sapiens
aggctgagggctcctgagggca

SEQ ID NO: 8327316 - DNA, 22 bp, Homo sapiens
aggctgaggctggcagctccag

SEQ ID NO: 8327317 - DNA, 22 bp, Homo sapiens
aggctgaggatccctgtgttct

SEQ ID NO: 8327318 - DNA, 22 bp, Homo sapiens
acatttaaccaaactgtttaat

SEQ ID NO: 8327319 - DNA, 22 bp, Homo sapiens
aggcctttgtggagctcatggc

SEQ ID NO: 8327320 - DNA, 22 bp, Homo sapiens
aggcgcctgcgggatccttgcc

SEQ ID NO: 8327321 - DNA, 22 bp, Homo sapiens
aagcaatagcaacaactttaca

SEQ ID NO: 8327322 - DNA, 22 bp, Homo sapiens
aagatatagatggtggtataaa

SEQ ID NO: 8327323 - DNA, 22 bp, Homo sapiens
acagcagagacactcaggaggc

SEQ ID NO: 8327324 - DNA, 22 bp, Homo sapiens
acagcagagaactttagagggt

SEQ ID NO: 8327325 - DNA, 22 bp, Homo sapiens
aagcagaactgggaagtagtgg

SEQ ID NO: 8327326 - DNA, 22 bp, Homo sapiens
aagcagaatttcccactagttg

SEQ ID NO: 8327327 - DNA, 22 bp, Homo sapiens
aagcaatatactgatatgatta

SEQ ID NO: 8327328 - DNA, 22 bp, Homo sapiens
aagcaatgtgttaatgaatgag

SEQ ID NO: 8327329 - DNA, 22 bp, Homo sapiens
aagcaatgtgtttgaaaggcca

SEQ ID NO: 8327330 - DNA, 22 bp, Homo sapiens
aagcacaatttaggactgaaat

SEQ ID NO: 8327331 - DNA, 20 bp, Homo sapiens
aattttatctccatcctttg

SEQ ID NO: 8327332 - DNA, 20 bp, Homo sapiens
aattttatctccatcctttg

SEQ ID NO: 8327333 - DNA, 22 bp, Homo sapiens
aattttatctctaagcaggctt

SEQ ID NO: 8327334 - DNA, 22 bp, Homo sapiens
aattttatctctaagcaggctt

SEQ ID NO: 8327335 - DNA, 20 bp, Homo sapiens
aagagaagaagtctttgaaa

SEQ ID NO: 8327336 - DNA, 22 bp, Homo sapiens
aagagaagaaagtgtctacaca

SEQ ID NO: 8327337 - DNA, 22 bp, Homo sapiens
aatttgttagcatactctagtt

SEQ ID NO: 8327338 - DNA, 22 bp, Homo sapiens
acacaaagttggatgacaaaat

SEQ ID NO: 8327339 - DNA, 22 bp, Homo sapiens
aagagacatgaatactcgaagg

SEQ ID NO: 8327340 - DNA, 21 bp, Homo sapiens
aagagacatttctcatcagca

SEQ ID NO: 8327341 - DNA, 22 bp, Homo sapiens
aagagacaagaattccaacgct

SEQ ID NO: 8327342 - DNA, 22 bp, Homo sapiens
aagagacaatgacacttgggag

SEQ ID NO: 8327343 - DNA, 22 bp, Homo sapiens
aagagaattctggttttcctat

SEQ ID NO: 8327344 - DNA, 22 bp, Homo sapiens
aagagaattctggttttcctat

SEQ ID NO: 8327345 - DNA, 22 bp, Homo sapiens
aagagacagagccatgtttcta

SEQ ID NO: 8327346 - DNA, 22 bp, Homo sapiens
aagagacaatgtcttttggata

SEQ ID NO: 8327347 - DNA, 22 bp, Homo sapiens
aagaaaagatgtttggttttca

SEQ ID NO: 8327348 - DNA, 22 bp, Homo sapiens
aagaaaagaaacctgaggcttt

SEQ ID NO: 8327349 - DNA, 22 bp, Homo sapiens
aagaaaaggtaaccgcttatct

SEQ ID NO: 8327350 - DNA, 22 bp, Homo sapiens
aagaaactggaatatagagagc

SEQ ID NO: 8327351 - DNA, 22 bp, Homo sapiens
aagaaaatcagttctggtcagt

SEQ ID NO: 8327352 - DNA, 20 bp, Homo sapiens
aagaaacttgaaagtacaag

SEQ ID NO: 8327353 - DNA, 22 bp, Homo sapiens
aagaacaactgctttaaaagca

SEQ ID NO: 8327354 - DNA, 22 bp, Homo sapiens
aagaacaactgctttaaaagca

SEQ ID NO: 8327355 - DNA, 22 bp, Homo sapiens
aacagaaaaggtaggtggcttt

SEQ ID NO: 8327356 - DNA, 22 bp, Homo sapiens
aacagaaatcatttagggctct

SEQ ID NO: 8327357 - DNA, 22 bp, Homo sapiens
aacagaatagttgatgtacagt

SEQ ID NO: 8327358 - DNA, 22 bp, Homo sapiens
aacagaatatcaaaagattatg

SEQ ID NO: 8327359 - DNA, 22 bp, Homo sapiens
aacagacatatttttaatatgc

SEQ ID NO: 8327360 - DNA, 22 bp, Homo sapiens
aacagactcacagctagagaag

SEQ ID NO: 8327361 - DNA, 22 bp, Homo sapiens
aacactttttatatattgtatc

SEQ ID NO: 8327362 - DNA, 22 bp, Homo sapiens
aacacaatcttccagtttgctg

SEQ ID NO: 8327363 - DNA, 22 bp, Homo sapiens
aacacagaagtgccaagagcca

SEQ ID NO: 8327364 - DNA, 22 bp, Homo sapiens
aacacagagtatttgaagcatt

SEQ ID NO: 8327365 - DNA, 22 bp, Homo sapiens
aacacagacatagtgattacag

SEQ ID NO: 8327366 - DNA, 20 bp, Homo sapiens
aacacagataccaaaggttg

SEQ ID NO: 8327367 - DNA, 22 bp, Homo sapiens
aacacagatcaaaatatttcct

SEQ ID NO: 8327368 - DNA, 22 bp, Homo sapiens
aacacagatcaaaatatttcct

SEQ ID NO: 8327369 - DNA, 22 bp, Homo sapiens
aacaatgtgaagtgctgttcag

SEQ ID NO: 8327370 - DNA, 22 bp, Homo sapiens
aaattttaaggctggaacttaa

SEQ ID NO: 8327371 - DNA, 22 bp, Homo sapiens
aaggaagagcaaagaattatgt

SEQ ID NO: 8327372 - DNA, 22 bp, Homo sapiens
aaatgcatttcactaatgtttc

SEQ ID NO: 8327373 - DNA, 22 bp, Homo sapiens
aaatgtcagaagctttacttct

SEQ ID NO: 8327374 - DNA, 22 bp, Homo sapiens
aaattcaattaactttcatgct

SEQ ID NO: 8327375 - DNA, 22 bp, Homo sapiens
aacccgtgatcctgactcccct

SEQ ID NO: 8327376 - DNA, 22 bp, Homo sapiens
aacccacaaaggatttcagctc

SEQ ID NO: 8327377 - DNA, 22 bp, Homo sapiens
aacccgggaggcggaggttgtg

SEQ ID NO: 8327378 - DNA, 22 bp, Homo sapiens
aaccatttgcagttactgagac

SEQ ID NO: 8327379 - DNA, 22 bp, Homo sapiens
aatgaattcgagtgaaggaaag

SEQ ID NO: 8327380 - DNA, 22 bp, Homo sapiens
aacgaatagggatttttctaac

SEQ ID NO: 8327381 - DNA, 22 bp, Homo sapiens
aacctgctttctcagagaaggg

SEQ ID NO: 8327382 - DNA, 22 bp, Homo sapiens
aatggctgggtttcattttgta

SEQ ID NO: 8327383 - DNA, 22 bp, Homo sapiens
aactagaaagaacatatttcca

SEQ ID NO: 8327384 - DNA, 22 bp, Homo sapiens
aatgacataagtgcagatgcta

SEQ ID NO: 8327385 - DNA, 22 bp, Homo sapiens
aatgacaaccacaatggtgctg

SEQ ID NO: 8327386 - DNA, 22 bp, Homo sapiens
aatgacaagacatagtctctga

SEQ ID NO: 8327387 - DNA, 22 bp, Homo sapiens
aatgacaatggcagaggtagaa

SEQ ID NO: 8327388 - DNA, 22 bp, Homo sapiens
aatgacagccctctagtctggg

SEQ ID NO: 8327389 - DNA, 22 bp, Homo sapiens
aatgacagccagattcttctct

SEQ ID NO: 8327390 - DNA, 22 bp, Homo sapiens
aacatctttgataaacttagtg

SEQ ID NO: 8327391 - DNA, 22 bp, Homo sapiens
aatagatactacttagatgtag

SEQ ID NO: 8327392 - DNA, 22 bp, Homo sapiens
aatagaggagctttggactccc

SEQ ID NO: 8327393 - DNA, 22 bp, Homo sapiens
aagtgtattaagcaacgttatt

SEQ ID NO: 8327394 - DNA, 22 bp, Homo sapiens
aagtgtctaactggttacttct

SEQ ID NO: 8327395 - DNA, 22 bp, Homo sapiens
aagtgtctacatttgctaacca

SEQ ID NO: 8327396 - DNA, 22 bp, Homo sapiens
aaaacctgtgaatagttaactc

SEQ ID NO: 8327397 - DNA, 22 bp, Homo sapiens
aaaaggctaatccagagcaact

SEQ ID NO: 8327398 - DNA, 22 bp, Homo sapiens
aaaaggcattttgtcaaccata

SEQ ID NO: 8327399 - DNA, 22 bp, Homo sapiens
aaaaggcatggaggttgatagt

SEQ ID NO: 8327400 - DNA, 22 bp, Homo sapiens
aaaaatacttcacttctgggtg

SEQ ID NO: 8327401 - DNA, 22 bp, Homo sapiens
aaaaagtctgcaaaggaggttg

SEQ ID NO: 8327402 - DNA, 22 bp, Homo sapiens
aaaaagtattggccatggttga

SEQ ID NO: 8327403 - DNA, 22 bp, Homo sapiens
aaaaatacttcacttctgggtg

SEQ ID NO: 8327404 - DNA, 22 bp, Homo sapiens
aaaaagcttaaatgagcagttc

SEQ ID NO: 8327405 - DNA, 22 bp, Homo sapiens
aaaaagtattggccatggttga

SEQ ID NO: 8327406 - DNA, 22 bp, Homo sapiens
aaaattatggagtatcccaaag

SEQ ID NO: 8327407 - DNA, 22 bp, Homo sapiens
aaaattatagatctagtgcctg

SEQ ID NO: 8327408 - DNA, 22 bp, Homo sapiens
aaacagctttcagaatctctca

SEQ ID NO: 8327409 - DNA, 22 bp, Homo sapiens
aaaaggtagttgccaaataagg

SEQ ID NO: 8327410 - DNA, 22 bp, Homo sapiens
aaaaggttttgagtacaaatat

SEQ ID NO: 8327411 - DNA, 17 bp, Homo sapiens
aaactggggtcaggagc

SEQ ID NO: 8327412 - DNA, 22 bp, Homo sapiens
aaactgggattcttcacaaggt

SEQ ID NO: 8327413 - DNA, 22 bp, Homo sapiens
aaactgcagccttgagttcagg

SEQ ID NO: 8327414 - DNA, 22 bp, Homo sapiens
aaactgcaggtcatgacccatt

SEQ ID NO: 8327415 - DNA, 23 bp, Homo sapiens
aaactgcatctctgagcctcagc

SEQ ID NO: 8327416 - DNA, 22 bp, Homo sapiens
aaactgcatgaagctgatttta

SEQ ID NO: 8327417 - DNA, 22 bp, Homo sapiens
aaaatattttagggccaggaga

SEQ ID NO: 8327418 - DNA, 22 bp, Homo sapiens
aaactgcacatgaggctggtgc

SEQ ID NO: 8327419 - DNA, 22 bp, Homo sapiens
aaactgcacacgatgtgcctga

SEQ ID NO: 8327420 - DNA, 22 bp, Homo sapiens
aaactgcagagccatggttcaa

SEQ ID NO: 8327421 - DNA, 22 bp, Homo sapiens
aaactgcactttattttgtcaa

SEQ ID NO: 8327422 - DNA, 22 bp, Homo sapiens
aaaatattttagggccaggaga

SEQ ID NO: 8327423 - DNA, 22 bp, Homo sapiens
aaactgcaattatttttgcaat

SEQ ID NO: 8327424 - DNA, 22 bp, Homo sapiens
aaactgcacaagggtgcatagc

SEQ ID NO: 8327425 - DNA, 22 bp, Homo sapiens
aaaatatgaagttgtcagtatg

SEQ ID NO: 8327426 - DNA, 22 bp, Homo sapiens
aaacagtattatcaatatattt

SEQ ID NO: 8327427 - DNA, 22 bp, Homo sapiens
aaacagtactcgatttttgtag

SEQ ID NO: 8327428 - DNA, 22 bp, Homo sapiens
aaacacattttaggaaaatcta

SEQ ID NO: 8327429 - DNA, 22 bp, Homo sapiens
aaacacattagccctgtggaaa

SEQ ID NO: 8327430 - DNA, 22 bp, Homo sapiens
aaagagcccttccatgactctt

SEQ ID NO: 8327431 - DNA, 22 bp, Homo sapiens
aaaattgaggctcatgttaaat

SEQ ID NO: 8327432 - DNA, 17 bp, Homo sapiens
aaaattctgtaaagagg

SEQ ID NO: 8327433 - DNA, 22 bp, Homo sapiens
aaacagctacttctgtataatg

SEQ ID NO: 8327434 - DNA, 22 bp, Homo sapiens
aaacagcagctgtttaatttgc

SEQ ID NO: 8327435 - DNA, 22 bp, Homo sapiens
aaagccaggcagccaagccagt

SEQ ID NO: 8327436 - DNA, 22 bp, Homo sapiens
aaagccagctctgagctgcacc

SEQ ID NO: 8327437 - DNA, 22 bp, Homo sapiens
aaagccaggaggagggcgctcg

SEQ ID NO: 8327438 - DNA, 22 bp, Homo sapiens
aaagccaggctggcctggggtt

SEQ ID NO: 8327439 - DNA, 22 bp, Homo sapiens
aaacagataagggacaatttca

SEQ ID NO: 8327440 - DNA, 22 bp, Homo sapiens
aaagccagagtgtgttagagac

SEQ ID NO: 8327441 - DNA, 22 bp, Homo sapiens
aaagccagcaaggtgagtttca

SEQ ID NO: 8327442 - DNA, 22 bp, Homo sapiens
aaagccagagcaagctgtcaca

SEQ ID NO: 8327443 - DNA, 22 bp, Homo sapiens
aaagccagaattcgtccagcct

SEQ ID NO: 8327444 - DNA, 22 bp, Homo sapiens
aaactgtaaacacagcagtaca

SEQ ID NO: 8327445 - DNA, 22 bp, Homo sapiens
aaactgtaaatactagtaagtg

SEQ ID NO: 8327446 - DNA, 22 bp, Homo sapiens
aaactgcaattacttttgcacc

SEQ ID NO: 8327447 - DNA, 22 bp, Homo sapiens
aaactgcaattacttttgcagc

SEQ ID NO: 8327448 - DNA, 22 bp, Homo sapiens
aaactgcaattatgtttgcaga

SEQ ID NO: 8327449 - DNA, 22 bp, Homo sapiens
aaacatgtttagaaagcagctg

SEQ ID NO: 8327450 - DNA, 22 bp, Homo sapiens
aaacatgtagtgcatgaggatc

SEQ ID NO: 8327451 - DNA, 22 bp, Homo sapiens
aaacatgtaagttcagatcacc

SEQ ID NO: 8327452 - DNA, 22 bp, Homo sapiens
aaacattagacaccatatgctc

SEQ ID NO: 8327453 - DNA, 21 bp, Homo sapiens
aaagatgtttcatctgagaaa

SEQ ID NO: 8327454 - DNA, 22 bp, Homo sapiens
aaagagatgtgccaaatagcct

SEQ ID NO: 8327455 - DNA, 22 bp, Homo sapiens
aaagagacaccaaagactctag

SEQ ID NO: 8327456 - DNA, 22 bp, Homo sapiens
aaagagaaaatgatctgtacat

SEQ ID NO: 8327457 - DNA, 22 bp, Homo sapiens
aaagagaaacttagaagcctga

SEQ ID NO: 8327458 - DNA, 22 bp, Homo sapiens
aaagactttcacctagcaaaga

SEQ ID NO: 8327459 - DNA, 22 bp, Homo sapiens
aaagacatggaactagagatgg

SEQ ID NO: 8327460 - DNA, 22 bp, Homo sapiens
aaagaacagatgtgtggtgcat

SEQ ID NO: 8327461 - DNA, 21 bp, Homo sapiens
aaagaacaggcagatgttctt

SEQ ID NO: 8327462 - DNA, 22 bp, Homo sapiens
aaagaacaaattagctgtttta

SEQ ID NO: 8327463 - DNA, 22 bp, Homo sapiens
aaagaaatagatggcatttaaa

SEQ ID NO: 8327464 - DNA, 22 bp, Homo sapiens
aaagaaatagatggcatttaaa

SEQ ID NO: 8327465 - DNA, 22 bp, Homo sapiens
aaatagttacttctgctgtctt

SEQ ID NO: 8327466 - DNA, 22 bp, Homo sapiens
aaatagttcagcttgtaaaccc

SEQ ID NO: 8327467 - DNA, 22 bp, Homo sapiens
aaatagttgtttggatcaataa

SEQ ID NO: 8327468 - DNA, 22 bp, Homo sapiens
aaatagtttagctctcatttca

SEQ ID NO: 8327469 - DNA, 22 bp, Homo sapiens
aagagggaggtgcgggtgcaga

SEQ ID NO: 8327470 - DNA, 23 bp, Homo sapiens
aaagtttgaagcaacagtagttg

SEQ ID NO: 8327471 - DNA, 22 bp, Homo sapiens
aaagttttagctgtccagttcc

SEQ ID NO: 8327472 - DNA, 22 bp, Homo sapiens
aaagtttggatccagcaaaaga

SEQ ID NO: 8327473 - DNA, 22 bp, Homo sapiens
aaagtttgttgcttacaaagaa

SEQ ID NO: 8327474 - DNA, 22 bp, Homo sapiens
aagaggggtggtctgtgaggat

SEQ ID NO: 8327475 - DNA, 22 bp, Homo sapiens
aaatacatttacagtcgtggct

SEQ ID NO: 8327476 - DNA, 23 bp, Homo sapiens
aaatacctgaattagatattatc

SEQ ID NO: 8327477 - DNA, 22 bp, Homo sapiens
aaatactagaattcagagttga

SEQ ID NO: 8327478 - DNA, 22 bp, Homo sapiens
aaatactattgaccaggtctct

SEQ ID NO: 8327479 - DNA, 22 bp, Homo sapiens
aagaacatgagttatgatgatt

SEQ ID NO: 8327480 - DNA, 22 bp, Homo sapiens
aaagtgaggacttgagtactgt

SEQ ID NO: 8327481 - DNA, 23 bp, Homo sapiens
aaagtgacttttataccactaac

SEQ ID NO: 8327482 - DNA, 15 bp, Homo sapiens
aaagtgcacccaata

SEQ ID NO: 8327483 - DNA, 22 bp, Homo sapiens
aaagtgcaatcagttagaccat

SEQ ID NO: 8327484 - DNA, 20 bp, Homo sapiens
aaagtgcacagatacagctc

SEQ ID NO: 8327485 - DNA, 20 bp, Homo sapiens
aaagtgcacagatacagctc

SEQ ID NO: 8327486 - DNA, 22 bp, Homo sapiens
aaagtgcactagaatccagatt

SEQ ID NO: 8327487 - DNA, 22 bp, Homo sapiens
aaagtgcacctgcttcttcttg

SEQ ID NO: 8327488 - DNA, 22 bp, Homo sapiens
aaagtgcactagaatccagatt

SEQ ID NO: 8327489 - DNA, 22 bp, Homo sapiens
aaagtgcaaggattacaggcat

SEQ ID NO: 8327490 - DNA, 22 bp, Homo sapiens
aaagtgcaaggattacaggcat

SEQ ID NO: 8327491 - DNA, 22 bp, Homo sapiens
aaagtgcaatcagttagaccat

SEQ ID NO: 8327492 - DNA, 22 bp, Homo sapiens
aaagtgcactctcagtgctgct

SEQ ID NO: 8327493 - DNA, 22 bp, Homo sapiens
aaagtgcagctgaaaacatcct

SEQ ID NO: 8327494 - DNA, 22 bp, Homo sapiens
aaagtgcagctgaaaacatcct

SEQ ID NO: 8327495 - DNA, 22 bp, Homo sapiens
aaagtgcagaactgttctcact

SEQ ID NO: 8327496 - DNA, 22 bp, Homo sapiens
aagacagatgcaacctgctagc

SEQ ID NO: 8327497 - DNA, 22 bp, Homo sapiens
aaagtgcagctgaaaacatcct

SEQ ID NO: 8327498 - DNA, 22 bp, Homo sapiens
aagactcttgcctaatacatct

SEQ ID NO: 8327499 - DNA, 22 bp, Homo sapiens
aagactgagtggcttaagaaaa

SEQ ID NO: 8327500 - DNA, 22 bp, Homo sapiens
aagattatggcagataacaatt

SEQ ID NO: 8327501 - DNA, 14 bp, Homo sapiens
aagatcaccttcct

SEQ ID NO: 8327502 - DNA, 22 bp, Homo sapiens
aagatcaagatttaggttgagg

SEQ ID NO: 8327503 - DNA, 22 bp, Homo sapiens
aagatcctgtactttcctcact

SEQ ID NO: 8327504 - DNA, 22 bp, Homo sapiens
aagcaggcatgggaggccatcc

SEQ ID NO: 8327505 - DNA, 22 bp, Homo sapiens
aagcccagatgtgagaactgag

SEQ ID NO: 8327506 - DNA, 22 bp, Homo sapiens
aaatctttccctttactatcca

SEQ ID NO: 8327507 - DNA, 22 bp, Homo sapiens
aagccgggcctgagaaatgaca

SEQ ID NO: 8327508 - DNA, 22 bp, Homo sapiens
aaatgcatgtagaataatagag

SEQ ID NO: 8327509 - DNA, 22 bp, Homo sapiens
aacataatgtggccaaagtcac

SEQ ID NO: 8327510 - DNA, 22 bp, Homo sapiens
aacataatgtggccaaagtcac

SEQ ID NO: 8327511 - DNA, 22 bp, Homo sapiens
aaagcactctatcctttgtaga

SEQ ID NO: 8327512 - DNA, 22 bp, Homo sapiens
aaagcactgcacatatatttgc

SEQ ID NO: 8327513 - DNA, 22 bp, Homo sapiens
aaagcactcgttagtatttctg

SEQ ID NO: 8327514 - DNA, 22 bp, Homo sapiens
aaagcagactgatttgcatcac

SEQ ID NO: 8327515 - DNA, 22 bp, Homo sapiens
aacagtgagttgatgactgaat

SEQ ID NO: 8327516 - DNA, 22 bp, Homo sapiens
aacagtgatatcaagacagaca

SEQ ID NO: 8327517 - DNA, 22 bp, Homo sapiens
aacagtgagttgatgactgaat

SEQ ID NO: 8327518 - DNA, 22 bp, Homo sapiens
aaagatttatgaagttcaatta

SEQ ID NO: 8327519 - DNA, 22 bp, Homo sapiens
aaagattaaggtattgttagct

SEQ ID NO: 8327520 - DNA, 22 bp, Homo sapiens
aaagattagataagatagattt

SEQ ID NO: 8327521 - DNA, 22 bp, Homo sapiens
aaagattaggcggcaactgggc

SEQ ID NO: 8327522 - DNA, 22 bp, Homo sapiens
aaagattatggcattgaaatac

SEQ ID NO: 8327523 - DNA, 22 bp, Homo sapiens
aaagattaaatcaaattggtca

SEQ ID NO: 8327524 - DNA, 22 bp, Homo sapiens
aaagtaattgcagtttctgcca

SEQ ID NO: 8327525 - DNA, 22 bp, Homo sapiens
aaagtaagggttaatctacttt

SEQ ID NO: 8327526 - DNA, 22 bp, Homo sapiens
aaagtaaagattgggaatgtgt

SEQ ID NO: 8327527 - DNA, 22 bp, Homo sapiens
aactgtagcaaagaacagctct

SEQ ID NO: 8327528 - DNA, 22 bp, Homo sapiens
aactgtagtgcttatagactct

SEQ ID NO: 8327529 - DNA, 22 bp, Homo sapiens
aactgcaaagccaatctcagga

SEQ ID NO: 8327530 - DNA, 21 bp, Homo sapiens
aactgcaaatcttagactgca

SEQ ID NO: 8327531 - DNA, 21 bp, Homo sapiens
aactgcaaatgatgctggaga

SEQ ID NO: 8327532 - DNA, 22 bp, Homo sapiens
aactgcaaaataatcaagttgt

SEQ ID NO: 8327533 - DNA, 22 bp, Homo sapiens
aaaggcagtgggtatgtggatc

SEQ ID NO: 8327534 - DNA, 22 bp, Homo sapiens
aacccgagggccccaggctcgg

SEQ ID NO: 8327535 - DNA, 22 bp, Homo sapiens
aacccgggaggcagaggttgtg

SEQ ID NO: 8327536 - DNA, 22 bp, Homo sapiens
acaagcatgtggtaaaaagacc

SEQ ID NO: 8327537 - DNA, 22 bp, Homo sapiens
acaagcataagtgagatgaata

SEQ ID NO: 8327538 - DNA, 22 bp, Homo sapiens
acaagcatcaggttcagcaata

SEQ ID NO: 8327539 - DNA, 22 bp, Homo sapiens
acaagcgggccacagtgctggt

SEQ ID NO: 8327540 - DNA, 22 bp, Homo sapiens
acaagattttatgactcttttt

SEQ ID NO: 8327541 - DNA, 23 bp, Homo sapiens
acaagatagggataaaaagataa

SEQ ID NO: 8327542 - DNA, 22 bp, Homo sapiens
acaatgattttttagagtagtt

SEQ ID NO: 8327543 - DNA, 22 bp, Homo sapiens
acaatgaacgctttttaactgt

SEQ ID NO: 8327544 - DNA, 22 bp, Homo sapiens
agataataagtctggtaataat

SEQ ID NO: 8327545 - DNA, 22 bp, Homo sapiens
agataataaatgttttaggttt

SEQ ID NO: 8327546 - DNA, 22 bp, Homo sapiens
acaagaatgtagattagttaag

SEQ ID NO: 8327547 - DNA, 22 bp, Homo sapiens
acaagagcattgcaggtgtgtt

SEQ ID NO: 8327548 - DNA, 22 bp, Homo sapiens
acaagagccctttcagattgac

SEQ ID NO: 8327549 - DNA, 22 bp, Homo sapiens
agataaattcctaagatttcag

SEQ ID NO: 8327550 - DNA, 22 bp, Homo sapiens
agataactcattttgtatatcc

SEQ ID NO: 8327551 - DNA, 22 bp, Homo sapiens
acaacaaagacacttgaaatga

SEQ ID NO: 8327552 - DNA, 22 bp, Homo sapiens
acaacaaagacacttgaaatga

SEQ ID NO: 8327553 - DNA, 22 bp, Homo sapiens
agaggggttaagtgctagtccg

SEQ ID NO: 8327554 - DNA, 22 bp, Homo sapiens
agaggctctaatcccctccaca

SEQ ID NO: 8327555 - DNA, 22 bp, Homo sapiens
agaggctctaataccagcatgg

SEQ ID NO: 8327556 - DNA, 22 bp, Homo sapiens
agaggctctgccgcctcaggta

SEQ ID NO: 8327557 - DNA, 22 bp, Homo sapiens
agaggctctggtgcagcatgca

SEQ ID NO: 8327558 - DNA, 22 bp, Homo sapiens
aattgcatatatatgaggccat

SEQ ID NO: 8327559 - DNA, 22 bp, Homo sapiens
aattgcattacagaaactttca

SEQ ID NO: 8327560 - DNA, 22 bp, Homo sapiens
aattgacaaatcatacttgtat

SEQ ID NO: 8327561 - DNA, 22 bp, Homo sapiens
aattcttaatcccataaagtga

SEQ ID NO: 8327562 - DNA, 20 bp, Homo sapiens
agaggcttccttgggaggag

SEQ ID NO: 8327563 - DNA, 22 bp, Homo sapiens
agaggctgtgcagagggagtgc

SEQ ID NO: 8327564 - DNA, 22 bp, Homo sapiens
agaggctgtgcccaccaggcaa

SEQ ID NO: 8327565 - DNA, 22 bp, Homo sapiens
agaggctgtgcccaccaggcaa

SEQ ID NO: 8327566 - DNA, 22 bp, Homo sapiens
agaggctgttacactcccagat

SEQ ID NO: 8327567 - DNA, 22 bp, Homo sapiens
agaggctgtgcccaccaggcaa

SEQ ID NO: 8327568 - DNA, 22 bp, Homo sapiens
acaaagtaagggctaatgagca

SEQ ID NO: 8327569 - DNA, 22 bp, Homo sapiens
acaaagtagtcaaagtagatga

SEQ ID NO: 8327570 - DNA, 22 bp, Homo sapiens
acaaagtaggtcatcaaagctc

SEQ ID NO: 8327571 - DNA, 22 bp, Homo sapiens
acaaagtaggaagattagctga

SEQ ID NO: 8327572 - DNA, 22 bp, Homo sapiens
agagggggaaaatagaggtgtt

SEQ ID NO: 8327573 - DNA, 22 bp, Homo sapiens
agagggggaaaatagaggtgtt

SEQ ID NO: 8327574 - DNA, 22 bp, Homo sapiens
agagggggaaaatagaggtgtt

SEQ ID NO: 8327575 - DNA, 22 bp, Homo sapiens
agagggggcagcggaccagtga

SEQ ID NO: 8327576 - DNA, 22 bp, Homo sapiens
agagggggcagcggaccagtga

SEQ ID NO: 8327577 - DNA, 22 bp, Homo sapiens
agagggggcagcggaccagtga

SEQ ID NO: 8327578 - DNA, 22 bp, Homo sapiens
agagggggtgttccagaagcat

SEQ ID NO: 8327579 - DNA, 22 bp, Homo sapiens
agagggggtgttccagaagcat

SEQ ID NO: 8327580 - DNA, 22 bp, Homo sapiens
agagggggtgtcagcactgcag

SEQ ID NO: 8327581 - DNA, 22 bp, Homo sapiens
agagggggtgtcagcactgcag

SEQ ID NO: 8327582 - DNA, 22 bp, Homo sapiens
agagggggtgtcagcactgcag

SEQ ID NO: 8327583 - DNA, 20 bp, Homo sapiens
agagcctggaaaaagacatc

SEQ ID NO: 8327584 - DNA, 22 bp, Homo sapiens
agagcctggacctgggctctga

SEQ ID NO: 8327585 - DNA, 22 bp, Homo sapiens
agagcctggacctgagctacaa

SEQ ID NO: 8327586 - DNA, 22 bp, Homo sapiens
agagcctgcatcaggcttgggg

SEQ ID NO: 8327587 - DNA, 22 bp, Homo sapiens
agagacagggttttgccatgtt

SEQ ID NO: 8327588 - DNA, 22 bp, Homo sapiens
agagacaggatatctgctcatg

SEQ ID NO: 8327589 - DNA, 22 bp, Homo sapiens
agaccccatacctcagcaggta

SEQ ID NO: 8327590 - DNA, 22 bp, Homo sapiens
agaccctctcctcatggacatg

SEQ ID NO: 8327591 - DNA, 22 bp, Homo sapiens
agaccctttgggtctgtgcagg

SEQ ID NO: 8327592 - DNA, 22 bp, Homo sapiens
aatgttttaaaagagattgaga

SEQ ID NO: 8327593 - DNA, 22 bp, Homo sapiens
agagacaggaatggcattaaga

SEQ ID NO: 8327594 - DNA, 22 bp, Homo sapiens
aattaacagagggcttattact

SEQ ID NO: 8327595 - DNA, 18 bp, Homo sapiens
agagacagcagcaaaaga

SEQ ID NO: 8327596 - DNA, 22 bp, Homo sapiens
aattaaaagataacccatgagt

SEQ ID NO: 8327597 - DNA, 22 bp, Homo sapiens
aattaaaagataacccatgagt

SEQ ID NO: 8327598 - DNA, 22 bp, Homo sapiens
aattaaaagataacccatgagt

SEQ ID NO: 8327599 - DNA, 20 bp, Homo sapiens
agacaaaatgacttcatgca

SEQ ID NO: 8327600 - DNA, 22 bp, Homo sapiens
agacaatgtttggtctacactt

SEQ ID NO: 8327601 - DNA, 19 bp, Homo sapiens
agacaatggggttggcagt

SEQ ID NO: 8327602 - DNA, 22 bp, Homo sapiens
agacaatgtcaaggtgatcatc

SEQ ID NO: 8327603 - DNA, 22 bp, Homo sapiens
agacaatggagagcagagtact

SEQ ID NO: 8327604 - DNA, 22 bp, Homo sapiens
agacaatggctaagtaacctgt

SEQ ID NO: 8327605 - DNA, 22 bp, Homo sapiens
agacaatggagggaaatacttc

SEQ ID NO: 8327606 - DNA, 20 bp, Homo sapiens
agacaatgagtgacagagtt

SEQ ID NO: 8327607 - DNA, 22 bp, Homo sapiens
agacaatgcaagcagggagtgg

SEQ ID NO: 8327608 - DNA, 22 bp, Homo sapiens
agacaatatgtatattaagaat

SEQ ID NO: 8327609 - DNA, 22 bp, Homo sapiens
agacaatatgtatattaagaat

SEQ ID NO: 8327610 - DNA, 22 bp, Homo sapiens
aatggcagaggcaaagatggta

SEQ ID NO: 8327611 - DNA, 22 bp, Homo sapiens
aatggagaggctgtgagtgaga

SEQ ID NO: 8327612 - DNA, 22 bp, Homo sapiens
aatggtttaacatatgcttgag

SEQ ID NO: 8327613 - DNA, 22 bp, Homo sapiens
aatggtttgtacctgtccttgg

SEQ ID NO: 8327614 - DNA, 23 bp, Homo sapiens
aatgggtgcaactatccatgaca

SEQ ID NO: 8327615 - DNA, 23 bp, Homo sapiens
aatgggtgcaactatccatgaca

SEQ ID NO: 8327616 - DNA, 22 bp, Homo sapiens
aatgtaaaatatcttgtacttg

SEQ ID NO: 8327617 - DNA, 22 bp, Homo sapiens
aatgtaaaatatcttgtacttg

SEQ ID NO: 8327618 - DNA, 18 bp, Homo sapiens
aatgtgaatatttacttc

SEQ ID NO: 8327619 - DNA, 22 bp, Homo sapiens
agcagagcctgggctaggggtg

SEQ ID NO: 8327620 - DNA, 22 bp, Homo sapiens
acacagaagatctcttaatgct

SEQ ID NO: 8327621 - DNA, 22 bp, Homo sapiens
agcagatggtgtcatgggatgg

SEQ ID NO: 8327622 - DNA, 22 bp, Homo sapiens
agcagagccagaattggaccag

SEQ ID NO: 8327623 - DNA, 22 bp, Homo sapiens
agcagagcatggtgggaagggc

SEQ ID NO: 8327624 - DNA, 22 bp, Homo sapiens
acaatgcatacctagcagctca

SEQ ID NO: 8327625 - DNA, 22 bp, Homo sapiens
acaatgcacctattttaaaact

SEQ ID NO: 8327626 - DNA, 22 bp, Homo sapiens
acaatgcacctattttaaaact

SEQ ID NO: 8327627 - DNA, 21 bp, Homo sapiens
acacagaggcatcatcacttt

SEQ ID NO: 8327628 - DNA, 22 bp, Homo sapiens
acacagaggcatgacagtggct

SEQ ID NO: 8327629 - DNA, 22 bp, Homo sapiens
acacagaggaaagtgtgaaggg

SEQ ID NO: 8327630 - DNA, 22 bp, Homo sapiens
acacagagtatcttttgcctag

SEQ ID NO: 8327631 - DNA, 22 bp, Homo sapiens
acacagaggctccagagataga

SEQ ID NO: 8327632 - DNA, 22 bp, Homo sapiens
acacagaggctccagagataga

SEQ ID NO: 8327633 - DNA, 22 bp, Homo sapiens
acacagagggcagaagatacat

SEQ ID NO: 8327634 - DNA, 22 bp, Homo sapiens
acacagagggcagaagatacat

SEQ ID NO: 8327635 - DNA, 22 bp, Homo sapiens
acacagagtttgacacatggga

SEQ ID NO: 8327636 - DNA, 22 bp, Homo sapiens
acacagagttattatgtgaact

SEQ ID NO: 8327637 - DNA, 22 bp, Homo sapiens
acacagagtccttactgaggta

SEQ ID NO: 8327638 - DNA, 22 bp, Homo sapiens
acactgagcatctctagaggca

SEQ ID NO: 8327639 - DNA, 22 bp, Homo sapiens
acacttcagcagtatgcttggg

SEQ ID NO: 8327640 - DNA, 22 bp, Homo sapiens
acactgagttttaccaggcaca

SEQ ID NO: 8327641 - DNA, 22 bp, Homo sapiens
acacatcttagactgaaatatg

SEQ ID NO: 8327642 - DNA, 17 bp, Homo sapiens
acacagggagagggagc

SEQ ID NO: 8327643 - DNA, 22 bp, Homo sapiens
acacatgtatatgcttgtgtgt

SEQ ID NO: 8327644 - DNA, 22 bp, Homo sapiens
agctcctgcacccagccttgag

SEQ ID NO: 8327645 - DNA, 22 bp, Homo sapiens
agctcctgcaccaggggcccct

SEQ ID NO: 8327646 - DNA, 22 bp, Homo sapiens
agctcctgcccaggaaggctct

SEQ ID NO: 8327647 - DNA, 22 bp, Homo sapiens
agctcctgcccaggaaggctct

SEQ ID NO: 8327648 - DNA, 19 bp, Homo sapiens
acagcacagaaatatttca

SEQ ID NO: 8327649 - DNA, 22 bp, Homo sapiens
acagcacaatctgagtcccaga

SEQ ID NO: 8327650 - DNA, 22 bp, Homo sapiens
acagcacagagtggtatggctg

SEQ ID NO: 8327651 - DNA, 22 bp, Homo sapiens
acagcacagagtggtatggctg

SEQ ID NO: 8327652 - DNA, 22 bp, Homo sapiens
agctcctgcgcacggtgcacac

SEQ ID NO: 8327653 - DNA, 22 bp, Homo sapiens
agctcctgcttgacagaagagg

SEQ ID NO: 8327654 - DNA, 22 bp, Homo sapiens
acagattcactgcactggccat

SEQ ID NO: 8327655 - DNA, 22 bp, Homo sapiens
acagatggccatattactatat

SEQ ID NO: 8327656 - DNA, 22 bp, Homo sapiens
acagagctaatgttgcataggc

SEQ ID NO: 8327657 - DNA, 22 bp, Homo sapiens
acagatgatgtgcacagataga

SEQ ID NO: 8327658 - DNA, 22 bp, Homo sapiens
acagatgagttaaagcagagtg

SEQ ID NO: 8327659 - DNA, 22 bp, Homo sapiens
acagatgagttagaataggcag

SEQ ID NO: 8327660 - DNA, 22 bp, Homo sapiens
agcctctgatggctcccaagga

SEQ ID NO: 8327661 - DNA, 22 bp, Homo sapiens
agcctctgatggctcccaagga

SEQ ID NO: 8327662 - DNA, 22 bp, Homo sapiens
agcctctgatgatcacaggggg

SEQ ID NO: 8327663 - DNA, 22 bp, Homo sapiens
agccagggtctctcgctctgtt

SEQ ID NO: 8327664 - DNA, 22 bp, Homo sapiens
acagactgtttggttcatgtct

SEQ ID NO: 8327665 - DNA, 22 bp, Homo sapiens
acagagaaactaaggagtttgg

SEQ ID NO: 8327666 - DNA, 22 bp, Homo sapiens
acagacattcatatcctcggta

SEQ ID NO: 8327667 - DNA, 22 bp, Homo sapiens
acagactgtgagtatgcatagt

SEQ ID NO: 8327668 - DNA, 22 bp, Homo sapiens
acagactgtcccaccacatgga

SEQ ID NO: 8327669 - DNA, 22 bp, Homo sapiens
acagagaaagtgggctgaagat

SEQ ID NO: 8327670 - DNA, 22 bp, Homo sapiens
acacttttaagactttaatgaa

SEQ ID NO: 8327671 - DNA, 22 bp, Homo sapiens
acagaaaatgccagaagggtgg

SEQ ID NO: 8327672 - DNA, 22 bp, Homo sapiens
acagaaaaatgagggagctgga

SEQ ID NO: 8327673 - DNA, 22 bp, Homo sapiens
acagaaaagtttacttttgctc

SEQ ID NO: 8327674 - DNA, 19 bp, Homo sapiens
accaggcttatggtcagtg

SEQ ID NO: 8327675 - DNA, 22 bp, Homo sapiens
accaggcttgataccaagaaat

SEQ ID NO: 8327676 - DNA, 19 bp, Homo sapiens
accaggcttatggtcagtg

SEQ ID NO: 8327677 - DNA, 22 bp, Homo sapiens
accaggcttaatcctttgctat

SEQ ID NO: 8327678 - DNA, 21 bp, Homo sapiens
acattttctgttttaggaagt

SEQ ID NO: 8327679 - DNA, 22 bp, Homo sapiens
accatgttggccaagctggtct

SEQ ID NO: 8327680 - DNA, 21 bp, Homo sapiens
accaggcttgtgggagggagc

SEQ ID NO: 8327681 - DNA, 22 bp, Homo sapiens
accaggcttgatgatttgctta

SEQ ID NO: 8327682 - DNA, 22 bp, Homo sapiens
acccagagctgggcttggcaaa

SEQ ID NO: 8327683 - DNA, 22 bp, Homo sapiens
acccagaggcggaggttgcagt

SEQ ID NO: 8327684 - DNA, 22 bp, Homo sapiens
acccagagtcagacagccatgg

SEQ ID NO: 8327685 - DNA, 22 bp, Homo sapiens
acccagagtcatggcacttagc

SEQ ID NO: 8327686 - DNA, 22 bp, Homo sapiens
acccaggaggcaaggttgcagt

SEQ ID NO: 8327687 - DNA, 22 bp, Homo sapiens
accccttctcctggctgttcca

SEQ ID NO: 8327688 - DNA, 22 bp, Homo sapiens
accctgagatgccacagcatga

SEQ ID NO: 8327689 - DNA, 21 bp, Homo sapiens
aaggctggagatgcaggtctg

SEQ ID NO: 8327690 - DNA, 22 bp, Homo sapiens
acatttaaatacctatgtttct

SEQ ID NO: 8327691 - DNA, 22 bp, Homo sapiens
acatttgtgcaacgtatccaca

SEQ ID NO: 8327692 - DNA, 22 bp, Homo sapiens
acatttctcttgatgtctctat

SEQ ID NO: 8327693 - DNA, 22 bp, Homo sapiens
aaggctctctgatggcagcagt

SEQ ID NO: 8327694 - DNA, 22 bp, Homo sapiens
aaggctctgcaaaacctccaag

SEQ ID NO: 8327695 - DNA, 23 bp, Homo sapiens
aagcgtcttttcaatgtggctgg

SEQ ID NO: 8327696 - DNA, 22 bp, Homo sapiens
aagctatgagctaggcatctct

SEQ ID NO: 8327697 - DNA, 19 bp, Homo sapiens
acagcctgttggtggggct

SEQ ID NO: 8327698 - DNA, 22 bp, Homo sapiens
aagcattttgttttaagaatga

SEQ ID NO: 8327699 - DNA, 22 bp, Homo sapiens
aagctatgttcctgcactgctc

SEQ ID NO: 8327700 - DNA, 22 bp, Homo sapiens
aaggagacatttgcagagcacc

SEQ ID NO: 8327701 - DNA, 22 bp, Homo sapiens
aaggagcacacaatctagaacc

SEQ ID NO: 8327702 - DNA, 22 bp, Homo sapiens
aaggaggaataaagaggtggtg

SEQ ID NO: 8327703 - DNA, 19 bp, Homo sapiens
acagtcttacaaatgtcca

SEQ ID NO: 8327704 - DNA, 22 bp, Homo sapiens
acagtcttcagaagggattggg

SEQ ID NO: 8327705 - DNA, 22 bp, Homo sapiens
acagtctttcagtaataatact

SEQ ID NO: 8327706 - DNA, 22 bp, Homo sapiens
aaggaggcagaactcacatgga

SEQ ID NO: 8327707 - DNA, 22 bp, Homo sapiens
aaggcagagggctggatcagag

SEQ ID NO: 8327708 - DNA, 22 bp, Homo sapiens
actgaggttgaaatagtgatgt

SEQ ID NO: 8327709 - DNA, 22 bp, Homo sapiens
actgcactccaacctgggtgac

SEQ ID NO: 8327710 - DNA, 22 bp, Homo sapiens
actctgcttattgctgcaggca

SEQ ID NO: 8327711 - DNA, 22 bp, Homo sapiens
actctgcttccacttttgctaa

SEQ ID NO: 8327712 - DNA, 22 bp, Homo sapiens
actctgcttgggccatatctgg

SEQ ID NO: 8327713 - DNA, 22 bp, Homo sapiens
actctgcttgcccaatggaaac

SEQ ID NO: 8327714 - DNA, 22 bp, Homo sapiens
actctgctcttatagtgttata

SEQ ID NO: 8327715 - DNA, 17 bp, Homo sapiens
actctgctgaagtagaa

SEQ ID NO: 8327716 - DNA, 22 bp, Homo sapiens
actctgctctttggacaatgcc

SEQ ID NO: 8327717 - DNA, 22 bp, Homo sapiens
actctgctgtctgatggcagga

SEQ ID NO: 8327718 - DNA, 22 bp, Homo sapiens
actctgcttaattaaaaccagg

SEQ ID NO: 8327719 - DNA, 22 bp, Homo sapiens
actctgctgtttactctctata

SEQ ID NO: 8327720 - DNA, 22 bp, Homo sapiens
actctgctggctgcagggcagc

SEQ ID NO: 8327721 - DNA, 21 bp, Homo sapiens
actctgctgcgggcttggcct

SEQ ID NO: 8327722 - DNA, 22 bp, Homo sapiens
actctgctgataggtcctcaga

SEQ ID NO: 8327723 - DNA, 22 bp, Homo sapiens
actgagactttgttgagttctt

SEQ ID NO: 8327724 - DNA, 22 bp, Homo sapiens
actggctgaaagtaaagaacac

SEQ ID NO: 8327725 - DNA, 22 bp, Homo sapiens
actggccagaactaagtcacat

SEQ ID NO: 8327726 - DNA, 22 bp, Homo sapiens
actggccaggcacagctgtggg

SEQ ID NO: 8327727 - DNA, 22 bp, Homo sapiens
actggccaggcagcagtagctt

SEQ ID NO: 8327728 - DNA, 22 bp, Homo sapiens
actggctgaggaagttgccact

SEQ ID NO: 8327729 - DNA, 22 bp, Homo sapiens
aatacagaggcttccagtaaaa

SEQ ID NO: 8327730 - DNA, 22 bp, Homo sapiens
aataccttccaacatcaagaca

SEQ ID NO: 8327731 - DNA, 22 bp, Homo sapiens
aataccttccacagtgaccttg

SEQ ID NO: 8327732 - DNA, 22 bp, Homo sapiens
aataccttttcagtgcacaaaa

SEQ ID NO: 8327733 - DNA, 22 bp, Homo sapiens
aatacctttcctgccattcact

SEQ ID NO: 8327734 - DNA, 22 bp, Homo sapiens
aatacctttcctgccattcact

SEQ ID NO: 8327735 - DNA, 22 bp, Homo sapiens
aataccttgctcatagggctga

SEQ ID NO: 8327736 - DNA, 22 bp, Homo sapiens
aataccttgctgtagccacgca

SEQ ID NO: 8327737 - DNA, 22 bp, Homo sapiens
actggagtacagtggcgtgaac

SEQ ID NO: 8327738 - DNA, 22 bp, Homo sapiens
actggagtgtttggaggatgca

SEQ ID NO: 8327739 - DNA, 22 bp, Homo sapiens
actggagtgagtatcgatgaac

SEQ ID NO: 8327740 - DNA, 22 bp, Homo sapiens
actggagtattgtttaatacca

SEQ ID NO: 8327741 - DNA, 22 bp, Homo sapiens
actggagtagatctgactgagt

SEQ ID NO: 8327742 - DNA, 22 bp, Homo sapiens
actcactgcactttgaaatgtg

SEQ ID NO: 8327743 - DNA, 22 bp, Homo sapiens
actacagaagtcttattagaga

SEQ ID NO: 8327744 - DNA, 22 bp, Homo sapiens
acctaaatctacctcatgtttt

SEQ ID NO: 8327745 - DNA, 22 bp, Homo sapiens
acctaataaaggtaaattctgt

SEQ ID NO: 8327746 - DNA, 22 bp, Homo sapiens
acggggctagagaaggtttctt

SEQ ID NO: 8327747 - DNA, 22 bp, Homo sapiens
acggtgaccaagcatcaccgag

SEQ ID NO: 8327748 - DNA, 18 bp, Homo sapiens
acgtgctgtgccttttgc

SEQ ID NO: 8327749 - DNA, 22 bp, Homo sapiens
acgtggagagaatagggcacca

SEQ ID NO: 8327750 - DNA, 22 bp, Homo sapiens
actttcttaggctgtataaatg

SEQ ID NO: 8327751 - DNA, 22 bp, Homo sapiens
actttcttatccatgatctcac

SEQ ID NO: 8327752 - DNA, 22 bp, Homo sapiens
actttcttcttatgcattaagg

SEQ ID NO: 8327753 - DNA, 22 bp, Homo sapiens
actttgaaatgtgtaagagaga

SEQ ID NO: 8327754 - DNA, 22 bp, Homo sapiens
aatcagaaagaggtcatgttgc

SEQ ID NO: 8327755 - DNA, 22 bp, Homo sapiens
aatcacatgaaaactgtgtgtt

SEQ ID NO: 8327756 - DNA, 22 bp, Homo sapiens
actgttgaagtgccagcttgat

SEQ ID NO: 8327757 - DNA, 22 bp, Homo sapiens
aatactatgtagccaaaataat

SEQ ID NO: 8327758 - DNA, 22 bp, Homo sapiens
aatatagttctagaaatatttt

SEQ ID NO: 8327759 - DNA, 22 bp, Homo sapiens
aatatagaatcactttccttca

SEQ ID NO: 8327760 - DNA, 22 bp, Homo sapiens
aatatagatttactcaagagaa

SEQ ID NO: 8327761 - DNA, 22 bp, Homo sapiens
aatataattttattcctagagt

SEQ ID NO: 8327762 - DNA, 22 bp, Homo sapiens
aatagtacaatctacagacata

SEQ ID NO: 8327763 - DNA, 22 bp, Homo sapiens
aatgatttggcaaaggaatcca

SEQ ID NO: 8327764 - DNA, 22 bp, Homo sapiens
agaaattattagtgaatagtct

SEQ ID NO: 8327765 - DNA, 22 bp, Homo sapiens
agaaattatgcagtagttttat

SEQ ID NO: 8327766 - DNA, 22 bp, Homo sapiens
agaacaaaattagaggagtgca

SEQ ID NO: 8327767 - DNA, 22 bp, Homo sapiens
aatgataagacatgagtagagg

SEQ ID NO: 8327768 - DNA, 22 bp, Homo sapiens
agaacaatgcgtattttactcc

SEQ ID NO: 8327769 - DNA, 22 bp, Homo sapiens
agaacaatgttaaattattaag

SEQ ID NO: 8327770 - DNA, 22 bp, Homo sapiens
aatcataattcaaataagctta

SEQ ID NO: 8327771 - DNA, 22 bp, Homo sapiens
agaaatgacaagactgatcagg

SEQ ID NO: 8327772 - DNA, 22 bp, Homo sapiens
agaaatgaagcaggagttatta

SEQ ID NO: 8327773 - DNA, 22 bp, Homo sapiens
agaaatgaagcaggagttatta

SEQ ID NO: 8327774 - DNA, 22 bp, Homo sapiens
gtggatggattgaggcagtggg

SEQ ID NO: 8327775 - DNA, 22 bp, Homo sapiens
gtggatggattgaggcagtggg

SEQ ID NO: 8327776 - DNA, 22 bp, Homo sapiens
gtggatggtggtccagtatcat

SEQ ID NO: 8327777 - DNA, 22 bp, Homo sapiens
gtggacaggcaggctgtcgggg

SEQ ID NO: 8327778 - DNA, 22 bp, Homo sapiens
gtggacagacataatcctaatt

SEQ ID NO: 8327779 - DNA, 22 bp, Homo sapiens
gtggacagagataataaactga

SEQ ID NO: 8327780 - DNA, 22 bp, Homo sapiens
gtggacagcttctaggtgccag

SEQ ID NO: 8327781 - DNA, 22 bp, Homo sapiens
gtggagagcaaataattggaat

SEQ ID NO: 8327782 - DNA, 22 bp, Homo sapiens
gtggagtggcctggccctgaga

SEQ ID NO: 8327783 - DNA, 17 bp, Homo sapiens
gtggaggtgctctggta

SEQ ID NO: 8327784 - DNA, 22 bp, Homo sapiens
gtggaggcagtgacacagtagc

SEQ ID NO: 8327785 - DNA, 22 bp, Homo sapiens
gtggaggagaggcgccttgcgg

SEQ ID NO: 8327786 - DNA, 22 bp, Homo sapiens
gtggagggaatgaatcttctct

SEQ ID NO: 8327787 - DNA, 22 bp, Homo sapiens
gtggagggtgagctcatgtttg

SEQ ID NO: 8327788 - DNA, 22 bp, Homo sapiens
gtggagggtgattgccggctgt

SEQ ID NO: 8327789 - DNA, 22 bp, Homo sapiens
gtggagggtgattgccggctgt

SEQ ID NO: 8327790 - DNA, 22 bp, Homo sapiens
gtggagggtgattgccggctgt

SEQ ID NO: 8327791 - DNA, 22 bp, Homo sapiens
gtgacattttttaagcccttgt

SEQ ID NO: 8327792 - DNA, 22 bp, Homo sapiens
gtgaccagccagtgctgtctgt

SEQ ID NO: 8327793 - DNA, 22 bp, Homo sapiens
gtgcctgagccagctgcagctc

SEQ ID NO: 8327794 - DNA, 22 bp, Homo sapiens
gtgcctggaactgggtaggctg

SEQ ID NO: 8327795 - DNA, 22 bp, Homo sapiens
gtgcctggaactgggtaggctg

SEQ ID NO: 8327796 - DNA, 22 bp, Homo sapiens
gtgacaggcccagtgggatgca

SEQ ID NO: 8327797 - DNA, 22 bp, Homo sapiens
gtgacagatttgctgcgcatgg

SEQ ID NO: 8327798 - DNA, 22 bp, Homo sapiens
gtgacagagttttagatctcat

SEQ ID NO: 8327799 - DNA, 22 bp, Homo sapiens
gtgacagattatagggagcgtt

SEQ ID NO: 8327800 - DNA, 22 bp, Homo sapiens
gtgacaaggaaagacagactgt

SEQ ID NO: 8327801 - DNA, 22 bp, Homo sapiens
gtgacaaaaacactgattattt

SEQ ID NO: 8327802 - DNA, 22 bp, Homo sapiens
gtgcgggggttcccagcagccg

SEQ ID NO: 8327803 - DNA, 23 bp, Homo sapiens
gtgcgccaggacaacctgacgga

SEQ ID NO: 8327804 - DNA, 22 bp, Homo sapiens
gtggaaggaagagatggcccca

SEQ ID NO: 8327805 - DNA, 22 bp, Homo sapiens
gtggaagggtcacagcccctac

SEQ ID NO: 8327806 - DNA, 21 bp, Homo sapiens
gtggccctggtgtggctgcac

SEQ ID NO: 8327807 - DNA, 22 bp, Homo sapiens
gtggcccttggagttgtgacct

SEQ ID NO: 8327808 - DNA, 22 bp, Homo sapiens
gtggcctggatagactccatct

SEQ ID NO: 8327809 - DNA, 22 bp, Homo sapiens
gtggcctggctggcaccacctc

SEQ ID NO: 8327810 - DNA, 22 bp, Homo sapiens
gtggctgcagagccagcaagct

SEQ ID NO: 8327811 - DNA, 17 bp, Homo sapiens
gtggctgcacacacatg

SEQ ID NO: 8327812 - DNA, 22 bp, Homo sapiens
gtggctctctggtcccctgcca

SEQ ID NO: 8327813 - DNA, 22 bp, Homo sapiens
gtggctgggctccgagcggctt

SEQ ID NO: 8327814 - DNA, 22 bp, Homo sapiens
gtggctgcagcccagcggcacg

SEQ ID NO: 8327815 - DNA, 22 bp, Homo sapiens
gtggctgcagagggcacagcat

SEQ ID NO: 8327816 - DNA, 22 bp, Homo sapiens
gtgggagctgctacctccttcc

SEQ ID NO: 8327817 - DNA, 22 bp, Homo sapiens
gtggccagaggtcccatgtgtc

SEQ ID NO: 8327818 - DNA, 22 bp, Homo sapiens
gtggccagccagggtgctgatg

SEQ ID NO: 8327819 - DNA, 22 bp, Homo sapiens
gtggccagccccatggacagtt

SEQ ID NO: 8327820 - DNA, 22 bp, Homo sapiens
gtggccagaagactgcaatgct

SEQ ID NO: 8327821 - DNA, 22 bp, Homo sapiens
gtggccagaagttaagtggtta

SEQ ID NO: 8327822 - DNA, 22 bp, Homo sapiens
gtggccagaaccaggagaatga

SEQ ID NO: 8327823 - DNA, 22 bp, Homo sapiens
gtggccagaatcttgaggcctt

SEQ ID NO: 8327824 - DNA, 22 bp, Homo sapiens
gtggccctggagttgtgacact

SEQ ID NO: 8327825 - DNA, 21 bp, Homo sapiens
gtggccctgccgcagtgtcca

SEQ ID NO: 8327826 - DNA, 22 bp, Homo sapiens
gtggcccaggcttggcgctggc

SEQ ID NO: 8327827 - DNA, 22 bp, Homo sapiens
gtggcccaggctggagtgcagt

SEQ ID NO: 8327828 - DNA, 22 bp, Homo sapiens
gtggcccaggcaccctgatgac

SEQ ID NO: 8327829 - DNA, 22 bp, Homo sapiens
gtggcccatcacgtttcgcctt

SEQ ID NO: 8327830 - DNA, 22 bp, Homo sapiens
gtggcccaggttggagtgcagt

SEQ ID NO: 8327831 - DNA, 22 bp, Homo sapiens
gtggccagctgtcagcaccctt

SEQ ID NO: 8327832 - DNA, 22 bp, Homo sapiens
gtggccaggacattgccaggca

SEQ ID NO: 8327833 - DNA, 22 bp, Homo sapiens
gtggccaggagagggtgggaca

SEQ ID NO: 8327834 - DNA, 22 bp, Homo sapiens
gtggcccacttacgtcatgtgt

SEQ ID NO: 8327835 - DNA, 22 bp, Homo sapiens
gtggcccagccctacagaggac

SEQ ID NO: 8327836 - DNA, 22 bp, Homo sapiens
gtggcaggagtgggccttgaag

SEQ ID NO: 8327837 - DNA, 22 bp, Homo sapiens
gtggcaggatcacggctcactg

SEQ ID NO: 8327838 - DNA, 22 bp, Homo sapiens
gtggcagggctttgctgttctt

SEQ ID NO: 8327839 - DNA, 22 bp, Homo sapiens
gtggccaaggcagagaaagagc

SEQ ID NO: 8327840 - DNA, 22 bp, Homo sapiens
gtggccaagaggggactggata

SEQ ID NO: 8327841 - DNA, 22 bp, Homo sapiens
gtggccaagggactctaaggca

SEQ ID NO: 8327842 - DNA, 22 bp, Homo sapiens
gtggccaaggtgcagagcagct

SEQ ID NO: 8327843 - DNA, 22 bp, Homo sapiens
gtggccaataggagcagctatc

SEQ ID NO: 8327844 - DNA, 22 bp, Homo sapiens
gtggccaaggtgcagagcagct

SEQ ID NO: 8327845 - DNA, 22 bp, Homo sapiens
gtggccaatttccatctgtaag

SEQ ID NO: 8327846 - DNA, 22 bp, Homo sapiens
gtggccaaaaggaagaaggtta

SEQ ID NO: 8327847 - DNA, 22 bp, Homo sapiens
gtggccaaacaccagtttagga

SEQ ID NO: 8327848 - DNA, 22 bp, Homo sapiens
gtggccaagagataaaattgtg

SEQ ID NO: 8327849 - DNA, 22 bp, Homo sapiens
gtggccaagaaaatagatgcat

SEQ ID NO: 8327850 - DNA, 22 bp, Homo sapiens
gtggccaaatcatgtcaaaggc

SEQ ID NO: 8327851 - DNA, 22 bp, Homo sapiens
gtggccaacctggccctgaact

SEQ ID NO: 8327852 - DNA, 22 bp, Homo sapiens
gtggccaactcaatgtttttca

SEQ ID NO: 8327853 - DNA, 22 bp, Homo sapiens
gtggcattaggccaggtgcata

SEQ ID NO: 8327854 - DNA, 22 bp, Homo sapiens
gtggcattctcggcaccatctg

SEQ ID NO: 8327855 - DNA, 22 bp, Homo sapiens
gtggcaggggcgggctgttccg

SEQ ID NO: 8327856 - DNA, 22 bp, Homo sapiens
gtctggggaagtcagggcatca

SEQ ID NO: 8327857 - DNA, 22 bp, Homo sapiens
gtctggggaagtcagggcatca

SEQ ID NO: 8327858 - DNA, 22 bp, Homo sapiens
gtctggggcagcaaggcgcgcg

SEQ ID NO: 8327859 - DNA, 22 bp, Homo sapiens
gtctggggcagcaaggcgcgcg

SEQ ID NO: 8327860 - DNA, 22 bp, Homo sapiens
gtctgggccaggcgagccgagg

SEQ ID NO: 8327861 - DNA, 22 bp, Homo sapiens
gtctgggctcccagggtcggcg

SEQ ID NO: 8327862 - DNA, 22 bp, Homo sapiens
gtctgggcttagggacatggca

SEQ ID NO: 8327863 - DNA, 22 bp, Homo sapiens
gtctgggctcctggcaggcagc

SEQ ID NO: 8327864 - DNA, 22 bp, Homo sapiens
gtctgggcttagggacatggca

SEQ ID NO: 8327865 - DNA, 22 bp, Homo sapiens
gtctgggcacctggcctgggaa

SEQ ID NO: 8327866 - DNA, 22 bp, Homo sapiens
gtctgggcaagggagatggcgc

SEQ ID NO: 8327867 - DNA, 22 bp, Homo sapiens
gtctggctgtccagcttatcta

SEQ ID NO: 8327868 - DNA, 22 bp, Homo sapiens
gtctggctgttcctgcctgtga

SEQ ID NO: 8327869 - DNA, 22 bp, Homo sapiens
gtctgcccagaagacatcccct

SEQ ID NO: 8327870 - DNA, 22 bp, Homo sapiens
gtctgcagagggaaggcttcag

SEQ ID NO: 8327871 - DNA, 22 bp, Homo sapiens
gtctgagactgggcacatacct

SEQ ID NO: 8327872 - DNA, 22 bp, Homo sapiens
gtctgaagccagtggtagtccg

SEQ ID NO: 8327873 - DNA, 20 bp, Homo sapiens
gtctgaggagcagtgggaaa

SEQ ID NO: 8327874 - DNA, 22 bp, Homo sapiens
gtctgagggacagagtcctggc

SEQ ID NO: 8327875 - DNA, 22 bp, Homo sapiens
gtccttggagctcccctctgta

SEQ ID NO: 8327876 - DNA, 22 bp, Homo sapiens
gtccagggaaatagcgacaggg

SEQ ID NO: 8327877 - DNA, 20 bp, Homo sapiens
gtcaggattagtaaactctg

SEQ ID NO: 8327878 - DNA, 22 bp, Homo sapiens
gtccagggccccgagcaccagg

SEQ ID NO: 8327879 - DNA, 19 bp, Homo sapiens
gtccagtgttttccagtca

SEQ ID NO: 8327880 - DNA, 22 bp, Homo sapiens
gtccagtgtcttctacataaca

SEQ ID NO: 8327881 - DNA, 22 bp, Homo sapiens
gtcccataagtagtgcaacttg

SEQ ID NO: 8327882 - DNA, 22 bp, Homo sapiens
gtcctgttggggtgttgcagtc

SEQ ID NO: 8327883 - DNA, 22 bp, Homo sapiens
gtaaagaagtttttgaatgcat

SEQ ID NO: 8327884 - DNA, 22 bp, Homo sapiens
gtacaggaaggagggagtttca

SEQ ID NO: 8327885 - DNA, 22 bp, Homo sapiens
gtacaggaccgcggccccctgg

SEQ ID NO: 8327886 - DNA, 22 bp, Homo sapiens
gtaaataactggtaattggggt

SEQ ID NO: 8327887 - DNA, 22 bp, Homo sapiens
gtaaatataaatgctagctgcc

SEQ ID NO: 8327888 - DNA, 22 bp, Homo sapiens
gtaaatattaaaggctgctaga

SEQ ID NO: 8327889 - DNA, 22 bp, Homo sapiens
gtaaatataaatgctagctgcc

SEQ ID NO: 8327890 - DNA, 22 bp, Homo sapiens
gtaaatattccctcggttccta

SEQ ID NO: 8327891 - DNA, 22 bp, Homo sapiens
gtacacaaaagaggaaaccgga

SEQ ID NO: 8327892 - DNA, 22 bp, Homo sapiens
gtacagtagtaaaagtgaatga

SEQ ID NO: 8327893 - DNA, 22 bp, Homo sapiens
gtatatatgtgtgaacatgtat

SEQ ID NO: 8327894 - DNA, 22 bp, Homo sapiens
ggtgtcagtgagagcacagtac

SEQ ID NO: 8327895 - DNA, 20 bp, Homo sapiens
ggtgtcagggccatgcctgg

SEQ ID NO: 8327896 - DNA, 22 bp, Homo sapiens
ggtgtcagcctgggagcctagc

SEQ ID NO: 8327897 - DNA, 22 bp, Homo sapiens
ggtggccattctaccgccttct

SEQ ID NO: 8327898 - DNA, 22 bp, Homo sapiens
ggtggccaggccagctctggcc

SEQ ID NO: 8327899 - DNA, 22 bp, Homo sapiens
ggtggccataggaccagcctgg

SEQ ID NO: 8327900 - DNA, 22 bp, Homo sapiens
ggtgaggggagagtgaaagaaa

SEQ ID NO: 8327901 - DNA, 22 bp, Homo sapiens
ggtgaggggcacctctgcccgg

SEQ ID NO: 8327902 - DNA, 22 bp, Homo sapiens
ggtgaggggcgcctctgcccag

SEQ ID NO: 8327903 - DNA, 22 bp, Homo sapiens
ggtgaggggctcctctgcccgg

SEQ ID NO: 8327904 - DNA, 22 bp, Homo sapiens
ggtgaggggcgcctctgcccgg

SEQ ID NO: 8327905 - DNA, 22 bp, Homo sapiens
ggtgagggtaaatataggcaaa

SEQ ID NO: 8327906 - DNA, 22 bp, Homo sapiens
ggtgagggtaaatataggcaaa

SEQ ID NO: 8327907 - DNA, 22 bp, Homo sapiens
gggtggggtgtatcggatccta

SEQ ID NO: 8327908 - DNA, 22 bp, Homo sapiens
ggtggcagaggtgcatcagccc

SEQ ID NO: 8327909 - DNA, 22 bp, Homo sapiens
ggtgcaggaaaattacctggag

SEQ ID NO: 8327910 - DNA, 22 bp, Homo sapiens
ggtgcaggaaaattacctggag

SEQ ID NO: 8327911 - DNA, 22 bp, Homo sapiens
gtgggcagagcaagggaactca

SEQ ID NO: 8327912 - DNA, 22 bp, Homo sapiens
gtgggcctcttgagggtggcta

SEQ ID NO: 8327913 - DNA, 22 bp, Homo sapiens
gtgggccttgcagggtgcaggg

SEQ ID NO: 8327914 - DNA, 22 bp, Homo sapiens
gtgggggacccaggtgctgtcc

SEQ ID NO: 8327915 - DNA, 22 bp, Homo sapiens
gtgggggacccaggtgctgtcc

SEQ ID NO: 8327916 - DNA, 22 bp, Homo sapiens
gtggggaggcattcttctccct

SEQ ID NO: 8327917 - DNA, 22 bp, Homo sapiens
gtggggaggcattcttctccct

SEQ ID NO: 8327918 - DNA, 22 bp, Homo sapiens
gtggggaggcctaagcaagttg

SEQ ID NO: 8327919 - DNA, 22 bp, Homo sapiens
gtggggaggcctaagcaagttg

SEQ ID NO: 8327920 - DNA, 22 bp, Homo sapiens
gtggggagcagccttagcccct

SEQ ID NO: 8327921 - DNA, 22 bp, Homo sapiens
gtggggagcagccttagcccct

SEQ ID NO: 8327922 - DNA, 22 bp, Homo sapiens
gtgtaaaaacatactatttcta

SEQ ID NO: 8327923 - DNA, 22 bp, Homo sapiens
gtgtaaatcagcttgtgtaata

SEQ ID NO: 8327924 - DNA, 22 bp, Homo sapiens
gtgtaagtggaatcatatagta

SEQ ID NO: 8327925 - DNA, 21 bp, Homo sapiens
gtggttctagagaaacagaat

SEQ ID NO: 8327926 - DNA, 22 bp, Homo sapiens
gtgggtgcggggagccgaggcg

SEQ ID NO: 8327927 - DNA, 22 bp, Homo sapiens
gtgggtgatgtactggaggcca

SEQ ID NO: 8327928 - DNA, 22 bp, Homo sapiens
gtggtcaggcagtgggagagaa

SEQ ID NO: 8327929 - DNA, 22 bp, Homo sapiens
gtggggggacgttggtcacttt

SEQ ID NO: 8327930 - DNA, 22 bp, Homo sapiens
gtggggggagctgcaagctgga

SEQ ID NO: 8327931 - DNA, 22 bp, Homo sapiens
gtggggtgggctgagttaggcc

SEQ ID NO: 8327932 - DNA, 22 bp, Homo sapiens
gtggggtctgtcctcttctggg

SEQ ID NO: 8327933 - DNA, 22 bp, Homo sapiens
gtggggtctctctgtacctccc

SEQ ID NO: 8327934 - DNA, 22 bp, Homo sapiens
gtggggtgcagcagtactgtgt

SEQ ID NO: 8327935 - DNA, 22 bp, Homo sapiens
gtggggtgcagcagtactgtgt

SEQ ID NO: 8327936 - DNA, 18 bp, Homo sapiens
gtggggtgttgtgaggat

SEQ ID NO: 8327937 - DNA, 22 bp, Homo sapiens
gttcaagaccagcctggccaac

SEQ ID NO: 8327938 - DNA, 22 bp, Homo sapiens
gttcaagaccagcctggccaac

SEQ ID NO: 8327939 - DNA, 22 bp, Homo sapiens
gttctaataggagaaaagacag

SEQ ID NO: 8327940 - DNA, 22 bp, Homo sapiens
gttctacagttcctattactta

SEQ ID NO: 8327941 - DNA, 22 bp, Homo sapiens
gttctaatattttaaaagccaa

SEQ ID NO: 8327942 - DNA, 22 bp, Homo sapiens
gttctactttctgtgtctttga

SEQ ID NO: 8327943 - DNA, 22 bp, Homo sapiens
gttattttaacttctcagtaat

SEQ ID NO: 8327944 - DNA, 21 bp, Homo sapiens
gttattttaagtgagctttgc

SEQ ID NO: 8327945 - DNA, 22 bp, Homo sapiens
gttattttcattggctcagact

SEQ ID NO: 8327946 - DNA, 22 bp, Homo sapiens
gttattttatctctgagaggtt

SEQ ID NO: 8327947 - DNA, 22 bp, Homo sapiens
gttctattccccttatctgtga

SEQ ID NO: 8327948 - DNA, 22 bp, Homo sapiens
gttctatttcagtaagcaggca

SEQ ID NO: 8327949 - DNA, 22 bp, Homo sapiens
gttgtatttgcctgaatgcagt

SEQ ID NO: 8327950 - DNA, 22 bp, Homo sapiens
gttgtattcttcaatatcagag

SEQ ID NO: 8327951 - DNA, 22 bp, Homo sapiens
gttctgagtggcccaagccctg

SEQ ID NO: 8327952 - DNA, 22 bp, Homo sapiens
gttgtcccttcaggtttcactg

SEQ ID NO: 8327953 - DNA, 22 bp, Homo sapiens
gttgtttataaaaatatctagc

SEQ ID NO: 8327954 - DNA, 22 bp, Homo sapiens
gtgtcctcttattgctcttggc

SEQ ID NO: 8327955 - DNA, 22 bp, Homo sapiens
gtgtcctgcaggccaggaatgg

SEQ ID NO: 8327956 - DNA, 22 bp, Homo sapiens
gtgtcctgggctggtagagctg

SEQ ID NO: 8327957 - DNA, 22 bp, Homo sapiens
gtgtctgagtttggaaagtcca

SEQ ID NO: 8327958 - DNA, 22 bp, Homo sapiens
gtgtcattactgaaagattgaa

SEQ ID NO: 8327959 - DNA, 22 bp, Homo sapiens
gtgtgataacagggcatgacgg

SEQ ID NO: 8327960 - DNA, 22 bp, Homo sapiens
gtgtgcagtgagcaaaagatct

SEQ ID NO: 8327961 - DNA, 22 bp, Homo sapiens
gtgtggtcgaagttctcccgga

SEQ ID NO: 8327962 - DNA, 22 bp, Homo sapiens
gtttttccttgctgaggacccg

SEQ ID NO: 8327963 - DNA, 19 bp, Homo sapiens
gtttttcccagacgaggca

SEQ ID NO: 8327964 - DNA, 22 bp, Homo sapiens
gtttttcctgctgacttgggtc

SEQ ID NO: 8327965 - DNA, 22 bp, Homo sapiens
gtttaattcccacacctgccct

SEQ ID NO: 8327966 - DNA, 22 bp, Homo sapiens
gtttaagtttcagaagctaaga

SEQ ID NO: 8327967 - DNA, 22 bp, Homo sapiens
gtttaaataattaggggcctgt

SEQ ID NO: 8327968 - DNA, 20 bp, Homo sapiens
gtttttctctcttgccacta

SEQ ID NO: 8327969 - DNA, 22 bp, Homo sapiens
taaaacagcagggcagagaagt

SEQ ID NO: 8327970 - DNA, 22 bp, Homo sapiens
taaaaccataaggctggaagga

SEQ ID NO: 8327971 - DNA, 22 bp, Homo sapiens
taaaaccattcctgctttcatg

SEQ ID NO: 8327972 - DNA, 22 bp, Homo sapiens
taaatcacccatctcctaatct

SEQ ID NO: 8327973 - DNA, 22 bp, Homo sapiens
taaatcactgtactttattcct

SEQ ID NO: 8327974 - DNA, 22 bp, Homo sapiens
taaatccttatcttctttgaat

SEQ ID NO: 8327975 - DNA, 22 bp, Homo sapiens
taaatctttaggaagctcaaac

SEQ ID NO: 8327976 - DNA, 22 bp, Homo sapiens
taaatcttgtggcaatgcttct

SEQ ID NO: 8327977 - DNA, 22 bp, Homo sapiens
taaatcttctacatcatcataa

SEQ ID NO: 8327978 - DNA, 22 bp, Homo sapiens
taaatgaaagggtttaatttat

SEQ ID NO: 8327979 - DNA, 22 bp, Homo sapiens
taaatgagatgtacataactca

SEQ ID NO: 8327980 - DNA, 22 bp, Homo sapiens
taaatgataataatgctagtgt

SEQ ID NO: 8327981 - DNA, 22 bp, Homo sapiens
taagaaatttagttatagaatg

SEQ ID NO: 8327982 - DNA, 22 bp, Homo sapiens
taacagaatcctgttattgcca

SEQ ID NO: 8327983 - DNA, 22 bp, Homo sapiens
ggggggtgctgatcagtggagc

SEQ ID NO: 8327984 - DNA, 22 bp, Homo sapiens
gggggtgacgatggcagctggt

SEQ ID NO: 8327985 - DNA, 22 bp, Homo sapiens
ggggggctgttctggacaggaa

SEQ ID NO: 8327986 - DNA, 22 bp, Homo sapiens
ggggggcagctgtcctggccat

SEQ ID NO: 8327987 - DNA, 20 bp, Homo sapiens
ggggggcttcagggcctgtg

SEQ ID NO: 8327988 - DNA, 22 bp, Homo sapiens
ggggggtgacaagtagaggttg

SEQ ID NO: 8327989 - DNA, 22 bp, Homo sapiens
gggtccagggccagtggctgag

SEQ ID NO: 8327990 - DNA, 22 bp, Homo sapiens
ggggtactggctggagccccac

SEQ ID NO: 8327991 - DNA, 22 bp, Homo sapiens
gggggtggttctaagtcctata

SEQ ID NO: 8327992 - DNA, 22 bp, Homo sapiens
gggggtgagcctgccaggccca

SEQ ID NO: 8327993 - DNA, 16 bp, Homo sapiens
gggggtgagagagagt

SEQ ID NO: 8327994 - DNA, 22 bp, Homo sapiens
gggggtgaggacaggagcactg

SEQ ID NO: 8327995 - DNA, 22 bp, Homo sapiens
gggggctgtcctgtgcattgta

SEQ ID NO: 8327996 - DNA, 23 bp, Homo sapiens
gggggctggttgactctctgcag

SEQ ID NO: 8327997 - DNA, 22 bp, Homo sapiens
gggggctggactttcccacaca

SEQ ID NO: 8327998 - DNA, 22 bp, Homo sapiens
gggggctggaatatccatcaac

SEQ ID NO: 8327999 - DNA, 22 bp, Homo sapiens
gggggctgatcatttactgggc

SEQ ID NO: 8328000 - DNA, 22 bp, Homo sapiens
ggggaccctcaggactgcgtct

SEQ ID NO: 8328001 - DNA, 22 bp, Homo sapiens
ggggactgaggcactgaaggtg

SEQ ID NO: 8328002 - DNA, 22 bp, Homo sapiens
gggggctagagagatgaaatat

SEQ ID NO: 8328003 - DNA, 19 bp, Homo sapiens
ggggagaactagagacagc

SEQ ID NO: 8328004 - DNA, 22 bp, Homo sapiens
gggggctctgactccctcagct

SEQ ID NO: 8328005 - DNA, 22 bp, Homo sapiens
gggggctcctcccagctgccag

SEQ ID NO: 8328006 - DNA, 22 bp, Homo sapiens
gggtgggatgccgctgtctcca

SEQ ID NO: 8328007 - DNA, 22 bp, Homo sapiens
gggtggctgagaacaggacccc

SEQ ID NO: 8328008 - DNA, 23 bp, Homo sapiens
gggtgggccaaattaggtagcct

SEQ ID NO: 8328009 - DNA, 22 bp, Homo sapiens
gggtgggatggcaggagccgct

SEQ ID NO: 8328010 - DNA, 22 bp, Homo sapiens
gggtgggcccagcccagagaag

SEQ ID NO: 8328011 - DNA, 22 bp, Homo sapiens
gggtctggcatgctgagatgga

SEQ ID NO: 8328012 - DNA, 22 bp, Homo sapiens
gggtctgggcaggcgcttcctc

SEQ ID NO: 8328013 - DNA, 22 bp, Homo sapiens
gggtctgagctgaggggaaatc

SEQ ID NO: 8328014 - DNA, 22 bp, Homo sapiens
gggtctggacggctgcaggaag

SEQ ID NO: 8328015 - DNA, 22 bp, Homo sapiens
gggtctggagatccgggtgaag

SEQ ID NO: 8328016 - DNA, 22 bp, Homo sapiens
gggtctggagggcagcccttct

SEQ ID NO: 8328017 - DNA, 22 bp, Homo sapiens
ggggacagtcgatctagtgatt

SEQ ID NO: 8328018 - DNA, 22 bp, Homo sapiens
ggggacagtcgatctagtgatt

SEQ ID NO: 8328019 - DNA, 22 bp, Homo sapiens
ggggacagttaaagaccaagac

SEQ ID NO: 8328020 - DNA, 22 bp, Homo sapiens
ggggaagggagtccaagtgtta

SEQ ID NO: 8328021 - DNA, 23 bp, Homo sapiens
ggggacagagggcagcccgcatc

SEQ ID NO: 8328022 - DNA, 23 bp, Homo sapiens
ggggacagagggcagcccgcatc

SEQ ID NO: 8328023 - DNA, 22 bp, Homo sapiens
gggctggagcctggcggtggtt

SEQ ID NO: 8328024 - DNA, 22 bp, Homo sapiens
gggctggatctcctgcaggcag

SEQ ID NO: 8328025 - DNA, 22 bp, Homo sapiens
gggctggaccgctcgcctccct

SEQ ID NO: 8328026 - DNA, 22 bp, Homo sapiens
gggctggagagtcccacgtggg

SEQ ID NO: 8328027 - DNA, 22 bp, Homo sapiens
gggctggcatcagttgccgaga

SEQ ID NO: 8328028 - DNA, 22 bp, Homo sapiens
gggctggcaggacctgggctga

SEQ ID NO: 8328029 - DNA, 22 bp, Homo sapiens
gggctggcatcagttgccgaga

SEQ ID NO: 8328030 - DNA, 17 bp, Homo sapiens
gggctggatggccatgg

SEQ ID NO: 8328031 - DNA, 17 bp, Homo sapiens
gggctggatggccatgg

SEQ ID NO: 8328032 - DNA, 22 bp, Homo sapiens
gggctggatgggagccttggcc

SEQ ID NO: 8328033 - DNA, 22 bp, Homo sapiens
gggctggatgtttgatgacgaa

SEQ ID NO: 8328034 - DNA, 22 bp, Homo sapiens
gggctgcttttttcttagcaga

SEQ ID NO: 8328035 - DNA, 22 bp, Homo sapiens
gggctggaaaaacaacatacaa

SEQ ID NO: 8328036 - DNA, 21 bp, Homo sapiens
gggctggacatggtggctcat

SEQ ID NO: 8328037 - DNA, 22 bp, Homo sapiens
gggctgagacgatggggtcttc

SEQ ID NO: 8328038 - DNA, 22 bp, Homo sapiens
gggctgagaattcagctttcct

SEQ ID NO: 8328039 - DNA, 22 bp, Homo sapiens
gggctctggggtgccctggcat

SEQ ID NO: 8328040 - DNA, 22 bp, Homo sapiens
gggctagcctcttccctgctcc

SEQ ID NO: 8328041 - DNA, 22 bp, Homo sapiens
gggctctggtacttcctggctc

SEQ ID NO: 8328042 - DNA, 22 bp, Homo sapiens
gggccacattgaagggtgggta

SEQ ID NO: 8328043 - DNA, 22 bp, Homo sapiens
gggccaggagtggagatatggg

SEQ ID NO: 8328044 - DNA, 22 bp, Homo sapiens
gggccaggtcggtgaatggtca

SEQ ID NO: 8328045 - DNA, 22 bp, Homo sapiens
gggccaggtggaccccagcctc

SEQ ID NO: 8328046 - DNA, 21 bp, Homo sapiens
gggccacaccttctgcagacc

SEQ ID NO: 8328047 - DNA, 22 bp, Homo sapiens
gggcagctcagccaccatgcag

SEQ ID NO: 8328048 - DNA, 22 bp, Homo sapiens
gggcggggggagctggaatgaa

SEQ ID NO: 8328049 - DNA, 22 bp, Homo sapiens
gggcgtggatggtcagtgcagg

SEQ ID NO: 8328050 - DNA, 22 bp, Homo sapiens
gggctactgagctggaactggg

SEQ ID NO: 8328051 - DNA, 22 bp, Homo sapiens
gggctagaaattctgcagtgga

SEQ ID NO: 8328052 - DNA, 22 bp, Homo sapiens
gggctactgagctggaactggg

SEQ ID NO: 8328053 - DNA, 23 bp, Homo sapiens
gggcccagcacaggacctggcag

SEQ ID NO: 8328054 - DNA, 22 bp, Homo sapiens
gggcccagcactggctgggatc

SEQ ID NO: 8328055 - DNA, 22 bp, Homo sapiens
gggcccagcactggctgggatc

SEQ ID NO: 8328056 - DNA, 22 bp, Homo sapiens
gggcccagcgtggttccatctg

SEQ ID NO: 8328057 - DNA, 19 bp, Homo sapiens
gggcccagcatggagggtt

SEQ ID NO: 8328058 - DNA, 19 bp, Homo sapiens
gggcccagcatggagggtt

SEQ ID NO: 8328059 - DNA, 22 bp, Homo sapiens
gggcccagccctctgctcactg

SEQ ID NO: 8328060 - DNA, 22 bp, Homo sapiens
gggaccaggtgggtgcattccg

SEQ ID NO: 8328061 - DNA, 22 bp, Homo sapiens
gggaccaggtcagggctctgac

SEQ ID NO: 8328062 - DNA, 22 bp, Homo sapiens
gggacccaggtaatcctgtgct

SEQ ID NO: 8328063 - DNA, 22 bp, Homo sapiens
gggaggctgccatccttcagga

SEQ ID NO: 8328064 - DNA, 22 bp, Homo sapiens
gggaggctctgctcagcccccg

SEQ ID NO: 8328065 - DNA, 20 bp, Homo sapiens
gggaggcgagggctgagcag

SEQ ID NO: 8328066 - DNA, 20 bp, Homo sapiens
gggaggccccagagtccagg

SEQ ID NO: 8328067 - DNA, 20 bp, Homo sapiens
gggagaagggctgatgagag

SEQ ID NO: 8328068 - DNA, 22 bp, Homo sapiens
gggatggggagctggaaagggg

SEQ ID NO: 8328069 - DNA, 22 bp, Homo sapiens
gggatggggagctggaaagggg

SEQ ID NO: 8328070 - DNA, 22 bp, Homo sapiens
gggatggggagctggaaagggg

SEQ ID NO: 8328071 - DNA, 22 bp, Homo sapiens
gggatggggagctggaaagggg

SEQ ID NO: 8328072 - DNA, 22 bp, Homo sapiens
gggatggactgacggtagcgcg

SEQ ID NO: 8328073 - DNA, 22 bp, Homo sapiens
gggatggatcttggctgaggct

SEQ ID NO: 8328074 - DNA, 22 bp, Homo sapiens
gggatggcctagactagcttgg

SEQ ID NO: 8328075 - DNA, 22 bp, Homo sapiens
gggagggaaggtacctgtgtga

SEQ ID NO: 8328076 - DNA, 22 bp, Homo sapiens
gggaggcttgagccatactgcc

SEQ ID NO: 8328077 - DNA, 22 bp, Homo sapiens
gggaggctggctctggccacag

SEQ ID NO: 8328078 - DNA, 22 bp, Homo sapiens
gggatccatccgtgcagcagag

SEQ ID NO: 8328079 - DNA, 22 bp, Homo sapiens
ggctgcagagctgggtgggcct

SEQ ID NO: 8328080 - DNA, 22 bp, Homo sapiens
ggctgcagagctggtgccctgg

SEQ ID NO: 8328081 - DNA, 22 bp, Homo sapiens
ggctgcagaagtacttccggat

SEQ ID NO: 8328082 - DNA, 19 bp, Homo sapiens
ggctgcagagccccggcgc

SEQ ID NO: 8328083 - DNA, 19 bp, Homo sapiens
ggctgcagagccccggcgc

SEQ ID NO: 8328084 - DNA, 22 bp, Homo sapiens
ggctgcagaggcccccagtggg

SEQ ID NO: 8328085 - DNA, 22 bp, Homo sapiens
ggctgcagaggcccccagtggg

SEQ ID NO: 8328086 - DNA, 22 bp, Homo sapiens
ggctgcagaggcccccagtggg

SEQ ID NO: 8328087 - DNA, 22 bp, Homo sapiens
ggctcgagcagctgtgtaggat

SEQ ID NO: 8328088 - DNA, 22 bp, Homo sapiens
ggctcctgggatgggactgagc

SEQ ID NO: 8328089 - DNA, 23 bp, Homo sapiens
ggctcctggattcaaatcctgcc

SEQ ID NO: 8328090 - DNA, 23 bp, Homo sapiens
ggctcctggattcaaatcctgcc

SEQ ID NO: 8328091 - DNA, 22 bp, Homo sapiens
ggctggcctctacagggaggca

SEQ ID NO: 8328092 - DNA, 22 bp, Homo sapiens
ggctggctacattggaggaagg

SEQ ID NO: 8328093 - DNA, 19 bp, Homo sapiens
ggctgccttctgctcatct

SEQ ID NO: 8328094 - DNA, 22 bp, Homo sapiens
ggctgccttccctgagccccgg

SEQ ID NO: 8328095 - DNA, 22 bp, Homo sapiens
ggctgctcttcttggcgacctc

SEQ ID NO: 8328096 - DNA, 22 bp, Homo sapiens
ggctgcaggcagaggctgtctg

SEQ ID NO: 8328097 - DNA, 22 bp, Homo sapiens
ggctgcaggatgcccagccgtg

SEQ ID NO: 8328098 - DNA, 22 bp, Homo sapiens
ggctgcaggaacgacggagggg

SEQ ID NO: 8328099 - DNA, 22 bp, Homo sapiens
ggctgcctgtgcccaggcacac

SEQ ID NO: 8328100 - DNA, 22 bp, Homo sapiens
ggctgccttcagactccagctt

SEQ ID NO: 8328101 - DNA, 22 bp, Homo sapiens
ggctgccttcatagaccatggg

SEQ ID NO: 8328102 - DNA, 22 bp, Homo sapiens
gggaacagagtgccagactgac

SEQ ID NO: 8328103 - DNA, 23 bp, Homo sapiens
gggaccaggcccttcctggtttg

SEQ ID NO: 8328104 - DNA, 22 bp, Homo sapiens
gggaagagatttccacatcatt

SEQ ID NO: 8328105 - DNA, 22 bp, Homo sapiens
ggctttgggggtgtccaagaaa

SEQ ID NO: 8328106 - DNA, 22 bp, Homo sapiens
gggaaatctcgtcctctattta

SEQ ID NO: 8328107 - DNA, 22 bp, Homo sapiens
ggctttggggtgtgcagagatg

SEQ ID NO: 8328108 - DNA, 22 bp, Homo sapiens
ggctggctacattggaggaagg

SEQ ID NO: 8328109 - DNA, 22 bp, Homo sapiens
ggctggctatctgtggttgcct

SEQ ID NO: 8328110 - DNA, 22 bp, Homo sapiens
ggctggctcttaccgacagcgt

SEQ ID NO: 8328111 - DNA, 22 bp, Homo sapiens
ggctggctgataaagggttgag

SEQ ID NO: 8328112 - DNA, 22 bp, Homo sapiens
ggctggctggatgaatggatta

SEQ ID NO: 8328113 - DNA, 22 bp, Homo sapiens
ggctggctgcatgccccctcct

SEQ ID NO: 8328114 - DNA, 22 bp, Homo sapiens
ggctggctggcttagcagagga

SEQ ID NO: 8328115 - DNA, 22 bp, Homo sapiens
ggctggcttgccaagctcaggg

SEQ ID NO: 8328116 - DNA, 19 bp, Homo sapiens
ggcttcagtttagcaggct

SEQ ID NO: 8328117 - DNA, 22 bp, Homo sapiens
ggctgtggtggcatccctgagc

SEQ ID NO: 8328118 - DNA, 22 bp, Homo sapiens
ggccctctgtggctgccatgga

SEQ ID NO: 8328119 - DNA, 22 bp, Homo sapiens
ggccctgcaaggtacccaggcc

SEQ ID NO: 8328120 - DNA, 22 bp, Homo sapiens
ggctcaggactgcagcgtagag

SEQ ID NO: 8328121 - DNA, 22 bp, Homo sapiens
ggctcagcttggtgcgcagaaa

SEQ ID NO: 8328122 - DNA, 22 bp, Homo sapiens
ggctcaggacctgggattgcca

SEQ ID NO: 8328123 - DNA, 22 bp, Homo sapiens
ggctcaggtttaaagtgcttta

SEQ ID NO: 8328124 - DNA, 22 bp, Homo sapiens
ggctcaggtttccttcccagct

SEQ ID NO: 8328125 - DNA, 23 bp, Homo sapiens
ggctcctgcttcatgtcccacct

SEQ ID NO: 8328126 - DNA, 22 bp, Homo sapiens
ggccatggtcatgggtgagctt

SEQ ID NO: 8328127 - DNA, 22 bp, Homo sapiens
ggcccacatggaagcatcgagg

SEQ ID NO: 8328128 - DNA, 22 bp, Homo sapiens
ggcccacactgacagctgagct

SEQ ID NO: 8328129 - DNA, 22 bp, Homo sapiens
ggcccagccggcgagtctcgcg

SEQ ID NO: 8328130 - DNA, 22 bp, Homo sapiens
ggcccagcgaggccacctacag

SEQ ID NO: 8328131 - DNA, 22 bp, Homo sapiens
ggcccagcctcagacatgccct

SEQ ID NO: 8328132 - DNA, 22 bp, Homo sapiens
ggcccagcctggcaacaatgac

SEQ ID NO: 8328133 - DNA, 22 bp, Homo sapiens
ggcccagccttggggtttcttt

SEQ ID NO: 8328134 - DNA, 22 bp, Homo sapiens
ggcccctgcggactgcctagag

SEQ ID NO: 8328135 - DNA, 22 bp, Homo sapiens
ggccccagttcactcctggccg

SEQ ID NO: 8328136 - DNA, 21 bp, Homo sapiens
ggccccgcagacccagcacgt

SEQ ID NO: 8328137 - DNA, 22 bp, Homo sapiens
ggccagaggccacagctgtgtc

SEQ ID NO: 8328138 - DNA, 22 bp, Homo sapiens
ggccagaggacctctcatagcc

SEQ ID NO: 8328139 - DNA, 17 bp, Homo sapiens
ggccagaggcggggctg

SEQ ID NO: 8328140 - DNA, 18 bp, Homo sapiens
ggccagagggagggtccc

SEQ ID NO: 8328141 - DNA, 22 bp, Homo sapiens
ggccagaagttggaaaagagcc

SEQ ID NO: 8328142 - DNA, 22 bp, Homo sapiens
ggccagaagttggaaaagagcc

SEQ ID NO: 8328143 - DNA, 22 bp, Homo sapiens
ggcagacacaaaaacataaggt

SEQ ID NO: 8328144 - DNA, 22 bp, Homo sapiens
ggcacagcacagtggacccagg

SEQ ID NO: 8328145 - DNA, 22 bp, Homo sapiens
ggcacagcacagagcacatgta

SEQ ID NO: 8328146 - DNA, 22 bp, Homo sapiens
ggcacagagttggcagagctgc

SEQ ID NO: 8328147 - DNA, 22 bp, Homo sapiens
ggagtgggcagcactgccctgt

SEQ ID NO: 8328148 - DNA, 22 bp, Homo sapiens
ggagtgggcagcactgccctgt

SEQ ID NO: 8328149 - DNA, 19 bp, Homo sapiens
ggagtgggtagttagtggt

SEQ ID NO: 8328150 - DNA, 22 bp, Homo sapiens
ggcaggctccagagccctctcc

SEQ ID NO: 8328151 - DNA, 22 bp, Homo sapiens
ggcaggctcagcagccaaggag

SEQ ID NO: 8328152 - DNA, 22 bp, Homo sapiens
ggcaggcattgcaacatgtaca

SEQ ID NO: 8328153 - DNA, 22 bp, Homo sapiens
ggcaggcgtggtggcctcagaa

SEQ ID NO: 8328154 - DNA, 22 bp, Homo sapiens
ggcaggctgggagtcatcagag

SEQ ID NO: 8328155 - DNA, 22 bp, Homo sapiens
ggcagctgggttggccagaaac

SEQ ID NO: 8328156 - DNA, 22 bp, Homo sapiens
ggcagaggaagctggaagtggg

SEQ ID NO: 8328157 - DNA, 22 bp, Homo sapiens
ggcagaggaagctggaagtggg

SEQ ID NO: 8328158 - DNA, 22 bp, Homo sapiens
ggcagctggcctcctcgcccac

SEQ ID NO: 8328159 - DNA, 22 bp, Homo sapiens
ggcagctgcacgttgtcccgtc

SEQ ID NO: 8328160 - DNA, 22 bp, Homo sapiens
ggcagctgcaaatctgctctgt

SEQ ID NO: 8328161 - DNA, 22 bp, Homo sapiens
ggagggcccctccagtgggcag

SEQ ID NO: 8328162 - DNA, 22 bp, Homo sapiens
ggagggacccactgcggtgacc

SEQ ID NO: 8328163 - DNA, 22 bp, Homo sapiens
ggagggaatgtctagcattctt

SEQ ID NO: 8328164 - DNA, 22 bp, Homo sapiens
ggagggacccactctagaggtg

SEQ ID NO: 8328165 - DNA, 22 bp, Homo sapiens
ggagggacccactctagaggtg

SEQ ID NO: 8328166 - DNA, 22 bp, Homo sapiens
ggagggctgccaggtggagcgg

SEQ ID NO: 8328167 - DNA, 22 bp, Homo sapiens
ggagggctgccaggtggagcgg

SEQ ID NO: 8328168 - DNA, 22 bp, Homo sapiens
ggagggctgccaggtggagcgg

SEQ ID NO: 8328169 - DNA, 18 bp, Homo sapiens
ggagggctttggggactg

SEQ ID NO: 8328170 - DNA, 18 bp, Homo sapiens
ggagggctttggggactg

SEQ ID NO: 8328171 - DNA, 18 bp, Homo sapiens
ggagggctttggggactg

SEQ ID NO: 8328172 - DNA, 23 bp, Homo sapiens
ggagggcttcatcagacccccag

SEQ ID NO: 8328173 - DNA, 22 bp, Homo sapiens
ggagggctccctgggagtggat

SEQ ID NO: 8328174 - DNA, 22 bp, Homo sapiens
ggagggctcaattgactcctga

SEQ ID NO: 8328175 - DNA, 22 bp, Homo sapiens
ggagggctgagactggggtctg

SEQ ID NO: 8328176 - DNA, 22 bp, Homo sapiens
ggagggctcgtcatccaccact

SEQ ID NO: 8328177 - DNA, 22 bp, Homo sapiens
ggagggctgagactggggtctg

SEQ ID NO: 8328178 - DNA, 22 bp, Homo sapiens
ggagggctgccacccgctcacg

SEQ ID NO: 8328179 - DNA, 22 bp, Homo sapiens
ggaggctctgccatctgtcaca

SEQ ID NO: 8328180 - DNA, 18 bp, Homo sapiens
ggaggctctgtggtttcc

SEQ ID NO: 8328181 - DNA, 22 bp, Homo sapiens
ggaggctcttgagaggggagta

SEQ ID NO: 8328182 - DNA, 22 bp, Homo sapiens
ggaggctgagaagtccaagatc

SEQ ID NO: 8328183 - DNA, 19 bp, Homo sapiens
ggaggcttcttggggtcgg

SEQ ID NO: 8328184 - DNA, 19 bp, Homo sapiens
ggaggcttcttggggtcgg

SEQ ID NO: 8328185 - DNA, 22 bp, Homo sapiens
ggaggctgaggcccctcacagg

SEQ ID NO: 8328186 - DNA, 22 bp, Homo sapiens
ggaggctgagaggtcgcagtgg

SEQ ID NO: 8328187 - DNA, 22 bp, Homo sapiens
ggaggctgagaggtcgcagtgg

SEQ ID NO: 8328188 - DNA, 22 bp, Homo sapiens
ggaggctgaggcaggcggatca

SEQ ID NO: 8328189 - DNA, 22 bp, Homo sapiens
ggagggtgcattttaccctgtg

SEQ ID NO: 8328190 - DNA, 22 bp, Homo sapiens
ggagggtgcagaccctttgcaa

SEQ ID NO: 8328191 - DNA, 22 bp, Homo sapiens
ggaggggtggtcgcgaagagca

SEQ ID NO: 8328192 - DNA, 22 bp, Homo sapiens
ggaggggtggaaggagtgcctg

SEQ ID NO: 8328193 - DNA, 22 bp, Homo sapiens
ggaggggtggtcacctggcagg

SEQ ID NO: 8328194 - DNA, 22 bp, Homo sapiens
ggaggggtctctagcgaggaga

SEQ ID NO: 8328195 - DNA, 22 bp, Homo sapiens
ggaggggtctctagcgaggaga

SEQ ID NO: 8328196 - DNA, 22 bp, Homo sapiens
ggagggggactgacactgattt

SEQ ID NO: 8328197 - DNA, 22 bp, Homo sapiens
ggaggggtgagaatggctgcct

SEQ ID NO: 8328198 - DNA, 22 bp, Homo sapiens
ggaggggtggaaggagtgcctg

SEQ ID NO: 8328199 - DNA, 22 bp, Homo sapiens
ggaggggtgctcagctgtcacg

SEQ ID NO: 8328200 - DNA, 22 bp, Homo sapiens
ggaggggtgctcagctgtcacg

SEQ ID NO: 8328201 - DNA, 22 bp, Homo sapiens
ggaggggagatgtttgggctca

SEQ ID NO: 8328202 - DNA, 22 bp, Homo sapiens
ggaggggaggtccagctgatct

SEQ ID NO: 8328203 - DNA, 22 bp, Homo sapiens
ggagggggaagaagctaaagac

SEQ ID NO: 8328204 - DNA, 22 bp, Homo sapiens
ggagggggaattcagccccagc

SEQ ID NO: 8328205 - DNA, 22 bp, Homo sapiens
ggagggggaattcagccccagc

SEQ ID NO: 8328206 - DNA, 22 bp, Homo sapiens
ggagggggaaactttggctgcc

SEQ ID NO: 8328207 - DNA, 22 bp, Homo sapiens
ggaggtcatagctgtgcaggta

SEQ ID NO: 8328208 - DNA, 22 bp, Homo sapiens
ggaggtcacgactgggatgcct

SEQ ID NO: 8328209 - DNA, 22 bp, Homo sapiens
ggaggtcacaaggtgagtaaag

SEQ ID NO: 8328210 - DNA, 23 bp, Homo sapiens
ggaggtcagtgcctgagggtgag

SEQ ID NO: 8328211 - DNA, 22 bp, Homo sapiens
ggaggtcataagtgtatagatg

SEQ ID NO: 8328212 - DNA, 22 bp, Homo sapiens
ggaggtggcagagggacattct

SEQ ID NO: 8328213 - DNA, 22 bp, Homo sapiens
ggagggtgggtcattcttacat

SEQ ID NO: 8328214 - DNA, 22 bp, Homo sapiens
ggaggtagcctcaaaagcagct

SEQ ID NO: 8328215 - DNA, 22 bp, Homo sapiens
ggaggtagtctgagtcataggc

SEQ ID NO: 8328216 - DNA, 22 bp, Homo sapiens
ggaggtcaaatggagggctggg

SEQ ID NO: 8328217 - DNA, 20 bp, Homo sapiens
ggaggtcaaatgatgagaag

SEQ ID NO: 8328218 - DNA, 22 bp, Homo sapiens
ggagggtggcagcgtcctgggc

SEQ ID NO: 8328219 - DNA, 22 bp, Homo sapiens
ggagggtggcagcgtcctgggc

SEQ ID NO: 8328220 - DNA, 22 bp, Homo sapiens
ggagggtggcagcgtcctgggc

SEQ ID NO: 8328221 - DNA, 22 bp, Homo sapiens
ggaggtgggagacataggcggc

SEQ ID NO: 8328222 - DNA, 22 bp, Homo sapiens
ggaggtggcctgaaaatgtggc

SEQ ID NO: 8328223 - DNA, 22 bp, Homo sapiens
ggaggtgggattaggacctaaa

SEQ ID NO: 8328224 - DNA, 22 bp, Homo sapiens
ggaggtgggagcctccagtggt

SEQ ID NO: 8328225 - DNA, 22 bp, Homo sapiens
ggagtaggccccgggagagagt

SEQ ID NO: 8328226 - DNA, 22 bp, Homo sapiens
ggaggtgggctaaggactctct

SEQ ID NO: 8328227 - DNA, 22 bp, Homo sapiens
ggaggtgggctaaggactctct

SEQ ID NO: 8328228 - DNA, 22 bp, Homo sapiens
ggaggtgggctaaggactctct

SEQ ID NO: 8328229 - DNA, 22 bp, Homo sapiens
ggagctcctggcagtgacagag

SEQ ID NO: 8328230 - DNA, 22 bp, Homo sapiens
ggagctgaggctgaggcctcac

SEQ ID NO: 8328231 - DNA, 22 bp, Homo sapiens
ggaggccatcagggagggcatt

SEQ ID NO: 8328232 - DNA, 22 bp, Homo sapiens
ggaggccatctggctggaggct

SEQ ID NO: 8328233 - DNA, 22 bp, Homo sapiens
ggaggccatcagggagggcatt

SEQ ID NO: 8328234 - DNA, 22 bp, Homo sapiens
ggaggccaggatgggaactcaa

SEQ ID NO: 8328235 - DNA, 22 bp, Homo sapiens
ggaggccagcctgaggctgagg

SEQ ID NO: 8328236 - DNA, 22 bp, Homo sapiens
ggaggccagggacccagtcagc

SEQ ID NO: 8328237 - DNA, 22 bp, Homo sapiens
ggaggccacctgacctgctgtt

SEQ ID NO: 8328238 - DNA, 22 bp, Homo sapiens
ggaggccagcctgaggctgagg

SEQ ID NO: 8328239 - DNA, 22 bp, Homo sapiens
ggaggaggcggcagaagttcct

SEQ ID NO: 8328240 - DNA, 22 bp, Homo sapiens
ggaggaggcaagtaccagatgc

SEQ ID NO: 8328241 - DNA, 22 bp, Homo sapiens
ggaggaggcaagtaccagatgc

SEQ ID NO: 8328242 - DNA, 22 bp, Homo sapiens
ggagaaggaagaaagctactat

SEQ ID NO: 8328243 - DNA, 22 bp, Homo sapiens
ggagaaggtggctcagcaaagg

SEQ ID NO: 8328244 - DNA, 23 bp, Homo sapiens
ggaagtcagcggagaggtggctg

SEQ ID NO: 8328245 - DNA, 22 bp, Homo sapiens
ggagcctgtggccgtcacgact

SEQ ID NO: 8328246 - DNA, 22 bp, Homo sapiens
ggagcgtgcactccaggccctt

SEQ ID NO: 8328247 - DNA, 22 bp, Homo sapiens
ggagagggtaggggtcctgccc

SEQ ID NO: 8328248 - DNA, 22 bp, Homo sapiens
ggagagggtaggggtcctgccc

SEQ ID NO: 8328249 - DNA, 22 bp, Homo sapiens
ggagaggtgtattcagtgggtc

SEQ ID NO: 8328250 - DNA, 22 bp, Homo sapiens
ggagaggggaacttgttgcttg

SEQ ID NO: 8328251 - DNA, 22 bp, Homo sapiens
ggagaggggcaagtttatctag

SEQ ID NO: 8328252 - DNA, 22 bp, Homo sapiens
ggagagggggctccctgcttgg

SEQ ID NO: 8328253 - DNA, 23 bp, Homo sapiens
ggagaggggtgtgggcatcttta

SEQ ID NO: 8328254 - DNA, 22 bp, Homo sapiens
gctgggctgagctagacttggc

SEQ ID NO: 8328255 - DNA, 22 bp, Homo sapiens
gctgggctgcgtcggggaagcc

SEQ ID NO: 8328256 - DNA, 22 bp, Homo sapiens
gcttaattctggctcagtttcc

SEQ ID NO: 8328257 - DNA, 22 bp, Homo sapiens
gcttaattctggctcagtttcc

SEQ ID NO: 8328258 - DNA, 22 bp, Homo sapiens
gctgggctcagacctagtgaac

SEQ ID NO: 8328259 - DNA, 22 bp, Homo sapiens
gcttcatagcattcattgcctg

SEQ ID NO: 8328260 - DNA, 22 bp, Homo sapiens
ggaaggggtgggtgagcctcag

SEQ ID NO: 8328261 - DNA, 22 bp, Homo sapiens
ggaaggggtgggtgagcctcag

SEQ ID NO: 8328262 - DNA, 22 bp, Homo sapiens
ggaagaaatctggttaagagat

SEQ ID NO: 8328263 - DNA, 22 bp, Homo sapiens
ggaaggggtgtcgcccatggat

SEQ ID NO: 8328264 - DNA, 22 bp, Homo sapiens
ggaaggggttaggggtccctga

SEQ ID NO: 8328265 - DNA, 20 bp, Homo sapiens
ggaaaaatgcatgctcaaga

SEQ ID NO: 8328266 - DNA, 22 bp, Homo sapiens
ggaaaacaagagaatgatgttt

SEQ ID NO: 8328267 - DNA, 22 bp, Homo sapiens
ggaaaacagcgattggtatcat

SEQ ID NO: 8328268 - DNA, 22 bp, Homo sapiens
ggaaagaatcaagtgatcctgt

SEQ ID NO: 8328269 - DNA, 22 bp, Homo sapiens
ggaaagagctaaaagggtgaga

SEQ ID NO: 8328270 - DNA, 22 bp, Homo sapiens
gaggtatagttctattagatga

SEQ ID NO: 8328271 - DNA, 22 bp, Homo sapiens
gaggtatgttatttcttgaaac

SEQ ID NO: 8328272 - DNA, 22 bp, Homo sapiens
gaggtaacactgttcagtgggc

SEQ ID NO: 8328273 - DNA, 22 bp, Homo sapiens
gaggtagtgagttaaacagatg

SEQ ID NO: 8328274 - DNA, 22 bp, Homo sapiens
gaggtagtttagttttggggaa

SEQ ID NO: 8328275 - DNA, 22 bp, Homo sapiens
gaggtagtgagcagctgaacta

SEQ ID NO: 8328276 - DNA, 22 bp, Homo sapiens
gaggtagtaagcagagtggggt

SEQ ID NO: 8328277 - DNA, 22 bp, Homo sapiens
gaggggcgtcctgagtgggcct

SEQ ID NO: 8328278 - DNA, 22 bp, Homo sapiens
gaggggctctttaatagtaaca

SEQ ID NO: 8328279 - DNA, 22 bp, Homo sapiens
gaggggcctggcgaggacatgt

SEQ ID NO: 8328280 - DNA, 22 bp, Homo sapiens
gaggtccagccaagcggcaagg

SEQ ID NO: 8328281 - DNA, 22 bp, Homo sapiens
gaggtccagggtggggcctgag

SEQ ID NO: 8328282 - DNA, 22 bp, Homo sapiens
gaggtccagggtggggcctgag

SEQ ID NO: 8328283 - DNA, 22 bp, Homo sapiens
gaggtcaggggagaggctgatg

SEQ ID NO: 8328284 - DNA, 22 bp, Homo sapiens
gaggtccaacacaatgggtgtt

SEQ ID NO: 8328285 - DNA, 22 bp, Homo sapiens
gaggtccactgaggcaacaggg

SEQ ID NO: 8328286 - DNA, 22 bp, Homo sapiens
gaggtcaggctcaagctgggcc

SEQ ID NO: 8328287 - DNA, 22 bp, Homo sapiens
gagtcctcaacggggagaggcg

SEQ ID NO: 8328288 - DNA, 22 bp, Homo sapiens
gagtcctcagatagaaagtgcg

SEQ ID NO: 8328289 - DNA, 22 bp, Homo sapiens
gagtcagaatgtcctcctgcgg

SEQ ID NO: 8328290 - DNA, 22 bp, Homo sapiens
gagtcacatactatgtaataga

SEQ ID NO: 8328291 - DNA, 22 bp, Homo sapiens
gaggctgggaagtccaagacca

SEQ ID NO: 8328292 - DNA, 22 bp, Homo sapiens
gaggctgggaagtccaagacca

SEQ ID NO: 8328293 - DNA, 22 bp, Homo sapiens
gaggctgggggctgccttcctc

SEQ ID NO: 8328294 - DNA, 22 bp, Homo sapiens
gaggctgggggctgccttcctc

SEQ ID NO: 8328295 - DNA, 22 bp, Homo sapiens
gaggctgggaagtccaagatca

SEQ ID NO: 8328296 - DNA, 22 bp, Homo sapiens
gagggatgcagaaacagaggcc

SEQ ID NO: 8328297 - DNA, 22 bp, Homo sapiens
gaggctggcagaaaagcacagg

SEQ ID NO: 8328298 - DNA, 22 bp, Homo sapiens
gaggctggcagaaaagcacagg

SEQ ID NO: 8328299 - DNA, 22 bp, Homo sapiens
gaggctggaggtcaaagatgaa

SEQ ID NO: 8328300 - DNA, 22 bp, Homo sapiens
gaggctgcccaactggagtgga

SEQ ID NO: 8328301 - DNA, 22 bp, Homo sapiens
gaggctgcccacacctgcgccg

SEQ ID NO: 8328302 - DNA, 22 bp, Homo sapiens
gaggctgcccaactggagtgga

SEQ ID NO: 8328303 - DNA, 22 bp, Homo sapiens
gaggggcacagtaaagggtccc

SEQ ID NO: 8328304 - DNA, 22 bp, Homo sapiens
gaggggagtaaagtcatgttac

SEQ ID NO: 8328305 - DNA, 22 bp, Homo sapiens
gaggggagtgtcctccgggccc

SEQ ID NO: 8328306 - DNA, 22 bp, Homo sapiens
gagggccaaagagcaagagcct

SEQ ID NO: 8328307 - DNA, 22 bp, Homo sapiens
gagggccaatgtgtccctgagc

SEQ ID NO: 8328308 - DNA, 22 bp, Homo sapiens
gaggacagcttagggcttcctg

SEQ ID NO: 8328309 - DNA, 22 bp, Homo sapiens
gaggacagcttagggcttcctg

SEQ ID NO: 8328310 - DNA, 18 bp, Homo sapiens
gagctgggagaaggaagg

SEQ ID NO: 8328311 - DNA, 18 bp, Homo sapiens
gagctgggagaaggaagg

SEQ ID NO: 8328312 - DNA, 22 bp, Homo sapiens
gagctgggagctgggatttgga

SEQ ID NO: 8328313 - DNA, 22 bp, Homo sapiens
gagctgggagttatagcatgtt

SEQ ID NO: 8328314 - DNA, 22 bp, Homo sapiens
gagagtctagtgcacctagttt

SEQ ID NO: 8328315 - DNA, 22 bp, Homo sapiens
gagatacagttggctgcaggct

SEQ ID NO: 8328316 - DNA, 22 bp, Homo sapiens
gagatatgttggcagctggtat

SEQ ID NO: 8328317 - DNA, 22 bp, Homo sapiens
gagctggaagtctgtggtcaga

SEQ ID NO: 8328318 - DNA, 22 bp, Homo sapiens
gagctggcacagaaggatctta

SEQ ID NO: 8328319 - DNA, 22 bp, Homo sapiens
gagctggcaatgacttgtgtat

SEQ ID NO: 8328320 - DNA, 22 bp, Homo sapiens
gagctggctgtggttgagtgca

SEQ ID NO: 8328321 - DNA, 22 bp, Homo sapiens
gagctggctgtggttgagtgca

SEQ ID NO: 8328322 - DNA, 22 bp, Homo sapiens
gaggcagaggttgcagtgagct

SEQ ID NO: 8328323 - DNA, 22 bp, Homo sapiens
gaggagggttggccttaggtag

SEQ ID NO: 8328324 - DNA, 22 bp, Homo sapiens
gaggagggttggccttaggtag

SEQ ID NO: 8328325 - DNA, 22 bp, Homo sapiens
gaggaggctgtttctctgcatt

SEQ ID NO: 8328326 - DNA, 22 bp, Homo sapiens
gaggaggcttccgggaggcacg

SEQ ID NO: 8328327 - DNA, 22 bp, Homo sapiens
gaggagggagctggaagctctt

SEQ ID NO: 8328328 - DNA, 22 bp, Homo sapiens
gaggagggagctggaagctctt

SEQ ID NO: 8328329 - DNA, 22 bp, Homo sapiens
gaggagggagctggaagctctt

SEQ ID NO: 8328330 - DNA, 23 bp, Homo sapiens
gaggagggtctgacaagtgtagc

SEQ ID NO: 8328331 - DNA, 23 bp, Homo sapiens
gaggagggtctgacaagtgtagc

SEQ ID NO: 8328332 - DNA, 22 bp, Homo sapiens
gaggagggagaattaggcttaa

SEQ ID NO: 8328333 - DNA, 22 bp, Homo sapiens
gaggagggagaattaggcttaa

SEQ ID NO: 8328334 - DNA, 22 bp, Homo sapiens
gaggcccagcagcgcaggtctt

SEQ ID NO: 8328335 - DNA, 22 bp, Homo sapiens
gaggcagctgggatacaaggga

SEQ ID NO: 8328336 - DNA, 20 bp, Homo sapiens
gaggcctcagcctcagctcc

SEQ ID NO: 8328337 - DNA, 22 bp, Homo sapiens
gaggcccagtcctgcaagcacg

SEQ ID NO: 8328338 - DNA, 22 bp, Homo sapiens
gaggcccagtcctgcaagcacg

SEQ ID NO: 8328339 - DNA, 22 bp, Homo sapiens
gaggcctcctctgagacatctg

SEQ ID NO: 8328340 - DNA, 22 bp, Homo sapiens
gatgaagtcattatccttttgg

SEQ ID NO: 8328341 - DNA, 22 bp, Homo sapiens
gatgaaatttgggcaggttaaa

SEQ ID NO: 8328342 - DNA, 22 bp, Homo sapiens
gatgacttatgtttacaaatgt

SEQ ID NO: 8328343 - DNA, 22 bp, Homo sapiens
gatgcacagtgaccctgccagt

SEQ ID NO: 8328344 - DNA, 22 bp, Homo sapiens
gatgcacagagggcctggaact

SEQ ID NO: 8328345 - DNA, 22 bp, Homo sapiens
gatgaaaaaagacgagcatata

SEQ ID NO: 8328346 - DNA, 22 bp, Homo sapiens
gatgaaaaaagacgagcatata

SEQ ID NO: 8328347 - DNA, 19 bp, Homo sapiens
gatctttgccaatttaagc

SEQ ID NO: 8328348 - DNA, 22 bp, Homo sapiens
gatgaaaatcttgagatgtcga

SEQ ID NO: 8328349 - DNA, 22 bp, Homo sapiens
gatgaaaaattgctgtgtcata

SEQ ID NO: 8328350 - DNA, 22 bp, Homo sapiens
gatgaaaaattgctgtgtcata

SEQ ID NO: 8328351 - DNA, 17 bp, Homo sapiens
gatgaaatgatgcacac

SEQ ID NO: 8328352 - DNA, 22 bp, Homo sapiens
gatgaaatccagatcacaggtg

SEQ ID NO: 8328353 - DNA, 22 bp, Homo sapiens
gatgaaatagcaaaggcatttg

SEQ ID NO: 8328354 - DNA, 20 bp, Homo sapiens
gatgaaatcactgggcagcc

SEQ ID NO: 8328355 - DNA, 22 bp, Homo sapiens
gatgaaatagaattaatttagg

SEQ ID NO: 8328356 - DNA, 22 bp, Homo sapiens
gatgaaattcagaattgagggg

SEQ ID NO: 8328357 - DNA, 22 bp, Homo sapiens
gatgaaattgttttgatacttt

SEQ ID NO: 8328358 - DNA, 22 bp, Homo sapiens
gatgaaatttgaaaatagtgtt

SEQ ID NO: 8328359 - DNA, 22 bp, Homo sapiens
gatgaaatgctgagcctgagtt

SEQ ID NO: 8328360 - DNA, 22 bp, Homo sapiens
gatgaaatgtgaaagttctggg

SEQ ID NO: 8328361 - DNA, 22 bp, Homo sapiens
gatcctcttttcctaggaaggt

SEQ ID NO: 8328362 - DNA, 22 bp, Homo sapiens
gatcccatgtaggagaatgtta

SEQ ID NO: 8328363 - DNA, 19 bp, Homo sapiens
gatcatttttgcactgctt

SEQ ID NO: 8328364 - DNA, 22 bp, Homo sapiens
gatcattttatagctatagcaa

SEQ ID NO: 8328365 - DNA, 22 bp, Homo sapiens
gatcatttgcaggaaacattaa

SEQ ID NO: 8328366 - DNA, 22 bp, Homo sapiens
gataataagcacagcaggatgt

SEQ ID NO: 8328367 - DNA, 22 bp, Homo sapiens
gataatatctggtttattcacc

SEQ ID NO: 8328368 - DNA, 22 bp, Homo sapiens
gatacccagcaaaatgcaggag

SEQ ID NO: 8328369 - DNA, 22 bp, Homo sapiens
gataccttttgttggaatttcc

SEQ ID NO: 8328370 - DNA, 22 bp, Homo sapiens
gatagaaagaatatagattcca

SEQ ID NO: 8328371 - DNA, 22 bp, Homo sapiens
gatagaaagaatatagattcca

SEQ ID NO: 8328372 - DNA, 22 bp, Homo sapiens
gatagataaaactatattttca

SEQ ID NO: 8328373 - DNA, 22 bp, Homo sapiens
gatagaaaggtgttgaaatcca

SEQ ID NO: 8328374 - DNA, 22 bp, Homo sapiens
gatagaaagagtggttcttttt

SEQ ID NO: 8328375 - DNA, 22 bp, Homo sapiens
gatagaaagagtggttcttttt

SEQ ID NO: 8328376 - DNA, 22 bp, Homo sapiens
gatattttgagaaatcctatga

SEQ ID NO: 8328377 - DNA, 22 bp, Homo sapiens
gatattttgagaaatcctatga

SEQ ID NO: 8328378 - DNA, 22 bp, Homo sapiens
gatatttttaggtgatgcaggc

SEQ ID NO: 8328379 - DNA, 22 bp, Homo sapiens
gatattttcgcagggagaattc

SEQ ID NO: 8328380 - DNA, 22 bp, Homo sapiens
gagtttaaagcatacatatttt

SEQ ID NO: 8328381 - DNA, 22 bp, Homo sapiens
gagtttaaataacacatttcca

SEQ ID NO: 8328382 - DNA, 22 bp, Homo sapiens
gagtttccaaatccctgaaggg

SEQ ID NO: 8328383 - DNA, 22 bp, Homo sapiens
gagttttaaagctggggaagag

SEQ ID NO: 8328384 - DNA, 22 bp, Homo sapiens
gagttttaacctcagctctctg

SEQ ID NO: 8328385 - DNA, 22 bp, Homo sapiens
gagttttaatgagctgctgtgg

SEQ ID NO: 8328386 - DNA, 22 bp, Homo sapiens
gagttttatttggtgctaagta

SEQ ID NO: 8328387 - DNA, 22 bp, Homo sapiens
gataaactggaaccattgcctc

SEQ ID NO: 8328388 - DNA, 22 bp, Homo sapiens
gataaacttgtggagttttggt

SEQ ID NO: 8328389 - DNA, 20 bp, Homo sapiens
gataaattgtctcttaagtg

SEQ ID NO: 8328390 - DNA, 22 bp, Homo sapiens
gagttaaaggcagttgaggaaa

SEQ ID NO: 8328391 - DNA, 22 bp, Homo sapiens
gagtggggtctgggcatcagtc

SEQ ID NO: 8328392 - DNA, 22 bp, Homo sapiens
gagtggggggtccgtctcagtg

SEQ ID NO: 8328393 - DNA, 22 bp, Homo sapiens
gagtggggggtccgtctcagtg

SEQ ID NO: 8328394 - DNA, 22 bp, Homo sapiens
gagtggggtctgggcatcagtc

SEQ ID NO: 8328395 - DNA, 22 bp, Homo sapiens
gagtgacggctcatctctggaa

SEQ ID NO: 8328396 - DNA, 22 bp, Homo sapiens
gagtctctggaggggtcagacc

SEQ ID NO: 8328397 - DNA, 22 bp, Homo sapiens
gagtctcggagggagcatggct

SEQ ID NO: 8328398 - DNA, 22 bp, Homo sapiens
gagtggagatcgtgccactgca

SEQ ID NO: 8328399 - DNA, 22 bp, Homo sapiens
gagtggggctttaaaggctcag

SEQ ID NO: 8328400 - DNA, 22 bp, Homo sapiens
gagtggggctttaaaggctcag

SEQ ID NO: 8328401 - DNA, 22 bp, Homo sapiens
gagtgctggggtgcagagaggt

SEQ ID NO: 8328402 - DNA, 22 bp, Homo sapiens
gagtgctgcttgggatagtgag

SEQ ID NO: 8328403 - DNA, 22 bp, Homo sapiens
gagtgctgctaatgcaagggtg

SEQ ID NO: 8328404 - DNA, 22 bp, Homo sapiens
gagtgctccgtcttggacaggg

SEQ ID NO: 8328405 - DNA, 21 bp, Homo sapiens
gagtgctcagttaagtggaga

SEQ ID NO: 8328406 - DNA, 22 bp, Homo sapiens
gagtgcagtatgagaggctgct

SEQ ID NO: 8328407 - DNA, 22 bp, Homo sapiens
gagtgcagtatgagaggctgct

SEQ ID NO: 8328408 - DNA, 21 bp, Homo sapiens
gacaggcaaggagtcacttag

SEQ ID NO: 8328409 - DNA, 22 bp, Homo sapiens
gacaggcaggccagggctgtgg

SEQ ID NO: 8328410 - DNA, 22 bp, Homo sapiens
gacccagaggcctgacagtgtg

SEQ ID NO: 8328411 - DNA, 22 bp, Homo sapiens
gacttcatgtgcaagcgctttg

SEQ ID NO: 8328412 - DNA, 22 bp, Homo sapiens
gacttcataatattgagcatgt

SEQ ID NO: 8328413 - DNA, 22 bp, Homo sapiens
gagacacacacaggaggtggca

SEQ ID NO: 8328414 - DNA, 22 bp, Homo sapiens
gagacacacattctggagagaa

SEQ ID NO: 8328415 - DNA, 22 bp, Homo sapiens
gagacacacattctggagagaa

SEQ ID NO: 8328416 - DNA, 22 bp, Homo sapiens
gagacacacccaaggttatgag

SEQ ID NO: 8328417 - DNA, 22 bp, Homo sapiens
gagacacacccaaggttatgag

SEQ ID NO: 8328418 - DNA, 22 bp, Homo sapiens
gagacacaatttccccatccta

SEQ ID NO: 8328419 - DNA, 18 bp, Homo sapiens
gagacacaagggcctgga

SEQ ID NO: 8328420 - DNA, 22 bp, Homo sapiens
gagacacaagaagacatgcaca

SEQ ID NO: 8328421 - DNA, 21 bp, Homo sapiens
gagacagactttcgtcccctg

SEQ ID NO: 8328422 - DNA, 22 bp, Homo sapiens
gagacagagaggtactcaacat

SEQ ID NO: 8328423 - DNA, 22 bp, Homo sapiens
gagacacagttatcaggcatac

SEQ ID NO: 8328424 - DNA, 22 bp, Homo sapiens
gagacacaggcacagaagaggc

SEQ ID NO: 8328425 - DNA, 22 bp, Homo sapiens
gagacacaggcacagaagaggc

SEQ ID NO: 8328426 - DNA, 22 bp, Homo sapiens
gagacacagttatcaggcatac

SEQ ID NO: 8328427 - DNA, 22 bp, Homo sapiens
gagacacaagaagacatgcaca

SEQ ID NO: 8328428 - DNA, 22 bp, Homo sapiens
gagaaacaacacttgatgcctt

SEQ ID NO: 8328429 - DNA, 22 bp, Homo sapiens
gagaaaatcttgggtcaagaat

SEQ ID NO: 8328430 - DNA, 22 bp, Homo sapiens
gagaaaatagcatgtgtagtat

SEQ ID NO: 8328431 - DNA, 17 bp, Homo sapiens
gagagctgctgcttccg

SEQ ID NO: 8328432 - DNA, 22 bp, Homo sapiens
gagagctgcagccgagaggggg

SEQ ID NO: 8328433 - DNA, 22 bp, Homo sapiens
gagacagagtttcactcttgtt

SEQ ID NO: 8328434 - DNA, 22 bp, Homo sapiens
gagacagatctcggctccatgc

SEQ ID NO: 8328435 - DNA, 22 bp, Homo sapiens
gagacagagtgttttttaaggt

SEQ ID NO: 8328436 - DNA, 22 bp, Homo sapiens
gagacagagatcttgctgagtc

SEQ ID NO: 8328437 - DNA, 22 bp, Homo sapiens
gagacagagatcttgctgagtc

SEQ ID NO: 8328438 - DNA, 22 bp, Homo sapiens
gagagtctaggaacctcatata

SEQ ID NO: 8328439 - DNA, 22 bp, Homo sapiens
gagagtctaggaacctcatata

SEQ ID NO: 8328440 - DNA, 22 bp, Homo sapiens
gaaggccctggtattcttgagg

SEQ ID NO: 8328441 - DNA, 22 bp, Homo sapiens
gaaggcctcactctgcagcata

SEQ ID NO: 8328442 - DNA, 22 bp, Homo sapiens
gaaggagaggattgtgaggctg

SEQ ID NO: 8328443 - DNA, 22 bp, Homo sapiens
gaaggctgatgacagattctgc

SEQ ID NO: 8328444 - DNA, 22 bp, Homo sapiens
gaaggctctggggattgagata

SEQ ID NO: 8328445 - DNA, 22 bp, Homo sapiens
gaagtgtagtcttgagccccca

SEQ ID NO: 8328446 - DNA, 22 bp, Homo sapiens
gaagttacatactgtcacttct

SEQ ID NO: 8328447 - DNA, 22 bp, Homo sapiens
gacacagcttgatgagggcttt

SEQ ID NO: 8328448 - DNA, 22 bp, Homo sapiens
gacacagatgatcaggtgtgga

SEQ ID NO: 8328449 - DNA, 22 bp, Homo sapiens
gacacagatatctctgagatta

SEQ ID NO: 8328450 - DNA, 22 bp, Homo sapiens
gacacagagataggcctgtgtt

SEQ ID NO: 8328451 - DNA, 22 bp, Homo sapiens
gacacagagctcacagtctcct

SEQ ID NO: 8328452 - DNA, 18 bp, Homo sapiens
gacacaggagagagtccc

SEQ ID NO: 8328453 - DNA, 20 bp, Homo sapiens
gacacaggcagtcctcagag

SEQ ID NO: 8328454 - DNA, 22 bp, Homo sapiens
gacagctgtggagaggcatgtg

SEQ ID NO: 8328455 - DNA, 22 bp, Homo sapiens
gaattctgggagagatctgaca

SEQ ID NO: 8328456 - DNA, 22 bp, Homo sapiens
gaattctagtcacacacattca

SEQ ID NO: 8328457 - DNA, 22 bp, Homo sapiens
gaatttaaggaccaagcatttt

SEQ ID NO: 8328458 - DNA, 22 bp, Homo sapiens
gaagttcaactgccatgcttgg

SEQ ID NO: 8328459 - DNA, 22 bp, Homo sapiens
gaagttcaatgtcagcatctat

SEQ ID NO: 8328460 - DNA, 22 bp, Homo sapiens
gaaagtgcctcagtcctcttat

SEQ ID NO: 8328461 - DNA, 22 bp, Homo sapiens
gaaagtgcctcagtcctcttat

SEQ ID NO: 8328462 - DNA, 18 bp, Homo sapiens
gaaagtgcggggcagggg

SEQ ID NO: 8328463 - DNA, 18 bp, Homo sapiens
gaaagtgcggggcagggg

SEQ ID NO: 8328464 - DNA, 22 bp, Homo sapiens
gaaagtgcatgtgcccaccatt

SEQ ID NO: 8328465 - DNA, 22 bp, Homo sapiens
gaaagtgccagaataggaggcc

SEQ ID NO: 8328466 - DNA, 22 bp, Homo sapiens
gaaagtgccagaataggaggcc

SEQ ID NO: 8328467 - DNA, 22 bp, Homo sapiens
gaaagtgcatgtgcccaccatt

SEQ ID NO: 8328468 - DNA, 22 bp, Homo sapiens
gaaagtgcttttgagtgtgtgc

SEQ ID NO: 8328469 - DNA, 22 bp, Homo sapiens
gaaagtgcttttgagtgtgtgc

SEQ ID NO: 8328470 - DNA, 22 bp, Homo sapiens
gaaagtgctaggaagtgttaga

SEQ ID NO: 8328471 - DNA, 22 bp, Homo sapiens
gaaagtgctaggaagtgttaga

SEQ ID NO: 8328472 - DNA, 22 bp, Homo sapiens
gaaagtgcttagagtgtggtat

SEQ ID NO: 8328473 - DNA, 22 bp, Homo sapiens
gaaagtgctctctctatacaca

SEQ ID NO: 8328474 - DNA, 22 bp, Homo sapiens
gaaagtgcttagagtgtggtat

SEQ ID NO: 8328475 - DNA, 22 bp, Homo sapiens
gaaagtgctctctctatacaca

SEQ ID NO: 8328476 - DNA, 22 bp, Homo sapiens
gaaaagtatgtttattttgact

SEQ ID NO: 8328477 - DNA, 21 bp, Homo sapiens
gaaaatacaatgagcttgacc

SEQ ID NO: 8328478 - DNA, 22 bp, Homo sapiens
gaaaatacaaatagccttgaaa

SEQ ID NO: 8328479 - DNA, 22 bp, Homo sapiens
gaaaatacaaatagccttgaaa

SEQ ID NO: 8328480 - DNA, 21 bp, Homo sapiens
gaaaatacaatgagcttgacc

SEQ ID NO: 8328481 - DNA, 18 bp, Homo sapiens
gaaaatactctgggctca

SEQ ID NO: 8328482 - DNA, 22 bp, Homo sapiens
gaaaagtaaacactaggggtca

SEQ ID NO: 8328483 - DNA, 22 bp, Homo sapiens
gaaaagtacacagcccaaacat

SEQ ID NO: 8328484 - DNA, 22 bp, Homo sapiens
gaaaaggattggtaaaatatct

SEQ ID NO: 8328485 - DNA, 22 bp, Homo sapiens
gaaaaggaaatttatagagatc

SEQ ID NO: 8328486 - DNA, 21 bp, Homo sapiens
gaaaagcaagggagtagaaca

SEQ ID NO: 8328487 - DNA, 22 bp, Homo sapiens
gaaaacatccagagatagacct

SEQ ID NO: 8328488 - DNA, 22 bp, Homo sapiens
cttttaagggataataagatgt

SEQ ID NO: 8328489 - DNA, 22 bp, Homo sapiens
ctttgttttactcagaggcatg

SEQ ID NO: 8328490 - DNA, 22 bp, Homo sapiens
ctttgttttactcagaggcatg

SEQ ID NO: 8328491 - DNA, 22 bp, Homo sapiens
cttttaatgggagcagtatttg

SEQ ID NO: 8328492 - DNA, 22 bp, Homo sapiens
ctttgtgtctgttaataattat

SEQ ID NO: 8328493 - DNA, 22 bp, Homo sapiens
ctttgtttatatttctcctcga

SEQ ID NO: 8328494 - DNA, 22 bp, Homo sapiens
gaaagttttctcacacagtaat

SEQ ID NO: 8328495 - DNA, 22 bp, Homo sapiens
gaaataatacagtgctcttctc

SEQ ID NO: 8328496 - DNA, 22 bp, Homo sapiens
gaaataatacagtgctcttctc

SEQ ID NO: 8328497 - DNA, 22 bp, Homo sapiens
gaaataatttagaaggtattcc

SEQ ID NO: 8328498 - DNA, 22 bp, Homo sapiens
gaaataattctgtgtctgaaca

SEQ ID NO: 8328499 - DNA, 22 bp, Homo sapiens
gaacacagtcaagggctgctgt

SEQ ID NO: 8328500 - DNA, 22 bp, Homo sapiens
gaaatacaaatgcctagatcct

SEQ ID NO: 8328501 - DNA, 22 bp, Homo sapiens
cttggctttctgacccttgtca

SEQ ID NO: 8328502 - DNA, 17 bp, Homo sapiens
cttggctgctgtgcgat

SEQ ID NO: 8328503 - DNA, 18 bp, Homo sapiens
cttggctgatgggggtgt

SEQ ID NO: 8328504 - DNA, 22 bp, Homo sapiens
cttgaatgaaaccaactgatga

SEQ ID NO: 8328505 - DNA, 23 bp, Homo sapiens
cttgaatgggatggaattcactg

SEQ ID NO: 8328506 - DNA, 22 bp, Homo sapiens
cttgaatgtaaataatgtacag

SEQ ID NO: 8328507 - DNA, 22 bp, Homo sapiens
cttgaatgtcctgtggcaaagt

SEQ ID NO: 8328508 - DNA, 22 bp, Homo sapiens
cttgaatggtatgagagtaatt

SEQ ID NO: 8328509 - DNA, 22 bp, Homo sapiens
cttgaatgggccataagacggt

SEQ ID NO: 8328510 - DNA, 21 bp, Homo sapiens
cttggagttggttgaggatgc

SEQ ID NO: 8328511 - DNA, 22 bp, Homo sapiens
ctttgtattcatccgtaataat

SEQ ID NO: 8328512 - DNA, 19 bp, Homo sapiens
ctttgtcagaacatgcttc

SEQ ID NO: 8328513 - DNA, 22 bp, Homo sapiens
ctttatctagggtaagaaaacc

SEQ ID NO: 8328514 - DNA, 22 bp, Homo sapiens
cttctcattcaagcaaaacaga

SEQ ID NO: 8328515 - DNA, 22 bp, Homo sapiens
ctggctgtgaaatggcagtgtc

SEQ ID NO: 8328516 - DNA, 22 bp, Homo sapiens
ctggctggttccctgctccagg

SEQ ID NO: 8328517 - DNA, 22 bp, Homo sapiens
ctggctggttccctgctccagg

SEQ ID NO: 8328518 - DNA, 22 bp, Homo sapiens
ctggctggtctgagcagtcgca

SEQ ID NO: 8328519 - DNA, 22 bp, Homo sapiens
ctggctggtttttaaagctagg

SEQ ID NO: 8328520 - DNA, 22 bp, Homo sapiens
ctggctggttggggagaagaca

SEQ ID NO: 8328521 - DNA, 22 bp, Homo sapiens
ctggctggttgtctcaatccag

SEQ ID NO: 8328522 - DNA, 22 bp, Homo sapiens
ctggctggtaatggaacgacag

SEQ ID NO: 8328523 - DNA, 22 bp, Homo sapiens
ctggctggggtccatcctctaa

SEQ ID NO: 8328524 - DNA, 22 bp, Homo sapiens
ctggctgggttccaggattcca

SEQ ID NO: 8328525 - DNA, 22 bp, Homo sapiens
ctggctggtcatgtcatgagcc

SEQ ID NO: 8328526 - DNA, 22 bp, Homo sapiens
ctggctggtcctcggggacagc

SEQ ID NO: 8328527 - DNA, 22 bp, Homo sapiens
ctggctggtcctcggggacagc

SEQ ID NO: 8328528 - DNA, 22 bp, Homo sapiens
ctggctggagtgcaggtgagtg

SEQ ID NO: 8328529 - DNA, 22 bp, Homo sapiens
ctggctgggagctcgcctgcgg

SEQ ID NO: 8328530 - DNA, 22 bp, Homo sapiens
ctggctggaggtgagtcactga

SEQ ID NO: 8328531 - DNA, 22 bp, Homo sapiens
ctggctggagctgttgtaggct

SEQ ID NO: 8328532 - DNA, 22 bp, Homo sapiens
ctggctggggtaccagttgaac

SEQ ID NO: 8328533 - DNA, 22 bp, Homo sapiens
ctggctggggaagtcatttgat

SEQ ID NO: 8328534 - DNA, 22 bp, Homo sapiens
gcaatcaatgatttatatttgt

SEQ ID NO: 8328535 - DNA, 20 bp, Homo sapiens
gcaatatatgagtgcaataa

SEQ ID NO: 8328536 - DNA, 22 bp, Homo sapiens
gcaatatactttctggcagtga

SEQ ID NO: 8328537 - DNA, 22 bp, Homo sapiens
gcaatataatttgtgggatatc

SEQ ID NO: 8328538 - DNA, 22 bp, Homo sapiens
gcacaagcagcccactgacatt

SEQ ID NO: 8328539 - DNA, 22 bp, Homo sapiens
gcaaaaaatgcttgttgcttag

SEQ ID NO: 8328540 - DNA, 22 bp, Homo sapiens
gcaaacatccactgcccttgta

SEQ ID NO: 8328541 - DNA, 22 bp, Homo sapiens
gcaaacataatatgaagacact

SEQ ID NO: 8328542 - DNA, 22 bp, Homo sapiens
gatttttatataaagtgagaaa

SEQ ID NO: 8328543 - DNA, 22 bp, Homo sapiens
gcaaacattcaggagtacagga

SEQ ID NO: 8328544 - DNA, 22 bp, Homo sapiens
gcaaacattcaggagtacagga

SEQ ID NO: 8328545 - DNA, 22 bp, Homo sapiens
gcaatataaccagttgtcatgc

SEQ ID NO: 8328546 - DNA, 22 bp, Homo sapiens
gcaaacattccacagaaggaag

SEQ ID NO: 8328547 - DNA, 22 bp, Homo sapiens
gattttatatggcatactgtgg

SEQ ID NO: 8328548 - DNA, 22 bp, Homo sapiens
gattttatagtcaggaaaaaga

SEQ ID NO: 8328549 - DNA, 22 bp, Homo sapiens
gattttattagcccaaactttg

SEQ ID NO: 8328550 - DNA, 22 bp, Homo sapiens
gattttatcgtcatccttctgg

SEQ ID NO: 8328551 - DNA, 22 bp, Homo sapiens
gattttatctttgtgtgcagta

SEQ ID NO: 8328552 - DNA, 22 bp, Homo sapiens
gcacttgtggatttgatataca

SEQ ID NO: 8328553 - DNA, 22 bp, Homo sapiens
gcagagcagtgcttgcccagcg

SEQ ID NO: 8328554 - DNA, 22 bp, Homo sapiens
gatgtaaaacctatggagctga

SEQ ID NO: 8328555 - DNA, 22 bp, Homo sapiens
gatgtaaactgggacttcctag

SEQ ID NO: 8328556 - DNA, 18 bp, Homo sapiens
gatgtaaaatagtagctt

SEQ ID NO: 8328557 - DNA, 22 bp, Homo sapiens
gatgggtgccccagacaagctg

SEQ ID NO: 8328558 - DNA, 17 bp, Homo sapiens
gatggggctgacatcag

SEQ ID NO: 8328559 - DNA, 22 bp, Homo sapiens
gatggggatgagaagtgagcag

SEQ ID NO: 8328560 - DNA, 22 bp, Homo sapiens
gatgtgtccttttctccatcca

SEQ ID NO: 8328561 - DNA, 22 bp, Homo sapiens
gatggctgtcttctccctgtgt

SEQ ID NO: 8328562 - DNA, 22 bp, Homo sapiens
gatggctggctatatcagggga

SEQ ID NO: 8328563 - DNA, 22 bp, Homo sapiens
gatggctgccttctccctgtgt

SEQ ID NO: 8328564 - DNA, 22 bp, Homo sapiens
gatggcggtggccacctccttg

SEQ ID NO: 8328565 - DNA, 22 bp, Homo sapiens
gatggctgcctcctgcggtcct

SEQ ID NO: 8328566 - DNA, 22 bp, Homo sapiens
gatggaggagatggcagggtgc

SEQ ID NO: 8328567 - DNA, 22 bp, Homo sapiens
gatggaatgtcacttctgtggt

SEQ ID NO: 8328568 - DNA, 18 bp, Homo sapiens
gatgggagcaagagaaga

SEQ ID NO: 8328569 - DNA, 18 bp, Homo sapiens
gatgggagcaagagaaga

SEQ ID NO: 8328570 - DNA, 22 bp, Homo sapiens
gatgctgggaccacagagtgtt

SEQ ID NO: 8328571 - DNA, 22 bp, Homo sapiens
gatgctgtagatgagaacattg

SEQ ID NO: 8328572 - DNA, 22 bp, Homo sapiens
gatgctttccaagaaatcctca

SEQ ID NO: 8328573 - DNA, 22 bp, Homo sapiens
gatgctgaagtgaagtgatctt

SEQ ID NO: 8328574 - DNA, 22 bp, Homo sapiens
gatgcgggcccgctccactgcc

SEQ ID NO: 8328575 - DNA, 22 bp, Homo sapiens
gattcaaaaataagctcctatt

SEQ ID NO: 8328576 - DNA, 22 bp, Homo sapiens
gattcaaaagtttgagctccaa

SEQ ID NO: 8328577 - DNA, 22 bp, Homo sapiens
gattcaaagacagactcatttc

SEQ ID NO: 8328578 - DNA, 22 bp, Homo sapiens
gattcaaagttaatgaagatgc

SEQ ID NO: 8328579 - DNA, 22 bp, Homo sapiens
gattcaatgttgcagatggaat

SEQ ID NO: 8328580 - DNA, 22 bp, Homo sapiens
gattaaaaataacccatgctga

SEQ ID NO: 8328581 - DNA, 21 bp, Homo sapiens
gattaaatttaagctacatgc

SEQ ID NO: 8328582 - DNA, 22 bp, Homo sapiens
gatttattggtctttcattggt

SEQ ID NO: 8328583 - DNA, 22 bp, Homo sapiens
gatttacaggttaggtcctgta

SEQ ID NO: 8328584 - DNA, 22 bp, Homo sapiens
gatttacagctatacccaatgg

SEQ ID NO: 8328585 - DNA, 22 bp, Homo sapiens
gatttaaagtagacctttgttt

SEQ ID NO: 8328586 - DNA, 19 bp, Homo sapiens
gatttaaacgtggctctat

SEQ ID NO: 8328587 - DNA, 22 bp, Homo sapiens
gatttacagatctaagggtcac

SEQ ID NO: 8328588 - DNA, 22 bp, Homo sapiens
gatttacaaagctctctagtgt

SEQ ID NO: 8328589 - DNA, 22 bp, Homo sapiens
gattgaatcatatgaaattgtg

SEQ ID NO: 8328590 - DNA, 22 bp, Homo sapiens
gattgtaattttcaagaggtaa

SEQ ID NO: 8328591 - DNA, 22 bp, Homo sapiens
gattgtaattctactttccgct

SEQ ID NO: 8328592 - DNA, 22 bp, Homo sapiens
gattgtaaaacagatcattatc

SEQ ID NO: 8328593 - DNA, 16 bp, Homo sapiens
gcagagctcagggact

SEQ ID NO: 8328594 - DNA, 22 bp, Homo sapiens
gcagcctctgcagttcaggagg

SEQ ID NO: 8328595 - DNA, 22 bp, Homo sapiens
gcaggcaccgggttgctcccct

SEQ ID NO: 8328596 - DNA, 22 bp, Homo sapiens
gcaggagctcgtttccaggctg

SEQ ID NO: 8328597 - DNA, 22 bp, Homo sapiens
gcaggagaacaaagcaagctgc

SEQ ID NO: 8328598 - DNA, 22 bp, Homo sapiens
gcaggagaaatgaagattgggt

SEQ ID NO: 8328599 - DNA, 22 bp, Homo sapiens
gcaggggctgagcaccagcggg

SEQ ID NO: 8328600 - DNA, 22 bp, Homo sapiens
gcagggggtcattcacgctggc

SEQ ID NO: 8328601 - DNA, 19 bp, Homo sapiens
gccacaggatgaagtttgg

SEQ ID NO: 8328602 - DNA, 22 bp, Homo sapiens
gccacagcggggccgctagagc

SEQ ID NO: 8328603 - DNA, 22 bp, Homo sapiens
gccacagctcacgttccccatt

SEQ ID NO: 8328604 - DNA, 22 bp, Homo sapiens
gccacaggctccagcatcagta

SEQ ID NO: 8328605 - DNA, 22 bp, Homo sapiens
gccagcaccttagcatgaatca

SEQ ID NO: 8328606 - DNA, 22 bp, Homo sapiens
gccagcaccttctcatatgttt

SEQ ID NO: 8328607 - DNA, 22 bp, Homo sapiens
gccagcaccttctcatatgttt

SEQ ID NO: 8328608 - DNA, 22 bp, Homo sapiens
gccagcaccagctactagtcac

SEQ ID NO: 8328609 - DNA, 19 bp, Homo sapiens
gccagcacatgtcttctag

SEQ ID NO: 8328610 - DNA, 22 bp, Homo sapiens
gcatgtgtctttatagcagcat

SEQ ID NO: 8328611 - DNA, 21 bp, Homo sapiens
gcattaaaagcagttgttggt

SEQ ID NO: 8328612 - DNA, 22 bp, Homo sapiens
gccacagcagggccctctcagg

SEQ ID NO: 8328613 - DNA, 22 bp, Homo sapiens
gccacagcccgagcaccatgag

SEQ ID NO: 8328614 - DNA, 22 bp, Homo sapiens
gccacagcctctgggaaaactc

SEQ ID NO: 8328615 - DNA, 22 bp, Homo sapiens
gccacacttattctcatgcaca

SEQ ID NO: 8328616 - DNA, 22 bp, Homo sapiens
gcagggtgacgttgcccacctc

SEQ ID NO: 8328617 - DNA, 22 bp, Homo sapiens
gcagtgggcaacaagagctgga

SEQ ID NO: 8328618 - DNA, 19 bp, Homo sapiens
gccaggctcttattctgtg

SEQ ID NO: 8328619 - DNA, 22 bp, Homo sapiens
gccaggctcttccatttgggtc

SEQ ID NO: 8328620 - DNA, 22 bp, Homo sapiens
gccaggctgaggctctggaaga

SEQ ID NO: 8328621 - DNA, 22 bp, Homo sapiens
gccaggctgccttatctctagc

SEQ ID NO: 8328622 - DNA, 22 bp, Homo sapiens
gccaggctgaggctctggaaga

SEQ ID NO: 8328623 - DNA, 22 bp, Homo sapiens
gccaggctcttggttatgtttt

SEQ ID NO: 8328624 - DNA, 22 bp, Homo sapiens
gccaggctgactcccccggcct

SEQ ID NO: 8328625 - DNA, 22 bp, Homo sapiens
gccaggctgctccagggaggcc

SEQ ID NO: 8328626 - DNA, 22 bp, Homo sapiens
gccaggctgccttatctctagc

SEQ ID NO: 8328627 - DNA, 22 bp, Homo sapiens
gccaggctggttatttaatgag

SEQ ID NO: 8328628 - DNA, 22 bp, Homo sapiens
gccaggctgctggctgctgtcc

SEQ ID NO: 8328629 - DNA, 22 bp, Homo sapiens
gccaggctggtgtcacaactct

SEQ ID NO: 8328630 - DNA, 22 bp, Homo sapiens
gccaggctggtgtcacaactct

SEQ ID NO: 8328631 - DNA, 22 bp, Homo sapiens
gccaggctgtggggaacttgaa

SEQ ID NO: 8328632 - DNA, 22 bp, Homo sapiens
gccagggaaactgcagaccagc

SEQ ID NO: 8328633 - DNA, 22 bp, Homo sapiens
gccaggctgtttttattactgt

SEQ ID NO: 8328634 - DNA, 22 bp, Homo sapiens
gcccaggatggctggaggtgct

SEQ ID NO: 8328635 - DNA, 22 bp, Homo sapiens
gcccaggattctttcttcctta

SEQ ID NO: 8328636 - DNA, 20 bp, Homo sapiens
gcccaggatctctgaggcat

SEQ ID NO: 8328637 - DNA, 22 bp, Homo sapiens
gcccaggagttggtggctgcag

SEQ ID NO: 8328638 - DNA, 22 bp, Homo sapiens
gcccaggataatgctgtccctg

SEQ ID NO: 8328639 - DNA, 22 bp, Homo sapiens
gccattaacaagaatatagtag

SEQ ID NO: 8328640 - DNA, 22 bp, Homo sapiens
gccattaatgtgaaggaaggaa

SEQ ID NO: 8328641 - DNA, 22 bp, Homo sapiens
gccattaatgagatcaagaatc

SEQ ID NO: 8328642 - DNA, 22 bp, Homo sapiens
gcccaggaggagaggctgcagt

SEQ ID NO: 8328643 - DNA, 22 bp, Homo sapiens
gcccaggaggcagaggttgtgg

SEQ ID NO: 8328644 - DNA, 22 bp, Homo sapiens
gcccaggagttggaggctgcag

SEQ ID NO: 8328645 - DNA, 22 bp, Homo sapiens
gccatgttcttgaatctgggtc

SEQ ID NO: 8328646 - DNA, 22 bp, Homo sapiens
gccattaaagtgcatgttttgc

SEQ ID NO: 8328647 - DNA, 21 bp, Homo sapiens
gccatgtttccttactaagag

SEQ ID NO: 8328648 - DNA, 22 bp, Homo sapiens
gcctcctgttatgccatgtgcc

SEQ ID NO: 8328649 - DNA, 22 bp, Homo sapiens
gcctcctgtcccaggctgagga

SEQ ID NO: 8328650 - DNA, 22 bp, Homo sapiens
gcctcctgtcccaggctgagga

SEQ ID NO: 8328651 - DNA, 22 bp, Homo sapiens
gccctcagcaggaaagatcaac

SEQ ID NO: 8328652 - DNA, 22 bp, Homo sapiens
gcccttccaacccagagggcaa

SEQ ID NO: 8328653 - DNA, 22 bp, Homo sapiens
gcccttccttagacagcaggat

SEQ ID NO: 8328654 - DNA, 22 bp, Homo sapiens
gccctttcttcttctggactgg

SEQ ID NO: 8328655 - DNA, 16 bp, Homo sapiens
gccctttccttggctg

SEQ ID NO: 8328656 - DNA, 22 bp, Homo sapiens
gccctctgctggcctcacctcg

SEQ ID NO: 8328657 - DNA, 22 bp, Homo sapiens
gcctggggaacttgatcctgtc

SEQ ID NO: 8328658 - DNA, 21 bp, Homo sapiens
gcctgtggagcccaagggccc

SEQ ID NO: 8328659 - DNA, 22 bp, Homo sapiens
gcctggagtactccttgaagtg

SEQ ID NO: 8328660 - DNA, 17 bp, Homo sapiens
gcctggcccagcctggc

SEQ ID NO: 8328661 - DNA, 22 bp, Homo sapiens
gcctggcctgaactaggaggtg

SEQ ID NO: 8328662 - DNA, 20 bp, Homo sapiens
gcctggaggcagagataaag

SEQ ID NO: 8328663 - DNA, 22 bp, Homo sapiens
gcctggagggatagaatgcaag

SEQ ID NO: 8328664 - DNA, 22 bp, Homo sapiens
gcctggagcctcagcaaggagg

SEQ ID NO: 8328665 - DNA, 22 bp, Homo sapiens
gcctggagggctctagagaggc

SEQ ID NO: 8328666 - DNA, 22 bp, Homo sapiens
gcctggagggtccctctctgga

SEQ ID NO: 8328667 - DNA, 22 bp, Homo sapiens
gcctggaggggccagggtggta

SEQ ID NO: 8328668 - DNA, 22 bp, Homo sapiens
gcctggaggggccagggtggta

SEQ ID NO: 8328669 - DNA, 22 bp, Homo sapiens
gcctgctgttaactgcaggaat

SEQ ID NO: 8328670 - DNA, 22 bp, Homo sapiens
gcctgctgtcctgattcccatg

SEQ ID NO: 8328671 - DNA, 21 bp, Homo sapiens
gcctgctgttcaccctgccac

SEQ ID NO: 8328672 - DNA, 22 bp, Homo sapiens
gcctgccttttggaggcacatt

SEQ ID NO: 8328673 - DNA, 22 bp, Homo sapiens
gcctgccttcggtgcgcagcgg

SEQ ID NO: 8328674 - DNA, 22 bp, Homo sapiens
gctggagctgagttccctgggc

SEQ ID NO: 8328675 - DNA, 22 bp, Homo sapiens
gctggagcgtgatccttgatct

SEQ ID NO: 8328676 - DNA, 22 bp, Homo sapiens
gctggagccttctgctctgttg

SEQ ID NO: 8328677 - DNA, 22 bp, Homo sapiens
gctggagatagtaggatccata

SEQ ID NO: 8328678 - DNA, 22 bp, Homo sapiens
gctggagatagtaggatccata

SEQ ID NO: 8328679 - DNA, 22 bp, Homo sapiens
gctggcctctggagaagggctt

SEQ ID NO: 8328680 - DNA, 22 bp, Homo sapiens
gctggcctgacctgaggctggg

SEQ ID NO: 8328681 - DNA, 22 bp, Homo sapiens
gctggcctgacctgaggctggg

SEQ ID NO: 8328682 - DNA, 22 bp, Homo sapiens
gctggccagggctgctcgcgga

SEQ ID NO: 8328683 - DNA, 22 bp, Homo sapiens
gctggccagtgtcccagggatc

SEQ ID NO: 8328684 - DNA, 22 bp, Homo sapiens
gctggagctgcagcctgggcct

SEQ ID NO: 8328685 - DNA, 22 bp, Homo sapiens
gctggcggcagtggtgtctctg

SEQ ID NO: 8328686 - DNA, 22 bp, Homo sapiens
gctgggagtgggcaagatgaga

SEQ ID NO: 8328687 - DNA, 22 bp, Homo sapiens
gctgggatggagactgcagtga

SEQ ID NO: 8328688 - DNA, 22 bp, Homo sapiens
gctgggatgcgtcttcccaggc

SEQ ID NO: 8328689 - DNA, 22 bp, Homo sapiens
gctggccttgtgtctgaggaag

SEQ ID NO: 8328690 - DNA, 22 bp, Homo sapiens
gctggcctgcgagggcaggctg

SEQ ID NO: 8328691 - DNA, 22 bp, Homo sapiens
gctggcctgggcagaggctatg

SEQ ID NO: 8328692 - DNA, 22 bp, Homo sapiens
gctgggcaatgccagagaggag

SEQ ID NO: 8328693 - DNA, 22 bp, Homo sapiens
gctgagctgaggcagggctggg

SEQ ID NO: 8328694 - DNA, 22 bp, Homo sapiens
gctgagccatgaggcctcttgc

SEQ ID NO: 8328695 - DNA, 22 bp, Homo sapiens
gctgagccacccttgcttccct

SEQ ID NO: 8328696 - DNA, 22 bp, Homo sapiens
gctgagccctcatccctagttt

SEQ ID NO: 8328697 - DNA, 22 bp, Homo sapiens
gctgagcctagctgtctcctgt

SEQ ID NO: 8328698 - DNA, 22 bp, Homo sapiens
gctgagcccccctgcgtgggtc

SEQ ID NO: 8328699 - DNA, 22 bp, Homo sapiens
gctgagccacaggcagtgcact

SEQ ID NO: 8328700 - DNA, 22 bp, Homo sapiens
gctgagcaggtttgatgctttt

SEQ ID NO: 8328701 - DNA, 22 bp, Homo sapiens
gctgaggcaagatttgaaccca

SEQ ID NO: 8328702 - DNA, 22 bp, Homo sapiens
gctgaggcaaatagttttaagt

SEQ ID NO: 8328703 - DNA, 22 bp, Homo sapiens
gctgaggcaaaccaagaatgta

SEQ ID NO: 8328704 - DNA, 22 bp, Homo sapiens
gctgcctgcttcatgtgggaga

SEQ ID NO: 8328705 - DNA, 22 bp, Homo sapiens
gctgcctgatcatacaccaggg

SEQ ID NO: 8328706 - DNA, 22 bp, Homo sapiens
gctgcctggagaggcagggatg

SEQ ID NO: 8328707 - DNA, 22 bp, Homo sapiens
gctgcctgtcccaggatgagga

SEQ ID NO: 8328708 - DNA, 22 bp, Homo sapiens
gctgcctgggcaggaggcgctg

SEQ ID NO: 8328709 - DNA, 22 bp, Homo sapiens
gctgcctggtttctcagctgca

SEQ ID NO: 8328710 - DNA, 22 bp, Homo sapiens
gctgctgcctgtagccagggtg

SEQ ID NO: 8328711 - DNA, 22 bp, Homo sapiens
gctcttctaaagaatgtacagg

SEQ ID NO: 8328712 - DNA, 22 bp, Homo sapiens
gctctgtgttgtcagaggcacc

SEQ ID NO: 8328713 - DNA, 22 bp, Homo sapiens
gctctgcccaggaccgtccttg

SEQ ID NO: 8328714 - DNA, 22 bp, Homo sapiens
gctctgcccaatgtccctacac

SEQ ID NO: 8328715 - DNA, 22 bp, Homo sapiens
gctctgcccaaagctgtggctg

SEQ ID NO: 8328716 - DNA, 17 bp, Homo sapiens
gctctgccaggaaagag

SEQ ID NO: 8328717 - DNA, 19 bp, Homo sapiens
gctctgccagtggtaacat

SEQ ID NO: 8328718 - DNA, 17 bp, Homo sapiens
gctctgccaggaaagag

SEQ ID NO: 8328719 - DNA, 22 bp, Homo sapiens
gctctgccagcccaaggcgcag

SEQ ID NO: 8328720 - DNA, 20 bp, Homo sapiens
gctctgccacttagaagctg

SEQ ID NO: 8328721 - DNA, 22 bp, Homo sapiens
gctctgccagacactgtggcca

SEQ ID NO: 8328722 - DNA, 22 bp, Homo sapiens
gctgagagtgggtgcagtgctt

SEQ ID NO: 8328723 - DNA, 20 bp, Homo sapiens
gctgaagaagtagcatgtac

SEQ ID NO: 8328724 - DNA, 22 bp, Homo sapiens
gctgagcacagcctgtgtcctc

SEQ ID NO: 8328725 - DNA, 22 bp, Homo sapiens
gctgaaatgggcactgaaggcc

SEQ ID NO: 8328726 - DNA, 22 bp, Homo sapiens
gctgaaattcagattcctaggc

SEQ ID NO: 8328727 - DNA, 22 bp, Homo sapiens
gctgaaattggaacctgggcct

SEQ ID NO: 8328728 - DNA, 19 bp, Homo sapiens
gctcctgggcctcactcat

SEQ ID NO: 8328729 - DNA, 16 bp, Homo sapiens
gctcctgggccctcga

SEQ ID NO: 8328730 - DNA, 22 bp, Homo sapiens
gctcctgggccctgggctaact

SEQ ID NO: 8328731 - DNA, 22 bp, Homo sapiens
gctcctggctctggccaaggga

SEQ ID NO: 8328732 - DNA, 22 bp, Homo sapiens
gctcctggcttcactgacatca

SEQ ID NO: 8328733 - DNA, 22 bp, Homo sapiens
gctcctgggctctaccttgcta

SEQ ID NO: 8328734 - DNA, 22 bp, Homo sapiens
gctcctgggtgtggctgcccct

SEQ ID NO: 8328735 - DNA, 22 bp, Homo sapiens
gctctgccaacagtttgggcaa

SEQ ID NO: 8328736 - DNA, 22 bp, Homo sapiens
gctctgccaaggacccattctc

SEQ ID NO: 8328737 - DNA, 21 bp, Homo sapiens
gctctgccacttaccagattt

SEQ ID NO: 8328738 - DNA, 21 bp, Homo sapiens
gctctgccacttaccagattt

SEQ ID NO: 8328739 - DNA, 22 bp, Homo sapiens
gctctgccaaggacccattctc

SEQ ID NO: 8328740 - DNA, 23 bp, Homo sapiens
gctctgccacttaatagctgtgt

SEQ ID NO: 8328741 - DNA, 22 bp, Homo sapiens
gctccagctcgtggctcccagc

SEQ ID NO: 8328742 - DNA, 22 bp, Homo sapiens
gctccagctcgtggctcccagc

SEQ ID NO: 8328743 - DNA, 22 bp, Homo sapiens
gctccagctccggctccgaagc

SEQ ID NO: 8328744 - DNA, 22 bp, Homo sapiens
gctccagcacctagagcaggtc

SEQ ID NO: 8328745 - DNA, 22 bp, Homo sapiens
gctcctggctccaggcagccaa

SEQ ID NO: 8328746 - DNA, 22 bp, Homo sapiens
gctcctggctctctgagggctg

SEQ ID NO: 8328747 - DNA, 22 bp, Homo sapiens
gctcctggcaggcagtgtgtgt

SEQ ID NO: 8328748 - DNA, 22 bp, Homo sapiens
gctcctggcatcctgcttttaa

SEQ ID NO: 8328749 - DNA, 22 bp, Homo sapiens
gctcctggccagcacagggccc

SEQ ID NO: 8328750 - DNA, 22 bp, Homo sapiens
gcctgtttggcatcattggttg

SEQ ID NO: 8328751 - DNA, 22 bp, Homo sapiens
gcctgtttgttatgtcatggta

SEQ ID NO: 8328752 - DNA, 22 bp, Homo sapiens
gcctgtttatctatcatgaact

SEQ ID NO: 8328753 - DNA, 22 bp, Homo sapiens
gcctgtttactttgccgcagga

SEQ ID NO: 8328754 - DNA, 22 bp, Homo sapiens
gcctgtttctcctccttggccc

SEQ ID NO: 8328755 - DNA, 22 bp, Homo sapiens
gcctgtttgagaatagtcaggg

SEQ ID NO: 8328756 - DNA, 22 bp, Homo sapiens
gcctgtttgactggtctctgct

SEQ ID NO: 8328757 - DNA, 22 bp, Homo sapiens
gctcagacctgtaatcttagca

SEQ ID NO: 8328758 - DNA, 22 bp, Homo sapiens
ttggctgctctgtgtttagtat

SEQ ID NO: 8328759 - DNA, 22 bp, Homo sapiens
ctcataatgtgactgtatttga

SEQ ID NO: 8328760 - DNA, 22 bp, Homo sapiens
ttggccaaccagaacggaggtc

SEQ ID NO: 8328761 - DNA, 22 bp, Homo sapiens
ttggccaagactcatgtcctat

SEQ ID NO: 8328762 - DNA, 22 bp, Homo sapiens
ttggccaagatacgagcacata

SEQ ID NO: 8328763 - DNA, 22 bp, Homo sapiens
ttggccaaataatcttgcagat

SEQ ID NO: 8328764 - DNA, 22 bp, Homo sapiens
ttggccaaatacacaccttttg

SEQ ID NO: 8328765 - DNA, 20 bp, Homo sapiens
ttggccaaatcttagtcatg

SEQ ID NO: 8328766 - DNA, 22 bp, Homo sapiens
ttggccaacagcgacagggcca

SEQ ID NO: 8328767 - DNA, 22 bp, Homo sapiens
ttggccaacatggtgaaacccc

SEQ ID NO: 8328768 - DNA, 22 bp, Homo sapiens
ttggccaaggaagtagcaacgg

SEQ ID NO: 8328769 - DNA, 22 bp, Homo sapiens
ttggccaaggacctttttggag

SEQ ID NO: 8328770 - DNA, 22 bp, Homo sapiens
ttggccaagggatcgaggttgg

SEQ ID NO: 8328771 - DNA, 22 bp, Homo sapiens
ttggccaagggctctttaggct

SEQ ID NO: 8328772 - DNA, 22 bp, Homo sapiens
ttggccaagggctctttaggct

SEQ ID NO: 8328773 - DNA, 22 bp, Homo sapiens
ttggccaaggtcactgggtgag

SEQ ID NO: 8328774 - DNA, 22 bp, Homo sapiens
ttggccaagtcactggttaatg

SEQ ID NO: 8328775 - DNA, 22 bp, Homo sapiens
ttggccaagtggttaatctcca

SEQ ID NO: 8328776 - DNA, 22 bp, Homo sapiens
ttggccaatcctattgggtggg

SEQ ID NO: 8328777 - DNA, 22 bp, Homo sapiens
ttggccaattccagaggatcat

SEQ ID NO: 8328778 - DNA, 22 bp, Homo sapiens
ttggccaattccagaggatcat

SEQ ID NO: 8328779 - DNA, 22 bp, Homo sapiens
ttggccaatggtgattcccggc

SEQ ID NO: 8328780 - DNA, 22 bp, Homo sapiens
ttggccaatttagaacgtgttg

SEQ ID NO: 8328781 - DNA, 22 bp, Homo sapiens
ttgctttggtagcagctataga

SEQ ID NO: 8328782 - DNA, 22 bp, Homo sapiens
ttgcttttaatctttgtacatc

SEQ ID NO: 8328783 - DNA, 22 bp, Homo sapiens
ttgcttttgtgtgctctctgga

SEQ ID NO: 8328784 - DNA, 22 bp, Homo sapiens
ttgcttttccctgtctctgatt

SEQ ID NO: 8328785 - DNA, 22 bp, Homo sapiens
ttggcatttattctaaggtcaa

SEQ ID NO: 8328786 - DNA, 22 bp, Homo sapiens
ttggccaaaaaagtcattagaa

SEQ ID NO: 8328787 - DNA, 22 bp, Homo sapiens
ttggccaaacagagttcaacag

SEQ ID NO: 8328788 - DNA, 22 bp, Homo sapiens
ttggccaaagctcaccagtgct

SEQ ID NO: 8328789 - DNA, 22 bp, Homo sapiens
ttggccaaaggaaagactactg

SEQ ID NO: 8328790 - DNA, 22 bp, Homo sapiens
ctcagtttccccggcctgggcg

SEQ ID NO: 8328791 - DNA, 20 bp, Homo sapiens
ctcagtttcctcatggctca

SEQ ID NO: 8328792 - DNA, 22 bp, Homo sapiens
ctcagtttctgaagtggacagg

SEQ ID NO: 8328793 - DNA, 22 bp, Homo sapiens
ctcagtttctggataagctggg

SEQ ID NO: 8328794 - DNA, 22 bp, Homo sapiens
ctcagttttcccttgggagcgt

SEQ ID NO: 8328795 - DNA, 22 bp, Homo sapiens
ctcagttttgctagctggagtt

SEQ ID NO: 8328796 - DNA, 22 bp, Homo sapiens
ctcagttttgaaaaggtaagct

SEQ ID NO: 8328797 - DNA, 22 bp, Homo sapiens
ctcagtttttgtgggcatcagc

SEQ ID NO: 8328798 - DNA, 22 bp, Homo sapiens
ctccagtcctagtctcttgctt

SEQ ID NO: 8328799 - DNA, 22 bp, Homo sapiens
ctccagtcatagtctgtcttgt

SEQ ID NO: 8328800 - DNA, 22 bp, Homo sapiens
ctccagtgcacccagaggattt

SEQ ID NO: 8328801 - DNA, 22 bp, Homo sapiens
ctccagtgagtgagcaggcgac

SEQ ID NO: 8328802 - DNA, 22 bp, Homo sapiens
ctccagtgagcgcggggcatgg

SEQ ID NO: 8328803 - DNA, 22 bp, Homo sapiens
ctccagtgagtgagcaggcgac

SEQ ID NO: 8328804 - DNA, 22 bp, Homo sapiens
ctccagtgccctccttgggggc

SEQ ID NO: 8328805 - DNA, 22 bp, Homo sapiens
tttaaaaaactagtctgagtct

SEQ ID NO: 8328806 - DNA, 22 bp, Homo sapiens
tttaaaaaactagtctgagtct

SEQ ID NO: 8328807 - DNA, 22 bp, Homo sapiens
ttgttacacataataacatttt

SEQ ID NO: 8328808 - DNA, 22 bp, Homo sapiens
ttgttacagcacttaacctttt

SEQ ID NO: 8328809 - DNA, 22 bp, Homo sapiens
ttgttaaaatgcatattctggt

SEQ ID NO: 8328810 - DNA, 22 bp, Homo sapiens
ttgttaaaatgaggtcattctg

SEQ ID NO: 8328811 - DNA, 22 bp, Homo sapiens
ttgtatttgattgtcatatcgt

SEQ ID NO: 8328812 - DNA, 22 bp, Homo sapiens
ttgtatttgggtagtatagaga

SEQ ID NO: 8328813 - DNA, 22 bp, Homo sapiens
tttaaaaaactagtctgagtct

SEQ ID NO: 8328814 - DNA, 22 bp, Homo sapiens
tttaaaagttatcatctgtcca

SEQ ID NO: 8328815 - DNA, 22 bp, Homo sapiens
tttaaaaggggtattaagtcca

SEQ ID NO: 8328816 - DNA, 22 bp, Homo sapiens
tttaaaaggcagcttcttttgt

SEQ ID NO: 8328817 - DNA, 22 bp, Homo sapiens
tttaaaaggggtattaagtcca

SEQ ID NO: 8328818 - DNA, 22 bp, Homo sapiens
tttaaatttagaagaaacactg

SEQ ID NO: 8328819 - DNA, 22 bp, Homo sapiens
tttacatttccctctgtcagtt

SEQ ID NO: 8328820 - DNA, 22 bp, Homo sapiens
tttacatggaatattgtcttgt

SEQ ID NO: 8328821 - DNA, 22 bp, Homo sapiens
tttacatgtaatgttatacaaa

SEQ ID NO: 8328822 - DNA, 22 bp, Homo sapiens
tttacatgtccttcaagagcag

SEQ ID NO: 8328823 - DNA, 22 bp, Homo sapiens
tttaacagatgctatgtctacc

SEQ ID NO: 8328824 - DNA, 22 bp, Homo sapiens
tttacagttaagaaatgttacc

SEQ ID NO: 8328825 - DNA, 22 bp, Homo sapiens
tttacatgagtagcagatgttc

SEQ ID NO: 8328826 - DNA, 22 bp, Homo sapiens
ctcctctgggtcctggtggcca

SEQ ID NO: 8328827 - DNA, 22 bp, Homo sapiens
ctcctctggcttcctggaggca

SEQ ID NO: 8328828 - DNA, 22 bp, Homo sapiens
ctcctctgcccaaatttgtata

SEQ ID NO: 8328829 - DNA, 20 bp, Homo sapiens
ctctcctcacccgtgtcagg

SEQ ID NO: 8328830 - DNA, 22 bp, Homo sapiens
ctctcctccaacagccctgccg

SEQ ID NO: 8328831 - DNA, 22 bp, Homo sapiens
ctctcctccaggaactcacagt

SEQ ID NO: 8328832 - DNA, 20 bp, Homo sapiens
ctctcacagctccctcagcc

SEQ ID NO: 8328833 - DNA, 22 bp, Homo sapiens
ctcctgggctgtcggcgctctg

SEQ ID NO: 8328834 - DNA, 22 bp, Homo sapiens
ctcctgggaggatgcggacccg

SEQ ID NO: 8328835 - DNA, 22 bp, Homo sapiens
ttcattctcttagcatagtcct

SEQ ID NO: 8328836 - DNA, 22 bp, Homo sapiens
ttcattcccttatattagcatt

SEQ ID NO: 8328837 - DNA, 21 bp, Homo sapiens
cggctcagtgcctgctccttc

SEQ ID NO: 8328838 - DNA, 22 bp, Homo sapiens
ttcagaaaggataattggaagg

SEQ ID NO: 8328839 - DNA, 22 bp, Homo sapiens
cctgggtggttccggcaaggag

SEQ ID NO: 8328840 - DNA, 22 bp, Homo sapiens
ttcacagtggtagtgcatttag

SEQ ID NO: 8328841 - DNA, 22 bp, Homo sapiens
ttcacataaatagatcacatca

SEQ ID NO: 8328842 - DNA, 22 bp, Homo sapiens
ttcacataaatagatcacatca

SEQ ID NO: 8328843 - DNA, 22 bp, Homo sapiens
cgctgggggaacagcgagggtg

SEQ ID NO: 8328844 - DNA, 22 bp, Homo sapiens
cgctgggggaacagcgagggtg

SEQ ID NO: 8328845 - DNA, 22 bp, Homo sapiens
cgctgggggaacagcgagggtg

SEQ ID NO: 8328846 - DNA, 22 bp, Homo sapiens
ttcacatgttggacatagagga

SEQ ID NO: 8328847 - DNA, 22 bp, Homo sapiens
ttccaaagaagttcacatttac

SEQ ID NO: 8328848 - DNA, 22 bp, Homo sapiens
ttccggaaggttctctagaatt

SEQ ID NO: 8328849 - DNA, 22 bp, Homo sapiens
ttccggacgcccgtcttccagc

SEQ ID NO: 8328850 - DNA, 21 bp, Homo sapiens
ttcccttctggttttgagaga

SEQ ID NO: 8328851 - DNA, 22 bp, Homo sapiens
ttccctttcttaaagagttagg

SEQ ID NO: 8328852 - DNA, 22 bp, Homo sapiens
ttcccttctagttttgagagac

SEQ ID NO: 8328853 - DNA, 22 bp, Homo sapiens
ttccgagtctccaaggggttgt

SEQ ID NO: 8328854 - DNA, 22 bp, Homo sapiens
ttccgaacccggatctgctgct

SEQ ID NO: 8328855 - DNA, 22 bp, Homo sapiens
ttccctttggcagccttctcct

SEQ ID NO: 8328856 - DNA, 22 bp, Homo sapiens
ttcccttttttctagtaggtag

SEQ ID NO: 8328857 - DNA, 22 bp, Homo sapiens
ttccctttgttaaattggaaga

SEQ ID NO: 8328858 - DNA, 22 bp, Homo sapiens
ttcccttaaattatggcatcta

SEQ ID NO: 8328859 - DNA, 22 bp, Homo sapiens
ttcccttaaattatggcatcta

SEQ ID NO: 8328860 - DNA, 22 bp, Homo sapiens
ttcccttcctcactctacttgt

SEQ ID NO: 8328861 - DNA, 22 bp, Homo sapiens
ttcccactgtggcagagcctcg

SEQ ID NO: 8328862 - DNA, 20 bp, Homo sapiens
ctaatattctactctaagga

SEQ ID NO: 8328863 - DNA, 22 bp, Homo sapiens
ctaatatttttagaaatcacga

SEQ ID NO: 8328864 - DNA, 22 bp, Homo sapiens
ctaatttaatgaatgagtctta

SEQ ID NO: 8328865 - DNA, 22 bp, Homo sapiens
ctacaaaagtaattgtggtttt

SEQ ID NO: 8328866 - DNA, 22 bp, Homo sapiens
ctacaaaagtaattgtggtttt

SEQ ID NO: 8328867 - DNA, 22 bp, Homo sapiens
ctacaaatataaaacacagata

SEQ ID NO: 8328868 - DNA, 22 bp, Homo sapiens
ctatttctgcctaatgacctgt

SEQ ID NO: 8328869 - DNA, 22 bp, Homo sapiens
ctatttggatgttagcctcagt

SEQ ID NO: 8328870 - DNA, 22 bp, Homo sapiens
ctatttggggtagaagatggat

SEQ ID NO: 8328871 - DNA, 22 bp, Homo sapiens
ctatttggccaagctgcccaca

SEQ ID NO: 8328872 - DNA, 22 bp, Homo sapiens
ctatttctaaacctataagtga

SEQ ID NO: 8328873 - DNA, 22 bp, Homo sapiens
ctatttattgtgggtatccagg

SEQ ID NO: 8328874 - DNA, 22 bp, Homo sapiens
ttctgtcaaatgccagtagaga

SEQ ID NO: 8328875 - DNA, 22 bp, Homo sapiens
ttctgtcagcgtcagaaattct

SEQ ID NO: 8328876 - DNA, 22 bp, Homo sapiens
ctattttaacttgattacctct

SEQ ID NO: 8328877 - DNA, 22 bp, Homo sapiens
ctattttaacttgattacctct

SEQ ID NO: 8328878 - DNA, 22 bp, Homo sapiens
ctaggctgcacctaggatggct

SEQ ID NO: 8328879 - DNA, 22 bp, Homo sapiens
ttccttttcttaaacatatgtg

SEQ ID NO: 8328880 - DNA, 22 bp, Homo sapiens
ttccttttatttgtccaggctt

SEQ ID NO: 8328881 - DNA, 18 bp, Homo sapiens
ttgataaacaatttcatt

SEQ ID NO: 8328882 - DNA, 22 bp, Homo sapiens
ttgataaaatgatatcttcttt

SEQ ID NO: 8328883 - DNA, 22 bp, Homo sapiens
ttgagctgtatacctatgactg

SEQ ID NO: 8328884 - DNA, 22 bp, Homo sapiens
ttgagaaaagctgtgtaaggat

SEQ ID NO: 8328885 - DNA, 22 bp, Homo sapiens
ttgagaaaatagttcgaatgtt

SEQ ID NO: 8328886 - DNA, 22 bp, Homo sapiens
ctcagcagtatactctgaagat

SEQ ID NO: 8328887 - DNA, 22 bp, Homo sapiens
ttgactgtgaatctaagttact

SEQ ID NO: 8328888 - DNA, 22 bp, Homo sapiens
ttcttgtatataaaaatcattt

SEQ ID NO: 8328889 - DNA, 22 bp, Homo sapiens
ttcttgtatgtatgcaaaatca

SEQ ID NO: 8328890 - DNA, 22 bp, Homo sapiens
ctattttaagaggccattaggt

SEQ ID NO: 8328891 - DNA, 22 bp, Homo sapiens
ctattttaagaggccattaggt

SEQ ID NO: 8328892 - DNA, 22 bp, Homo sapiens
ctctgggcaaagatgcctcatc

SEQ ID NO: 8328893 - DNA, 23 bp, Homo sapiens
ttttattgatatgtagctgttgt

SEQ ID NO: 8328894 - DNA, 22 bp, Homo sapiens
ctctggcttctaccttgcagtt

SEQ ID NO: 8328895 - DNA, 22 bp, Homo sapiens
ctctggcttagtatgctccaaa

SEQ ID NO: 8328896 - DNA, 22 bp, Homo sapiens
ctctggctggcattgctggact

SEQ ID NO: 8328897 - DNA, 22 bp, Homo sapiens
ctctggctgcctctcaggcctg

SEQ ID NO: 8328898 - DNA, 22 bp, Homo sapiens
tttgtcttgtgtccttaggacc

SEQ ID NO: 8328899 - DNA, 22 bp, Homo sapiens
tttgtcttgaggctggggaagt

SEQ ID NO: 8328900 - DNA, 22 bp, Homo sapiens
tttgtcttggcctcagttttct

SEQ ID NO: 8328901 - DNA, 22 bp, Homo sapiens
ctctcctcccatgtaggagatg

SEQ ID NO: 8328902 - DNA, 22 bp, Homo sapiens
ctctcctctgaagtggtgaccc

SEQ ID NO: 8328903 - DNA, 22 bp, Homo sapiens
ctgagaaattctttctttcact

SEQ ID NO: 8328904 - DNA, 22 bp, Homo sapiens
ctgagaaatacccaagtctggt

SEQ ID NO: 8328905 - DNA, 22 bp, Homo sapiens
ctgagaaagtgagggttaaaca

SEQ ID NO: 8328906 - DNA, 22 bp, Homo sapiens
ctgagaaatacccaagtctggt

SEQ ID NO: 8328907 - DNA, 22 bp, Homo sapiens
tttttaatgcagtctgagacat

SEQ ID NO: 8328908 - DNA, 22 bp, Homo sapiens
ctgaagaagtctctaggctatt

SEQ ID NO: 8328909 - DNA, 22 bp, Homo sapiens
ctgaagagactggagggggcat

SEQ ID NO: 8328910 - DNA, 22 bp, Homo sapiens
ctgaagagaaagggagctcttc

SEQ ID NO: 8328911 - DNA, 20 bp, Homo sapiens
ctgaagagactggaggggca

SEQ ID NO: 8328912 - DNA, 22 bp, Homo sapiens
ctctttggcccccgatgattca

SEQ ID NO: 8328913 - DNA, 22 bp, Homo sapiens
ctctttgtatttctttgggcca

SEQ ID NO: 8328914 - DNA, 21 bp, Homo sapiens
ttttattgatgaatggccact

SEQ ID NO: 8328915 - DNA, 22 bp, Homo sapiens
tttttaagagtctggaaatagt

SEQ ID NO: 8328916 - DNA, 22 bp, Homo sapiens
ttttgttttcttagaaacctgg

SEQ ID NO: 8328917 - DNA, 22 bp, Homo sapiens
ctgagacccagacacctgagga

SEQ ID NO: 8328918 - DNA, 22 bp, Homo sapiens
ctgagacacggagaggctgtgt

SEQ ID NO: 8328919 - DNA, 22 bp, Homo sapiens
ctgagacacggagaggctgtgt

SEQ ID NO: 8328920 - DNA, 22 bp, Homo sapiens
ctgagacatggtttgactggca

SEQ ID NO: 8328921 - DNA, 22 bp, Homo sapiens
ctgagacaggagaatggcgtga

SEQ ID NO: 8328922 - DNA, 22 bp, Homo sapiens
ctgagacaggagaatggcgtga

SEQ ID NO: 8328923 - DNA, 22 bp, Homo sapiens
ctgagacacagtggctgaaaag

SEQ ID NO: 8328924 - DNA, 17 bp, Homo sapiens
ctgatttattagcagac

SEQ ID NO: 8328925 - DNA, 22 bp, Homo sapiens
ctgatttacatatacaaaagat

SEQ ID NO: 8328926 - DNA, 22 bp, Homo sapiens
ctgatttagatttcacacgtga

SEQ ID NO: 8328927 - DNA, 22 bp, Homo sapiens
ctgcagagcatgaggaggtctg

SEQ ID NO: 8328928 - DNA, 22 bp, Homo sapiens
ctgcagaatggggccaagtgga

SEQ ID NO: 8328929 - DNA, 22 bp, Homo sapiens
ctgatgcccctggacctgtgac

SEQ ID NO: 8328930 - DNA, 22 bp, Homo sapiens
ctgatgcttgcaacaaagaacc

SEQ ID NO: 8328931 - DNA, 22 bp, Homo sapiens
ctgattaactgaactgaattta

SEQ ID NO: 8328932 - DNA, 22 bp, Homo sapiens
ctgatgagtcggctgccaccag

SEQ ID NO: 8328933 - DNA, 22 bp, Homo sapiens
ctgcctcctcacgtccacagtg

SEQ ID NO: 8328934 - DNA, 20 bp, Homo sapiens
ctgccatgattgatagagtg

SEQ ID NO: 8328935 - DNA, 22 bp, Homo sapiens
ctgccatcctcaccagagcagc

SEQ ID NO: 8328936 - DNA, 22 bp, Homo sapiens
ctgccaggtgagctccaggcct

SEQ ID NO: 8328937 - DNA, 22 bp, Homo sapiens
ctgccatgccactgtgactgca

SEQ ID NO: 8328938 - DNA, 22 bp, Homo sapiens
ctgcagaggggttgaagggtcc

SEQ ID NO: 8328939 - DNA, 22 bp, Homo sapiens
ctgcagaggcctcgcctcctct

SEQ ID NO: 8328940 - DNA, 22 bp, Homo sapiens
ctgcagagctaggctgagtgaa

SEQ ID NO: 8328941 - DNA, 22 bp, Homo sapiens
ctgcagccacgagtcacagccc

SEQ ID NO: 8328942 - DNA, 22 bp, Homo sapiens
ctgccagctctctggaggctct

SEQ ID NO: 8328943 - DNA, 22 bp, Homo sapiens
ctgccagctctctggaggctct

SEQ ID NO: 8328944 - DNA, 22 bp, Homo sapiens
ctgccagctggagaccaaggaa

SEQ ID NO: 8328945 - DNA, 22 bp, Homo sapiens
ctgccaggcctccgctgtcccc

SEQ ID NO: 8328946 - DNA, 22 bp, Homo sapiens
ctgccagctctctggaggctct

SEQ ID NO: 8328947 - DNA, 22 bp, Homo sapiens
ctgccagggccctactcagttt

SEQ ID NO: 8328948 - DNA, 22 bp, Homo sapiens
ctggagctcttctgagtgtgct

SEQ ID NO: 8328949 - DNA, 22 bp, Homo sapiens
ctggaggaataatggcatcttg

SEQ ID NO: 8328950 - DNA, 22 bp, Homo sapiens
ctggacagtgggcagaggagac

SEQ ID NO: 8328951 - DNA, 22 bp, Homo sapiens
ctggaggctgagttgggtctcc

SEQ ID NO: 8328952 - DNA, 22 bp, Homo sapiens
ctggagggacaaggtatgcatt

SEQ ID NO: 8328953 - DNA, 22 bp, Homo sapiens
ctggaggctggcttcccctggc

SEQ ID NO: 8328954 - DNA, 21 bp, Homo sapiens
ctggaggcaggtggtgccagg

SEQ ID NO: 8328955 - DNA, 22 bp, Homo sapiens
ctggaggcagttgccccagtca

SEQ ID NO: 8328956 - DNA, 22 bp, Homo sapiens
ctggaggcacccttagagaggc

SEQ ID NO: 8328957 - DNA, 21 bp, Homo sapiens
ctggagggtagagttgggctg

SEQ ID NO: 8328958 - DNA, 21 bp, Homo sapiens
ctggagggtagagttgggctg

SEQ ID NO: 8328959 - DNA, 21 bp, Homo sapiens
ctggagggtagagttgggctg

SEQ ID NO: 8328960 - DNA, 22 bp, Homo sapiens
ctggagggggaaatgttcattg

SEQ ID NO: 8328961 - DNA, 22 bp, Homo sapiens
ctggagggggaaatgttcattg

SEQ ID NO: 8328962 - DNA, 22 bp, Homo sapiens
ctggagggggaaatgttcattg

SEQ ID NO: 8328963 - DNA, 19 bp, Homo sapiens
ctggaggtagagggttagt

SEQ ID NO: 8328964 - DNA, 22 bp, Homo sapiens
ctggagggtgagcctcatctct

SEQ ID NO: 8328965 - DNA, 22 bp, Homo sapiens
ctggaggtctacagtggtagct

SEQ ID NO: 8328966 - DNA, 22 bp, Homo sapiens
ctggaggggctggcatggtagc

SEQ ID NO: 8328967 - DNA, 22 bp, Homo sapiens
ctggaggggccatccacagtct

SEQ ID NO: 8328968 - DNA, 22 bp, Homo sapiens
ctggagggcttctgcaggttac

SEQ ID NO: 8328969 - DNA, 22 bp, Homo sapiens
ctggagggcttctgcaggttac

SEQ ID NO: 8328970 - DNA, 22 bp, Homo sapiens
ctggagggactttctcacggat

SEQ ID NO: 8328971 - DNA, 22 bp, Homo sapiens
ctggagggacaaggtatgcatt

SEQ ID NO: 8328972 - DNA, 22 bp, Homo sapiens
ctggagggactttctcacggat

SEQ ID NO: 8328973 - DNA, 22 bp, Homo sapiens
ctggagggctggactaaggaaa

SEQ ID NO: 8328974 - DNA, 22 bp, Homo sapiens
ctggagggctggactaaggaaa

SEQ ID NO: 8328975 - DNA, 22 bp, Homo sapiens
ctggagtcactcatgtagctgc

SEQ ID NO: 8328976 - DNA, 18 bp, Homo sapiens
ctggagtcacagtgggga

SEQ ID NO: 8328977 - DNA, 18 bp, Homo sapiens
ctggagtcacagtgggga

SEQ ID NO: 8328978 - DNA, 21 bp, Homo sapiens
ctggagtcattttctgagtag

SEQ ID NO: 8328979 - DNA, 22 bp, Homo sapiens
ctggagttgggatgtgcctgga

SEQ ID NO: 8328980 - DNA, 22 bp, Homo sapiens
ctggagtctcttctgtagctac

SEQ ID NO: 8328981 - DNA, 22 bp, Homo sapiens
ctgcttttgagcccagtgctca

SEQ ID NO: 8328982 - DNA, 22 bp, Homo sapiens
ctgctttttgtaggtcccagag

SEQ ID NO: 8328983 - DNA, 22 bp, Homo sapiens
ctgctttgaaaataaacttgtc

SEQ ID NO: 8328984 - DNA, 22 bp, Homo sapiens
ctgctttgtggaatcacactgg

SEQ ID NO: 8328985 - DNA, 22 bp, Homo sapiens
ctggacaggaagaattgggagc

SEQ ID NO: 8328986 - DNA, 22 bp, Homo sapiens
ctggacaaaggactcacaggat

SEQ ID NO: 8328987 - DNA, 17 bp, Homo sapiens
ctgcctggagtcccatc

SEQ ID NO: 8328988 - DNA, 22 bp, Homo sapiens
ctgcctggcatagtctggtcga

SEQ ID NO: 8328989 - DNA, 22 bp, Homo sapiens
ctgcctggccacaacccagggt

SEQ ID NO: 8328990 - DNA, 22 bp, Homo sapiens
ctgcctgctacctgaaatgcca

SEQ ID NO: 8328991 - DNA, 22 bp, Homo sapiens
ctgcctggcccagggatgggcc

SEQ ID NO: 8328992 - DNA, 22 bp, Homo sapiens
ctgcctggcccagggatgggcc

SEQ ID NO: 8328993 - DNA, 22 bp, Homo sapiens
ctgcctggcccagggatgggcc

SEQ ID NO: 8328994 - DNA, 23 bp, Homo sapiens
ctggctccgaagactccaggatc

SEQ ID NO: 8328995 - DNA, 22 bp, Homo sapiens
ctggctccaccccaggaggatg

SEQ ID NO: 8328996 - DNA, 22 bp, Homo sapiens
ctggccagttgccttcctgggt

SEQ ID NO: 8328997 - DNA, 22 bp, Homo sapiens
ctggcccagagagcagagctta

SEQ ID NO: 8328998 - DNA, 21 bp, Homo sapiens
ctggcccagggatctgcattt

SEQ ID NO: 8328999 - DNA, 23 bp, Homo sapiens
ctggcccaggtgagaggttggtg

SEQ ID NO: 8329000 - DNA, 22 bp, Homo sapiens
ctggcccaggctcctggggcac

SEQ ID NO: 8329001 - DNA, 20 bp, Homo sapiens
ctggcccaggatgatggcgc

SEQ ID NO: 8329002 - DNA, 22 bp, Homo sapiens
ctggcccaggagagcaggcatt

SEQ ID NO: 8329003 - DNA, 22 bp, Homo sapiens
ctggcccaggaagacgtgtccc

SEQ ID NO: 8329004 - DNA, 22 bp, Homo sapiens
ctggcccagagctctggccttt

SEQ ID NO: 8329005 - DNA, 22 bp, Homo sapiens
ctggcctggcagggagggcatg

SEQ ID NO: 8329006 - DNA, 22 bp, Homo sapiens
ctggcctggcagggagggcatg

SEQ ID NO: 8329007 - DNA, 22 bp, Homo sapiens
ctggcctgctgggtgaggtcct

SEQ ID NO: 8329008 - DNA, 22 bp, Homo sapiens
ctggatgcaactgcttctctca

SEQ ID NO: 8329009 - DNA, 22 bp, Homo sapiens
ctggatggtcccatgagcagct

SEQ ID NO: 8329010 - DNA, 22 bp, Homo sapiens
ctggatggaaggaggatagtat

SEQ ID NO: 8329011 - DNA, 22 bp, Homo sapiens
ctggatggtcccatgagcagct

SEQ ID NO: 8329012 - DNA, 22 bp, Homo sapiens
ctggattctttcataaaagtca

SEQ ID NO: 8329013 - DNA, 22 bp, Homo sapiens
ctggcagcattaacagagagca

SEQ ID NO: 8329014 - DNA, 22 bp, Homo sapiens
ctggcagggctctttgggtgct

SEQ ID NO: 8329015 - DNA, 22 bp, Homo sapiens
ctggcagtgacattgcaggtgc

SEQ ID NO: 8329016 - DNA, 22 bp, Homo sapiens
ctggcagtctggtggaaggcct

SEQ ID NO: 8329017 - DNA, 22 bp, Homo sapiens
ctggcagttggcagggctgcca

SEQ ID NO: 8329018 - DNA, 22 bp, Homo sapiens
ctggcagtgtccagctcgtgat

SEQ ID NO: 8329019 - DNA, 22 bp, Homo sapiens
ctggcagtttgccaggagctcg

SEQ ID NO: 8329020 - DNA, 22 bp, Homo sapiens
ctggccagtgcctgtgggcccc

SEQ ID NO: 8329021 - DNA, 22 bp, Homo sapiens
ctggccaggcggcccctgcatg

SEQ ID NO: 8329022 - DNA, 22 bp, Homo sapiens
ctggccacaactagcccaggac

SEQ ID NO: 8329023 - DNA, 22 bp, Homo sapiens
ctggccaatgcctggggaatag

SEQ ID NO: 8329024 - DNA, 22 bp, Homo sapiens
ctggccaatccattaatttgtt

SEQ ID NO: 8329025 - DNA, 22 bp, Homo sapiens
ctggccaatatagggaaatctt

SEQ ID NO: 8329026 - DNA, 22 bp, Homo sapiens
ctggccaagcttctctaagcag

SEQ ID NO: 8329027 - DNA, 22 bp, Homo sapiens
ctggccaagatggtgaaacccc

SEQ ID NO: 8329028 - DNA, 22 bp, Homo sapiens
ctggccaacttgcttgttggca

SEQ ID NO: 8329029 - DNA, 22 bp, Homo sapiens
ctggccaagcactggggtcaaa

SEQ ID NO: 8329030 - DNA, 22 bp, Homo sapiens
ctggccaagcactggggtcaaa

SEQ ID NO: 8329031 - DNA, 22 bp, Homo sapiens
ctggccaacatctggggcacat

SEQ ID NO: 8329032 - DNA, 22 bp, Homo sapiens
ctggccaacatctggggcacat

SEQ ID NO: 8329033 - DNA, 22 bp, Homo sapiens
ctggcatgtgtttggctcctgt

SEQ ID NO: 8329034 - DNA, 22 bp, Homo sapiens
ctggcatgccttgggtgcctct

SEQ ID NO: 8329035 - DNA, 22 bp, Homo sapiens
tgtctcagtatacgaaacactt

SEQ ID NO: 8329036 - DNA, 22 bp, Homo sapiens
tgtctcaggtacatgcgtcctg

SEQ ID NO: 8329037 - DNA, 19 bp, Homo sapiens
tgtctcagtgtcccttcct

SEQ ID NO: 8329038 - DNA, 18 bp, Homo sapiens
tgtctcaggctgaaacag

SEQ ID NO: 8329039 - DNA, 22 bp, Homo sapiens
tgtctcagagtatccctgaact

SEQ ID NO: 8329040 - DNA, 22 bp, Homo sapiens
tgtctcagaggcaggaagagcc

SEQ ID NO: 8329041 - DNA, 21 bp, Homo sapiens
tgtctcaatcagaagtcatta

SEQ ID NO: 8329042 - DNA, 22 bp, Homo sapiens
tgtcctgcaattaaggaagaca

SEQ ID NO: 8329043 - DNA, 22 bp, Homo sapiens
tgtcctggaaaaatggagagtt

SEQ ID NO: 8329044 - DNA, 19 bp, Homo sapiens
cctggccctgctgcgcggg

SEQ ID NO: 8329045 - DNA, 22 bp, Homo sapiens
cctggccgcggagcccttccag

SEQ ID NO: 8329046 - DNA, 22 bp, Homo sapiens
cctggccggtatcccacctcct

SEQ ID NO: 8329047 - DNA, 22 bp, Homo sapiens
cctggctccagctgcctgtcct

SEQ ID NO: 8329048 - DNA, 22 bp, Homo sapiens
cctggctcctgcctctgcaggg

SEQ ID NO: 8329049 - DNA, 22 bp, Homo sapiens
cctggctcctgcacagatcttt

SEQ ID NO: 8329050 - DNA, 22 bp, Homo sapiens
cctggctccctgcacagggctc

SEQ ID NO: 8329051 - DNA, 22 bp, Homo sapiens
cctggctctagaggccactcct

SEQ ID NO: 8329052 - DNA, 22 bp, Homo sapiens
cctggctctgaagtccacatca

SEQ ID NO: 8329053 - DNA, 22 bp, Homo sapiens
cctggctcgctgacctcagggg

SEQ ID NO: 8329054 - DNA, 22 bp, Homo sapiens
cctggctctagaggccactcct

SEQ ID NO: 8329055 - DNA, 22 bp, Homo sapiens
cctggccaggctccaagtactg

SEQ ID NO: 8329056 - DNA, 22 bp, Homo sapiens
cctggccagtttccaggccctg

SEQ ID NO: 8329057 - DNA, 22 bp, Homo sapiens
cctggccagtttccaggccctg

SEQ ID NO: 8329058 - DNA, 22 bp, Homo sapiens
cctggccatagggcccaggaaa

SEQ ID NO: 8329059 - DNA, 22 bp, Homo sapiens
tgtcccagacataagtggacat

SEQ ID NO: 8329060 - DNA, 19 bp, Homo sapiens
tgtcccagactccgtgtct

SEQ ID NO: 8329061 - DNA, 22 bp, Homo sapiens
tgtcccagcactttgggagtct

SEQ ID NO: 8329062 - DNA, 22 bp, Homo sapiens
tgtcctcaggacctggcacagt

SEQ ID NO: 8329063 - DNA, 22 bp, Homo sapiens
tgtcctccagcagcatggtatg

SEQ ID NO: 8329064 - DNA, 22 bp, Homo sapiens
tgtccataaattcacaagtgta

SEQ ID NO: 8329065 - DNA, 22 bp, Homo sapiens
tgtcatggacagattagatgag

SEQ ID NO: 8329066 - DNA, 22 bp, Homo sapiens
tgtcatggagcttatattccag

SEQ ID NO: 8329067 - DNA, 22 bp, Homo sapiens
tgtcatggactggatttctgct

SEQ ID NO: 8329068 - DNA, 22 bp, Homo sapiens
tgtcatggcgttgtggggacta

SEQ ID NO: 8329069 - DNA, 22 bp, Homo sapiens
tgtcatggcactggtaggagtg

SEQ ID NO: 8329070 - DNA, 22 bp, Homo sapiens
tgtcatggcactagagtggggt

SEQ ID NO: 8329071 - DNA, 22 bp, Homo sapiens
tgtcatggaggcctcccctaaa

SEQ ID NO: 8329072 - DNA, 17 bp, Homo sapiens
tgtcatggctatggttg

SEQ ID NO: 8329073 - DNA, 22 bp, Homo sapiens
tgtcatggggaaaataacagac

SEQ ID NO: 8329074 - DNA, 22 bp, Homo sapiens
tgtcatgggcatttattgaggg

SEQ ID NO: 8329075 - DNA, 22 bp, Homo sapiens
tgtcatggctgaaagtgggggc

SEQ ID NO: 8329076 - DNA, 22 bp, Homo sapiens
tgtcatggtgctatttaattag

SEQ ID NO: 8329077 - DNA, 22 bp, Homo sapiens
tgtcatggtctgtaaggagccc

SEQ ID NO: 8329078 - DNA, 22 bp, Homo sapiens
tgtcatggtatttgtgagctgc

SEQ ID NO: 8329079 - DNA, 22 bp, Homo sapiens
tgtcatggggttgttttgtaca

SEQ ID NO: 8329080 - DNA, 22 bp, Homo sapiens
tgtcatgggtctaaacattgat

SEQ ID NO: 8329081 - DNA, 22 bp, Homo sapiens
tgtcatggtagctgaaggatgt

SEQ ID NO: 8329082 - DNA, 20 bp, Homo sapiens
tgtattacttggtcttacaa

SEQ ID NO: 8329083 - DNA, 23 bp, Homo sapiens
tgtattacagatgcatcagtgat

SEQ ID NO: 8329084 - DNA, 22 bp, Homo sapiens
tgtattaacattaataaaatgg

SEQ ID NO: 8329085 - DNA, 22 bp, Homo sapiens
tgtattaacattaataaaatgg

SEQ ID NO: 8329086 - DNA, 22 bp, Homo sapiens
tgtcaggacattttatgaatca

SEQ ID NO: 8329087 - DNA, 22 bp, Homo sapiens
tgtattatcaagtaaatacatg

SEQ ID NO: 8329088 - DNA, 22 bp, Homo sapiens
cctggcacatagcaacccctcc

SEQ ID NO: 8329089 - DNA, 22 bp, Homo sapiens
cctggcacatagtgggcatgca

SEQ ID NO: 8329090 - DNA, 22 bp, Homo sapiens
cctggcacatagcaacccctcc

SEQ ID NO: 8329091 - DNA, 22 bp, Homo sapiens
tgtagtaagtgcgcaataaata

SEQ ID NO: 8329092 - DNA, 22 bp, Homo sapiens
tgtagtgtagcagggtgggaca

SEQ ID NO: 8329093 - DNA, 22 bp, Homo sapiens
tgtagtgtggcctatctttgcc

SEQ ID NO: 8329094 - DNA, 22 bp, Homo sapiens
tgtagtgtgacataggtgtcca

SEQ ID NO: 8329095 - DNA, 22 bp, Homo sapiens
tgtataaaccatggacagcttt

SEQ ID NO: 8329096 - DNA, 22 bp, Homo sapiens
tgtaggtaagttcgtagatttg

SEQ ID NO: 8329097 - DNA, 22 bp, Homo sapiens
tgtagggactgaggctggagag

SEQ ID NO: 8329098 - DNA, 22 bp, Homo sapiens
tggtctttgagagaagttgatt

SEQ ID NO: 8329099 - DNA, 22 bp, Homo sapiens
tggtcttgtactatgttgcatt

SEQ ID NO: 8329100 - DNA, 17 bp, Homo sapiens
cctgcccagagacagat

SEQ ID NO: 8329101 - DNA, 22 bp, Homo sapiens
cctgccagtgcctcccactggt

SEQ ID NO: 8329102 - DNA, 22 bp, Homo sapiens
cctgcccactccaggagcaact

SEQ ID NO: 8329103 - DNA, 22 bp, Homo sapiens
cctgcccacagagagggtgcat

SEQ ID NO: 8329104 - DNA, 22 bp, Homo sapiens
tggtcccattgttctgcccagg

SEQ ID NO: 8329105 - DNA, 22 bp, Homo sapiens
tggtccagtcgttcctttcctt

SEQ ID NO: 8329106 - DNA, 22 bp, Homo sapiens
tggtccagtaagggtggagaga

SEQ ID NO: 8329107 - DNA, 18 bp, Homo sapiens
tggtccagttcagatata

SEQ ID NO: 8329108 - DNA, 17 bp, Homo sapiens
tggtccaggtggagcca

SEQ ID NO: 8329109 - DNA, 22 bp, Homo sapiens
cctctgtgcctcgtgtcctctg

SEQ ID NO: 8329110 - DNA, 21 bp, Homo sapiens
cctctgtgctaaagggctccc

SEQ ID NO: 8329111 - DNA, 22 bp, Homo sapiens
tggtgctgtggaggggcagaag

SEQ ID NO: 8329112 - DNA, 22 bp, Homo sapiens
tggtgctgcctcagatgcctta

SEQ ID NO: 8329113 - DNA, 22 bp, Homo sapiens
tggtgctgcaggtgggcacagt

SEQ ID NO: 8329114 - DNA, 22 bp, Homo sapiens
tggtggctaccaggtcctgggg

SEQ ID NO: 8329115 - DNA, 17 bp, Homo sapiens
tggtggctggagtcagg

SEQ ID NO: 8329116 - DNA, 17 bp, Homo sapiens
tggtggctggagtcagg

SEQ ID NO: 8329117 - DNA, 22 bp, Homo sapiens
tggtggctgctccctgccttga

SEQ ID NO: 8329118 - DNA, 22 bp, Homo sapiens
tgtaaacagtaggactaaagag

SEQ ID NO: 8329119 - DNA, 22 bp, Homo sapiens
cctggagacgaggctggaccat

SEQ ID NO: 8329120 - DNA, 22 bp, Homo sapiens
tgtgaagagagtaataaagtca

SEQ ID NO: 8329121 - DNA, 22 bp, Homo sapiens
tgtctttggaatatttagctga

SEQ ID NO: 8329122 - DNA, 22 bp, Homo sapiens
tgtgaggcctagacagcctggg

SEQ ID NO: 8329123 - DNA, 22 bp, Homo sapiens
cctggctgacagcttaattcca

SEQ ID NO: 8329124 - DNA, 23 bp, Homo sapiens
cctggctgacctgaaggtgtagt

SEQ ID NO: 8329125 - DNA, 22 bp, Homo sapiens
cctggctgaacaaagtccctcc

SEQ ID NO: 8329126 - DNA, 22 bp, Homo sapiens
cctggctcttcagaggttccta

SEQ ID NO: 8329127 - DNA, 19 bp, Homo sapiens
cctggctctgagcccagcc

SEQ ID NO: 8329128 - DNA, 22 bp, Homo sapiens
cctggctgagggacctcgggta

SEQ ID NO: 8329129 - DNA, 22 bp, Homo sapiens
cctggctgagcctccaggaaga

SEQ ID NO: 8329130 - DNA, 22 bp, Homo sapiens
cctggctgaggggccaaggacc

SEQ ID NO: 8329131 - DNA, 22 bp, Homo sapiens
cctggctgcattttgctggatg

SEQ ID NO: 8329132 - DNA, 22 bp, Homo sapiens
cctggctgccttgtgttgatct

SEQ ID NO: 8329133 - DNA, 22 bp, Homo sapiens
cctggctgccgagtgtgcagcg

SEQ ID NO: 8329134 - DNA, 22 bp, Homo sapiens
cctggctgtgcattgccggccc

SEQ ID NO: 8329135 - DNA, 22 bp, Homo sapiens
cctggctgtgcatgtttctatg

SEQ ID NO: 8329136 - DNA, 22 bp, Homo sapiens
cctggctgctatagcagcatgt

SEQ ID NO: 8329137 - DNA, 22 bp, Homo sapiens
cctggctgtggcggtgctctca

SEQ ID NO: 8329138 - DNA, 22 bp, Homo sapiens
cctggctgtggcggtgctctca

SEQ ID NO: 8329139 - DNA, 22 bp, Homo sapiens
cctggctgtttgagcggggaat

SEQ ID NO: 8329140 - DNA, 22 bp, Homo sapiens
tgtgctgggaaatggcaggata

SEQ ID NO: 8329141 - DNA, 22 bp, Homo sapiens
tgtgctggggtccagctgagcc

SEQ ID NO: 8329142 - DNA, 22 bp, Homo sapiens
tgtgctggtacatgtgaggatg

SEQ ID NO: 8329143 - DNA, 22 bp, Homo sapiens
tgtgcccatccctctggagtgt

SEQ ID NO: 8329144 - DNA, 22 bp, Homo sapiens
tgtgcccagactgcctcagtga

SEQ ID NO: 8329145 - DNA, 20 bp, Homo sapiens
tgtgcccagcagaggctgcc

SEQ ID NO: 8329146 - DNA, 21 bp, Homo sapiens
tgtgccagggatggggagccc

SEQ ID NO: 8329147 - DNA, 22 bp, Homo sapiens
tgtgccagcctctggctgtgtc

SEQ ID NO: 8329148 - DNA, 22 bp, Homo sapiens
cctgggagagtctgtggtctcc

SEQ ID NO: 8329149 - DNA, 19 bp, Homo sapiens
cctgggaggcggaggttgc

SEQ ID NO: 8329150 - DNA, 22 bp, Homo sapiens
cctgggcctcacccagctcttg

SEQ ID NO: 8329151 - DNA, 22 bp, Homo sapiens
tgtggggctgtcaggcaactgg

SEQ ID NO: 8329152 - DNA, 22 bp, Homo sapiens
cctggggaaaagcaggcattta

SEQ ID NO: 8329153 - DNA, 22 bp, Homo sapiens
cctggggaatcttgcaggggaa

SEQ ID NO: 8329154 - DNA, 22 bp, Homo sapiens
cctggggaatcttgcaggggaa

SEQ ID NO: 8329155 - DNA, 20 bp, Homo sapiens
cctgggctcaaagcatcctc

SEQ ID NO: 8329156 - DNA, 23 bp, Homo sapiens
tggccaggcataaaggtgggtgg

SEQ ID NO: 8329157 - DNA, 22 bp, Homo sapiens
cctaggctggctgtcttcaggt

SEQ ID NO: 8329158 - DNA, 22 bp, Homo sapiens
tggcacaggagcactgccctgg

SEQ ID NO: 8329159 - DNA, 22 bp, Homo sapiens
tggcacaggatctcagcggcca

SEQ ID NO: 8329160 - DNA, 22 bp, Homo sapiens
tggagctgagaagtggagctct

SEQ ID NO: 8329161 - DNA, 22 bp, Homo sapiens
tggagctgagagccaggctggc

SEQ ID NO: 8329162 - DNA, 22 bp, Homo sapiens
ccctggagctagtctgagcaga

SEQ ID NO: 8329163 - DNA, 22 bp, Homo sapiens
ccctggagatcgggagaggaag

SEQ ID NO: 8329164 - DNA, 22 bp, Homo sapiens
ccctggagatcgggagaggaag

SEQ ID NO: 8329165 - DNA, 22 bp, Homo sapiens
ccctggagcatctctgctgtct

SEQ ID NO: 8329166 - DNA, 20 bp, Homo sapiens
ccctggagagaagctccacg

SEQ ID NO: 8329167 - DNA, 22 bp, Homo sapiens
ccctggagaaggggacgcggag

SEQ ID NO: 8329168 - DNA, 22 bp, Homo sapiens
ccctccaccaagcagggcgcca

SEQ ID NO: 8329169 - DNA, 22 bp, Homo sapiens
ccctggcctacaggcccagaga

SEQ ID NO: 8329170 - DNA, 18 bp, Homo sapiens
tggagctgagggcaatgc

SEQ ID NO: 8329171 - DNA, 23 bp, Homo sapiens
ccctggccttggggcacaggctg

SEQ ID NO: 8329172 - DNA, 17 bp, Homo sapiens
ccctggctctaggtgga

SEQ ID NO: 8329173 - DNA, 22 bp, Homo sapiens
ccctggctctgcctcagagccc

SEQ ID NO: 8329174 - DNA, 22 bp, Homo sapiens
tggatctggttccctgagcctt

SEQ ID NO: 8329175 - DNA, 22 bp, Homo sapiens
cctctctgtgtggcctctccat

SEQ ID NO: 8329176 - DNA, 22 bp, Homo sapiens
cctctctgtcacaccagtggcc

SEQ ID NO: 8329177 - DNA, 22 bp, Homo sapiens
cctctctgtaagggtccctccc

SEQ ID NO: 8329178 - DNA, 20 bp, Homo sapiens
cctctctgccctgcaaggcc

SEQ ID NO: 8329179 - DNA, 22 bp, Homo sapiens
cctctctgtagcagcccccagt

SEQ ID NO: 8329180 - DNA, 20 bp, Homo sapiens
cctctctgaagaggtcatct

SEQ ID NO: 8329181 - DNA, 20 bp, Homo sapiens
cctctctgcatgctccctga

SEQ ID NO: 8329182 - DNA, 22 bp, Homo sapiens
cctctcccgggtgccgctgggc

SEQ ID NO: 8329183 - DNA, 22 bp, Homo sapiens
cctctctcttgtagtccctgcc

SEQ ID NO: 8329184 - DNA, 22 bp, Homo sapiens
cctctaaattgtttgaagttgg

SEQ ID NO: 8329185 - DNA, 23 bp, Homo sapiens
cctctaataaacttgaccttgtg

SEQ ID NO: 8329186 - DNA, 22 bp, Homo sapiens
tggctgcctagtccctcagcct

SEQ ID NO: 8329187 - DNA, 22 bp, Homo sapiens
tggctgcctgatcgagcaggtg

SEQ ID NO: 8329188 - DNA, 22 bp, Homo sapiens
cctctgactccacacttgaact

SEQ ID NO: 8329189 - DNA, 22 bp, Homo sapiens
cctctgacttctctttattggc

SEQ ID NO: 8329190 - DNA, 22 bp, Homo sapiens
tggcccgacctctgctcatgca

SEQ ID NO: 8329191 - DNA, 22 bp, Homo sapiens
tggccctgctatgatcctgcaa

SEQ ID NO: 8329192 - DNA, 22 bp, Homo sapiens
tggccccattttacagatgaaa

SEQ ID NO: 8329193 - DNA, 20 bp, Homo sapiens
tggcccagtggggcagggtg

SEQ ID NO: 8329194 - DNA, 20 bp, Homo sapiens
tggcccagtggggcagggtg

SEQ ID NO: 8329195 - DNA, 22 bp, Homo sapiens
tggcccagtgcttatgctctga

SEQ ID NO: 8329196 - DNA, 22 bp, Homo sapiens
tggcccagtgcttatgctctga

SEQ ID NO: 8329197 - DNA, 22 bp, Homo sapiens
tggctcagtttctgcccagctg

SEQ ID NO: 8329198 - DNA, 22 bp, Homo sapiens
tggctcagtttgggggattgaa

SEQ ID NO: 8329199 - DNA, 22 bp, Homo sapiens
cctccagcgcgatccactccgg

SEQ ID NO: 8329200 - DNA, 22 bp, Homo sapiens
cctccagccttcctgaagagcc

SEQ ID NO: 8329201 - DNA, 22 bp, Homo sapiens
tggctgaggtctggggcttctg

SEQ ID NO: 8329202 - DNA, 22 bp, Homo sapiens
cctccctgggtgctgggattgc

SEQ ID NO: 8329203 - DNA, 22 bp, Homo sapiens
cctcctctgggaagattcagag

SEQ ID NO: 8329204 - DNA, 22 bp, Homo sapiens
cccccatccatgtcaggagagg

SEQ ID NO: 8329205 - DNA, 22 bp, Homo sapiens
cccccagccagcagtgctcagc

SEQ ID NO: 8329206 - DNA, 22 bp, Homo sapiens
cccccagctctgctgggtcccg

SEQ ID NO: 8329207 - DNA, 22 bp, Homo sapiens
cccccagatgcgagccatagcc

SEQ ID NO: 8329208 - DNA, 22 bp, Homo sapiens
cccccagccagcagtgctcagc

SEQ ID NO: 8329209 - DNA, 22 bp, Homo sapiens
ccctcaggagatgtcagctgga

SEQ ID NO: 8329210 - DNA, 22 bp, Homo sapiens
tgctgcaggaattctcaaggga

SEQ ID NO: 8329211 - DNA, 22 bp, Homo sapiens
ccccactctcggccagataggc

SEQ ID NO: 8329212 - DNA, 22 bp, Homo sapiens
tgctgcaggaacttaagaagct

SEQ ID NO: 8329213 - DNA, 22 bp, Homo sapiens
tgctgcagattgcagattaact

SEQ ID NO: 8329214 - DNA, 22 bp, Homo sapiens
tgctgcagacgaagcccatgcc

SEQ ID NO: 8329215 - DNA, 17 bp, Homo sapiens
tgctgcagacccacccc

SEQ ID NO: 8329216 - DNA, 22 bp, Homo sapiens
ccccagcagactcagggcaggt

SEQ ID NO: 8329217 - DNA, 22 bp, Homo sapiens
ccccagcagcacctggggcagt

SEQ ID NO: 8329218 - DNA, 22 bp, Homo sapiens
ccccagccagcaggacctctga

SEQ ID NO: 8329219 - DNA, 22 bp, Homo sapiens
ccccagccagcttgtagtagaa

SEQ ID NO: 8329220 - DNA, 22 bp, Homo sapiens
tgctggagatgaaagggccctg

SEQ ID NO: 8329221 - DNA, 22 bp, Homo sapiens
tgctggagagctagttctgcag

SEQ ID NO: 8329222 - DNA, 22 bp, Homo sapiens
ccccagccttccatgggaattg

SEQ ID NO: 8329223 - DNA, 22 bp, Homo sapiens
ccccagcccacaagcatattaa

SEQ ID NO: 8329224 - DNA, 22 bp, Homo sapiens
tgctggagacctgcttgcacca

SEQ ID NO: 8329225 - DNA, 22 bp, Homo sapiens
tgctggagactcactcaggtgc

SEQ ID NO: 8329226 - DNA, 22 bp, Homo sapiens
tgctccatgcgctcggccggcg

SEQ ID NO: 8329227 - DNA, 22 bp, Homo sapiens
tgctccagtgcctgccccacag

SEQ ID NO: 8329228 - DNA, 22 bp, Homo sapiens
cccaggctcctgactcattcta

SEQ ID NO: 8329229 - DNA, 22 bp, Homo sapiens
cccaggctcctgctgtgttgac

SEQ ID NO: 8329230 - DNA, 22 bp, Homo sapiens
tgctcagtaagtaaacagtaac

SEQ ID NO: 8329231 - DNA, 22 bp, Homo sapiens
cccaggctcttatgtgacttgc

SEQ ID NO: 8329232 - DNA, 21 bp, Homo sapiens
cccaggctgaattaaaaatat

SEQ ID NO: 8329233 - DNA, 22 bp, Homo sapiens
tgcctgggacatgctgtggact

SEQ ID NO: 8329234 - DNA, 22 bp, Homo sapiens
tgcctgggacatgctgtggact

SEQ ID NO: 8329235 - DNA, 20 bp, Homo sapiens
tgcctgggaaggcgtggagg

SEQ ID NO: 8329236 - DNA, 22 bp, Homo sapiens
cccaggctcctagaggcccaga

SEQ ID NO: 8329237 - DNA, 22 bp, Homo sapiens
tgccaggcgattgctatcagca

SEQ ID NO: 8329238 - DNA, 22 bp, Homo sapiens
cccaggagttcgaggctgtagt

SEQ ID NO: 8329239 - DNA, 22 bp, Homo sapiens
cccaggagttcgaggctgtagt

SEQ ID NO: 8329240 - DNA, 22 bp, Homo sapiens
cccaggaggttgaggctgcagt

SEQ ID NO: 8329241 - DNA, 22 bp, Homo sapiens
cccaggaggtgtgcccaactcg

SEQ ID NO: 8329242 - DNA, 22 bp, Homo sapiens
tgccaggcctcaggagtctcca

SEQ ID NO: 8329243 - DNA, 22 bp, Homo sapiens
cccaggaggtgtagctgcgtgg

SEQ ID NO: 8329244 - DNA, 22 bp, Homo sapiens
cccaggaggtgtagctgcgtgg

SEQ ID NO: 8329245 - DNA, 22 bp, Homo sapiens
cccaggaggtggaggttgcggt

SEQ ID NO: 8329246 - DNA, 22 bp, Homo sapiens
cccaggaggtggaggttgcggt

SEQ ID NO: 8329247 - DNA, 22 bp, Homo sapiens
cccaggaggtggaggctgcagt

SEQ ID NO: 8329248 - DNA, 22 bp, Homo sapiens
cccaggaggtggaggctgcagt

SEQ ID NO: 8329249 - DNA, 22 bp, Homo sapiens
cccaggagggtggcctctgccc

SEQ ID NO: 8329250 - DNA, 22 bp, Homo sapiens
tgccaagggtatgggcaagata

SEQ ID NO: 8329251 - DNA, 22 bp, Homo sapiens
tgcattatcgtcttgatcctct

SEQ ID NO: 8329252 - DNA, 22 bp, Homo sapiens
tgcattcagttggtcagctttt

SEQ ID NO: 8329253 - DNA, 20 bp, Homo sapiens
tgccaagctctttagatcga

SEQ ID NO: 8329254 - DNA, 22 bp, Homo sapiens
tgccaaggagctggatcagggc

SEQ ID NO: 8329255 - DNA, 22 bp, Homo sapiens
tgccaagaggtccaggtgggaa

SEQ ID NO: 8329256 - DNA, 22 bp, Homo sapiens
tgcattaaaatgatggagaaat

SEQ ID NO: 8329257 - DNA, 22 bp, Homo sapiens
tgcattaaaatgatggagaaat

SEQ ID NO: 8329258 - DNA, 22 bp, Homo sapiens
tgcattaaaaccatcgaccatc

SEQ ID NO: 8329259 - DNA, 22 bp, Homo sapiens
tgcattaaaatgtgcctctctt

SEQ ID NO: 8329260 - DNA, 22 bp, Homo sapiens
tgcattaaaatgtgcctctctt

SEQ ID NO: 8329261 - DNA, 22 bp, Homo sapiens
tgcattaaatataatctgttga

SEQ ID NO: 8329262 - DNA, 22 bp, Homo sapiens
tgcattaaatataatctgttga

SEQ ID NO: 8329263 - DNA, 22 bp, Homo sapiens
tgcatcagaggatagctgcagt

SEQ ID NO: 8329264 - DNA, 22 bp, Homo sapiens
tgcatcaacctaatatcagctc

SEQ ID NO: 8329265 - DNA, 22 bp, Homo sapiens
tgcattaagtgtctgcatatgg

SEQ ID NO: 8329266 - DNA, 22 bp, Homo sapiens
tgcattaagtgtctgcatatgg

SEQ ID NO: 8329267 - DNA, 20 bp, Homo sapiens
tgcattaagtggcattgagc

SEQ ID NO: 8329268 - DNA, 22 bp, Homo sapiens
tgcattaaggtaattgtataat

SEQ ID NO: 8329269 - DNA, 22 bp, Homo sapiens
tgcattaatttttgccaggttc

SEQ ID NO: 8329270 - DNA, 22 bp, Homo sapiens
tgcattaaggccattgaaattt

SEQ ID NO: 8329271 - DNA, 22 bp, Homo sapiens
tgcattaaggtaattgtataat

SEQ ID NO: 8329272 - DNA, 22 bp, Homo sapiens
tgcattaagggcctggagatac

SEQ ID NO: 8329273 - DNA, 22 bp, Homo sapiens
tgcattaagggcctggagatac

SEQ ID NO: 8329274 - DNA, 22 bp, Homo sapiens
tgcattaaggccattgaaattt

SEQ ID NO: 8329275 - DNA, 22 bp, Homo sapiens
tgcattaagcacacttttgaat

SEQ ID NO: 8329276 - DNA, 22 bp, Homo sapiens
tgcattaagcacacttttgaat

SEQ ID NO: 8329277 - DNA, 22 bp, Homo sapiens
tgcattaagaatttctgaggat

SEQ ID NO: 8329278 - DNA, 22 bp, Homo sapiens
tgcattaagaatttctgaggat

SEQ ID NO: 8329279 - DNA, 22 bp, Homo sapiens
tgcagggagggcccagcaatct

SEQ ID NO: 8329280 - DNA, 22 bp, Homo sapiens
cccagctacctctgctaggaga

SEQ ID NO: 8329281 - DNA, 23 bp, Homo sapiens
cccagcgctgagccctgcaggca

SEQ ID NO: 8329282 - DNA, 22 bp, Homo sapiens
tgcagggaatctgtggctggac

SEQ ID NO: 8329283 - DNA, 22 bp, Homo sapiens
tacagtttgttacattgttagt

SEQ ID NO: 8329284 - DNA, 22 bp, Homo sapiens
tacagtaaatgtggtagaaact

SEQ ID NO: 8329285 - DNA, 22 bp, Homo sapiens
tacagtaaagctgctatgaatt

SEQ ID NO: 8329286 - DNA, 22 bp, Homo sapiens
tacagtaacatgttgtacaagc

SEQ ID NO: 8329287 - DNA, 22 bp, Homo sapiens
tacagtaaccagtctacttaga

SEQ ID NO: 8329288 - DNA, 22 bp, Homo sapiens
tacagtaacatgttgtacaagc

SEQ ID NO: 8329289 - DNA, 22 bp, Homo sapiens
tacagtaaccttatttgtcatt

SEQ ID NO: 8329290 - DNA, 22 bp, Homo sapiens
tacaaatgagttgtatgaacca

SEQ ID NO: 8329291 - DNA, 20 bp, Homo sapiens
tacaaattttccatgtttcc

SEQ ID NO: 8329292 - DNA, 20 bp, Homo sapiens
tacaaattttccatgtttcc

SEQ ID NO: 8329293 - DNA, 22 bp, Homo sapiens
tacaaatgtattttattttggt

SEQ ID NO: 8329294 - DNA, 22 bp, Homo sapiens
tacaagtccgtaaagggcagat

SEQ ID NO: 8329295 - DNA, 21 bp, Homo sapiens
tacaagttcatgttgaaggaa

SEQ ID NO: 8329296 - DNA, 22 bp, Homo sapiens
tacaagttccattttgaaagtg

SEQ ID NO: 8329297 - DNA, 22 bp, Homo sapiens
tacaagtgtgcaccaccatgtc

SEQ ID NO: 8329298 - DNA, 22 bp, Homo sapiens
tacaagtgtgcaccaccatgtc

SEQ ID NO: 8329299 - DNA, 22 bp, Homo sapiens
tacaagtgtggctcctctgtct

SEQ ID NO: 8329300 - DNA, 17 bp, Homo sapiens
caggcagacatgtaagc

SEQ ID NO: 8329301 - DNA, 22 bp, Homo sapiens
taatttacttgcaaataacaat

SEQ ID NO: 8329302 - DNA, 22 bp, Homo sapiens
taattgttttcaatgttaatga

SEQ ID NO: 8329303 - DNA, 22 bp, Homo sapiens
taagacacatgcgtacaagata

SEQ ID NO: 8329304 - DNA, 22 bp, Homo sapiens
taagacacattcatatctgtct

SEQ ID NO: 8329305 - DNA, 22 bp, Homo sapiens
taagacacattggagtagatga

SEQ ID NO: 8329306 - DNA, 22 bp, Homo sapiens
taagacacattgagaaacacaa

SEQ ID NO: 8329307 - DNA, 23 bp, Homo sapiens
taagacacccgactccagagatg

SEQ ID NO: 8329308 - DNA, 22 bp, Homo sapiens
taagacacctctctgcccttca

SEQ ID NO: 8329309 - DNA, 22 bp, Homo sapiens
taagacacgggctgatctaaag

SEQ ID NO: 8329310 - DNA, 22 bp, Homo sapiens
taagcaaagtttataaggctct

SEQ ID NO: 8329311 - DNA, 22 bp, Homo sapiens
taagattacagtgagaaataaa

SEQ ID NO: 8329312 - DNA, 22 bp, Homo sapiens
taagatgtcaaagggtcacagt

SEQ ID NO: 8329313 - DNA, 22 bp, Homo sapiens
taagcaaatagctagatcagag

SEQ ID NO: 8329314 - DNA, 22 bp, Homo sapiens
taagcaaatagctagatcagag

SEQ ID NO: 8329315 - DNA, 22 bp, Homo sapiens
taagcaaatagctagatcagag

SEQ ID NO: 8329316 - DNA, 22 bp, Homo sapiens
taagcaaataatgcatcaaggg

SEQ ID NO: 8329317 - DNA, 22 bp, Homo sapiens
taagacacagtccgcactctct

SEQ ID NO: 8329318 - DNA, 22 bp, Homo sapiens
caggcacatgggagctcatcat

SEQ ID NO: 8329319 - DNA, 22 bp, Homo sapiens
taacaatacccattctaattac

SEQ ID NO: 8329320 - DNA, 22 bp, Homo sapiens
taacaatacccattctaattac

SEQ ID NO: 8329321 - DNA, 22 bp, Homo sapiens
taacaatacccattctaattac

SEQ ID NO: 8329322 - DNA, 22 bp, Homo sapiens
taacaagttctgacagcattgt

SEQ ID NO: 8329323 - DNA, 22 bp, Homo sapiens
taacaagtttcatttatagaat

SEQ ID NO: 8329324 - DNA, 22 bp, Homo sapiens
taacaagatttgtaaaattgta

SEQ ID NO: 8329325 - DNA, 22 bp, Homo sapiens
taacaagtcattttaaattatg

SEQ ID NO: 8329326 - DNA, 22 bp, Homo sapiens
taacaagaaatacattggttct

SEQ ID NO: 8329327 - DNA, 22 bp, Homo sapiens
taacattgagtccactaaacag

SEQ ID NO: 8329328 - DNA, 22 bp, Homo sapiens
taagaaacccaggaatttctta

SEQ ID NO: 8329329 - DNA, 22 bp, Homo sapiens
caggatctgcccaggcctttgg

SEQ ID NO: 8329330 - DNA, 22 bp, Homo sapiens
caggatcttttaatgtctccag

SEQ ID NO: 8329331 - DNA, 22 bp, Homo sapiens
caggatctgttaagttgttcca

SEQ ID NO: 8329332 - DNA, 18 bp, Homo sapiens
caggatgagtgatgggga

SEQ ID NO: 8329333 - DNA, 19 bp, Homo sapiens
caggatgatcccatgacac

SEQ ID NO: 8329334 - DNA, 22 bp, Homo sapiens
taacatttaaatttttcacata

SEQ ID NO: 8329335 - DNA, 19 bp, Homo sapiens
taacttgtagatatgaagt

SEQ ID NO: 8329336 - DNA, 22 bp, Homo sapiens
taacttgtgttacattactctt

SEQ ID NO: 8329337 - DNA, 22 bp, Homo sapiens
taacttgataagtattctctgc

SEQ ID NO: 8329338 - DNA, 22 bp, Homo sapiens
taactttggggacacttctctt

SEQ ID NO: 8329339 - DNA, 22 bp, Homo sapiens
taactttgaagggaattttact

SEQ ID NO: 8329340 - DNA, 22 bp, Homo sapiens
caggagacaatggctgtggggc

SEQ ID NO: 8329341 - DNA, 22 bp, Homo sapiens
caggagaagtctctagggggtg

SEQ ID NO: 8329342 - DNA, 19 bp, Homo sapiens
caggacagtttgccaagaa

SEQ ID NO: 8329343 - DNA, 22 bp, Homo sapiens
caggacagtgcaggtccatcct

SEQ ID NO: 8329344 - DNA, 22 bp, Homo sapiens
taaaccttatttgaataccaac

SEQ ID NO: 8329345 - DNA, 22 bp, Homo sapiens
taaaccattcacatcccagaaa

SEQ ID NO: 8329346 - DNA, 22 bp, Homo sapiens
taaaccatgcagacagctccat

SEQ ID NO: 8329347 - DNA, 22 bp, Homo sapiens
taaaccattcagactgaaccac

SEQ ID NO: 8329348 - DNA, 22 bp, Homo sapiens
taaaccatccatcccacctgtg

SEQ ID NO: 8329349 - DNA, 22 bp, Homo sapiens
taaacatttgttattcttgttt

SEQ ID NO: 8329350 - DNA, 22 bp, Homo sapiens
gttttcctgagcccagagatgc

SEQ ID NO: 8329351 - DNA, 22 bp, Homo sapiens
taaaaaacattactctgtcctg

SEQ ID NO: 8329352 - DNA, 22 bp, Homo sapiens
gttttcttcctgcaattggcat

SEQ ID NO: 8329353 - DNA, 22 bp, Homo sapiens
taaaaagtagtgagaatggcgc

SEQ ID NO: 8329354 - DNA, 22 bp, Homo sapiens
taaaatgacttcctccaacatc

SEQ ID NO: 8329355 - DNA, 22 bp, Homo sapiens
taaaatcattctggtgtcagta

SEQ ID NO: 8329356 - DNA, 22 bp, Homo sapiens
taaaatcaccaaaagcaggtgg

SEQ ID NO: 8329357 - DNA, 22 bp, Homo sapiens
taaaaatcttatgaatggcaag

SEQ ID NO: 8329358 - DNA, 22 bp, Homo sapiens
taaaaatcttatgaatggcaag

SEQ ID NO: 8329359 - DNA, 22 bp, Homo sapiens
caggaatccagagtgagcctcc

SEQ ID NO: 8329360 - DNA, 22 bp, Homo sapiens
caggaagtcgcagagctggggg

SEQ ID NO: 8329361 - DNA, 22 bp, Homo sapiens
caggaagtgctcgctgtgggga

SEQ ID NO: 8329362 - DNA, 22 bp, Homo sapiens
caggaagtggctgggctgggtt

SEQ ID NO: 8329363 - DNA, 22 bp, Homo sapiens
caggaaggaaagggtgtggaga

SEQ ID NO: 8329364 - DNA, 22 bp, Homo sapiens
gttttcctactgtatcatcaaa

SEQ ID NO: 8329365 - DNA, 22 bp, Homo sapiens
caggagtgtctccacacagcaa

SEQ ID NO: 8329366 - DNA, 22 bp, Homo sapiens
caggagtgtcgggtcactaggt

SEQ ID NO: 8329367 - DNA, 22 bp, Homo sapiens
caggataaatagtaaatgtaag

SEQ ID NO: 8329368 - DNA, 22 bp, Homo sapiens
caggaggcgtcttcagtttgtt

SEQ ID NO: 8329369 - DNA, 22 bp, Homo sapiens
caggaggctcctagggctctgt

SEQ ID NO: 8329370 - DNA, 23 bp, Homo sapiens
caggagggaatgaagttagacaa

SEQ ID NO: 8329371 - DNA, 22 bp, Homo sapiens
caggaggccaactgtgggactt

SEQ ID NO: 8329372 - DNA, 22 bp, Homo sapiens
caggaggcagaggttgcagtga

SEQ ID NO: 8329373 - DNA, 22 bp, Homo sapiens
caggaggcagtgggtgttgtct

SEQ ID NO: 8329374 - DNA, 22 bp, Homo sapiens
caggaggcagcgctctcaggac

SEQ ID NO: 8329375 - DNA, 22 bp, Homo sapiens
caggagctactcaggttgggtt

SEQ ID NO: 8329376 - DNA, 22 bp, Homo sapiens
taaagcatgtactgtgtgctag

SEQ ID NO: 8329377 - DNA, 22 bp, Homo sapiens
taaatatgcatgtatccttatc

SEQ ID NO: 8329378 - DNA, 22 bp, Homo sapiens
taaatatcagtccagctcttcc

SEQ ID NO: 8329379 - DNA, 22 bp, Homo sapiens
taaatcacaaattttctcattt

SEQ ID NO: 8329380 - DNA, 22 bp, Homo sapiens
taaatagggaatagaagaggaa

SEQ ID NO: 8329381 - DNA, 22 bp, Homo sapiens
taaagtgagtacaaaatgaggg

SEQ ID NO: 8329382 - DNA, 22 bp, Homo sapiens
taaagtgcagactcccggaaac

SEQ ID NO: 8329383 - DNA, 22 bp, Homo sapiens
taaagtgcagattgtgattcag

SEQ ID NO: 8329384 - DNA, 22 bp, Homo sapiens
taaagtgcaggctactcagaag

SEQ ID NO: 8329385 - DNA, 22 bp, Homo sapiens
taaagtgcatgcggggccagat

SEQ ID NO: 8329386 - DNA, 22 bp, Homo sapiens
taaatagaatctaaactgctca

SEQ ID NO: 8329387 - DNA, 22 bp, Homo sapiens
taaagtgcccagggaaagcggg

SEQ ID NO: 8329388 - DNA, 22 bp, Homo sapiens
cagctggctgcggtgaggggac

SEQ ID NO: 8329389 - DNA, 22 bp, Homo sapiens
gtgtggccctgcgtcctgagtc

SEQ ID NO: 8329390 - DNA, 22 bp, Homo sapiens
gtgtggccaattatgggcattc

SEQ ID NO: 8329391 - DNA, 20 bp, Homo sapiens
gtgtggccaggagctgcgct

SEQ ID NO: 8329392 - DNA, 22 bp, Homo sapiens
gtgtggccaattatgggcattc

SEQ ID NO: 8329393 - DNA, 22 bp, Homo sapiens
cagctggggcagccacgtgcgg

SEQ ID NO: 8329394 - DNA, 22 bp, Homo sapiens
cagctgggcctcctgagccctg

SEQ ID NO: 8329395 - DNA, 22 bp, Homo sapiens
cagctgggctaagagtagaggc

SEQ ID NO: 8329396 - DNA, 22 bp, Homo sapiens
cagctggcctgagcggtggcgg

SEQ ID NO: 8329397 - DNA, 22 bp, Homo sapiens
cagctggccccacagtagaggc

SEQ ID NO: 8329398 - DNA, 22 bp, Homo sapiens
cagctggccctttggtagcctt

SEQ ID NO: 8329399 - DNA, 22 bp, Homo sapiens
cagctggccaatcagggcgccc

SEQ ID NO: 8329400 - DNA, 22 bp, Homo sapiens
cagctggctccacctctgggct

SEQ ID NO: 8329401 - DNA, 22 bp, Homo sapiens
gtggggagtgttctgtgattgg

SEQ ID NO: 8329402 - DNA, 22 bp, Homo sapiens
gtgggcaggaggccctgccctg

SEQ ID NO: 8329403 - DNA, 22 bp, Homo sapiens
gtgggacagcggggtgggacag

SEQ ID NO: 8329404 - DNA, 22 bp, Homo sapiens
gtgggacagctggagggtccct

SEQ ID NO: 8329405 - DNA, 22 bp, Homo sapiens
gtggggagggagatgctgaagt

SEQ ID NO: 8329406 - DNA, 22 bp, Homo sapiens
gtggggagggagatgctgaagt

SEQ ID NO: 8329407 - DNA, 22 bp, Homo sapiens
gtgggcaggtaggcaccagcta

SEQ ID NO: 8329408 - DNA, 22 bp, Homo sapiens
gtggctcagcggagctctgcac

SEQ ID NO: 8329409 - DNA, 22 bp, Homo sapiens
gtggccttggcttctaccctga

SEQ ID NO: 8329410 - DNA, 22 bp, Homo sapiens
cagctctgtgcaggcctgggga

SEQ ID NO: 8329411 - DNA, 22 bp, Homo sapiens
gtggcccacacagacagcatct

SEQ ID NO: 8329412 - DNA, 19 bp, Homo sapiens
gtggccagggcaggggctg

SEQ ID NO: 8329413 - DNA, 22 bp, Homo sapiens
gtggcagtctcatctgtggctc

SEQ ID NO: 8329414 - DNA, 22 bp, Homo sapiens
gtggccagtgggaatgggctca

SEQ ID NO: 8329415 - DNA, 22 bp, Homo sapiens
gtggccaggtcagggacttgtg

SEQ ID NO: 8329416 - DNA, 22 bp, Homo sapiens
gtggccagggcccacaggatga

SEQ ID NO: 8329417 - DNA, 22 bp, Homo sapiens
cagcccagccgagggcctggct

SEQ ID NO: 8329418 - DNA, 22 bp, Homo sapiens
gttggctcattttatagacagc

SEQ ID NO: 8329419 - DNA, 22 bp, Homo sapiens
gttggctatgagagctttagtg

SEQ ID NO: 8329420 - DNA, 22 bp, Homo sapiens
caggaacaactcccagcatctc

SEQ ID NO: 8329421 - DNA, 22 bp, Homo sapiens
gttcctaaatctggaggacctc

SEQ ID NO: 8329422 - DNA, 22 bp, Homo sapiens
gttcccttctcatggggtccag

SEQ ID NO: 8329423 - DNA, 21 bp, Homo sapiens
gttcccttattggggcaggca

SEQ ID NO: 8329424 - DNA, 22 bp, Homo sapiens
gttccctttcgtatggactggg

SEQ ID NO: 8329425 - DNA, 22 bp, Homo sapiens
gttctgggtgatgaggttggct

SEQ ID NO: 8329426 - DNA, 22 bp, Homo sapiens
caggaacacaatgagtctcaaa

SEQ ID NO: 8329427 - DNA, 22 bp, Homo sapiens
caggaacacctgcagctagtgg

SEQ ID NO: 8329428 - DNA, 22 bp, Homo sapiens
caggaacagagtggcattgtct

SEQ ID NO: 8329429 - DNA, 22 bp, Homo sapiens
caggaacaatgtaagtctcatt

SEQ ID NO: 8329430 - DNA, 22 bp, Homo sapiens
gtttacaacatcttgtccttca

SEQ ID NO: 8329431 - DNA, 22 bp, Homo sapiens
gtttacatatgtctgtctgcac

SEQ ID NO: 8329432 - DNA, 22 bp, Homo sapiens
gtttacatgcagaaaatcaatg

SEQ ID NO: 8329433 - DNA, 22 bp, Homo sapiens
gtttacatgcagaaaatcaatg

SEQ ID NO: 8329434 - DNA, 22 bp, Homo sapiens
gtttacatattttaattggtga

SEQ ID NO: 8329435 - DNA, 22 bp, Homo sapiens
gtttacatgcagaaaatcaatg

SEQ ID NO: 8329436 - DNA, 22 bp, Homo sapiens
gtttcctttctattgccttgat

SEQ ID NO: 8329437 - DNA, 22 bp, Homo sapiens
gtttcctctgctggttttcatt

SEQ ID NO: 8329438 - DNA, 22 bp, Homo sapiens
gtttattgataaaagctggaca

SEQ ID NO: 8329439 - DNA, 22 bp, Homo sapiens
gtttcaaaagtcaggctattct

SEQ ID NO: 8329440 - DNA, 18 bp, Homo sapiens
gtttacattactgaatag

SEQ ID NO: 8329441 - DNA, 22 bp, Homo sapiens
gtttacattaagtattagcatc

SEQ ID NO: 8329442 - DNA, 22 bp, Homo sapiens
gtttacatgtttttctcttaca

SEQ ID NO: 8329443 - DNA, 22 bp, Homo sapiens
gtttacatgtactcattatact

SEQ ID NO: 8329444 - DNA, 22 bp, Homo sapiens
gtttacatgtaatgtgttattg

SEQ ID NO: 8329445 - DNA, 22 bp, Homo sapiens
gtttacatgcatgcaagaatga

SEQ ID NO: 8329446 - DNA, 22 bp, Homo sapiens
caggaaaatggaatcacctgta

SEQ ID NO: 8329447 - DNA, 22 bp, Homo sapiens
caggaaagagctgccaggcagg

SEQ ID NO: 8329448 - DNA, 22 bp, Homo sapiens
gttcacacttttgatatgtgaa

SEQ ID NO: 8329449 - DNA, 22 bp, Homo sapiens
caggaaagaaatgagaacacca

SEQ ID NO: 8329450 - DNA, 22 bp, Homo sapiens
cagcttctccagatgaccctca

SEQ ID NO: 8329451 - DNA, 22 bp, Homo sapiens
cagcttctcgggagcgcatgtg

SEQ ID NO: 8329452 - DNA, 22 bp, Homo sapiens
gttattaaagtatttgatgtta

SEQ ID NO: 8329453 - DNA, 22 bp, Homo sapiens
gttacatttattagaggtctct

SEQ ID NO: 8329454 - DNA, 22 bp, Homo sapiens
gttacaaatgccaaagctgaga

SEQ ID NO: 8329455 - DNA, 22 bp, Homo sapiens
gttacaaatgtaaattctgggg

SEQ ID NO: 8329456 - DNA, 20 bp, Homo sapiens
gttaaaagagtaatttgagg

SEQ ID NO: 8329457 - DNA, 22 bp, Homo sapiens
gttaaaagaacaactcggaggt

SEQ ID NO: 8329458 - DNA, 22 bp, Homo sapiens
cagctgtgattcctgctgtcca

SEQ ID NO: 8329459 - DNA, 22 bp, Homo sapiens
cagctgtgtatgagagcatgct

SEQ ID NO: 8329460 - DNA, 22 bp, Homo sapiens
cagctgtgggcctgacgtggca

SEQ ID NO: 8329461 - DNA, 22 bp, Homo sapiens
catttatataaaatgtccagaa

SEQ ID NO: 8329462 - DNA, 22 bp, Homo sapiens
catttattagttagttcgatgt

SEQ ID NO: 8329463 - DNA, 22 bp, Homo sapiens
catttacacttctaaccacaag

SEQ ID NO: 8329464 - DNA, 22 bp, Homo sapiens
catttgaatggcatttcacttt

SEQ ID NO: 8329465 - DNA, 22 bp, Homo sapiens
catttgaacctggatgttctta

SEQ ID NO: 8329466 - DNA, 22 bp, Homo sapiens
tcctggggagggttctggctcc

SEQ ID NO: 8329467 - DNA, 20 bp, Homo sapiens
ccacagaggacagggctgtg

SEQ ID NO: 8329468 - DNA, 20 bp, Homo sapiens
ccacagaggacagggctgtg

SEQ ID NO: 8329469 - DNA, 22 bp, Homo sapiens
ccacagaggacaactgcctggc

SEQ ID NO: 8329470 - DNA, 19 bp, Homo sapiens
tcctgcccaccagccaggg

SEQ ID NO: 8329471 - DNA, 22 bp, Homo sapiens
tcctgccaaagcatgtactggg

SEQ ID NO: 8329472 - DNA, 22 bp, Homo sapiens
tcctgccaggagtgctggccct

SEQ ID NO: 8329473 - DNA, 22 bp, Homo sapiens
tcctccccaaagcccagcctgg

SEQ ID NO: 8329474 - DNA, 22 bp, Homo sapiens
ccaaatcaccagcacgatcatt

SEQ ID NO: 8329475 - DNA, 22 bp, Homo sapiens
ccaaatagtctttcattgaatt

SEQ ID NO: 8329476 - DNA, 22 bp, Homo sapiens
ccacacagggggatgagttatt

SEQ ID NO: 8329477 - DNA, 22 bp, Homo sapiens
tcctgcagttacatcccagcca

SEQ ID NO: 8329478 - DNA, 22 bp, Homo sapiens
ccacaagatgcaaactctaaca

SEQ ID NO: 8329479 - DNA, 22 bp, Homo sapiens
ccactgagaaggggttggggtc

SEQ ID NO: 8329480 - DNA, 22 bp, Homo sapiens
ccacagtgacacgggctggccc

SEQ ID NO: 8329481 - DNA, 22 bp, Homo sapiens
ccacagtgacacgggctggccc

SEQ ID NO: 8329482 - DNA, 22 bp, Homo sapiens
ccacagtgagtgtcatacttgg

SEQ ID NO: 8329483 - DNA, 22 bp, Homo sapiens
ccacagggtgtcatcagcttga

SEQ ID NO: 8329484 - DNA, 22 bp, Homo sapiens
tcctggggagggttctggctcc

SEQ ID NO: 8329485 - DNA, 20 bp, Homo sapiens
tcctggtcatgtggctgggc

SEQ ID NO: 8329486 - DNA, 22 bp, Homo sapiens
ccagaatccaaaacgttttgag

SEQ ID NO: 8329487 - DNA, 22 bp, Homo sapiens
ccagaatagaaggcagctgtca

SEQ ID NO: 8329488 - DNA, 22 bp, Homo sapiens
ccactgagtacccgatggctgc

SEQ ID NO: 8329489 - DNA, 22 bp, Homo sapiens
ccactgagtgagcagagcaggg

SEQ ID NO: 8329490 - DNA, 22 bp, Homo sapiens
ccactgaggcctgggcccaggg

SEQ ID NO: 8329491 - DNA, 22 bp, Homo sapiens
ccactgaggttttgtggttatg

SEQ ID NO: 8329492 - DNA, 22 bp, Homo sapiens
ccactgaggggtcatggtggga

SEQ ID NO: 8329493 - DNA, 22 bp, Homo sapiens
ccactgagcagtagctgcgtcg

SEQ ID NO: 8329494 - DNA, 20 bp, Homo sapiens
ccagacagcacctgcctggt

SEQ ID NO: 8329495 - DNA, 22 bp, Homo sapiens
tctcctgggaggacaaggaagg

SEQ ID NO: 8329496 - DNA, 22 bp, Homo sapiens
tctctaaagcctggaagaggag

SEQ ID NO: 8329497 - DNA, 22 bp, Homo sapiens
tctccatacttgcctttggcct

SEQ ID NO: 8329498 - DNA, 22 bp, Homo sapiens
tctccataggcagttcataaca

SEQ ID NO: 8329499 - DNA, 22 bp, Homo sapiens
ccagatgtatgtatgagtgcat

SEQ ID NO: 8329500 - DNA, 20 bp, Homo sapiens
tctctctggttggaggagct

SEQ ID NO: 8329501 - DNA, 22 bp, Homo sapiens
ccagctagtaagcacctgcatc

SEQ ID NO: 8329502 - DNA, 22 bp, Homo sapiens
ccagctccaagtttgggcatca

SEQ ID NO: 8329503 - DNA, 22 bp, Homo sapiens
tctgccagaagttctgagagta

SEQ ID NO: 8329504 - DNA, 22 bp, Homo sapiens
tctgaggcccagttcaactctt

SEQ ID NO: 8329505 - DNA, 22 bp, Homo sapiens
tctgaggttttcatgttttctg

SEQ ID NO: 8329506 - DNA, 22 bp, Homo sapiens
tctgaggttgaactttgcaaag

SEQ ID NO: 8329507 - DNA, 22 bp, Homo sapiens
tctgaggcagcttgccactcta

SEQ ID NO: 8329508 - DNA, 22 bp, Homo sapiens
ccagcccctatcctcgctccac

SEQ ID NO: 8329509 - DNA, 22 bp, Homo sapiens
ccagccccgggaacctggccgt

SEQ ID NO: 8329510 - DNA, 19 bp, Homo sapiens
ccagcccatagtccatcac

SEQ ID NO: 8329511 - DNA, 22 bp, Homo sapiens
tctctctgtgacagctttgctg

SEQ ID NO: 8329512 - DNA, 16 bp, Homo sapiens
tctctctgtatttgct

SEQ ID NO: 8329513 - DNA, 19 bp, Homo sapiens
tctctctgtacattagata

SEQ ID NO: 8329514 - DNA, 22 bp, Homo sapiens
tctcttggaggttcttcctgtt

SEQ ID NO: 8329515 - DNA, 22 bp, Homo sapiens
tctcttggaaagcttgcccact

SEQ ID NO: 8329516 - DNA, 22 bp, Homo sapiens
tctcttggacatgtggctctgc

SEQ ID NO: 8329517 - DNA, 22 bp, Homo sapiens
ccagccataaacccagatgact

SEQ ID NO: 8329518 - DNA, 22 bp, Homo sapiens
ccaggaggcggaaggtacagtg

SEQ ID NO: 8329519 - DNA, 22 bp, Homo sapiens
tctgtcacccaggctggagtgc

SEQ ID NO: 8329520 - DNA, 22 bp, Homo sapiens
tctgtcacccctgtttctggct

SEQ ID NO: 8329521 - DNA, 23 bp, Homo sapiens
tctgtcactttctgctgtggagt

SEQ ID NO: 8329522 - DNA, 23 bp, Homo sapiens
tctgtcactttctgctgtggagt

SEQ ID NO: 8329523 - DNA, 22 bp, Homo sapiens
tctgtcataaacacacacaagc

SEQ ID NO: 8329524 - DNA, 19 bp, Homo sapiens
tctggagctgatgcaggtg

SEQ ID NO: 8329525 - DNA, 22 bp, Homo sapiens
tctggctgttaggcctgacctt

SEQ ID NO: 8329526 - DNA, 22 bp, Homo sapiens
tctggctgttgttaggttcctg

SEQ ID NO: 8329527 - DNA, 22 bp, Homo sapiens
ccagctgggattaagggaaaat

SEQ ID NO: 8329528 - DNA, 22 bp, Homo sapiens
ccagctggtgttccttaggacc

SEQ ID NO: 8329529 - DNA, 22 bp, Homo sapiens
cagtcctggggaccaggctgag

SEQ ID NO: 8329530 - DNA, 22 bp, Homo sapiens
cagtcctggggaccaggctgag

SEQ ID NO: 8329531 - DNA, 22 bp, Homo sapiens
cagtcctgtgttaaacaagagc

SEQ ID NO: 8329532 - DNA, 20 bp, Homo sapiens
tatttagattcaagtatgga

SEQ ID NO: 8329533 - DNA, 22 bp, Homo sapiens
tatttagctggagtcagtgctt

SEQ ID NO: 8329534 - DNA, 19 bp, Homo sapiens
tatttacttcttgattgca

SEQ ID NO: 8329535 - DNA, 20 bp, Homo sapiens
tatttacaacttagagcctc

SEQ ID NO: 8329536 - DNA, 22 bp, Homo sapiens
cagtgattttctcagaacttga

SEQ ID NO: 8329537 - DNA, 19 bp, Homo sapiens
cagtgattaattcatctta

SEQ ID NO: 8329538 - DNA, 22 bp, Homo sapiens
cagtgattattgattgcattca

SEQ ID NO: 8329539 - DNA, 22 bp, Homo sapiens
cagtgagtaagtagacagctta

SEQ ID NO: 8329540 - DNA, 22 bp, Homo sapiens
cagtgagggcccccttccaggt

SEQ ID NO: 8329541 - DNA, 22 bp, Homo sapiens
tcagaaatgtaagctgatgact

SEQ ID NO: 8329542 - DNA, 22 bp, Homo sapiens
cagtgctggtgtaggctgacca

SEQ ID NO: 8329543 - DNA, 22 bp, Homo sapiens
cagtgctgtgctggaagctgtt

SEQ ID NO: 8329544 - DNA, 22 bp, Homo sapiens
cagtgctggaggctggagggaa

SEQ ID NO: 8329545 - DNA, 22 bp, Homo sapiens
cagtgctgggcagaggagagcg

SEQ ID NO: 8329546 - DNA, 22 bp, Homo sapiens
cagggtggaatggaatgctggc

SEQ ID NO: 8329547 - DNA, 22 bp, Homo sapiens
tatacagatggaaagatacaca

SEQ ID NO: 8329548 - DNA, 22 bp, Homo sapiens
cagggtggcacatcacagcatt

SEQ ID NO: 8329549 - DNA, 22 bp, Homo sapiens
tatacagattaacagatttaaa

SEQ ID NO: 8329550 - DNA, 22 bp, Homo sapiens
tatacagatttctgggcaatct

SEQ ID NO: 8329551 - DNA, 21 bp, Homo sapiens
tatacagcaaagtctggagca

SEQ ID NO: 8329552 - DNA, 22 bp, Homo sapiens
tatacagctatggcaagacaaa

SEQ ID NO: 8329553 - DNA, 17 bp, Homo sapiens
caggtctgaggccaggc

SEQ ID NO: 8329554 - DNA, 22 bp, Homo sapiens
caggtctgcagacagggccatg

SEQ ID NO: 8329555 - DNA, 22 bp, Homo sapiens
caggtctgaagagtcacatgcc

SEQ ID NO: 8329556 - DNA, 22 bp, Homo sapiens
caggggcctggctgtctaggaa

SEQ ID NO: 8329557 - DNA, 22 bp, Homo sapiens
tataagaagtgaagaagagtta

SEQ ID NO: 8329558 - DNA, 23 bp, Homo sapiens
tatggcatggtacttccagcaga

SEQ ID NO: 8329559 - DNA, 22 bp, Homo sapiens
tatctgatacaacagaataaca

SEQ ID NO: 8329560 - DNA, 22 bp, Homo sapiens
tatctgaatcagttaggactct

SEQ ID NO: 8329561 - DNA, 22 bp, Homo sapiens
tatgtgtatacctatacatgtg

SEQ ID NO: 8329562 - DNA, 22 bp, Homo sapiens
tatgtttttcaagtgcacacta

SEQ ID NO: 8329563 - DNA, 22 bp, Homo sapiens
tattaaatatatctgttagttg

SEQ ID NO: 8329564 - DNA, 22 bp, Homo sapiens
tattggaaggaagcaagagagg

SEQ ID NO: 8329565 - DNA, 22 bp, Homo sapiens
catgcacaaaggtaagatgcgt

SEQ ID NO: 8329566 - DNA, 22 bp, Homo sapiens
catggccagccctgaggttcag

SEQ ID NO: 8329567 - DNA, 22 bp, Homo sapiens
catggctgaggcagaggactga

SEQ ID NO: 8329568 - DNA, 22 bp, Homo sapiens
catggctgcgagaagagtgggt

SEQ ID NO: 8329569 - DNA, 22 bp, Homo sapiens
catggctgcgagaagagtgggt

SEQ ID NO: 8329570 - DNA, 20 bp, Homo sapiens
catgcaacagattatttccc

SEQ ID NO: 8329571 - DNA, 22 bp, Homo sapiens
tccagccaggatggcccaggga

SEQ ID NO: 8329572 - DNA, 22 bp, Homo sapiens
tccagccatgcatgacaatcac

SEQ ID NO: 8329573 - DNA, 21 bp, Homo sapiens
tccagccagtaaatgctcagc

SEQ ID NO: 8329574 - DNA, 22 bp, Homo sapiens
tccagccattcattatgacacc

SEQ ID NO: 8329575 - DNA, 22 bp, Homo sapiens
catgtgaattccaaagctaggt

SEQ ID NO: 8329576 - DNA, 19 bp, Homo sapiens
catgtgcacatgtgaatgc

SEQ ID NO: 8329577 - DNA, 22 bp, Homo sapiens
catgtgcagactctgacaggct

SEQ ID NO: 8329578 - DNA, 23 bp, Homo sapiens
catgtgcaggaactgtgcttttg

SEQ ID NO: 8329579 - DNA, 22 bp, Homo sapiens
catcccattggctaaggcaaat

SEQ ID NO: 8329580 - DNA, 22 bp, Homo sapiens
catctttaaaggggagacaccc

SEQ ID NO: 8329581 - DNA, 22 bp, Homo sapiens
catctttaaaggggagacaccc

SEQ ID NO: 8329582 - DNA, 22 bp, Homo sapiens
catctttgcaccctcaaaacct

SEQ ID NO: 8329583 - DNA, 20 bp, Homo sapiens
tcagtttaaatcctggcttt

SEQ ID NO: 8329584 - DNA, 22 bp, Homo sapiens
tcatggggtgacagaagggagg

SEQ ID NO: 8329585 - DNA, 22 bp, Homo sapiens
tcatggggtttggctggatgtc

SEQ ID NO: 8329586 - DNA, 22 bp, Homo sapiens
tcatggggtagaagcatgttta

SEQ ID NO: 8329587 - DNA, 22 bp, Homo sapiens
tcatggggtgaattagtatgct

SEQ ID NO: 8329588 - DNA, 22 bp, Homo sapiens
tcatggggctcttcaagtggag

SEQ ID NO: 8329589 - DNA, 22 bp, Homo sapiens
tcatggggaaagcccgccctca

SEQ ID NO: 8329590 - DNA, 22 bp, Homo sapiens
tcatggggccacagctgccagc

SEQ ID NO: 8329591 - DNA, 21 bp, Homo sapiens
catgataatgaaggtgttatt

SEQ ID NO: 8329592 - DNA, 22 bp, Homo sapiens
catgagaagtggccttcaaaaa

SEQ ID NO: 8329593 - DNA, 22 bp, Homo sapiens
catgataacacttctgtttaat

SEQ ID NO: 8329594 - DNA, 22 bp, Homo sapiens
catgagtgtgccagtctgatat

SEQ ID NO: 8329595 - DNA, 22 bp, Homo sapiens
catatctggagactcctggtct

SEQ ID NO: 8329596 - DNA, 23 bp, Homo sapiens
catatgaattttagaggcagttt

SEQ ID NO: 8329597 - DNA, 20 bp, Homo sapiens
catatatacctagaagtgga

SEQ ID NO: 8329598 - DNA, 22 bp, Homo sapiens
catcacagaaataaacatacct

SEQ ID NO: 8329599 - DNA, 22 bp, Homo sapiens
tcagggccatcttttgcctcaa

SEQ ID NO: 8329600 - DNA, 22 bp, Homo sapiens
catccagctcctgggggccacc

SEQ ID NO: 8329601 - DNA, 22 bp, Homo sapiens
catcacagtttgtcagaaatca

SEQ ID NO: 8329602 - DNA, 22 bp, Homo sapiens
cagtttcttatcttcaaaattg

SEQ ID NO: 8329603 - DNA, 22 bp, Homo sapiens
cagtttcttagtgacacaaatc

SEQ ID NO: 8329604 - DNA, 22 bp, Homo sapiens
catacctttctcaagcacatgt

SEQ ID NO: 8329605 - DNA, 22 bp, Homo sapiens
ttaaaattatggcccatttgga

SEQ ID NO: 8329606 - DNA, 22 bp, Homo sapiens
ttaaaatgtacaggggaaagtg

SEQ ID NO: 8329607 - DNA, 22 bp, Homo sapiens
ttaaaatttccccaccatgtat

SEQ ID NO: 8329608 - DNA, 22 bp, Homo sapiens
ttaaaacagcgtgaatctggca

SEQ ID NO: 8329609 - DNA, 22 bp, Homo sapiens
ttaaaacagcgtgaatctggca

SEQ ID NO: 8329610 - DNA, 22 bp, Homo sapiens
ttaaaactgcaaatcctactga

SEQ ID NO: 8329611 - DNA, 22 bp, Homo sapiens
ttaaaactgcaaatcctactga

SEQ ID NO: 8329612 - DNA, 22 bp, Homo sapiens
ttaaaagaatcctgttatcctc

SEQ ID NO: 8329613 - DNA, 22 bp, Homo sapiens
ttaaaagagacttcctttgttt

SEQ ID NO: 8329614 - DNA, 22 bp, Homo sapiens
ttaaaaaccatcttcctttcct

SEQ ID NO: 8329615 - DNA, 22 bp, Homo sapiens
tgttttatttctccaagaggga

SEQ ID NO: 8329616 - DNA, 22 bp, Homo sapiens
tgttttatgagccatataacct

SEQ ID NO: 8329617 - DNA, 22 bp, Homo sapiens
tgttttatataagcagagcggt

SEQ ID NO: 8329618 - DNA, 22 bp, Homo sapiens
tgttttagttctgtcttgcatg

SEQ ID NO: 8329619 - DNA, 22 bp, Homo sapiens
tgttttatcaagatggcatgtc

SEQ ID NO: 8329620 - DNA, 22 bp, Homo sapiens
tgtttgttccctctctttcctg

SEQ ID NO: 8329621 - DNA, 22 bp, Homo sapiens
tgtttgtgctgcctggtgggca

SEQ ID NO: 8329622 - DNA, 22 bp, Homo sapiens
tgtttgtagagacagctgatgc

SEQ ID NO: 8329623 - DNA, 22 bp, Homo sapiens
tgtttgtatggacctgttctat

SEQ ID NO: 8329624 - DNA, 18 bp, Homo sapiens
tgtttatttttctcttac

SEQ ID NO: 8329625 - DNA, 22 bp, Homo sapiens
tgtttcaaagaaagaaaatata

SEQ ID NO: 8329626 - DNA, 22 bp, Homo sapiens
tgtttcaaagaaagaaaatata

SEQ ID NO: 8329627 - DNA, 22 bp, Homo sapiens
tgttaaatgttttgctagtgtc

SEQ ID NO: 8329628 - DNA, 22 bp, Homo sapiens
tgttaaattgattcacctttct

SEQ ID NO: 8329629 - DNA, 22 bp, Homo sapiens
tgttaacacaattctggagaga

SEQ ID NO: 8329630 - DNA, 18 bp, Homo sapiens
tgttaaatgaagatttgc

SEQ ID NO: 8329631 - DNA, 22 bp, Homo sapiens
tgttaaatgagattggaatttg

SEQ ID NO: 8329632 - DNA, 22 bp, Homo sapiens
tgttaaatgtattatgtgttct

SEQ ID NO: 8329633 - DNA, 21 bp, Homo sapiens
tgtttactccctgcaagcacg

SEQ ID NO: 8329634 - DNA, 22 bp, Homo sapiens
tgtttactcctgatatattttt

SEQ ID NO: 8329635 - DNA, 22 bp, Homo sapiens
tgtttaaatagaacatactgca

SEQ ID NO: 8329636 - DNA, 22 bp, Homo sapiens
tgtttaaatagaacatactgca

SEQ ID NO: 8329637 - DNA, 22 bp, Homo sapiens
tgtttattgctgcaattgtgcc

SEQ ID NO: 8329638 - DNA, 18 bp, Homo sapiens
tgtttattctcctgacag

SEQ ID NO: 8329639 - DNA, 22 bp, Homo sapiens
tgtggctctcctcctgctgccc

SEQ ID NO: 8329640 - DNA, 22 bp, Homo sapiens
tgtgggaggaacacagccagaa

SEQ ID NO: 8329641 - DNA, 22 bp, Homo sapiens
tgtgggccaggaggcctcagtg

SEQ ID NO: 8329642 - DNA, 22 bp, Homo sapiens
tgtgggcccagattctgaggct

SEQ ID NO: 8329643 - DNA, 22 bp, Homo sapiens
tgtgggccctaggcaccttgtc

SEQ ID NO: 8329644 - DNA, 22 bp, Homo sapiens
tgtgggcctgggaaggtgacac

SEQ ID NO: 8329645 - DNA, 22 bp, Homo sapiens
tgtgggcctcagcaggactcca

SEQ ID NO: 8329646 - DNA, 20 bp, Homo sapiens
tgtgggcccttggctggcaa

SEQ ID NO: 8329647 - DNA, 20 bp, Homo sapiens
tgtgggccttcggcgtgctc

SEQ ID NO: 8329648 - DNA, 20 bp, Homo sapiens
tgtgggcctgtgaagcggcg

SEQ ID NO: 8329649 - DNA, 22 bp, Homo sapiens
tgtgtacacaatgattgcagag

SEQ ID NO: 8329650 - DNA, 22 bp, Homo sapiens
tgtgtacacacagatatataca

SEQ ID NO: 8329651 - DNA, 23 bp, Homo sapiens
tgtgtacatacatatgtacacac

SEQ ID NO: 8329652 - DNA, 22 bp, Homo sapiens
tgtgtacaagcctgagtacaga

SEQ ID NO: 8329653 - DNA, 22 bp, Homo sapiens
tgtgtacacaagtatatataca

SEQ ID NO: 8329654 - DNA, 22 bp, Homo sapiens
tgtgcctggatctctgtgacaa

SEQ ID NO: 8329655 - DNA, 22 bp, Homo sapiens
tgtgcctggagtccctgaggag

SEQ ID NO: 8329656 - DNA, 22 bp, Homo sapiens
tgtggaaagtcaagttccagga

SEQ ID NO: 8329657 - DNA, 23 bp, Homo sapiens
tgtgctggcatctcaggctttgg

SEQ ID NO: 8329658 - DNA, 22 bp, Homo sapiens
tgtgcaatttagagacttggga

SEQ ID NO: 8329659 - DNA, 22 bp, Homo sapiens
tgtgcaatagaaagtggcatgg

SEQ ID NO: 8329660 - DNA, 20 bp, Homo sapiens
tgtgacaaaggcatatttta

SEQ ID NO: 8329661 - DNA, 22 bp, Homo sapiens
tgtgagacaggatttagagcag

SEQ ID NO: 8329662 - DNA, 22 bp, Homo sapiens
tgtgagacacactgctgcttca

SEQ ID NO: 8329663 - DNA, 20 bp, Homo sapiens
tgtgatgggttctttcctgg

SEQ ID NO: 8329664 - DNA, 22 bp, Homo sapiens
tgtgattcaagaaagtaaaatg

SEQ ID NO: 8329665 - DNA, 22 bp, Homo sapiens
tgtgagtctaggtcagggtgtt

SEQ ID NO: 8329666 - DNA, 22 bp, Homo sapiens
tgtctacttgggctctacagca

SEQ ID NO: 8329667 - DNA, 22 bp, Homo sapiens
tgtctctcctgatgatctggtg

SEQ ID NO: 8329668 - DNA, 22 bp, Homo sapiens
tgtctctcatttagttttgcac

SEQ ID NO: 8329669 - DNA, 20 bp, Homo sapiens
tgtctctcagtgtcagtgca

SEQ ID NO: 8329670 - DNA, 22 bp, Homo sapiens
tgtctcctgggtcccttccacc

SEQ ID NO: 8329671 - DNA, 22 bp, Homo sapiens
tgtctcctactgcctgtggatc

SEQ ID NO: 8329672 - DNA, 22 bp, Homo sapiens
tgtctgagtggtgcaaggctga

SEQ ID NO: 8329673 - DNA, 18 bp, Homo sapiens
tgtctgagagctgggcgc

SEQ ID NO: 8329674 - DNA, 22 bp, Homo sapiens
tgtctgaattttggaatcaagt

SEQ ID NO: 8329675 - DNA, 22 bp, Homo sapiens
tgtctgaggaagtcagcccttt

SEQ ID NO: 8329676 - DNA, 22 bp, Homo sapiens
tgtctgaatcgcttcctagagg

SEQ ID NO: 8329677 - DNA, 22 bp, Homo sapiens
tgtctgaaggcaggtggagaac

SEQ ID NO: 8329678 - DNA, 22 bp, Homo sapiens
tgtctgaatctcggtttcctca

SEQ ID NO: 8329679 - DNA, 22 bp, Homo sapiens
tgtctgaattcaagaaattcaa

SEQ ID NO: 8329680 - DNA, 22 bp, Homo sapiens
tgtctgaacaaactctgcctcc

SEQ ID NO: 8329681 - DNA, 22 bp, Homo sapiens
tgtctgaacgaagtaggtccac

SEQ ID NO: 8329682 - DNA, 22 bp, Homo sapiens
tgtctgaactgcactgaaagac

SEQ ID NO: 8329683 - DNA, 22 bp, Homo sapiens
tgtctgaagcagccagtgctgt

SEQ ID NO: 8329684 - DNA, 22 bp, Homo sapiens
tgtctgaaacttggtcctatgc

SEQ ID NO: 8329685 - DNA, 20 bp, Homo sapiens
tgtctgaaaaggaagctatc

SEQ ID NO: 8329686 - DNA, 22 bp, Homo sapiens
tgtctgaaagaggacgagctgg

SEQ ID NO: 8329687 - DNA, 22 bp, Homo sapiens
tgtctctctagctcttggtttg

SEQ ID NO: 8329688 - DNA, 22 bp, Homo sapiens
tgtctctctgcccccattgctc

SEQ ID NO: 8329689 - DNA, 22 bp, Homo sapiens
tgtgaaaagcgtgtgttctagg

SEQ ID NO: 8329690 - DNA, 22 bp, Homo sapiens
tgtcttggattatctgtgcaac

SEQ ID NO: 8329691 - DNA, 22 bp, Homo sapiens
tgtcttggccactaggagtgcc

SEQ ID NO: 8329692 - DNA, 22 bp, Homo sapiens
tgtcttggctctggagggggat

SEQ ID NO: 8329693 - DNA, 22 bp, Homo sapiens
tgtcttggttcttctgaaacac

SEQ ID NO: 8329694 - DNA, 23 bp, Homo sapiens
tgtcttggtttcttcaccctagt

SEQ ID NO: 8329695 - DNA, 22 bp, Homo sapiens
tgtcttatgctgcatagactat

SEQ ID NO: 8329696 - DNA, 22 bp, Homo sapiens
ttcacatttgcccttatgtgtg

SEQ ID NO: 8329697 - DNA, 20 bp, Homo sapiens
ttcacatttctgtagtgatt

SEQ ID NO: 8329698 - DNA, 22 bp, Homo sapiens
ttatttcctctctaatagggta

SEQ ID NO: 8329699 - DNA, 22 bp, Homo sapiens
ttatttcctgacacagctgatt

SEQ ID NO: 8329700 - DNA, 22 bp, Homo sapiens
ttatttgaatgatggcacaatt

SEQ ID NO: 8329701 - DNA, 22 bp, Homo sapiens
ttatttgaaaagaaggttacgt

SEQ ID NO: 8329702 - DNA, 22 bp, Homo sapiens
ttatttggaaatatggcttctg

SEQ ID NO: 8329703 - DNA, 21 bp, Homo sapiens
ttcagcagtcctctagagata

SEQ ID NO: 8329704 - DNA, 22 bp, Homo sapiens
ttcagcagtttctgagaagcaa

SEQ ID NO: 8329705 - DNA, 19 bp, Homo sapiens
ttcagcagtgtctgctctt

SEQ ID NO: 8329706 - DNA, 22 bp, Homo sapiens
ttcactataaagtttcaacttt

SEQ ID NO: 8329707 - DNA, 22 bp, Homo sapiens
ttcagcttgctgactgcggcag

SEQ ID NO: 8329708 - DNA, 17 bp, Homo sapiens
ttcattaataaaagcaa

SEQ ID NO: 8329709 - DNA, 17 bp, Homo sapiens
ttcattaataaaagcaa

SEQ ID NO: 8329710 - DNA, 17 bp, Homo sapiens
ttcattaataaaagcaa

SEQ ID NO: 8329711 - DNA, 22 bp, Homo sapiens
ttcattaattcattcagtgact

SEQ ID NO: 8329712 - DNA, 22 bp, Homo sapiens
ttaatacagtctccagaagtaa

SEQ ID NO: 8329713 - DNA, 21 bp, Homo sapiens
ttaatgctatgcagaaaatct

SEQ ID NO: 8329714 - DNA, 22 bp, Homo sapiens
ttaataagtagtagttattgtt

SEQ ID NO: 8329715 - DNA, 22 bp, Homo sapiens
ttaatacaactgttgtcactgg

SEQ ID NO: 8329716 - DNA, 22 bp, Homo sapiens
ttaataaagtatgaattggaaa

SEQ ID NO: 8329717 - DNA, 22 bp, Homo sapiens
ttaataaagtatgaattggaaa

SEQ ID NO: 8329718 - DNA, 22 bp, Homo sapiens
ttaaagatgcagctttagagaa

SEQ ID NO: 8329719 - DNA, 22 bp, Homo sapiens
ttaaagattctgaggctgatta

SEQ ID NO: 8329720 - DNA, 22 bp, Homo sapiens
ttaaagagggaaagacttcaga

SEQ ID NO: 8329721 - DNA, 22 bp, Homo sapiens
ttaaagaggcatgggaatgtat

SEQ ID NO: 8329722 - DNA, 22 bp, Homo sapiens
ttaaagagaactcaatgaatga

SEQ ID NO: 8329723 - DNA, 22 bp, Homo sapiens
ttacaaagttctgagttcaaac

SEQ ID NO: 8329724 - DNA, 22 bp, Homo sapiens
ttacaaagtgttatgataaaca

SEQ ID NO: 8329725 - DNA, 22 bp, Homo sapiens
ttacaaagttctgagttcaaac

SEQ ID NO: 8329726 - DNA, 22 bp, Homo sapiens
ttacaaagtgctgcaccatttt

SEQ ID NO: 8329727 - DNA, 22 bp, Homo sapiens
ttacaaaggtagttttgtctat

SEQ ID NO: 8329728 - DNA, 22 bp, Homo sapiens
ttacaaagagaagttgtagaat

SEQ ID NO: 8329729 - DNA, 20 bp, Homo sapiens
ttacaaagaggcatcgcttt

SEQ ID NO: 8329730 - DNA, 22 bp, Homo sapiens
ttaattaattagttaagcatgt

SEQ ID NO: 8329731 - DNA, 22 bp, Homo sapiens
ttaattaaattcatgagcattg

SEQ ID NO: 8329732 - DNA, 22 bp, Homo sapiens
ttaattaactagccaaccacta

SEQ ID NO: 8329733 - DNA, 22 bp, Homo sapiens
ttaattaagagatactgcagta

SEQ ID NO: 8329734 - DNA, 21 bp, Homo sapiens
ttacaacatttgtgttctatg

SEQ ID NO: 8329735 - DNA, 22 bp, Homo sapiens
ttacaacatatttagcttgatt

SEQ ID NO: 8329736 - DNA, 17 bp, Homo sapiens
ttacaacaattcatgag

SEQ ID NO: 8329737 - DNA, 17 bp, Homo sapiens
ttacaacaattcatgag

SEQ ID NO: 8329738 - DNA, 22 bp, Homo sapiens
ttacaacaccaggcagtatcct

SEQ ID NO: 8329739 - DNA, 22 bp, Homo sapiens
ttacaacactacttatccttga

SEQ ID NO: 8329740 - DNA, 22 bp, Homo sapiens
ttacatgttctcatacacagag

SEQ ID NO: 8329741 - DNA, 22 bp, Homo sapiens
ttacatgtggtgtgaagaagag

SEQ ID NO: 8329742 - DNA, 22 bp, Homo sapiens
ttacatgatgatttcataaaca

SEQ ID NO: 8329743 - DNA, 22 bp, Homo sapiens
ttacagcagtgggaaggagtca

SEQ ID NO: 8329744 - DNA, 22 bp, Homo sapiens
ttacagattaaaatgctgaggt

SEQ ID NO: 8329745 - DNA, 22 bp, Homo sapiens
ttacaattgagtctattgtatg

SEQ ID NO: 8329746 - DNA, 22 bp, Homo sapiens
ttacaattgagtctattgtatg

SEQ ID NO: 8329747 - DNA, 22 bp, Homo sapiens
ttacaagtactgaatatgattt

SEQ ID NO: 8329748 - DNA, 22 bp, Homo sapiens
ttacagaaaatgtgttttaact

SEQ ID NO: 8329749 - DNA, 20 bp, Homo sapiens
ttacactttgtagcattttt

SEQ ID NO: 8329750 - DNA, 22 bp, Homo sapiens
ttacacaaaagcaagtgtgtgt

SEQ ID NO: 8329751 - DNA, 22 bp, Homo sapiens
ttacacaaaaataagatatggc

SEQ ID NO: 8329752 - DNA, 22 bp, Homo sapiens
ttacagagtagggaattgaagt

SEQ ID NO: 8329753 - DNA, 22 bp, Homo sapiens
ttacagagtagtgcagaactca

SEQ ID NO: 8329754 - DNA, 22 bp, Homo sapiens
ttacagagtggtctggctatgt

SEQ ID NO: 8329755 - DNA, 22 bp, Homo sapiens
ttacagagttcgcacctggtgg

SEQ ID NO: 8329756 - DNA, 22 bp, Homo sapiens
ttacagatactttgtaggcaag

SEQ ID NO: 8329757 - DNA, 22 bp, Homo sapiens
ttacagagaggtgattgtgaag

SEQ ID NO: 8329758 - DNA, 22 bp, Homo sapiens
ttacagagaggtgattgtgaag

SEQ ID NO: 8329759 - DNA, 22 bp, Homo sapiens
ttacagagcctcattttagaga

SEQ ID NO: 8329760 - DNA, 22 bp, Homo sapiens
ttacagagataaactgtaagtg

SEQ ID NO: 8329761 - DNA, 22 bp, Homo sapiens
ttacagaggcttccagggccca

SEQ ID NO: 8329762 - DNA, 22 bp, Homo sapiens
ttacagagctgggtggagagag

SEQ ID NO: 8329763 - DNA, 22 bp, Homo sapiens
ttacagagctcatttctaaggg

SEQ ID NO: 8329764 - DNA, 22 bp, Homo sapiens
ttacagaggtatgtatgtctct

SEQ ID NO: 8329765 - DNA, 17 bp, Homo sapiens
ttacagaggtaattaag

SEQ ID NO: 8329766 - DNA, 17 bp, Homo sapiens
ttacagaggtaattaag

SEQ ID NO: 8329767 - DNA, 22 bp, Homo sapiens
ttacagagggcttctctgaact

SEQ ID NO: 8329768 - DNA, 22 bp, Homo sapiens
ttagtcaatagtgaatatagag

SEQ ID NO: 8329769 - DNA, 22 bp, Homo sapiens
ttagtcaaatcattctgtttct

SEQ ID NO: 8329770 - DNA, 22 bp, Homo sapiens
ttagtctccagcttagggtttg

SEQ ID NO: 8329771 - DNA, 22 bp, Homo sapiens
ttagtgatcaaaatcaaaattg

SEQ ID NO: 8329772 - DNA, 22 bp, Homo sapiens
ttatattagttagacttgctgt

SEQ ID NO: 8329773 - DNA, 22 bp, Homo sapiens
ttatctgaaaacctcaaaatat

SEQ ID NO: 8329774 - DNA, 22 bp, Homo sapiens
ttatcttggtgttttagtaatt

SEQ ID NO: 8329775 - DNA, 22 bp, Homo sapiens
ttatgagactgttttacacact

SEQ ID NO: 8329776 - DNA, 22 bp, Homo sapiens
ttatgatttgccacagattggt

SEQ ID NO: 8329777 - DNA, 22 bp, Homo sapiens
ttatgatttgccacagattggt

SEQ ID NO: 8329778 - DNA, 22 bp, Homo sapiens
ttatgcaaagaaatagactaat

SEQ ID NO: 8329779 - DNA, 22 bp, Homo sapiens
ttattattccccaagtcattat

SEQ ID NO: 8329780 - DNA, 22 bp, Homo sapiens
ttattattgattcgctctcaaa

SEQ ID NO: 8329781 - DNA, 22 bp, Homo sapiens
ttatttatggccctcacctgat

SEQ ID NO: 8329782 - DNA, 22 bp, Homo sapiens
ttagtaattagaaagtaattct

SEQ ID NO: 8329783 - DNA, 22 bp, Homo sapiens
ttagggttacaccagcctcctg

SEQ ID NO: 8329784 - DNA, 22 bp, Homo sapiens
ttagggttacaccagcctcctg

SEQ ID NO: 8329785 - DNA, 22 bp, Homo sapiens
ttagaaatacaagtgaggttga

SEQ ID NO: 8329786 - DNA, 22 bp, Homo sapiens
ttagaaaggggtgaatcaatgg

SEQ ID NO: 8329787 - DNA, 22 bp, Homo sapiens
ttagaaaggggtgaatcaatgg

SEQ ID NO: 8329788 - DNA, 22 bp, Homo sapiens
ttagaaatcacctctgaagatc

SEQ ID NO: 8329789 - DNA, 22 bp, Homo sapiens
ttagaaatgtcacagatctgat

SEQ ID NO: 8329790 - DNA, 22 bp, Homo sapiens
ttagataatgttattgtaattt

SEQ ID NO: 8329791 - DNA, 22 bp, Homo sapiens
ttagataatgttattgtaattt

SEQ ID NO: 8329792 - DNA, 22 bp, Homo sapiens
ttagataatgtagagatatgag

SEQ ID NO: 8329793 - DNA, 22 bp, Homo sapiens
ttagataacagtagaatatcaa

SEQ ID NO: 8329794 - DNA, 22 bp, Homo sapiens
ttagatacattctcatttgttt

SEQ ID NO: 8329795 - DNA, 22 bp, Homo sapiens
tgggccagtttctcattgaaat

SEQ ID NO: 8329796 - DNA, 22 bp, Homo sapiens
tgggcctcaccttcttggcagc

SEQ ID NO: 8329797 - DNA, 22 bp, Homo sapiens
tgggccagtcctgcctaaggtg

SEQ ID NO: 8329798 - DNA, 21 bp, Homo sapiens
tgggccagtagaaaggaaggc

SEQ ID NO: 8329799 - DNA, 22 bp, Homo sapiens
tgggccaggtgcagtgctttag

SEQ ID NO: 8329800 - DNA, 17 bp, Homo sapiens
tgggccagtagaaggga

SEQ ID NO: 8329801 - DNA, 22 bp, Homo sapiens
tgggccagtagctactcgcaag

SEQ ID NO: 8329802 - DNA, 22 bp, Homo sapiens
tgggccagtccagccccaggga

SEQ ID NO: 8329803 - DNA, 22 bp, Homo sapiens
tgggccagggcacccagtccag

SEQ ID NO: 8329804 - DNA, 22 bp, Homo sapiens
tgggccaggcatgtgatcagca

SEQ ID NO: 8329805 - DNA, 22 bp, Homo sapiens
tgggccaggtctgtgtcagctg

SEQ ID NO: 8329806 - DNA, 22 bp, Homo sapiens
tgggcctgaaggagctgcgccc

SEQ ID NO: 8329807 - DNA, 22 bp, Homo sapiens
tgggcctgactcacctgcctcc

SEQ ID NO: 8329808 - DNA, 22 bp, Homo sapiens
tgggcctgagctcaccaggggc

SEQ ID NO: 8329809 - DNA, 22 bp, Homo sapiens
tgggcctgggctggacagcctg

SEQ ID NO: 8329810 - DNA, 22 bp, Homo sapiens
tgggcctgggctcctgtcctct

SEQ ID NO: 8329811 - DNA, 20 bp, Homo sapiens
tgggcctgtggcagaagtct

SEQ ID NO: 8329812 - DNA, 22 bp, Homo sapiens
tgggcgacagagcaagactccg

SEQ ID NO: 8329813 - DNA, 22 bp, Homo sapiens
tgggctctggtttcctggctgg

SEQ ID NO: 8329814 - DNA, 22 bp, Homo sapiens
tgggctgcaccctcagcctctg

SEQ ID NO: 8329815 - DNA, 22 bp, Homo sapiens
tgggctgcaggggttgagagct

SEQ ID NO: 8329816 - DNA, 22 bp, Homo sapiens
tgggctgcccaaggtggccatg

SEQ ID NO: 8329817 - DNA, 20 bp, Homo sapiens
tgggctctgcttcctggagt

SEQ ID NO: 8329818 - DNA, 22 bp, Homo sapiens
tgggctctgggtggcctgagca

SEQ ID NO: 8329819 - DNA, 22 bp, Homo sapiens
tgggctctggaattgagtggcc

SEQ ID NO: 8329820 - DNA, 22 bp, Homo sapiens
tgggctctggagggcctaggat

SEQ ID NO: 8329821 - DNA, 22 bp, Homo sapiens
tgggctctctcacctggaggct

SEQ ID NO: 8329822 - DNA, 22 bp, Homo sapiens
tgggctctcaaagtgcggcttg

SEQ ID NO: 8329823 - DNA, 22 bp, Homo sapiens
tgggccagctgaagtgccgccc

SEQ ID NO: 8329824 - DNA, 22 bp, Homo sapiens
tgggccagctccctgcccctgg

SEQ ID NO: 8329825 - DNA, 22 bp, Homo sapiens
tgggcagcagaaccaggccgac

SEQ ID NO: 8329826 - DNA, 22 bp, Homo sapiens
tgggcagggatctcttttgcaa

SEQ ID NO: 8329827 - DNA, 22 bp, Homo sapiens
tgggcagggagctggaaccaca

SEQ ID NO: 8329828 - DNA, 22 bp, Homo sapiens
tgggcagggagctggaaccaca

SEQ ID NO: 8329829 - DNA, 23 bp, Homo sapiens
tgggcagcttctgcatgcccacc

SEQ ID NO: 8329830 - DNA, 23 bp, Homo sapiens
tgggcagcttctgcatgcccacc

SEQ ID NO: 8329831 - DNA, 22 bp, Homo sapiens
tgggcaagggacaggcctggct

SEQ ID NO: 8329832 - DNA, 22 bp, Homo sapiens
tgggatgggatctcgctgtgtc

SEQ ID NO: 8329833 - DNA, 22 bp, Homo sapiens
tgggatggcatcctgggccttg

SEQ ID NO: 8329834 - DNA, 22 bp, Homo sapiens
tgggatggcatcctgggccttg

SEQ ID NO: 8329835 - DNA, 17 bp, Homo sapiens
tgggatccgtctctgtg

SEQ ID NO: 8329836 - DNA, 22 bp, Homo sapiens
tgggatgaatacaatgggatca

SEQ ID NO: 8329837 - DNA, 22 bp, Homo sapiens
tgggagtgcacctgggacacga

SEQ ID NO: 8329838 - DNA, 22 bp, Homo sapiens
tgggagtgatacagtatggaat

SEQ ID NO: 8329839 - DNA, 22 bp, Homo sapiens
tgggaggcaggtaggtgatgat

SEQ ID NO: 8329840 - DNA, 22 bp, Homo sapiens
tgggaggcaggtaggtgatgat

SEQ ID NO: 8329841 - DNA, 22 bp, Homo sapiens
tgggaggccaaggcaggcggat

SEQ ID NO: 8329842 - DNA, 22 bp, Homo sapiens
tgggaggccgaggcaggtggat

SEQ ID NO: 8329843 - DNA, 22 bp, Homo sapiens
tggggctaacgagagagcagag

SEQ ID NO: 8329844 - DNA, 22 bp, Homo sapiens
tggggcctgaggtggagctgca

SEQ ID NO: 8329845 - DNA, 22 bp, Homo sapiens
tggggcctggtcagagctgcac

SEQ ID NO: 8329846 - DNA, 23 bp, Homo sapiens
tggggctgatggagacggaccag

SEQ ID NO: 8329847 - DNA, 22 bp, Homo sapiens
tggggctgaggagcctcactct

SEQ ID NO: 8329848 - DNA, 22 bp, Homo sapiens
tggggctgaggagcctcactct

SEQ ID NO: 8329849 - DNA, 23 bp, Homo sapiens
tggggctctggcaggcctgaggt

SEQ ID NO: 8329850 - DNA, 22 bp, Homo sapiens
tggggctcctcctggcaggagg

SEQ ID NO: 8329851 - DNA, 22 bp, Homo sapiens
tggggccaggtggctgcaggtc

SEQ ID NO: 8329852 - DNA, 22 bp, Homo sapiens
tggggccagggaggaccagaca

SEQ ID NO: 8329853 - DNA, 22 bp, Homo sapiens
tggggccagcggggaggactca

SEQ ID NO: 8329854 - DNA, 22 bp, Homo sapiens
tggggccagcggggaggactca

SEQ ID NO: 8329855 - DNA, 22 bp, Homo sapiens
tggggcacagctgagaaagcac

SEQ ID NO: 8329856 - DNA, 22 bp, Homo sapiens
tggggcagagtaggattttggc

SEQ ID NO: 8329857 - DNA, 22 bp, Homo sapiens
tggggcagcagacctttcttgg

SEQ ID NO: 8329858 - DNA, 22 bp, Homo sapiens
tggggccacagcctcctagctt

SEQ ID NO: 8329859 - DNA, 22 bp, Homo sapiens
tggggccagagctgcagggagc

SEQ ID NO: 8329860 - DNA, 22 bp, Homo sapiens
tggggccagagatggggcgcag

SEQ ID NO: 8329861 - DNA, 22 bp, Homo sapiens
tggggctggcacagtctctatt

SEQ ID NO: 8329862 - DNA, 22 bp, Homo sapiens
tggggctggctattgtctccct

SEQ ID NO: 8329863 - DNA, 22 bp, Homo sapiens
tggggctgtcccggtttggcga

SEQ ID NO: 8329864 - DNA, 22 bp, Homo sapiens
tggggctggggatcttgagcct

SEQ ID NO: 8329865 - DNA, 22 bp, Homo sapiens
tggggctggggatcttgagcct

SEQ ID NO: 8329866 - DNA, 22 bp, Homo sapiens
tgggggagattgtgcatctcta

SEQ ID NO: 8329867 - DNA, 22 bp, Homo sapiens
tgggggagattgtgcatctcta

SEQ ID NO: 8329868 - DNA, 22 bp, Homo sapiens
tgggggagatagagtctgatgg

SEQ ID NO: 8329869 - DNA, 22 bp, Homo sapiens
tggggctgtccttagtctgaga

SEQ ID NO: 8329870 - DNA, 22 bp, Homo sapiens
tgggggagagtgcaagcatgaa

SEQ ID NO: 8329871 - DNA, 22 bp, Homo sapiens
tgggggagagtgcaagcatgaa

SEQ ID NO: 8329872 - DNA, 22 bp, Homo sapiens
tgggggagccttcacagtagct

SEQ ID NO: 8329873 - DNA, 22 bp, Homo sapiens
tgggggagcgacagacataatt

SEQ ID NO: 8329874 - DNA, 22 bp, Homo sapiens
tgggggagtatagtctggcctc

SEQ ID NO: 8329875 - DNA, 22 bp, Homo sapiens
tgggggagtatagtctggcctc

SEQ ID NO: 8329876 - DNA, 22 bp, Homo sapiens
tgggggagctcagtccagccca

SEQ ID NO: 8329877 - DNA, 22 bp, Homo sapiens
tgggggcacttcgaggtcgcct

SEQ ID NO: 8329878 - DNA, 22 bp, Homo sapiens
tgggggcacttcgaggtcgcct

SEQ ID NO: 8329879 - DNA, 22 bp, Homo sapiens
tgggggctccaggctccaggga

SEQ ID NO: 8329880 - DNA, 22 bp, Homo sapiens
tgggggctccaggctccaggga

SEQ ID NO: 8329881 - DNA, 22 bp, Homo sapiens
tgggggctgagtaagatgagat

SEQ ID NO: 8329882 - DNA, 22 bp, Homo sapiens
tgggggcatggaccagcctggc

SEQ ID NO: 8329883 - DNA, 22 bp, Homo sapiens
tgggggcagccaggctgtcaag

SEQ ID NO: 8329884 - DNA, 22 bp, Homo sapiens
tgggggcagaggattcaggaat

SEQ ID NO: 8329885 - DNA, 22 bp, Homo sapiens
tgggcttaggtcggaggcggcc

SEQ ID NO: 8329886 - DNA, 22 bp, Homo sapiens
tggggaaaatgcttgtagtcag

SEQ ID NO: 8329887 - DNA, 22 bp, Homo sapiens
tggggaaaatgcagaagattac

SEQ ID NO: 8329888 - DNA, 22 bp, Homo sapiens
tggggaaaacagaggaaattag

SEQ ID NO: 8329889 - DNA, 22 bp, Homo sapiens
tggggaaaagcgttaggagttc

SEQ ID NO: 8329890 - DNA, 22 bp, Homo sapiens
tggggacacagagccaaactat

SEQ ID NO: 8329891 - DNA, 22 bp, Homo sapiens
tggggacacagagccaaactat

SEQ ID NO: 8329892 - DNA, 22 bp, Homo sapiens
tggggacacagagccaaactat

SEQ ID NO: 8329893 - DNA, 22 bp, Homo sapiens
tggggacacagaggttcgttgg

SEQ ID NO: 8329894 - DNA, 22 bp, Homo sapiens
tggggacaggagacttacagct

SEQ ID NO: 8329895 - DNA, 22 bp, Homo sapiens
tggggaagggcaccctggagac

SEQ ID NO: 8329896 - DNA, 22 bp, Homo sapiens
tggggaaggcggagcttgcagc

SEQ ID NO: 8329897 - DNA, 17 bp, Homo sapiens
tggggaagctcagattt

SEQ ID NO: 8329898 - DNA, 22 bp, Homo sapiens
tggggaaactatttccttgtcc

SEQ ID NO: 8329899 - DNA, 22 bp, Homo sapiens
tggggaaagatagttttctcta

SEQ ID NO: 8329900 - DNA, 22 bp, Homo sapiens
tggggaaagacattcatacagt

SEQ ID NO: 8329901 - DNA, 22 bp, Homo sapiens
tggggaaagttcttgaaagtaa

SEQ ID NO: 8329902 - DNA, 22 bp, Homo sapiens
tggggaaaggagagcattattt

SEQ ID NO: 8329903 - DNA, 22 bp, Homo sapiens
tggggaaagggatggctcccgc

SEQ ID NO: 8329904 - DNA, 20 bp, Homo sapiens
tggggaaagccatcgatgag

SEQ ID NO: 8329905 - DNA, 22 bp, Homo sapiens
tggggaaaggaaagttaacctg

SEQ ID NO: 8329906 - DNA, 22 bp, Homo sapiens
tggggaagacagcagacactgt

SEQ ID NO: 8329907 - DNA, 22 bp, Homo sapiens
tggggaaatgtcctgccttccc

SEQ ID NO: 8329908 - DNA, 22 bp, Homo sapiens
tggggaggatatgtgagttatt

SEQ ID NO: 8329909 - DNA, 22 bp, Homo sapiens
tggggaggatatgtgagttatt

SEQ ID NO: 8329910 - DNA, 22 bp, Homo sapiens
tggggaggacgggcgccttcct

SEQ ID NO: 8329911 - DNA, 22 bp, Homo sapiens
tggggaggacgggcgccttcct

SEQ ID NO: 8329912 - DNA, 23 bp, Homo sapiens
tggggagggaagtcatttctgta

SEQ ID NO: 8329913 - DNA, 23 bp, Homo sapiens
tggggagggaagtcatttctgta

SEQ ID NO: 8329914 - DNA, 21 bp, Homo sapiens
tggggaggggacctgattatg

SEQ ID NO: 8329915 - DNA, 22 bp, Homo sapiens
tggggacatagccagtctggct

SEQ ID NO: 8329916 - DNA, 22 bp, Homo sapiens
tggggacattcatgcaggttgt

SEQ ID NO: 8329917 - DNA, 22 bp, Homo sapiens
tggggacattcatgcaggttgt

SEQ ID NO: 8329918 - DNA, 22 bp, Homo sapiens
tggggacaggagacttacagct

SEQ ID NO: 8329919 - DNA, 22 bp, Homo sapiens
tggggacagggctcagcaattt

SEQ ID NO: 8329920 - DNA, 22 bp, Homo sapiens
tggggacagggctcagcaattt

SEQ ID NO: 8329921 - DNA, 22 bp, Homo sapiens
tggggaggaagtcagatttcag

SEQ ID NO: 8329922 - DNA, 22 bp, Homo sapiens
tggggaggaagtcagatttcag

SEQ ID NO: 8329923 - DNA, 22 bp, Homo sapiens
tggggaccagattagaccatgg

SEQ ID NO: 8329924 - DNA, 22 bp, Homo sapiens
tggggacgtactgagaggtccg

SEQ ID NO: 8329925 - DNA, 22 bp, Homo sapiens
tggggacccggactcctgggtc

SEQ ID NO: 8329926 - DNA, 22 bp, Homo sapiens
tggggaggttcgggaatcttgt

SEQ ID NO: 8329927 - DNA, 22 bp, Homo sapiens
tggggaggttcgggaatcttgt

SEQ ID NO: 8329928 - DNA, 21 bp, Homo sapiens
tggggaggggacctgattatg

SEQ ID NO: 8329929 - DNA, 22 bp, Homo sapiens
tggggaggtaacaatttcaggc

SEQ ID NO: 8329930 - DNA, 22 bp, Homo sapiens
tggggaggtaacaatttcaggc

SEQ ID NO: 8329931 - DNA, 22 bp, Homo sapiens
tggggatgtaaatgaggtgata

SEQ ID NO: 8329932 - DNA, 22 bp, Homo sapiens
tggggatgtaaatgaggtgata

SEQ ID NO: 8329933 - DNA, 22 bp, Homo sapiens
tggggatgtaaatgaggtgata

SEQ ID NO: 8329934 - DNA, 16 bp, Homo sapiens
tggggatggggaagag

SEQ ID NO: 8329935 - DNA, 22 bp, Homo sapiens
tggggagtgatgcctcggataa

SEQ ID NO: 8329936 - DNA, 19 bp, Homo sapiens
tggggatgctgatgaccaa

SEQ ID NO: 8329937 - DNA, 22 bp, Homo sapiens
tgggtgctctgcgaccgtaggg

SEQ ID NO: 8329938 - DNA, 22 bp, Homo sapiens
tgggtgaggatgatgaggcagc

SEQ ID NO: 8329939 - DNA, 22 bp, Homo sapiens
tgggtgaggatgatgaggcagc

SEQ ID NO: 8329940 - DNA, 22 bp, Homo sapiens
tgggtgagggacaaaagtttct

SEQ ID NO: 8329941 - DNA, 22 bp, Homo sapiens
tgggtgagtggagggcattcta

SEQ ID NO: 8329942 - DNA, 22 bp, Homo sapiens
tgggtgagtggagggcattcta

SEQ ID NO: 8329943 - DNA, 22 bp, Homo sapiens
tgggtgagtgggaaaagcccag

SEQ ID NO: 8329944 - DNA, 22 bp, Homo sapiens
tgggtgagcggctgcacacccg

SEQ ID NO: 8329945 - DNA, 22 bp, Homo sapiens
tgggtgaggagaggctgtctaa

SEQ ID NO: 8329946 - DNA, 20 bp, Homo sapiens
tgggtgagagtgtttgctct

SEQ ID NO: 8329947 - DNA, 22 bp, Homo sapiens
tggtagtcggcctcggtggctc

SEQ ID NO: 8329948 - DNA, 22 bp, Homo sapiens
tggtcaagggacagagctgaac

SEQ ID NO: 8329949 - DNA, 22 bp, Homo sapiens
tggtaagataagagccaggcct

SEQ ID NO: 8329950 - DNA, 22 bp, Homo sapiens
tggtaagaataggggctttgga

SEQ ID NO: 8329951 - DNA, 19 bp, Homo sapiens
tggtaactgcatctccaga

SEQ ID NO: 8329952 - DNA, 22 bp, Homo sapiens
tggtaacacaggcattaaagtt

SEQ ID NO: 8329953 - DNA, 19 bp, Homo sapiens
tgggttggaagggaatgaa

SEQ ID NO: 8329954 - DNA, 22 bp, Homo sapiens
tgggttggaagcaggaggcacc

SEQ ID NO: 8329955 - DNA, 22 bp, Homo sapiens
tggggtgggcatgcgctgtcct

SEQ ID NO: 8329956 - DNA, 22 bp, Homo sapiens
tggggtgtgctcagagcagggg

SEQ ID NO: 8329957 - DNA, 22 bp, Homo sapiens
tggggtgtgagaagtagaggga

SEQ ID NO: 8329958 - DNA, 22 bp, Homo sapiens
tggggtggaacccttctgctgg

SEQ ID NO: 8329959 - DNA, 22 bp, Homo sapiens
tggggtgaggcagccacattta

SEQ ID NO: 8329960 - DNA, 22 bp, Homo sapiens
tggggtgacagtgcagtggtca

SEQ ID NO: 8329961 - DNA, 22 bp, Homo sapiens
tggggtgagattcagatattca

SEQ ID NO: 8329962 - DNA, 22 bp, Homo sapiens
tggggtggatagaaagtgatgt

SEQ ID NO: 8329963 - DNA, 22 bp, Homo sapiens
tggggtgaatctttgttgtccg

SEQ ID NO: 8329964 - DNA, 18 bp, Homo sapiens
tggggtctctcaggtaag

SEQ ID NO: 8329965 - DNA, 20 bp, Homo sapiens
tggggtctagttggcctggg

SEQ ID NO: 8329966 - DNA, 22 bp, Homo sapiens
tggggtcgagggttctctggca

SEQ ID NO: 8329967 - DNA, 22 bp, Homo sapiens
tgggggtggttcttgcctccag

SEQ ID NO: 8329968 - DNA, 22 bp, Homo sapiens
tgggggtgccctatgaggaagc

SEQ ID NO: 8329969 - DNA, 23 bp, Homo sapiens
tgggggtgcacgggccacatctt

SEQ ID NO: 8329970 - DNA, 21 bp, Homo sapiens
tgggggtgaggcctaggaatc

SEQ ID NO: 8329971 - DNA, 22 bp, Homo sapiens
tgggggctgtgcacaggctcac

SEQ ID NO: 8329972 - DNA, 22 bp, Homo sapiens
tgggggctgtgcacaggctcac

SEQ ID NO: 8329973 - DNA, 22 bp, Homo sapiens
tgggggtgaaagtctggacagt

SEQ ID NO: 8329974 - DNA, 22 bp, Homo sapiens
tggggttgcctcccgccctgga

SEQ ID NO: 8329975 - DNA, 22 bp, Homo sapiens
tggggttgaagaaaggatctag

SEQ ID NO: 8329976 - DNA, 23 bp, Homo sapiens
tggggttgaattgtagctgtgcc

SEQ ID NO: 8329977 - DNA, 22 bp, Homo sapiens
tgggtccatggaacagaggtgc

SEQ ID NO: 8329978 - DNA, 22 bp, Homo sapiens
tgtatacaggattactcatagc

SEQ ID NO: 8329979 - DNA, 22 bp, Homo sapiens
tgtatcccctgcaggttgctat

SEQ ID NO: 8329980 - DNA, 22 bp, Homo sapiens
tgtagaaagctcttctgaaatc

SEQ ID NO: 8329981 - DNA, 22 bp, Homo sapiens
tgtagaaattagtaagatcaac

SEQ ID NO: 8329982 - DNA, 22 bp, Homo sapiens
tgtagaaattagtaagatcaac

SEQ ID NO: 8329983 - DNA, 22 bp, Homo sapiens
tgtagaaactacacatgcaaca

SEQ ID NO: 8329984 - DNA, 22 bp, Homo sapiens
tgtagaaagaatatgtttcata

SEQ ID NO: 8329985 - DNA, 18 bp, Homo sapiens
tgtagaaaagataggaat

SEQ ID NO: 8329986 - DNA, 22 bp, Homo sapiens
tgtagaaaattggagcattcat

SEQ ID NO: 8329987 - DNA, 22 bp, Homo sapiens
tgtagaaaattggagcattcat

SEQ ID NO: 8329988 - DNA, 18 bp, Homo sapiens
tgtagaaaagataggaat

SEQ ID NO: 8329989 - DNA, 22 bp, Homo sapiens
tgtagatacacacatatagtgg

SEQ ID NO: 8329990 - DNA, 22 bp, Homo sapiens
tgtagctctccagccagcaagg

SEQ ID NO: 8329991 - DNA, 18 bp, Homo sapiens
tgtagctggaggccaggc

SEQ ID NO: 8329992 - DNA, 22 bp, Homo sapiens
tgtaggaagatataaaatatct

SEQ ID NO: 8329993 - DNA, 22 bp, Homo sapiens
tgtcacagatcgtttttgagct

SEQ ID NO: 8329994 - DNA, 22 bp, Homo sapiens
tgtcacataatttatctgtagg

SEQ ID NO: 8329995 - DNA, 22 bp, Homo sapiens
tgtcacatgaaacttgctcatc

SEQ ID NO: 8329996 - DNA, 22 bp, Homo sapiens
tgtcacattgaatatgatttat

SEQ ID NO: 8329997 - DNA, 22 bp, Homo sapiens
tgtatttttagacctttagacc

SEQ ID NO: 8329998 - DNA, 22 bp, Homo sapiens
tgtatttttagacctttagacc

SEQ ID NO: 8329999 - DNA, 22 bp, Homo sapiens
tgtatttttaggaatgcgctat

SEQ ID NO: 8330000 - DNA, 22 bp, Homo sapiens
tgtattcttagttttaatcaga

SEQ ID NO: 8330001 - DNA, 22 bp, Homo sapiens
tgtatttaattgtatcatcaca

SEQ ID NO: 8330002 - DNA, 22 bp, Homo sapiens
tgtatttatattagaatggttg

SEQ ID NO: 8330003 - DNA, 22 bp, Homo sapiens
tgtattttctgaagataatcaa

SEQ ID NO: 8330004 - DNA, 22 bp, Homo sapiens
tgtattttctgaggagcattag

SEQ ID NO: 8330005 - DNA, 22 bp, Homo sapiens
tgtattttctgaggagcattag

SEQ ID NO: 8330006 - DNA, 22 bp, Homo sapiens
tgtattttctgaggagcattag

SEQ ID NO: 8330007 - DNA, 22 bp, Homo sapiens
tgtattttcagagtggcatttc

SEQ ID NO: 8330008 - DNA, 22 bp, Homo sapiens
tgtattttgtgaggatcactct

SEQ ID NO: 8330009 - DNA, 22 bp, Homo sapiens
tgtcctcacaggaatgaacttt

SEQ ID NO: 8330010 - DNA, 22 bp, Homo sapiens
tgtcctggccaaggccttgctt

SEQ ID NO: 8330011 - DNA, 22 bp, Homo sapiens
tgtcctcagatatgtctactct

SEQ ID NO: 8330012 - DNA, 22 bp, Homo sapiens
tgtcctgggccggcgactggtc

SEQ ID NO: 8330013 - DNA, 22 bp, Homo sapiens
tgtcctgggccggcgactggtc

SEQ ID NO: 8330014 - DNA, 22 bp, Homo sapiens
tgtcctgggtccctgctagaag

SEQ ID NO: 8330015 - DNA, 22 bp, Homo sapiens
tgtcctggtgcttcttgggatt

SEQ ID NO: 8330016 - DNA, 22 bp, Homo sapiens
tgtccccagagcctgttcctgc

SEQ ID NO: 8330017 - DNA, 22 bp, Homo sapiens
tgtcccctttctttccttcgta

SEQ ID NO: 8330018 - DNA, 22 bp, Homo sapiens
tgtccctggtggaggctggcag

SEQ ID NO: 8330019 - DNA, 22 bp, Homo sapiens
tgtcccagggaaggcccagcac

SEQ ID NO: 8330020 - DNA, 22 bp, Homo sapiens
tgtcccagctgtctctgttttt

SEQ ID NO: 8330021 - DNA, 22 bp, Homo sapiens
tgtcccagtcaaggctgtcatc

SEQ ID NO: 8330022 - DNA, 22 bp, Homo sapiens
tgtcccagcagctgggttctct

SEQ ID NO: 8330023 - DNA, 22 bp, Homo sapiens
tgtcatagtgtggtagcagtgg

SEQ ID NO: 8330024 - DNA, 22 bp, Homo sapiens
tgtcatcttaaatcattcccac

SEQ ID NO: 8330025 - DNA, 22 bp, Homo sapiens
tgtcatatctattaaatgtcta

SEQ ID NO: 8330026 - DNA, 22 bp, Homo sapiens
tgtcatttatcttatagtaatc

SEQ ID NO: 8330027 - DNA, 22 bp, Homo sapiens
tgtcattttagtgcatcactca

SEQ ID NO: 8330028 - DNA, 22 bp, Homo sapiens
tggtcaggggcttctgagctgt

SEQ ID NO: 8330029 - DNA, 22 bp, Homo sapiens
tggtcagcgtttgtcagagcag

SEQ ID NO: 8330030 - DNA, 22 bp, Homo sapiens
tggtcagaactcagcgtgcttg

SEQ ID NO: 8330031 - DNA, 22 bp, Homo sapiens
tggtcagaaggaagggctccta

SEQ ID NO: 8330032 - DNA, 22 bp, Homo sapiens
tggtgcagacaggagccccgct

SEQ ID NO: 8330033 - DNA, 22 bp, Homo sapiens
tggtgcagagagggatctaggg

SEQ ID NO: 8330034 - DNA, 22 bp, Homo sapiens
tggtgagatgtatggagggttg

SEQ ID NO: 8330035 - DNA, 20 bp, Homo sapiens
tggtgagagcacctgatggg

SEQ ID NO: 8330036 - DNA, 22 bp, Homo sapiens
tggtgagaccttgttccttatg

SEQ ID NO: 8330037 - DNA, 22 bp, Homo sapiens
tggtgagagctgaccgtgcgag

SEQ ID NO: 8330038 - DNA, 22 bp, Homo sapiens
tggtgagataactttcggcaag

SEQ ID NO: 8330039 - DNA, 22 bp, Homo sapiens
tggtctctacggaggaaagctg

SEQ ID NO: 8330040 - DNA, 19 bp, Homo sapiens
tggtggcaatgtcagctaa

SEQ ID NO: 8330041 - DNA, 22 bp, Homo sapiens
tggtggcatcactcagcctccc

SEQ ID NO: 8330042 - DNA, 22 bp, Homo sapiens
tggtggcagctgagtgtcaggt

SEQ ID NO: 8330043 - DNA, 22 bp, Homo sapiens
tggtggcagctgggacagaggt

SEQ ID NO: 8330044 - DNA, 22 bp, Homo sapiens
tggtgggggaggctgtctagca

SEQ ID NO: 8330045 - DNA, 22 bp, Homo sapiens
tggtggggctttccttctgctt

SEQ ID NO: 8330046 - DNA, 22 bp, Homo sapiens
tggtggggccagacttcagctc

SEQ ID NO: 8330047 - DNA, 22 bp, Homo sapiens
tggtgggagtgacgttgccttc

SEQ ID NO: 8330048 - DNA, 22 bp, Homo sapiens
tggtgggagtgacgttgccttc

SEQ ID NO: 8330049 - DNA, 21 bp, Homo sapiens
tggtggagtgtgctgagcatg

SEQ ID NO: 8330050 - DNA, 21 bp, Homo sapiens
tggtggagtgtgctgagcatg

SEQ ID NO: 8330051 - DNA, 19 bp, Homo sapiens
tggtggaggtgcacctgac

SEQ ID NO: 8330052 - DNA, 22 bp, Homo sapiens
tggtggaggtgcatttcggagc

SEQ ID NO: 8330053 - DNA, 19 bp, Homo sapiens
tggtggaggtgcacctgac

SEQ ID NO: 8330054 - DNA, 22 bp, Homo sapiens
tggtggagtttctctttcaaac

SEQ ID NO: 8330055 - DNA, 22 bp, Homo sapiens
tggtggacaccgcagccatgaa

SEQ ID NO: 8330056 - DNA, 22 bp, Homo sapiens
tggtggagctgtggccacgacc

SEQ ID NO: 8330057 - DNA, 22 bp, Homo sapiens
tggtggagggaactatttccag

SEQ ID NO: 8330058 - DNA, 22 bp, Homo sapiens
tggtggagagacagtgtattgg

SEQ ID NO: 8330059 - DNA, 22 bp, Homo sapiens
tggtgcaggagttggcagggac

SEQ ID NO: 8330060 - DNA, 22 bp, Homo sapiens
tggtgcagtagaaggccgactt

SEQ ID NO: 8330061 - DNA, 22 bp, Homo sapiens
tggtgcagtagagctgtctggg

SEQ ID NO: 8330062 - DNA, 22 bp, Homo sapiens
tggtgccaccctccttcagctg

SEQ ID NO: 8330063 - DNA, 22 bp, Homo sapiens
tggtgcagtcattggcccaggg

SEQ ID NO: 8330064 - DNA, 22 bp, Homo sapiens
tggtgcagtccaaagggagcag

SEQ ID NO: 8330065 - DNA, 22 bp, Homo sapiens
tggtgcagttcccagggccggg

SEQ ID NO: 8330066 - DNA, 22 bp, Homo sapiens
tgtaacatcacagtgatgtttg

SEQ ID NO: 8330067 - DNA, 23 bp, Homo sapiens
tgtaacaatttcatatacatgca

SEQ ID NO: 8330068 - DNA, 22 bp, Homo sapiens
tgtaacaatttcttactattgt

SEQ ID NO: 8330069 - DNA, 22 bp, Homo sapiens
tgtaacaatttcttactattgt

SEQ ID NO: 8330070 - DNA, 17 bp, Homo sapiens
tgtaacaactcctatta

SEQ ID NO: 8330071 - DNA, 21 bp, Homo sapiens
tgtaacaaaatactgcagatt

SEQ ID NO: 8330072 - DNA, 22 bp, Homo sapiens
tgtaacaagtgcttactttggg

SEQ ID NO: 8330073 - DNA, 22 bp, Homo sapiens
tgtaagatttgctatgtgttgt

SEQ ID NO: 8330074 - DNA, 22 bp, Homo sapiens
tgtaagattctaagagttaatg

SEQ ID NO: 8330075 - DNA, 22 bp, Homo sapiens
tgtaagaataatgatttctaag

SEQ ID NO: 8330076 - DNA, 23 bp, Homo sapiens
tgtaacttcttaaattcttcact

SEQ ID NO: 8330077 - DNA, 22 bp, Homo sapiens
tgtaagaaaacctgtacaaaga

SEQ ID NO: 8330078 - DNA, 22 bp, Homo sapiens
tgtaagaacaactgtcaaatgt

SEQ ID NO: 8330079 - DNA, 22 bp, Homo sapiens
tgtacaaagagtatagctttga

SEQ ID NO: 8330080 - DNA, 22 bp, Homo sapiens
tgtacaaagagtatagctttga

SEQ ID NO: 8330081 - DNA, 22 bp, Homo sapiens
tgtaagtagaacaacataatct

SEQ ID NO: 8330082 - DNA, 22 bp, Homo sapiens
tgtacagatatcaggagtgagg

SEQ ID NO: 8330083 - DNA, 22 bp, Homo sapiens
tgtacagagactaccattaata

SEQ ID NO: 8330084 - DNA, 22 bp, Homo sapiens
tgtacacatggtgtacactccc

SEQ ID NO: 8330085 - DNA, 22 bp, Homo sapiens
tgtacaaattcattgaactgta

SEQ ID NO: 8330086 - DNA, 23 bp, Homo sapiens
tgtaaaatggggtagtgttacca

SEQ ID NO: 8330087 - DNA, 22 bp, Homo sapiens
tgtaaaaccaaatcaatctagt

SEQ ID NO: 8330088 - DNA, 22 bp, Homo sapiens
tgtaaaaagcccagccgctgag

SEQ ID NO: 8330089 - DNA, 22 bp, Homo sapiens
tgtaaaaagcccagccgctgag

SEQ ID NO: 8330090 - DNA, 22 bp, Homo sapiens
tggtttgtatatgtttgtgaga

SEQ ID NO: 8330091 - DNA, 22 bp, Homo sapiens
tgtaaataattcctaggctttt

SEQ ID NO: 8330092 - DNA, 20 bp, Homo sapiens
tgtaaataggcattgtagtt

SEQ ID NO: 8330093 - DNA, 22 bp, Homo sapiens
tgtaaatagttagcttgcctct

SEQ ID NO: 8330094 - DNA, 22 bp, Homo sapiens
tgtaaagtccaagatcaaagag

SEQ ID NO: 8330095 - DNA, 22 bp, Homo sapiens
tgtaaagatccttagcaacatc

SEQ ID NO: 8330096 - DNA, 22 bp, Homo sapiens
tggtgtcttggaagtaggtgct

SEQ ID NO: 8330097 - DNA, 22 bp, Homo sapiens
tggtgtctggcacacaggaagc

SEQ ID NO: 8330098 - DNA, 18 bp, Homo sapiens
tggtggtgacagggtcat

SEQ ID NO: 8330099 - DNA, 22 bp, Homo sapiens
tggttgcctctcagagattccg

SEQ ID NO: 8330100 - DNA, 22 bp, Homo sapiens
tgctgtcccccgtgtctgggct

SEQ ID NO: 8330101 - DNA, 19 bp, Homo sapiens
tgctgtcctcagagtaagt

SEQ ID NO: 8330102 - DNA, 22 bp, Homo sapiens
tgctgtcctgctgagggatgtg

SEQ ID NO: 8330103 - DNA, 22 bp, Homo sapiens
tgctgtcctgttttggagtaat

SEQ ID NO: 8330104 - DNA, 22 bp, Homo sapiens
tgctgtcttttcccaatcctgg

SEQ ID NO: 8330105 - DNA, 22 bp, Homo sapiens
tgcttctgaaatgcaggtcttc

SEQ ID NO: 8330106 - DNA, 22 bp, Homo sapiens
tgcttctgagttgcaggacttg

SEQ ID NO: 8330107 - DNA, 22 bp, Homo sapiens
tgcttcatgaggtagtggcagt

SEQ ID NO: 8330108 - DNA, 22 bp, Homo sapiens
tgctggtgaggtccttgctgga

SEQ ID NO: 8330109 - DNA, 22 bp, Homo sapiens
tgctggggatccgtaccaaccc

SEQ ID NO: 8330110 - DNA, 22 bp, Homo sapiens
tgctggggatccgtaccaaccc

SEQ ID NO: 8330111 - DNA, 22 bp, Homo sapiens
tgctggggagtgattgaccatc

SEQ ID NO: 8330112 - DNA, 20 bp, Homo sapiens
tgctggggacatacagggtg

SEQ ID NO: 8330113 - DNA, 22 bp, Homo sapiens
tgctggggtcatggggcgcccg

SEQ ID NO: 8330114 - DNA, 22 bp, Homo sapiens
tgctggggtcatggggcgcccg

SEQ ID NO: 8330115 - DNA, 23 bp, Homo sapiens
tgctggggtagtttgtggcacag

SEQ ID NO: 8330116 - DNA, 23 bp, Homo sapiens
tgctggggtagtttgtggcacag

SEQ ID NO: 8330117 - DNA, 22 bp, Homo sapiens
tgctggggtctctccggtgccc

SEQ ID NO: 8330118 - DNA, 22 bp, Homo sapiens
tgctggggtctctccggtgccc

SEQ ID NO: 8330119 - DNA, 21 bp, Homo sapiens
tgctgggctgcaggggatgca

SEQ ID NO: 8330120 - DNA, 22 bp, Homo sapiens
tgctggcttcctgtgcacagca

SEQ ID NO: 8330121 - DNA, 20 bp, Homo sapiens
tgctgggcatgcagtggaaa

SEQ ID NO: 8330122 - DNA, 22 bp, Homo sapiens
tgctgctgacatttggggcttg

SEQ ID NO: 8330123 - DNA, 23 bp, Homo sapiens
tgctgcccactcttccagccctc

SEQ ID NO: 8330124 - DNA, 22 bp, Homo sapiens
tgctgccagggctctgcccaca

SEQ ID NO: 8330125 - DNA, 21 bp, Homo sapiens
tgctgccatagacctgaggga

SEQ ID NO: 8330126 - DNA, 21 bp, Homo sapiens
tgctgccatcatgcagagatg

SEQ ID NO: 8330127 - DNA, 22 bp, Homo sapiens
tgctgccagccaggccatggag

SEQ ID NO: 8330128 - DNA, 22 bp, Homo sapiens
tgctgccagagagacagggact

SEQ ID NO: 8330129 - DNA, 22 bp, Homo sapiens
tgctgccacctggtggctgaag

SEQ ID NO: 8330130 - DNA, 22 bp, Homo sapiens
tgctgccacatttaaagagggg

SEQ ID NO: 8330131 - DNA, 22 bp, Homo sapiens
tgctgccacccctcaccagagc

SEQ ID NO: 8330132 - DNA, 17 bp, Homo sapiens
tgctgccaagtcccaac

SEQ ID NO: 8330133 - DNA, 22 bp, Homo sapiens
tgctgccacaaattcagctgcc

SEQ ID NO: 8330134 - DNA, 23 bp, Homo sapiens
tgctgccaagcacgagttgagtt

SEQ ID NO: 8330135 - DNA, 20 bp, Homo sapiens
tgctgctgtgagcgtccctg

SEQ ID NO: 8330136 - DNA, 22 bp, Homo sapiens
tgctgctttgatgtgtaaatca

SEQ ID NO: 8330137 - DNA, 22 bp, Homo sapiens
tgctgcttgttttgtaaataaa

SEQ ID NO: 8330138 - DNA, 22 bp, Homo sapiens
tgctggaaagttaaattttgga

SEQ ID NO: 8330139 - DNA, 22 bp, Homo sapiens
tgctggaaccaggaatttgaag

SEQ ID NO: 8330140 - DNA, 22 bp, Homo sapiens
tgctggagaaagtttttctgaa

SEQ ID NO: 8330141 - DNA, 22 bp, Homo sapiens
tgctggaggagaaggttgctca

SEQ ID NO: 8330142 - DNA, 23 bp, Homo sapiens
tgctggagaagcaaagttctgag

SEQ ID NO: 8330143 - DNA, 22 bp, Homo sapiens
tgctggagaagctcctgggact

SEQ ID NO: 8330144 - DNA, 22 bp, Homo sapiens
tgctggagaactgctctgtgtt

SEQ ID NO: 8330145 - DNA, 22 bp, Homo sapiens
tgctggctggcctggcctggac

SEQ ID NO: 8330146 - DNA, 22 bp, Homo sapiens
tgctggctggatcagagattgg

SEQ ID NO: 8330147 - DNA, 22 bp, Homo sapiens
tgctggctgggctgctggagac

SEQ ID NO: 8330148 - DNA, 22 bp, Homo sapiens
tgctggctgccaggttccctgt

SEQ ID NO: 8330149 - DNA, 22 bp, Homo sapiens
tgctggctggagtgcctctgga

SEQ ID NO: 8330150 - DNA, 22 bp, Homo sapiens
tgctggctgtccctacctggct

SEQ ID NO: 8330151 - DNA, 23 bp, Homo sapiens
tgctggctgtgttattgccaaca

SEQ ID NO: 8330152 - DNA, 22 bp, Homo sapiens
tgctggcttagatatcactgcc

SEQ ID NO: 8330153 - DNA, 22 bp, Homo sapiens
tgctggctgttctagggaggcc

SEQ ID NO: 8330154 - DNA, 22 bp, Homo sapiens
tgctggctactgatggcaggcc

SEQ ID NO: 8330155 - DNA, 22 bp, Homo sapiens
tgctggctccaacctggcatct

SEQ ID NO: 8330156 - DNA, 21 bp, Homo sapiens
tgctggctgaaaggcacagag

SEQ ID NO: 8330157 - DNA, 23 bp, Homo sapiens
tgctggctgaaacagccaaagga

SEQ ID NO: 8330158 - DNA, 21 bp, Homo sapiens
tgctggctgaaaggcacagag

SEQ ID NO: 8330159 - DNA, 22 bp, Homo sapiens
tgctggctgaggcctgagcggg

SEQ ID NO: 8330160 - DNA, 22 bp, Homo sapiens
tgctggctcctcgaggcttcgt

SEQ ID NO: 8330161 - DNA, 22 bp, Homo sapiens
tgctggctctgggccaagcagg

SEQ ID NO: 8330162 - DNA, 22 bp, Homo sapiens
tgctggctctaggctgagacag

SEQ ID NO: 8330163 - DNA, 22 bp, Homo sapiens
tgctggaggggcctgaccagga

SEQ ID NO: 8330164 - DNA, 22 bp, Homo sapiens
tgctggaggggatgccttcact

SEQ ID NO: 8330165 - DNA, 22 bp, Homo sapiens
tgctggagtaacaagacactca

SEQ ID NO: 8330166 - DNA, 22 bp, Homo sapiens
tgctggagtctcttgaccctgg

SEQ ID NO: 8330167 - DNA, 19 bp, Homo sapiens
tgctggagtgacattctga

SEQ ID NO: 8330168 - DNA, 22 bp, Homo sapiens
tgctggagtgagattatgagtt

SEQ ID NO: 8330169 - DNA, 22 bp, Homo sapiens
tgctggaggcagtggaggtgcc

SEQ ID NO: 8330170 - DNA, 17 bp, Homo sapiens
tgctggaggcggggtat

SEQ ID NO: 8330171 - DNA, 22 bp, Homo sapiens
tgctggagtggcactgtgtggc

SEQ ID NO: 8330172 - DNA, 22 bp, Homo sapiens
tgctggagtgcagtggcttaac

SEQ ID NO: 8330173 - DNA, 22 bp, Homo sapiens
tgctggagtgagtggtttctta

SEQ ID NO: 8330174 - DNA, 22 bp, Homo sapiens
tgctggagttcgacattgcaaa

SEQ ID NO: 8330175 - DNA, 22 bp, Homo sapiens
tgctggagtggcactgtgtggc

SEQ ID NO: 8330176 - DNA, 20 bp, Homo sapiens
tgctggcatgcaagagggaa

SEQ ID NO: 8330177 - DNA, 22 bp, Homo sapiens
tgctcccaggcattctctgttg

SEQ ID NO: 8330178 - DNA, 22 bp, Homo sapiens
tgctccagcccctggtgcacag

SEQ ID NO: 8330179 - DNA, 22 bp, Homo sapiens
tgctccagcgctgccaccagtt

SEQ ID NO: 8330180 - DNA, 20 bp, Homo sapiens
tgctccaggaacactggccg

SEQ ID NO: 8330181 - DNA, 22 bp, Homo sapiens
tgctccagggcctccagtgggg

SEQ ID NO: 8330182 - DNA, 18 bp, Homo sapiens
tgctccaggcccatgggc

SEQ ID NO: 8330183 - DNA, 22 bp, Homo sapiens
tgctctggggagctcctctgcg

SEQ ID NO: 8330184 - DNA, 22 bp, Homo sapiens
tgctctgggctcaatggcagct

SEQ ID NO: 8330185 - DNA, 22 bp, Homo sapiens
tgctctgggctcaatggcagct

SEQ ID NO: 8330186 - DNA, 22 bp, Homo sapiens
tgctctcctgctcctcagccca

SEQ ID NO: 8330187 - DNA, 22 bp, Homo sapiens
tgctgaggtcatttccaagtga

SEQ ID NO: 8330188 - DNA, 22 bp, Homo sapiens
tgctgaggtcaccttgctgcta

SEQ ID NO: 8330189 - DNA, 22 bp, Homo sapiens
tgctgaggcagatgtctgtgac

SEQ ID NO: 8330190 - DNA, 20 bp, Homo sapiens
tgctgaggcctgaggcctgg

SEQ ID NO: 8330191 - DNA, 22 bp, Homo sapiens
tgctgaggttgtggagtgcatt

SEQ ID NO: 8330192 - DNA, 22 bp, Homo sapiens
tgctgcagttattgaaactatg

SEQ ID NO: 8330193 - DNA, 22 bp, Homo sapiens
tgctgcaggtgtgttcagtgag

SEQ ID NO: 8330194 - DNA, 22 bp, Homo sapiens
tgctgcagggatttcagagaca

SEQ ID NO: 8330195 - DNA, 22 bp, Homo sapiens
tgctgcagggccttccctgcat

SEQ ID NO: 8330196 - DNA, 18 bp, Homo sapiens
tgctctggtctcacttgg

SEQ ID NO: 8330197 - DNA, 22 bp, Homo sapiens
tgctctggtaactcacttccat

SEQ ID NO: 8330198 - DNA, 20 bp, Homo sapiens
tgctctgggggtggagagac

SEQ ID NO: 8330199 - DNA, 22 bp, Homo sapiens
tgctgaggaggtggctgtgctt

SEQ ID NO: 8330200 - DNA, 22 bp, Homo sapiens
tgctgaggaggtggctgtgctt

SEQ ID NO: 8330201 - DNA, 22 bp, Homo sapiens
tgctgaaacaataacatactgg

SEQ ID NO: 8330202 - DNA, 22 bp, Homo sapiens
tgctgaaattagaacattgagg

SEQ ID NO: 8330203 - DNA, 22 bp, Homo sapiens
tgctgagcgcatccggcggccg

SEQ ID NO: 8330204 - DNA, 22 bp, Homo sapiens
tgctcagagctccagctctcct

SEQ ID NO: 8330205 - DNA, 22 bp, Homo sapiens
tgctcaaatgtggacaactgat

SEQ ID NO: 8330206 - DNA, 17 bp, Homo sapiens
tgctcaaatacttttga

SEQ ID NO: 8330207 - DNA, 22 bp, Homo sapiens
tgctcatttcaaagtgaataat

SEQ ID NO: 8330208 - DNA, 22 bp, Homo sapiens
tgctccagcaccaagagctcca

SEQ ID NO: 8330209 - DNA, 22 bp, Homo sapiens
tgctccagaacctgaccatgct

SEQ ID NO: 8330210 - DNA, 22 bp, Homo sapiens
tgctcagtgagtctgtgacagg

SEQ ID NO: 8330211 - DNA, 23 bp, Homo sapiens
tgctcagtctaaagaagaataac

SEQ ID NO: 8330212 - DNA, 22 bp, Homo sapiens
tgctcagtagcagtgtgctgct

SEQ ID NO: 8330213 - DNA, 22 bp, Homo sapiens
tgctcagtatagaaaatgatat

SEQ ID NO: 8330214 - DNA, 18 bp, Homo sapiens
tgctcaaaagggattgct

SEQ ID NO: 8330215 - DNA, 22 bp, Homo sapiens
tgcgggtcccagggtcacaggc

SEQ ID NO: 8330216 - DNA, 22 bp, Homo sapiens
tgcggggccctcccgtgcactg

SEQ ID NO: 8330217 - DNA, 22 bp, Homo sapiens
tgcgcccagccaagtctggcac

SEQ ID NO: 8330218 - DNA, 22 bp, Homo sapiens
tgcctgtcagggggagtgggaa

SEQ ID NO: 8330219 - DNA, 22 bp, Homo sapiens
tgcctgtcttaatatctggaaa

SEQ ID NO: 8330220 - DNA, 18 bp, Homo sapiens
tggagggcttgctgcagc

SEQ ID NO: 8330221 - DNA, 22 bp, Homo sapiens
tggagggcgcttagatggaggg

SEQ ID NO: 8330222 - DNA, 22 bp, Homo sapiens
tggagggctaagctgagggata

SEQ ID NO: 8330223 - DNA, 22 bp, Homo sapiens
tggagggctaagctgagggata

SEQ ID NO: 8330224 - DNA, 20 bp, Homo sapiens
tggaggtggtctgctgtcct

SEQ ID NO: 8330225 - DNA, 22 bp, Homo sapiens
tggaggtggcacaagggaggtc

SEQ ID NO: 8330226 - DNA, 22 bp, Homo sapiens
tggaggtggcacaagggaggtc

SEQ ID NO: 8330227 - DNA, 22 bp, Homo sapiens
tggaggtgggagggactgtcct

SEQ ID NO: 8330228 - DNA, 22 bp, Homo sapiens
tggagggcatctgtggtcaggc

SEQ ID NO: 8330229 - DNA, 22 bp, Homo sapiens
tggagggcatgctgtccatggg

SEQ ID NO: 8330230 - DNA, 22 bp, Homo sapiens
tggagggcatagctgttctttc

SEQ ID NO: 8330231 - DNA, 20 bp, Homo sapiens
tggagggattgttggcaaat

SEQ ID NO: 8330232 - DNA, 22 bp, Homo sapiens
tggagggaacccaggctgctct

SEQ ID NO: 8330233 - DNA, 22 bp, Homo sapiens
tggaggctggtttctgctgagg

SEQ ID NO: 8330234 - DNA, 22 bp, Homo sapiens
tggaggctgtgtgcatgagacc

SEQ ID NO: 8330235 - DNA, 22 bp, Homo sapiens
tggataaactcactgtaagttg

SEQ ID NO: 8330236 - DNA, 22 bp, Homo sapiens
tggagttctcaggtgagggctt

SEQ ID NO: 8330237 - DNA, 22 bp, Homo sapiens
tggagtgggcaatgtaggcaag

SEQ ID NO: 8330238 - DNA, 22 bp, Homo sapiens
tggagtggacttcatgaggcca

SEQ ID NO: 8330239 - DNA, 20 bp, Homo sapiens
tggagtctgacagatgggta

SEQ ID NO: 8330240 - DNA, 22 bp, Homo sapiens
tggagtctgtgatgctctgggt

SEQ ID NO: 8330241 - DNA, 22 bp, Homo sapiens
tggaggtgtggagtcaaaggga

SEQ ID NO: 8330242 - DNA, 22 bp, Homo sapiens
tggaggtgtataaggtagcttc

SEQ ID NO: 8330243 - DNA, 22 bp, Homo sapiens
tggaggtgtataaggtagcttc

SEQ ID NO: 8330244 - DNA, 22 bp, Homo sapiens
tggagctggtaaacagtgacat

SEQ ID NO: 8330245 - DNA, 23 bp, Homo sapiens
tggagctgggcagctgggaaagt

SEQ ID NO: 8330246 - DNA, 22 bp, Homo sapiens
tggagctggttctggggaagct

SEQ ID NO: 8330247 - DNA, 20 bp, Homo sapiens
tggagctgtaatcttgtctg

SEQ ID NO: 8330248 - DNA, 22 bp, Homo sapiens
tggagctgtcactcagaaccaa

SEQ ID NO: 8330249 - DNA, 22 bp, Homo sapiens
tggaggaaaaaaccaggcagag

SEQ ID NO: 8330250 - DNA, 22 bp, Homo sapiens
tggaggaaaattactggggtct

SEQ ID NO: 8330251 - DNA, 22 bp, Homo sapiens
tggaggagaactccctggctac

SEQ ID NO: 8330252 - DNA, 22 bp, Homo sapiens
tggaggagaatttatggtcgaa

SEQ ID NO: 8330253 - DNA, 22 bp, Homo sapiens
tggaggagaccattccactcag

SEQ ID NO: 8330254 - DNA, 22 bp, Homo sapiens
tggaggagggctggtgtctgta

SEQ ID NO: 8330255 - DNA, 22 bp, Homo sapiens
tggaggagtgtgattgtctgcc

SEQ ID NO: 8330256 - DNA, 22 bp, Homo sapiens
tggaggcaggtggaggagtgaa

SEQ ID NO: 8330257 - DNA, 22 bp, Homo sapiens
tggaggcctggtctctcttccc

SEQ ID NO: 8330258 - DNA, 22 bp, Homo sapiens
tggaggcctaggttgatgtgtg

SEQ ID NO: 8330259 - DNA, 22 bp, Homo sapiens
tggaggcccccaggcaacagca

SEQ ID NO: 8330260 - DNA, 22 bp, Homo sapiens
tggaggccgcgtagtctgagca

SEQ ID NO: 8330261 - DNA, 19 bp, Homo sapiens
tggaggccaggacacaggt

SEQ ID NO: 8330262 - DNA, 22 bp, Homo sapiens
tggaggcccacactgggtagat

SEQ ID NO: 8330263 - DNA, 22 bp, Homo sapiens
tggagctggaatttctgggcct

SEQ ID NO: 8330264 - DNA, 22 bp, Homo sapiens
tggagctggaatttgagctgga

SEQ ID NO: 8330265 - DNA, 22 bp, Homo sapiens
tggagctggcagcggaaaaggg

SEQ ID NO: 8330266 - DNA, 22 bp, Homo sapiens
tggagctggcttgtggaagttg

SEQ ID NO: 8330267 - DNA, 22 bp, Homo sapiens
tggagctgatacagctggcttt

SEQ ID NO: 8330268 - DNA, 21 bp, Homo sapiens
tggagctgccacttgtcctcc

SEQ ID NO: 8330269 - DNA, 22 bp, Homo sapiens
tggagctgaactttgaggccag

SEQ ID NO: 8330270 - DNA, 18 bp, Homo sapiens
tggagctgagtgctgtgc

SEQ ID NO: 8330271 - DNA, 23 bp, Homo sapiens
tggagctgacagtcagagggagg

SEQ ID NO: 8330272 - DNA, 21 bp, Homo sapiens
tggagctgaatttttggcatc

SEQ ID NO: 8330273 - DNA, 22 bp, Homo sapiens
tggagcaggtgccaggtgtgtg

SEQ ID NO: 8330274 - DNA, 22 bp, Homo sapiens
tggagcaggacggggagtggta

SEQ ID NO: 8330275 - DNA, 22 bp, Homo sapiens
tggagcagctctagcgggcgcc

SEQ ID NO: 8330276 - DNA, 22 bp, Homo sapiens
tggagcagctctagcgggcgcc

SEQ ID NO: 8330277 - DNA, 22 bp, Homo sapiens
tggagcagctgaacagagttga

SEQ ID NO: 8330278 - DNA, 19 bp, Homo sapiens
tggagaggaaatgctgctc

SEQ ID NO: 8330279 - DNA, 22 bp, Homo sapiens
tggagaggagcaccatggccat

SEQ ID NO: 8330280 - DNA, 19 bp, Homo sapiens
tggagaggaaatgctgctc

SEQ ID NO: 8330281 - DNA, 22 bp, Homo sapiens
tggagaggagcaccatggccat

SEQ ID NO: 8330282 - DNA, 22 bp, Homo sapiens
tggagcagcattcatccagcag

SEQ ID NO: 8330283 - DNA, 22 bp, Homo sapiens
tggagcagagatggtggccttc

SEQ ID NO: 8330284 - DNA, 22 bp, Homo sapiens
tggaccaacattcactggcata

SEQ ID NO: 8330285 - DNA, 22 bp, Homo sapiens
tggaccagggtcccagagtatg

SEQ ID NO: 8330286 - DNA, 22 bp, Homo sapiens
tggacccaccccagggcctgct

SEQ ID NO: 8330287 - DNA, 22 bp, Homo sapiens
tggaccagcagccccagtgcct

SEQ ID NO: 8330288 - DNA, 22 bp, Homo sapiens
tggaccagcagccccagtgcct

SEQ ID NO: 8330289 - DNA, 21 bp, Homo sapiens
tggaccaggaaggtggtggtg

SEQ ID NO: 8330290 - DNA, 21 bp, Homo sapiens
tggaccaggaaggtggtggtg

SEQ ID NO: 8330291 - DNA, 22 bp, Homo sapiens
tggaccagctcctcgggagacg

SEQ ID NO: 8330292 - DNA, 22 bp, Homo sapiens
tggactcttggaccttctctaa

SEQ ID NO: 8330293 - DNA, 22 bp, Homo sapiens
tggacccaggcaggtctgtcct

SEQ ID NO: 8330294 - DNA, 22 bp, Homo sapiens
tggacagccatgcaaatgagct

SEQ ID NO: 8330295 - DNA, 22 bp, Homo sapiens
tggacagcaaacatggagagaa

SEQ ID NO: 8330296 - DNA, 22 bp, Homo sapiens
tggacaaatagcatgacacttg

SEQ ID NO: 8330297 - DNA, 22 bp, Homo sapiens
tggaagggggaagacagctctg

SEQ ID NO: 8330298 - DNA, 22 bp, Homo sapiens
tggaagggagtgacagtcagag

SEQ ID NO: 8330299 - DNA, 22 bp, Homo sapiens
tggaaggggagctggaaagggg

SEQ ID NO: 8330300 - DNA, 21 bp, Homo sapiens
tggaagtcttgagtagggggc

SEQ ID NO: 8330301 - DNA, 22 bp, Homo sapiens
tggaagtccctgtgtgtggcct

SEQ ID NO: 8330302 - DNA, 22 bp, Homo sapiens
tgctttggccactagaattcag

SEQ ID NO: 8330303 - DNA, 22 bp, Homo sapiens
tgctttgggtttgactctcatg

SEQ ID NO: 8330304 - DNA, 22 bp, Homo sapiens
tgcttttaggagattaaaatta

SEQ ID NO: 8330305 - DNA, 22 bp, Homo sapiens
tgctttgtgtttgaatagataa

SEQ ID NO: 8330306 - DNA, 22 bp, Homo sapiens
tgctttgtgtacacaagaatca

SEQ ID NO: 8330307 - DNA, 22 bp, Homo sapiens
tggaaacactcaagcttatatt

SEQ ID NO: 8330308 - DNA, 22 bp, Homo sapiens
tggaaaatgtgactattctaaa

SEQ ID NO: 8330309 - DNA, 22 bp, Homo sapiens
tggaaatgtttcttgagctcag

SEQ ID NO: 8330310 - DNA, 22 bp, Homo sapiens
tggaacaaaatatttatgtttg

SEQ ID NO: 8330311 - DNA, 22 bp, Homo sapiens
tggaaatatgctccattctttt

SEQ ID NO: 8330312 - DNA, 22 bp, Homo sapiens
tggaaatatacaatgtgtctct

SEQ ID NO: 8330313 - DNA, 22 bp, Homo sapiens
tggaaatagtaatgcataagtg

SEQ ID NO: 8330314 - DNA, 22 bp, Homo sapiens
tggaaatacaagaagtatgtca

SEQ ID NO: 8330315 - DNA, 22 bp, Homo sapiens
tggaaagtgagacatatttata

SEQ ID NO: 8330316 - DNA, 22 bp, Homo sapiens
tgcttctggggacaggctgcct

SEQ ID NO: 8330317 - DNA, 22 bp, Homo sapiens
tgcttctgggtaggcctcagga

SEQ ID NO: 8330318 - DNA, 22 bp, Homo sapiens
tgctttatgtggctgatactca

SEQ ID NO: 8330319 - DNA, 20 bp, Homo sapiens
tgctttgatggaaatacagc

SEQ ID NO: 8330320 - DNA, 20 bp, Homo sapiens
tgctttgatggaaatacagc

SEQ ID NO: 8330321 - DNA, 22 bp, Homo sapiens
tgctttgaaagataatactgtc

SEQ ID NO: 8330322 - DNA, 22 bp, Homo sapiens
tgctttattaagagagaaattt

SEQ ID NO: 8330323 - DNA, 22 bp, Homo sapiens
tgggaagggtcaacagctggaa

SEQ ID NO: 8330324 - DNA, 22 bp, Homo sapiens
tgggaagggagagtgtcctgga

SEQ ID NO: 8330325 - DNA, 22 bp, Homo sapiens
tgggacacctcagatagtgtct

SEQ ID NO: 8330326 - DNA, 22 bp, Homo sapiens
tgggacagggaatctgatcccc

SEQ ID NO: 8330327 - DNA, 22 bp, Homo sapiens
tgggacacaaaccagaccagga

SEQ ID NO: 8330328 - DNA, 22 bp, Homo sapiens
tgggacagtgtgccttgctcct

SEQ ID NO: 8330329 - DNA, 22 bp, Homo sapiens
tgggaccaagtcatttctttag

SEQ ID NO: 8330330 - DNA, 22 bp, Homo sapiens
tgggaccacactttgaacaaca

SEQ ID NO: 8330331 - DNA, 22 bp, Homo sapiens
tgggacagtgaccccagaggtc

SEQ ID NO: 8330332 - DNA, 21 bp, Homo sapiens
tgggacagtgatggctcctcc

SEQ ID NO: 8330333 - DNA, 22 bp, Homo sapiens
tgggaccagataaagggaggtc

SEQ ID NO: 8330334 - DNA, 19 bp, Homo sapiens
tgggagaggcaacagagta

SEQ ID NO: 8330335 - DNA, 19 bp, Homo sapiens
tgggagaggcaacagagta

SEQ ID NO: 8330336 - DNA, 19 bp, Homo sapiens
tgggagaggcaacagagta

SEQ ID NO: 8330337 - DNA, 22 bp, Homo sapiens
tgggagagtctaaaaccgaggt

SEQ ID NO: 8330338 - DNA, 22 bp, Homo sapiens
tgggagagaataatcaataggt

SEQ ID NO: 8330339 - DNA, 22 bp, Homo sapiens
tgggagaagcagtgggacagta

SEQ ID NO: 8330340 - DNA, 22 bp, Homo sapiens
tgggaggatcgcttgagcccag

SEQ ID NO: 8330341 - DNA, 22 bp, Homo sapiens
tgggaggcagaagttgactgga

SEQ ID NO: 8330342 - DNA, 22 bp, Homo sapiens
tgggaggcagaagttgactgga

SEQ ID NO: 8330343 - DNA, 22 bp, Homo sapiens
tggctggatgtgagatcaagag

SEQ ID NO: 8330344 - DNA, 22 bp, Homo sapiens
tggctggatatcaggcaagggg

SEQ ID NO: 8330345 - DNA, 22 bp, Homo sapiens
tggctggataatattctgttgt

SEQ ID NO: 8330346 - DNA, 22 bp, Homo sapiens
tggctggatatcaggcaagggg

SEQ ID NO: 8330347 - DNA, 22 bp, Homo sapiens
tggctggagtataggagtagga

SEQ ID NO: 8330348 - DNA, 22 bp, Homo sapiens
tggctggacagtgggcagtgga

SEQ ID NO: 8330349 - DNA, 22 bp, Homo sapiens
tggctggacagtgggcagtgga

SEQ ID NO: 8330350 - DNA, 22 bp, Homo sapiens
tggctggaatggagctgagcct

SEQ ID NO: 8330351 - DNA, 22 bp, Homo sapiens
tggctggagagggtcccatgag

SEQ ID NO: 8330352 - DNA, 22 bp, Homo sapiens
tggctggagagggtcccatgag

SEQ ID NO: 8330353 - DNA, 22 bp, Homo sapiens
tggctggagaacttggggatct

SEQ ID NO: 8330354 - DNA, 22 bp, Homo sapiens
tggctggagcgccctcctctgc

SEQ ID NO: 8330355 - DNA, 22 bp, Homo sapiens
tggctggagcgccctcctctgc

SEQ ID NO: 8330356 - DNA, 22 bp, Homo sapiens
tggctggagcattccttgtctt

SEQ ID NO: 8330357 - DNA, 22 bp, Homo sapiens
tggctggagcattccttgtctt

SEQ ID NO: 8330358 - DNA, 22 bp, Homo sapiens
tggctggagcccctcaagagca

SEQ ID NO: 8330359 - DNA, 22 bp, Homo sapiens
tggctggagggacccactcaga

SEQ ID NO: 8330360 - DNA, 22 bp, Homo sapiens
tggctggaggcatgcaagctcc

SEQ ID NO: 8330361 - DNA, 22 bp, Homo sapiens
tggctgggagctggaactgggc

SEQ ID NO: 8330362 - DNA, 22 bp, Homo sapiens
tggctggcgccgggctagccac

SEQ ID NO: 8330363 - DNA, 22 bp, Homo sapiens
tggctggcatagccattgctcc

SEQ ID NO: 8330364 - DNA, 22 bp, Homo sapiens
tggctggcagtaggctagtggc

SEQ ID NO: 8330365 - DNA, 22 bp, Homo sapiens
tggctggcagtaggctagtggc

SEQ ID NO: 8330366 - DNA, 22 bp, Homo sapiens
tggctgggggtgctatagctgc

SEQ ID NO: 8330367 - DNA, 22 bp, Homo sapiens
tggctggggccacagttttcct

SEQ ID NO: 8330368 - DNA, 22 bp, Homo sapiens
tgggaaagtgtagcctgcaggc

SEQ ID NO: 8330369 - DNA, 22 bp, Homo sapiens
tgggaaagtgttgaggtgtctt

SEQ ID NO: 8330370 - DNA, 22 bp, Homo sapiens
tgggaaagactcaggacaggag

SEQ ID NO: 8330371 - DNA, 22 bp, Homo sapiens
tgggaaagccagcagtgtcacc

SEQ ID NO: 8330372 - DNA, 22 bp, Homo sapiens
tgggaaagtaattgtcatcctt

SEQ ID NO: 8330373 - DNA, 22 bp, Homo sapiens
tggcttctcagtttcataatga

SEQ ID NO: 8330374 - DNA, 22 bp, Homo sapiens
tggcttctgctcccagaatgat

SEQ ID NO: 8330375 - DNA, 22 bp, Homo sapiens
tggcttctcccgacaccctggc

SEQ ID NO: 8330376 - DNA, 22 bp, Homo sapiens
tggcttctccctacaacatgcc

SEQ ID NO: 8330377 - DNA, 20 bp, Homo sapiens
tggctgcccgaggcacacac

SEQ ID NO: 8330378 - DNA, 22 bp, Homo sapiens
tggctgccaagcaggtcagaga

SEQ ID NO: 8330379 - DNA, 22 bp, Homo sapiens
tggctgcagatctgtgggacac

SEQ ID NO: 8330380 - DNA, 21 bp, Homo sapiens
tggctgctggccctctctcca

SEQ ID NO: 8330381 - DNA, 22 bp, Homo sapiens
tggctggaaacaggagattcag

SEQ ID NO: 8330382 - DNA, 22 bp, Homo sapiens
tggctggaagtcagaaatggga

SEQ ID NO: 8330383 - DNA, 22 bp, Homo sapiens
tggctggaatatgtggagacca

SEQ ID NO: 8330384 - DNA, 22 bp, Homo sapiens
tggctgaagtgggcaggaggga

SEQ ID NO: 8330385 - DNA, 22 bp, Homo sapiens
tggctgaatctgcagcaggaag

SEQ ID NO: 8330386 - DNA, 22 bp, Homo sapiens
tggctgagaagttctggtggga

SEQ ID NO: 8330387 - DNA, 22 bp, Homo sapiens
tggctgagagcaattgactctg

SEQ ID NO: 8330388 - DNA, 22 bp, Homo sapiens
tggctgaggttatgctggttgt

SEQ ID NO: 8330389 - DNA, 22 bp, Homo sapiens
tggctgaggagggtcttctggt

SEQ ID NO: 8330390 - DNA, 20 bp, Homo sapiens
tggctctcaccctgtgcgat

SEQ ID NO: 8330391 - DNA, 20 bp, Homo sapiens
tggctcctggctcctccctc

SEQ ID NO: 8330392 - DNA, 20 bp, Homo sapiens
tggcggggatgagggagtta

SEQ ID NO: 8330393 - DNA, 22 bp, Homo sapiens
tggctcagatgctcttccagtg

SEQ ID NO: 8330394 - DNA, 22 bp, Homo sapiens
tggctcagaaggctgccttcac

SEQ ID NO: 8330395 - DNA, 22 bp, Homo sapiens
tggcgaagctgaacataggcta

SEQ ID NO: 8330396 - DNA, 20 bp, Homo sapiens
tggccttttggcttggagct

SEQ ID NO: 8330397 - DNA, 22 bp, Homo sapiens
tggcgcagtttctctgctgcct

SEQ ID NO: 8330398 - DNA, 22 bp, Homo sapiens
tggccttgccacatttgtcagc

SEQ ID NO: 8330399 - DNA, 22 bp, Homo sapiens
tggccttgagagatcaaaaggt

SEQ ID NO: 8330400 - DNA, 22 bp, Homo sapiens
tggcctggtgctcaggcagtag

SEQ ID NO: 8330401 - DNA, 22 bp, Homo sapiens
tggcctggtgctcaggcagtag

SEQ ID NO: 8330402 - DNA, 22 bp, Homo sapiens
tggcctggtccttgtcaaggca

SEQ ID NO: 8330403 - DNA, 22 bp, Homo sapiens
tggcctggtgtctgcgaggcct

SEQ ID NO: 8330404 - DNA, 22 bp, Homo sapiens
tggcctggtgtctgcgaggcct

SEQ ID NO: 8330405 - DNA, 22 bp, Homo sapiens
tggcctggccctgaggccctgt

SEQ ID NO: 8330406 - DNA, 22 bp, Homo sapiens
tggctcagtggcagccgcagct

SEQ ID NO: 8330407 - DNA, 22 bp, Homo sapiens
tggctcagccagccctaggaac

SEQ ID NO: 8330408 - DNA, 22 bp, Homo sapiens
tggctcaggcttgaaaatagat

SEQ ID NO: 8330409 - DNA, 22 bp, Homo sapiens
tggctcagttaggtcagaaaca

SEQ ID NO: 8330410 - DNA, 23 bp, Homo sapiens
tggctccaggagaagccagaagc

SEQ ID NO: 8330411 - DNA, 20 bp, Homo sapiens
tggctccagcctcccctacc

SEQ ID NO: 8330412 - DNA, 22 bp, Homo sapiens
tggctccagatttcctgctgca

SEQ ID NO: 8330413 - DNA, 22 bp, Homo sapiens
tggctccaggggacacgcagta

SEQ ID NO: 8330414 - DNA, 22 bp, Homo sapiens
tggctccatcatccatgcaaga

SEQ ID NO: 8330415 - DNA, 19 bp, Homo sapiens
tggctcctgcctgccttct

SEQ ID NO: 8330416 - DNA, 22 bp, Homo sapiens
tggccctgaatcaaggccagca

SEQ ID NO: 8330417 - DNA, 17 bp, Homo sapiens
tggccctagactccagc

SEQ ID NO: 8330418 - DNA, 22 bp, Homo sapiens
tggccctatttggaaatagagc

SEQ ID NO: 8330419 - DNA, 22 bp, Homo sapiens
tggcccagtcagcaggagaggg

SEQ ID NO: 8330420 - DNA, 22 bp, Homo sapiens
tggcccgccggaagaagatgtc

SEQ ID NO: 8330421 - DNA, 22 bp, Homo sapiens
tggcccagtatgtataatctta

SEQ ID NO: 8330422 - DNA, 22 bp, Homo sapiens
tggcccagtcagcaggagaggg

SEQ ID NO: 8330423 - DNA, 22 bp, Homo sapiens
tggcccaggtgcacccagaggc

SEQ ID NO: 8330424 - DNA, 22 bp, Homo sapiens
tggcccaggtgcacccagaggc

SEQ ID NO: 8330425 - DNA, 22 bp, Homo sapiens
tggcccagtagaaaagggatcg

SEQ ID NO: 8330426 - DNA, 22 bp, Homo sapiens
tggcccaggtgcaagagacaga

SEQ ID NO: 8330427 - DNA, 22 bp, Homo sapiens
tggcccaggtgcaagagacaga

SEQ ID NO: 8330428 - DNA, 22 bp, Homo sapiens
tggccctgaggggctgtgcccc

SEQ ID NO: 8330429 - DNA, 22 bp, Homo sapiens
tggccctgaggggctgtgcccc

SEQ ID NO: 8330430 - DNA, 22 bp, Homo sapiens
tggccctgcagaactagcctgg

SEQ ID NO: 8330431 - DNA, 22 bp, Homo sapiens
tggccctgcacccagagcagtt

SEQ ID NO: 8330432 - DNA, 22 bp, Homo sapiens
tggccctgactgatgtggaggg

SEQ ID NO: 8330433 - DNA, 22 bp, Homo sapiens
tggccctgacttggaggcctga

SEQ ID NO: 8330434 - DNA, 22 bp, Homo sapiens
tggcccaggaggccagagggca

SEQ ID NO: 8330435 - DNA, 22 bp, Homo sapiens
tggcccagggagttcatggtgt

SEQ ID NO: 8330436 - DNA, 22 bp, Homo sapiens
tggcccaggccaaagccctgga

SEQ ID NO: 8330437 - DNA, 22 bp, Homo sapiens
tggcccaggcgaggtgggcaga

SEQ ID NO: 8330438 - DNA, 22 bp, Homo sapiens
tggcccagggcacagcagggag

SEQ ID NO: 8330439 - DNA, 22 bp, Homo sapiens
tggcccagggcacagcagggag

SEQ ID NO: 8330440 - DNA, 22 bp, Homo sapiens
tggcccaggggctcttggtgtt

SEQ ID NO: 8330441 - DNA, 22 bp, Homo sapiens
tggcccaggtctctctgagccc

SEQ ID NO: 8330442 - DNA, 22 bp, Homo sapiens
tggcccaggtctctctgagccc

SEQ ID NO: 8330443 - DNA, 22 bp, Homo sapiens
tggcccagggtctacagcctca

SEQ ID NO: 8330444 - DNA, 22 bp, Homo sapiens
tggcccagctcagggtgggcgg

SEQ ID NO: 8330445 - DNA, 22 bp, Homo sapiens
tggcccagctgcagatggtgga

SEQ ID NO: 8330446 - DNA, 22 bp, Homo sapiens
tggcccagccctgctctagggc

SEQ ID NO: 8330447 - DNA, 22 bp, Homo sapiens
tggcccagactctgctcttatc

SEQ ID NO: 8330448 - DNA, 22 bp, Homo sapiens
tggcccagccctgctctagggc

SEQ ID NO: 8330449 - DNA, 22 bp, Homo sapiens
tggcccaagtctgctagaagag

SEQ ID NO: 8330450 - DNA, 15 bp, Homo sapiens
tggcccacccgttga

SEQ ID NO: 8330451 - DNA, 22 bp, Homo sapiens
tggccatgggatagtgcagggg

SEQ ID NO: 8330452 - DNA, 22 bp, Homo sapiens
tggcccaaagcagcccagcagg

SEQ ID NO: 8330453 - DNA, 22 bp, Homo sapiens
tggccatgaaggaggcagcaga

SEQ ID NO: 8330454 - DNA, 22 bp, Homo sapiens
tggccagtggggttgagcagga

SEQ ID NO: 8330455 - DNA, 20 bp, Homo sapiens
tggccctgttttctccaggc

SEQ ID NO: 8330456 - DNA, 22 bp, Homo sapiens
tggccctgttctgtacctcata

SEQ ID NO: 8330457 - DNA, 22 bp, Homo sapiens
tggcctcaaccgtcctaagcac

SEQ ID NO: 8330458 - DNA, 22 bp, Homo sapiens
tggcctagagaagccaaaagat

SEQ ID NO: 8330459 - DNA, 23 bp, Homo sapiens
tggccctgtgcatgctgcttccc

SEQ ID NO: 8330460 - DNA, 22 bp, Homo sapiens
tggccctgtggcttcagaacag

SEQ ID NO: 8330461 - DNA, 22 bp, Homo sapiens
tggccctgtgtgcaggctgcac

SEQ ID NO: 8330462 - DNA, 22 bp, Homo sapiens
tggccctgtgtcctgctgccag

SEQ ID NO: 8330463 - DNA, 21 bp, Homo sapiens
tggccctggccacggctgcca

SEQ ID NO: 8330464 - DNA, 22 bp, Homo sapiens
tggccctgccactcactgctga

SEQ ID NO: 8330465 - DNA, 22 bp, Homo sapiens
tggcctgccactgccacgccac

SEQ ID NO: 8330466 - DNA, 22 bp, Homo sapiens
tggcctggaacctggcagggac

SEQ ID NO: 8330467 - DNA, 22 bp, Homo sapiens
tggcctggaacctggcagggac

SEQ ID NO: 8330468 - DNA, 22 bp, Homo sapiens
tggcctggaaaaatgcagatgg

SEQ ID NO: 8330469 - DNA, 22 bp, Homo sapiens
tggcctggaagagaggtcgagg

SEQ ID NO: 8330470 - DNA, 22 bp, Homo sapiens
tggcctggccctgaggccctgt

SEQ ID NO: 8330471 - DNA, 22 bp, Homo sapiens
tggccaggggagttcccctcca

SEQ ID NO: 8330472 - DNA, 19 bp, Homo sapiens
tggccaggtactgtctgct

SEQ ID NO: 8330473 - DNA, 23 bp, Homo sapiens
tggccagggtactacacccaccc

SEQ ID NO: 8330474 - DNA, 19 bp, Homo sapiens
tggccaggtactgtctgct

SEQ ID NO: 8330475 - DNA, 23 bp, Homo sapiens
tggccaggtagaggaggtagtga

SEQ ID NO: 8330476 - DNA, 22 bp, Homo sapiens
tggccagcacttagcccttacc

SEQ ID NO: 8330477 - DNA, 22 bp, Homo sapiens
tggccagcccttcagccatgcc

SEQ ID NO: 8330478 - DNA, 22 bp, Homo sapiens
tggccagcccttcagccatgcc

SEQ ID NO: 8330479 - DNA, 22 bp, Homo sapiens
tggccagccagaaagaagcctt

SEQ ID NO: 8330480 - DNA, 22 bp, Homo sapiens
tggccagccctcttcccacact

SEQ ID NO: 8330481 - DNA, 22 bp, Homo sapiens
tggccagccctcttcccacact

SEQ ID NO: 8330482 - DNA, 21 bp, Homo sapiens
tggccagctggagtctccaca

SEQ ID NO: 8330483 - DNA, 22 bp, Homo sapiens
tggccaggcattcagataagac

SEQ ID NO: 8330484 - DNA, 17 bp, Homo sapiens
tggccaggccccgccag

SEQ ID NO: 8330485 - DNA, 22 bp, Homo sapiens
tggccacactgcccccactggg

SEQ ID NO: 8330486 - DNA, 22 bp, Homo sapiens
tggcatttcacctttcatttcc

SEQ ID NO: 8330487 - DNA, 22 bp, Homo sapiens
tggcatttcctcagtgctcaga

SEQ ID NO: 8330488 - DNA, 23 bp, Homo sapiens
tggccacagtccatgcatgccca

SEQ ID NO: 8330489 - DNA, 23 bp, Homo sapiens
tggccacagtccatgcatgccca

SEQ ID NO: 8330490 - DNA, 22 bp, Homo sapiens
tggccagacctgactgtcaggg

SEQ ID NO: 8330491 - DNA, 17 bp, Homo sapiens
tggccagagcaggcccc

SEQ ID NO: 8330492 - DNA, 22 bp, Homo sapiens
tggcagtcggacttctatctca

SEQ ID NO: 8330493 - DNA, 22 bp, Homo sapiens
tggcagtcccctgtgcctggaa

SEQ ID NO: 8330494 - DNA, 22 bp, Homo sapiens
tggcagtggctcagagtgcaga

SEQ ID NO: 8330495 - DNA, 22 bp, Homo sapiens
tggcatggcaaccctgcaggga

SEQ ID NO: 8330496 - DNA, 22 bp, Homo sapiens
tggcatggactagtgctgaggt

SEQ ID NO: 8330497 - DNA, 22 bp, Homo sapiens
tggcaccaccagacaccaggag

SEQ ID NO: 8330498 - DNA, 22 bp, Homo sapiens
tggcacagttaaagttgtagaa

SEQ ID NO: 8330499 - DNA, 22 bp, Homo sapiens
tggcactggcgcaggatggcgg

SEQ ID NO: 8330500 - DNA, 22 bp, Homo sapiens
tggcaaagattaccacatctac

SEQ ID NO: 8330501 - DNA, 22 bp, Homo sapiens
tggcaaaggcgctcacatgcct

SEQ ID NO: 8330502 - DNA, 22 bp, Homo sapiens
tggcaaagacgctagctaagat

SEQ ID NO: 8330503 - DNA, 22 bp, Homo sapiens
tggcaaagtttatcaggaatat

SEQ ID NO: 8330504 - DNA, 22 bp, Homo sapiens
tggatgggttgaaatgtgagcc

SEQ ID NO: 8330505 - DNA, 22 bp, Homo sapiens
tggattcacaccattctcctgc

SEQ ID NO: 8330506 - DNA, 22 bp, Homo sapiens
tggattcacaccattctcctgc

SEQ ID NO: 8330507 - DNA, 20 bp, Homo sapiens
tggcacagaacccttgccta

SEQ ID NO: 8330508 - DNA, 22 bp, Homo sapiens
tggcacagacagcacagcaatg

SEQ ID NO: 8330509 - DNA, 22 bp, Homo sapiens
tggcacagacagcacagcaatg

SEQ ID NO: 8330510 - DNA, 22 bp, Homo sapiens
tggcacagaaaaatgctccatt

SEQ ID NO: 8330511 - DNA, 22 bp, Homo sapiens
tggcacagagggacccagcagc

SEQ ID NO: 8330512 - DNA, 22 bp, Homo sapiens
tggcacagactgggccaaggaa

SEQ ID NO: 8330513 - DNA, 22 bp, Homo sapiens
tggcacagactgggccaaggaa

SEQ ID NO: 8330514 - DNA, 22 bp, Homo sapiens
tggcacagcccattcagagaag

SEQ ID NO: 8330515 - DNA, 22 bp, Homo sapiens
tggcacagcccattcagagaag

SEQ ID NO: 8330516 - DNA, 22 bp, Homo sapiens
tggcacagccactgaatcggga

SEQ ID NO: 8330517 - DNA, 22 bp, Homo sapiens
tggcagagttggaggtggaaga

SEQ ID NO: 8330518 - DNA, 20 bp, Homo sapiens
tggcaggaggcagcagtgga

SEQ ID NO: 8330519 - DNA, 19 bp, Homo sapiens
tggcagggagtgatattag

SEQ ID NO: 8330520 - DNA, 18 bp, Homo sapiens
tggcagggaggaaatata

SEQ ID NO: 8330521 - DNA, 18 bp, Homo sapiens
tggcaggggcagtacgcc

SEQ ID NO: 8330522 - DNA, 22 bp, Homo sapiens
tggcagggagttgcaggatttc

SEQ ID NO: 8330523 - DNA, 22 bp, Homo sapiens
tgaggaagcaaaggcttgtgtg

SEQ ID NO: 8330524 - DNA, 22 bp, Homo sapiens
tgaggaaggaattgaggtttta

SEQ ID NO: 8330525 - DNA, 22 bp, Homo sapiens
tgaggaagtggttgtatggttt

SEQ ID NO: 8330526 - DNA, 22 bp, Homo sapiens
tgaggccacttccccacagccc

SEQ ID NO: 8330527 - DNA, 22 bp, Homo sapiens
tgaggccacaggaaagggcccg

SEQ ID NO: 8330528 - DNA, 19 bp, Homo sapiens
tgaggccaaggtcacagat

SEQ ID NO: 8330529 - DNA, 21 bp, Homo sapiens
tgaggccaatagcccctggac

SEQ ID NO: 8330530 - DNA, 22 bp, Homo sapiens
tgaggccagccacagccaccct

SEQ ID NO: 8330531 - DNA, 18 bp, Homo sapiens
tgaggccagagtgggcat

SEQ ID NO: 8330532 - DNA, 22 bp, Homo sapiens
tgaggccagcttcagcagtgga

SEQ ID NO: 8330533 - DNA, 22 bp, Homo sapiens
tgaggccaggacccccagcagg

SEQ ID NO: 8330534 - DNA, 18 bp, Homo sapiens
tgaggcccgcagaggtgg

SEQ ID NO: 8330535 - DNA, 22 bp, Homo sapiens
tgaggcctcataatgagatttc

SEQ ID NO: 8330536 - DNA, 21 bp, Homo sapiens
tgaggcctctcctgggctggc

SEQ ID NO: 8330537 - DNA, 22 bp, Homo sapiens
tgaggcctcatttagggagagg

SEQ ID NO: 8330538 - DNA, 22 bp, Homo sapiens
tgaggcctgaagcctggagcct

SEQ ID NO: 8330539 - DNA, 22 bp, Homo sapiens
tgaggcctgacagaccaagcct

SEQ ID NO: 8330540 - DNA, 21 bp, Homo sapiens
tgaggcctgccagtctcagaa

SEQ ID NO: 8330541 - DNA, 22 bp, Homo sapiens
tgaggcctgcattgaactagaa

SEQ ID NO: 8330542 - DNA, 17 bp, Homo sapiens
tgaggcctgcatcagtg

SEQ ID NO: 8330543 - DNA, 22 bp, Homo sapiens
tgaggcctctgtgccatccagg

SEQ ID NO: 8330544 - DNA, 22 bp, Homo sapiens
tgaggcctgaagcctgaagtga

SEQ ID NO: 8330545 - DNA, 22 bp, Homo sapiens
tgaggcctcttggtatggtgtg

SEQ ID NO: 8330546 - DNA, 18 bp, Homo sapiens
tgaggcctctgctgggcc

SEQ ID NO: 8330547 - DNA, 19 bp, Homo sapiens
tgaggccaaggtcacagat

SEQ ID NO: 8330548 - DNA, 22 bp, Homo sapiens
tgaggccaactagggagatgga

SEQ ID NO: 8330549 - DNA, 22 bp, Homo sapiens
tgagggaggccctttgagcaga

SEQ ID NO: 8330550 - DNA, 22 bp, Homo sapiens
tgagggaggccctttgagcaga

SEQ ID NO: 8330551 - DNA, 22 bp, Homo sapiens
tgagggagcacacactgaagtg

SEQ ID NO: 8330552 - DNA, 22 bp, Homo sapiens
tgagggagctgacctttctgtg

SEQ ID NO: 8330553 - DNA, 22 bp, Homo sapiens
tgagggaggcctccatctgcca

SEQ ID NO: 8330554 - DNA, 20 bp, Homo sapiens
tgagggagtattgatttccc

SEQ ID NO: 8330555 - DNA, 19 bp, Homo sapiens
tgagggacattgggagcag

SEQ ID NO: 8330556 - DNA, 19 bp, Homo sapiens
tgagggacattgggagcag

SEQ ID NO: 8330557 - DNA, 22 bp, Homo sapiens
tgagggagagggcgaaaatgaa

SEQ ID NO: 8330558 - DNA, 22 bp, Homo sapiens
tgagggagtgtggatacagtag

SEQ ID NO: 8330559 - DNA, 22 bp, Homo sapiens
tgagggagtgtggatacagtag

SEQ ID NO: 8330560 - DNA, 22 bp, Homo sapiens
tgaggggagcccgccctggacg

SEQ ID NO: 8330561 - DNA, 22 bp, Homo sapiens
tgaggggcagagaggtgtccag

SEQ ID NO: 8330562 - DNA, 22 bp, Homo sapiens
tgaggggatacggtacacattg

SEQ ID NO: 8330563 - DNA, 22 bp, Homo sapiens
tgaggctcaagaatagacagta

SEQ ID NO: 8330564 - DNA, 22 bp, Homo sapiens
tgaggctcaagaaagatttgtt

SEQ ID NO: 8330565 - DNA, 22 bp, Homo sapiens
tgaggcctgtcattgtcttgtt

SEQ ID NO: 8330566 - DNA, 22 bp, Homo sapiens
tgaggcctgggcacataacctc

SEQ ID NO: 8330567 - DNA, 22 bp, Homo sapiens
tgaggccttttctgtctggcta

SEQ ID NO: 8330568 - DNA, 22 bp, Homo sapiens
tgaggcctggactctgcatgga

SEQ ID NO: 8330569 - DNA, 22 bp, Homo sapiens
tgaggcctggagggaggagttt

SEQ ID NO: 8330570 - DNA, 22 bp, Homo sapiens
tgaggcctgccctggggaagtt

SEQ ID NO: 8330571 - DNA, 22 bp, Homo sapiens
tgaggcctgcttggaattgaat

SEQ ID NO: 8330572 - DNA, 20 bp, Homo sapiens
tgaggctcagagaggttgag

SEQ ID NO: 8330573 - DNA, 22 bp, Homo sapiens
tgaggctccttgtagagagtgg

SEQ ID NO: 8330574 - DNA, 22 bp, Homo sapiens
tgaggctcacgaacagaagact

SEQ ID NO: 8330575 - DNA, 22 bp, Homo sapiens
tgaggctcacgaacagaagact

SEQ ID NO: 8330576 - DNA, 22 bp, Homo sapiens
tgaggctcagagaagtgctgtt

SEQ ID NO: 8330577 - DNA, 22 bp, Homo sapiens
tgaggctggatgggatgcctcc

SEQ ID NO: 8330578 - DNA, 22 bp, Homo sapiens
tgaggctctccaagcagatgag

SEQ ID NO: 8330579 - DNA, 22 bp, Homo sapiens
tgaggctctgcttctgtggctc

SEQ ID NO: 8330580 - DNA, 21 bp, Homo sapiens
tgaggctctgttgtgcctgca

SEQ ID NO: 8330581 - DNA, 22 bp, Homo sapiens
tgaggtgggtgtcaggtcagag

SEQ ID NO: 8330582 - DNA, 22 bp, Homo sapiens
tgaggtggctagggaggcactc

SEQ ID NO: 8330583 - DNA, 22 bp, Homo sapiens
tgagggtgcatttagcatgtag

SEQ ID NO: 8330584 - DNA, 22 bp, Homo sapiens
tgagggggttaattaggagagt

SEQ ID NO: 8330585 - DNA, 22 bp, Homo sapiens
tgaggggggtaatcactgggtt

SEQ ID NO: 8330586 - DNA, 22 bp, Homo sapiens
tgaggggccagaccccacctag

SEQ ID NO: 8330587 - DNA, 22 bp, Homo sapiens
tgaggggcatgtgtttacacat

SEQ ID NO: 8330588 - DNA, 22 bp, Homo sapiens
tgaggggcgctggcaggttcct

SEQ ID NO: 8330589 - DNA, 22 bp, Homo sapiens
tgaggggcggcctgcagaggcc

SEQ ID NO: 8330590 - DNA, 19 bp, Homo sapiens
tgaggggctcacagtctca

SEQ ID NO: 8330591 - DNA, 22 bp, Homo sapiens
tgagggtggccttgtgtggact

SEQ ID NO: 8330592 - DNA, 22 bp, Homo sapiens
tgagggtgtgcggcccagacag

SEQ ID NO: 8330593 - DNA, 21 bp, Homo sapiens
tgaggtagccagtgagatgga

SEQ ID NO: 8330594 - DNA, 22 bp, Homo sapiens
tgaggtagagattgtgactgta

SEQ ID NO: 8330595 - DNA, 18 bp, Homo sapiens
tgaggtagctttcctcct

SEQ ID NO: 8330596 - DNA, 22 bp, Homo sapiens
tgaggtagctgtttagaaagac

SEQ ID NO: 8330597 - DNA, 22 bp, Homo sapiens
tgaggtagctgctatttgtagt

SEQ ID NO: 8330598 - DNA, 22 bp, Homo sapiens
tgaggtagaaaaagcttgtagt

SEQ ID NO: 8330599 - DNA, 22 bp, Homo sapiens
tgaggtagaagttgggctgctt

SEQ ID NO: 8330600 - DNA, 22 bp, Homo sapiens
tgaggtagaagcctgggttgag

SEQ ID NO: 8330601 - DNA, 22 bp, Homo sapiens
tgaggtaggagtgggaaagtag

SEQ ID NO: 8330602 - DNA, 22 bp, Homo sapiens
tgaggtaggataagacaatgag

SEQ ID NO: 8330603 - DNA, 22 bp, Homo sapiens
tgaggtctgcagggctgtgcat

SEQ ID NO: 8330604 - DNA, 22 bp, Homo sapiens
tgaggtaggaatttgtattggg

SEQ ID NO: 8330605 - DNA, 22 bp, Homo sapiens
tgaggtaggagggtgatcagca

SEQ ID NO: 8330606 - DNA, 22 bp, Homo sapiens
tgaggtaggaggattgattgag

SEQ ID NO: 8330607 - DNA, 22 bp, Homo sapiens
tgagacaatatcctttgtaacc

SEQ ID NO: 8330608 - DNA, 22 bp, Homo sapiens
tgagacaacagcttgtgctgct

SEQ ID NO: 8330609 - DNA, 22 bp, Homo sapiens
tgagacaacagcttgtgctgct

SEQ ID NO: 8330610 - DNA, 22 bp, Homo sapiens
tgagacagcagattagcaatga

SEQ ID NO: 8330611 - DNA, 19 bp, Homo sapiens
tgagacagagaccagttct

SEQ ID NO: 8330612 - DNA, 22 bp, Homo sapiens
tgagacaggcttccttcttggg

SEQ ID NO: 8330613 - DNA, 22 bp, Homo sapiens
tgagacagcccttctgcacagg

SEQ ID NO: 8330614 - DNA, 22 bp, Homo sapiens
tgagacagggtcttgctctgtt

SEQ ID NO: 8330615 - DNA, 23 bp, Homo sapiens
tgagaaattttgattcagtagga

SEQ ID NO: 8330616 - DNA, 22 bp, Homo sapiens
tgagaagattgggcagagtgga

SEQ ID NO: 8330617 - DNA, 22 bp, Homo sapiens
tgagaaatattgcacagtgagg

SEQ ID NO: 8330618 - DNA, 22 bp, Homo sapiens
tgagaaagtgggtgcctagcaa

SEQ ID NO: 8330619 - DNA, 20 bp, Homo sapiens
tgagaaagtagagactcagg

SEQ ID NO: 8330620 - DNA, 22 bp, Homo sapiens
tgagaaaggtatttcatgcact

SEQ ID NO: 8330621 - DNA, 19 bp, Homo sapiens
tgagaaattccacaggatg

SEQ ID NO: 8330622 - DNA, 22 bp, Homo sapiens
tgagaaatccagatgtgcagtt

SEQ ID NO: 8330623 - DNA, 22 bp, Homo sapiens
tgagaaagcctttagtcccagg

SEQ ID NO: 8330624 - DNA, 22 bp, Homo sapiens
tgagaaagacagacattcctaa

SEQ ID NO: 8330625 - DNA, 22 bp, Homo sapiens
tgagaaaagtgtggaggtcaat

SEQ ID NO: 8330626 - DNA, 22 bp, Homo sapiens
tgagagagcgcctgggatcatt

SEQ ID NO: 8330627 - DNA, 22 bp, Homo sapiens
tgagagagcctgaatctcttac

SEQ ID NO: 8330628 - DNA, 22 bp, Homo sapiens
tgagagagtaattgagtggtaa

SEQ ID NO: 8330629 - DNA, 22 bp, Homo sapiens
tgagagagggatgcaccctcct

SEQ ID NO: 8330630 - DNA, 22 bp, Homo sapiens
tgagagaggggactgcctgctt

SEQ ID NO: 8330631 - DNA, 22 bp, Homo sapiens
tgagagaggatgccctcatatt

SEQ ID NO: 8330632 - DNA, 21 bp, Homo sapiens
tgagagagtagcaggacatat

SEQ ID NO: 8330633 - DNA, 22 bp, Homo sapiens
tgagagcacacagaaatatttt

SEQ ID NO: 8330634 - DNA, 22 bp, Homo sapiens
tgagaggcagaatggtgcctgc

SEQ ID NO: 8330635 - DNA, 22 bp, Homo sapiens
tgagaggcgctcactctcaggt

SEQ ID NO: 8330636 - DNA, 22 bp, Homo sapiens
tgagaggcgctcactctcaggt

SEQ ID NO: 8330637 - DNA, 18 bp, Homo sapiens
tgagaggctattttttgc

SEQ ID NO: 8330638 - DNA, 22 bp, Homo sapiens
tgagagggcccagagcacacca

SEQ ID NO: 8330639 - DNA, 22 bp, Homo sapiens
tgagagggttcccaggggtttc

SEQ ID NO: 8330640 - DNA, 22 bp, Homo sapiens
tgagatggattgggttggttcc

SEQ ID NO: 8330641 - DNA, 22 bp, Homo sapiens
tgagatggagttttggggatat

SEQ ID NO: 8330642 - DNA, 22 bp, Homo sapiens
tgagatgggtcatcaggtttgg

SEQ ID NO: 8330643 - DNA, 22 bp, Homo sapiens
tgagatgggtgtccagggagga

SEQ ID NO: 8330644 - DNA, 22 bp, Homo sapiens
tgagatggttgaccagagagca

SEQ ID NO: 8330645 - DNA, 22 bp, Homo sapiens
tgagatgctgctgtaacaaata

SEQ ID NO: 8330646 - DNA, 22 bp, Homo sapiens
tgagatgaataactcctgctaa

SEQ ID NO: 8330647 - DNA, 22 bp, Homo sapiens
tgagatgctgggaacaaggaag

SEQ ID NO: 8330648 - DNA, 22 bp, Homo sapiens
tgagatggagtcttgctctgtt

SEQ ID NO: 8330649 - DNA, 22 bp, Homo sapiens
tgagatcacttacgtggctgca

SEQ ID NO: 8330650 - DNA, 22 bp, Homo sapiens
tgagcctggagtcgtggagggg

SEQ ID NO: 8330651 - DNA, 22 bp, Homo sapiens
tgagcctgcctgcaggtgtgct

SEQ ID NO: 8330652 - DNA, 20 bp, Homo sapiens
tgagcctgctgtaggaggcc

SEQ ID NO: 8330653 - DNA, 22 bp, Homo sapiens
tgagcctggggcctgggcagcg

SEQ ID NO: 8330654 - DNA, 22 bp, Homo sapiens
tgagccctaagggtcaagcagg

SEQ ID NO: 8330655 - DNA, 22 bp, Homo sapiens
tgagccctacctgctcatctcc

SEQ ID NO: 8330656 - DNA, 22 bp, Homo sapiens
tgagccctccaaacccaggatt

SEQ ID NO: 8330657 - DNA, 22 bp, Homo sapiens
tgagcccatgtagcacttccat

SEQ ID NO: 8330658 - DNA, 22 bp, Homo sapiens
tgagcccatgtagcacttccat

SEQ ID NO: 8330659 - DNA, 22 bp, Homo sapiens
tgagcccttgacatcgcccact

SEQ ID NO: 8330660 - DNA, 22 bp, Homo sapiens
tgagccaggtctcactcacctt

SEQ ID NO: 8330661 - DNA, 22 bp, Homo sapiens
tgagctggtcttgagtgtagct

SEQ ID NO: 8330662 - DNA, 22 bp, Homo sapiens
tgagctggttcttgaggcatga

SEQ ID NO: 8330663 - DNA, 22 bp, Homo sapiens
tgagctgtgtcctgggggcagt

SEQ ID NO: 8330664 - DNA, 22 bp, Homo sapiens
tgagctttcatgtatgaaaaga

SEQ ID NO: 8330665 - DNA, 22 bp, Homo sapiens
tgagctttgtgggtaaagagag

SEQ ID NO: 8330666 - DNA, 21 bp, Homo sapiens
tgagccaggctgacggctgtg

SEQ ID NO: 8330667 - DNA, 22 bp, Homo sapiens
tgagccaggcactgctcctgga

SEQ ID NO: 8330668 - DNA, 22 bp, Homo sapiens
tgagccaggcactgctcctgga

SEQ ID NO: 8330669 - DNA, 22 bp, Homo sapiens
tgagccagctccttgcctgtca

SEQ ID NO: 8330670 - DNA, 22 bp, Homo sapiens
tgagccaagatcatgccgttgt

SEQ ID NO: 8330671 - DNA, 22 bp, Homo sapiens
tgagcattggatcaaatgactt

SEQ ID NO: 8330672 - DNA, 22 bp, Homo sapiens
tgagccaaacttctccttggtc

SEQ ID NO: 8330673 - DNA, 22 bp, Homo sapiens
tgagcaggactcactgcagcct

SEQ ID NO: 8330674 - DNA, 22 bp, Homo sapiens
tgagcagaggagtgacgtaggt

SEQ ID NO: 8330675 - DNA, 22 bp, Homo sapiens
tgactctgctgtgaaagcattt

SEQ ID NO: 8330676 - DNA, 22 bp, Homo sapiens
tgactctggggttgaccagatg

SEQ ID NO: 8330677 - DNA, 19 bp, Homo sapiens
tgactctgtggaacagaag

SEQ ID NO: 8330678 - DNA, 22 bp, Homo sapiens
tgactcctggtatggatgacag

SEQ ID NO: 8330679 - DNA, 21 bp, Homo sapiens
tgactaattgtgataaagtgc

SEQ ID NO: 8330680 - DNA, 22 bp, Homo sapiens
tgacttcctgcactcaggtgat

SEQ ID NO: 8330681 - DNA, 22 bp, Homo sapiens
tgacttaagctgttctttagat

SEQ ID NO: 8330682 - DNA, 22 bp, Homo sapiens
tgacttgtctctttgggagaca

SEQ ID NO: 8330683 - DNA, 22 bp, Homo sapiens
tgactgccgattgtccttctct

SEQ ID NO: 8330684 - DNA, 22 bp, Homo sapiens
tgacatttatcaaagaaatggt

SEQ ID NO: 8330685 - DNA, 18 bp, Homo sapiens
tgacatttccagagtgta

SEQ ID NO: 8330686 - DNA, 22 bp, Homo sapiens
tgacagacatggaagccagagt

SEQ ID NO: 8330687 - DNA, 22 bp, Homo sapiens
tgacagatgaagctggggacca

SEQ ID NO: 8330688 - DNA, 22 bp, Homo sapiens
tgacagattttttctgagctaa

SEQ ID NO: 8330689 - DNA, 22 bp, Homo sapiens
tgacagcagcatagtgagcaat

SEQ ID NO: 8330690 - DNA, 22 bp, Homo sapiens
tgacaggaggcttgaggccagg

SEQ ID NO: 8330691 - DNA, 23 bp, Homo sapiens
tgacaggctgcttctggctgagg

SEQ ID NO: 8330692 - DNA, 22 bp, Homo sapiens
tgacaggcagtgctgggcatgt

SEQ ID NO: 8330693 - DNA, 22 bp, Homo sapiens
tgacaggctaggaggctgaagg

SEQ ID NO: 8330694 - DNA, 22 bp, Homo sapiens
tgaaggcctaacttccagtgct

SEQ ID NO: 8330695 - DNA, 23 bp, Homo sapiens
tgaaggccctggagccacgaggc

SEQ ID NO: 8330696 - DNA, 22 bp, Homo sapiens
tgaaggcccagccacagaatgg

SEQ ID NO: 8330697 - DNA, 22 bp, Homo sapiens
tgaaggccagcagagtgaaggc

SEQ ID NO: 8330698 - DNA, 22 bp, Homo sapiens
tgaagtttaaggttagataagt

SEQ ID NO: 8330699 - DNA, 22 bp, Homo sapiens
tgaagtttcttgaatcttggag

SEQ ID NO: 8330700 - DNA, 22 bp, Homo sapiens
tgaagtttcttgaatcttggag

SEQ ID NO: 8330701 - DNA, 22 bp, Homo sapiens
tgaataaattgagagcgaatgt

SEQ ID NO: 8330702 - DNA, 22 bp, Homo sapiens
tgaagttttctggttgattaag

SEQ ID NO: 8330703 - DNA, 22 bp, Homo sapiens
tgaagttttacatcctctccaa

SEQ ID NO: 8330704 - DNA, 23 bp, Homo sapiens
tgaatgtttattctcggtgcaga

SEQ ID NO: 8330705 - DNA, 22 bp, Homo sapiens
tgaatgttctctaaatactcct

SEQ ID NO: 8330706 - DNA, 22 bp, Homo sapiens
tgaatgagaacactgaaagagg

SEQ ID NO: 8330707 - DNA, 22 bp, Homo sapiens
tgaatagtccttggaataactg

SEQ ID NO: 8330708 - DNA, 22 bp, Homo sapiens
tgaatttaccttgcctatattt

SEQ ID NO: 8330709 - DNA, 23 bp, Homo sapiens
tgaatttggaactcagagaatta

SEQ ID NO: 8330710 - DNA, 22 bp, Homo sapiens
tgaatttatcaaagattcttaa

SEQ ID NO: 8330711 - DNA, 22 bp, Homo sapiens
tgaatttatcaaagattcttaa

SEQ ID NO: 8330712 - DNA, 22 bp, Homo sapiens
tgacaaaactgcaattactttt

SEQ ID NO: 8330713 - DNA, 22 bp, Homo sapiens
tgacaaaccagtagcaataaag

SEQ ID NO: 8330714 - DNA, 20 bp, Homo sapiens
tgacacaaattgctttctca

SEQ ID NO: 8330715 - DNA, 22 bp, Homo sapiens
tgaaatgtttatctctcctgct

SEQ ID NO: 8330716 - DNA, 22 bp, Homo sapiens
tgaaatgtttgaagaccactga

SEQ ID NO: 8330717 - DNA, 22 bp, Homo sapiens
tgaaatgtttaggaccactaga

SEQ ID NO: 8330718 - DNA, 22 bp, Homo sapiens
tgaaatgtttaggaccactaga

SEQ ID NO: 8330719 - DNA, 22 bp, Homo sapiens
tgaaatgttggtaattttatat

SEQ ID NO: 8330720 - DNA, 22 bp, Homo sapiens
tgaaatgttgccatgaggtctc

SEQ ID NO: 8330721 - DNA, 22 bp, Homo sapiens
tgaaatgttaatcacacaaagg

SEQ ID NO: 8330722 - DNA, 22 bp, Homo sapiens
tgaaatgtgttctagtgttttg

SEQ ID NO: 8330723 - DNA, 22 bp, Homo sapiens
tgaaatgttaaacaagtggctc

SEQ ID NO: 8330724 - DNA, 22 bp, Homo sapiens
tgaaatgtgttctagtgttttg

SEQ ID NO: 8330725 - DNA, 22 bp, Homo sapiens
tgaaatgtctgaaagccaatct

SEQ ID NO: 8330726 - DNA, 22 bp, Homo sapiens
tgaaatgtctttgcaattgaaa

SEQ ID NO: 8330727 - DNA, 22 bp, Homo sapiens
tgaaatgtgatctgagcttggc

SEQ ID NO: 8330728 - DNA, 22 bp, Homo sapiens
tgaaatgtgtccatgttatttc

SEQ ID NO: 8330729 - DNA, 22 bp, Homo sapiens
tgaaatgtgttatctgggcctg

SEQ ID NO: 8330730 - DNA, 22 bp, Homo sapiens
tgaaatgtcatcctttagccat

SEQ ID NO: 8330731 - DNA, 22 bp, Homo sapiens
tgaaatgtctcacttagacttt

SEQ ID NO: 8330732 - DNA, 22 bp, Homo sapiens
tgaaatgtcagtgttttataag

SEQ ID NO: 8330733 - DNA, 22 bp, Homo sapiens
tgaaatgtcagtgttttataag

SEQ ID NO: 8330734 - DNA, 22 bp, Homo sapiens
tgaaatgtagtgaagcatggaa

SEQ ID NO: 8330735 - DNA, 23 bp, Homo sapiens
tgaaatgtagaggaattccacct

SEQ ID NO: 8330736 - DNA, 22 bp, Homo sapiens
tgaaatgtacataaaaacgcac

SEQ ID NO: 8330737 - DNA, 22 bp, Homo sapiens
tgaaatcatgagatagtgtcac

SEQ ID NO: 8330738 - DNA, 22 bp, Homo sapiens
tgaaatgcaacagttatttttg

SEQ ID NO: 8330739 - DNA, 22 bp, Homo sapiens
tgaaatgtacaagtgctttttt

SEQ ID NO: 8330740 - DNA, 22 bp, Homo sapiens
tgaaatgtacaagtgctttttt

SEQ ID NO: 8330741 - DNA, 22 bp, Homo sapiens
tgaaatatttagagagtaagtt

SEQ ID NO: 8330742 - DNA, 22 bp, Homo sapiens
tgaaatcaataattggtgattg

SEQ ID NO: 8330743 - DNA, 22 bp, Homo sapiens
tgaaatcataacagtttggctt

SEQ ID NO: 8330744 - DNA, 22 bp, Homo sapiens
tgaaataggaaacagatgtttc

SEQ ID NO: 8330745 - DNA, 22 bp, Homo sapiens
tgaaatacacaaatttagtaag

SEQ ID NO: 8330746 - DNA, 22 bp, Homo sapiens
tgaaatagacttgcactatatg

SEQ ID NO: 8330747 - DNA, 22 bp, Homo sapiens
tgaaatagtctaaaaaaccaga

SEQ ID NO: 8330748 - DNA, 22 bp, Homo sapiens
tgaaatatccagcccagcagga

SEQ ID NO: 8330749 - DNA, 22 bp, Homo sapiens
tgaaagttacaggaaaacagat

SEQ ID NO: 8330750 - DNA, 22 bp, Homo sapiens
tgaaagttaggatgtagtaatt

SEQ ID NO: 8330751 - DNA, 22 bp, Homo sapiens
tgaaagttattactgatgatgt

SEQ ID NO: 8330752 - DNA, 20 bp, Homo sapiens
tgaaaggtgggaattgtggg

SEQ ID NO: 8330753 - DNA, 22 bp, Homo sapiens
tgaaagatgctcaatgaatggt

SEQ ID NO: 8330754 - DNA, 22 bp, Homo sapiens
tgaaagcaacctgtaacagtga

SEQ ID NO: 8330755 - DNA, 22 bp, Homo sapiens
tgaagactcagaagctaagata

SEQ ID NO: 8330756 - DNA, 22 bp, Homo sapiens
tgaagactcagaagctaagata

SEQ ID NO: 8330757 - DNA, 18 bp, Homo sapiens
tgaacttttcctgctgct

SEQ ID NO: 8330758 - DNA, 22 bp, Homo sapiens
tgaacttttatttgatgacagg

SEQ ID NO: 8330759 - DNA, 22 bp, Homo sapiens
tgaacatacaattattaagaac

SEQ ID NO: 8330760 - DNA, 22 bp, Homo sapiens
tgaacatgctgttgatggcctg

SEQ ID NO: 8330761 - DNA, 22 bp, Homo sapiens
tgaactgagcagtttcctggga

SEQ ID NO: 8330762 - DNA, 22 bp, Homo sapiens
tgaacttagtgggaatatctct

SEQ ID NO: 8330763 - DNA, 22 bp, Homo sapiens
tgaacttgaattttggaaatac

SEQ ID NO: 8330764 - DNA, 22 bp, Homo sapiens
tgaacttcagtgcataattatc

SEQ ID NO: 8330765 - DNA, 22 bp, Homo sapiens
tgaactttgtagtaatggagat

SEQ ID NO: 8330766 - DNA, 18 bp, Homo sapiens
tgaactttggtgtctctc

SEQ ID NO: 8330767 - DNA, 22 bp, Homo sapiens
tgaactttcacaagaatatgct

SEQ ID NO: 8330768 - DNA, 22 bp, Homo sapiens
tgaacaaactgcattcttcact

SEQ ID NO: 8330769 - DNA, 18 bp, Homo sapiens
tgaaattgcatccatgag

SEQ ID NO: 8330770 - DNA, 22 bp, Homo sapiens
tgaaatttaggtgcagataaat

SEQ ID NO: 8330771 - DNA, 22 bp, Homo sapiens
tctttgcattcctgtgtgcttt

SEQ ID NO: 8330772 - DNA, 22 bp, Homo sapiens
tctttgctattgtgaatagtgc

SEQ ID NO: 8330773 - DNA, 22 bp, Homo sapiens
tctttggaagctttcagagaag

SEQ ID NO: 8330774 - DNA, 22 bp, Homo sapiens
tctttgcagtctgggcttgttt

SEQ ID NO: 8330775 - DNA, 22 bp, Homo sapiens
tctttggatcccaactggctgg

SEQ ID NO: 8330776 - DNA, 22 bp, Homo sapiens
tctttggatctcaaggtggcag

SEQ ID NO: 8330777 - DNA, 22 bp, Homo sapiens
tctttggaatgctagcattcta

SEQ ID NO: 8330778 - DNA, 22 bp, Homo sapiens
tctttgtctgaacagggacatt

SEQ ID NO: 8330779 - DNA, 22 bp, Homo sapiens
tctttgtaagttatatgtagta

SEQ ID NO: 8330780 - DNA, 22 bp, Homo sapiens
tctttggcatttaggagcagga

SEQ ID NO: 8330781 - DNA, 22 bp, Homo sapiens
tctttggcatcagggccagcta

SEQ ID NO: 8330782 - DNA, 20 bp, Homo sapiens
tctttgtgtcagatggacag

SEQ ID NO: 8330783 - DNA, 22 bp, Homo sapiens
tctttgtgttcaggagccacgt

SEQ ID NO: 8330784 - DNA, 22 bp, Homo sapiens
tcttttaaaagccctgctgtct

SEQ ID NO: 8330785 - DNA, 22 bp, Homo sapiens
tcttttaacctaactagcttgg

SEQ ID NO: 8330786 - DNA, 22 bp, Homo sapiens
tcttttgtggatgaagaaatgg

SEQ ID NO: 8330787 - DNA, 22 bp, Homo sapiens
tcttttccttccctacagatct

SEQ ID NO: 8330788 - DNA, 22 bp, Homo sapiens
tcttttccttccctacagatct

SEQ ID NO: 8330789 - DNA, 22 bp, Homo sapiens
tcttttcattgagaacacactg

SEQ ID NO: 8330790 - DNA, 22 bp, Homo sapiens
tcttttatctgttgtgtaacaa

SEQ ID NO: 8330791 - DNA, 20 bp, Homo sapiens
tgaaaaggtcaggagacatg

SEQ ID NO: 8330792 - DNA, 22 bp, Homo sapiens
tgaaaagtcttatattgtctga

SEQ ID NO: 8330793 - DNA, 22 bp, Homo sapiens
tgaaaagtcttatattgtctga

SEQ ID NO: 8330794 - DNA, 22 bp, Homo sapiens
tgaaaatatagttttccagact

SEQ ID NO: 8330795 - DNA, 22 bp, Homo sapiens
tgaaaagtgatcatggattagg

SEQ ID NO: 8330796 - DNA, 22 bp, Homo sapiens
tgaaaattcatctcatagcaga

SEQ ID NO: 8330797 - DNA, 22 bp, Homo sapiens
tgaaaattaagcagatgaatga

SEQ ID NO: 8330798 - DNA, 22 bp, Homo sapiens
tgaaaattgttgtacttgataa

SEQ ID NO: 8330799 - DNA, 22 bp, Homo sapiens
tgaaaatttccatcagttatat

SEQ ID NO: 8330800 - DNA, 22 bp, Homo sapiens
tgaaaatttccatcagttatat

SEQ ID NO: 8330801 - DNA, 22 bp, Homo sapiens
tgaaaatttccatcagttatat

SEQ ID NO: 8330802 - DNA, 22 bp, Homo sapiens
tctttttatattgacaaaaggt

SEQ ID NO: 8330803 - DNA, 22 bp, Homo sapiens
tctttttttcctgtgcagagct

SEQ ID NO: 8330804 - DNA, 22 bp, Homo sapiens
tctttttatattgacaaaaggt

SEQ ID NO: 8330805 - DNA, 22 bp, Homo sapiens
tctttttatattgacaaaaggt

SEQ ID NO: 8330806 - DNA, 23 bp, Homo sapiens
tctttttaagagatctagtgacg

SEQ ID NO: 8330807 - DNA, 22 bp, Homo sapiens
tgaaaacactttagtttaggtc

SEQ ID NO: 8330808 - DNA, 22 bp, Homo sapiens
tgaaagaactagcatcttcaag

SEQ ID NO: 8330809 - DNA, 22 bp, Homo sapiens
tgaaagaaacaggtatattggg

SEQ ID NO: 8330810 - DNA, 22 bp, Homo sapiens
tgaaacaaaagtatgtagcttg

SEQ ID NO: 8330811 - DNA, 22 bp, Homo sapiens
tgattaatatcaccaccattgg

SEQ ID NO: 8330812 - DNA, 22 bp, Homo sapiens
tgattcaattatctgatgcttt

SEQ ID NO: 8330813 - DNA, 22 bp, Homo sapiens
tgattacacaccacagtgctcc

SEQ ID NO: 8330814 - DNA, 22 bp, Homo sapiens
tgattcaataggaattgagtag

SEQ ID NO: 8330815 - DNA, 18 bp, Homo sapiens
tgattcaagttgccctcc

SEQ ID NO: 8330816 - DNA, 22 bp, Homo sapiens
tgattcaataggaattgagtag

SEQ ID NO: 8330817 - DNA, 22 bp, Homo sapiens
tgattaaaatttaacttagtta

SEQ ID NO: 8330818 - DNA, 22 bp, Homo sapiens
tgattaaattaattaagatgag

SEQ ID NO: 8330819 - DNA, 22 bp, Homo sapiens
tgattaaattaattaagatgag

SEQ ID NO: 8330820 - DNA, 23 bp, Homo sapiens
tgattgaaatgaggagtatttgt

SEQ ID NO: 8330821 - DNA, 22 bp, Homo sapiens
tgatttaaaagaaacattgtct

SEQ ID NO: 8330822 - DNA, 21 bp, Homo sapiens
tgattgatatttgcaaacaga

SEQ ID NO: 8330823 - DNA, 22 bp, Homo sapiens
tgattgaattcaaatgcaatct

SEQ ID NO: 8330824 - DNA, 21 bp, Homo sapiens
tgattctgcatttctaacagg

SEQ ID NO: 8330825 - DNA, 22 bp, Homo sapiens
tgatggtagggatactacagga

SEQ ID NO: 8330826 - DNA, 22 bp, Homo sapiens
tgatggtaaacaaagacattta

SEQ ID NO: 8330827 - DNA, 22 bp, Homo sapiens
tgatggaaggtttctcggtgat

SEQ ID NO: 8330828 - DNA, 22 bp, Homo sapiens
tgatgaaactgaggttccaaga

SEQ ID NO: 8330829 - DNA, 22 bp, Homo sapiens
tgatgaaagttcagtagtgaat

SEQ ID NO: 8330830 - DNA, 22 bp, Homo sapiens
tgatctttgggccattaataaa

SEQ ID NO: 8330831 - DNA, 22 bp, Homo sapiens
tgatgctttaagattaatctgg

SEQ ID NO: 8330832 - DNA, 22 bp, Homo sapiens
tgatgcaatgtttacatcttga

SEQ ID NO: 8330833 - DNA, 22 bp, Homo sapiens
tgatgcacaaagtcagcatcct

SEQ ID NO: 8330834 - DNA, 22 bp, Homo sapiens
tgagtgaggaagcggtggagga

SEQ ID NO: 8330835 - DNA, 19 bp, Homo sapiens
tgagtgtcacgtcagtgcc

SEQ ID NO: 8330836 - DNA, 22 bp, Homo sapiens
tgagtgtctggtcatggcaggc

SEQ ID NO: 8330837 - DNA, 22 bp, Homo sapiens
tgagttctaggcttaaaactaa

SEQ ID NO: 8330838 - DNA, 22 bp, Homo sapiens
tgagttaagcaggtagcaagct

SEQ ID NO: 8330839 - DNA, 22 bp, Homo sapiens
tgagttactgcctagtaacttg

SEQ ID NO: 8330840 - DNA, 17 bp, Homo sapiens
tgagttaagtttagatc

SEQ ID NO: 8330841 - DNA, 22 bp, Homo sapiens
tgagttaaatgagaacatgaaa

SEQ ID NO: 8330842 - DNA, 22 bp, Homo sapiens
tgatcattatcaaactggtcat

SEQ ID NO: 8330843 - DNA, 21 bp, Homo sapiens
tgatcatttgtgtaaaggaga

SEQ ID NO: 8330844 - DNA, 22 bp, Homo sapiens
tgatcactttggaagttggggg

SEQ ID NO: 8330845 - DNA, 22 bp, Homo sapiens
tgatcaaaacattactccacca

SEQ ID NO: 8330846 - DNA, 22 bp, Homo sapiens
tgagttctgactgtgatgccag

SEQ ID NO: 8330847 - DNA, 22 bp, Homo sapiens
tgagttctccaagagaaggtat

SEQ ID NO: 8330848 - DNA, 22 bp, Homo sapiens
tgagttctcacccattcttctt

SEQ ID NO: 8330849 - DNA, 22 bp, Homo sapiens
tgagttctccaagagaaggtaa

SEQ ID NO: 8330850 - DNA, 23 bp, Homo sapiens
tgagttctaggcttaaaactagc

SEQ ID NO: 8330851 - DNA, 22 bp, Homo sapiens
tgagttctagtggctgcagatt

SEQ ID NO: 8330852 - DNA, 22 bp, Homo sapiens
tgatataagaagtagtatggat

SEQ ID NO: 8330853 - DNA, 22 bp, Homo sapiens
tgcaactaggaggttcttagct

SEQ ID NO: 8330854 - DNA, 22 bp, Homo sapiens
tgcaacaaggcctcatttcttg

SEQ ID NO: 8330855 - DNA, 23 bp, Homo sapiens
tgcaacaatgaggaaagctactg

SEQ ID NO: 8330856 - DNA, 22 bp, Homo sapiens
tgcaaatttctttagtacataa

SEQ ID NO: 8330857 - DNA, 21 bp, Homo sapiens
tgcaatccagcctgggcgaca

SEQ ID NO: 8330858 - DNA, 22 bp, Homo sapiens
tgattttcatgggtgatctttg

SEQ ID NO: 8330859 - DNA, 22 bp, Homo sapiens
tgatttttagctattctgaaga

SEQ ID NO: 8330860 - DNA, 22 bp, Homo sapiens
tgatttttagctattctgaaga

SEQ ID NO: 8330861 - DNA, 22 bp, Homo sapiens
tgatttttagctattctgaaga

SEQ ID NO: 8330862 - DNA, 22 bp, Homo sapiens
tgatttttggatctgagctgca

SEQ ID NO: 8330863 - DNA, 22 bp, Homo sapiens
tgcaaaaacagccttgaggcct

SEQ ID NO: 8330864 - DNA, 22 bp, Homo sapiens
tgatttttggatctgagctgca

SEQ ID NO: 8330865 - DNA, 22 bp, Homo sapiens
tgcaaaaaggcagactggtgat

SEQ ID NO: 8330866 - DNA, 22 bp, Homo sapiens
tgcaaaaactgcaattgctttt

SEQ ID NO: 8330867 - DNA, 22 bp, Homo sapiens
tgcaaaaactgcaattgctttt

SEQ ID NO: 8330868 - DNA, 22 bp, Homo sapiens
tgcaaaagaatatagatattgt

SEQ ID NO: 8330869 - DNA, 22 bp, Homo sapiens
tgatttacttctggataaatcc

SEQ ID NO: 8330870 - DNA, 22 bp, Homo sapiens
tgatttacacacctatgattta

SEQ ID NO: 8330871 - DNA, 22 bp, Homo sapiens
tgatttacaattgtaaaagttt

SEQ ID NO: 8330872 - DNA, 22 bp, Homo sapiens
tgatttacacatcaaagcagca

SEQ ID NO: 8330873 - DNA, 22 bp, Homo sapiens
tgatttacagtagtgtctaaac

SEQ ID NO: 8330874 - DNA, 22 bp, Homo sapiens
tgatttaccagttactatcttg

SEQ ID NO: 8330875 - DNA, 22 bp, Homo sapiens
tgcaaacaggagagtaagtata

SEQ ID NO: 8330876 - DNA, 22 bp, Homo sapiens
tgcaaactattggtagagatgg

SEQ ID NO: 8330877 - DNA, 22 bp, Homo sapiens
tgcaaatgatgaaactaacttt

SEQ ID NO: 8330878 - DNA, 22 bp, Homo sapiens
tgcaaatgcccatttattttct

SEQ ID NO: 8330879 - DNA, 22 bp, Homo sapiens
tgcaaatggagcatgtataaga

SEQ ID NO: 8330880 - DNA, 19 bp, Homo sapiens
tgcaaatgctgttgagaat

SEQ ID NO: 8330881 - DNA, 22 bp, Homo sapiens
tgcaaatgagttgcagatcagg

SEQ ID NO: 8330882 - DNA, 22 bp, Homo sapiens
tgcaaatgtgttttaaaccaaa

SEQ ID NO: 8330883 - DNA, 22 bp, Homo sapiens
tgcaaatgtgtggtgaggcatt

SEQ ID NO: 8330884 - DNA, 19 bp, Homo sapiens
tgcaaatgtaggaagaata

SEQ ID NO: 8330885 - DNA, 22 bp, Homo sapiens
tgcaaatgtgtaggtttacata

SEQ ID NO: 8330886 - DNA, 22 bp, Homo sapiens
tgcaaatgtcaagggttagtgt

SEQ ID NO: 8330887 - DNA, 22 bp, Homo sapiens
tgcaaatgggtgagggttagga

SEQ ID NO: 8330888 - DNA, 22 bp, Homo sapiens
tgcaaatgggcatctccaagtg

SEQ ID NO: 8330889 - DNA, 22 bp, Homo sapiens
tgcaaatgggaaacccagcagt

SEQ ID NO: 8330890 - DNA, 18 bp, Homo sapiens
tgcaaatggctgtttgat

SEQ ID NO: 8330891 - DNA, 19 bp, Homo sapiens
tgcaaattctaaaaactga

SEQ ID NO: 8330892 - DNA, 22 bp, Homo sapiens
tgcagctctgggtgtagaggct

SEQ ID NO: 8330893 - DNA, 22 bp, Homo sapiens
tgcagctcaggattctcagggc

SEQ ID NO: 8330894 - DNA, 22 bp, Homo sapiens
tgcagctctgcatggctggttc

SEQ ID NO: 8330895 - DNA, 22 bp, Homo sapiens
tgcagctcgggcttagggtggg

SEQ ID NO: 8330896 - DNA, 22 bp, Homo sapiens
tgcagctcaagctggtgaggtg

SEQ ID NO: 8330897 - DNA, 22 bp, Homo sapiens
tgcagcctttagaagttcagat

SEQ ID NO: 8330898 - DNA, 17 bp, Homo sapiens
tgcagctgctcccaggc

SEQ ID NO: 8330899 - DNA, 22 bp, Homo sapiens
tgcagctgatgatacccccatg

SEQ ID NO: 8330900 - DNA, 22 bp, Homo sapiens
tgcagctgcttgattcatcttg

SEQ ID NO: 8330901 - DNA, 22 bp, Homo sapiens
tgcagcagacataatgtggatt

SEQ ID NO: 8330902 - DNA, 21 bp, Homo sapiens
tgcagcagatttgggggaaga

SEQ ID NO: 8330903 - DNA, 22 bp, Homo sapiens
tgcagcaggcacaggacggaag

SEQ ID NO: 8330904 - DNA, 22 bp, Homo sapiens
tgcagccagactttgtgcgaaa

SEQ ID NO: 8330905 - DNA, 22 bp, Homo sapiens
tgcagccatctttcttggagga

SEQ ID NO: 8330906 - DNA, 22 bp, Homo sapiens
tgcagcccagccccagaacctt

SEQ ID NO: 8330907 - DNA, 22 bp, Homo sapiens
tgcagccctgtgcacatcccct

SEQ ID NO: 8330908 - DNA, 22 bp, Homo sapiens
tgcagcccttccttcctctggg

SEQ ID NO: 8330909 - DNA, 22 bp, Homo sapiens
tgcagcctagacattctggtca

SEQ ID NO: 8330910 - DNA, 22 bp, Homo sapiens
tgcagcctctctgcttcaggaa

SEQ ID NO: 8330911 - DNA, 22 bp, Homo sapiens
tgcagcctggtggtcactggag

SEQ ID NO: 8330912 - DNA, 18 bp, Homo sapiens
tgcagcctgtagtcttgt

SEQ ID NO: 8330913 - DNA, 21 bp, Homo sapiens
tgcaggaaagtgctgcgaccc

SEQ ID NO: 8330914 - DNA, 22 bp, Homo sapiens
tgcaggaaaacacctatcaccc

SEQ ID NO: 8330915 - DNA, 22 bp, Homo sapiens
tgcagaagaaaacagctgtgtg

SEQ ID NO: 8330916 - DNA, 22 bp, Homo sapiens
tgcagaaacagtcattaatgta

SEQ ID NO: 8330917 - DNA, 22 bp, Homo sapiens
tgcagaaaccaattcaagtaag

SEQ ID NO: 8330918 - DNA, 22 bp, Homo sapiens
tgcagaaagtcacattcccttt

SEQ ID NO: 8330919 - DNA, 22 bp, Homo sapiens
tgcagaaataaagatattatca

SEQ ID NO: 8330920 - DNA, 23 bp, Homo sapiens
tgcacaggacggccttataagta

SEQ ID NO: 8330921 - DNA, 22 bp, Homo sapiens
tgcaccagagcagggtgcccaa

SEQ ID NO: 8330922 - DNA, 22 bp, Homo sapiens
tgcaccttccacaagaactacc

SEQ ID NO: 8330923 - DNA, 22 bp, Homo sapiens
tgcacctgtagtgagctgtgcc

SEQ ID NO: 8330924 - DNA, 23 bp, Homo sapiens
tgcagagggactgaagccagctt

SEQ ID NO: 8330925 - DNA, 22 bp, Homo sapiens
tgcagagtgggagaggtgcggg

SEQ ID NO: 8330926 - DNA, 22 bp, Homo sapiens
tgcagagtgaagacatcacccc

SEQ ID NO: 8330927 - DNA, 22 bp, Homo sapiens
tgcagagtcctctggagggact

SEQ ID NO: 8330928 - DNA, 22 bp, Homo sapiens
tgcagagtagtgaggggacaga

SEQ ID NO: 8330929 - DNA, 22 bp, Homo sapiens
tgcagagtagtgaggggacaga

SEQ ID NO: 8330930 - DNA, 22 bp, Homo sapiens
tgcagattcaaatgaaatgcaa

SEQ ID NO: 8330931 - DNA, 22 bp, Homo sapiens
tgcagatggggatcagtggctc

SEQ ID NO: 8330932 - DNA, 22 bp, Homo sapiens
tgcagaggagctggaaggctgg

SEQ ID NO: 8330933 - DNA, 22 bp, Homo sapiens
tgcagaggagctggaaggctgg

SEQ ID NO: 8330934 - DNA, 22 bp, Homo sapiens
tgcagaggctggctcgccgggt

SEQ ID NO: 8330935 - DNA, 22 bp, Homo sapiens
tgcagaggaccattgtcctgga

SEQ ID NO: 8330936 - DNA, 22 bp, Homo sapiens
tgcagggaaaacccaggatgct

SEQ ID NO: 8330937 - DNA, 22 bp, Homo sapiens
tgcagggccatggtggcggctg

SEQ ID NO: 8330938 - DNA, 21 bp, Homo sapiens
tgcagtgtccctaacagtggt

SEQ ID NO: 8330939 - DNA, 21 bp, Homo sapiens
tgcagtgtccctaacagtggt

SEQ ID NO: 8330940 - DNA, 20 bp, Homo sapiens
tgcagtgtcctcacttgtca

SEQ ID NO: 8330941 - DNA, 22 bp, Homo sapiens
tgcagtgtttggatgctgagtc

SEQ ID NO: 8330942 - DNA, 22 bp, Homo sapiens
tgcagtgtttccagatattgtc

SEQ ID NO: 8330943 - DNA, 20 bp, Homo sapiens
tgcagtgtggaagactgaga

SEQ ID NO: 8330944 - DNA, 22 bp, Homo sapiens
tgcagtgtgctagatttggact

SEQ ID NO: 8330945 - DNA, 22 bp, Homo sapiens
tgcaggggcttgtctgggcctg

SEQ ID NO: 8330946 - DNA, 22 bp, Homo sapiens
tgcaggggcttgtctgggcctg

SEQ ID NO: 8330947 - DNA, 19 bp, Homo sapiens
tgcagggctgcgcctgggg

SEQ ID NO: 8330948 - DNA, 20 bp, Homo sapiens
tgcagggctgcctcccagct

SEQ ID NO: 8330949 - DNA, 22 bp, Homo sapiens
tgcaggtacttgacaacttggg

SEQ ID NO: 8330950 - DNA, 21 bp, Homo sapiens
tgcataaagaaatacaaatac

SEQ ID NO: 8330951 - DNA, 22 bp, Homo sapiens
tgcataaacttctctggtgtga

SEQ ID NO: 8330952 - DNA, 22 bp, Homo sapiens
tgcataaacagatacttcatgt

SEQ ID NO: 8330953 - DNA, 22 bp, Homo sapiens
tgcataaatcttggaagttgtt

SEQ ID NO: 8330954 - DNA, 22 bp, Homo sapiens
tgcagttcaaggttgtacagct

SEQ ID NO: 8330955 - DNA, 22 bp, Homo sapiens
tgcagtttgccctttgctcact

SEQ ID NO: 8330956 - DNA, 22 bp, Homo sapiens
tgcagtttcctttctagtcttt

SEQ ID NO: 8330957 - DNA, 22 bp, Homo sapiens
tgcagtttcctggtctctactt

SEQ ID NO: 8330958 - DNA, 22 bp, Homo sapiens
tgcagtttatctagtcatccat

SEQ ID NO: 8330959 - DNA, 21 bp, Homo sapiens
tgcagttttgcttgatctctg

SEQ ID NO: 8330960 - DNA, 17 bp, Homo sapiens
tgcatgtcctttgttcc

SEQ ID NO: 8330961 - DNA, 22 bp, Homo sapiens
tgcatctgttcagagctgtcga

SEQ ID NO: 8330962 - DNA, 22 bp, Homo sapiens
tgcattgttgaccagttgtgca

SEQ ID NO: 8330963 - DNA, 22 bp, Homo sapiens
tgcatttgtaacattcaagaat

SEQ ID NO: 8330964 - DNA, 22 bp, Homo sapiens
tgcatttttaacaaggctaatt

SEQ ID NO: 8330965 - DNA, 22 bp, Homo sapiens
tgcatttttgataactgtgtac

SEQ ID NO: 8330966 - DNA, 22 bp, Homo sapiens
tgcatttttgaggttaactcaa

SEQ ID NO: 8330967 - DNA, 22 bp, Homo sapiens
tgccaaatgccaccacagctgc

SEQ ID NO: 8330968 - DNA, 21 bp, Homo sapiens
tgcatttctaactagttgacc

SEQ ID NO: 8330969 - DNA, 22 bp, Homo sapiens
tgcatttcttttgagtatatgc

SEQ ID NO: 8330970 - DNA, 22 bp, Homo sapiens
tgcatttcagaagaaaattcgg

SEQ ID NO: 8330971 - DNA, 22 bp, Homo sapiens
tgccaccccggaccccgaagtg

SEQ ID NO: 8330972 - DNA, 22 bp, Homo sapiens
tgccaccaggagaaccagtgca

SEQ ID NO: 8330973 - DNA, 22 bp, Homo sapiens
tgccagagaagacccagtcact

SEQ ID NO: 8330974 - DNA, 20 bp, Homo sapiens
tgccacctggtttaagtgtg

SEQ ID NO: 8330975 - DNA, 22 bp, Homo sapiens
tgccacccctctgcaccctcag

SEQ ID NO: 8330976 - DNA, 22 bp, Homo sapiens
tgccaccctctctgctacccgc

SEQ ID NO: 8330977 - DNA, 22 bp, Homo sapiens
tgccagagttacatgagggtca

SEQ ID NO: 8330978 - DNA, 22 bp, Homo sapiens
tgccagcacttctggctgtctg

SEQ ID NO: 8330979 - DNA, 19 bp, Homo sapiens
tgccagagatactcccaga

SEQ ID NO: 8330980 - DNA, 23 bp, Homo sapiens
tgccagcagggaatgggaaggac

SEQ ID NO: 8330981 - DNA, 22 bp, Homo sapiens
tgccagccaggttctgaggcta

SEQ ID NO: 8330982 - DNA, 22 bp, Homo sapiens
tgcccacagatatgtgcagtct

SEQ ID NO: 8330983 - DNA, 22 bp, Homo sapiens
tgcccacagctcagggctgctc

SEQ ID NO: 8330984 - DNA, 22 bp, Homo sapiens
tgcccaaacctctcctagctct

SEQ ID NO: 8330985 - DNA, 22 bp, Homo sapiens
tgccatggattaagtgggtggc

SEQ ID NO: 8330986 - DNA, 22 bp, Homo sapiens
tgcccagcactgtgccagtcac

SEQ ID NO: 8330987 - DNA, 22 bp, Homo sapiens
tgcccagcactgtgccagtcac

SEQ ID NO: 8330988 - DNA, 22 bp, Homo sapiens
tgcccagcagggagctacctgg

SEQ ID NO: 8330989 - DNA, 22 bp, Homo sapiens
tgcccagccaatttgttatgtt

SEQ ID NO: 8330990 - DNA, 22 bp, Homo sapiens
tgcccagcaataaaccagaaga

SEQ ID NO: 8330991 - DNA, 22 bp, Homo sapiens
tgcccagcaataaaccagaaga

SEQ ID NO: 8330992 - DNA, 22 bp, Homo sapiens
tgcccagcacccagcatgatgc

SEQ ID NO: 8330993 - DNA, 22 bp, Homo sapiens
tgcccacatggtgccatggcca

SEQ ID NO: 8330994 - DNA, 22 bp, Homo sapiens
tgcccacattcaaaaggtgatg

SEQ ID NO: 8330995 - DNA, 22 bp, Homo sapiens
tgcccacattctgaagctccct

SEQ ID NO: 8330996 - DNA, 18 bp, Homo sapiens
tgcccaccagaagaggga

SEQ ID NO: 8330997 - DNA, 20 bp, Homo sapiens
tgcccagcaagagtgcagtt

SEQ ID NO: 8330998 - DNA, 22 bp, Homo sapiens
tgcccagggtttctaagagcag

SEQ ID NO: 8330999 - DNA, 21 bp, Homo sapiens
tgcccatgagcagaagtcacc

SEQ ID NO: 8331000 - DNA, 22 bp, Homo sapiens
tgcccaggtttgagtgcccaag

SEQ ID NO: 8331001 - DNA, 20 bp, Homo sapiens
tgccccaggcctgcacctgc

SEQ ID NO: 8331002 - DNA, 22 bp, Homo sapiens
tgccccagacctactgaatggg

SEQ ID NO: 8331003 - DNA, 22 bp, Homo sapiens
tgccccaggtgctgaggttgga

SEQ ID NO: 8331004 - DNA, 22 bp, Homo sapiens
tgcccaggctggagtacagtgg

SEQ ID NO: 8331005 - DNA, 22 bp, Homo sapiens
tgcccaggctggaatgcagtgg

SEQ ID NO: 8331006 - DNA, 22 bp, Homo sapiens
tgcccaggctggagtgcagagg

SEQ ID NO: 8331007 - DNA, 22 bp, Homo sapiens
tgcccaggcttcaccctcagag

SEQ ID NO: 8331008 - DNA, 22 bp, Homo sapiens
tgccaggccctgtgctggatgc

SEQ ID NO: 8331009 - DNA, 22 bp, Homo sapiens
tgccaggctcagcccctatctt

SEQ ID NO: 8331010 - DNA, 22 bp, Homo sapiens
tgccaggccctcccacagatta

SEQ ID NO: 8331011 - DNA, 22 bp, Homo sapiens
tgccaggcccagctccagagct

SEQ ID NO: 8331012 - DNA, 22 bp, Homo sapiens
tgccaggcccagcagggcggcc

SEQ ID NO: 8331013 - DNA, 22 bp, Homo sapiens
tgccaggcatttgacagacact

SEQ ID NO: 8331014 - DNA, 22 bp, Homo sapiens
tgccaggcaactgcccagccat

SEQ ID NO: 8331015 - DNA, 22 bp, Homo sapiens
tgccaggcatatggcctctttg

SEQ ID NO: 8331016 - DNA, 22 bp, Homo sapiens
tgccaggcaggaccctagaacc

SEQ ID NO: 8331017 - DNA, 22 bp, Homo sapiens
tgccatcctgtgtcatgctcat

SEQ ID NO: 8331018 - DNA, 22 bp, Homo sapiens
tgccaggctcaggatgtccctg

SEQ ID NO: 8331019 - DNA, 22 bp, Homo sapiens
tgccaggctgccctccagtctg

SEQ ID NO: 8331020 - DNA, 22 bp, Homo sapiens
tgccctgccaagactgagtggt

SEQ ID NO: 8331021 - DNA, 22 bp, Homo sapiens
tgccctgctgtgcctggagcca

SEQ ID NO: 8331022 - DNA, 22 bp, Homo sapiens
tgccctgcatgcagggagctgt

SEQ ID NO: 8331023 - DNA, 22 bp, Homo sapiens
tgccctgcagaccctgcagtgt

SEQ ID NO: 8331024 - DNA, 22 bp, Homo sapiens
tgccctggctcctcccacgctg

SEQ ID NO: 8331025 - DNA, 22 bp, Homo sapiens
tgccctggatgctgcaggtgtg

SEQ ID NO: 8331026 - DNA, 22 bp, Homo sapiens
tgccctggaggggcttacagtc

SEQ ID NO: 8331027 - DNA, 22 bp, Homo sapiens
tgccctggaaccatctacagtc

SEQ ID NO: 8331028 - DNA, 22 bp, Homo sapiens
tgccctggaaccatctacagtc

SEQ ID NO: 8331029 - DNA, 22 bp, Homo sapiens
tgccctggaaatgagaggtgtg

SEQ ID NO: 8331030 - DNA, 22 bp, Homo sapiens
tgccctgttatcttggaagagt

SEQ ID NO: 8331031 - DNA, 22 bp, Homo sapiens
tgcccttgggtaacttgctgat

SEQ ID NO: 8331032 - DNA, 22 bp, Homo sapiens
tgccctgggacatgcagcggag

SEQ ID NO: 8331033 - DNA, 22 bp, Homo sapiens
tgccctgggaggctttcctgtt

SEQ ID NO: 8331034 - DNA, 22 bp, Homo sapiens
tgccctggctggagtgcagtgg

SEQ ID NO: 8331035 - DNA, 22 bp, Homo sapiens
tgccctgggaacacagatgcca

SEQ ID NO: 8331036 - DNA, 22 bp, Homo sapiens
tgccctgggaacacagatgcca

SEQ ID NO: 8331037 - DNA, 22 bp, Homo sapiens
tgcctagtagggttgttgtagg

SEQ ID NO: 8331038 - DNA, 22 bp, Homo sapiens
tgcctcaagccctccactgcac

SEQ ID NO: 8331039 - DNA, 22 bp, Homo sapiens
tgccgtggggctgaggctggag

SEQ ID NO: 8331040 - DNA, 22 bp, Homo sapiens
tgccgtggggctgaggctggag

SEQ ID NO: 8331041 - DNA, 22 bp, Homo sapiens
tgcctacccatggttagacata

SEQ ID NO: 8331042 - DNA, 22 bp, Homo sapiens
tgccgcagtgcggggagggccc

SEQ ID NO: 8331043 - DNA, 22 bp, Homo sapiens
tgccgctccaggtctcgcggtg

SEQ ID NO: 8331044 - DNA, 22 bp, Homo sapiens
tgcctgcttgtgtacctggtga

SEQ ID NO: 8331045 - DNA, 22 bp, Homo sapiens
tgcctgctgattggagttgaat

SEQ ID NO: 8331046 - DNA, 22 bp, Homo sapiens
tgcctgctgattggagttgaat

SEQ ID NO: 8331047 - DNA, 17 bp, Homo sapiens
tgcctgccagcattgga

SEQ ID NO: 8331048 - DNA, 22 bp, Homo sapiens
tgcctggcaagaggggctggct

SEQ ID NO: 8331049 - DNA, 22 bp, Homo sapiens
tgcctcagtctaaagtctctca

SEQ ID NO: 8331050 - DNA, 22 bp, Homo sapiens
tgcctctctaacccatgcccaa

SEQ ID NO: 8331051 - DNA, 22 bp, Homo sapiens
tgcctcttggagcctttcctct

SEQ ID NO: 8331052 - DNA, 22 bp, Homo sapiens
tctcagcagggccatcctgagc

SEQ ID NO: 8331053 - DNA, 22 bp, Homo sapiens
tctcagagtaattctttaaggt

SEQ ID NO: 8331054 - DNA, 22 bp, Homo sapiens
tctcagctcttttttcacagaa

SEQ ID NO: 8331055 - DNA, 22 bp, Homo sapiens
tctcagagcctaactaacctaa

SEQ ID NO: 8331056 - DNA, 23 bp, Homo sapiens
tctcagaggattcctgggccttg

SEQ ID NO: 8331057 - DNA, 22 bp, Homo sapiens
tctcagagagatgaaacttcca

SEQ ID NO: 8331058 - DNA, 22 bp, Homo sapiens
tctcactgatttgagaccaagg

SEQ ID NO: 8331059 - DNA, 22 bp, Homo sapiens
tctcactgggtcacagcagagg

SEQ ID NO: 8331060 - DNA, 22 bp, Homo sapiens
tctcaccaaagccttgaccata

SEQ ID NO: 8331061 - DNA, 22 bp, Homo sapiens
tctcaccatcttgaatccctta

SEQ ID NO: 8331062 - DNA, 22 bp, Homo sapiens
tctcacatttcattgacagctg

SEQ ID NO: 8331063 - DNA, 22 bp, Homo sapiens
tctcacagtgcaggtctgtctc

SEQ ID NO: 8331064 - DNA, 22 bp, Homo sapiens
tctcatgtgattcccgtgcatg

SEQ ID NO: 8331065 - DNA, 22 bp, Homo sapiens
tctccaaatagttatatttaga

SEQ ID NO: 8331066 - DNA, 22 bp, Homo sapiens
tctcagtgcagagaggctatct

SEQ ID NO: 8331067 - DNA, 22 bp, Homo sapiens
tctcagtgatggcccatttgga

SEQ ID NO: 8331068 - DNA, 22 bp, Homo sapiens
tctcagtgagcttttctatgtt

SEQ ID NO: 8331069 - DNA, 23 bp, Homo sapiens
tctcagtgaatctcagaattcgc

SEQ ID NO: 8331070 - DNA, 22 bp, Homo sapiens
tctcagtgacactcttcataca

SEQ ID NO: 8331071 - DNA, 22 bp, Homo sapiens
tctcatcacacagccagtatgt

SEQ ID NO: 8331072 - DNA, 22 bp, Homo sapiens
tctcagtggacgtgtctgtctt

SEQ ID NO: 8331073 - DNA, 22 bp, Homo sapiens
tctcagtgctatccatattcca

SEQ ID NO: 8331074 - DNA, 22 bp, Homo sapiens
tctcccactgcaagcccaggct

SEQ ID NO: 8331075 - DNA, 21 bp, Homo sapiens
tctccccattcttattcccat

SEQ ID NO: 8331076 - DNA, 20 bp, Homo sapiens
tctcccaggctcagggaaga

SEQ ID NO: 8331077 - DNA, 19 bp, Homo sapiens
tctcccagctgagaagggc

SEQ ID NO: 8331078 - DNA, 22 bp, Homo sapiens
tctcctccagaggctgtgggga

SEQ ID NO: 8331079 - DNA, 22 bp, Homo sapiens
tctcctcccaggctcttccagg

SEQ ID NO: 8331080 - DNA, 22 bp, Homo sapiens
tctcctctatttctgtatgtat

SEQ ID NO: 8331081 - DNA, 22 bp, Homo sapiens
tctcctctcctttcatgttgtt

SEQ ID NO: 8331082 - DNA, 22 bp, Homo sapiens
tctcctggatggaccttctctt

SEQ ID NO: 8331083 - DNA, 22 bp, Homo sapiens
tctcctggatagatactatcca

SEQ ID NO: 8331084 - DNA, 22 bp, Homo sapiens
tctcctggcatgtgggtcatct

SEQ ID NO: 8331085 - DNA, 22 bp, Homo sapiens
tctcctggcatttggttgagta

SEQ ID NO: 8331086 - DNA, 22 bp, Homo sapiens
tctcctggagcccagatgctgg

SEQ ID NO: 8331087 - DNA, 22 bp, Homo sapiens
tctcctggagcccagatgctgg

SEQ ID NO: 8331088 - DNA, 22 bp, Homo sapiens
tctcctggagcaggaaggtggg

SEQ ID NO: 8331089 - DNA, 22 bp, Homo sapiens
tctcctggaagtgattcccctg

SEQ ID NO: 8331090 - DNA, 22 bp, Homo sapiens
tctcctggaagaataccacact

SEQ ID NO: 8331091 - DNA, 22 bp, Homo sapiens
tctcctggtcacctcagaagtc

SEQ ID NO: 8331092 - DNA, 20 bp, Homo sapiens
tctcctggtctggtccgtgc

SEQ ID NO: 8331093 - DNA, 22 bp, Homo sapiens
tctcctggtttgttaaataatt

SEQ ID NO: 8331094 - DNA, 20 bp, Homo sapiens
tctcctggtgacagtaccca

SEQ ID NO: 8331095 - DNA, 22 bp, Homo sapiens
tctcctgggtgctttatcagaa

SEQ ID NO: 8331096 - DNA, 21 bp, Homo sapiens
tctcctgggtccaacccatgc

SEQ ID NO: 8331097 - DNA, 22 bp, Homo sapiens
tctcctggtatgtatgcacctg

SEQ ID NO: 8331098 - DNA, 22 bp, Homo sapiens
tctcctggtacccttcctagca

SEQ ID NO: 8331099 - DNA, 22 bp, Homo sapiens
tctcctgggtaaaagggttgat

SEQ ID NO: 8331100 - DNA, 18 bp, Homo sapiens
tctcctgggtaggggcct

SEQ ID NO: 8331101 - DNA, 22 bp, Homo sapiens
tctcctgggcttggttgaagtt

SEQ ID NO: 8331102 - DNA, 22 bp, Homo sapiens
tctcgctctgtcgcccaggctg

SEQ ID NO: 8331103 - DNA, 22 bp, Homo sapiens
tctcgctctgtcgcccaggctg

SEQ ID NO: 8331104 - DNA, 22 bp, Homo sapiens
tctctaaacttatatgaactat

SEQ ID NO: 8331105 - DNA, 22 bp, Homo sapiens
tctcctttcttttaaaatgtca

SEQ ID NO: 8331106 - DNA, 22 bp, Homo sapiens
tctcctttaagatttcctcagg

SEQ ID NO: 8331107 - DNA, 19 bp, Homo sapiens
tctctggcttgtctgcctg

SEQ ID NO: 8331108 - DNA, 19 bp, Homo sapiens
tctctgccgatcagggccc

SEQ ID NO: 8331109 - DNA, 23 bp, Homo sapiens
tctctggcctttgatcaggttga

SEQ ID NO: 8331110 - DNA, 22 bp, Homo sapiens
tctctggctcctgccgggtcca

SEQ ID NO: 8331111 - DNA, 22 bp, Homo sapiens
tctctggctgatattcctctgc

SEQ ID NO: 8331112 - DNA, 20 bp, Homo sapiens
tctctggcaagaagctgcag

SEQ ID NO: 8331113 - DNA, 22 bp, Homo sapiens
tctctggcagacacctccctga

SEQ ID NO: 8331114 - DNA, 22 bp, Homo sapiens
tctctggcagaggccctatccc

SEQ ID NO: 8331115 - DNA, 22 bp, Homo sapiens
tctctcagggggaaggctgaag

SEQ ID NO: 8331116 - DNA, 22 bp, Homo sapiens
tctctatattatatgtagtttg

SEQ ID NO: 8331117 - DNA, 22 bp, Homo sapiens
tctctctgagccctgctttttc

SEQ ID NO: 8331118 - DNA, 22 bp, Homo sapiens
tctctctgagttgagcaggagt

SEQ ID NO: 8331119 - DNA, 18 bp, Homo sapiens
tctctctgataacatttt

SEQ ID NO: 8331120 - DNA, 22 bp, Homo sapiens
tctctctgcagcccgggacact

SEQ ID NO: 8331121 - DNA, 18 bp, Homo sapiens
tctctctgaagagttccc

SEQ ID NO: 8331122 - DNA, 23 bp, Homo sapiens
tctctctggcaaatttcacatat

SEQ ID NO: 8331123 - DNA, 22 bp, Homo sapiens
tctctctgcgaattaggtttgc

SEQ ID NO: 8331124 - DNA, 22 bp, Homo sapiens
tctctctggagctggggcatga

SEQ ID NO: 8331125 - DNA, 22 bp, Homo sapiens
tctctctgccaactcacagcca

SEQ ID NO: 8331126 - DNA, 22 bp, Homo sapiens
tctgaagaactgagtaaacatg

SEQ ID NO: 8331127 - DNA, 22 bp, Homo sapiens
tctgaaataggaaagcaaatgg

SEQ ID NO: 8331128 - DNA, 22 bp, Homo sapiens
tctgaattttaactacacaaag

SEQ ID NO: 8331129 - DNA, 22 bp, Homo sapiens
tctgaaggttgagaagggctga

SEQ ID NO: 8331130 - DNA, 22 bp, Homo sapiens
tctgaaggtgctagagaaagct

SEQ ID NO: 8331131 - DNA, 21 bp, Homo sapiens
tctgaaggcttgactggggct

SEQ ID NO: 8331132 - DNA, 18 bp, Homo sapiens
tctgaaggaatgattcca

SEQ ID NO: 8331133 - DNA, 22 bp, Homo sapiens
tctgaaggaaaagggtagatat

SEQ ID NO: 8331134 - DNA, 22 bp, Homo sapiens
tctgaagctggaggaagctttg

SEQ ID NO: 8331135 - DNA, 22 bp, Homo sapiens
tctgaagagtcttgcaagaaag

SEQ ID NO: 8331136 - DNA, 22 bp, Homo sapiens
tctgaagcacagcaggaagggt

SEQ ID NO: 8331137 - DNA, 19 bp, Homo sapiens
tctgaagaattagagagca

SEQ ID NO: 8331138 - DNA, 22 bp, Homo sapiens
tctgaagagctttggaagtatg

SEQ ID NO: 8331139 - DNA, 22 bp, Homo sapiens
tctctttgtctgctcttagttg

SEQ ID NO: 8331140 - DNA, 22 bp, Homo sapiens
tctgaaaactccatgagctcgt

SEQ ID NO: 8331141 - DNA, 22 bp, Homo sapiens
tctctttctcaaaatgtaagca

SEQ ID NO: 8331142 - DNA, 22 bp, Homo sapiens
tctctttctttgtatgtctatt

SEQ ID NO: 8331143 - DNA, 22 bp, Homo sapiens
tctctttgcctgctgccatcca

SEQ ID NO: 8331144 - DNA, 22 bp, Homo sapiens
tctctttctattgcaccatgct

SEQ ID NO: 8331145 - DNA, 22 bp, Homo sapiens
tctctgtcacacaatctacaca

SEQ ID NO: 8331146 - DNA, 22 bp, Homo sapiens
tctctgtgacagctgggtatgt

SEQ ID NO: 8331147 - DNA, 22 bp, Homo sapiens
tctctgtgacagctgggtatgt

SEQ ID NO: 8331148 - DNA, 22 bp, Homo sapiens
tctctgtgcaggatgctgagtt

SEQ ID NO: 8331149 - DNA, 22 bp, Homo sapiens
tctctgtgcccagtagttctct

SEQ ID NO: 8331150 - DNA, 22 bp, Homo sapiens
tctctgtggagcagtgtgttca

SEQ ID NO: 8331151 - DNA, 22 bp, Homo sapiens
tctctgtggcaactacttagct

SEQ ID NO: 8331152 - DNA, 22 bp, Homo sapiens
tctctgtggcaagcatgctgct

SEQ ID NO: 8331153 - DNA, 22 bp, Homo sapiens
tctctgtgtctcatgttcctat

SEQ ID NO: 8331154 - DNA, 22 bp, Homo sapiens
tctctgtgtcttagtgaaggga

SEQ ID NO: 8331155 - DNA, 22 bp, Homo sapiens
tctctgtggtttgagagccggg

SEQ ID NO: 8331156 - DNA, 21 bp, Homo sapiens
tctctgtgtacagtctcaccc

SEQ ID NO: 8331157 - DNA, 22 bp, Homo sapiens
tctctgtgggtttcaccagcgc

SEQ ID NO: 8331158 - DNA, 22 bp, Homo sapiens
tctctgtggtactgagagtcta

SEQ ID NO: 8331159 - DNA, 22 bp, Homo sapiens
tcctgggcgaggtactggggct

SEQ ID NO: 8331160 - DNA, 19 bp, Homo sapiens
tcctgggctgcgtcttgcc

SEQ ID NO: 8331161 - DNA, 19 bp, Homo sapiens
tcctgggctgggccaggtc

SEQ ID NO: 8331162 - DNA, 22 bp, Homo sapiens
tcctggggaggtcgaggctgag

SEQ ID NO: 8331163 - DNA, 22 bp, Homo sapiens
tcctgggcaaagaggggcagtg

SEQ ID NO: 8331164 - DNA, 22 bp, Homo sapiens
tcctgggattctgcatttctaa

SEQ ID NO: 8331165 - DNA, 22 bp, Homo sapiens
tcctgggacaccccaatatgag

SEQ ID NO: 8331166 - DNA, 22 bp, Homo sapiens
tcctggctgccgtcgtcctgcg

SEQ ID NO: 8331167 - DNA, 22 bp, Homo sapiens
tcctggcttccactcctctgtt

SEQ ID NO: 8331168 - DNA, 21 bp, Homo sapiens
tcctggctttatgctacctct

SEQ ID NO: 8331169 - DNA, 22 bp, Homo sapiens
tcctggttttcctgggacaggg

SEQ ID NO: 8331170 - DNA, 22 bp, Homo sapiens
tccttaaatatttactgttaac

SEQ ID NO: 8331171 - DNA, 22 bp, Homo sapiens
tccttaaatatttactgttaac

SEQ ID NO: 8331172 - DNA, 18 bp, Homo sapiens
tcctgtggcccagagttt

SEQ ID NO: 8331173 - DNA, 22 bp, Homo sapiens
tcctgtctgtctttggtccctt

SEQ ID NO: 8331174 - DNA, 22 bp, Homo sapiens
tcctgtctgtctttggtccctt

SEQ ID NO: 8331175 - DNA, 20 bp, Homo sapiens
tcctggggtaagccatggtc

SEQ ID NO: 8331176 - DNA, 20 bp, Homo sapiens
tcctggggtaagccatggtc

SEQ ID NO: 8331177 - DNA, 21 bp, Homo sapiens
tcctggggggtaggtgagttt

SEQ ID NO: 8331178 - DNA, 21 bp, Homo sapiens
tcctggggggtaggtgagttt

SEQ ID NO: 8331179 - DNA, 22 bp, Homo sapiens
tcctggggctgcaaggcctgtc

SEQ ID NO: 8331180 - DNA, 22 bp, Homo sapiens
tcctggggctgcaaggcctgtc

SEQ ID NO: 8331181 - DNA, 22 bp, Homo sapiens
tcctggggctctttgatgtgat

SEQ ID NO: 8331182 - DNA, 22 bp, Homo sapiens
tcctggggctctttgatgtgat

SEQ ID NO: 8331183 - DNA, 22 bp, Homo sapiens
tcctggggaggtcgaggctgag

SEQ ID NO: 8331184 - DNA, 19 bp, Homo sapiens
tcctggggatgtggtcacc

SEQ ID NO: 8331185 - DNA, 22 bp, Homo sapiens
tcctggggctcatgggatttgt

SEQ ID NO: 8331186 - DNA, 22 bp, Homo sapiens
tcctggggctcatgggatttgt

SEQ ID NO: 8331187 - DNA, 22 bp, Homo sapiens
tcctggggccagcactggtgga

SEQ ID NO: 8331188 - DNA, 22 bp, Homo sapiens
tcctggggccagcactggtgga

SEQ ID NO: 8331189 - DNA, 22 bp, Homo sapiens
tcctggggtttagagggaagtg

SEQ ID NO: 8331190 - DNA, 22 bp, Homo sapiens
tcctggggtgtgttttgctgct

SEQ ID NO: 8331191 - DNA, 21 bp, Homo sapiens
tcctggcccactctatcccca

SEQ ID NO: 8331192 - DNA, 22 bp, Homo sapiens
tcctggcccgatccctgtgaag

SEQ ID NO: 8331193 - DNA, 22 bp, Homo sapiens
tcctggcccggccgggcctgct

SEQ ID NO: 8331194 - DNA, 22 bp, Homo sapiens
tcctggcccggccgggcctgct

SEQ ID NO: 8331195 - DNA, 22 bp, Homo sapiens
tcctggcccgatccctgtgaag

SEQ ID NO: 8331196 - DNA, 22 bp, Homo sapiens
tcctggccgccgcgtggggccg

SEQ ID NO: 8331197 - DNA, 22 bp, Homo sapiens
tcctggccgccgcgtggggccg

SEQ ID NO: 8331198 - DNA, 22 bp, Homo sapiens
tcctggccctgtggcctgcagt

SEQ ID NO: 8331199 - DNA, 22 bp, Homo sapiens
tcctggccgctggcccctgaga

SEQ ID NO: 8331200 - DNA, 22 bp, Homo sapiens
tcctggcctcacagtcctgggt

SEQ ID NO: 8331201 - DNA, 22 bp, Homo sapiens
tcctggcctagctcaccctgga

SEQ ID NO: 8331202 - DNA, 17 bp, Homo sapiens
tcctggctctgccactg

SEQ ID NO: 8331203 - DNA, 22 bp, Homo sapiens
tcctggctcggcttggggactt

SEQ ID NO: 8331204 - DNA, 22 bp, Homo sapiens
tcctggcctcgctgtccacctt

SEQ ID NO: 8331205 - DNA, 20 bp, Homo sapiens
tcctggcctccctggggctc

SEQ ID NO: 8331206 - DNA, 20 bp, Homo sapiens
tcctggagtctggtttggct

SEQ ID NO: 8331207 - DNA, 22 bp, Homo sapiens
tcctggagtttgtaaggtgagc

SEQ ID NO: 8331208 - DNA, 22 bp, Homo sapiens
tcctggccaagtagatgtggcg

SEQ ID NO: 8331209 - DNA, 22 bp, Homo sapiens
tcctggccaagtagatgtggcg

SEQ ID NO: 8331210 - DNA, 17 bp, Homo sapiens
tcctggcagtcccctgg

SEQ ID NO: 8331211 - DNA, 22 bp, Homo sapiens
tcctggcacattgcaggggctc

SEQ ID NO: 8331212 - DNA, 21 bp, Homo sapiens
tcctggccagggcactaggca

SEQ ID NO: 8331213 - DNA, 22 bp, Homo sapiens
tcctggccatgcaagatgagga

SEQ ID NO: 8331214 - DNA, 22 bp, Homo sapiens
tcctggccatgcaagatgagga

SEQ ID NO: 8331215 - DNA, 22 bp, Homo sapiens
tcctggccacccgacagaagtc

SEQ ID NO: 8331216 - DNA, 22 bp, Homo sapiens
taagaatcggtcgcaacagagg

SEQ ID NO: 8331217 - DNA, 22 bp, Homo sapiens
taagaatcagtagatatagatt

SEQ ID NO: 8331218 - DNA, 22 bp, Homo sapiens
taagaatcgatgtttatttaga

SEQ ID NO: 8331219 - DNA, 22 bp, Homo sapiens
tcctgctgggtctaactctggt

SEQ ID NO: 8331220 - DNA, 22 bp, Homo sapiens
taagaacagtgtctgtctcaca

SEQ ID NO: 8331221 - DNA, 22 bp, Homo sapiens
taagaacattttcggaaagata

SEQ ID NO: 8331222 - DNA, 22 bp, Homo sapiens
taagaacattttcggaaagata

SEQ ID NO: 8331223 - DNA, 22 bp, Homo sapiens
taagaatagtccctagatgtgt

SEQ ID NO: 8331224 - DNA, 22 bp, Homo sapiens
tcctggagagtgggcgagcaca

SEQ ID NO: 8331225 - DNA, 22 bp, Homo sapiens
tcctggagaaactcagagatct

SEQ ID NO: 8331226 - DNA, 22 bp, Homo sapiens
tcctggagaagaggggcttgga

SEQ ID NO: 8331227 - DNA, 22 bp, Homo sapiens
tcctggacagatccccatcatc

SEQ ID NO: 8331228 - DNA, 22 bp, Homo sapiens
tcctggaggggacagcatgggc

SEQ ID NO: 8331229 - DNA, 22 bp, Homo sapiens
tcctggagggctcacaggcggc

SEQ ID NO: 8331230 - DNA, 22 bp, Homo sapiens
tcctggaggcaaatgagcacat

SEQ ID NO: 8331231 - DNA, 22 bp, Homo sapiens
tcctggaggcaaatgaagactc

SEQ ID NO: 8331232 - DNA, 22 bp, Homo sapiens
tcctggagggaggcggtgctac

SEQ ID NO: 8331233 - DNA, 23 bp, Homo sapiens
tctcaaatctttgcgttgtatct

SEQ ID NO: 8331234 - DNA, 22 bp, Homo sapiens
tctcaaatggacaatattgtgg

SEQ ID NO: 8331235 - DNA, 22 bp, Homo sapiens
tctcaaggactttgggcactaa

SEQ ID NO: 8331236 - DNA, 23 bp, Homo sapiens
tctcacagcgatctaggaagagg

SEQ ID NO: 8331237 - DNA, 22 bp, Homo sapiens
tctattttcttgccaaaactgc

SEQ ID NO: 8331238 - DNA, 22 bp, Homo sapiens
tctattttatactcaaatcttc

SEQ ID NO: 8331239 - DNA, 22 bp, Homo sapiens
tctattttatactcaaatcttc

SEQ ID NO: 8331240 - DNA, 22 bp, Homo sapiens
tctcaaatatttggagagagga

SEQ ID NO: 8331241 - DNA, 22 bp, Homo sapiens
tctcaaataggccttggtcctg

SEQ ID NO: 8331242 - DNA, 22 bp, Homo sapiens
tctatttttatagttgaagtgc

SEQ ID NO: 8331243 - DNA, 22 bp, Homo sapiens
tctattttgtttccagctctac

SEQ ID NO: 8331244 - DNA, 22 bp, Homo sapiens
tctagttctagatccctgagga

SEQ ID NO: 8331245 - DNA, 22 bp, Homo sapiens
tctagtttaagatctgttagtc

SEQ ID NO: 8331246 - DNA, 22 bp, Homo sapiens
tctagttttagcttgagttgca

SEQ ID NO: 8331247 - DNA, 22 bp, Homo sapiens
tctagttttggtatgagatgca

SEQ ID NO: 8331248 - DNA, 22 bp, Homo sapiens
tctattaatgattcaatagtgt

SEQ ID NO: 8331249 - DNA, 19 bp, Homo sapiens
tctatgtggcagtgatggc

SEQ ID NO: 8331250 - DNA, 22 bp, Homo sapiens
tctatctggccccttttatata

SEQ ID NO: 8331251 - DNA, 22 bp, Homo sapiens
tctataaagggccagatagtag

SEQ ID NO: 8331252 - DNA, 22 bp, Homo sapiens
tctacaaagaagaattaatgtc

SEQ ID NO: 8331253 - DNA, 22 bp, Homo sapiens
tctacaaagaagaattaatgtc

SEQ ID NO: 8331254 - DNA, 22 bp, Homo sapiens
tctaattttaggcatttgttca

SEQ ID NO: 8331255 - DNA, 22 bp, Homo sapiens
tctaattccattaaattgatgt

SEQ ID NO: 8331256 - DNA, 22 bp, Homo sapiens
tctaagaaagattaagaaattt

SEQ ID NO: 8331257 - DNA, 22 bp, Homo sapiens
tctacctatttcttctattggt

SEQ ID NO: 8331258 - DNA, 17 bp, Homo sapiens
tctaggagagcagagct

SEQ ID NO: 8331259 - DNA, 22 bp, Homo sapiens
tctagcagagggaagaggcttt

SEQ ID NO: 8331260 - DNA, 22 bp, Homo sapiens
tctagacctggcactgccctgt

SEQ ID NO: 8331261 - DNA, 22 bp, Homo sapiens
tccttaggcaatttgggagagt

SEQ ID NO: 8331262 - DNA, 22 bp, Homo sapiens
tccttaggcaatttgggagagt

SEQ ID NO: 8331263 - DNA, 22 bp, Homo sapiens
tccttagacaaagagtgggctt

SEQ ID NO: 8331264 - DNA, 20 bp, Homo sapiens
tccttaagtacctaagagtg

SEQ ID NO: 8331265 - DNA, 22 bp, Homo sapiens
tccttaaatccttcagagatta

SEQ ID NO: 8331266 - DNA, 22 bp, Homo sapiens
tccttggaagagcattcccagg

SEQ ID NO: 8331267 - DNA, 22 bp, Homo sapiens
tctaaaatgcagatctactggt

SEQ ID NO: 8331268 - DNA, 22 bp, Homo sapiens
tctaaaaaagtctgttcacttg

SEQ ID NO: 8331269 - DNA, 22 bp, Homo sapiens
tctaaacacgtctctttgaata

SEQ ID NO: 8331270 - DNA, 20 bp, Homo sapiens
tctaaagtacagtttgtgtg

SEQ ID NO: 8331271 - DNA, 23 bp, Homo sapiens
tcgttgaatagcaatagcacaac

SEQ ID NO: 8331272 - DNA, 22 bp, Homo sapiens
tcgcccagctcatctcccacaa

SEQ ID NO: 8331273 - DNA, 23 bp, Homo sapiens
tcctttgacaagagacagatgtt

SEQ ID NO: 8331274 - DNA, 22 bp, Homo sapiens
tcctttcttttctatgggccca

SEQ ID NO: 8331275 - DNA, 23 bp, Homo sapiens
tcctttgtctttgcatagatggt

SEQ ID NO: 8331276 - DNA, 22 bp, Homo sapiens
tcctttgttgagataaattggg

SEQ ID NO: 8331277 - DNA, 22 bp, Homo sapiens
tcctttgttaaggaggtttgtt

SEQ ID NO: 8331278 - DNA, 22 bp, Homo sapiens
tcgaaataatttagaatataga

SEQ ID NO: 8331279 - DNA, 22 bp, Homo sapiens
tctttcccgccagagcatgagt

SEQ ID NO: 8331280 - DNA, 17 bp, Homo sapiens
tctttccctgggagatg

SEQ ID NO: 8331281 - DNA, 22 bp, Homo sapiens
tctttgaagttcccctggaaga

SEQ ID NO: 8331282 - DNA, 22 bp, Homo sapiens
tctttcatgtatatgcaaccta

SEQ ID NO: 8331283 - DNA, 22 bp, Homo sapiens
tctttcaatgtgaaaccatgta

SEQ ID NO: 8331284 - DNA, 19 bp, Homo sapiens
tctttcatttctagctctg

SEQ ID NO: 8331285 - DNA, 22 bp, Homo sapiens
tctttcattctagtctgaggtt

SEQ ID NO: 8331286 - DNA, 22 bp, Homo sapiens
tctttcaatgagcattctttcc

SEQ ID NO: 8331287 - DNA, 22 bp, Homo sapiens
tctttccagaggaatttttaga

SEQ ID NO: 8331288 - DNA, 22 bp, Homo sapiens
tctttccacattctctgtttag

SEQ ID NO: 8331289 - DNA, 21 bp, Homo sapiens
tctttatgacttgcccatttg

SEQ ID NO: 8331290 - DNA, 23 bp, Homo sapiens
tctttacagcagcaggatttgga

SEQ ID NO: 8331291 - DNA, 19 bp, Homo sapiens
tcttggctttgtctactgt

SEQ ID NO: 8331292 - DNA, 22 bp, Homo sapiens
tcttggcttttcccctatggtc

SEQ ID NO: 8331293 - DNA, 22 bp, Homo sapiens
tcttggctcccttgtaggccct

SEQ ID NO: 8331294 - DNA, 22 bp, Homo sapiens
tcttggctgcgtcctggctgtg

SEQ ID NO: 8331295 - DNA, 22 bp, Homo sapiens
tcttggctttctcctagggatg

SEQ ID NO: 8331296 - DNA, 20 bp, Homo sapiens
tcttggctgtgtgaggacac

SEQ ID NO: 8331297 - DNA, 22 bp, Homo sapiens
tcttggctgtaccattgactag

SEQ ID NO: 8331298 - DNA, 23 bp, Homo sapiens
tcttggctggacaagtcactcac

SEQ ID NO: 8331299 - DNA, 22 bp, Homo sapiens
tcttggactcaaaattgcctta

SEQ ID NO: 8331300 - DNA, 22 bp, Homo sapiens
tcttggccaggtgtggtgcctc

SEQ ID NO: 8331301 - DNA, 17 bp, Homo sapiens
tcttggccagcttgctg

SEQ ID NO: 8331302 - DNA, 22 bp, Homo sapiens
tcttggccagatgcacttcctc

SEQ ID NO: 8331303 - DNA, 22 bp, Homo sapiens
tcttggccccaaccctctattt

SEQ ID NO: 8331304 - DNA, 22 bp, Homo sapiens
tcttgacattgttgttagcagg

SEQ ID NO: 8331305 - DNA, 22 bp, Homo sapiens
tcttgaaagtatcttattttgt

SEQ ID NO: 8331306 - DNA, 21 bp, Homo sapiens
tcttccaagggctgctgagac

SEQ ID NO: 8331307 - DNA, 22 bp, Homo sapiens
tcttcagcagggcctctctgag

SEQ ID NO: 8331308 - DNA, 22 bp, Homo sapiens
tcttcacagatgcatatacttc

SEQ ID NO: 8331309 - DNA, 22 bp, Homo sapiens
tcttcaatatgtgtttaatatt

SEQ ID NO: 8331310 - DNA, 22 bp, Homo sapiens
tcttattttttaatgacagaga

SEQ ID NO: 8331311 - DNA, 22 bp, Homo sapiens
tcttattattgttgtaaaagca

SEQ ID NO: 8331312 - DNA, 22 bp, Homo sapiens
tcttatgtcaagaatgaatatt

SEQ ID NO: 8331313 - DNA, 22 bp, Homo sapiens
tcttctgttaccacagcgatga

SEQ ID NO: 8331314 - DNA, 22 bp, Homo sapiens
tcttcctcttctgctgagaagt

SEQ ID NO: 8331315 - DNA, 22 bp, Homo sapiens
tcttcctccctacagagctcag

SEQ ID NO: 8331316 - DNA, 22 bp, Homo sapiens
tctgtgtgatttcagggaagtc

SEQ ID NO: 8331317 - DNA, 22 bp, Homo sapiens
tctgtgtgttgtcaggaggatt

SEQ ID NO: 8331318 - DNA, 22 bp, Homo sapiens
tctgtgtgttgtcaggaggatt

SEQ ID NO: 8331319 - DNA, 22 bp, Homo sapiens
tctgttgactcctagcagccat

SEQ ID NO: 8331320 - DNA, 22 bp, Homo sapiens
tctgttgcaatgtgcatggtga

SEQ ID NO: 8331321 - DNA, 22 bp, Homo sapiens
tctgttttctctgtattttgac

SEQ ID NO: 8331322 - DNA, 22 bp, Homo sapiens
tctgttttgcataatgttcttt

SEQ ID NO: 8331323 - DNA, 23 bp, Homo sapiens
tctgttttgcaacatgtgacaag

SEQ ID NO: 8331324 - DNA, 22 bp, Homo sapiens
tcttaaaagtatgccaattgga

SEQ ID NO: 8331325 - DNA, 22 bp, Homo sapiens
tctgttttgtaccagatacagc

SEQ ID NO: 8331326 - DNA, 22 bp, Homo sapiens
tctgttttgtaccagatacagc

SEQ ID NO: 8331327 - DNA, 22 bp, Homo sapiens
tcttagttagctcccttcttct

SEQ ID NO: 8331328 - DNA, 22 bp, Homo sapiens
tcttatatgcacatacattggg

SEQ ID NO: 8331329 - DNA, 20 bp, Homo sapiens
tcttaaatccccagggccat

SEQ ID NO: 8331330 - DNA, 22 bp, Homo sapiens
tcttaaatgactgataagagga

SEQ ID NO: 8331331 - DNA, 22 bp, Homo sapiens
tcttagatgaataaaaagttat

SEQ ID NO: 8331332 - DNA, 22 bp, Homo sapiens
tctgtgataggaaaataaatgg

SEQ ID NO: 8331333 - DNA, 22 bp, Homo sapiens
tctgtgacttacaagaagggac

SEQ ID NO: 8331334 - DNA, 22 bp, Homo sapiens
tctgtgccctcggtgctgggcc

SEQ ID NO: 8331335 - DNA, 22 bp, Homo sapiens
tctgtgcactaacattcctggt

SEQ ID NO: 8331336 - DNA, 22 bp, Homo sapiens
tctgtggctggagaacttgtct

SEQ ID NO: 8331337 - DNA, 22 bp, Homo sapiens
tctgtgctgtctcagagaaagc

SEQ ID NO: 8331338 - DNA, 18 bp, Homo sapiens
tctgtggagagggcagtt

SEQ ID NO: 8331339 - DNA, 22 bp, Homo sapiens
tctgtggactcaagggatcaca

SEQ ID NO: 8331340 - DNA, 19 bp, Homo sapiens
tctgtggagctcagagtag

SEQ ID NO: 8331341 - DNA, 22 bp, Homo sapiens
tctgtggcttgggcctgcctgt

SEQ ID NO: 8331342 - DNA, 22 bp, Homo sapiens
tctgtgggtgcctccagcagtg

SEQ ID NO: 8331343 - DNA, 22 bp, Homo sapiens
tctgtgtcccttctaatttcag

SEQ ID NO: 8331344 - DNA, 22 bp, Homo sapiens
tctgtgtctgcagaagttcagc

SEQ ID NO: 8331345 - DNA, 22 bp, Homo sapiens
tctgtgtctgcagaagttcagc

SEQ ID NO: 8331346 - DNA, 20 bp, Homo sapiens
tctgggcttcccccagctcc

SEQ ID NO: 8331347 - DNA, 22 bp, Homo sapiens
tctgggctgggagcgtgtggac

SEQ ID NO: 8331348 - DNA, 22 bp, Homo sapiens
tctgggctttaagaactctgtt

SEQ ID NO: 8331349 - DNA, 22 bp, Homo sapiens
tctgggctttacactgtgctta

SEQ ID NO: 8331350 - DNA, 22 bp, Homo sapiens
tctgggggcgaccagggactgc

SEQ ID NO: 8331351 - DNA, 22 bp, Homo sapiens
tctgggggaggaggcatggccc

SEQ ID NO: 8331352 - DNA, 21 bp, Homo sapiens
tctgggggtgagcctagaaat

SEQ ID NO: 8331353 - DNA, 22 bp, Homo sapiens
tctgggggcgaccagggactgc

SEQ ID NO: 8331354 - DNA, 22 bp, Homo sapiens
tctggggcagttactggggcct

SEQ ID NO: 8331355 - DNA, 22 bp, Homo sapiens
tctgtaaaacttctttgtaaat

SEQ ID NO: 8331356 - DNA, 22 bp, Homo sapiens
tctgggtaataggaagtgcagt

SEQ ID NO: 8331357 - DNA, 22 bp, Homo sapiens
tctgggggttaagtgaggacaa

SEQ ID NO: 8331358 - DNA, 22 bp, Homo sapiens
tctggggtcacctggggtgctt

SEQ ID NO: 8331359 - DNA, 18 bp, Homo sapiens
tctggggtgtgctgtgta

SEQ ID NO: 8331360 - DNA, 19 bp, Homo sapiens
tctggggtgtggcctggca

SEQ ID NO: 8331361 - DNA, 22 bp, Homo sapiens
tctgtccctgagagctcaggag

SEQ ID NO: 8331362 - DNA, 22 bp, Homo sapiens
tctgtcattgcaataaaatttc

SEQ ID NO: 8331363 - DNA, 22 bp, Homo sapiens
tctgtcatgtttccattacatg

SEQ ID NO: 8331364 - DNA, 18 bp, Homo sapiens
tctgtccttccattcttc

SEQ ID NO: 8331365 - DNA, 21 bp, Homo sapiens
tctgtctctccactgccctgc

SEQ ID NO: 8331366 - DNA, 20 bp, Homo sapiens
tctgtctctgagctagactt

SEQ ID NO: 8331367 - DNA, 22 bp, Homo sapiens
tctgtctctttgttctgtgagt

SEQ ID NO: 8331368 - DNA, 22 bp, Homo sapiens
tctgtacatttgtgttgtgaat

SEQ ID NO: 8331369 - DNA, 22 bp, Homo sapiens
tctgtaggacagagaaatgggg

SEQ ID NO: 8331370 - DNA, 20 bp, Homo sapiens
tctgtaggcaagttagcagg

SEQ ID NO: 8331371 - DNA, 22 bp, Homo sapiens
tctgtagtatggtacttattta

SEQ ID NO: 8331372 - DNA, 22 bp, Homo sapiens
tctgtagtaggttgtagttctt

SEQ ID NO: 8331373 - DNA, 22 bp, Homo sapiens
tctgtagggtagtagtggagat

SEQ ID NO: 8331374 - DNA, 22 bp, Homo sapiens
tctgtaggttaaaagtagacaa

SEQ ID NO: 8331375 - DNA, 20 bp, Homo sapiens
tctgtagtctatgaggctta

SEQ ID NO: 8331376 - DNA, 22 bp, Homo sapiens
tctgtagtttacagtatttcag

SEQ ID NO: 8331377 - DNA, 22 bp, Homo sapiens
tctggccccggtcttcacagct

SEQ ID NO: 8331378 - DNA, 22 bp, Homo sapiens
tctggctgaaaggggctgtgcc

SEQ ID NO: 8331379 - DNA, 22 bp, Homo sapiens
tctggctgaaaggggctgtgcc

SEQ ID NO: 8331380 - DNA, 19 bp, Homo sapiens
tctggctcctgccaggctg

SEQ ID NO: 8331381 - DNA, 22 bp, Homo sapiens
tctggctgctgcgtgagtgctt

SEQ ID NO: 8331382 - DNA, 22 bp, Homo sapiens
tctggctggcagtgatggtgtg

SEQ ID NO: 8331383 - DNA, 22 bp, Homo sapiens
tctggctggctcggccgggagt

SEQ ID NO: 8331384 - DNA, 22 bp, Homo sapiens
tctggctgcaccattatagtag

SEQ ID NO: 8331385 - DNA, 22 bp, Homo sapiens
tctggctgattccctgggactg

SEQ ID NO: 8331386 - DNA, 22 bp, Homo sapiens
tctggctgacatcctgtatgag

SEQ ID NO: 8331387 - DNA, 22 bp, Homo sapiens
tctggctgggaagggggcccga

SEQ ID NO: 8331388 - DNA, 22 bp, Homo sapiens
tctggctgggctgacattgaac

SEQ ID NO: 8331389 - DNA, 22 bp, Homo sapiens
tctggctgtcattggaggcccc

SEQ ID NO: 8331390 - DNA, 22 bp, Homo sapiens
tctggctgtgtaaggtagcacc

SEQ ID NO: 8331391 - DNA, 22 bp, Homo sapiens
tctggctgtgtaatatgtgtag

SEQ ID NO: 8331392 - DNA, 22 bp, Homo sapiens
tctgggcagcctcaggccaggg

SEQ ID NO: 8331393 - DNA, 21 bp, Homo sapiens
tctgggcccatgctgcctcac

SEQ ID NO: 8331394 - DNA, 23 bp, Homo sapiens
tctgggccacttgtctgcacttc

SEQ ID NO: 8331395 - DNA, 22 bp, Homo sapiens
tctgggctgctatgaggcagag

SEQ ID NO: 8331396 - DNA, 21 bp, Homo sapiens
tctgggctgctgctgcccatc

SEQ ID NO: 8331397 - DNA, 22 bp, Homo sapiens
tctggagtatgtccctggtgaa

SEQ ID NO: 8331398 - DNA, 22 bp, Homo sapiens
tctggagtaactctgtttctgg

SEQ ID NO: 8331399 - DNA, 22 bp, Homo sapiens
tctggagtgccctgctctgccc

SEQ ID NO: 8331400 - DNA, 22 bp, Homo sapiens
tctggagtggagctgatcattt

SEQ ID NO: 8331401 - DNA, 22 bp, Homo sapiens
tctggagtccagatccatttgg

SEQ ID NO: 8331402 - DNA, 22 bp, Homo sapiens
tctggaggctctgagggtgagt

SEQ ID NO: 8331403 - DNA, 22 bp, Homo sapiens
tctggagcaacagagcaggaca

SEQ ID NO: 8331404 - DNA, 22 bp, Homo sapiens
tctggagggggatgcctcatcc

SEQ ID NO: 8331405 - DNA, 22 bp, Homo sapiens
tctggaggctctgagggtgagt

SEQ ID NO: 8331406 - DNA, 17 bp, Homo sapiens
tctggatgtcatggaag

SEQ ID NO: 8331407 - DNA, 22 bp, Homo sapiens
tctggatttgtggaaaatctgc

SEQ ID NO: 8331408 - DNA, 22 bp, Homo sapiens
tctggatgatatgtgaacttga

SEQ ID NO: 8331409 - DNA, 22 bp, Homo sapiens
tctggatgatatgtgaacttga

SEQ ID NO: 8331410 - DNA, 22 bp, Homo sapiens
tctggagttttttctgtctgtg

SEQ ID NO: 8331411 - DNA, 22 bp, Homo sapiens
tctggagtgtccagttctactc

SEQ ID NO: 8331412 - DNA, 22 bp, Homo sapiens
tctggagtgggactttgcatct

SEQ ID NO: 8331413 - DNA, 22 bp, Homo sapiens
tctggagtggcagtcatctgaa

SEQ ID NO: 8331414 - DNA, 22 bp, Homo sapiens
tctggagtggaggtgccttggg

SEQ ID NO: 8331415 - DNA, 22 bp, Homo sapiens
tctggagtgtgtgtattcagct

SEQ ID NO: 8331416 - DNA, 22 bp, Homo sapiens
tctggagttactgctggctttg

SEQ ID NO: 8331417 - DNA, 22 bp, Homo sapiens
tctggccaatgttgtgatcaca

SEQ ID NO: 8331418 - DNA, 22 bp, Homo sapiens
tctggccaatgttgtgatcaca

SEQ ID NO: 8331419 - DNA, 22 bp, Homo sapiens
tctggccaaccctcaagttgta

SEQ ID NO: 8331420 - DNA, 22 bp, Homo sapiens
tctggccaaccctcaagttgta

SEQ ID NO: 8331421 - DNA, 22 bp, Homo sapiens
tctggccagtgaaatgcagaat

SEQ ID NO: 8331422 - DNA, 22 bp, Homo sapiens
tctggccactaataggtctcac

SEQ ID NO: 8331423 - DNA, 22 bp, Homo sapiens
tctggccacccgaggcccctgc

SEQ ID NO: 8331424 - DNA, 22 bp, Homo sapiens
tctggccagaaagacttgatgt

SEQ ID NO: 8331425 - DNA, 20 bp, Homo sapiens
tctggcacactgagaagctc

SEQ ID NO: 8331426 - DNA, 22 bp, Homo sapiens
tctggcacatagcagggtctct

SEQ ID NO: 8331427 - DNA, 22 bp, Homo sapiens
tctgctggccttagcaggtcta

SEQ ID NO: 8331428 - DNA, 22 bp, Homo sapiens
tctgctctccatacttccgcac

SEQ ID NO: 8331429 - DNA, 17 bp, Homo sapiens
tctgctctgccaatcca

SEQ ID NO: 8331430 - DNA, 22 bp, Homo sapiens
tctggagaacttgcaagaggat

SEQ ID NO: 8331431 - DNA, 22 bp, Homo sapiens
tctggagaaggaagagtctttg

SEQ ID NO: 8331432 - DNA, 22 bp, Homo sapiens
tctggagaggaggatgtggaca

SEQ ID NO: 8331433 - DNA, 22 bp, Homo sapiens
tctgcagaagccatggccttgc

SEQ ID NO: 8331434 - DNA, 22 bp, Homo sapiens
tctgcaggctctagatgaggtt

SEQ ID NO: 8331435 - DNA, 22 bp, Homo sapiens
tctgcaggatggatgctcagaa

SEQ ID NO: 8331436 - DNA, 22 bp, Homo sapiens
tctgcaggaaaaaagtgcctgg

SEQ ID NO: 8331437 - DNA, 22 bp, Homo sapiens
tctgccaggtggggagaggcca

SEQ ID NO: 8331438 - DNA, 22 bp, Homo sapiens
tctgccacatgagggcacagca

SEQ ID NO: 8331439 - DNA, 22 bp, Homo sapiens
tctgcccaaggctgtcactaga

SEQ ID NO: 8331440 - DNA, 22 bp, Homo sapiens
tctgcccttggctctcttgttg

SEQ ID NO: 8331441 - DNA, 22 bp, Homo sapiens
tctgccctggggtcagcctcca

SEQ ID NO: 8331442 - DNA, 23 bp, Homo sapiens
tctgccctctgcctgtttttgta

SEQ ID NO: 8331443 - DNA, 22 bp, Homo sapiens
tctgccctgcagggagcagtaa

SEQ ID NO: 8331444 - DNA, 22 bp, Homo sapiens
tctgcctgccagtctggtcctc

SEQ ID NO: 8331445 - DNA, 20 bp, Homo sapiens
tctgcccaccccggctccca

SEQ ID NO: 8331446 - DNA, 22 bp, Homo sapiens
tctgcccaccagcggttgcata

SEQ ID NO: 8331447 - DNA, 22 bp, Homo sapiens
tctgcccaccagcggttgcata

SEQ ID NO: 8331448 - DNA, 22 bp, Homo sapiens
tctgcccacagcctcctgtcca

SEQ ID NO: 8331449 - DNA, 22 bp, Homo sapiens
tctgcccactgctctgctgccc

SEQ ID NO: 8331450 - DNA, 22 bp, Homo sapiens
tctgcccagccagacccaaggt

SEQ ID NO: 8331451 - DNA, 19 bp, Homo sapiens
tctgcccagttgtctgccc

SEQ ID NO: 8331452 - DNA, 22 bp, Homo sapiens
tctgcccagggacccacaggga

SEQ ID NO: 8331453 - DNA, 22 bp, Homo sapiens
tctgcccagggacaggacacag

SEQ ID NO: 8331454 - DNA, 22 bp, Homo sapiens
tctgcccaggacacctgccact

SEQ ID NO: 8331455 - DNA, 22 bp, Homo sapiens
tctgcccaggaggtcccatggg

SEQ ID NO: 8331456 - DNA, 22 bp, Homo sapiens
tctgccctcgaggagcttgtgt

SEQ ID NO: 8331457 - DNA, 22 bp, Homo sapiens
tctgccctcattgctgcctgga

SEQ ID NO: 8331458 - DNA, 22 bp, Homo sapiens
tctgccctcagggtaatgatca

SEQ ID NO: 8331459 - DNA, 22 bp, Homo sapiens
tctgcccctgctgggcacagag

SEQ ID NO: 8331460 - DNA, 22 bp, Homo sapiens
tctgcccattcttagagtctag

SEQ ID NO: 8331461 - DNA, 22 bp, Homo sapiens
tctgcccagtttgtgctcaggt

SEQ ID NO: 8331462 - DNA, 22 bp, Homo sapiens
tctgcccagtttgtgctcaggt

SEQ ID NO: 8331463 - DNA, 22 bp, Homo sapiens
tctgcccagtttgtgctcaggt

SEQ ID NO: 8331464 - DNA, 17 bp, Homo sapiens
tctgaggcctctaggag

SEQ ID NO: 8331465 - DNA, 22 bp, Homo sapiens
tctgaggctgcatctatgtgac

SEQ ID NO: 8331466 - DNA, 22 bp, Homo sapiens
tctgaggctgaatggactccgt

SEQ ID NO: 8331467 - DNA, 22 bp, Homo sapiens
tctgagggtgggagaaggagct

SEQ ID NO: 8331468 - DNA, 23 bp, Homo sapiens
tctgaggtccaccagtttgcaga

SEQ ID NO: 8331469 - DNA, 22 bp, Homo sapiens
tctgaggtcctactataagtgg

SEQ ID NO: 8331470 - DNA, 20 bp, Homo sapiens
tctgaggtatgatagggtct

SEQ ID NO: 8331471 - DNA, 22 bp, Homo sapiens
tctgaggtcataaagcaacttt

SEQ ID NO: 8331472 - DNA, 21 bp, Homo sapiens
tctgatgttcacaccctgtat

SEQ ID NO: 8331473 - DNA, 22 bp, Homo sapiens
tctgatgtggagacactgtttt

SEQ ID NO: 8331474 - DNA, 22 bp, Homo sapiens
tctgagagatacaaggaggcaa

SEQ ID NO: 8331475 - DNA, 22 bp, Homo sapiens
tctgagccagggtctcctccct

SEQ ID NO: 8331476 - DNA, 22 bp, Homo sapiens
tctgagcccctagaactgagcg

SEQ ID NO: 8331477 - DNA, 22 bp, Homo sapiens
tctgagccagacaagacagcca

SEQ ID NO: 8331478 - DNA, 22 bp, Homo sapiens
tctgagccacagatgtcctgtt

SEQ ID NO: 8331479 - DNA, 22 bp, Homo sapiens
tctgagccaatttctgtgtcca

SEQ ID NO: 8331480 - DNA, 22 bp, Homo sapiens
tctgagcattttaggtggtatc

SEQ ID NO: 8331481 - DNA, 20 bp, Homo sapiens
tctgacccagagcccaggct

SEQ ID NO: 8331482 - DNA, 22 bp, Homo sapiens
tctgacattttgagaatgacat

SEQ ID NO: 8331483 - DNA, 22 bp, Homo sapiens
aatcataattcaaataagctta

SEQ ID NO: 8331484 - DNA, 22 bp, Homo sapiens
aatcagtgtgtaaagtggctgc

SEQ ID NO: 8331485 - DNA, 22 bp, Homo sapiens
aatcagtggttcccagcccagg

SEQ ID NO: 8331486 - DNA, 22 bp, Homo sapiens
aatcagtgtggtgacttgtctg

SEQ ID NO: 8331487 - DNA, 22 bp, Homo sapiens
aatcagtctcatttagcaggga

SEQ ID NO: 8331488 - DNA, 22 bp, Homo sapiens
aatcagaatcagttgacacagc

SEQ ID NO: 8331489 - DNA, 22 bp, Homo sapiens
aatcagaacttctcagggtggg

SEQ ID NO: 8331490 - DNA, 15 bp, Homo sapiens
aatcagaagtgtggc

SEQ ID NO: 8331491 - DNA, 22 bp, Homo sapiens
aatcagaaattctacatcacaa

SEQ ID NO: 8331492 - DNA, 22 bp, Homo sapiens
aatcagaaattgagggtctggt

SEQ ID NO: 8331493 - DNA, 22 bp, Homo sapiens
aatcagaaccttgggtcataac

SEQ ID NO: 8331494 - DNA, 22 bp, Homo sapiens
aatcagaacgctcgatcttcgg

SEQ ID NO: 8331495 - DNA, 22 bp, Homo sapiens
aatcagaactcctaccacagag

SEQ ID NO: 8331496 - DNA, 17 bp, Homo sapiens
aatcagatttctgagga

SEQ ID NO: 8331497 - DNA, 22 bp, Homo sapiens
aatcagaatttgtcccctgagt

SEQ ID NO: 8331498 - DNA, 22 bp, Homo sapiens
aatcagaatttattgaatcttt

SEQ ID NO: 8331499 - DNA, 22 bp, Homo sapiens
aatcagctaaataaactagtca

SEQ ID NO: 8331500 - DNA, 22 bp, Homo sapiens
aatactgagatcccacaaagca

SEQ ID NO: 8331501 - DNA, 22 bp, Homo sapiens
aatcagaaagaggtcatgttgc

SEQ ID NO: 8331502 - DNA, 19 bp, Homo sapiens
aatcagaaatatcgaggcc

SEQ ID NO: 8331503 - DNA, 20 bp, Homo sapiens
aatcagaaagtgtgagctct

SEQ ID NO: 8331504 - DNA, 22 bp, Homo sapiens
aatcagaaaggctaaggaagca

SEQ ID NO: 8331505 - DNA, 22 bp, Homo sapiens
aatcagaaagatcttgatgaga

SEQ ID NO: 8331506 - DNA, 22 bp, Homo sapiens
actttgaaagccttggccccgg

SEQ ID NO: 8331507 - DNA, 22 bp, Homo sapiens
actttgaaactaaaattcatta

SEQ ID NO: 8331508 - DNA, 22 bp, Homo sapiens
aagtcctttctcatggaggaat

SEQ ID NO: 8331509 - DNA, 22 bp, Homo sapiens
aagtcctttccagtcctgtgat

SEQ ID NO: 8331510 - DNA, 22 bp, Homo sapiens
aagtcctttatcctaaaaggtc

SEQ ID NO: 8331511 - DNA, 22 bp, Homo sapiens
aagtcctttaatatcacatagt

SEQ ID NO: 8331512 - DNA, 22 bp, Homo sapiens
actatacaagattagggatttg

SEQ ID NO: 8331513 - DNA, 22 bp, Homo sapiens
actatacaccaaaatattaagg

SEQ ID NO: 8331514 - DNA, 22 bp, Homo sapiens
actatacataaaacatttgggt

SEQ ID NO: 8331515 - DNA, 22 bp, Homo sapiens
actatacagtatgtacgtgcac

SEQ ID NO: 8331516 - DNA, 22 bp, Homo sapiens
actatacagaagaggataggaa

SEQ ID NO: 8331517 - DNA, 22 bp, Homo sapiens
acagaattaatgaaaattacaa

SEQ ID NO: 8331518 - DNA, 22 bp, Homo sapiens
acagatgatttttatgaaaaca

SEQ ID NO: 8331519 - DNA, 22 bp, Homo sapiens
aatggttttctagaacatgaaa

SEQ ID NO: 8331520 - DNA, 22 bp, Homo sapiens
aatgtgatcgctttagaagctt

SEQ ID NO: 8331521 - DNA, 22 bp, Homo sapiens
aatggtatttgtcaagcatagt

SEQ ID NO: 8331522 - DNA, 22 bp, Homo sapiens
aatggtttgatggacaaaatga

SEQ ID NO: 8331523 - DNA, 22 bp, Homo sapiens
aatgggataggtcttcaggaat

SEQ ID NO: 8331524 - DNA, 22 bp, Homo sapiens
aatgggataattgttcatggga

SEQ ID NO: 8331525 - DNA, 22 bp, Homo sapiens
aattaaatgacaggggaagatg

SEQ ID NO: 8331526 - DNA, 22 bp, Homo sapiens
aattaaattggtttagagagga

SEQ ID NO: 8331527 - DNA, 22 bp, Homo sapiens
aattccaggatgcaggaggtgc

SEQ ID NO: 8331528 - DNA, 22 bp, Homo sapiens
aattccaggcagaaatgtgagt

SEQ ID NO: 8331529 - DNA, 22 bp, Homo sapiens
aattgcaattttcttaaggtct

SEQ ID NO: 8331530 - DNA, 22 bp, Homo sapiens
acaacaaagacacttgaaatga

SEQ ID NO: 8331531 - DNA, 22 bp, Homo sapiens
agataatgaatgccatgacatt

SEQ ID NO: 8331532 - DNA, 22 bp, Homo sapiens
acaatgaacacacaaggaattc

SEQ ID NO: 8331533 - DNA, 22 bp, Homo sapiens
acaagccaattactgtgccagg

SEQ ID NO: 8331534 - DNA, 22 bp, Homo sapiens
aaagcctttgtctcaggctctg

SEQ ID NO: 8331535 - DNA, 19 bp, Homo sapiens
aactgtaattaatacccta

SEQ ID NO: 8331536 - DNA, 22 bp, Homo sapiens
aacataatgtggccaaagtcac

SEQ ID NO: 8331537 - DNA, 22 bp, Homo sapiens
aaagccattacaaaatttcata

SEQ ID NO: 8331538 - DNA, 22 bp, Homo sapiens
aaatgcatggctgttttaaagc

SEQ ID NO: 8331539 - DNA, 22 bp, Homo sapiens
aaatctcagtgttctaagcatt

SEQ ID NO: 8331540 - DNA, 22 bp, Homo sapiens
aaatctcactgtagtcaaagtg

SEQ ID NO: 8331541 - DNA, 22 bp, Homo sapiens
aaatctcaatttgaattgtagc

SEQ ID NO: 8331542 - DNA, 22 bp, Homo sapiens
aagatatagatggtggtataaa

SEQ ID NO: 8331543 - DNA, 22 bp, Homo sapiens
aaatactgggctcaaaagggtt

SEQ ID NO: 8331544 - DNA, 22 bp, Homo sapiens
aaactttggattgtgattgtgc

SEQ ID NO: 8331545 - DNA, 22 bp, Homo sapiens
aaactttggtatgtagcaaaac

SEQ ID NO: 8331546 - DNA, 22 bp, Homo sapiens
aaactttgttcgtctgatgtgg

SEQ ID NO: 8331547 - DNA, 22 bp, Homo sapiens
aaactttgtagagaatgctggc

SEQ ID NO: 8331548 - DNA, 22 bp, Homo sapiens
aaacatgttttctgaatatttt

SEQ ID NO: 8331549 - DNA, 22 bp, Homo sapiens
aaaattgaggctcatgttaaat

SEQ ID NO: 8331550 - DNA, 19 bp, Homo sapiens
aaaattgcgtattttgagg

SEQ ID NO: 8331551 - DNA, 22 bp, Homo sapiens
aaaattgagagtcttgtgcaag

SEQ ID NO: 8331552 - DNA, 22 bp, Homo sapiens
aaaactttcagggatacagaaa

SEQ ID NO: 8331553 - DNA, 22 bp, Homo sapiens
aaaaaggttgatccagattagg

SEQ ID NO: 8331554 - DNA, 22 bp, Homo sapiens
aaaaggcatggaggttgatagt

SEQ ID NO: 8331555 - DNA, 22 bp, Homo sapiens
aaaactgaaatacgatccaatg

SEQ ID NO: 8331556 - DNA, 22 bp, Homo sapiens
aacatgtctgggtattcacaag

SEQ ID NO: 8331557 - DNA, 22 bp, Homo sapiens
aatacatgttttctactattct

SEQ ID NO: 8331558 - DNA, 22 bp, Homo sapiens
aatggcttctgaagcacacttt

SEQ ID NO: 8331559 - DNA, 22 bp, Homo sapiens
aaattcaattaactttcatgct

SEQ ID NO: 8331560 - DNA, 22 bp, Homo sapiens
aaatgtcagaggaacatattga

SEQ ID NO: 8331561 - DNA, 22 bp, Homo sapiens
aacactttgggcatggccttcc

SEQ ID NO: 8331562 - DNA, 22 bp, Homo sapiens
aacactttctattattatggtt

SEQ ID NO: 8331563 - DNA, 22 bp, Homo sapiens
aacagaatagttgatgtacagt

SEQ ID NO: 8331564 - DNA, 22 bp, Homo sapiens
aattctaaatgtaatttagaat

SEQ ID NO: 8331565 - DNA, 22 bp, Homo sapiens
aattctcaggtaaaagttaagt

SEQ ID NO: 8331566 - DNA, 22 bp, Homo sapiens
aagaaacaaccactgctctcct

SEQ ID NO: 8331567 - DNA, 22 bp, Homo sapiens
aactggattaactggctcaaat

SEQ ID NO: 8331568 - DNA, 19 bp, Homo sapiens
aactggataatggccacat

SEQ ID NO: 8331569 - DNA, 22 bp, Homo sapiens
aactggatttaggaacagagaa

SEQ ID NO: 8331570 - DNA, 22 bp, Homo sapiens
acacaaactgctagaaaattgg

SEQ ID NO: 8331571 - DNA, 22 bp, Homo sapiens
aagactttcaaacctatgtttg

SEQ ID NO: 8331572 - DNA, 22 bp, Homo sapiens
aagactttcaagtatgcatgca

SEQ ID NO: 8331573 - DNA, 22 bp, Homo sapiens
aagcaatagcaacaactttaca

SEQ ID NO: 8331574 - DNA, 22 bp, Homo sapiens
aagatatagataaaactatgca

SEQ ID NO: 8331575 - DNA, 22 bp, Homo sapiens
actggttttccaggttacttct

SEQ ID NO: 8331576 - DNA, 22 bp, Homo sapiens
acttcacagaaattttatgagg

SEQ ID NO: 8331577 - DNA, 22 bp, Homo sapiens
acttcacacagcaaatttatct

SEQ ID NO: 8331578 - DNA, 22 bp, Homo sapiens
agaaacatcctgctttccattt

SEQ ID NO: 8331579 - DNA, 22 bp, Homo sapiens
atatgaaaagaagtcaccattg

SEQ ID NO: 8331580 - DNA, 22 bp, Homo sapiens
atatacaaagggcaacctcgct

SEQ ID NO: 8331581 - DNA, 22 bp, Homo sapiens
atataattgttctgaagtgttt

SEQ ID NO: 8331582 - DNA, 22 bp, Homo sapiens
actggatctaattggttatagt

SEQ ID NO: 8331583 - DNA, 20 bp, Homo sapiens
actggatctggctggagctg

SEQ ID NO: 8331584 - DNA, 22 bp, Homo sapiens
actggatcagaatctgattttt

SEQ ID NO: 8331585 - DNA, 22 bp, Homo sapiens
actggattccattgtgcaaaga

SEQ ID NO: 8331586 - DNA, 22 bp, Homo sapiens
actaaactgaagcatgaaaagg

SEQ ID NO: 8331587 - DNA, 22 bp, Homo sapiens
actatacattgaatgttaaggt

SEQ ID NO: 8331588 - DNA, 22 bp, Homo sapiens
caatgaaagcaactgcctataa

SEQ ID NO: 8331589 - DNA, 22 bp, Homo sapiens
caatgaaaatttaagttgcagc

SEQ ID NO: 8331590 - DNA, 22 bp, Homo sapiens
agcataaaggcactagaaagag

SEQ ID NO: 8331591 - DNA, 22 bp, Homo sapiens
caatgaaattgagatccagaga

SEQ ID NO: 8331592 - DNA, 22 bp, Homo sapiens
cagcacagggacaatagcagat

SEQ ID NO: 8331593 - DNA, 22 bp, Homo sapiens
cagagattattataactaatta

SEQ ID NO: 8331594 - DNA, 22 bp, Homo sapiens
agccagtcggggccatgctggg

SEQ ID NO: 8331595 - DNA, 21 bp, Homo sapiens
agccagtctgttttctagtgc

SEQ ID NO: 8331596 - DNA, 23 bp, Homo sapiens
cagaaatctgaaatctagaaatg

SEQ ID NO: 8331597 - DNA, 22 bp, Homo sapiens
atggtttagttagggcttttca

SEQ ID NO: 8331598 - DNA, 22 bp, Homo sapiens
atggtttactgatctttttggt

SEQ ID NO: 8331599 - DNA, 22 bp, Homo sapiens
atggtttattgctttaatgaaa

SEQ ID NO: 8331600 - DNA, 23 bp, Homo sapiens
atggtttatgtcacacttttgat

SEQ ID NO: 8331601 - DNA, 22 bp, Homo sapiens
atggttttgaagggaggtcaaa

SEQ ID NO: 8331602 - DNA, 22 bp, Homo sapiens
atggtttttcaagtattcagaa

SEQ ID NO: 8331603 - DNA, 22 bp, Homo sapiens
atggttttgtcctctttggttc

SEQ ID NO: 8331604 - DNA, 22 bp, Homo sapiens
atggttttcctctgctgcttaa

SEQ ID NO: 8331605 - DNA, 22 bp, Homo sapiens
atggttttagaatcaggaaaaa

SEQ ID NO: 8331606 - DNA, 21 bp, Homo sapiens
agaataatggtatcatttgct

SEQ ID NO: 8331607 - DNA, 23 bp, Homo sapiens
agaattccagtttcttatgtcac

SEQ ID NO: 8331608 - DNA, 22 bp, Homo sapiens
agaattcataggaagtttccta

SEQ ID NO: 8331609 - DNA, 22 bp, Homo sapiens
agaattcctctaggatctgccc

SEQ ID NO: 8331610 - DNA, 22 bp, Homo sapiens
agaattcctcctctgggacact

SEQ ID NO: 8331611 - DNA, 21 bp, Homo sapiens
agaattcttaagtattctaat

SEQ ID NO: 8331612 - DNA, 22 bp, Homo sapiens
atttccaatttcatccatgtcc

SEQ ID NO: 8331613 - DNA, 21 bp, Homo sapiens
atttccaaataaggtcacatt

SEQ ID NO: 8331614 - DNA, 22 bp, Homo sapiens
atttccaagaaagctttaggat

SEQ ID NO: 8331615 - DNA, 22 bp, Homo sapiens
agatgaaaagataagcagcaat

SEQ ID NO: 8331616 - DNA, 18 bp, Homo sapiens
agatgaaagcaaatgaca

SEQ ID NO: 8331617 - DNA, 22 bp, Homo sapiens
agatttcagatgctcggcagtt

SEQ ID NO: 8331618 - DNA, 22 bp, Homo sapiens
atttagcaaaaaatgatgaagc

SEQ ID NO: 8331619 - DNA, 22 bp, Homo sapiens
atttagtgtattctaatatgtg

SEQ ID NO: 8331620 - DNA, 22 bp, Homo sapiens
atttagcctcatttttgacata

SEQ ID NO: 8331621 - DNA, 22 bp, Homo sapiens
attaaagaaacccagcatgtga

SEQ ID NO: 8331622 - DNA, 22 bp, Homo sapiens
attaaagacagcagatggatgg

SEQ ID NO: 8331623 - DNA, 22 bp, Homo sapiens
attaaactgagcaaattaacat

SEQ ID NO: 8331624 - DNA, 22 bp, Homo sapiens
atgttaaatggtttattattaa

SEQ ID NO: 8331625 - DNA, 22 bp, Homo sapiens
catttacatttaaggttaatat

SEQ ID NO: 8331626 - DNA, 21 bp, Homo sapiens
catttacatgacagattggtt

SEQ ID NO: 8331627 - DNA, 22 bp, Homo sapiens
catttacagcagactgatgaaa

SEQ ID NO: 8331628 - DNA, 22 bp, Homo sapiens
catttacataacagtaacgctg

SEQ ID NO: 8331629 - DNA, 22 bp, Homo sapiens
catttacagtgagagtttttac

SEQ ID NO: 8331630 - DNA, 22 bp, Homo sapiens
ccagtcactctgtgagagctac

SEQ ID NO: 8331631 - DNA, 22 bp, Homo sapiens
ccataatattaaatgcttttgt

SEQ ID NO: 8331632 - DNA, 22 bp, Homo sapiens
ataaaagttcaagagagtacag

SEQ ID NO: 8331633 - DNA, 20 bp, Homo sapiens
atacttgttttcaggctttt

SEQ ID NO: 8331634 - DNA, 22 bp, Homo sapiens
atacagaattcactacagtttc

SEQ ID NO: 8331635 - DNA, 22 bp, Homo sapiens
atacagaatttgcccttttcat

SEQ ID NO: 8331636 - DNA, 22 bp, Homo sapiens
atacagaagttttccacttatt

SEQ ID NO: 8331637 - DNA, 22 bp, Homo sapiens
atacagaatactaattcctgag

SEQ ID NO: 8331638 - DNA, 22 bp, Homo sapiens
atccaaacctggacatgagtgg

SEQ ID NO: 8331639 - DNA, 22 bp, Homo sapiens
atccaaacatgtaccacactaa

SEQ ID NO: 8331640 - DNA, 22 bp, Homo sapiens
ctgtgcagctggcttcctggaa

SEQ ID NO: 8331641 - DNA, 22 bp, Homo sapiens
atatataacctggataaggctt

SEQ ID NO: 8331642 - DNA, 18 bp, Homo sapiens
atatgttaattaggtagg

SEQ ID NO: 8331643 - DNA, 23 bp, Homo sapiens
atatggctgttgtgtgttaacat

SEQ ID NO: 8331644 - DNA, 22 bp, Homo sapiens
atatccaagaaacaattaattc

SEQ ID NO: 8331645 - DNA, 22 bp, Homo sapiens
atatatgcatgtgtacttatgt

SEQ ID NO: 8331646 - DNA, 20 bp, Homo sapiens
caccagtcatgagtcaatac

SEQ ID NO: 8331647 - DNA, 22 bp, Homo sapiens
ggatctgagagcaagcaggacc

SEQ ID NO: 8331648 - DNA, 22 bp, Homo sapiens
ggatctgattaataaggtggac

SEQ ID NO: 8331649 - DNA, 22 bp, Homo sapiens
caagatcagggtgccagaatgg

SEQ ID NO: 8331650 - DNA, 22 bp, Homo sapiens
caacatttgagtaaagaaatgg

SEQ ID NO: 8331651 - DNA, 22 bp, Homo sapiens
caacagtctggtttatataata

SEQ ID NO: 8331652 - DNA, 22 bp, Homo sapiens
cacaatactatttttaggtctt

SEQ ID NO: 8331653 - DNA, 22 bp, Homo sapiens
cacaatttccaagtcatgttat

SEQ ID NO: 8331654 - DNA, 22 bp, Homo sapiens
cacaatttggtgctaaagaaag

SEQ ID NO: 8331655 - DNA, 22 bp, Homo sapiens
caattttttccatgctcttaca

SEQ ID NO: 8331656 - DNA, 22 bp, Homo sapiens
cagaagtcaccctcagaataac

SEQ ID NO: 8331657 - DNA, 22 bp, Homo sapiens
gtaaacaacacaaatcatttga

SEQ ID NO: 8331658 - DNA, 20 bp, Homo sapiens
gtaaaatatggtctttgggt

SEQ ID NO: 8331659 - DNA, 22 bp, Homo sapiens
atgggtttccctctgaaattat

SEQ ID NO: 8331660 - DNA, 22 bp, Homo sapiens
atggtattgcaacaactgtcat

SEQ ID NO: 8331661 - DNA, 22 bp, Homo sapiens
atgtgtatgcatgcactaagat

SEQ ID NO: 8331662 - DNA, 22 bp, Homo sapiens
atctatcccagtttaactcatt

SEQ ID NO: 8331663 - DNA, 22 bp, Homo sapiens
atctatactacaaatggctggt

SEQ ID NO: 8331664 - DNA, 22 bp, Homo sapiens
atctatacccatcatgatttaa

SEQ ID NO: 8331665 - DNA, 22 bp, Homo sapiens
atctatactcagagttaatatc

SEQ ID NO: 8331666 - DNA, 22 bp, Homo sapiens
atctagaacttaaagtcagtca

SEQ ID NO: 8331667 - DNA, 22 bp, Homo sapiens
atgaaaacggaccagagctatt

SEQ ID NO: 8331668 - DNA, 22 bp, Homo sapiens
atgaaacagtgtgtatagcaaa

SEQ ID NO: 8331669 - DNA, 22 bp, Homo sapiens
atgaaatatttcagagcagagt

SEQ ID NO: 8331670 - DNA, 22 bp, Homo sapiens
atgaaatatcttgaagaaattc

SEQ ID NO: 8331671 - DNA, 22 bp, Homo sapiens
atgcaaaataaggcagaaacat

SEQ ID NO: 8331672 - DNA, 22 bp, Homo sapiens
caaactggctatgggaatcttg

SEQ ID NO: 8331673 - DNA, 22 bp, Homo sapiens
atttactgaggtaaataaactg

SEQ ID NO: 8331674 - DNA, 22 bp, Homo sapiens
atttcacaaaccatcctgattt

SEQ ID NO: 8331675 - DNA, 22 bp, Homo sapiens
atttcatactaaggctcaaaaa

SEQ ID NO: 8331676 - DNA, 22 bp, Homo sapiens
atttcaggatagcctagttttg

SEQ ID NO: 8331677 - DNA, 22 bp, Homo sapiens
atttcaggagcagtttcagtgg

SEQ ID NO: 8331678 - DNA, 22 bp, Homo sapiens
gatgataacagcatttcaactg

SEQ ID NO: 8331679 - DNA, 22 bp, Homo sapiens
attacaagatgcatccatattt

SEQ ID NO: 8331680 - DNA, 22 bp, Homo sapiens
gcaactttagaaaaatctataa

SEQ ID NO: 8331681 - DNA, 22 bp, Homo sapiens
gcaactttagggccagcaagta

SEQ ID NO: 8331682 - DNA, 22 bp, Homo sapiens
gcaactttcaagcaccatgggg

SEQ ID NO: 8331683 - DNA, 16 bp, Homo sapiens
gcaactttggggttga

SEQ ID NO: 8331684 - DNA, 22 bp, Homo sapiens
catactttctttttcacgcata

SEQ ID NO: 8331685 - DNA, 22 bp, Homo sapiens
catactttgggataagagtgga

SEQ ID NO: 8331686 - DNA, 22 bp, Homo sapiens
catataatgtttgaagatgtgg

SEQ ID NO: 8331687 - DNA, 22 bp, Homo sapiens
catgataattgttaacaaagta

SEQ ID NO: 8331688 - DNA, 22 bp, Homo sapiens
catggctttttagcatattcaa

SEQ ID NO: 8331689 - DNA, 22 bp, Homo sapiens
catggctttgttctgttagatg

SEQ ID NO: 8331690 - DNA, 22 bp, Homo sapiens
catggctttgttcatataattt

SEQ ID NO: 8331691 - DNA, 22 bp, Homo sapiens
catggcttgtaataaatttata

SEQ ID NO: 8331692 - DNA, 22 bp, Homo sapiens
catggcttctaagtgataacgt

SEQ ID NO: 8331693 - DNA, 22 bp, Homo sapiens
tattaaagggaagttatgcatg

SEQ ID NO: 8331694 - DNA, 22 bp, Homo sapiens
tatctgagaaagaagcaccaga

SEQ ID NO: 8331695 - DNA, 23 bp, Homo sapiens
tatggcttacagtgctttaggta

SEQ ID NO: 8331696 - DNA, 22 bp, Homo sapiens
tataagaaacaaggcaaatttt

SEQ ID NO: 8331697 - DNA, 22 bp, Homo sapiens
tatacagattaacagatttaaa

SEQ ID NO: 8331698 - DNA, 22 bp, Homo sapiens
tatacagatggaaagatacaca

SEQ ID NO: 8331699 - DNA, 22 bp, Homo sapiens
tatacagtcttttgctatattc

SEQ ID NO: 8331700 - DNA, 22 bp, Homo sapiens
tcaccagtctttcttaccattg

SEQ ID NO: 8331701 - DNA, 22 bp, Homo sapiens
tcagaaatgatcgttattcatt

SEQ ID NO: 8331702 - DNA, 22 bp, Homo sapiens
tcagaaatagtctttaaaatga

SEQ ID NO: 8331703 - DNA, 22 bp, Homo sapiens
tcagaaatacaaaacacttact

SEQ ID NO: 8331704 - DNA, 19 bp, Homo sapiens
cagtcctttccgctttctc

SEQ ID NO: 8331705 - DNA, 22 bp, Homo sapiens
cagtcctttctgaaatcctata

SEQ ID NO: 8331706 - DNA, 22 bp, Homo sapiens
cagtccttggcttcatccgagt

SEQ ID NO: 8331707 - DNA, 22 bp, Homo sapiens
cagtcctttcaatggtgacctt

SEQ ID NO: 8331708 - DNA, 20 bp, Homo sapiens
tatttacaacttagagcctc

SEQ ID NO: 8331709 - DNA, 22 bp, Homo sapiens
cagtccttaaggaaacatttgt

SEQ ID NO: 8331710 - DNA, 22 bp, Homo sapiens
cagtccttgatccaatagtggg

SEQ ID NO: 8331711 - DNA, 22 bp, Homo sapiens
cagtccttgctatgaccctgag

SEQ ID NO: 8331712 - DNA, 22 bp, Homo sapiens
cagtccttgctcaaagtctaca

SEQ ID NO: 8331713 - DNA, 22 bp, Homo sapiens
cagtccttgctctgggatgatg

SEQ ID NO: 8331714 - DNA, 22 bp, Homo sapiens
cagtccttggcaagttctcagt

SEQ ID NO: 8331715 - DNA, 22 bp, Homo sapiens
cagtccttagattttactgcca

SEQ ID NO: 8331716 - DNA, 22 bp, Homo sapiens
cagtccttagtctggatggctt

SEQ ID NO: 8331717 - DNA, 22 bp, Homo sapiens
cagtccttattcctatattcct

SEQ ID NO: 8331718 - DNA, 22 bp, Homo sapiens
cagtccttcattcctcctttga

SEQ ID NO: 8331719 - DNA, 22 bp, Homo sapiens
cagtccttccttgccccttggg

SEQ ID NO: 8331720 - DNA, 22 bp, Homo sapiens
cagtccttctccattaaggctc

SEQ ID NO: 8331721 - DNA, 22 bp, Homo sapiens
ccagctgtcagtgtgaaaataa

SEQ ID NO: 8331722 - DNA, 22 bp, Homo sapiens
ccagctattgctgtgtaacagt

SEQ ID NO: 8331723 - DNA, 22 bp, Homo sapiens
tctgataactctggccccaggc

SEQ ID NO: 8331724 - DNA, 22 bp, Homo sapiens
ccagataaggctttttaaaagc

SEQ ID NO: 8331725 - DNA, 22 bp, Homo sapiens
ccagatctaagtccaaagtact

SEQ ID NO: 8331726 - DNA, 22 bp, Homo sapiens
ccagatcttcttttcagtgtct

SEQ ID NO: 8331727 - DNA, 22 bp, Homo sapiens
ccagatctagtgttgtaaagct

SEQ ID NO: 8331728 - DNA, 19 bp, Homo sapiens
tctctacactacatttcta

SEQ ID NO: 8331729 - DNA, 22 bp, Homo sapiens
ccagaatttggatcatgatttt

SEQ ID NO: 8331730 - DNA, 22 bp, Homo sapiens
ccagaattcagaaagggcataa

SEQ ID NO: 8331731 - DNA, 23 bp, Homo sapiens
ccaaagtcgaagtctagtccaga

SEQ ID NO: 8331732 - DNA, 22 bp, Homo sapiens
catttacacttctaaccacaag

SEQ ID NO: 8331733 - DNA, 22 bp, Homo sapiens
catttagttatactaaaacatt

SEQ ID NO: 8331734 - DNA, 22 bp, Homo sapiens
gttaaagagtttggctttcttc

SEQ ID NO: 8331735 - DNA, 22 bp, Homo sapiens
gttaaagaagaatagttccttt

SEQ ID NO: 8331736 - DNA, 22 bp, Homo sapiens
gtttacatgtactcattatact

SEQ ID NO: 8331737 - DNA, 18 bp, Homo sapiens
taaatatatttccccctt

SEQ ID NO: 8331738 - DNA, 22 bp, Homo sapiens
taaatatgcatgtatccttatc

SEQ ID NO: 8331739 - DNA, 22 bp, Homo sapiens
taaagccaacactttactgctc

SEQ ID NO: 8331740 - DNA, 22 bp, Homo sapiens
taaagccatactgaaagccact

SEQ ID NO: 8331741 - DNA, 17 bp, Homo sapiens
taaagccagtcaagtca

SEQ ID NO: 8331742 - DNA, 22 bp, Homo sapiens
taaagccacttcattctagtct

SEQ ID NO: 8331743 - DNA, 22 bp, Homo sapiens
taaagccacgctggaaatcagg

SEQ ID NO: 8331744 - DNA, 22 bp, Homo sapiens
taaagccaatatacctagcata

SEQ ID NO: 8331745 - DNA, 22 bp, Homo sapiens
taaagtcatctttacatctttg

SEQ ID NO: 8331746 - DNA, 22 bp, Homo sapiens
taaagcagtgttgggtcggacg

SEQ ID NO: 8331747 - DNA, 22 bp, Homo sapiens
taaacatgttgacatcttacct

SEQ ID NO: 8331748 - DNA, 22 bp, Homo sapiens
taacagaaaggggacagaaata

SEQ ID NO: 8331749 - DNA, 22 bp, Homo sapiens
taacagaagatgaaacttcttt

SEQ ID NO: 8331750 - DNA, 22 bp, Homo sapiens
taacagaagaaaacatattgga

SEQ ID NO: 8331751 - DNA, 22 bp, Homo sapiens
taacagaaattttagttagggg

SEQ ID NO: 8331752 - DNA, 22 bp, Homo sapiens
taacaagtcattttaaattatg

SEQ ID NO: 8331753 - DNA, 22 bp, Homo sapiens
taattgtagctttgtaatcagc

SEQ ID NO: 8331754 - DNA, 22 bp, Homo sapiens
tacaatacttaacctattttgc

SEQ ID NO: 8331755 - DNA, 20 bp, Homo sapiens
tacaatacacatgcatatga

SEQ ID NO: 8331756 - DNA, 19 bp, Homo sapiens
tgctgaagttgtcagtctg

SEQ ID NO: 8331757 - DNA, 22 bp, Homo sapiens
cctatacaggcttctttacatg

SEQ ID NO: 8331758 - DNA, 22 bp, Homo sapiens
cctatacagcctcagctgagat

SEQ ID NO: 8331759 - DNA, 22 bp, Homo sapiens
tgtatgttgggtcaaagtacat

SEQ ID NO: 8331760 - DNA, 22 bp, Homo sapiens
ctggattttagaaggcttccta

SEQ ID NO: 8331761 - DNA, 22 bp, Homo sapiens
ctggatttgcctatggtgcttt

SEQ ID NO: 8331762 - DNA, 22 bp, Homo sapiens
ctggatttaggactagtccaag

SEQ ID NO: 8331763 - DNA, 22 bp, Homo sapiens
ctggatcatgggaaagggatca

SEQ ID NO: 8331764 - DNA, 22 bp, Homo sapiens
ctggatcatgcattgcttgtcc

SEQ ID NO: 8331765 - DNA, 22 bp, Homo sapiens
ctggactctgcagagaaaagta

SEQ ID NO: 8331766 - DNA, 22 bp, Homo sapiens
ctaattatgttgttataatcaa

SEQ ID NO: 8331767 - DNA, 22 bp, Homo sapiens
ttccaaactgccaattcagaag

SEQ ID NO: 8331768 - DNA, 22 bp, Homo sapiens
ttccaaagtgctggaattacat

SEQ ID NO: 8331769 - DNA, 22 bp, Homo sapiens
ttccaaagttagttattagaaa

SEQ ID NO: 8331770 - DNA, 22 bp, Homo sapiens
ttcccaatattctgcttttatg

SEQ ID NO: 8331771 - DNA, 22 bp, Homo sapiens
ttcacataatgatacaaagctt

SEQ ID NO: 8331772 - DNA, 22 bp, Homo sapiens
ttcagaaacccattgggtctct

SEQ ID NO: 8331773 - DNA, 22 bp, Homo sapiens
ttcagaaacagagtgagtgagt

SEQ ID NO: 8331774 - DNA, 22 bp, Homo sapiens
ttcagaaacatcagtggatgga

SEQ ID NO: 8331775 - DNA, 22 bp, Homo sapiens
ttcagaaaaagaccattgcaat

SEQ ID NO: 8331776 - DNA, 22 bp, Homo sapiens
ttcagaaaaaacttcaataagt

SEQ ID NO: 8331777 - DNA, 22 bp, Homo sapiens
ttcagaaaggttaatctggatt

SEQ ID NO: 8331778 - DNA, 22 bp, Homo sapiens
ttcagaaaggtaaatggatttc

SEQ ID NO: 8331779 - DNA, 22 bp, Homo sapiens
ttcagaaaggataattggaagg

SEQ ID NO: 8331780 - DNA, 22 bp, Homo sapiens
ttccaaacctcaaataattaat

SEQ ID NO: 8331781 - DNA, 22 bp, Homo sapiens
tttagaatgtgactgtatttga

SEQ ID NO: 8331782 - DNA, 22 bp, Homo sapiens
ttggtacaaaagtaactgtggt

SEQ ID NO: 8331783 - DNA, 22 bp, Homo sapiens
ttggtacaatgtgctaggtagg

SEQ ID NO: 8331784 - DNA, 22 bp, Homo sapiens
ttggtacagatgaggtattctc

SEQ ID NO: 8331785 - DNA, 22 bp, Homo sapiens
ttgttaaaaatagatttccagg

SEQ ID NO: 8331786 - DNA, 22 bp, Homo sapiens
ttgatactattaagcactgggc

SEQ ID NO: 8331787 - DNA, 22 bp, Homo sapiens
ctcatacatatgccattcctgc

SEQ ID NO: 8331788 - DNA, 22 bp, Homo sapiens
gccttaatttatgtctaacata

SEQ ID NO: 8331789 - DNA, 22 bp, Homo sapiens
gccttaattttttataatctct

SEQ ID NO: 8331790 - DNA, 22 bp, Homo sapiens
gcatgttatgtatctgcccagc

SEQ ID NO: 8331791 - DNA, 22 bp, Homo sapiens
gcagggcaaacccaggtgttca

SEQ ID NO: 8331792 - DNA, 22 bp, Homo sapiens
gcagggcagacctccagcctat

SEQ ID NO: 8331793 - DNA, 18 bp, Homo sapiens
gcaggcttttcctgggtc

SEQ ID NO: 8331794 - DNA, 22 bp, Homo sapiens
gatttacaaagctctctagtgt

SEQ ID NO: 8331795 - DNA, 22 bp, Homo sapiens
gatttacagatctaagggtcac

SEQ ID NO: 8331796 - DNA, 22 bp, Homo sapiens
gatttacaggttaggtcctgta

SEQ ID NO: 8331797 - DNA, 22 bp, Homo sapiens
gatttacagctatacccaatgg

SEQ ID NO: 8331798 - DNA, 22 bp, Homo sapiens
gatttagagcaggaatgcatgg

SEQ ID NO: 8331799 - DNA, 22 bp, Homo sapiens
gatttcaaaggttctgcatgcc

SEQ ID NO: 8331800 - DNA, 20 bp, Homo sapiens
gatttcaaagcagagtggcc

SEQ ID NO: 8331801 - DNA, 22 bp, Homo sapiens
gatttcaaaagtagatccatca

SEQ ID NO: 8331802 - DNA, 22 bp, Homo sapiens
gatggctttgtgcaccatgatt

SEQ ID NO: 8331803 - DNA, 22 bp, Homo sapiens
gatggcttcagtctccttgggt

SEQ ID NO: 8331804 - DNA, 22 bp, Homo sapiens
gatggcttcacttacatggctg

SEQ ID NO: 8331805 - DNA, 22 bp, Homo sapiens
gatgggattttttatgtgttca

SEQ ID NO: 8331806 - DNA, 22 bp, Homo sapiens
gcacaataatttttttaagagg

SEQ ID NO: 8331807 - DNA, 22 bp, Homo sapiens
gcacaataacagccaaggttat

SEQ ID NO: 8331808 - DNA, 22 bp, Homo sapiens
gcacaataattcttgttttgct

SEQ ID NO: 8331809 - DNA, 22 bp, Homo sapiens
gattttcatttgcactctagaa

SEQ ID NO: 8331810 - DNA, 22 bp, Homo sapiens
gatttcaaggatgttagaggtg

SEQ ID NO: 8331811 - DNA, 22 bp, Homo sapiens
gatttcaagtatcttgggcgag

SEQ ID NO: 8331812 - DNA, 22 bp, Homo sapiens
gatttcaatccagctttcttct

SEQ ID NO: 8331813 - DNA, 22 bp, Homo sapiens
gatttcaagcccccagagattc

SEQ ID NO: 8331814 - DNA, 22 bp, Homo sapiens
gatttcaaggagttttcacagt

SEQ ID NO: 8331815 - DNA, 22 bp, Homo sapiens
gatttcaacctaacagtatgac

SEQ ID NO: 8331816 - DNA, 21 bp, Homo sapiens
gatttgcagaaactagacagg

SEQ ID NO: 8331817 - DNA, 17 bp, Homo sapiens
cttttaatttacttccc

SEQ ID NO: 8331818 - DNA, 22 bp, Homo sapiens
gaagttcaaaagacagatttga

SEQ ID NO: 8331819 - DNA, 22 bp, Homo sapiens
gaattacatgaccctgagtaga

SEQ ID NO: 8331820 - DNA, 22 bp, Homo sapiens
gaagtgaaggttactctagatt

SEQ ID NO: 8331821 - DNA, 22 bp, Homo sapiens
gaagtgaagagattagaaatca

SEQ ID NO: 8331822 - DNA, 22 bp, Homo sapiens
gagtccttctggctggcaggat

SEQ ID NO: 8331823 - DNA, 22 bp, Homo sapiens
gagtccttccagcaggcattta

SEQ ID NO: 8331824 - DNA, 22 bp, Homo sapiens
gagtccttgtcataattcagtg

SEQ ID NO: 8331825 - DNA, 22 bp, Homo sapiens
gagtcctttgttccttgccaca

SEQ ID NO: 8331826 - DNA, 22 bp, Homo sapiens
gagtccttgacacatagtaggt

SEQ ID NO: 8331827 - DNA, 22 bp, Homo sapiens
gagtccttggcatcatcagtac

SEQ ID NO: 8331828 - DNA, 22 bp, Homo sapiens
gagtccttttgtgccacaggga

SEQ ID NO: 8331829 - DNA, 22 bp, Homo sapiens
gagtccttttctctgtccactg

SEQ ID NO: 8331830 - DNA, 22 bp, Homo sapiens
gagtccttttcatagcagtggg

SEQ ID NO: 8331831 - DNA, 22 bp, Homo sapiens
gagtccttaatacactggtgga

SEQ ID NO: 8331832 - DNA, 21 bp, Homo sapiens
gagtccttccaatgtcctcag

SEQ ID NO: 8331833 - DNA, 20 bp, Homo sapiens
gagtccttatgggctgaggt

SEQ ID NO: 8331834 - DNA, 22 bp, Homo sapiens
gataaaattcttattttacccg

SEQ ID NO: 8331835 - DNA, 22 bp, Homo sapiens
gataaaataactatggaatact

SEQ ID NO: 8331836 - DNA, 22 bp, Homo sapiens
gataaaatatgtggcctttagt

SEQ ID NO: 8331837 - DNA, 21 bp, Homo sapiens
gataaaatgggccttggtcct

SEQ ID NO: 8331838 - DNA, 22 bp, Homo sapiens
gatcagaatcttcattttcagt

SEQ ID NO: 8331839 - DNA, 22 bp, Homo sapiens
gatcagaattcttgtgtgtttc

SEQ ID NO: 8331840 - DNA, 22 bp, Homo sapiens
gatcagaatgggacatatcctg

SEQ ID NO: 8331841 - DNA, 22 bp, Homo sapiens
gatcagaatttacttataattg

SEQ ID NO: 8331842 - DNA, 22 bp, Homo sapiens
gatagaaagaatatagattcca

SEQ ID NO: 8331843 - DNA, 22 bp, Homo sapiens
gatagaaagagtggttcttttt

SEQ ID NO: 8331844 - DNA, 22 bp, Homo sapiens
gatagaaaggtgttgaaatcca

SEQ ID NO: 8331845 - DNA, 22 bp, Homo sapiens
gataataagcacagcaggatgt

SEQ ID NO: 8331846 - DNA, 22 bp, Homo sapiens
gatgaaaaattgctgtgtcata

SEQ ID NO: 8331847 - DNA, 22 bp, Homo sapiens
gatgaaaatcttgagatgtcga

SEQ ID NO: 8331848 - DNA, 22 bp, Homo sapiens
gatgaaaaaagacgagcatata

SEQ ID NO: 8331849 - DNA, 22 bp, Homo sapiens
gagtcaccacacggtgctgact

SEQ ID NO: 8331850 - DNA, 22 bp, Homo sapiens
gagtcaccactgtgatagtcga

SEQ ID NO: 8331851 - DNA, 22 bp, Homo sapiens
gagtcaccttggccgctgtccc

SEQ ID NO: 8331852 - DNA, 22 bp, Homo sapiens
gagtcaccttgggtcagcgata

SEQ ID NO: 8331853 - DNA, 22 bp, Homo sapiens
gcttcacactaaaaatgttaaa

SEQ ID NO: 8331854 - DNA, 22 bp, Homo sapiens
gcttcacaggcaagttaagcct

SEQ ID NO: 8331855 - DNA, 22 bp, Homo sapiens
ggagaatgatatatagctcagt

SEQ ID NO: 8331856 - DNA, 23 bp, Homo sapiens
ggccatttcatttggttcaaact

SEQ ID NO: 8331857 - DNA, 22 bp, Homo sapiens
gtttaataatgttgaattacta

SEQ ID NO: 8331858 - DNA, 22 bp, Homo sapiens
gtttaatcagaggaattataga

SEQ ID NO: 8331859 - DNA, 22 bp, Homo sapiens
gttctaataggagaaaagacag

SEQ ID NO: 8331860 - DNA, 22 bp, Homo sapiens
gttctaatattttaaaagccaa

SEQ ID NO: 8331861 - DNA, 22 bp, Homo sapiens
gttctaatttggggctccttag

SEQ ID NO: 8331862 - DNA, 22 bp, Homo sapiens
gtatagaaacccagaaagatag

SEQ ID NO: 8331863 - DNA, 22 bp, Homo sapiens
gtacataaaggaggctctttgc

SEQ ID NO: 8331864 - DNA, 22 bp, Homo sapiens
gtacagaattatgccatgaggg

SEQ ID NO: 8331865 - DNA, 22 bp, Homo sapiens
gtacagaatgcttggtaaggca

SEQ ID NO: 8331866 - DNA, 22 bp, Homo sapiens
gtacagaaggatttctagtagt

SEQ ID NO: 8331867 - DNA, 22 bp, Homo sapiens
gtacagaaggagctttggattc

SEQ ID NO: 8331868 - DNA, 22 bp, Homo sapiens
gtacagaaatgtgatgacgcaa

SEQ ID NO: 8331869 - DNA, 22 bp, Homo sapiens
gtacagaaagtacccatagaag

SEQ ID NO: 8331870 - DNA, 22 bp, Homo sapiens
gtacagaaatggggccccaggt

SEQ ID NO: 8331871 - DNA, 22 bp, Homo sapiens
gtaaacattttcatctgtgccc

SEQ ID NO: 8331872 - DNA, 23 bp, Homo sapiens
gtaaaatacgcagtgcagtgtga

SEQ ID NO: 8331873 - DNA, 22 bp, Homo sapiens
gtaaacattactgtgctgtata

SEQ ID NO: 8331874 - DNA, 22 bp, Homo sapiens
gtccttagttacttttcatgtc

SEQ ID NO: 8331875 - DNA, 22 bp, Homo sapiens
tctggatcaccacttctgcctc

SEQ ID NO: 8331876 - DNA, 22 bp, Homo sapiens
tctggatcccaccgccacacac

SEQ ID NO: 8331877 - DNA, 22 bp, Homo sapiens
tctggatcctatgcactggact

SEQ ID NO: 8331878 - DNA, 22 bp, Homo sapiens
tctggatctccagcacttatca

SEQ ID NO: 8331879 - DNA, 22 bp, Homo sapiens
tctggatcgccggcgcctgggc

SEQ ID NO: 8331880 - DNA, 22 bp, Homo sapiens
tctggatcgggttcctcaggtc

SEQ ID NO: 8331881 - DNA, 22 bp, Homo sapiens
tctggatctccctcatcctggg

SEQ ID NO: 8331882 - DNA, 23 bp, Homo sapiens
tctgtacacatcagcatctccca

SEQ ID NO: 8331883 - DNA, 20 bp, Homo sapiens
tcttatacagaaaacatttt

SEQ ID NO: 8331884 - DNA, 22 bp, Homo sapiens
tctttaattgtggaagagcagc

SEQ ID NO: 8331885 - DNA, 22 bp, Homo sapiens
tctttaattcagcatgatgcgg

SEQ ID NO: 8331886 - DNA, 22 bp, Homo sapiens
tctttaatgtgattgtaattat

SEQ ID NO: 8331887 - DNA, 22 bp, Homo sapiens
tctttaatgtactttctttcac

SEQ ID NO: 8331888 - DNA, 22 bp, Homo sapiens
tctttaatcataaccaagatgg

SEQ ID NO: 8331889 - DNA, 22 bp, Homo sapiens
tctttaatatctgccccagagc

SEQ ID NO: 8331890 - DNA, 22 bp, Homo sapiens
tctaaacagcctcttaccaact

SEQ ID NO: 8331891 - DNA, 22 bp, Homo sapiens
tctaaacagtttcactcttaat

SEQ ID NO: 8331892 - DNA, 22 bp, Homo sapiens
tctaaacactaagtcttgatgc

SEQ ID NO: 8331893 - DNA, 19 bp, Homo sapiens
tccttcagtcagatctggg

SEQ ID NO: 8331894 - DNA, 22 bp, Homo sapiens
tctagacactactagtaaccgg

SEQ ID NO: 8331895 - DNA, 20 bp, Homo sapiens
tctaattaaaattgtctagt

SEQ ID NO: 8331896 - DNA, 21 bp, Homo sapiens
tctattcattacagttatttg

SEQ ID NO: 8331897 - DNA, 22 bp, Homo sapiens
taagaagtacaaaaattttctg

SEQ ID NO: 8331898 - DNA, 22 bp, Homo sapiens
taagaatcagtagatatagatt

SEQ ID NO: 8331899 - DNA, 22 bp, Homo sapiens
taagaatcgatgtttatttaga

SEQ ID NO: 8331900 - DNA, 22 bp, Homo sapiens
taagaatcggtcgcaacagagg

SEQ ID NO: 8331901 - DNA, 22 bp, Homo sapiens
taagaatctattaggaatatgt

SEQ ID NO: 8331902 - DNA, 22 bp, Homo sapiens
taagaatctgcattttaacaag

SEQ ID NO: 8331903 - DNA, 22 bp, Homo sapiens
tcctggatatcaaacaaacatt

SEQ ID NO: 8331904 - DNA, 22 bp, Homo sapiens
tctgaagattaccagctaaatg

SEQ ID NO: 8331905 - DNA, 22 bp, Homo sapiens
tctgaagaactgagtaaacatg

SEQ ID NO: 8331906 - DNA, 22 bp, Homo sapiens
tctcactttgttgcccagactt

SEQ ID NO: 8331907 - DNA, 22 bp, Homo sapiens
tgccattttgagatgttaatga

SEQ ID NO: 8331908 - DNA, 22 bp, Homo sapiens
tgcataatacgtttcctataac

SEQ ID NO: 8331909 - DNA, 22 bp, Homo sapiens
tgcagtctccacctcctgggtg

SEQ ID NO: 8331910 - DNA, 22 bp, Homo sapiens
tgcagggccctcattcctgtcc

SEQ ID NO: 8331911 - DNA, 22 bp, Homo sapiens
tgcaacttgtttggagagaaag

SEQ ID NO: 8331912 - DNA, 22 bp, Homo sapiens
tgcacaaacttgtgtcccaggg

SEQ ID NO: 8331913 - DNA, 22 bp, Homo sapiens
tgatctgaaggacatgggaccc

SEQ ID NO: 8331914 - DNA, 22 bp, Homo sapiens
tgatctgagagcagatcaccat

SEQ ID NO: 8331915 - DNA, 22 bp, Homo sapiens
tgaaactaggccaatcaaatta

SEQ ID NO: 8331916 - DNA, 21 bp, Homo sapiens
tgaaagaaggtgcagtctgaa

SEQ ID NO: 8331917 - DNA, 22 bp, Homo sapiens
tgaaaatggcctgaagaagcaa

SEQ ID NO: 8331918 - DNA, 22 bp, Homo sapiens
tgaaaagactgcaagagagcat

SEQ ID NO: 8331919 - DNA, 22 bp, Homo sapiens
tgaagaataagatagatggagc

SEQ ID NO: 8331920 - DNA, 22 bp, Homo sapiens
tgaagaataaatggttgagact

SEQ ID NO: 8331921 - DNA, 22 bp, Homo sapiens
tgaagaatcagattggcctgcg

SEQ ID NO: 8331922 - DNA, 22 bp, Homo sapiens
tgaagaatcccagggaatttgg

SEQ ID NO: 8331923 - DNA, 22 bp, Homo sapiens
tgaaatagtctaaaaaaccaga

SEQ ID NO: 8331924 - DNA, 22 bp, Homo sapiens
tgaaatagacacagtgctatac

SEQ ID NO: 8331925 - DNA, 22 bp, Homo sapiens
tgaaataggaaacagatgtttc

SEQ ID NO: 8331926 - DNA, 22 bp, Homo sapiens
tgaaataatatctggatcaatc

SEQ ID NO: 8331927 - DNA, 22 bp, Homo sapiens
tgaaatagaaaaacaggcttct

SEQ ID NO: 8331928 - DNA, 17 bp, Homo sapiens
tgaaatcagcacccagg

SEQ ID NO: 8331929 - DNA, 22 bp, Homo sapiens
tgaatagatttttaacatataa

SEQ ID NO: 8331930 - DNA, 22 bp, Homo sapiens
tgaataattcctttttgtcaag

SEQ ID NO: 8331931 - DNA, 22 bp, Homo sapiens
tgaataatcttgggtattaata

SEQ ID NO: 8331932 - DNA, 22 bp, Homo sapiens
tgaataattatgggagtcctaa

SEQ ID NO: 8331933 - DNA, 22 bp, Homo sapiens
tgaatgaatgaattaatagagt

SEQ ID NO: 8331934 - DNA, 22 bp, Homo sapiens
tgaatgaatcctaacaaagaca

SEQ ID NO: 8331935 - DNA, 22 bp, Homo sapiens
tgaatgaactaaatcatagttc

SEQ ID NO: 8331936 - DNA, 22 bp, Homo sapiens
tgaataatccacagtcattcat

SEQ ID NO: 8331937 - DNA, 22 bp, Homo sapiens
tgaataatcatgtccatagtgt

SEQ ID NO: 8331938 - DNA, 22 bp, Homo sapiens
tgacttcaaggttcagcacctt

SEQ ID NO: 8331939 - DNA, 22 bp, Homo sapiens
tgagatttgttttataaaatag

SEQ ID NO: 8331940 - DNA, 22 bp, Homo sapiens
tgagacaacctaattaaacacc

SEQ ID NO: 8331941 - DNA, 22 bp, Homo sapiens
tgagacaaaattgacagacaaa

SEQ ID NO: 8331942 - DNA, 22 bp, Homo sapiens
tggcaattttaggtggtttagt

SEQ ID NO: 8331943 - DNA, 22 bp, Homo sapiens
tggatttatggagaccgaaagt

SEQ ID NO: 8331944 - DNA, 22 bp, Homo sapiens
tggatttattaggttggtgaaa

SEQ ID NO: 8331945 - DNA, 19 bp, Homo sapiens
tggatttatattctttatc

SEQ ID NO: 8331946 - DNA, 22 bp, Homo sapiens
tggatttagttcttcacaggcc

SEQ ID NO: 8331947 - DNA, 22 bp, Homo sapiens
tggatttaccacagggccacag

SEQ ID NO: 8331948 - DNA, 22 bp, Homo sapiens
tggatttaatggatgaggggca

SEQ ID NO: 8331949 - DNA, 22 bp, Homo sapiens
tggattagttaagaaatgttag

SEQ ID NO: 8331950 - DNA, 22 bp, Homo sapiens
tggattaggtactatgaatata

SEQ ID NO: 8331951 - DNA, 22 bp, Homo sapiens
tggattagtgctgaaatgatgg

SEQ ID NO: 8331952 - DNA, 22 bp, Homo sapiens
tggcatttcagtattttcataa

SEQ ID NO: 8331953 - DNA, 22 bp, Homo sapiens
tggcatttagaaaacaacatgt

SEQ ID NO: 8331954 - DNA, 22 bp, Homo sapiens
tggcatttctggccatttgtgt

SEQ ID NO: 8331955 - DNA, 20 bp, Homo sapiens
tggcctttaaatagtattcc

SEQ ID NO: 8331956 - DNA, 22 bp, Homo sapiens
tggctattgagtgatctctaga

SEQ ID NO: 8331957 - DNA, 22 bp, Homo sapiens
tggctttataaatccactggtt

SEQ ID NO: 8331958 - DNA, 22 bp, Homo sapiens
tggcttaatatttcatatttaa

SEQ ID NO: 8331959 - DNA, 22 bp, Homo sapiens
tggcttaagcgcaactctgtct

SEQ ID NO: 8331960 - DNA, 22 bp, Homo sapiens
tggcttaagatttatgctttta

SEQ ID NO: 8331961 - DNA, 22 bp, Homo sapiens
tgctttaacataagatatcttt

SEQ ID NO: 8331962 - DNA, 22 bp, Homo sapiens
tgctttaaccatcttgtttgga

SEQ ID NO: 8331963 - DNA, 22 bp, Homo sapiens
tgctttaagacactaagtttga

SEQ ID NO: 8331964 - DNA, 22 bp, Homo sapiens
tgctttaagagattgttagtac

SEQ ID NO: 8331965 - DNA, 22 bp, Homo sapiens
tgctttaaaatggactgttttg

SEQ ID NO: 8331966 - DNA, 22 bp, Homo sapiens
tgctttaaatatgaattagcat

SEQ ID NO: 8331967 - DNA, 22 bp, Homo sapiens
tggaataaagtgctttgatcag

SEQ ID NO: 8331968 - DNA, 23 bp, Homo sapiens
tggaataataaggtacattaaca

SEQ ID NO: 8331969 - DNA, 22 bp, Homo sapiens
tgctatacggagcatcttcagg

SEQ ID NO: 8331970 - DNA, 22 bp, Homo sapiens
tgctatacatgtacatattagt

SEQ ID NO: 8331971 - DNA, 22 bp, Homo sapiens
tgctgagatctgccagtagatg

SEQ ID NO: 8331972 - DNA, 22 bp, Homo sapiens
tgctggaggattaaacaagtca

SEQ ID NO: 8331973 - DNA, 22 bp, Homo sapiens
tgcttattctttccacaattca

SEQ ID NO: 8331974 - DNA, 22 bp, Homo sapiens
tgcttattgctttcaagactgt

SEQ ID NO: 8331975 - DNA, 22 bp, Homo sapiens
tgcttatttatagtcaatagag

SEQ ID NO: 8331976 - DNA, 22 bp, Homo sapiens
tgcttaataggagttgaacatt

SEQ ID NO: 8331977 - DNA, 22 bp, Homo sapiens
tgcttaatacgtatttgctgga

SEQ ID NO: 8331978 - DNA, 22 bp, Homo sapiens
tgcttaatattgtgatgtaata

SEQ ID NO: 8331979 - DNA, 22 bp, Homo sapiens
tgcttaatagtgcactggtttc

SEQ ID NO: 8331980 - DNA, 19 bp, Homo sapiens
tgcttaattcctagtaggt

SEQ ID NO: 8331981 - DNA, 22 bp, Homo sapiens
tgcttaatgtacgtgagtgtac

SEQ ID NO: 8331982 - DNA, 17 bp, Homo sapiens
tgcttaattttgactgg

SEQ ID NO: 8331983 - DNA, 23 bp, Homo sapiens
tggttctaggcctataattatat

SEQ ID NO: 8331984 - DNA, 22 bp, Homo sapiens
tggtttaatttccatttccttg

SEQ ID NO: 8331985 - DNA, 22 bp, Homo sapiens
tggtttaacctgtctcttatta

SEQ ID NO: 8331986 - DNA, 22 bp, Homo sapiens
tgtaaataattcctaggctttt

SEQ ID NO: 8331987 - DNA, 22 bp, Homo sapiens
tgtaaatagttagcttgcctct

SEQ ID NO: 8331988 - DNA, 22 bp, Homo sapiens
tgtaaataatgcatgtaaatca

SEQ ID NO: 8331989 - DNA, 22 bp, Homo sapiens
tggttttagatgcctttactgc

SEQ ID NO: 8331990 - DNA, 22 bp, Homo sapiens
tggttttagggaatcaatctat

SEQ ID NO: 8331991 - DNA, 22 bp, Homo sapiens
tgtacaatcttggtccctttat

SEQ ID NO: 8331992 - DNA, 22 bp, Homo sapiens
tgtacaatctgatgatgtatgg

SEQ ID NO: 8331993 - DNA, 22 bp, Homo sapiens
tgtacaatagctattatctcca

SEQ ID NO: 8331994 - DNA, 22 bp, Homo sapiens
tgtacaatgccagggaacacca

SEQ ID NO: 8331995 - DNA, 22 bp, Homo sapiens
tgtacaatgccgagactaactc

SEQ ID NO: 8331996 - DNA, 22 bp, Homo sapiens
tgtacaatgctgaggtttgggg

SEQ ID NO: 8331997 - DNA, 22 bp, Homo sapiens
tgtacaatggctataataccct

SEQ ID NO: 8331998 - DNA, 22 bp, Homo sapiens
tgtacaatgtggccagtgttaa

SEQ ID NO: 8331999 - DNA, 22 bp, Homo sapiens
tgtacaatgtgtttgttggctt

SEQ ID NO: 8332000 - DNA, 22 bp, Homo sapiens
tgtaagaatcagtctttaatgt

SEQ ID NO: 8332001 - DNA, 20 bp, Homo sapiens
tgtaacaatctggatgttgc

SEQ ID NO: 8332002 - DNA, 22 bp, Homo sapiens
tgtaacaaaataccttggattg

SEQ ID NO: 8332003 - DNA, 22 bp, Homo sapiens
tgtaacaatttcttactattgt

SEQ ID NO: 8332004 - DNA, 23 bp, Homo sapiens
tgtaacaatttcatatacatgca

SEQ ID NO: 8332005 - DNA, 23 bp, Homo sapiens
tgtaacaattcccagcctttgcc

SEQ ID NO: 8332006 - DNA, 22 bp, Homo sapiens
tgtcataatcagttttgcatgt

SEQ ID NO: 8332007 - DNA, 22 bp, Homo sapiens
tgtcataacttagtgacaaatc

SEQ ID NO: 8332008 - DNA, 22 bp, Homo sapiens
tgtccttatctccaaacaatca

SEQ ID NO: 8332009 - DNA, 22 bp, Homo sapiens
tgtccttatattgtggaagggg

SEQ ID NO: 8332010 - DNA, 22 bp, Homo sapiens
tgtccttataagaaaaggaaat

SEQ ID NO: 8332011 - DNA, 22 bp, Homo sapiens
tgtccttacaaggtccctttcg

SEQ ID NO: 8332012 - DNA, 22 bp, Homo sapiens
tgtccttagggatataaaatat

SEQ ID NO: 8332013 - DNA, 22 bp, Homo sapiens
tgtccttagaagaagtgaaaga

SEQ ID NO: 8332014 - DNA, 22 bp, Homo sapiens
tgtccttaaggagcttaatgtc

SEQ ID NO: 8332015 - DNA, 21 bp, Homo sapiens
tgtccttaatgcaatgtcctt

SEQ ID NO: 8332016 - DNA, 22 bp, Homo sapiens
tgtcaccatgcgaggctaattt

SEQ ID NO: 8332017 - DNA, 22 bp, Homo sapiens
tgtcaccagttccaggaaataa

SEQ ID NO: 8332018 - DNA, 22 bp, Homo sapiens
tgtcaccagctgctcctcagga

SEQ ID NO: 8332019 - DNA, 22 bp, Homo sapiens
tgtcaccatgccagcttctgcc

SEQ ID NO: 8332020 - DNA, 22 bp, Homo sapiens
tgtcaccactggctgaaacacc

SEQ ID NO: 8332021 - DNA, 22 bp, Homo sapiens
tgtcaccaagttgatgaatgca

SEQ ID NO: 8332022 - DNA, 22 bp, Homo sapiens
tgtcaccaccggaagaaactgc

SEQ ID NO: 8332023 - DNA, 22 bp, Homo sapiens
tgtcaccacatttgtcaatatc

SEQ ID NO: 8332024 - DNA, 22 bp, Homo sapiens
tgtatacaattcacacttccca

SEQ ID NO: 8332025 - DNA, 22 bp, Homo sapiens
tgtatacaggcataagagatac

SEQ ID NO: 8332026 - DNA, 22 bp, Homo sapiens
tgtatacatttaactagataga

SEQ ID NO: 8332027 - DNA, 22 bp, Homo sapiens
tgggtttaaactcaactctaaa

SEQ ID NO: 8332028 - DNA, 22 bp, Homo sapiens
ttagaaatgatttcacctcttt

SEQ ID NO: 8332029 - DNA, 22 bp, Homo sapiens
ttagaaatgcacccaagaccta

SEQ ID NO: 8332030 - DNA, 22 bp, Homo sapiens
ttagaaatgtcacagatctgat

SEQ ID NO: 8332031 - DNA, 22 bp, Homo sapiens
ttagaaatacaagtgaggttga

SEQ ID NO: 8332032 - DNA, 22 bp, Homo sapiens
ttagaaatatggtgctgccgcc

SEQ ID NO: 8332033 - DNA, 22 bp, Homo sapiens
ttagaaatcacctctgaagatc

SEQ ID NO: 8332034 - DNA, 22 bp, Homo sapiens
ttagaaatctgctgccatgcaa

SEQ ID NO: 8332035 - DNA, 22 bp, Homo sapiens
ttagtactgatagggtcaatca

SEQ ID NO: 8332036 - DNA, 22 bp, Homo sapiens
ttatttatggccctcacctgat

SEQ ID NO: 8332037 - DNA, 22 bp, Homo sapiens
ttattccattcagttcaacaag

SEQ ID NO: 8332038 - DNA, 22 bp, Homo sapiens
ttattattccccaagtcattat

SEQ ID NO: 8332039 - DNA, 22 bp, Homo sapiens
ttacagaatgttcttccaacag

SEQ ID NO: 8332040 - DNA, 22 bp, Homo sapiens
ttacagaatctactcgtggtga

SEQ ID NO: 8332041 - DNA, 22 bp, Homo sapiens
ttacagaatgtgccatttggtc

SEQ ID NO: 8332042 - DNA, 22 bp, Homo sapiens
ttacagaaaagggctttaagag

SEQ ID NO: 8332043 - DNA, 22 bp, Homo sapiens
ttacagaaaaggggttgtcctt

SEQ ID NO: 8332044 - DNA, 22 bp, Homo sapiens
ttacagatggatctagcaaaat

SEQ ID NO: 8332045 - DNA, 22 bp, Homo sapiens
ttacaaagtgttatgataaaca

SEQ ID NO: 8332046 - DNA, 22 bp, Homo sapiens
ttaaagaatagtgcccctattg

SEQ ID NO: 8332047 - DNA, 23 bp, Homo sapiens
ttaaacttcagtgcagaacactc

SEQ ID NO: 8332048 - DNA, 22 bp, Homo sapiens
ttaaagattctgaggctgatta

SEQ ID NO: 8332049 - DNA, 22 bp, Homo sapiens
ttaataaagtatgaattggaaa

SEQ ID NO: 8332050 - DNA, 22 bp, Homo sapiens
ttcattaattcattcagtgact

SEQ ID NO: 8332051 - DNA, 22 bp, Homo sapiens
ttcaccgtgaaccgattcctca

SEQ ID NO: 8332052 - DNA, 22 bp, Homo sapiens
ttcaccacagtctcatctacgc

SEQ ID NO: 8332053 - DNA, 22 bp, Homo sapiens
tgtgaatagtgccgcaataaac

SEQ ID NO: 8332054 - DNA, 22 bp, Homo sapiens
tgtgaataccttgaattcatca

SEQ ID NO: 8332055 - DNA, 22 bp, Homo sapiens
tgtgaatacagcatgtgcttct

SEQ ID NO: 8332056 - DNA, 22 bp, Homo sapiens
tgtgaataatgccgcaataaac

SEQ ID NO: 8332057 - DNA, 22 bp, Homo sapiens
tgtgtacacagatagtaatggc

SEQ ID NO: 8332058 - DNA, 22 bp, Homo sapiens
ttaaaattatggcccatttgga

SEQ ID NO: 8332059 - DNA, 22 bp, Homo sapiens
aagtaaatatctgtttatagca

SEQ ID NO: 8332060 - DNA, 22 bp, Homo sapiens
aatattatcaaaagctttttca

SEQ ID NO: 8332061 - DNA, 22 bp, Homo sapiens
aatactgtctttcacagatatt

SEQ ID NO: 8332062 - DNA, 22 bp, Homo sapiens
aataactggcacatatcacata

SEQ ID NO: 8332063 - DNA, 22 bp, Homo sapiens
acttattagctgtgtgaccttg

SEQ ID NO: 8332064 - DNA, 22 bp, Homo sapiens
aatagaaaggaggggctcttgt

SEQ ID NO: 8332065 - DNA, 22 bp, Homo sapiens
acagatttttggtaaataattt

SEQ ID NO: 8332066 - DNA, 22 bp, Homo sapiens
aaggttctaagggaagccatgc

SEQ ID NO: 8332067 - DNA, 22 bp, Homo sapiens
accagctgctgattgctaaatg

SEQ ID NO: 8332068 - DNA, 22 bp, Homo sapiens
acataataaaaataacagctca

SEQ ID NO: 8332069 - DNA, 22 bp, Homo sapiens
acataagttatggataaaatgt

SEQ ID NO: 8332070 - DNA, 22 bp, Homo sapiens
acataatacctaggacagtttg

SEQ ID NO: 8332071 - DNA, 22 bp, Homo sapiens
acataatagcatttctaatttg

SEQ ID NO: 8332072 - DNA, 22 bp, Homo sapiens
acataataggtacctgaataat

SEQ ID NO: 8332073 - DNA, 22 bp, Homo sapiens
acataataggtgcctgaatatt

SEQ ID NO: 8332074 - DNA, 22 bp, Homo sapiens
acagaactgggggcacagatag

SEQ ID NO: 8332075 - DNA, 22 bp, Homo sapiens
agcatctggcagaaagtcagaa

SEQ ID NO: 8332076 - DNA, 22 bp, Homo sapiens
acacactcaattgcataagcac

SEQ ID NO: 8332077 - DNA, 22 bp, Homo sapiens
agatttcctatggtaattatag

SEQ ID NO: 8332078 - DNA, 22 bp, Homo sapiens
aatttcaatgcactcatggttg

SEQ ID NO: 8332079 - DNA, 22 bp, Homo sapiens
aatttcaagtggcatctttgat

SEQ ID NO: 8332080 - DNA, 22 bp, Homo sapiens
aatttcaaactaataggaacca

SEQ ID NO: 8332081 - DNA, 22 bp, Homo sapiens
aatttcaaactcttgccctcag

SEQ ID NO: 8332082 - DNA, 22 bp, Homo sapiens
aatttcaagtcttgaagaagta

SEQ ID NO: 8332083 - DNA, 22 bp, Homo sapiens
aatttcaaagctcactggcata

SEQ ID NO: 8332084 - DNA, 22 bp, Homo sapiens
agatataataatttacaagtgt

SEQ ID NO: 8332085 - DNA, 23 bp, Homo sapiens
agatctgatgttaccaagaattg

SEQ ID NO: 8332086 - DNA, 22 bp, Homo sapiens
agatctattagcaaactgccat

SEQ ID NO: 8332087 - DNA, 22 bp, Homo sapiens
agatctgaatctcatccgagga

SEQ ID NO: 8332088 - DNA, 22 bp, Homo sapiens
agatctgacctaaccccaccac

SEQ ID NO: 8332089 - DNA, 22 bp, Homo sapiens
agatctgagggtccaagggagg

SEQ ID NO: 8332090 - DNA, 22 bp, Homo sapiens
agatatcaccagttttacatac

SEQ ID NO: 8332091 - DNA, 22 bp, Homo sapiens
agactgaataacaagcaaataa

SEQ ID NO: 8332092 - DNA, 22 bp, Homo sapiens
agaataatcactgaagttcaaa

SEQ ID NO: 8332093 - DNA, 22 bp, Homo sapiens
agaataatactgaaatgctgaa

SEQ ID NO: 8332094 - DNA, 22 bp, Homo sapiens
aatgaaaattggaccctagaac

SEQ ID NO: 8332095 - DNA, 22 bp, Homo sapiens
agaatttctggaagattgcaag

SEQ ID NO: 8332096 - DNA, 22 bp, Homo sapiens
agaatttcctatgagagattcc

SEQ ID NO: 8332097 - DNA, 20 bp, Homo sapiens
agaatctgacccagagagac

SEQ ID NO: 8332098 - DNA, 22 bp, Homo sapiens
agaatctggtagaaccaaggat

SEQ ID NO: 8332099 - DNA, 22 bp, Homo sapiens
agaatttcaaatggaagtttta

SEQ ID NO: 8332100 - DNA, 22 bp, Homo sapiens
aagaatgagctcaaagatctta

SEQ ID NO: 8332101 - DNA, 22 bp, Homo sapiens
aagaatgattacaaagcaacga

SEQ ID NO: 8332102 - DNA, 22 bp, Homo sapiens
aactttgtgtgtttaatatggc

SEQ ID NO: 8332103 - DNA, 22 bp, Homo sapiens
aactttgaggtcactgaattcc

SEQ ID NO: 8332104 - DNA, 22 bp, Homo sapiens
aagccaatgagagaggcctcag

SEQ ID NO: 8332105 - DNA, 22 bp, Homo sapiens
aaatatcatttataacttttaa

SEQ ID NO: 8332106 - DNA, 22 bp, Homo sapiens
aaacatgaatagatattaaaca

SEQ ID NO: 8332107 - DNA, 22 bp, Homo sapiens
aaagaaggatgggagaaatcct

SEQ ID NO: 8332108 - DNA, 22 bp, Homo sapiens
aaacaaacataggtttgaaagt

SEQ ID NO: 8332109 - DNA, 22 bp, Homo sapiens
aaatcatgttggcacaataaaa

SEQ ID NO: 8332110 - DNA, 22 bp, Homo sapiens
aaatcagttggaacacaagcag

SEQ ID NO: 8332111 - DNA, 22 bp, Homo sapiens
aaatcagttctccctttcttca

SEQ ID NO: 8332112 - DNA, 22 bp, Homo sapiens
aaatcagttgttatattaaaga

SEQ ID NO: 8332113 - DNA, 22 bp, Homo sapiens
aaatcagttaagatgaggccat

SEQ ID NO: 8332114 - DNA, 22 bp, Homo sapiens
aaatcagtccctcttggaattt

SEQ ID NO: 8332115 - DNA, 22 bp, Homo sapiens
aaatcagtgctcatttgaaagg

SEQ ID NO: 8332116 - DNA, 22 bp, Homo sapiens
aaatcagttagtggtaggattg

SEQ ID NO: 8332117 - DNA, 22 bp, Homo sapiens
aaatcagttcacgttctgaggt

SEQ ID NO: 8332118 - DNA, 22 bp, Homo sapiens
aaatcagtaaatgttcattaac

SEQ ID NO: 8332119 - DNA, 22 bp, Homo sapiens
aaacggatataacagcaaacgc

SEQ ID NO: 8332120 - DNA, 22 bp, Homo sapiens
aaatactgtagataatagagtt

SEQ ID NO: 8332121 - DNA, 22 bp, Homo sapiens
aaatactgtctctgagagagcc

SEQ ID NO: 8332122 - DNA, 22 bp, Homo sapiens
aacatgttgctttaataatatt

SEQ ID NO: 8332123 - DNA, 22 bp, Homo sapiens
aacattggatatttattaaaag

SEQ ID NO: 8332124 - DNA, 22 bp, Homo sapiens
aatcagaaaattcagtggaatt

SEQ ID NO: 8332125 - DNA, 20 bp, Homo sapiens
aagttacattgtattgtacc

SEQ ID NO: 8332126 - DNA, 22 bp, Homo sapiens
aataaaatggtcagttttctca

SEQ ID NO: 8332127 - DNA, 20 bp, Homo sapiens
aataaactactgagagatgt

SEQ ID NO: 8332128 - DNA, 22 bp, Homo sapiens
aagccagatttcactcttaatt

SEQ ID NO: 8332129 - DNA, 22 bp, Homo sapiens
aaattataggtgccaccttgga

SEQ ID NO: 8332130 - DNA, 22 bp, Homo sapiens
aaggacagggatggttgattgt

SEQ ID NO: 8332131 - DNA, 22 bp, Homo sapiens
aaatttcaagcaaagtagctat

SEQ ID NO: 8332132 - DNA, 22 bp, Homo sapiens
aaatttcagttacctttacgtt

SEQ ID NO: 8332133 - DNA, 22 bp, Homo sapiens
aaatttcagttggaatgagctc

SEQ ID NO: 8332134 - DNA, 22 bp, Homo sapiens
aagatatactattaagtaccat

SEQ ID NO: 8332135 - DNA, 22 bp, Homo sapiens
acaacttttctatcatgtggaa

SEQ ID NO: 8332136 - DNA, 22 bp, Homo sapiens
acaactttgtagcaattccacg

SEQ ID NO: 8332137 - DNA, 22 bp, Homo sapiens
acaactttgacccttgttctta

SEQ ID NO: 8332138 - DNA, 22 bp, Homo sapiens
acaactttaatgggtttcagct

SEQ ID NO: 8332139 - DNA, 22 bp, Homo sapiens
acaactttagtctggagggaaa

SEQ ID NO: 8332140 - DNA, 23 bp, Homo sapiens
acaactttacagatacattttgt

SEQ ID NO: 8332141 - DNA, 22 bp, Homo sapiens
acaactttctgggttatctgat

SEQ ID NO: 8332142 - DNA, 22 bp, Homo sapiens
aattcacaaaagttagatccat

SEQ ID NO: 8332143 - DNA, 22 bp, Homo sapiens
aagaattcactggtagagtcaa

SEQ ID NO: 8332144 - DNA, 22 bp, Homo sapiens
aatgttaatgtgtttgcttatg

SEQ ID NO: 8332145 - DNA, 22 bp, Homo sapiens
aatgttaatttactgtcttcat

SEQ ID NO: 8332146 - DNA, 22 bp, Homo sapiens
cagagacattcagtaaattatc

SEQ ID NO: 8332147 - DNA, 22 bp, Homo sapiens
caccagacaggtgtatgcatat

SEQ ID NO: 8332148 - DNA, 22 bp, Homo sapiens
agatcatatgaaaaatttcaag

SEQ ID NO: 8332149 - DNA, 22 bp, Homo sapiens
agatcagttagatagcttgatg

SEQ ID NO: 8332150 - DNA, 22 bp, Homo sapiens
caaagattttagaatttgcaat

SEQ ID NO: 8332151 - DNA, 22 bp, Homo sapiens
caaagcaccacaaaccaggtga

SEQ ID NO: 8332152 - DNA, 22 bp, Homo sapiens
caaaggcaggccccctgtgcag

SEQ ID NO: 8332153 - DNA, 22 bp, Homo sapiens
attacacttgttcatcatcacc

SEQ ID NO: 8332154 - DNA, 22 bp, Homo sapiens
attacagaatgcagttccttat

SEQ ID NO: 8332155 - DNA, 22 bp, Homo sapiens
agagacaatgccaatgcacacg

SEQ ID NO: 8332156 - DNA, 22 bp, Homo sapiens
agaatatcgtagcatattatct

SEQ ID NO: 8332157 - DNA, 22 bp, Homo sapiens
agacaacatcactaaagctgag

SEQ ID NO: 8332158 - DNA, 22 bp, Homo sapiens
atgccaaagcccaagttcatca

SEQ ID NO: 8332159 - DNA, 22 bp, Homo sapiens
acattcacgctctcaaagctga

SEQ ID NO: 8332160 - DNA, 22 bp, Homo sapiens
acattcactatgtccaaactct

SEQ ID NO: 8332161 - DNA, 22 bp, Homo sapiens
acattccaaaaactagcagata

SEQ ID NO: 8332162 - DNA, 22 bp, Homo sapiens
acatgaaactgttgcattagaa

SEQ ID NO: 8332163 - DNA, 22 bp, Homo sapiens
acatgaaaaatgtttgcagttt

SEQ ID NO: 8332164 - DNA, 22 bp, Homo sapiens
actagaaactaatggattatta

SEQ ID NO: 8332165 - DNA, 22 bp, Homo sapiens
agtataattagatatcaaaagt

SEQ ID NO: 8332166 - DNA, 22 bp, Homo sapiens
agtcaccagggtttgctgggtt

SEQ ID NO: 8332167 - DNA, 22 bp, Homo sapiens
agtcaccaggttttagagacct

SEQ ID NO: 8332168 - DNA, 22 bp, Homo sapiens
agtcaccatctgtggcagcctg

SEQ ID NO: 8332169 - DNA, 22 bp, Homo sapiens
agtcaccattttcacctgcctc

SEQ ID NO: 8332170 - DNA, 21 bp, Homo sapiens
actttaatatacatgaggagg

SEQ ID NO: 8332171 - DNA, 22 bp, Homo sapiens
actttaattaatgaactgtggc

SEQ ID NO: 8332172 - DNA, 22 bp, Homo sapiens
ataaagtctaccgtattaaaga

SEQ ID NO: 8332173 - DNA, 22 bp, Homo sapiens
ataaagtcattatgaagatcta

SEQ ID NO: 8332174 - DNA, 22 bp, Homo sapiens
agaaagcatctccattgtaggt

SEQ ID NO: 8332175 - DNA, 22 bp, Homo sapiens
atcagttagttactgctaagat

SEQ ID NO: 8332176 - DNA, 22 bp, Homo sapiens
agaaatcatgtcttatttctat

SEQ ID NO: 8332177 - DNA, 22 bp, Homo sapiens
agaaatcattgaattatttgct

SEQ ID NO: 8332178 - DNA, 22 bp, Homo sapiens
aggtacaaaagagtatatgaga

SEQ ID NO: 8332179 - DNA, 22 bp, Homo sapiens
agtagaatagatggatactatt

SEQ ID NO: 8332180 - DNA, 22 bp, Homo sapiens
agtaaacagtatctttagtgtc

SEQ ID NO: 8332181 - DNA, 22 bp, Homo sapiens
agtaaacattttcatattttct

SEQ ID NO: 8332182 - DNA, 22 bp, Homo sapiens
agtaaacatttcagatttattt

SEQ ID NO: 8332183 - DNA, 22 bp, Homo sapiens
agtaaacatagaatgttcttcc

SEQ ID NO: 8332184 - DNA, 22 bp, Homo sapiens
ctatgacacaggccattatata

SEQ ID NO: 8332185 - DNA, 22 bp, Homo sapiens
atacatgtgggtctaaacatat

SEQ ID NO: 8332186 - DNA, 22 bp, Homo sapiens
atatacaggtggtatgtgtaaa

SEQ ID NO: 8332187 - DNA, 22 bp, Homo sapiens
atataatacaacctgctaagtg

SEQ ID NO: 8332188 - DNA, 22 bp, Homo sapiens
atatactgaggagactttatat

SEQ ID NO: 8332189 - DNA, 22 bp, Homo sapiens
atatactgatagctgcacttct

SEQ ID NO: 8332190 - DNA, 22 bp, Homo sapiens
atatacagttttacagggtttc

SEQ ID NO: 8332191 - DNA, 22 bp, Homo sapiens
ataaaacttgggtatgatccct

SEQ ID NO: 8332192 - DNA, 22 bp, Homo sapiens
ataaagatttttaggcatttct

SEQ ID NO: 8332193 - DNA, 22 bp, Homo sapiens
ataaactcatgccaagaaatga

SEQ ID NO: 8332194 - DNA, 22 bp, Homo sapiens
atcacaaagggttttctctgag

SEQ ID NO: 8332195 - DNA, 22 bp, Homo sapiens
atcacaaaggtctcagagcaca

SEQ ID NO: 8332196 - DNA, 22 bp, Homo sapiens
atcagcatctttaacaattacc

SEQ ID NO: 8332197 - DNA, 22 bp, Homo sapiens
atcataaagtgctatctgattg

SEQ ID NO: 8332198 - DNA, 22 bp, Homo sapiens
atcagcttttctcatcagaaat

SEQ ID NO: 8332199 - DNA, 22 bp, Homo sapiens
atattattctagtaacagtgat

SEQ ID NO: 8332200 - DNA, 22 bp, Homo sapiens
atccatttgaaagaacagtcca

SEQ ID NO: 8332201 - DNA, 22 bp, Homo sapiens
ccaaagcaagtcacatgatcaa

SEQ ID NO: 8332202 - DNA, 22 bp, Homo sapiens
ccaaaattattacatttgtagg

SEQ ID NO: 8332203 - DNA, 22 bp, Homo sapiens
ccaaacaaatccccattcttag

SEQ ID NO: 8332204 - DNA, 22 bp, Homo sapiens
ccaaaattaagcctcttatgtt

SEQ ID NO: 8332205 - DNA, 22 bp, Homo sapiens
aggatctgtgagtgctgcagac

SEQ ID NO: 8332206 - DNA, 22 bp, Homo sapiens
catcagaatgttagagaaggga

SEQ ID NO: 8332207 - DNA, 22 bp, Homo sapiens
catcagaatgttatggggggct

SEQ ID NO: 8332208 - DNA, 22 bp, Homo sapiens
catcagaattacttggggagct

SEQ ID NO: 8332209 - DNA, 22 bp, Homo sapiens
catcagaaccagctgggtgagg

SEQ ID NO: 8332210 - DNA, 22 bp, Homo sapiens
catcagaacaaatcggttaaga

SEQ ID NO: 8332211 - DNA, 22 bp, Homo sapiens
catcagaaaccttgaggaaact

SEQ ID NO: 8332212 - DNA, 22 bp, Homo sapiens
catcagaaagagtcctggactt

SEQ ID NO: 8332213 - DNA, 20 bp, Homo sapiens
catcagaaatcctgacccac

SEQ ID NO: 8332214 - DNA, 22 bp, Homo sapiens
catcagaagaaagacaaatgat

SEQ ID NO: 8332215 - DNA, 22 bp, Homo sapiens
catcagaaccagtggggacatt

SEQ ID NO: 8332216 - DNA, 22 bp, Homo sapiens
catcagaacgtgagctccttgt

SEQ ID NO: 8332217 - DNA, 22 bp, Homo sapiens
catcagaaggccagagggtagc

SEQ ID NO: 8332218 - DNA, 22 bp, Homo sapiens
catcagaatagctctgtggata

SEQ ID NO: 8332219 - DNA, 22 bp, Homo sapiens
catcagaatctgagtctctgcc

SEQ ID NO: 8332220 - DNA, 22 bp, Homo sapiens
catcagaatgaatgttctggag

SEQ ID NO: 8332221 - DNA, 22 bp, Homo sapiens
catcagaagatggctctggaaa

SEQ ID NO: 8332222 - DNA, 22 bp, Homo sapiens
catcagaaggaaggacgattat

SEQ ID NO: 8332223 - DNA, 22 bp, Homo sapiens
cagttcacactgtgctatctgc

SEQ ID NO: 8332224 - DNA, 22 bp, Homo sapiens
ccatttcactcttcctgaagga

SEQ ID NO: 8332225 - DNA, 22 bp, Homo sapiens
caaattcaaatttcatcagtgt

SEQ ID NO: 8332226 - DNA, 22 bp, Homo sapiens
caaattcaatgaacatgtttaa

SEQ ID NO: 8332227 - DNA, 22 bp, Homo sapiens
gctctaattgaaaaatactgca

SEQ ID NO: 8332228 - DNA, 22 bp, Homo sapiens
gcgttaataacattaataatgc

SEQ ID NO: 8332229 - DNA, 22 bp, Homo sapiens
gcaaaatttacactccttcttc

SEQ ID NO: 8332230 - DNA, 22 bp, Homo sapiens
gcaaaattaaacttagcatcat

SEQ ID NO: 8332231 - DNA, 22 bp, Homo sapiens
gcaaaaagtagtgctggttagg

SEQ ID NO: 8332232 - DNA, 22 bp, Homo sapiens
gcaaacaaggacatacatcctg

SEQ ID NO: 8332233 - DNA, 22 bp, Homo sapiens
gcaaacaagctgcctgaagatt

SEQ ID NO: 8332234 - DNA, 22 bp, Homo sapiens
gcagaattctacagatgataaa

SEQ ID NO: 8332235 - DNA, 22 bp, Homo sapiens
gcagaattgatggagaacttaa

SEQ ID NO: 8332236 - DNA, 22 bp, Homo sapiens
gcagaattggatagttgtgata

SEQ ID NO: 8332237 - DNA, 22 bp, Homo sapiens
gatctgaatcaatagaataact

SEQ ID NO: 8332238 - DNA, 22 bp, Homo sapiens
gatctgaagagcaatgaaatat

SEQ ID NO: 8332239 - DNA, 22 bp, Homo sapiens
atggtttaaagagtatgacttt

SEQ ID NO: 8332240 - DNA, 22 bp, Homo sapiens
atgtacaaaatgttttgaaatg

SEQ ID NO: 8332241 - DNA, 22 bp, Homo sapiens
atgtaaatcaagcagtgctggt

SEQ ID NO: 8332242 - DNA, 22 bp, Homo sapiens
atggtttaagggagaatattga

SEQ ID NO: 8332243 - DNA, 22 bp, Homo sapiens
atggtttacaatgttttcagtt

SEQ ID NO: 8332244 - DNA, 22 bp, Homo sapiens
atgaataaaacattttaatcag

SEQ ID NO: 8332245 - DNA, 22 bp, Homo sapiens
atgaataaacaggtgcctcttc

SEQ ID NO: 8332246 - DNA, 22 bp, Homo sapiens
atgaataagtaaactcctttgg

SEQ ID NO: 8332247 - DNA, 23 bp, Homo sapiens
atgaatgaataaggcaggaaagc

SEQ ID NO: 8332248 - DNA, 22 bp, Homo sapiens
gaaaatagcagatagaccaatg

SEQ ID NO: 8332249 - DNA, 22 bp, Homo sapiens
gaaatatacatgaagtcggctg

SEQ ID NO: 8332250 - DNA, 19 bp, Homo sapiens
atgctttatgttatttctt

SEQ ID NO: 8332251 - DNA, 22 bp, Homo sapiens
atgcttaatacactgttaaagg

SEQ ID NO: 8332252 - DNA, 22 bp, Homo sapiens
atgcttaagctcagttatatat

SEQ ID NO: 8332253 - DNA, 22 bp, Homo sapiens
atgctttagtgtcaagtttggg

SEQ ID NO: 8332254 - DNA, 22 bp, Homo sapiens
atgctttaaatgtcttttgctt

SEQ ID NO: 8332255 - DNA, 22 bp, Homo sapiens
atgctttaaactataaatccac

SEQ ID NO: 8332256 - DNA, 22 bp, Homo sapiens
atgcacaagcaagagataatgg

SEQ ID NO: 8332257 - DNA, 23 bp, Homo sapiens
gaatcagtggctaacaaggaaac

SEQ ID NO: 8332258 - DNA, 22 bp, Homo sapiens
ggcgcacaatgtgcaggtttgt

SEQ ID NO: 8332259 - DNA, 22 bp, Homo sapiens
caaattcctcagaatcagaaaa

SEQ ID NO: 8332260 - DNA, 22 bp, Homo sapiens
cagatactgtaaaatttcagta

SEQ ID NO: 8332261 - DNA, 22 bp, Homo sapiens
cagataaaggcttactagtagt

SEQ ID NO: 8332262 - DNA, 22 bp, Homo sapiens
gtaaacatcagccactctattt

SEQ ID NO: 8332263 - DNA, 22 bp, Homo sapiens
gtgaataacctactccaggcct

SEQ ID NO: 8332264 - DNA, 22 bp, Homo sapiens
gtgaataaagggagttttcaaa

SEQ ID NO: 8332265 - DNA, 22 bp, Homo sapiens
gtgaataaaacacctgccaaga

SEQ ID NO: 8332266 - DNA, 22 bp, Homo sapiens
gtgaataatattgtttataaaa

SEQ ID NO: 8332267 - DNA, 22 bp, Homo sapiens
gtgaataagacctaaggatgaa

SEQ ID NO: 8332268 - DNA, 22 bp, Homo sapiens
gtgaataactttctatgttaat

SEQ ID NO: 8332269 - DNA, 22 bp, Homo sapiens
gtgaataatcacccttctggat

SEQ ID NO: 8332270 - DNA, 22 bp, Homo sapiens
gtgaataattttttagtataag

SEQ ID NO: 8332271 - DNA, 22 bp, Homo sapiens
tatatactttcttcctgggtag

SEQ ID NO: 8332272 - DNA, 20 bp, Homo sapiens
tattccaagggtagagaaaa

SEQ ID NO: 8332273 - DNA, 22 bp, Homo sapiens
tattccaactgtcatagtcata

SEQ ID NO: 8332274 - DNA, 22 bp, Homo sapiens
tcacacattctaggtatgttga

SEQ ID NO: 8332275 - DNA, 22 bp, Homo sapiens
tagcatctgttctttcattaaa

SEQ ID NO: 8332276 - DNA, 22 bp, Homo sapiens
tagcatctggagaaacaagtcc

SEQ ID NO: 8332277 - DNA, 22 bp, Homo sapiens
catcagtctagattctagtacc

SEQ ID NO: 8332278 - DNA, 22 bp, Homo sapiens
catcataaaattgagataactg

SEQ ID NO: 8332279 - DNA, 22 bp, Homo sapiens
tcataatacaaagagttctgca

SEQ ID NO: 8332280 - DNA, 22 bp, Homo sapiens
tcatacacaagagcatgtaaca

SEQ ID NO: 8332281 - DNA, 22 bp, Homo sapiens
cattaatattgttcttctttag

SEQ ID NO: 8332282 - DNA, 22 bp, Homo sapiens
catgcttatgatttgctaagcc

SEQ ID NO: 8332283 - DNA, 22 bp, Homo sapiens
catgcttattcattctgctaac

SEQ ID NO: 8332284 - DNA, 22 bp, Homo sapiens
catgcttttcaatctatcttaa

SEQ ID NO: 8332285 - DNA, 22 bp, Homo sapiens
catgcttttttctagtataaat

SEQ ID NO: 8332286 - DNA, 22 bp, Homo sapiens
catggttttgagcctattatgc

SEQ ID NO: 8332287 - DNA, 22 bp, Homo sapiens
catggtttattagagcttattt

SEQ ID NO: 8332288 - DNA, 21 bp, Homo sapiens
ccaagactcccatctagtggt

SEQ ID NO: 8332289 - DNA, 22 bp, Homo sapiens
tccatacattgaaataccattc

SEQ ID NO: 8332290 - DNA, 17 bp, Homo sapiens
tccatacaattctctct

SEQ ID NO: 8332291 - DNA, 19 bp, Homo sapiens
tccataatgaagatagagg

SEQ ID NO: 8332292 - DNA, 22 bp, Homo sapiens
ccagatttgagcgtcttaaacc

SEQ ID NO: 8332293 - DNA, 22 bp, Homo sapiens
tctatacaagtttcactttgac

SEQ ID NO: 8332294 - DNA, 23 bp, Homo sapiens
tctatacatactgcagcctctgg

SEQ ID NO: 8332295 - DNA, 22 bp, Homo sapiens
tctatacacacaaagaatgctt

SEQ ID NO: 8332296 - DNA, 22 bp, Homo sapiens
tctatacatgtgcacacacatc

SEQ ID NO: 8332297 - DNA, 22 bp, Homo sapiens
tctatactgatgggatactatt

SEQ ID NO: 8332298 - DNA, 22 bp, Homo sapiens
tgaagtaactgtccaggatcca

SEQ ID NO: 8332299 - DNA, 22 bp, Homo sapiens
tgaaacaatgtgaagttgctga

SEQ ID NO: 8332300 - DNA, 18 bp, Homo sapiens
tgaaacaagaatggtgca

SEQ ID NO: 8332301 - DNA, 22 bp, Homo sapiens
tgaaacaaatttggaaaatcta

SEQ ID NO: 8332302 - DNA, 22 bp, Homo sapiens
tgaaacaagatccacagacttg

SEQ ID NO: 8332303 - DNA, 21 bp, Homo sapiens
tgaaacaatcagacagagtct

SEQ ID NO: 8332304 - DNA, 22 bp, Homo sapiens
tgataatattttgaatcataag

SEQ ID NO: 8332305 - DNA, 22 bp, Homo sapiens
tggctttaaatctgtattcata

SEQ ID NO: 8332306 - DNA, 22 bp, Homo sapiens
tggctttaggagctatatacct

SEQ ID NO: 8332307 - DNA, 22 bp, Homo sapiens
tggctttaggttgcatgtttct

SEQ ID NO: 8332308 - DNA, 22 bp, Homo sapiens
tggctttactgtcattcttatg

SEQ ID NO: 8332309 - DNA, 22 bp, Homo sapiens
tggctttacacatccactgcct

SEQ ID NO: 8332310 - DNA, 22 bp, Homo sapiens
tggctttacatcaaattgagta

SEQ ID NO: 8332311 - DNA, 22 bp, Homo sapiens
tggcattttgttcagtatatgg

SEQ ID NO: 8332312 - DNA, 22 bp, Homo sapiens
tggcattttctcctttgagttt

SEQ ID NO: 8332313 - DNA, 22 bp, Homo sapiens
tggcatttggcttacttatgtt

SEQ ID NO: 8332314 - DNA, 19 bp, Homo sapiens
tggcatttggaggcaacct

SEQ ID NO: 8332315 - DNA, 22 bp, Homo sapiens
tggcatttgggctggcttttct

SEQ ID NO: 8332316 - DNA, 22 bp, Homo sapiens
tggcatttgctcccttgtgttc

SEQ ID NO: 8332317 - DNA, 22 bp, Homo sapiens
tggcatttctgttagactctca

SEQ ID NO: 8332318 - DNA, 22 bp, Homo sapiens
tggagaattttgtcaccagaca

SEQ ID NO: 8332319 - DNA, 22 bp, Homo sapiens
gaaacaactactattgatttct

SEQ ID NO: 8332320 - DNA, 22 bp, Homo sapiens
gaaagaggaaggagatgtatta

SEQ ID NO: 8332321 - DNA, 18 bp, Homo sapiens
gaaagccatgcagcagtg

SEQ ID NO: 8332322 - DNA, 22 bp, Homo sapiens
gaaagccatctggctgctggga

SEQ ID NO: 8332323 - DNA, 22 bp, Homo sapiens
gaaagccatagcccagctttac

SEQ ID NO: 8332324 - DNA, 22 bp, Homo sapiens
gaaagccagagagaaagggctc

SEQ ID NO: 8332325 - DNA, 22 bp, Homo sapiens
ctttaacaaatgactcttgtct

SEQ ID NO: 8332326 - DNA, 22 bp, Homo sapiens
ctttgaagatggcaaatttaga

SEQ ID NO: 8332327 - DNA, 22 bp, Homo sapiens
ctttgaattccagtacaataac

SEQ ID NO: 8332328 - DNA, 22 bp, Homo sapiens
ctttgaattgccgtttcatctg

SEQ ID NO: 8332329 - DNA, 22 bp, Homo sapiens
cttatacaccctcttcccaggc

SEQ ID NO: 8332330 - DNA, 22 bp, Homo sapiens
cttaggcagactgctgatgcag

SEQ ID NO: 8332331 - DNA, 22 bp, Homo sapiens
cttaggcagtttaggaaagaga

SEQ ID NO: 8332332 - DNA, 22 bp, Homo sapiens
cttaggcatccagggttcttcc

SEQ ID NO: 8332333 - DNA, 22 bp, Homo sapiens
cttaggcagggctggaagatct

SEQ ID NO: 8332334 - DNA, 22 bp, Homo sapiens
cttaggcaagcagagcccatcc

SEQ ID NO: 8332335 - DNA, 22 bp, Homo sapiens
cttaggcaaccaggtcaatgct

SEQ ID NO: 8332336 - DNA, 22 bp, Homo sapiens
cttccaaatgtaaataagtttc

SEQ ID NO: 8332337 - DNA, 22 bp, Homo sapiens
cttccaaagcactttatggacc

SEQ ID NO: 8332338 - DNA, 22 bp, Homo sapiens
cttccaaacccagggtatgggc

SEQ ID NO: 8332339 - DNA, 22 bp, Homo sapiens
cttccaaaatttatatgttgaa

SEQ ID NO: 8332340 - DNA, 22 bp, Homo sapiens
cttaaactgaaagctacaagat

SEQ ID NO: 8332341 - DNA, 22 bp, Homo sapiens
cttaaagaaattgaggagagga

SEQ ID NO: 8332342 - DNA, 22 bp, Homo sapiens
cttaaagagtatttaatataat

SEQ ID NO: 8332343 - DNA, 22 bp, Homo sapiens
cttaaagatgtcaaggctgttt

SEQ ID NO: 8332344 - DNA, 22 bp, Homo sapiens
cttaattactgtccaatatgca

SEQ ID NO: 8332345 - DNA, 22 bp, Homo sapiens
cttaattacccaatgtggtagg

SEQ ID NO: 8332346 - DNA, 22 bp, Homo sapiens
cttacagagaagaaaatgtagt

SEQ ID NO: 8332347 - DNA, 22 bp, Homo sapiens
gaatgaaagatttgcattctat

SEQ ID NO: 8332348 - DNA, 22 bp, Homo sapiens
gaatgaaaaccttggctcaaat

SEQ ID NO: 8332349 - DNA, 22 bp, Homo sapiens
gaatgaattcagcacatggaat

SEQ ID NO: 8332350 - DNA, 22 bp, Homo sapiens
tttgaagtgcaatgaggattct

SEQ ID NO: 8332351 - DNA, 22 bp, Homo sapiens
tttgaagtcaaagattgattcc

SEQ ID NO: 8332352 - DNA, 22 bp, Homo sapiens
tttgaagtggaaaaggatttaa

SEQ ID NO: 8332353 - DNA, 22 bp, Homo sapiens
tttgaagtgttatttctatcac

SEQ ID NO: 8332354 - DNA, 22 bp, Homo sapiens
ctctactcttaacacagctagg

SEQ ID NO: 8332355 - DNA, 22 bp, Homo sapiens
ctctaacactgtaatgctttct

SEQ ID NO: 8332356 - DNA, 22 bp, Homo sapiens
ctctaacaccacagtgtggttt

SEQ ID NO: 8332357 - DNA, 22 bp, Homo sapiens
ctctaatcctttgtccctgggt

SEQ ID NO: 8332358 - DNA, 22 bp, Homo sapiens
ctgaataatattccattatgag

SEQ ID NO: 8332359 - DNA, 22 bp, Homo sapiens
ctgaataatacagactagcttc

SEQ ID NO: 8332360 - DNA, 22 bp, Homo sapiens
ctgaataaagccctcgcgcgct

SEQ ID NO: 8332361 - DNA, 22 bp, Homo sapiens
ctgaataattttctgttgtatg

SEQ ID NO: 8332362 - DNA, 22 bp, Homo sapiens
ctgaataatgttctcttgtatg

SEQ ID NO: 8332363 - DNA, 22 bp, Homo sapiens
ctgaataattttatagttgctg

SEQ ID NO: 8332364 - DNA, 22 bp, Homo sapiens
ttaaaatctaaagcagttgtct

SEQ ID NO: 8332365 - DNA, 22 bp, Homo sapiens
ttaatatgttgaaatttattag

SEQ ID NO: 8332366 - DNA, 22 bp, Homo sapiens
ttaatgatacctatgttaattt

SEQ ID NO: 8332367 - DNA, 22 bp, Homo sapiens
ttacagaaagtttcccatgccg

SEQ ID NO: 8332368 - DNA, 22 bp, Homo sapiens
ttacagaaaggaaggactgact

SEQ ID NO: 8332369 - DNA, 22 bp, Homo sapiens
ttacagaaaggttgtgggatag

SEQ ID NO: 8332370 - DNA, 23 bp, Homo sapiens
ttacagaaagtatgcttttgttt

SEQ ID NO: 8332371 - DNA, 22 bp, Homo sapiens
ttacagaaaatgtgttttaact

SEQ ID NO: 8332372 - DNA, 20 bp, Homo sapiens
ttacagaaatgatgttattt

SEQ ID NO: 8332373 - DNA, 22 bp, Homo sapiens
ttacagaactgccctagttggc

SEQ ID NO: 8332374 - DNA, 22 bp, Homo sapiens
ttacagaactgtcttgaaattt

SEQ ID NO: 8332375 - DNA, 22 bp, Homo sapiens
ttacagaagagtaacttggcaa

SEQ ID NO: 8332376 - DNA, 22 bp, Homo sapiens
ttacagaaggaacactactcag

SEQ ID NO: 8332377 - DNA, 22 bp, Homo sapiens
ttacagaagagaaagaattcag

SEQ ID NO: 8332378 - DNA, 22 bp, Homo sapiens
cctttaatttacaatgttaatt

SEQ ID NO: 8332379 - DNA, 22 bp, Homo sapiens
ttattattgtggttgcattatc

SEQ ID NO: 8332380 - DNA, 22 bp, Homo sapiens
cgtccttacagagggtcacagc

SEQ ID NO: 8332381 - DNA, 22 bp, Homo sapiens
ttcctctagcttctcactaaca

SEQ ID NO: 8332382 - DNA, 22 bp, Homo sapiens
ctaactttagcttagattatca

SEQ ID NO: 8332383 - DNA, 22 bp, Homo sapiens
ttgaataatatgcttcgttctc

SEQ ID NO: 8332384 - DNA, 22 bp, Homo sapiens
ttgaataatatgttcaggagga

SEQ ID NO: 8332385 - DNA, 22 bp, Homo sapiens
ttgaataaatgagcagtgaatt

SEQ ID NO: 8332386 - DNA, 22 bp, Homo sapiens
ttgaataatgtgtatgttgtta

SEQ ID NO: 8332387 - DNA, 22 bp, Homo sapiens
ttgaataattaattacactcag

SEQ ID NO: 8332388 - DNA, 22 bp, Homo sapiens
gtcaactttaagatgatctttt

SEQ ID NO: 8332389 - DNA, 22 bp, Homo sapiens
gtcaacttgcaagatgctgggc

SEQ ID NO: 8332390 - DNA, 20 bp, Homo sapiens
gtaatgaatgtaaacagtaa

SEQ ID NO: 8332391 - DNA, 22 bp, Homo sapiens
gtaatgaatgaaagaaactggg

SEQ ID NO: 8332392 - DNA, 22 bp, Homo sapiens
gtaaattatttcaagatcatct

SEQ ID NO: 8332393 - DNA, 22 bp, Homo sapiens
gtgatttagtgttaagtatgtt

SEQ ID NO: 8332394 - DNA, 22 bp, Homo sapiens
gtgatttagatgttgaaagtga

SEQ ID NO: 8332395 - DNA, 22 bp, Homo sapiens
ggtacaatccactgtgggttag

SEQ ID NO: 8332396 - DNA, 22 bp, Homo sapiens
ggtacaatggaccataaaagct

SEQ ID NO: 8332397 - DNA, 22 bp, Homo sapiens
ggtacaatggttcattttatgt

SEQ ID NO: 8332398 - DNA, 22 bp, Homo sapiens
ggtacaatgtcttacagaccca

SEQ ID NO: 8332399 - DNA, 22 bp, Homo sapiens
ggtacaattctggggtatgctc

SEQ ID NO: 8332400 - DNA, 22 bp, Homo sapiens
ggattctaactgaacagaatat

SEQ ID NO: 8332401 - DNA, 22 bp, Homo sapiens
ggattcagtgtctgttaatagt

SEQ ID NO: 8332402 - DNA, 23 bp, Homo sapiens
ggatttagtggatgagctgagtg

SEQ ID NO: 8332403 - DNA, 22 bp, Homo sapiens
ggatttcctcttgactctaaag

SEQ ID NO: 8332404 - DNA, 22 bp, Homo sapiens
ggatttgaattgttgaaatgat

SEQ ID NO: 8332405 - DNA, 22 bp, Homo sapiens
ggatttacaagtttaactctca

SEQ ID NO: 8332406 - DNA, 18 bp, Homo sapiens
gcacttcacccagctagt

SEQ ID NO: 8332407 - DNA, 22 bp, Homo sapiens
gcaggctccaaggcctgggaga

SEQ ID NO: 8332408 - DNA, 22 bp, Homo sapiens
gcataatatacatgcttgatcc

SEQ ID NO: 8332409 - DNA, 22 bp, Homo sapiens
gcctaataactagctgtgtaac

SEQ ID NO: 8332410 - DNA, 22 bp, Homo sapiens
gccagtctgctcccacaagttc

SEQ ID NO: 8332411 - DNA, 21 bp, Homo sapiens
gctatacagaatggccagagg

SEQ ID NO: 8332412 - DNA, 22 bp, Homo sapiens
gctatacagcaggagaatggaa

SEQ ID NO: 8332413 - DNA, 22 bp, Homo sapiens
tatgttaagtgggataatcaaa

SEQ ID NO: 8332414 - DNA, 22 bp, Homo sapiens
tatgctgtggaaaatacaaaga

SEQ ID NO: 8332415 - DNA, 22 bp, Homo sapiens
tatgctgtgctagatacaatat

SEQ ID NO: 8332416 - DNA, 22 bp, Homo sapiens
tatgcccagcttaaagtacaca

SEQ ID NO: 8332417 - DNA, 22 bp, Homo sapiens
tatttcaacgtatgaaaagctg

SEQ ID NO: 8332418 - DNA, 22 bp, Homo sapiens
tatttcaagaacttctatccat

SEQ ID NO: 8332419 - DNA, 22 bp, Homo sapiens
tatcaagtgactatcacagaac

SEQ ID NO: 8332420 - DNA, 22 bp, Homo sapiens
tatactttcctgcaactttgat

SEQ ID NO: 8332421 - DNA, 22 bp, Homo sapiens
tatacagaactgcacgtgcacg

SEQ ID NO: 8332422 - DNA, 22 bp, Homo sapiens
tagcagaaactgttacagaagg

SEQ ID NO: 8332423 - DNA, 22 bp, Homo sapiens
tacttgtagcaggtggcattta

SEQ ID NO: 8332424 - DNA, 22 bp, Homo sapiens
tactttgaagacaatatctgga

SEQ ID NO: 8332425 - DNA, 22 bp, Homo sapiens
tagatgctgtagaaatacttat

SEQ ID NO: 8332426 - DNA, 22 bp, Homo sapiens
tagatgctacaattttgtactc

SEQ ID NO: 8332427 - DNA, 22 bp, Homo sapiens
tagtacagtttaaatattaata

SEQ ID NO: 8332428 - DNA, 22 bp, Homo sapiens
tagtatctattagtaacaagag

SEQ ID NO: 8332429 - DNA, 22 bp, Homo sapiens
tagtcacctgttgtgtgatgcc

SEQ ID NO: 8332430 - DNA, 22 bp, Homo sapiens
tagtcacctttggcacctgcaa

SEQ ID NO: 8332431 - DNA, 22 bp, Homo sapiens
tagtcacctctttaaatgtcct

SEQ ID NO: 8332432 - DNA, 22 bp, Homo sapiens
tagtcacctgtgagctgcgtag

SEQ ID NO: 8332433 - DNA, 22 bp, Homo sapiens
tagtcaccagctacaggacagc

SEQ ID NO: 8332434 - DNA, 22 bp, Homo sapiens
tagtccttggtaaaattctatg

SEQ ID NO: 8332435 - DNA, 22 bp, Homo sapiens
tagtcctttaatagttaatgtg

SEQ ID NO: 8332436 - DNA, 22 bp, Homo sapiens
tagtcctttatcaaacatttat

SEQ ID NO: 8332437 - DNA, 22 bp, Homo sapiens
tagtccttgctgggcacagagt

SEQ ID NO: 8332438 - DNA, 22 bp, Homo sapiens
tagtccttacttactagaataa

SEQ ID NO: 8332439 - DNA, 22 bp, Homo sapiens
tagtcctttccggctgctataa

SEQ ID NO: 8332440 - DNA, 22 bp, Homo sapiens
gttaggcaaataactgtggagc

SEQ ID NO: 8332441 - DNA, 22 bp, Homo sapiens
gttaggcagcccaagatgtcag

SEQ ID NO: 8332442 - DNA, 19 bp, Homo sapiens
gttaggcagggtggggagt

SEQ ID NO: 8332443 - DNA, 22 bp, Homo sapiens
gttaggcaatacctcttacacc

SEQ ID NO: 8332444 - DNA, 22 bp, Homo sapiens
gttaggcatttgccttaatttt

SEQ ID NO: 8332445 - DNA, 22 bp, Homo sapiens
gttaggcatgagtgtgtattaa

SEQ ID NO: 8332446 - DNA, 22 bp, Homo sapiens
gttaggcagtgtggtatagcag

SEQ ID NO: 8332447 - DNA, 22 bp, Homo sapiens
gttaggcagttttcttcattct

SEQ ID NO: 8332448 - DNA, 22 bp, Homo sapiens
gttccaaatttggatctttagg

SEQ ID NO: 8332449 - DNA, 22 bp, Homo sapiens
gttccaaagttagagtgtattg

SEQ ID NO: 8332450 - DNA, 22 bp, Homo sapiens
gttccaaagtctctgagctgag

SEQ ID NO: 8332451 - DNA, 19 bp, Homo sapiens
gttccaaaggccagacctt

SEQ ID NO: 8332452 - DNA, 22 bp, Homo sapiens
gttccaaacaagtcataaagta

SEQ ID NO: 8332453 - DNA, 22 bp, Homo sapiens
gttccaaagcaaaggaggtgag

SEQ ID NO: 8332454 - DNA, 22 bp, Homo sapiens
taagaaacccaggaatttctta

SEQ ID NO: 8332455 - DNA, 22 bp, Homo sapiens
taaacatggctgtttcagttat

SEQ ID NO: 8332456 - DNA, 22 bp, Homo sapiens
taaacatggattctgatcacag

SEQ ID NO: 8332457 - DNA, 22 bp, Homo sapiens
taaagtttgtagcaattgatat

SEQ ID NO: 8332458 - DNA, 21 bp, Homo sapiens
taaataataagttgctgagat

SEQ ID NO: 8332459 - DNA, 22 bp, Homo sapiens
tacaggaagtaagtaatgaaat

SEQ ID NO: 8332460 - DNA, 23 bp, Homo sapiens
tacttagggtttagatctgactg

SEQ ID NO: 8332461 - DNA, 20 bp, Homo sapiens
tactggattagggctcaccc

SEQ ID NO: 8332462 - DNA, 22 bp, Homo sapiens
tactgaaagtggtcaacagtgg

SEQ ID NO: 8332463 - DNA, 22 bp, Homo sapiens
tactgaaatactaagaagttaa

SEQ ID NO: 8332464 - DNA, 22 bp, Homo sapiens
tactaaaccctcgatggatctt

SEQ ID NO: 8332465 - DNA, 22 bp, Homo sapiens
tactaaacatctggcattaaat

SEQ ID NO: 8332466 - DNA, 19 bp, Homo sapiens
tactaaacatgcatattgg

SEQ ID NO: 8332467 - DNA, 22 bp, Homo sapiens
taattttatgacagtgtatttt

SEQ ID NO: 8332468 - DNA, 22 bp, Homo sapiens
taatttttccacgtacactggg

SEQ ID NO: 8332469 - DNA, 22 bp, Homo sapiens
tacacatgtttggcaagtatgt

SEQ ID NO: 8332470 - DNA, 22 bp, Homo sapiens
tacacatgtatttatgtgtaca

SEQ ID NO: 8332471 - DNA, 22 bp, Homo sapiens
tacacatgatcatttagtagca

SEQ ID NO: 8332472 - DNA, 22 bp, Homo sapiens
taatttcaccgttgctagaaat

SEQ ID NO: 8332473 - DNA, 22 bp, Homo sapiens
taatttcagtgggctctgggct

SEQ ID NO: 8332474 - DNA, 22 bp, Homo sapiens
taatttcagtgcaagctcacgg

SEQ ID NO: 8332475 - DNA, 22 bp, Homo sapiens
taatttcactgatatgaagtca

SEQ ID NO: 8332476 - DNA, 22 bp, Homo sapiens
taatttcaatagcttgcataat

SEQ ID NO: 8332477 - DNA, 22 bp, Homo sapiens
taatttcacagttcaacgcaca

SEQ ID NO: 8332478 - DNA, 22 bp, Homo sapiens
taataaactgctacgcttagtt

SEQ ID NO: 8332479 - DNA, 22 bp, Homo sapiens
tcaaaattaaaccaacgtccag

SEQ ID NO: 8332480 - DNA, 22 bp, Homo sapiens
tcaaaattagtgaccaaaggca

SEQ ID NO: 8332481 - DNA, 22 bp, Homo sapiens
tcaaaattttatttctcaagga

SEQ ID NO: 8332482 - DNA, 22 bp, Homo sapiens
tcaaaattctagggagaatggt

SEQ ID NO: 8332483 - DNA, 22 bp, Homo sapiens
tcaaaatttcagcactagccct

SEQ ID NO: 8332484 - DNA, 22 bp, Homo sapiens
tcaattcaattgaacagttact

SEQ ID NO: 8332485 - DNA, 22 bp, Homo sapiens
tcaccgtcgggggtcgctgtct

SEQ ID NO: 8332486 - DNA, 22 bp, Homo sapiens
tcagccagtgccttgatcttgc

SEQ ID NO: 8332487 - DNA, 22 bp, Homo sapiens
tcagccaggccaggcattcaca

SEQ ID NO: 8332488 - DNA, 22 bp, Homo sapiens
tcagccagttgccccagttagt

SEQ ID NO: 8332489 - DNA, 22 bp, Homo sapiens
tcagccagtttgattctatttg

SEQ ID NO: 8332490 - DNA, 22 bp, Homo sapiens
tcagccagtttgtttattccgg

SEQ ID NO: 8332491 - DNA, 22 bp, Homo sapiens
tcataaaatgctcctgatattg

SEQ ID NO: 8332492 - DNA, 22 bp, Homo sapiens
tcagttcagtatacactattct

SEQ ID NO: 8332493 - DNA, 22 bp, Homo sapiens
tcataaaaatagactctaaagt

SEQ ID NO: 8332494 - DNA, 22 bp, Homo sapiens
tccctgggcttctccagacttg

SEQ ID NO: 8332495 - DNA, 21 bp, Homo sapiens
tccagaaaagaggtcattagc

SEQ ID NO: 8332496 - DNA, 22 bp, Homo sapiens
tttgaagaccttatctctaaat

SEQ ID NO: 8332497 - DNA, 22 bp, Homo sapiens
tttgaagacatattgttacata

SEQ ID NO: 8332498 - DNA, 22 bp, Homo sapiens
tttgaagacagatcaatataag

SEQ ID NO: 8332499 - DNA, 22 bp, Homo sapiens
tttgaacatgctgcatgataat

SEQ ID NO: 8332500 - DNA, 22 bp, Homo sapiens
tttgaacaggagtatctatagt

SEQ ID NO: 8332501 - DNA, 22 bp, Homo sapiens
tttctagtaatcaatataaagt

SEQ ID NO: 8332502 - DNA, 22 bp, Homo sapiens
tttctagtggttaagatttaca

SEQ ID NO: 8332503 - DNA, 22 bp, Homo sapiens
ttctcttagctgtaaagtcaat

SEQ ID NO: 8332504 - DNA, 22 bp, Homo sapiens
ttctaacaagtggcttgttagt

SEQ ID NO: 8332505 - DNA, 22 bp, Homo sapiens
ttcagaaatcgagtttcatgtc

SEQ ID NO: 8332506 - DNA, 22 bp, Homo sapiens
ttcagaaatgaatattggtatt

SEQ ID NO: 8332507 - DNA, 22 bp, Homo sapiens
ttcatactaaagtgtaagatgt

SEQ ID NO: 8332508 - DNA, 22 bp, Homo sapiens
ttcatactcactccaataactg

SEQ ID NO: 8332509 - DNA, 22 bp, Homo sapiens
ttcatactgtgtttccaagttt

SEQ ID NO: 8332510 - DNA, 22 bp, Homo sapiens
ttcatagatctcaattttgagg

SEQ ID NO: 8332511 - DNA, 20 bp, Homo sapiens
ttccaactcacatctctaca

SEQ ID NO: 8332512 - DNA, 19 bp, Homo sapiens
ttccaaaatcaggatttga

SEQ ID NO: 8332513 - DNA, 22 bp, Homo sapiens
ttccataataacctgagagaaa

SEQ ID NO: 8332514 - DNA, 22 bp, Homo sapiens
ttccataataggcttaagtgaa

SEQ ID NO: 8332515 - DNA, 22 bp, Homo sapiens
tttccaaataaggtcacattct

SEQ ID NO: 8332516 - DNA, 22 bp, Homo sapiens
tttccaaataaggtcacactca

SEQ ID NO: 8332517 - DNA, 22 bp, Homo sapiens
tttcataagggtttctagactt

SEQ ID NO: 8332518 - DNA, 22 bp, Homo sapiens
tttcataatactgtacatgaaa

SEQ ID NO: 8332519 - DNA, 22 bp, Homo sapiens
tttccatatttaatcaaaataa

SEQ ID NO: 8332520 - DNA, 22 bp, Homo sapiens
tttcaagtgtcctgattaatgg

SEQ ID NO: 8332521 - DNA, 22 bp, Homo sapiens
tttacagatgaggatactgagg

SEQ ID NO: 8332522 - DNA, 22 bp, Homo sapiens
tttacagatgaggaaactgaga

SEQ ID NO: 8332523 - DNA, 22 bp, Homo sapiens
tttacagatgtggaaagtgagc

SEQ ID NO: 8332524 - DNA, 22 bp, Homo sapiens
tttacagaatgtcaatttctat

SEQ ID NO: 8332525 - DNA, 22 bp, Homo sapiens
tttacagaatgttgaatttggg

SEQ ID NO: 8332526 - DNA, 22 bp, Homo sapiens
tttacagagaatgtacataaag

SEQ ID NO: 8332527 - DNA, 22 bp, Homo sapiens
tttacagagagagaactggact

SEQ ID NO: 8332528 - DNA, 22 bp, Homo sapiens
tttaacttaatctgcttgatga

SEQ ID NO: 8332529 - DNA, 23 bp, Homo sapiens
tttaactttccaataattcattg

SEQ ID NO: 8332530 - DNA, 22 bp, Homo sapiens
tttaggcaaactcattgtcaga

SEQ ID NO: 8332531 - DNA, 22 bp, Homo sapiens
tttaggcaagggcaagattatc

SEQ ID NO: 8332532 - DNA, 22 bp, Homo sapiens
tttaggcaaatttcagatgtgc

SEQ ID NO: 8332533 - DNA, 22 bp, Homo sapiens
tttaggcaagaactcactgaga

SEQ ID NO: 8332534 - DNA, 22 bp, Homo sapiens
tttaggcacagagttgagggac

SEQ ID NO: 8332535 - DNA, 22 bp, Homo sapiens
tttaggcacaactactcagcta

SEQ ID NO: 8332536 - DNA, 22 bp, Homo sapiens
tttaggcaatagatggcagtgt

SEQ ID NO: 8332537 - DNA, 22 bp, Homo sapiens
tttaggaatgtggtttttgagc

SEQ ID NO: 8332538 - DNA, 22 bp, Homo sapiens
tttatctgttgtacatttatgc

SEQ ID NO: 8332539 - DNA, 22 bp, Homo sapiens
tttaggcacagggagttggttt

SEQ ID NO: 8332540 - DNA, 22 bp, Homo sapiens
tttaggcagaacatggactttg

SEQ ID NO: 8332541 - DNA, 22 bp, Homo sapiens
tttaggcagcagtgaggatgaa

SEQ ID NO: 8332542 - DNA, 22 bp, Homo sapiens
tttaggcagcacgggcagccct

SEQ ID NO: 8332543 - DNA, 22 bp, Homo sapiens
tttaggcagaagccctgctgat

SEQ ID NO: 8332544 - DNA, 22 bp, Homo sapiens
aagtttcaaatataaaattaca

SEQ ID NO: 8332545 - DNA, 22 bp, Homo sapiens
aagtttcattgttcatgtaaca

SEQ ID NO: 8332546 - DNA, 22 bp, Homo sapiens
aagtttcatgatgtaattattg

SEQ ID NO: 8332547 - DNA, 22 bp, Homo sapiens
aagttctaattttgcattcagg

SEQ ID NO: 8332548 - DNA, 22 bp, Homo sapiens
aataagatcctgaagatatgtt

SEQ ID NO: 8332549 - DNA, 22 bp, Homo sapiens
aataattagtgggacagagaac

SEQ ID NO: 8332550 - DNA, 22 bp, Homo sapiens
aataatttccagccaactggaa

SEQ ID NO: 8332551 - DNA, 22 bp, Homo sapiens
aataattttagctcagagttgt

SEQ ID NO: 8332552 - DNA, 22 bp, Homo sapiens
aataattacccatctttttgta

SEQ ID NO: 8332553 - DNA, 18 bp, Homo sapiens
aagtcacccctgctccct

SEQ ID NO: 8332554 - DNA, 22 bp, Homo sapiens
aagtcaccctagggcctggact

SEQ ID NO: 8332555 - DNA, 22 bp, Homo sapiens
aagtcaccccacactcttggga

SEQ ID NO: 8332556 - DNA, 22 bp, Homo sapiens
aagtcacccacaggcagcagaa

SEQ ID NO: 8332557 - DNA, 22 bp, Homo sapiens
aatcccagctactcaggaagtt

SEQ ID NO: 8332558 - DNA, 22 bp, Homo sapiens
aatcaaaacctacagaggtaat

SEQ ID NO: 8332559 - DNA, 22 bp, Homo sapiens
aatatatgagggagctatttga

SEQ ID NO: 8332560 - DNA, 23 bp, Homo sapiens
aatatcaaggtgatgttcccaga

SEQ ID NO: 8332561 - DNA, 22 bp, Homo sapiens
aatgaacagatacacataggca

SEQ ID NO: 8332562 - DNA, 22 bp, Homo sapiens
aatgaacatataaagagatctt

SEQ ID NO: 8332563 - DNA, 22 bp, Homo sapiens
aagtcacaagcatatatgcatt

SEQ ID NO: 8332564 - DNA, 22 bp, Homo sapiens
aattatattgtggtgtgaatgt

SEQ ID NO: 8332565 - DNA, 22 bp, Homo sapiens
aattatccttaatgcagtaagc

SEQ ID NO: 8332566 - DNA, 22 bp, Homo sapiens
aatttacacttcatttggaggg

SEQ ID NO: 8332567 - DNA, 22 bp, Homo sapiens
aatttacaggtgcactcgccat

SEQ ID NO: 8332568 - DNA, 22 bp, Homo sapiens
aatttacagttgctgatggtac

SEQ ID NO: 8332569 - DNA, 22 bp, Homo sapiens
aatgcaaagcaagcagagattt

SEQ ID NO: 8332570 - DNA, 22 bp, Homo sapiens
acaaaatttttagacaaggctt

SEQ ID NO: 8332571 - DNA, 22 bp, Homo sapiens
acaaaattgtgttaaactttat

SEQ ID NO: 8332572 - DNA, 22 bp, Homo sapiens
acaaaattatgaagaggccttg

SEQ ID NO: 8332573 - DNA, 22 bp, Homo sapiens
acaaaattacctagttattttc

SEQ ID NO: 8332574 - DNA, 22 bp, Homo sapiens
acaattccacatggcatgcagg

SEQ ID NO: 8332575 - DNA, 22 bp, Homo sapiens
agccattcattgtgctctcaga

SEQ ID NO: 8332576 - DNA, 22 bp, Homo sapiens
agccattttcctgaaatataac

SEQ ID NO: 8332577 - DNA, 22 bp, Homo sapiens
acagagttcccactccagaagc

SEQ ID NO: 8332578 - DNA, 19 bp, Homo sapiens
acagaaattagttattttc

SEQ ID NO: 8332579 - DNA, 22 bp, Homo sapiens
acacagattttacatgttatgc

SEQ ID NO: 8332580 - DNA, 22 bp, Homo sapiens
acagaatttacacatctctaaa

SEQ ID NO: 8332581 - DNA, 22 bp, Homo sapiens
acagaatttgcttgggcaatgg

SEQ ID NO: 8332582 - DNA, 22 bp, Homo sapiens
acagaattgatggaaatctcag

SEQ ID NO: 8332583 - DNA, 22 bp, Homo sapiens
acagaatttaaagctctagact

SEQ ID NO: 8332584 - DNA, 22 bp, Homo sapiens
acagaattatcaggaaatgtta

SEQ ID NO: 8332585 - DNA, 22 bp, Homo sapiens
acagaattctagtatgtggctt

SEQ ID NO: 8332586 - DNA, 22 bp, Homo sapiens
acagaattgaaagtataatctg

SEQ ID NO: 8332587 - DNA, 22 bp, Homo sapiens
acaaagatcttgctttcctact

SEQ ID NO: 8332588 - DNA, 22 bp, Homo sapiens
aatgttttaaaagagattgaga

SEQ ID NO: 8332589 - DNA, 22 bp, Homo sapiens
aagaaatctgatatttgtttca

SEQ ID NO: 8332590 - DNA, 22 bp, Homo sapiens
aagaaatcagaaaagcattcgt

SEQ ID NO: 8332591 - DNA, 22 bp, Homo sapiens
aagaaatcatatcatttcttgg

SEQ ID NO: 8332592 - DNA, 22 bp, Homo sapiens
aaattgaatgattaagtggtga

SEQ ID NO: 8332593 - DNA, 22 bp, Homo sapiens
aaattgcagatgctaaatgact

SEQ ID NO: 8332594 - DNA, 22 bp, Homo sapiens
aaattgcaaaagtacttttagg

SEQ ID NO: 8332595 - DNA, 22 bp, Homo sapiens
aacatgctttgataaataaaag

SEQ ID NO: 8332596 - DNA, 21 bp, Homo sapiens
aactggttcaattcaactaga

SEQ ID NO: 8332597 - DNA, 22 bp, Homo sapiens
aatataatgctgttttatgcca

SEQ ID NO: 8332598 - DNA, 22 bp, Homo sapiens
aatcatgtgggatagtctgctc

SEQ ID NO: 8332599 - DNA, 22 bp, Homo sapiens
aaagccaggttgtgtgcaggaa

SEQ ID NO: 8332600 - DNA, 22 bp, Homo sapiens
aacaaacaaacattttgtcatc

SEQ ID NO: 8332601 - DNA, 22 bp, Homo sapiens
aaatagattgctgaggcattac

SEQ ID NO: 8332602 - DNA, 22 bp, Homo sapiens
aaatagcagcctttagttaaca

SEQ ID NO: 8332603 - DNA, 22 bp, Homo sapiens
aaataatgttaggcctttgctc

SEQ ID NO: 8332604 - DNA, 22 bp, Homo sapiens
aaagttcatggtgttatagaaa

SEQ ID NO: 8332605 - DNA, 22 bp, Homo sapiens
aaagaatcacatccttcagcaa

SEQ ID NO: 8332606 - DNA, 22 bp, Homo sapiens
aaagaatcgtgtgtagtttgaa

SEQ ID NO: 8332607 - DNA, 22 bp, Homo sapiens
aaagaatcagaagtctcaaaca

SEQ ID NO: 8332608 - DNA, 21 bp, Homo sapiens
aaagaatcatgggtaatttca

SEQ ID NO: 8332609 - DNA, 22 bp, Homo sapiens
aaagaatctatatatcaccacc

SEQ ID NO: 8332610 - DNA, 22 bp, Homo sapiens
aaacaaacaattagttgtgtgg

SEQ ID NO: 8332611 - DNA, 22 bp, Homo sapiens
aaagaaggggtctacatccaat

SEQ ID NO: 8332612 - DNA, 22 bp, Homo sapiens
agagatgaacataaaacaagga

SEQ ID NO: 8332613 - DNA, 22 bp, Homo sapiens
atggccttagtgatgattaata

SEQ ID NO: 8332614 - DNA, 22 bp, Homo sapiens
agaagtgagtgtgactcagcag

SEQ ID NO: 8332615 - DNA, 20 bp, Homo sapiens
agaagtcagctcagaagtga

SEQ ID NO: 8332616 - DNA, 22 bp, Homo sapiens
atgaaacatgctttgtggatga

SEQ ID NO: 8332617 - DNA, 22 bp, Homo sapiens
atgaacaagagagggaagattc

SEQ ID NO: 8332618 - DNA, 22 bp, Homo sapiens
atgaacaagtatttgcatgagc

SEQ ID NO: 8332619 - DNA, 22 bp, Homo sapiens
atgaacaataaaatagatcaca

SEQ ID NO: 8332620 - DNA, 22 bp, Homo sapiens
atgacaaaagaagacatgaggt

SEQ ID NO: 8332621 - DNA, 22 bp, Homo sapiens
agataaaatggttcaaaggcta

SEQ ID NO: 8332622 - DNA, 22 bp, Homo sapiens
atttcacatctatctcagattt

SEQ ID NO: 8332623 - DNA, 22 bp, Homo sapiens
atttccagactttttccaggaa

SEQ ID NO: 8332624 - DNA, 21 bp, Homo sapiens
attattataaagaccacaggg

SEQ ID NO: 8332625 - DNA, 22 bp, Homo sapiens
caagatttgccagtggccaact

SEQ ID NO: 8332626 - DNA, 22 bp, Homo sapiens
caatttttgtacttatagtact

SEQ ID NO: 8332627 - DNA, 22 bp, Homo sapiens
agcacataccagaaccacaggt

SEQ ID NO: 8332628 - DNA, 22 bp, Homo sapiens
cagaatcagcccttgctattaa

SEQ ID NO: 8332629 - DNA, 22 bp, Homo sapiens
cagaatgtagatcatcatcaag

SEQ ID NO: 8332630 - DNA, 22 bp, Homo sapiens
agcatataaatggacatatttg

SEQ ID NO: 8332631 - DNA, 22 bp, Homo sapiens
cagaaatcattgtgatgacagg

SEQ ID NO: 8332632 - DNA, 19 bp, Homo sapiens
cagaaatagcgaagtgtaa

SEQ ID NO: 8332633 - DNA, 23 bp, Homo sapiens
actttatcctatatctttgttct

SEQ ID NO: 8332634 - DNA, 22 bp, Homo sapiens
actttatcaggaatcacacagc

SEQ ID NO: 8332635 - DNA, 22 bp, Homo sapiens
ataaaatttgctactgttaaat

SEQ ID NO: 8332636 - DNA, 22 bp, Homo sapiens
atctaacactgtaaactgtctt

SEQ ID NO: 8332637 - DNA, 22 bp, Homo sapiens
atctaacagcaacaccagaata

SEQ ID NO: 8332638 - DNA, 22 bp, Homo sapiens
atctaaaaggagctctttatct

SEQ ID NO: 8332639 - DNA, 22 bp, Homo sapiens
atctaaacaggtgttctttaga

SEQ ID NO: 8332640 - DNA, 22 bp, Homo sapiens
atatgcttgggactgatacagt

SEQ ID NO: 8332641 - DNA, 21 bp, Homo sapiens
agtcccatccggtaagcaagc

SEQ ID NO: 8332642 - DNA, 22 bp, Homo sapiens
agtcaaatgagtaaatatataa

SEQ ID NO: 8332643 - DNA, 22 bp, Homo sapiens
agtaaaattgtattggaaaaca

SEQ ID NO: 8332644 - DNA, 22 bp, Homo sapiens
agtaaaatttctgctgaggaga

SEQ ID NO: 8332645 - DNA, 22 bp, Homo sapiens
agtaaaattaatggatcagaag

SEQ ID NO: 8332646 - DNA, 22 bp, Homo sapiens
agtaaacactgtctttatatat

SEQ ID NO: 8332647 - DNA, 22 bp, Homo sapiens
actagaaattactcagaataaa

SEQ ID NO: 8332648 - DNA, 22 bp, Homo sapiens
acatgcttttcccacaattata

SEQ ID NO: 8332649 - DNA, 22 bp, Homo sapiens
acatgcttccaaattatgttgg

SEQ ID NO: 8332650 - DNA, 22 bp, Homo sapiens
acatgcttcatattataaccaa

SEQ ID NO: 8332651 - DNA, 22 bp, Homo sapiens
acatgctttgatgtattttgca

SEQ ID NO: 8332652 - DNA, 22 bp, Homo sapiens
acatgctttaacttattttgat

SEQ ID NO: 8332653 - DNA, 22 bp, Homo sapiens
acatgcttgtttttcacaacct

SEQ ID NO: 8332654 - DNA, 22 bp, Homo sapiens
acatgctttgcacttacatcat

SEQ ID NO: 8332655 - DNA, 22 bp, Homo sapiens
acaggtttttgtggatatatgt

SEQ ID NO: 8332656 - DNA, 22 bp, Homo sapiens
acaggtttgtctgatgtaatga

SEQ ID NO: 8332657 - DNA, 22 bp, Homo sapiens
acagtccttgtgtggaacatta

SEQ ID NO: 8332658 - DNA, 21 bp, Homo sapiens
atacagaaggcagactctctc

SEQ ID NO: 8332659 - DNA, 22 bp, Homo sapiens
atacagaagcctgtatttctgg

SEQ ID NO: 8332660 - DNA, 22 bp, Homo sapiens
atacagaagacccctccgtcat

SEQ ID NO: 8332661 - DNA, 21 bp, Homo sapiens
atacagaaggtggcaaagtac

SEQ ID NO: 8332662 - DNA, 22 bp, Homo sapiens
ataattcatgggcctttcacct

SEQ ID NO: 8332663 - DNA, 22 bp, Homo sapiens
atacagaaaagtggatagccag

SEQ ID NO: 8332664 - DNA, 22 bp, Homo sapiens
atacagaacaagcctcacctcc

SEQ ID NO: 8332665 - DNA, 22 bp, Homo sapiens
atacagaaaatgatgcagagtt

SEQ ID NO: 8332666 - DNA, 21 bp, Homo sapiens
atacagaacattgatccaaga

SEQ ID NO: 8332667 - DNA, 22 bp, Homo sapiens
atacagaagaactatagccact

SEQ ID NO: 8332668 - DNA, 22 bp, Homo sapiens
atacagaactctcagttgtata

SEQ ID NO: 8332669 - DNA, 22 bp, Homo sapiens
atagacatagccgtaatttatt

SEQ ID NO: 8332670 - DNA, 22 bp, Homo sapiens
atagaatttgcactaaatctgc

SEQ ID NO: 8332671 - DNA, 22 bp, Homo sapiens
atagaattctttgaaatttatg

SEQ ID NO: 8332672 - DNA, 22 bp, Homo sapiens
atagaattatggaaagcatctt

SEQ ID NO: 8332673 - DNA, 22 bp, Homo sapiens
atagaattcgtgtttgtaattc

SEQ ID NO: 8332674 - DNA, 22 bp, Homo sapiens
atagacattttgcattcaagca

SEQ ID NO: 8332675 - DNA, 22 bp, Homo sapiens
ataggcttatataaaaacatct

SEQ ID NO: 8332676 - DNA, 18 bp, Homo sapiens
atagaaacctttaatcag

SEQ ID NO: 8332677 - DNA, 22 bp, Homo sapiens
atagaaatggcagctggtgcta

SEQ ID NO: 8332678 - DNA, 22 bp, Homo sapiens
atagaatagcatagaaaattga

SEQ ID NO: 8332679 - DNA, 22 bp, Homo sapiens
ctgatacatagtagcatgtcat

SEQ ID NO: 8332680 - DNA, 22 bp, Homo sapiens
ataataaaccaggatgggtctg

SEQ ID NO: 8332681 - DNA, 22 bp, Homo sapiens
atatcagaaatagtaagcagag

SEQ ID NO: 8332682 - DNA, 22 bp, Homo sapiens
atatcagacagaaagcattgac

SEQ ID NO: 8332683 - DNA, 22 bp, Homo sapiens
atagtcactgccttccatttgt

SEQ ID NO: 8332684 - DNA, 20 bp, Homo sapiens
ctgtatcaggttacaaagta

SEQ ID NO: 8332685 - DNA, 22 bp, Homo sapiens
atccttagttaagaacaggagt

SEQ ID NO: 8332686 - DNA, 21 bp, Homo sapiens
atccttagcacttagaagagt

SEQ ID NO: 8332687 - DNA, 22 bp, Homo sapiens
atccttaggtggtgcatcaggg

SEQ ID NO: 8332688 - DNA, 22 bp, Homo sapiens
atccttagaagggagtgaggac

SEQ ID NO: 8332689 - DNA, 22 bp, Homo sapiens
ctaaaattatcaagataattcc

SEQ ID NO: 8332690 - DNA, 22 bp, Homo sapiens
agtcaccaacatggttcccagg

SEQ ID NO: 8332691 - DNA, 21 bp, Homo sapiens
ctacagaatcgagcattctgg

SEQ ID NO: 8332692 - DNA, 22 bp, Homo sapiens
ctacagaaaatcagccacaggc

SEQ ID NO: 8332693 - DNA, 22 bp, Homo sapiens
ctacagaaacactggacatgtg

SEQ ID NO: 8332694 - DNA, 22 bp, Homo sapiens
ctacagaaacctttttcataca

SEQ ID NO: 8332695 - DNA, 22 bp, Homo sapiens
ctacagaagaaactatcactat

SEQ ID NO: 8332696 - DNA, 22 bp, Homo sapiens
ctacagaagccgtggtcaggaa

SEQ ID NO: 8332697 - DNA, 21 bp, Homo sapiens
ctacagaagctctcctatcca

SEQ ID NO: 8332698 - DNA, 22 bp, Homo sapiens
ctacagaaggagaaatgggtaa

SEQ ID NO: 8332699 - DNA, 22 bp, Homo sapiens
ctacagaagtttcccttgctta

SEQ ID NO: 8332700 - DNA, 22 bp, Homo sapiens
catagcttaggggttaaactca

SEQ ID NO: 8332701 - DNA, 22 bp, Homo sapiens
ccaatacactttatagaagaaa

SEQ ID NO: 8332702 - DNA, 22 bp, Homo sapiens
catggattgaatataaattaga

SEQ ID NO: 8332703 - DNA, 22 bp, Homo sapiens
catggtctacaatttcatttta

SEQ ID NO: 8332704 - DNA, 23 bp, Homo sapiens
aggatttaaaggcaatgcatttt

SEQ ID NO: 8332705 - DNA, 22 bp, Homo sapiens
aggatttacaatgattctaggt

SEQ ID NO: 8332706 - DNA, 22 bp, Homo sapiens
aggatttaaatccttaaccact

SEQ ID NO: 8332707 - DNA, 22 bp, Homo sapiens
aggatttattccagaaatgcaa

SEQ ID NO: 8332708 - DNA, 19 bp, Homo sapiens
aggatttattatgtgctca

SEQ ID NO: 8332709 - DNA, 22 bp, Homo sapiens
aggatttattatatgccctcat

SEQ ID NO: 8332710 - DNA, 22 bp, Homo sapiens
aggatttagatttggaggaact

SEQ ID NO: 8332711 - DNA, 22 bp, Homo sapiens
aggatttaggagctggctaacg

SEQ ID NO: 8332712 - DNA, 22 bp, Homo sapiens
aggatttagcatgaaatgtgaa

SEQ ID NO: 8332713 - DNA, 22 bp, Homo sapiens
aggatttattacaagccatggt

SEQ ID NO: 8332714 - DNA, 22 bp, Homo sapiens
aggatttatcaggaactctctt

SEQ ID NO: 8332715 - DNA, 22 bp, Homo sapiens
aggatttactagcaaggattct

SEQ ID NO: 8332716 - DNA, 20 bp, Homo sapiens
aggatttactactacctgct

SEQ ID NO: 8332717 - DNA, 22 bp, Homo sapiens
aggatttacctccagctaggct

SEQ ID NO: 8332718 - DNA, 22 bp, Homo sapiens
aggatttaccgtcatttagtct

SEQ ID NO: 8332719 - DNA, 21 bp, Homo sapiens
aggatttactattaactgtgt

SEQ ID NO: 8332720 - DNA, 22 bp, Homo sapiens
aggatttattggtgggaagtta

SEQ ID NO: 8332721 - DNA, 22 bp, Homo sapiens
ccatgcacaccagcaggcagac

SEQ ID NO: 8332722 - DNA, 22 bp, Homo sapiens
ccatggctctagagattgaaaa

SEQ ID NO: 8332723 - DNA, 22 bp, Homo sapiens
ccatggctttctttcattgtaa

SEQ ID NO: 8332724 - DNA, 22 bp, Homo sapiens
ccatggctcttaccttgttata

SEQ ID NO: 8332725 - DNA, 22 bp, Homo sapiens
ccatggcttttgagtctcaaga

SEQ ID NO: 8332726 - DNA, 22 bp, Homo sapiens
aggcttcttcttcctatttagt

SEQ ID NO: 8332727 - DNA, 22 bp, Homo sapiens
aggcttctgtgagctcatacaa

SEQ ID NO: 8332728 - DNA, 22 bp, Homo sapiens
aggcttctgctgatatttcatt

SEQ ID NO: 8332729 - DNA, 22 bp, Homo sapiens
caaagaagagatttacagagct

SEQ ID NO: 8332730 - DNA, 22 bp, Homo sapiens
atttatctctggaaactaagca

SEQ ID NO: 8332731 - DNA, 22 bp, Homo sapiens
atttcaacgttagatgtaatag

SEQ ID NO: 8332732 - DNA, 22 bp, Homo sapiens
atttcaacagagtttgaaggca

SEQ ID NO: 8332733 - DNA, 22 bp, Homo sapiens
atttcaacattctcagttgtag

SEQ ID NO: 8332734 - DNA, 22 bp, Homo sapiens
atttcaacacttttggaattag

SEQ ID NO: 8332735 - DNA, 22 bp, Homo sapiens
gcagaatttgggggtaaccttt

SEQ ID NO: 8332736 - DNA, 22 bp, Homo sapiens
gcagaattttctgttttctaga

SEQ ID NO: 8332737 - DNA, 22 bp, Homo sapiens
attatgctggtttacacatttt

SEQ ID NO: 8332738 - DNA, 22 bp, Homo sapiens
attatcctcagaaaacatgtga

SEQ ID NO: 8332739 - DNA, 22 bp, Homo sapiens
attatccagcaccaatgtcaga

SEQ ID NO: 8332740 - DNA, 22 bp, Homo sapiens
attccaaaggttaatgcccatt

SEQ ID NO: 8332741 - DNA, 22 bp, Homo sapiens
attccaaagacagaagcagctg

SEQ ID NO: 8332742 - DNA, 22 bp, Homo sapiens
attccaaagcacatcagaacta

SEQ ID NO: 8332743 - DNA, 22 bp, Homo sapiens
attccaaaggctggcctggagg

SEQ ID NO: 8332744 - DNA, 22 bp, Homo sapiens
attccaaagcctgaataatgga

SEQ ID NO: 8332745 - DNA, 22 bp, Homo sapiens
attccaaacagtgctgcagact

SEQ ID NO: 8332746 - DNA, 22 bp, Homo sapiens
attccaaacgcctcgcggactt

SEQ ID NO: 8332747 - DNA, 22 bp, Homo sapiens
attccaaaaggatgttagaatg

SEQ ID NO: 8332748 - DNA, 22 bp, Homo sapiens
attccaaacttaccccagagga

SEQ ID NO: 8332749 - DNA, 22 bp, Homo sapiens
attccaaactctttccctgtcg

SEQ ID NO: 8332750 - DNA, 22 bp, Homo sapiens
gaatttcatttgtttcctacca

SEQ ID NO: 8332751 - DNA, 22 bp, Homo sapiens
gaatttcaggacaactggaagg

SEQ ID NO: 8332752 - DNA, 22 bp, Homo sapiens
gaatttcagatcagagaccatt

SEQ ID NO: 8332753 - DNA, 22 bp, Homo sapiens
gaatttcagggtctggtaggaa

SEQ ID NO: 8332754 - DNA, 22 bp, Homo sapiens
gaatttcattgctctgctgtgt

SEQ ID NO: 8332755 - DNA, 22 bp, Homo sapiens
gaatttcacaaggtgaggataa

SEQ ID NO: 8332756 - DNA, 22 bp, Homo sapiens
gaatttcaagcagtgcaatgtt

SEQ ID NO: 8332757 - DNA, 22 bp, Homo sapiens
gaatttcagaggtaacatcatc

SEQ ID NO: 8332758 - DNA, 22 bp, Homo sapiens
gaatttcaaaagccagaacggg

SEQ ID NO: 8332759 - DNA, 22 bp, Homo sapiens
gaatttcaaagaggttaagagg

SEQ ID NO: 8332760 - DNA, 22 bp, Homo sapiens
gaatttcaacagtcctcaaatg

SEQ ID NO: 8332761 - DNA, 22 bp, Homo sapiens
gaagtcctcctatcttgctctt

SEQ ID NO: 8332762 - DNA, 19 bp, Homo sapiens
gaagtcctctagtaaattt

SEQ ID NO: 8332763 - DNA, 22 bp, Homo sapiens
gaagtcctcaatgcattgtctt

SEQ ID NO: 8332764 - DNA, 20 bp, Homo sapiens
gaagtcctttcactcttccc

SEQ ID NO: 8332765 - DNA, 22 bp, Homo sapiens
gaagtcctggtcctctcattca

SEQ ID NO: 8332766 - DNA, 20 bp, Homo sapiens
gaagtcctgttatatccttt

SEQ ID NO: 8332767 - DNA, 22 bp, Homo sapiens
ctttacagaataagaatactgg

SEQ ID NO: 8332768 - DNA, 22 bp, Homo sapiens
ctttacataaggataaacctgg

SEQ ID NO: 8332769 - DNA, 22 bp, Homo sapiens
ctttacatcctgtttcccgttt

SEQ ID NO: 8332770 - DNA, 22 bp, Homo sapiens
atggatttgcttatacacatgt

SEQ ID NO: 8332771 - DNA, 21 bp, Homo sapiens
atggatttaaacaggccacaa

SEQ ID NO: 8332772 - DNA, 22 bp, Homo sapiens
atggatttggatgagattactt

SEQ ID NO: 8332773 - DNA, 22 bp, Homo sapiens
atggatcagaatcccgggaggg

SEQ ID NO: 8332774 - DNA, 22 bp, Homo sapiens
atggatcacagtgccgtgggtg

SEQ ID NO: 8332775 - DNA, 22 bp, Homo sapiens
gagacaggatttaaccaaagct

SEQ ID NO: 8332776 - DNA, 22 bp, Homo sapiens
atgcttaacttcctagtctata

SEQ ID NO: 8332777 - DNA, 22 bp, Homo sapiens
atgcttaactctgtacatagtt

SEQ ID NO: 8332778 - DNA, 22 bp, Homo sapiens
atgcttaaccttggtgtacaat

SEQ ID NO: 8332779 - DNA, 22 bp, Homo sapiens
atgtatccttatacacatttat

SEQ ID NO: 8332780 - DNA, 22 bp, Homo sapiens
atgtgctttattaagtaaaaat

SEQ ID NO: 8332781 - DNA, 22 bp, Homo sapiens
atgtgcttgtaatgttaaatgt

SEQ ID NO: 8332782 - DNA, 22 bp, Homo sapiens
atgtgcttcattctacatgaca

SEQ ID NO: 8332783 - DNA, 22 bp, Homo sapiens
cagaatttagcacaatgtatgg

SEQ ID NO: 8332784 - DNA, 22 bp, Homo sapiens
cagaatttttcgaatgtactgt

SEQ ID NO: 8332785 - DNA, 22 bp, Homo sapiens
cagaatttaagtggattattct

SEQ ID NO: 8332786 - DNA, 22 bp, Homo sapiens
cagaataaaggtacaattgagt

SEQ ID NO: 8332787 - DNA, 22 bp, Homo sapiens
cagaataaaagtcccaaggcat

SEQ ID NO: 8332788 - DNA, 22 bp, Homo sapiens
cagaaaataaagtttctacgca

SEQ ID NO: 8332789 - DNA, 22 bp, Homo sapiens
gtcacagagttattaattgtgt

SEQ ID NO: 8332790 - DNA, 22 bp, Homo sapiens
gtagaaatatttatctctgaga

SEQ ID NO: 8332791 - DNA, 22 bp, Homo sapiens
gtagaaatagtggttgacagga

SEQ ID NO: 8332792 - DNA, 22 bp, Homo sapiens
cagatttcagctcatatattat

SEQ ID NO: 8332793 - DNA, 22 bp, Homo sapiens
cagatttctatttcaaatacat

SEQ ID NO: 8332794 - DNA, 22 bp, Homo sapiens
caaagtcagctgccagtcccaa

SEQ ID NO: 8332795 - DNA, 22 bp, Homo sapiens
caaagtcatggggatgcaggtc

SEQ ID NO: 8332796 - DNA, 22 bp, Homo sapiens
caacttttctgtgaatttaagt

SEQ ID NO: 8332797 - DNA, 22 bp, Homo sapiens
caactttgtgtgacctagatag

SEQ ID NO: 8332798 - DNA, 22 bp, Homo sapiens
caactttctgttaaatgttagt

SEQ ID NO: 8332799 - DNA, 22 bp, Homo sapiens
caactttatgattggtttgtca

SEQ ID NO: 8332800 - DNA, 22 bp, Homo sapiens
caagaatcctgttcttgaagat

SEQ ID NO: 8332801 - DNA, 22 bp, Homo sapiens
caagaatcagacctgtcagggt

SEQ ID NO: 8332802 - DNA, 22 bp, Homo sapiens
caagaatcaacattatttagtg

SEQ ID NO: 8332803 - DNA, 18 bp, Homo sapiens
caagaatctctaaagaag

SEQ ID NO: 8332804 - DNA, 22 bp, Homo sapiens
caagaatcttgcagcttagact

SEQ ID NO: 8332805 - DNA, 22 bp, Homo sapiens
caatttcaagattctgttcttt

SEQ ID NO: 8332806 - DNA, 22 bp, Homo sapiens
caatcagtaaccggatcatggt

SEQ ID NO: 8332807 - DNA, 21 bp, Homo sapiens
caatcagttggcatttgagca

SEQ ID NO: 8332808 - DNA, 22 bp, Homo sapiens
caatcagtttctgttgtataat

SEQ ID NO: 8332809 - DNA, 22 bp, Homo sapiens
caatttcaatgaggccacaggg

SEQ ID NO: 8332810 - DNA, 22 bp, Homo sapiens
caatttcaatacaaaatacatt

SEQ ID NO: 8332811 - DNA, 22 bp, Homo sapiens
caatttcactaataatatttac

SEQ ID NO: 8332812 - DNA, 18 bp, Homo sapiens
caatttcaatggtctgaa

SEQ ID NO: 8332813 - DNA, 22 bp, Homo sapiens
caatttcactgacaccctggaa

SEQ ID NO: 8332814 - DNA, 22 bp, Homo sapiens
caatttcactaatgatgtgggg

SEQ ID NO: 8332815 - DNA, 22 bp, Homo sapiens
caatttcagacctttccttgga

SEQ ID NO: 8332816 - DNA, 22 bp, Homo sapiens
caatttcagtctcagagagttc

SEQ ID NO: 8332817 - DNA, 22 bp, Homo sapiens
caatttcaggtggataggtttt

SEQ ID NO: 8332818 - DNA, 23 bp, Homo sapiens
caatttcatatgattctacctaa

SEQ ID NO: 8332819 - DNA, 22 bp, Homo sapiens
caatttcagtgctgtggagagg

SEQ ID NO: 8332820 - DNA, 17 bp, Homo sapiens
caatttcataggttttg

SEQ ID NO: 8332821 - DNA, 18 bp, Homo sapiens
caatttcatccttaagcc

SEQ ID NO: 8332822 - DNA, 20 bp, Homo sapiens
caatttcatcatttcctgtg

SEQ ID NO: 8332823 - DNA, 22 bp, Homo sapiens
caatttcatgccatgtattgct

SEQ ID NO: 8332824 - DNA, 22 bp, Homo sapiens
caatttcatcttgtgcttcaat

SEQ ID NO: 8332825 - DNA, 22 bp, Homo sapiens
caatttcattaatagatataga

SEQ ID NO: 8332826 - DNA, 21 bp, Homo sapiens
caatttcatgggaagatggga

SEQ ID NO: 8332827 - DNA, 22 bp, Homo sapiens
caatttcatggataaaagatgt

SEQ ID NO: 8332828 - DNA, 22 bp, Homo sapiens
caatatataggaacaacttagg

SEQ ID NO: 8332829 - DNA, 22 bp, Homo sapiens
caatatataatgagtactttcc

SEQ ID NO: 8332830 - DNA, 22 bp, Homo sapiens
ggcaatttcatgtggtttaaac

SEQ ID NO: 8332831 - DNA, 22 bp, Homo sapiens
cataaaatggcttgttctttaa

SEQ ID NO: 8332832 - DNA, 22 bp, Homo sapiens
tatcataagttaattaaacagt

SEQ ID NO: 8332833 - DNA, 23 bp, Homo sapiens
tatcagtgtgatgaggctgctgc

SEQ ID NO: 8332834 - DNA, 22 bp, Homo sapiens
tagaatatgattaattttctta

SEQ ID NO: 8332835 - DNA, 22 bp, Homo sapiens
tagaacataagtcattcatttg

SEQ ID NO: 8332836 - DNA, 22 bp, Homo sapiens
tagaataagttgatgatatatg

SEQ ID NO: 8332837 - DNA, 19 bp, Homo sapiens
catgttatgctgtagtatc

SEQ ID NO: 8332838 - DNA, 22 bp, Homo sapiens
tctttaatataaaggaatgaat

SEQ ID NO: 8332839 - DNA, 22 bp, Homo sapiens
ccgtagcacatgctcctggggc

SEQ ID NO: 8332840 - DNA, 22 bp, Homo sapiens
tttgaataatcactgggcatta

SEQ ID NO: 8332841 - DNA, 22 bp, Homo sapiens
tttcagaaccgctaaaataaat

SEQ ID NO: 8332842 - DNA, 22 bp, Homo sapiens
ctccttagtgcctctgcacgag

SEQ ID NO: 8332843 - DNA, 22 bp, Homo sapiens
ctagaaatacaggcacgtgcca

SEQ ID NO: 8332844 - DNA, 22 bp, Homo sapiens
ctatacagagcatccttaactt

SEQ ID NO: 8332845 - DNA, 22 bp, Homo sapiens
ctataattatgctcaaaatgta

SEQ ID NO: 8332846 - DNA, 19 bp, Homo sapiens
ctatacagcctctgaggaa

SEQ ID NO: 8332847 - DNA, 22 bp, Homo sapiens
ctatacagtaaccacagtgatt

SEQ ID NO: 8332848 - DNA, 22 bp, Homo sapiens
ctatagaaaattgtatcacacg

SEQ ID NO: 8332849 - DNA, 22 bp, Homo sapiens
ttggatcaaatttcatgctgtc

SEQ ID NO: 8332850 - DNA, 22 bp, Homo sapiens
ttggatcactctgaagccttac

SEQ ID NO: 8332851 - DNA, 22 bp, Homo sapiens
ttggatcatggaatgtctgctt

SEQ ID NO: 8332852 - DNA, 22 bp, Homo sapiens
ttggatcagatgatatctttgt

SEQ ID NO: 8332853 - DNA, 22 bp, Homo sapiens
ttacataacggtatgaaaaatg

SEQ ID NO: 8332854 - DNA, 22 bp, Homo sapiens
ttatattagttagacttgctgt

SEQ ID NO: 8332855 - DNA, 22 bp, Homo sapiens
ttacagaagtttcagcgtttta

SEQ ID NO: 8332856 - DNA, 21 bp, Homo sapiens
ttacagaatccatgggaagtc

SEQ ID NO: 8332857 - DNA, 22 bp, Homo sapiens
ttacagaagtgaaggcctttaa

SEQ ID NO: 8332858 - DNA, 22 bp, Homo sapiens
ttacagaagtattgagagatcc

SEQ ID NO: 8332859 - DNA, 22 bp, Homo sapiens
ttaagcaacacacattaattat

SEQ ID NO: 8332860 - DNA, 22 bp, Homo sapiens
ttatccaaactggtgaatcatt

SEQ ID NO: 8332861 - DNA, 22 bp, Homo sapiens
ttatccaacatgacttatgtcc

SEQ ID NO: 8332862 - DNA, 22 bp, Homo sapiens
ttatccaagcagaagctgcaca

SEQ ID NO: 8332863 - DNA, 22 bp, Homo sapiens
gaaatatacattgcaggaagag

SEQ ID NO: 8332864 - DNA, 22 bp, Homo sapiens
gaaaaaggataaatacagtgtt

SEQ ID NO: 8332865 - DNA, 22 bp, Homo sapiens
gaagaatcctgtcctctttagg

SEQ ID NO: 8332866 - DNA, 22 bp, Homo sapiens
gaagaatcaagcagtaatttgt

SEQ ID NO: 8332867 - DNA, 22 bp, Homo sapiens
gaagaatccatgctaatttacc

SEQ ID NO: 8332868 - DNA, 22 bp, Homo sapiens
gaagaatctgaggacagtcatt

SEQ ID NO: 8332869 - DNA, 22 bp, Homo sapiens
gaatttttctggaagcaattat

SEQ ID NO: 8332870 - DNA, 22 bp, Homo sapiens
gactatgtgaagtgtgaatagg

SEQ ID NO: 8332871 - DNA, 22 bp, Homo sapiens
gacagtccttgcccagtatcta

SEQ ID NO: 8332872 - DNA, 22 bp, Homo sapiens
gagatttagctgcttaactcct

SEQ ID NO: 8332873 - DNA, 22 bp, Homo sapiens
gtttcacagatggtgttcatat

SEQ ID NO: 8332874 - DNA, 22 bp, Homo sapiens
taaagatcttaggaagattttc

SEQ ID NO: 8332875 - DNA, 22 bp, Homo sapiens
taaaacttaactatccagatta

SEQ ID NO: 8332876 - DNA, 22 bp, Homo sapiens
taaaagtatactttcaaaggag

SEQ ID NO: 8332877 - DNA, 22 bp, Homo sapiens
taagagaactggatagatagga

SEQ ID NO: 8332878 - DNA, 22 bp, Homo sapiens
taagacttcattagtaatatgg

SEQ ID NO: 8332879 - DNA, 22 bp, Homo sapiens
taagagaatgttgtggctaggt

SEQ ID NO: 8332880 - DNA, 22 bp, Homo sapiens
taacatgttaagaaattagata

SEQ ID NO: 8332881 - DNA, 22 bp, Homo sapiens
taatctgaagaaacaggacttg

SEQ ID NO: 8332882 - DNA, 22 bp, Homo sapiens
taatctactgtttatatgaaat

SEQ ID NO: 8332883 - DNA, 22 bp, Homo sapiens
taatctaccactattgcaatat

SEQ ID NO: 8332884 - DNA, 22 bp, Homo sapiens
taatatatttctgctaagctca

SEQ ID NO: 8332885 - DNA, 22 bp, Homo sapiens
taattccacctttttccaactt

SEQ ID NO: 8332886 - DNA, 22 bp, Homo sapiens
taatttacttgcaaataacaat

SEQ ID NO: 8332887 - DNA, 20 bp, Homo sapiens
tacagaatgcaataaaatgg

SEQ ID NO: 8332888 - DNA, 22 bp, Homo sapiens
tacagaattagattattagaga

SEQ ID NO: 8332889 - DNA, 22 bp, Homo sapiens
tacaagaaatttctgcatatat

SEQ ID NO: 8332890 - DNA, 22 bp, Homo sapiens
taatttcaagtttagggctcta

SEQ ID NO: 8332891 - DNA, 22 bp, Homo sapiens
taatttcaaatttcttagcgtg

SEQ ID NO: 8332892 - DNA, 22 bp, Homo sapiens
tacagagatactctagatcaaa

SEQ ID NO: 8332893 - DNA, 20 bp, Homo sapiens
tacagacatgacaataatgg

SEQ ID NO: 8332894 - DNA, 22 bp, Homo sapiens
tacagacagtttttcagatatt

SEQ ID NO: 8332895 - DNA, 22 bp, Homo sapiens
tacagtatgttcttgaatttgg

SEQ ID NO: 8332896 - DNA, 22 bp, Homo sapiens
tacatgaacctttatgtgtgat

SEQ ID NO: 8332897 - DNA, 22 bp, Homo sapiens
tacatgaagttgtctaaactgg

SEQ ID NO: 8332898 - DNA, 22 bp, Homo sapiens
tactagaacctcacaacaatcc

SEQ ID NO: 8332899 - DNA, 22 bp, Homo sapiens
tactataccatgtaagatatga

SEQ ID NO: 8332900 - DNA, 22 bp, Homo sapiens
tactgaaaagccacaaggacca

SEQ ID NO: 8332901 - DNA, 23 bp, Homo sapiens
tattacaattggtcttattaaga

SEQ ID NO: 8332902 - DNA, 22 bp, Homo sapiens
tattacaatttacattgcactt

SEQ ID NO: 8332903 - DNA, 22 bp, Homo sapiens
tatggcttttcattcctatgtg

SEQ ID NO: 8332904 - DNA, 22 bp, Homo sapiens
tatggctttttattcatcttac

SEQ ID NO: 8332905 - DNA, 22 bp, Homo sapiens
tatggctttaaacaacttaggt

SEQ ID NO: 8332906 - DNA, 22 bp, Homo sapiens
tatggcttgtctttataccagg

SEQ ID NO: 8332907 - DNA, 20 bp, Homo sapiens
tatggcttggcaaagcttca

SEQ ID NO: 8332908 - DNA, 22 bp, Homo sapiens
tatggcttttaactgtcgtatg

SEQ ID NO: 8332909 - DNA, 22 bp, Homo sapiens
tatgtcaaagttaagaaatagg

SEQ ID NO: 8332910 - DNA, 22 bp, Homo sapiens
tatcagaaatgccttaaattgg

SEQ ID NO: 8332911 - DNA, 22 bp, Homo sapiens
tatcagaaatcaacacacagtg

SEQ ID NO: 8332912 - DNA, 22 bp, Homo sapiens
tatcagaacacatgttttgcag

SEQ ID NO: 8332913 - DNA, 22 bp, Homo sapiens
tatcagaacacagccacagcca

SEQ ID NO: 8332914 - DNA, 22 bp, Homo sapiens
tatcagaaagatattactgggg

SEQ ID NO: 8332915 - DNA, 22 bp, Homo sapiens
tatcagaaactctggggcaggg

SEQ ID NO: 8332916 - DNA, 21 bp, Homo sapiens
tatcagaagagaaagaatgat

SEQ ID NO: 8332917 - DNA, 22 bp, Homo sapiens
tatcagaagacttacagtatcg

SEQ ID NO: 8332918 - DNA, 22 bp, Homo sapiens
tatcagaaggaagtgcctttaa

SEQ ID NO: 8332919 - DNA, 22 bp, Homo sapiens
tatcagaaggcacatggagtct

SEQ ID NO: 8332920 - DNA, 17 bp, Homo sapiens
tatcagaatgtgtttac

SEQ ID NO: 8332921 - DNA, 22 bp, Homo sapiens
tatcagaatgcagccatgtgca

SEQ ID NO: 8332922 - DNA, 22 bp, Homo sapiens
tataaaatggcatcagctccaa

SEQ ID NO: 8332923 - DNA, 22 bp, Homo sapiens
tataaaattctcagtttggggt

SEQ ID NO: 8332924 - DNA, 22 bp, Homo sapiens
tatgaaaaggtggccaatgtag

SEQ ID NO: 8332925 - DNA, 22 bp, Homo sapiens
tatgaaaatttagctgaagcat

SEQ ID NO: 8332926 - DNA, 22 bp, Homo sapiens
tatccaaacatatagtctctct

SEQ ID NO: 8332927 - DNA, 22 bp, Homo sapiens
tatccaaaggaacaatcacagc

SEQ ID NO: 8332928 - DNA, 22 bp, Homo sapiens
taggcagaattgttgaatgaag

SEQ ID NO: 8332929 - DNA, 22 bp, Homo sapiens
tagatataaggtccttagaaca

SEQ ID NO: 8332930 - DNA, 22 bp, Homo sapiens
tagatatatctgtcatactggt

SEQ ID NO: 8332931 - DNA, 22 bp, Homo sapiens
tagaactacaagcattaaaagt

SEQ ID NO: 8332932 - DNA, 22 bp, Homo sapiens
tcaactttagtgtagctattta

SEQ ID NO: 8332933 - DNA, 22 bp, Homo sapiens
tcaactttgaaaccatagtgaa

SEQ ID NO: 8332934 - DNA, 22 bp, Homo sapiens
tcacataaattatacaatttca

SEQ ID NO: 8332935 - DNA, 22 bp, Homo sapiens
tcagaaaataactgttagtttg

SEQ ID NO: 8332936 - DNA, 22 bp, Homo sapiens
tcagaatatgctaatgacattt

SEQ ID NO: 8332937 - DNA, 22 bp, Homo sapiens
tcagcatatcttgagcttcatg

SEQ ID NO: 8332938 - DNA, 22 bp, Homo sapiens
tcagccagaggcttcttggttt

SEQ ID NO: 8332939 - DNA, 22 bp, Homo sapiens
tcagccagcatcagctaagtgc

SEQ ID NO: 8332940 - DNA, 22 bp, Homo sapiens
tcagccaggccaccttcagctt

SEQ ID NO: 8332941 - DNA, 22 bp, Homo sapiens
tcagaatttgattcctgggata

SEQ ID NO: 8332942 - DNA, 22 bp, Homo sapiens
tcagaattttggtttggttggt

SEQ ID NO: 8332943 - DNA, 22 bp, Homo sapiens
tcagaatttttgttacccttga

SEQ ID NO: 8332944 - DNA, 22 bp, Homo sapiens
tcagaattgtctggggaatgtt

SEQ ID NO: 8332945 - DNA, 22 bp, Homo sapiens
tcagaattgcagggagggcagg

SEQ ID NO: 8332946 - DNA, 22 bp, Homo sapiens
tcagaattcagagggagtgggg

SEQ ID NO: 8332947 - DNA, 22 bp, Homo sapiens
tcagaattagagctcttcttga

SEQ ID NO: 8332948 - DNA, 22 bp, Homo sapiens
tcagaattctacaatagatcag

SEQ ID NO: 8332949 - DNA, 22 bp, Homo sapiens
tcagaattctgaccttgggtca

SEQ ID NO: 8332950 - DNA, 21 bp, Homo sapiens
tcagtaaacctaaagattgta

SEQ ID NO: 8332951 - DNA, 22 bp, Homo sapiens
tcagtaaacaggtttaagtcct

SEQ ID NO: 8332952 - DNA, 22 bp, Homo sapiens
tcagtaaagttctttcttgctg

SEQ ID NO: 8332953 - DNA, 22 bp, Homo sapiens
tcagtaaatggttgctgttatt

SEQ ID NO: 8332954 - DNA, 22 bp, Homo sapiens
tcagtaaatgagcaaaaatttc

SEQ ID NO: 8332955 - DNA, 22 bp, Homo sapiens
tcagtaaatgaatgaatatatg

SEQ ID NO: 8332956 - DNA, 22 bp, Homo sapiens
tcatagaagcaccagaagatat

SEQ ID NO: 8332957 - DNA, 18 bp, Homo sapiens
tcatagaagtgaatcaga

SEQ ID NO: 8332958 - DNA, 22 bp, Homo sapiens
tcatagaatgagttaatgaact

SEQ ID NO: 8332959 - DNA, 21 bp, Homo sapiens
tccaaaaaggagcgtccttct

SEQ ID NO: 8332960 - DNA, 22 bp, Homo sapiens
tccaaaaaacgtttgaatagtt

SEQ ID NO: 8332961 - DNA, 22 bp, Homo sapiens
tccaaatacatttactgtattt

SEQ ID NO: 8332962 - DNA, 22 bp, Homo sapiens
tccaaagtgttgggattatagg

SEQ ID NO: 8332963 - DNA, 22 bp, Homo sapiens
tccaatatggataaaaggggcc

SEQ ID NO: 8332964 - DNA, 22 bp, Homo sapiens
gctttaatgaagtcacgcaaag

SEQ ID NO: 8332965 - DNA, 22 bp, Homo sapiens
gctttaatgcaatttcacctca

SEQ ID NO: 8332966 - DNA, 22 bp, Homo sapiens
gctttaatgcttcgtggggcca

SEQ ID NO: 8332967 - DNA, 22 bp, Homo sapiens
gcttttattgtctttacgacga

SEQ ID NO: 8332968 - DNA, 22 bp, Homo sapiens
gctgcaggcattttcctgggca

SEQ ID NO: 8332969 - DNA, 22 bp, Homo sapiens
gctggatcatatggtggttcta

SEQ ID NO: 8332970 - DNA, 22 bp, Homo sapiens
gctggatcaagtccttcaccca

SEQ ID NO: 8332971 - DNA, 22 bp, Homo sapiens
gctggatcctgattcgtctttg

SEQ ID NO: 8332972 - DNA, 22 bp, Homo sapiens
gctggatccctgtgggagtggt

SEQ ID NO: 8332973 - DNA, 22 bp, Homo sapiens
gctggatccacaaataactttg

SEQ ID NO: 8332974 - DNA, 22 bp, Homo sapiens
gctatacaagtgtagaatagag

SEQ ID NO: 8332975 - DNA, 22 bp, Homo sapiens
gctatacacatttcttggtagt

SEQ ID NO: 8332976 - DNA, 22 bp, Homo sapiens
gctagatctctcataaattcca

SEQ ID NO: 8332977 - DNA, 22 bp, Homo sapiens
ggtttaatggagatatttcaga

SEQ ID NO: 8332978 - DNA, 22 bp, Homo sapiens
gtacaatagtccctgtttggat

SEQ ID NO: 8332979 - DNA, 22 bp, Homo sapiens
gtatacagatacttagacgtgc

SEQ ID NO: 8332980 - DNA, 22 bp, Homo sapiens
gtctaacaagcattaggaaccc

SEQ ID NO: 8332981 - DNA, 22 bp, Homo sapiens
ttatagtgggcccaacatggcg

SEQ ID NO: 8332982 - DNA, 22 bp, Homo sapiens
ttatagaacagcctcctctaga

SEQ ID NO: 8332983 - DNA, 22 bp, Homo sapiens
ttatactttatactacatcatt

SEQ ID NO: 8332984 - DNA, 22 bp, Homo sapiens
ttatacagtttatacttagaat

SEQ ID NO: 8332985 - DNA, 22 bp, Homo sapiens
ttattaatgagtacaagttatt

SEQ ID NO: 8332986 - DNA, 22 bp, Homo sapiens
ttcataatcaccaaaaactgga

SEQ ID NO: 8332987 - DNA, 21 bp, Homo sapiens
ttcaaagacttgatgctgacc

SEQ ID NO: 8332988 - DNA, 22 bp, Homo sapiens
ttcacagatttccctgcacatg

SEQ ID NO: 8332989 - DNA, 22 bp, Homo sapiens
ttcacagagagaactcaaacca

SEQ ID NO: 8332990 - DNA, 22 bp, Homo sapiens
ttcacagagttatttttatgct

SEQ ID NO: 8332991 - DNA, 22 bp, Homo sapiens
ttgaagaaagtcatatataatg

SEQ ID NO: 8332992 - DNA, 22 bp, Homo sapiens
tttatccatatcattaaaatct

SEQ ID NO: 8332993 - DNA, 22 bp, Homo sapiens
tttatccagcagctattcaaaa

SEQ ID NO: 8332994 - DNA, 22 bp, Homo sapiens
tttatccagtgttggaattttt

SEQ ID NO: 8332995 - DNA, 22 bp, Homo sapiens
tttatccaccttaccctgttcc

SEQ ID NO: 8332996 - DNA, 22 bp, Homo sapiens
tttatccagaatcaggattttt

SEQ ID NO: 8332997 - DNA, 22 bp, Homo sapiens
tttatccaagggttttaactgt

SEQ ID NO: 8332998 - DNA, 22 bp, Homo sapiens
tttaatgatagctgtttcacat

SEQ ID NO: 8332999 - DNA, 22 bp, Homo sapiens
tttaatgaataattcaaatctg

SEQ ID NO: 8333000 - DNA, 22 bp, Homo sapiens
tttaaagaaattcctcatcttt

SEQ ID NO: 8333001 - DNA, 22 bp, Homo sapiens
tttaaagagaatgtgaaggagt

SEQ ID NO: 8333002 - DNA, 21 bp, Homo sapiens
tttaaagaataggaagggagg

SEQ ID NO: 8333003 - DNA, 22 bp, Homo sapiens
tttcaacttgtttgcttccata

SEQ ID NO: 8333004 - DNA, 22 bp, Homo sapiens
tttcaagaacaacattcattca

SEQ ID NO: 8333005 - DNA, 22 bp, Homo sapiens
tttcaacgtgtaatcttattta

SEQ ID NO: 8333006 - DNA, 22 bp, Homo sapiens
tttcaactagcccctaagtcct

SEQ ID NO: 8333007 - DNA, 22 bp, Homo sapiens
tttcaacttgaagaattgatac

SEQ ID NO: 8333008 - DNA, 22 bp, Homo sapiens
tttcaacatataccataatgcc

SEQ ID NO: 8333009 - DNA, 22 bp, Homo sapiens
tttcacacaacgtgaatatact

SEQ ID NO: 8333010 - DNA, 21 bp, Homo sapiens
tttcagacctatctttgaagg

SEQ ID NO: 8333011 - DNA, 22 bp, Homo sapiens
tttcagacagattcttctcagt

SEQ ID NO: 8333012 - DNA, 22 bp, Homo sapiens
tttcagacaggacttcatatgt

SEQ ID NO: 8333013 - DNA, 19 bp, Homo sapiens
tttcagactcatctccagc

SEQ ID NO: 8333014 - DNA, 22 bp, Homo sapiens
ttgtccaaagtaacacatctag

SEQ ID NO: 8333015 - DNA, 22 bp, Homo sapiens
ttttatgtgctggactggcagt

SEQ ID NO: 8333016 - DNA, 22 bp, Homo sapiens
ttttatgttcctctttatgcga

SEQ ID NO: 8333017 - DNA, 21 bp, Homo sapiens
ttttattgatgaatggccact

SEQ ID NO: 8333018 - DNA, 22 bp, Homo sapiens
ttttcatttttgtagatgcaag

SEQ ID NO: 8333019 - DNA, 22 bp, Homo sapiens
ttttccaaagtaccatgtccct

SEQ ID NO: 8333020 - DNA, 22 bp, Homo sapiens
ttttcttaggtgctccaagtag

SEQ ID NO: 8333021 - DNA, 22 bp, Homo sapiens
tttggtcctgagcaaaactatg

SEQ ID NO: 8333022 - DNA, 22 bp, Homo sapiens
tttgaatagcataggattacat

SEQ ID NO: 8333023 - DNA, 22 bp, Homo sapiens
tttgaagattatgccagagtga

SEQ ID NO: 8333024 - DNA, 22 bp, Homo sapiens
tttgaagataaatatggagaaa

SEQ ID NO: 8333025 - DNA, 22 bp, Homo sapiens
tttgaatatcacaaactttcaa

SEQ ID NO: 8333026 - DNA, 22 bp, Homo sapiens
aagtccattcttccagccagct

SEQ ID NO: 8333027 - DNA, 22 bp, Homo sapiens
aagtccatgatcaagatgtggc

SEQ ID NO: 8333028 - DNA, 22 bp, Homo sapiens
aagtccttggagaatagaaagg

SEQ ID NO: 8333029 - DNA, 22 bp, Homo sapiens
aagtccttgtatacagaatcaa

SEQ ID NO: 8333030 - DNA, 22 bp, Homo sapiens
aagtccttaggaagcagtcgtt

SEQ ID NO: 8333031 - DNA, 22 bp, Homo sapiens
aagtccttcccaagcatgtacc

SEQ ID NO: 8333032 - DNA, 22 bp, Homo sapiens
aagtccttatgtggaggggcta

SEQ ID NO: 8333033 - DNA, 22 bp, Homo sapiens
aagtccttctttatatgagagt

SEQ ID NO: 8333034 - DNA, 22 bp, Homo sapiens
aagtccttgaagaaacagttct

SEQ ID NO: 8333035 - DNA, 18 bp, Homo sapiens
aagtccttcctttgcttt

SEQ ID NO: 8333036 - DNA, 23 bp, Homo sapiens
aatctatacttaggctggtaata

SEQ ID NO: 8333037 - DNA, 22 bp, Homo sapiens
aatgccaacttggatatacatt

SEQ ID NO: 8333038 - DNA, 22 bp, Homo sapiens
aatctagtctccttaagtcttt

SEQ ID NO: 8333039 - DNA, 22 bp, Homo sapiens
actttgaaggggaacattttaa

SEQ ID NO: 8333040 - DNA, 22 bp, Homo sapiens
actttgaatctcagataaccaa

SEQ ID NO: 8333041 - DNA, 22 bp, Homo sapiens
aatcaagtcaaccatcatgtgc

SEQ ID NO: 8333042 - DNA, 22 bp, Homo sapiens
aataataagatactaagggagt

SEQ ID NO: 8333043 - DNA, 22 bp, Homo sapiens
aataaaatgaactggtagagtt

SEQ ID NO: 8333044 - DNA, 19 bp, Homo sapiens
actgtaaggcatttttttc

SEQ ID NO: 8333045 - DNA, 22 bp, Homo sapiens
acacaatacagggctcaaaata

SEQ ID NO: 8333046 - DNA, 22 bp, Homo sapiens
acagaatgggatttgaatattt

SEQ ID NO: 8333047 - DNA, 22 bp, Homo sapiens
acagaagttggaattagatact

SEQ ID NO: 8333048 - DNA, 22 bp, Homo sapiens
acaaagtcaaattgcagccgcc

SEQ ID NO: 8333049 - DNA, 22 bp, Homo sapiens
acaaagtcacaataattaacct

SEQ ID NO: 8333050 - DNA, 22 bp, Homo sapiens
acaaagtcctggtgtatggcca

SEQ ID NO: 8333051 - DNA, 22 bp, Homo sapiens
agagtgaagtttttgaaagtga

SEQ ID NO: 8333052 - DNA, 20 bp, Homo sapiens
acaatacaggttgtgtctga

SEQ ID NO: 8333053 - DNA, 19 bp, Homo sapiens
agcaaatacatcaaaattg

SEQ ID NO: 8333054 - DNA, 22 bp, Homo sapiens
agcacaatagagcagttaaaaa

SEQ ID NO: 8333055 - DNA, 22 bp, Homo sapiens
aattaatggaaagtaaggaagg

SEQ ID NO: 8333056 - DNA, 22 bp, Homo sapiens
aattccaaatgttttcaatcca

SEQ ID NO: 8333057 - DNA, 22 bp, Homo sapiens
aattccaagtagcatcccatca

SEQ ID NO: 8333058 - DNA, 22 bp, Homo sapiens
aattccagaggaggacagtcct

SEQ ID NO: 8333059 - DNA, 22 bp, Homo sapiens
aattccagctaggaaaagcttc

SEQ ID NO: 8333060 - DNA, 18 bp, Homo sapiens
aatttccatatgaattgc

SEQ ID NO: 8333061 - DNA, 22 bp, Homo sapiens
aatttcaattacttttgcacca

SEQ ID NO: 8333062 - DNA, 22 bp, Homo sapiens
acagaaataactttttatgttt

SEQ ID NO: 8333063 - DNA, 22 bp, Homo sapiens
acagccaggaggaactcagtga

SEQ ID NO: 8333064 - DNA, 22 bp, Homo sapiens
aagcagggctttaagcggtttt

SEQ ID NO: 8333065 - DNA, 22 bp, Homo sapiens
acaaaaagggagatgaggtaga

SEQ ID NO: 8333066 - DNA, 22 bp, Homo sapiens
acaacaaaatcactagtcttcc

SEQ ID NO: 8333067 - DNA, 22 bp, Homo sapiens
acaatattgtacccagaagttt

SEQ ID NO: 8333068 - DNA, 22 bp, Homo sapiens
aatgtaaacagcaagagaaggg

SEQ ID NO: 8333069 - DNA, 22 bp, Homo sapiens
aatgaaactgtatatagactgt

SEQ ID NO: 8333070 - DNA, 22 bp, Homo sapiens
aataatgtctttggcttgacca

SEQ ID NO: 8333071 - DNA, 22 bp, Homo sapiens
aataatatttgaagcttcaaag

SEQ ID NO: 8333072 - DNA, 22 bp, Homo sapiens
aagttacacattttcattgtaa

SEQ ID NO: 8333073 - DNA, 22 bp, Homo sapiens
aatatttctgcagaatggtttt

SEQ ID NO: 8333074 - DNA, 22 bp, Homo sapiens
aaatggatctgtggaatacatt

SEQ ID NO: 8333075 - DNA, 21 bp, Homo sapiens
aaatggatagggcaatggaag

SEQ ID NO: 8333076 - DNA, 22 bp, Homo sapiens
aaatggatggaaagcaattttt

SEQ ID NO: 8333077 - DNA, 22 bp, Homo sapiens
aaagtcatcagaaccttccaga

SEQ ID NO: 8333078 - DNA, 22 bp, Homo sapiens
aaaatctgcttccttttacaga

SEQ ID NO: 8333079 - DNA, 22 bp, Homo sapiens
aaaagccaaggtcctcttcaga

SEQ ID NO: 8333080 - DNA, 22 bp, Homo sapiens
aaaagccatgcatacctaagag

SEQ ID NO: 8333081 - DNA, 22 bp, Homo sapiens
aaaacatgtccatacagaaact

SEQ ID NO: 8333082 - DNA, 22 bp, Homo sapiens
aaaaattgctgagaacggaatt

SEQ ID NO: 8333083 - DNA, 22 bp, Homo sapiens
aaagtcctgttaactgttaaca

SEQ ID NO: 8333084 - DNA, 22 bp, Homo sapiens
aaagtcctgtttgaaggacctg

SEQ ID NO: 8333085 - DNA, 22 bp, Homo sapiens
aaagtccttgcagtttcctctt

SEQ ID NO: 8333086 - DNA, 22 bp, Homo sapiens
aaagtcctgactgcaggggatg

SEQ ID NO: 8333087 - DNA, 22 bp, Homo sapiens
aaagtcctttttgccatgcaag

SEQ ID NO: 8333088 - DNA, 22 bp, Homo sapiens
aaagtcctagcgatccacagaa

SEQ ID NO: 8333089 - DNA, 22 bp, Homo sapiens
aaagtccagagggcacactgaa

SEQ ID NO: 8333090 - DNA, 22 bp, Homo sapiens
aaattccagaaactcagtatat

SEQ ID NO: 8333091 - DNA, 22 bp, Homo sapiens
aaagcaggttgcaattacagtg

SEQ ID NO: 8333092 - DNA, 22 bp, Homo sapiens
aaagcagtatattggtagttgt

SEQ ID NO: 8333093 - DNA, 22 bp, Homo sapiens
aaagcagtcactccagtgtgat

SEQ ID NO: 8333094 - DNA, 22 bp, Homo sapiens
aaatatagcaattatgcctact

SEQ ID NO: 8333095 - DNA, 22 bp, Homo sapiens
aaatatagtaaatgcatagttc

SEQ ID NO: 8333096 - DNA, 22 bp, Homo sapiens
aaatgaaatgagtgcctggagg

SEQ ID NO: 8333097 - DNA, 20 bp, Homo sapiens
attctacaagaataagcatg

SEQ ID NO: 8333098 - DNA, 22 bp, Homo sapiens
attctacaacccaataataatt

SEQ ID NO: 8333099 - DNA, 22 bp, Homo sapiens
attctaacacatgctctaagaa

SEQ ID NO: 8333100 - DNA, 22 bp, Homo sapiens
attgaaaataaggccagaaaca

SEQ ID NO: 8333101 - DNA, 22 bp, Homo sapiens
agattctactctagatccatgg

SEQ ID NO: 8333102 - DNA, 22 bp, Homo sapiens
agatttactgagaactgattac

SEQ ID NO: 8333103 - DNA, 22 bp, Homo sapiens
agatttactggagtctttggtg

SEQ ID NO: 8333104 - DNA, 19 bp, Homo sapiens
agatttacctcatatagtt

SEQ ID NO: 8333105 - DNA, 22 bp, Homo sapiens
atgttcaaacaagttaatgcca

SEQ ID NO: 8333106 - DNA, 22 bp, Homo sapiens
atgttcaaactttttacacacc

SEQ ID NO: 8333107 - DNA, 22 bp, Homo sapiens
agagattcatgtttactgtagg

SEQ ID NO: 8333108 - DNA, 22 bp, Homo sapiens
atgttacacataggcataaatg

SEQ ID NO: 8333109 - DNA, 22 bp, Homo sapiens
atgcttaatgagggtatatatg

SEQ ID NO: 8333110 - DNA, 22 bp, Homo sapiens
atgctgaattgatgcgagggag

SEQ ID NO: 8333111 - DNA, 22 bp, Homo sapiens
agccaactaggagattaaggta

SEQ ID NO: 8333112 - DNA, 22 bp, Homo sapiens
cagatctagagcttttccatct

SEQ ID NO: 8333113 - DNA, 22 bp, Homo sapiens
cagatctgtagtaaaagatctc

SEQ ID NO: 8333114 - DNA, 22 bp, Homo sapiens
cagatctgtttgccagatcagc

SEQ ID NO: 8333115 - DNA, 22 bp, Homo sapiens
cagatattaggagctcaataat

SEQ ID NO: 8333116 - DNA, 22 bp, Homo sapiens
caagtcctctggtttcaaatag

SEQ ID NO: 8333117 - DNA, 22 bp, Homo sapiens
caagtccttagatggttctttg

SEQ ID NO: 8333118 - DNA, 21 bp, Homo sapiens
caagtcctttgccaaagtgct

SEQ ID NO: 8333119 - DNA, 22 bp, Homo sapiens
caagtcctcgcttctagctgtg

SEQ ID NO: 8333120 - DNA, 22 bp, Homo sapiens
caagtcctcaaagggctctgct

SEQ ID NO: 8333121 - DNA, 22 bp, Homo sapiens
caagtcctccatgtgactaggt

SEQ ID NO: 8333122 - DNA, 22 bp, Homo sapiens
caagtcctaggtctgattgaac

SEQ ID NO: 8333123 - DNA, 22 bp, Homo sapiens
caagtccttttcttggctcagg

SEQ ID NO: 8333124 - DNA, 22 bp, Homo sapiens
caagtccaggtcaatttaaagc

SEQ ID NO: 8333125 - DNA, 22 bp, Homo sapiens
caagtccatcagataagcaaga

SEQ ID NO: 8333126 - DNA, 22 bp, Homo sapiens
caagtcctaaatgtatttgttg

SEQ ID NO: 8333127 - DNA, 22 bp, Homo sapiens
caatttttaaactatgaagttg

SEQ ID NO: 8333128 - DNA, 22 bp, Homo sapiens
cacactttgtgctaatctattt

SEQ ID NO: 8333129 - DNA, 22 bp, Homo sapiens
cagaaacatgtataaagttgta

SEQ ID NO: 8333130 - DNA, 22 bp, Homo sapiens
agccaactaattaaacaacttt

SEQ ID NO: 8333131 - DNA, 22 bp, Homo sapiens
agcatttagtctttattgcagc

SEQ ID NO: 8333132 - DNA, 22 bp, Homo sapiens
agaaatgctcaggtcaacttaa

SEQ ID NO: 8333133 - DNA, 22 bp, Homo sapiens
agaaatcaatatctatatgttg

SEQ ID NO: 8333134 - DNA, 20 bp, Homo sapiens
agaaatcagaccacacacta

SEQ ID NO: 8333135 - DNA, 22 bp, Homo sapiens
atattaaatggattttgggagc

SEQ ID NO: 8333136 - DNA, 22 bp, Homo sapiens
atataggctaacaactattgag

SEQ ID NO: 8333137 - DNA, 22 bp, Homo sapiens
agttcacatatctgttttattt

SEQ ID NO: 8333138 - DNA, 22 bp, Homo sapiens
agttcacagccatgttcatgtg

SEQ ID NO: 8333139 - DNA, 22 bp, Homo sapiens
atagctttacagaagagtttag

SEQ ID NO: 8333140 - DNA, 22 bp, Homo sapiens
atagctttcttaaatatataaa

SEQ ID NO: 8333141 - DNA, 20 bp, Homo sapiens
agaaaaagtgtggaaatttc

SEQ ID NO: 8333142 - DNA, 22 bp, Homo sapiens
agaaaagaggctttctaagcat

SEQ ID NO: 8333143 - DNA, 22 bp, Homo sapiens
atagaaatgtattttggactag

SEQ ID NO: 8333144 - DNA, 21 bp, Homo sapiens
atagaacaccaggcatatata

SEQ ID NO: 8333145 - DNA, 22 bp, Homo sapiens
actttagaccatcttccacagt

SEQ ID NO: 8333146 - DNA, 22 bp, Homo sapiens
agtccttatgagatgctgcctt

SEQ ID NO: 8333147 - DNA, 22 bp, Homo sapiens
agtccttagaacagtgcctggg

SEQ ID NO: 8333148 - DNA, 22 bp, Homo sapiens
agtccttagaacactgtatctg

SEQ ID NO: 8333149 - DNA, 22 bp, Homo sapiens
agtccttatgtggtggagagag

SEQ ID NO: 8333150 - DNA, 22 bp, Homo sapiens
agtccttacacctggaacctat

SEQ ID NO: 8333151 - DNA, 22 bp, Homo sapiens
agtccttactcgggggcccaga

SEQ ID NO: 8333152 - DNA, 18 bp, Homo sapiens
agtccttacgaggctata

SEQ ID NO: 8333153 - DNA, 22 bp, Homo sapiens
agttacagtgaccatttattta

SEQ ID NO: 8333154 - DNA, 21 bp, Homo sapiens
acatgtctggtcatttttagc

SEQ ID NO: 8333155 - DNA, 22 bp, Homo sapiens
acatgtctgtaattattttagg

SEQ ID NO: 8333156 - DNA, 22 bp, Homo sapiens
acatgtcttttaaagtctaata

SEQ ID NO: 8333157 - DNA, 22 bp, Homo sapiens
acaggattagcaagtaatcagg

SEQ ID NO: 8333158 - DNA, 22 bp, Homo sapiens
acagcattgctccatctcaaga

SEQ ID NO: 8333159 - DNA, 22 bp, Homo sapiens
acagcattgagagctaaattta

SEQ ID NO: 8333160 - DNA, 22 bp, Homo sapiens
acagcattcaataaataataac

SEQ ID NO: 8333161 - DNA, 22 bp, Homo sapiens
aggcagaccatgaatcatgacc

SEQ ID NO: 8333162 - DNA, 22 bp, Homo sapiens
acatctgaccattacaagacat

SEQ ID NO: 8333163 - DNA, 22 bp, Homo sapiens
cagtaaatacatatcagagaag

SEQ ID NO: 8333164 - DNA, 22 bp, Homo sapiens
cagtaaatttgagggatctaat

SEQ ID NO: 8333165 - DNA, 22 bp, Homo sapiens
cagtaaattatctcatctctgt

SEQ ID NO: 8333166 - DNA, 22 bp, Homo sapiens
cagtaaatgcagatatagatac

SEQ ID NO: 8333167 - DNA, 22 bp, Homo sapiens
cagtatctgtcagtaatcaggt

SEQ ID NO: 8333168 - DNA, 22 bp, Homo sapiens
cagtccagccccctgctaaaag

SEQ ID NO: 8333169 - DNA, 23 bp, Homo sapiens
catttcaacgaattttccttctg

SEQ ID NO: 8333170 - DNA, 21 bp, Homo sapiens
catttcaaagagctggaaatc

SEQ ID NO: 8333171 - DNA, 22 bp, Homo sapiens
catttcaagtaacagattgctt

SEQ ID NO: 8333172 - DNA, 22 bp, Homo sapiens
catttcaagcattgacttctat

SEQ ID NO: 8333173 - DNA, 22 bp, Homo sapiens
catttcaaggaccaccctggga

SEQ ID NO: 8333174 - DNA, 22 bp, Homo sapiens
catttcaaacagttacagctgc

SEQ ID NO: 8333175 - DNA, 22 bp, Homo sapiens
catttcaaaagaattgccagaa

SEQ ID NO: 8333176 - DNA, 22 bp, Homo sapiens
catttcaatgccttcaacatag

SEQ ID NO: 8333177 - DNA, 22 bp, Homo sapiens
catttcaattatttgctcttct

SEQ ID NO: 8333178 - DNA, 22 bp, Homo sapiens
catttcaatacagtttgtaaat

SEQ ID NO: 8333179 - DNA, 22 bp, Homo sapiens
catttcaatactatctgagaat

SEQ ID NO: 8333180 - DNA, 22 bp, Homo sapiens
aggcaactgtttgataatgttg

SEQ ID NO: 8333181 - DNA, 22 bp, Homo sapiens
ccagtactgtctccaatattcc

SEQ ID NO: 8333182 - DNA, 22 bp, Homo sapiens
atacataattacttccgatgtt

SEQ ID NO: 8333183 - DNA, 22 bp, Homo sapiens
agttatccgaaggcactgagat

SEQ ID NO: 8333184 - DNA, 22 bp, Homo sapiens
ataacatgacctgtgcttcaca

SEQ ID NO: 8333185 - DNA, 22 bp, Homo sapiens
ataacatgagccagattgaaag

SEQ ID NO: 8333186 - DNA, 22 bp, Homo sapiens
ataaatgcctcagaatcatccc

SEQ ID NO: 8333187 - DNA, 22 bp, Homo sapiens
atacaaatttatagatgcattt

SEQ ID NO: 8333188 - DNA, 22 bp, Homo sapiens
atcagaaaatacccagtgttta

SEQ ID NO: 8333189 - DNA, 22 bp, Homo sapiens
atcagaaaaacataatgttatt

SEQ ID NO: 8333190 - DNA, 22 bp, Homo sapiens
atcagaaaggtgggcaagcaga

SEQ ID NO: 8333191 - DNA, 22 bp, Homo sapiens
atcagaaatagtcatgttactt

SEQ ID NO: 8333192 - DNA, 22 bp, Homo sapiens
atcagaaagttcatcatgtttg

SEQ ID NO: 8333193 - DNA, 22 bp, Homo sapiens
atcagaaattgctaccagtgga

SEQ ID NO: 8333194 - DNA, 22 bp, Homo sapiens
atcagaaattgcccagctgttt

SEQ ID NO: 8333195 - DNA, 22 bp, Homo sapiens
atcagaaatctaggattcagaa

SEQ ID NO: 8333196 - DNA, 22 bp, Homo sapiens
atcagaataattagatttcaga

SEQ ID NO: 8333197 - DNA, 22 bp, Homo sapiens
atctgacttcacgcccatgcca

SEQ ID NO: 8333198 - DNA, 19 bp, Homo sapiens
atctgagattataaacaga

SEQ ID NO: 8333199 - DNA, 22 bp, Homo sapiens
cctggatcagagccagagaagc

SEQ ID NO: 8333200 - DNA, 22 bp, Homo sapiens
cctggatccatgaaaaggctac

SEQ ID NO: 8333201 - DNA, 22 bp, Homo sapiens
cctggatcagtcactgttgctg

SEQ ID NO: 8333202 - DNA, 22 bp, Homo sapiens
cctggatctttgttgtaaatat

SEQ ID NO: 8333203 - DNA, 22 bp, Homo sapiens
cctggatctttctgactgacaa

SEQ ID NO: 8333204 - DNA, 22 bp, Homo sapiens
cctggatctcctctattcatat

SEQ ID NO: 8333205 - DNA, 22 bp, Homo sapiens
cctggatcgatgccgagggaaa

SEQ ID NO: 8333206 - DNA, 22 bp, Homo sapiens
cctggatctaaggaagctggga

SEQ ID NO: 8333207 - DNA, 22 bp, Homo sapiens
cctggatcccgatggctgtgag

SEQ ID NO: 8333208 - DNA, 16 bp, Homo sapiens
cctggatcccctgtgg

SEQ ID NO: 8333209 - DNA, 22 bp, Homo sapiens
ctagaaatctctgtttacatca

SEQ ID NO: 8333210 - DNA, 22 bp, Homo sapiens
ctagaaatgctcaagagaaagt

SEQ ID NO: 8333211 - DNA, 22 bp, Homo sapiens
ctagaaatgtagattcttagtg

SEQ ID NO: 8333212 - DNA, 22 bp, Homo sapiens
ctagaaattctgattcagtagg

SEQ ID NO: 8333213 - DNA, 22 bp, Homo sapiens
ctagaaatattttacagtcaag

SEQ ID NO: 8333214 - DNA, 22 bp, Homo sapiens
ctacagaattcaacaaatggtt

SEQ ID NO: 8333215 - DNA, 22 bp, Homo sapiens
ctacagaatggagggtcagaga

SEQ ID NO: 8333216 - DNA, 22 bp, Homo sapiens
ctacagaatctacctcaagcca

SEQ ID NO: 8333217 - DNA, 22 bp, Homo sapiens
agtatttagcatagtggttagt

SEQ ID NO: 8333218 - DNA, 22 bp, Homo sapiens
agtccagtgaactgtaaatagg

SEQ ID NO: 8333219 - DNA, 22 bp, Homo sapiens
agtacaacattagagtatctta

SEQ ID NO: 8333220 - DNA, 20 bp, Homo sapiens
agtacaatgtatgattcaga

SEQ ID NO: 8333221 - DNA, 23 bp, Homo sapiens
agtacaataagtataattctttc

SEQ ID NO: 8333222 - DNA, 22 bp, Homo sapiens
agtacaatgtctgacacagtag

SEQ ID NO: 8333223 - DNA, 22 bp, Homo sapiens
agtacaattatatttagatggt

SEQ ID NO: 8333224 - DNA, 22 bp, Homo sapiens
agtacaatttaatgaagatagc

SEQ ID NO: 8333225 - DNA, 22 bp, Homo sapiens
caatgtcatgattttccattag

SEQ ID NO: 8333226 - DNA, 21 bp, Homo sapiens
caagccagaccaatagcagcc

SEQ ID NO: 8333227 - DNA, 22 bp, Homo sapiens
cacatacttgtgtgtacatatg

SEQ ID NO: 8333228 - DNA, 22 bp, Homo sapiens
ggcatttatttgtctcattctt

SEQ ID NO: 8333229 - DNA, 22 bp, Homo sapiens
ggcatttatctaatatagttta

SEQ ID NO: 8333230 - DNA, 22 bp, Homo sapiens
ggcatttagttttcatattctg

SEQ ID NO: 8333231 - DNA, 22 bp, Homo sapiens
ggcatttagattgaatttctgt

SEQ ID NO: 8333232 - DNA, 22 bp, Homo sapiens
ggcatttagagggcttttctga

SEQ ID NO: 8333233 - DNA, 22 bp, Homo sapiens
ggcatttacataatcttattta

SEQ ID NO: 8333234 - DNA, 22 bp, Homo sapiens
ggcatttaatccatctgattga

SEQ ID NO: 8333235 - DNA, 22 bp, Homo sapiens
cagaaaaggaagagctatgtaa

SEQ ID NO: 8333236 - DNA, 22 bp, Homo sapiens
cagaaagcttaggcaagttgga

SEQ ID NO: 8333237 - DNA, 23 bp, Homo sapiens
cagaaataaactggtttgtagat

SEQ ID NO: 8333238 - DNA, 22 bp, Homo sapiens
cagaaataaacttctcacatcg

SEQ ID NO: 8333239 - DNA, 22 bp, Homo sapiens
ggcttaatggttctttttctca

SEQ ID NO: 8333240 - DNA, 22 bp, Homo sapiens
gtcataaagcttgttgcattta

SEQ ID NO: 8333241 - DNA, 22 bp, Homo sapiens
gaaatagacactttctatgaat

SEQ ID NO: 8333242 - DNA, 22 bp, Homo sapiens
atgaaaatgtacatgtgtataa

SEQ ID NO: 8333243 - DNA, 22 bp, Homo sapiens
atgaaaattctatgcaggccag

SEQ ID NO: 8333244 - DNA, 22 bp, Homo sapiens
atgaaaatactgtggttgatag

SEQ ID NO: 8333245 - DNA, 22 bp, Homo sapiens
atgaaaattgacagcggaagta

SEQ ID NO: 8333246 - DNA, 22 bp, Homo sapiens
atgaaacacacacgcgcatact

SEQ ID NO: 8333247 - DNA, 22 bp, Homo sapiens
atgaaacagtgaattagtcaag

SEQ ID NO: 8333248 - DNA, 22 bp, Homo sapiens
ctttcaactacatacaggcgat

SEQ ID NO: 8333249 - DNA, 22 bp, Homo sapiens
gaataatcatgaaattcagtga

SEQ ID NO: 8333250 - DNA, 22 bp, Homo sapiens
gacaatacagaaagggacatgc

SEQ ID NO: 8333251 - DNA, 22 bp, Homo sapiens
gacataatcctcctcacctact

SEQ ID NO: 8333252 - DNA, 22 bp, Homo sapiens
gagttctaaaggcagaacataa

SEQ ID NO: 8333253 - DNA, 22 bp, Homo sapiens
gataatgatgacaatgacaacc

SEQ ID NO: 8333254 - DNA, 22 bp, Homo sapiens
gatatcatatcagacaacctct

SEQ ID NO: 8333255 - DNA, 22 bp, Homo sapiens
atggcttatggtaaatatttct

SEQ ID NO: 8333256 - DNA, 22 bp, Homo sapiens
atggcttatgaataacagtagg

SEQ ID NO: 8333257 - DNA, 22 bp, Homo sapiens
atggcttaagaatgcttttgtg

SEQ ID NO: 8333258 - DNA, 22 bp, Homo sapiens
atggctttcagatttctatgtt

SEQ ID NO: 8333259 - DNA, 22 bp, Homo sapiens
atggctttcctgggacatgggc

SEQ ID NO: 8333260 - DNA, 22 bp, Homo sapiens
atggctttcagatggtgaaaga

SEQ ID NO: 8333261 - DNA, 22 bp, Homo sapiens
atggctttctctaatgtggtat

SEQ ID NO: 8333262 - DNA, 22 bp, Homo sapiens
atggctttgaagtaatgtaatt

SEQ ID NO: 8333263 - DNA, 22 bp, Homo sapiens
atggctttgctcaagtttagcc

SEQ ID NO: 8333264 - DNA, 21 bp, Homo sapiens
atggcttttttaaagcttgtg

SEQ ID NO: 8333265 - DNA, 22 bp, Homo sapiens
atggctttttagactttggtac

SEQ ID NO: 8333266 - DNA, 22 bp, Homo sapiens
atggcttttcacagagggttct

SEQ ID NO: 8333267 - DNA, 22 bp, Homo sapiens
atggctttgttccaataaaact

SEQ ID NO: 8333268 - DNA, 22 bp, Homo sapiens
atggcatttgaatctgtctttt

SEQ ID NO: 8333269 - DNA, 22 bp, Homo sapiens
atggcatttgaccgctttgtgg

SEQ ID NO: 8333270 - DNA, 22 bp, Homo sapiens
atggcattccaagtcttctttt

SEQ ID NO: 8333271 - DNA, 22 bp, Homo sapiens
atggcattatagcaatggtttg

SEQ ID NO: 8333272 - DNA, 21 bp, Homo sapiens
caaagccaggcaactctctcc

SEQ ID NO: 8333273 - DNA, 22 bp, Homo sapiens
caaagccaggctttctaatgta

SEQ ID NO: 8333274 - DNA, 22 bp, Homo sapiens
caaagccatagagtagataaga

SEQ ID NO: 8333275 - DNA, 22 bp, Homo sapiens
caaacattcaagtacaagtctt

SEQ ID NO: 8333276 - DNA, 22 bp, Homo sapiens
atttccaggagaaaggatttta

SEQ ID NO: 8333277 - DNA, 22 bp, Homo sapiens
attgatggcggcctctccatat

SEQ ID NO: 8333278 - DNA, 22 bp, Homo sapiens
attcataagtaaatgattacct

SEQ ID NO: 8333279 - DNA, 22 bp, Homo sapiens
attcataacggcaaatgtcacc

SEQ ID NO: 8333280 - DNA, 22 bp, Homo sapiens
attcactggcagacagaactca

SEQ ID NO: 8333281 - DNA, 22 bp, Homo sapiens
attcaacgggtagaagggtctt

SEQ ID NO: 8333282 - DNA, 22 bp, Homo sapiens
attaggcagtgccattgtacgg

SEQ ID NO: 8333283 - DNA, 22 bp, Homo sapiens
attaggcatatatgcttttaat

SEQ ID NO: 8333284 - DNA, 22 bp, Homo sapiens
attaggcagacaacgtagccgg

SEQ ID NO: 8333285 - DNA, 22 bp, Homo sapiens
attaggcactagaatgtcaatt

SEQ ID NO: 8333286 - DNA, 22 bp, Homo sapiens
attaggcagggcatggtggctc

SEQ ID NO: 8333287 - DNA, 22 bp, Homo sapiens
attaggcaattctgggcatctc

SEQ ID NO: 8333288 - DNA, 22 bp, Homo sapiens
attaggcattatggggataagg

SEQ ID NO: 8333289 - DNA, 22 bp, Homo sapiens
attaggcattcatgcagctcct

SEQ ID NO: 8333290 - DNA, 22 bp, Homo sapiens
attaggcattctgaatgaggtc

SEQ ID NO: 8333291 - DNA, 22 bp, Homo sapiens
gatttccattttcaactcctgc

SEQ ID NO: 8333292 - DNA, 22 bp, Homo sapiens
gatttccaggtcattaataaag

SEQ ID NO: 8333293 - DNA, 22 bp, Homo sapiens
tgctggctacattattgctgtc

SEQ ID NO: 8333294 - DNA, 22 bp, Homo sapiens
cataattactgatatgctgatt

SEQ ID NO: 8333295 - DNA, 22 bp, Homo sapiens
catagaaagtattatggaattt

SEQ ID NO: 8333296 - DNA, 22 bp, Homo sapiens
catagaaacttgcagcaagcac

SEQ ID NO: 8333297 - DNA, 22 bp, Homo sapiens
catagaaactgagacaaggatt

SEQ ID NO: 8333298 - DNA, 22 bp, Homo sapiens
catagaaaagagtaggtaatgt

SEQ ID NO: 8333299 - DNA, 22 bp, Homo sapiens
catagaaatcaggtgagaatct

SEQ ID NO: 8333300 - DNA, 23 bp, Homo sapiens
cataaaatattagtatggtagca

SEQ ID NO: 8333301 - DNA, 22 bp, Homo sapiens
ccacttcatcagtgctccattt

SEQ ID NO: 8333302 - DNA, 23 bp, Homo sapiens
tctaatacatgaaacctagatgt

SEQ ID NO: 8333303 - DNA, 22 bp, Homo sapiens
tccttgttgctgcagtcacctg

SEQ ID NO: 8333304 - DNA, 22 bp, Homo sapiens
catttacacacagaggtgtgct

SEQ ID NO: 8333305 - DNA, 22 bp, Homo sapiens
catttacaatgtacaggttgtg

SEQ ID NO: 8333306 - DNA, 22 bp, Homo sapiens
cagtcaccttgaggactcagac

SEQ ID NO: 8333307 - DNA, 22 bp, Homo sapiens
cagtcacctgaagacttgacca

SEQ ID NO: 8333308 - DNA, 22 bp, Homo sapiens
cagtcacctagacagaacttac

SEQ ID NO: 8333309 - DNA, 22 bp, Homo sapiens
cagtcaccatagaataaaacat

SEQ ID NO: 8333310 - DNA, 22 bp, Homo sapiens
cagtcaccaccaggtggcagta

SEQ ID NO: 8333311 - DNA, 22 bp, Homo sapiens
tagatttaagaccctgaatttg

SEQ ID NO: 8333312 - DNA, 22 bp, Homo sapiens
taagtccttcacctaatcctca

SEQ ID NO: 8333313 - DNA, 22 bp, Homo sapiens
taagtcctattccaggtctctc

SEQ ID NO: 8333314 - DNA, 22 bp, Homo sapiens
taagtcctggctggtttgaagc

SEQ ID NO: 8333315 - DNA, 17 bp, Homo sapiens
taagtcctagttatttt

SEQ ID NO: 8333316 - DNA, 22 bp, Homo sapiens
taagtcctagctttggtaggaa

SEQ ID NO: 8333317 - DNA, 22 bp, Homo sapiens
taagtcctagatgattcacaga

SEQ ID NO: 8333318 - DNA, 22 bp, Homo sapiens
taagtcctaatggcagaagtct

SEQ ID NO: 8333319 - DNA, 22 bp, Homo sapiens
taagtcctaacagactgggggc

SEQ ID NO: 8333320 - DNA, 22 bp, Homo sapiens
tacaaaaaattgatactgacga

SEQ ID NO: 8333321 - DNA, 22 bp, Homo sapiens
taatatgtgttactgacttttt

SEQ ID NO: 8333322 - DNA, 22 bp, Homo sapiens
taatcatggcctcaaattttat

SEQ ID NO: 8333323 - DNA, 22 bp, Homo sapiens
ttcttttacattaagatttcag

SEQ ID NO: 8333324 - DNA, 22 bp, Homo sapiens
tttaatattctgcattctcctt

SEQ ID NO: 8333325 - DNA, 22 bp, Homo sapiens
tttaatatttctttcctgaagc

SEQ ID NO: 8333326 - DNA, 22 bp, Homo sapiens
tttaggcagtcattgaacaagt

SEQ ID NO: 8333327 - DNA, 22 bp, Homo sapiens
tttaggcagctacatactaact

SEQ ID NO: 8333328 - DNA, 22 bp, Homo sapiens
tttaggcatgcagttctattta

SEQ ID NO: 8333329 - DNA, 22 bp, Homo sapiens
tttaggcattgaattagaatag

SEQ ID NO: 8333330 - DNA, 22 bp, Homo sapiens
tttaggcatacttttgggagaa

SEQ ID NO: 8333331 - DNA, 20 bp, Homo sapiens
tttaggcattactcttttgt

SEQ ID NO: 8333332 - DNA, 22 bp, Homo sapiens
tttaggcattgggtgctcaagt

SEQ ID NO: 8333333 - DNA, 22 bp, Homo sapiens
ttttaagatgctagtatttcag

SEQ ID NO: 8333334 - DNA, 22 bp, Homo sapiens
ctaaagaagctagcaatctata

SEQ ID NO: 8333335 - DNA, 22 bp, Homo sapiens
cgtatacatgaagacattgctg

SEQ ID NO: 8333336 - DNA, 22 bp, Homo sapiens
ttcacagaatggcaagttatgg

SEQ ID NO: 8333337 - DNA, 22 bp, Homo sapiens
ttcaagttttgcctccccatcc

SEQ ID NO: 8333338 - DNA, 22 bp, Homo sapiens
ttcacacacagcttcctattgt

SEQ ID NO: 8333339 - DNA, 22 bp, Homo sapiens
ctattacatttctggacattca

SEQ ID NO: 8333340 - DNA, 22 bp, Homo sapiens
ttcctgggactggagcagccca

SEQ ID NO: 8333341 - DNA, 22 bp, Homo sapiens
ttagacaagggctccttaaaag

SEQ ID NO: 8333342 - DNA, 22 bp, Homo sapiens
tgttccaagctgctggataagc

SEQ ID NO: 8333343 - DNA, 20 bp, Homo sapiens
tgttccaagctaatgaatga

SEQ ID NO: 8333344 - DNA, 22 bp, Homo sapiens
gaatatattggtgaaaatagtt

SEQ ID NO: 8333345 - DNA, 22 bp, Homo sapiens
gagatttaattggattaactta

SEQ ID NO: 8333346 - DNA, 22 bp, Homo sapiens
gagatttagagagacttaaaca

SEQ ID NO: 8333347 - DNA, 21 bp, Homo sapiens
gagatttagaaggatcaattt

SEQ ID NO: 8333348 - DNA, 23 bp, Homo sapiens
gagatttagcagacaaagctctt

SEQ ID NO: 8333349 - DNA, 17 bp, Homo sapiens
ctgttaattcatttccc

SEQ ID NO: 8333350 - DNA, 22 bp, Homo sapiens
ctgttaattgtgaattttacat

SEQ ID NO: 8333351 - DNA, 22 bp, Homo sapiens
ctggctttaaccctacaaacct

SEQ ID NO: 8333352 - DNA, 22 bp, Homo sapiens
ctggctttcatttcaagcacgt

SEQ ID NO: 8333353 - DNA, 22 bp, Homo sapiens
ctggctttccctggacaacagc

SEQ ID NO: 8333354 - DNA, 18 bp, Homo sapiens
ctggctttcttatccatc

SEQ ID NO: 8333355 - DNA, 22 bp, Homo sapiens
ctggctttctgttataaagaca

SEQ ID NO: 8333356 - DNA, 22 bp, Homo sapiens
ctggctttctatttggtgctat

SEQ ID NO: 8333357 - DNA, 22 bp, Homo sapiens
ctggctttggtcatgtgatcat

SEQ ID NO: 8333358 - DNA, 22 bp, Homo sapiens
gtgaactattgggtatcataaa

SEQ ID NO: 8333359 - DNA, 22 bp, Homo sapiens
gtgcatttaggtcacatgatgt

SEQ ID NO: 8333360 - DNA, 22 bp, Homo sapiens
gtgcatttgacgaatactcact

SEQ ID NO: 8333361 - DNA, 22 bp, Homo sapiens
gtccaaatttttcacatgtaga

SEQ ID NO: 8333362 - DNA, 22 bp, Homo sapiens
gtagaaatggtgtgtttcttct

SEQ ID NO: 8333363 - DNA, 22 bp, Homo sapiens
gtagaaatgtaaccaggagata

SEQ ID NO: 8333364 - DNA, 22 bp, Homo sapiens
gtagaaattccatttactttga

SEQ ID NO: 8333365 - DNA, 22 bp, Homo sapiens
ggcctttaagcaattgaaaaga

SEQ ID NO: 8333366 - DNA, 22 bp, Homo sapiens
ggcattaagaatatcattaaaa

SEQ ID NO: 8333367 - DNA, 22 bp, Homo sapiens
ggcaccagccacctatttctag

SEQ ID NO: 8333368 - DNA, 22 bp, Homo sapiens
gggatttagtaggatagtatac

SEQ ID NO: 8333369 - DNA, 22 bp, Homo sapiens
gcatggctggtgtcctgaggga

SEQ ID NO: 8333370 - DNA, 22 bp, Homo sapiens
gccccagcgtggctgtgttagg

SEQ ID NO: 8333371 - DNA, 22 bp, Homo sapiens
tatctaaatggaatattccaga

SEQ ID NO: 8333372 - DNA, 22 bp, Homo sapiens
tatccaaagtttctcagaaact

SEQ ID NO: 8333373 - DNA, 22 bp, Homo sapiens
tatacagaaagaattcaagtct

SEQ ID NO: 8333374 - DNA, 22 bp, Homo sapiens
tataattagtaaatggcagatt

SEQ ID NO: 8333375 - DNA, 19 bp, Homo sapiens
tatttcaaagtgccgtcta

SEQ ID NO: 8333376 - DNA, 22 bp, Homo sapiens
tatttatcgagtgtctactatg

SEQ ID NO: 8333377 - DNA, 22 bp, Homo sapiens
tattccaaaatagttaagcact

SEQ ID NO: 8333378 - DNA, 22 bp, Homo sapiens
tagaattcaagattcaacaggc

SEQ ID NO: 8333379 - DNA, 23 bp, Homo sapiens
tagaattcaatctgttccacatc

SEQ ID NO: 8333380 - DNA, 22 bp, Homo sapiens
tagaattcatgttactgttagc

SEQ ID NO: 8333381 - DNA, 22 bp, Homo sapiens
tagaaatcagcaggcatatgta

SEQ ID NO: 8333382 - DNA, 22 bp, Homo sapiens
tagaaacagaaaactgtaatag

SEQ ID NO: 8333383 - DNA, 22 bp, Homo sapiens
tagaaacagatgtttttgaaga

SEQ ID NO: 8333384 - DNA, 22 bp, Homo sapiens
tagaaacagcatatattagccc

SEQ ID NO: 8333385 - DNA, 22 bp, Homo sapiens
tagcagaagaacaacatgatct

SEQ ID NO: 8333386 - DNA, 22 bp, Homo sapiens
taggcaacatgtcgaatactgt

SEQ ID NO: 8333387 - DNA, 22 bp, Homo sapiens
taggatttaggctttaacatct

SEQ ID NO: 8333388 - DNA, 22 bp, Homo sapiens
tacagaaaaactggcattgaag

SEQ ID NO: 8333389 - DNA, 18 bp, Homo sapiens
tacagattatagatacat

SEQ ID NO: 8333390 - DNA, 22 bp, Homo sapiens
tacagatatagagatttataga

SEQ ID NO: 8333391 - DNA, 22 bp, Homo sapiens
tacagaagtaaataccaaaagc

SEQ ID NO: 8333392 - DNA, 23 bp, Homo sapiens
tacagaaggagtagtcactaaga

SEQ ID NO: 8333393 - DNA, 19 bp, Homo sapiens
tacatacttattctaaaag

SEQ ID NO: 8333394 - DNA, 22 bp, Homo sapiens
tacagtaagatgaaatagcaat

SEQ ID NO: 8333395 - DNA, 22 bp, Homo sapiens
tacatatactgagtgatttgct

SEQ ID NO: 8333396 - DNA, 22 bp, Homo sapiens
taagtaaatttataatgtgatt

SEQ ID NO: 8333397 - DNA, 22 bp, Homo sapiens
taattacaggtccaaaacaatc

SEQ ID NO: 8333398 - DNA, 22 bp, Homo sapiens
taattataacagttacatctta

SEQ ID NO: 8333399 - DNA, 22 bp, Homo sapiens
taatacttttgccttgtattca

SEQ ID NO: 8333400 - DNA, 23 bp, Homo sapiens
taatactgcttcagaggcttaga

SEQ ID NO: 8333401 - DNA, 22 bp, Homo sapiens
taattatagccgctattttgct

SEQ ID NO: 8333402 - DNA, 22 bp, Homo sapiens
gttaatatttacctgtcaagaa

SEQ ID NO: 8333403 - DNA, 22 bp, Homo sapiens
taaaattgcggtgaatatttcc

SEQ ID NO: 8333404 - DNA, 22 bp, Homo sapiens
taaaatgtttgcaagagaccag

SEQ ID NO: 8333405 - DNA, 22 bp, Homo sapiens
tcagaaaagagaaaatcttata

SEQ ID NO: 8333406 - DNA, 22 bp, Homo sapiens
tcaataaaattgttttcctatc

SEQ ID NO: 8333407 - DNA, 22 bp, Homo sapiens
tcaataaatagcttggctcagc

SEQ ID NO: 8333408 - DNA, 22 bp, Homo sapiens
tcaataaatccctctgaccctg

SEQ ID NO: 8333409 - DNA, 22 bp, Homo sapiens
tcaagtttctctcagattatgg

SEQ ID NO: 8333410 - DNA, 22 bp, Homo sapiens
tcaagtttaattgagatgttta

SEQ ID NO: 8333411 - DNA, 22 bp, Homo sapiens
tcaataatggcaggataaattt

SEQ ID NO: 8333412 - DNA, 22 bp, Homo sapiens
tcacagaaataagatagttatt

SEQ ID NO: 8333413 - DNA, 22 bp, Homo sapiens
tcacagaagagatattgacaga

SEQ ID NO: 8333414 - DNA, 22 bp, Homo sapiens
tcacagaacaatgtttagttct

SEQ ID NO: 8333415 - DNA, 22 bp, Homo sapiens
tcacagaagatgctggatgttg

SEQ ID NO: 8333416 - DNA, 21 bp, Homo sapiens
tcattcacagggtattgtata

SEQ ID NO: 8333417 - DNA, 22 bp, Homo sapiens
tcagtgtatggagtgctggatt

SEQ ID NO: 8333418 - DNA, 22 bp, Homo sapiens
tccagaatactctgaaatcatt

SEQ ID NO: 8333419 - DNA, 22 bp, Homo sapiens
tccagaatatttgggaaagatg

SEQ ID NO: 8333420 - DNA, 22 bp, Homo sapiens
ttttttgtcttgaagaaatggt

SEQ ID NO: 8333421 - DNA, 22 bp, Homo sapiens
tttttgctgataagcagaattc

SEQ ID NO: 8333422 - DNA, 22 bp, Homo sapiens
tttggacaagttactggtttcc

SEQ ID NO: 8333423 - DNA, 22 bp, Homo sapiens
tttccaaaagtttgttctgtgc

SEQ ID NO: 8333424 - DNA, 22 bp, Homo sapiens
tttccaaaatgaatctaatgca

SEQ ID NO: 8333425 - DNA, 22 bp, Homo sapiens
tttccaaacccagcgagctaca

SEQ ID NO: 8333426 - DNA, 22 bp, Homo sapiens
tttccaaaggtggcaggaacaa

SEQ ID NO: 8333427 - DNA, 22 bp, Homo sapiens
tttccaaagttgccataagctt

SEQ ID NO: 8333428 - DNA, 22 bp, Homo sapiens
tttccaaaggaggaaccagttt

SEQ ID NO: 8333429 - DNA, 22 bp, Homo sapiens
tttccaaagctgagttgagcaa

SEQ ID NO: 8333430 - DNA, 22 bp, Homo sapiens
tttccaaaggctaaactcagtt

SEQ ID NO: 8333431 - DNA, 16 bp, Homo sapiens
tttccaaagggcagct

SEQ ID NO: 8333432 - DNA, 22 bp, Homo sapiens
tttccaaaggagtaccacgcat

SEQ ID NO: 8333433 - DNA, 22 bp, Homo sapiens
tttatacatggagaatttttgc

SEQ ID NO: 8333434 - DNA, 22 bp, Homo sapiens
tttattatgtacaggcactata

SEQ ID NO: 8333435 - DNA, 22 bp, Homo sapiens
tttattatgatggacaccttcg

SEQ ID NO: 8333436 - DNA, 22 bp, Homo sapiens
ttggtccactgtgaaattggga

SEQ ID NO: 8333437 - DNA, 22 bp, Homo sapiens
ttgattaatcccatgtgagtag

SEQ ID NO: 8333438 - DNA, 22 bp, Homo sapiens
ttgatggctgtgatttactcag

SEQ ID NO: 8333439 - DNA, 22 bp, Homo sapiens
ttgatccagttgaaagtgatga

SEQ ID NO: 8333440 - DNA, 22 bp, Homo sapiens
ttgaagaaattattttatatag

SEQ ID NO: 8333441 - DNA, 20 bp, Homo sapiens
ttctatacatatcactgaaa

SEQ ID NO: 8333442 - DNA, 22 bp, Homo sapiens
ttctatacaaagatttctcaca

SEQ ID NO: 8333443 - DNA, 22 bp, Homo sapiens
ttcaactttggagatttaataa

SEQ ID NO: 8333444 - DNA, 22 bp, Homo sapiens
ttcaactttatgcatatgtatt

SEQ ID NO: 8333445 - DNA, 22 bp, Homo sapiens
ttcaactcttcaagatcacatc

SEQ ID NO: 8333446 - DNA, 22 bp, Homo sapiens
ttcaacccaagttctccatttt

SEQ ID NO: 8333447 - DNA, 22 bp, Homo sapiens
ttccttagatccttcaatcacg

SEQ ID NO: 8333448 - DNA, 22 bp, Homo sapiens
ttccttagagtttccagaaagc

SEQ ID NO: 8333449 - DNA, 22 bp, Homo sapiens
ttccttagcagacctggtatcc

SEQ ID NO: 8333450 - DNA, 22 bp, Homo sapiens
ttccttagcctgccttccaggg

SEQ ID NO: 8333451 - DNA, 22 bp, Homo sapiens
ttccttagctcctcatggcctg

SEQ ID NO: 8333452 - DNA, 22 bp, Homo sapiens
ttccttagctgtccctggaaat

SEQ ID NO: 8333453 - DNA, 22 bp, Homo sapiens
ttccttagacagaggtggtcat

SEQ ID NO: 8333454 - DNA, 19 bp, Homo sapiens
ttccttagaggaggcggtg

SEQ ID NO: 8333455 - DNA, 22 bp, Homo sapiens
ttccttagtgcctcttccgctg

SEQ ID NO: 8333456 - DNA, 22 bp, Homo sapiens
ttccttagtgttagattctgtg

SEQ ID NO: 8333457 - DNA, 22 bp, Homo sapiens
ttccttagggtcagccagatct

SEQ ID NO: 8333458 - DNA, 22 bp, Homo sapiens
ttccttagtgacttctagctac

SEQ ID NO: 8333459 - DNA, 22 bp, Homo sapiens
ttccttaggggacagggggata

SEQ ID NO: 8333460 - DNA, 20 bp, Homo sapiens
ttccttaggcattggaagaa

SEQ ID NO: 8333461 - DNA, 22 bp, Homo sapiens
ttccttaggctgtttgcagtgc

SEQ ID NO: 8333462 - DNA, 22 bp, Homo sapiens
ttccttagggaaagggataagg

SEQ ID NO: 8333463 - DNA, 22 bp, Homo sapiens
ttccttagttgactgtcttagt

SEQ ID NO: 8333464 - DNA, 22 bp, Homo sapiens
ttccttagttatttggtcccct

SEQ ID NO: 8333465 - DNA, 23 bp, Homo sapiens
ttccacaatgaaaataaagcagg

SEQ ID NO: 8333466 - DNA, 22 bp, Homo sapiens
ttccacaatgtatgaataagat

SEQ ID NO: 8333467 - DNA, 22 bp, Homo sapiens
tgtttaataattctatgatagt

SEQ ID NO: 8333468 - DNA, 22 bp, Homo sapiens
ttaattactaagcacaatgcaa

SEQ ID NO: 8333469 - DNA, 22 bp, Homo sapiens
ttaattacaaaacacataggtt

SEQ ID NO: 8333470 - DNA, 22 bp, Homo sapiens
ttaattatgcaaaaggccccat

SEQ ID NO: 8333471 - DNA, 22 bp, Homo sapiens
ttaataaacaggtgcagctgaa

SEQ ID NO: 8333472 - DNA, 22 bp, Homo sapiens
ttaattctgcctttcatgtaac

SEQ ID NO: 8333473 - DNA, 22 bp, Homo sapiens
ttaattctagtttaacacttag

SEQ ID NO: 8333474 - DNA, 22 bp, Homo sapiens
ttaaggatgttgtgatttatta

SEQ ID NO: 8333475 - DNA, 23 bp, Homo sapiens
ttaagactggctgaacttagtag

SEQ ID NO: 8333476 - DNA, 22 bp, Homo sapiens
ttaacactatctgtcataatta

SEQ ID NO: 8333477 - DNA, 22 bp, Homo sapiens
ttaacactcctaactacagtct

SEQ ID NO: 8333478 - DNA, 22 bp, Homo sapiens
ttaacagagtgcctggcatgta

SEQ ID NO: 8333479 - DNA, 22 bp, Homo sapiens
ttaacacttgaactctacatgt

SEQ ID NO: 8333480 - DNA, 22 bp, Homo sapiens
ttactactgctttactactggg

SEQ ID NO: 8333481 - DNA, 22 bp, Homo sapiens
gccaggtgagaggactgaggct

SEQ ID NO: 8333482 - DNA, 21 bp, Homo sapiens
gcctagggagatgggactgcc

SEQ ID NO: 8333483 - DNA, 22 bp, Homo sapiens
gagatggggaataggagcaagc

SEQ ID NO: 8333484 - DNA, 22 bp, Homo sapiens
gaggagaagctaagaaacacag

SEQ ID NO: 8333485 - DNA, 22 bp, Homo sapiens
gaggagaagggcacggagaaaa

SEQ ID NO: 8333486 - DNA, 22 bp, Homo sapiens
cagcagctgcgtgcccaggccg

SEQ ID NO: 8333487 - DNA, 22 bp, Homo sapiens
ggaaggggagctggaaagggta

SEQ ID NO: 8333488 - DNA, 22 bp, Homo sapiens
cgggctcagcccggcccctcgc

SEQ ID NO: 8333489 - DNA, 21 bp, Homo sapiens
cctgccaggaaactgagtgtc

SEQ ID NO: 8333490 - DNA, 22 bp, Homo sapiens
cctgccagatcccctgagctga

SEQ ID NO: 8333491 - DNA, 19 bp, Homo sapiens
ctctgcatatgtgaggata

SEQ ID NO: 8333492 - DNA, 22 bp, Homo sapiens
ctccagggaaaggggcgtccgc

SEQ ID NO: 8333493 - DNA, 22 bp, Homo sapiens
ctccctcagaggagcacctgtt

SEQ ID NO: 8333494 - DNA, 22 bp, Homo sapiens
ctgcaaggctggggtgagctgg

SEQ ID NO: 8333495 - DNA, 22 bp, Homo sapiens
ccagaggctggcaagggctcct

SEQ ID NO: 8333496 - DNA, 22 bp, Homo sapiens
ccagaggtggtggtgtctagaa

SEQ ID NO: 8333497 - DNA, 23 bp, Homo sapiens
agggccaggtgcggaaacagctc

SEQ ID NO: 8333498 - DNA, 22 bp, Homo sapiens
aggggaagagccctttacatgg

SEQ ID NO: 8333499 - DNA, 22 bp, Homo sapiens
aggggaagattatacttttgaa

SEQ ID NO: 8333500 - DNA, 21 bp, Homo sapiens
aggggaagtagagttttgatt

SEQ ID NO: 8333501 - DNA, 22 bp, Homo sapiens
cctactctgagcgcctccgcat

SEQ ID NO: 8333502 - DNA, 22 bp, Homo sapiens
aggaagagctggaccagaggac

SEQ ID NO: 8333503 - DNA, 22 bp, Homo sapiens
caggcacacccactggtgcaga

SEQ ID NO: 8333504 - DNA, 22 bp, Homo sapiens
caggagcagagggtggtcagca

SEQ ID NO: 8333505 - DNA, 22 bp, Homo sapiens
acagtgagatccaagggcaggc

SEQ ID NO: 8333506 - DNA, 22 bp, Homo sapiens
aggctctctctgccagccgtgc

SEQ ID NO: 8333507 - DNA, 22 bp, Homo sapiens
aggctctcctccccaggaccat

SEQ ID NO: 8333508 - DNA, 22 bp, Homo sapiens
aggctctcaatatgatccagtc

SEQ ID NO: 8333509 - DNA, 22 bp, Homo sapiens
aggctctccagagagctgcttt

SEQ ID NO: 8333510 - DNA, 22 bp, Homo sapiens
aggctccagtctcctctggcag

SEQ ID NO: 8333511 - DNA, 22 bp, Homo sapiens
aggggagcccctggtcctggtg

SEQ ID NO: 8333512 - DNA, 22 bp, Homo sapiens
aggggagcttgaggcatggcct

SEQ ID NO: 8333513 - DNA, 22 bp, Homo sapiens
agggccagcactcctggcagga

SEQ ID NO: 8333514 - DNA, 22 bp, Homo sapiens
agggccagcccataatgccaaa

SEQ ID NO: 8333515 - DNA, 22 bp, Homo sapiens
agggccagttcagaggacatgg

SEQ ID NO: 8333516 - DNA, 22 bp, Homo sapiens
agggccagtcgtgtattactgt

SEQ ID NO: 8333517 - DNA, 21 bp, Homo sapiens
aggtgcaggcctcaagcccca

SEQ ID NO: 8333518 - DNA, 19 bp, Homo sapiens
agcaggctaggctgcctct

SEQ ID NO: 8333519 - DNA, 18 bp, Homo sapiens
actgcaggagaggtgagg

SEQ ID NO: 8333520 - DNA, 22 bp, Homo sapiens
tccaggagtgataaggccactg

SEQ ID NO: 8333521 - DNA, 22 bp, Homo sapiens
tccaggagtgtgtgctaatggg

SEQ ID NO: 8333522 - DNA, 22 bp, Homo sapiens
tccaggagggttttctgccttc

SEQ ID NO: 8333523 - DNA, 22 bp, Homo sapiens
tccagggccagtccttgtctgt

SEQ ID NO: 8333524 - DNA, 20 bp, Homo sapiens
tccagggccctggctcctct

SEQ ID NO: 8333525 - DNA, 22 bp, Homo sapiens
tccagggctacaaggcaccaga

SEQ ID NO: 8333526 - DNA, 20 bp, Homo sapiens
tccagggctagggagctcat

SEQ ID NO: 8333527 - DNA, 22 bp, Homo sapiens
tccagggctcattccctctgca

SEQ ID NO: 8333528 - DNA, 22 bp, Homo sapiens
tccatgcaaacagtggctagct

SEQ ID NO: 8333529 - DNA, 22 bp, Homo sapiens
tccatgcagcagcctcccagcc

SEQ ID NO: 8333530 - DNA, 22 bp, Homo sapiens
tcccagtttttctccactaagg

SEQ ID NO: 8333531 - DNA, 22 bp, Homo sapiens
tccccaggggcatctctctgct

SEQ ID NO: 8333532 - DNA, 22 bp, Homo sapiens
gcatgcagagtccctctgcatt

SEQ ID NO: 8333533 - DNA, 22 bp, Homo sapiens
gcagggctgggtcctgtctcat

SEQ ID NO: 8333534 - DNA, 22 bp, Homo sapiens
gcagggctggggctgctcctga

SEQ ID NO: 8333535 - DNA, 22 bp, Homo sapiens
gcagggcttgcagcagctagac

SEQ ID NO: 8333536 - DNA, 20 bp, Homo sapiens
gcagcctcaacaggcacagc

SEQ ID NO: 8333537 - DNA, 22 bp, Homo sapiens
gctgccctgtttagccagggtt

SEQ ID NO: 8333538 - DNA, 22 bp, Homo sapiens
gctgccctacccgaggcactct

SEQ ID NO: 8333539 - DNA, 22 bp, Homo sapiens
gctgccctaatatcacatgtta

SEQ ID NO: 8333540 - DNA, 22 bp, Homo sapiens
gggcacagcccagtggggtccc

SEQ ID NO: 8333541 - DNA, 22 bp, Homo sapiens
gggcagctgtcttggttctcaa

SEQ ID NO: 8333542 - DNA, 22 bp, Homo sapiens
gggagaggttacccgagcaact

SEQ ID NO: 8333543 - DNA, 22 bp, Homo sapiens
ggctgggctccgggagcatgcg

SEQ ID NO: 8333544 - DNA, 22 bp, Homo sapiens
ggagccagagcactggggagcc

SEQ ID NO: 8333545 - DNA, 23 bp, Homo sapiens
ggagccagcctgtggggagcggg

SEQ ID NO: 8333546 - DNA, 22 bp, Homo sapiens
ggccagggcctggggactgtcc

SEQ ID NO: 8333547 - DNA, 22 bp, Homo sapiens
ggccagggggcttcagactcca

SEQ ID NO: 8333548 - DNA, 22 bp, Homo sapiens
gtcccccacacttccatgtcac

SEQ ID NO: 8333549 - DNA, 22 bp, Homo sapiens
gtgcactggagttcgtacagat

SEQ ID NO: 8333550 - DNA, 22 bp, Homo sapiens
ctggggcccatcgagggctgag

SEQ ID NO: 8333551 - DNA, 19 bp, Homo sapiens
ctggccaggccaggggccc

SEQ ID NO: 8333552 - DNA, 21 bp, Homo sapiens
ccttctccacagggtctccgg

SEQ ID NO: 8333553 - DNA, 22 bp, Homo sapiens
ctctgccatctcactgggtcct

SEQ ID NO: 8333554 - DNA, 22 bp, Homo sapiens
ctctgccagccaaagtcatcac

SEQ ID NO: 8333555 - DNA, 22 bp, Homo sapiens
ctgcacagagcagggcagacac

SEQ ID NO: 8333556 - DNA, 22 bp, Homo sapiens
ctgcacagtgggtggggcgtca

SEQ ID NO: 8333557 - DNA, 22 bp, Homo sapiens
ctgcacaggggatgagggcagt

SEQ ID NO: 8333558 - DNA, 22 bp, Homo sapiens
ctgcacagcctgtctgggggcc

SEQ ID NO: 8333559 - DNA, 22 bp, Homo sapiens
ctgcacagctggccagggagag

SEQ ID NO: 8333560 - DNA, 22 bp, Homo sapiens
ctgcacagggatatggggagct

SEQ ID NO: 8333561 - DNA, 22 bp, Homo sapiens
ctgcactgagaccctctttgct

SEQ ID NO: 8333562 - DNA, 18 bp, Homo sapiens
ctgcactcccgcctgggc

SEQ ID NO: 8333563 - DNA, 20 bp, Homo sapiens
ctgcactgaacatgtctgag

SEQ ID NO: 8333564 - DNA, 22 bp, Homo sapiens
ctgcactgaagaaaggagctct

SEQ ID NO: 8333565 - DNA, 22 bp, Homo sapiens
ctgcactgtgtattccttggct

SEQ ID NO: 8333566 - DNA, 18 bp, Homo sapiens
ctgcactgtgggtagctc

SEQ ID NO: 8333567 - DNA, 22 bp, Homo sapiens
ctcctccacagacctactgaat

SEQ ID NO: 8333568 - DNA, 18 bp, Homo sapiens
ctcctccacagcccctgc

SEQ ID NO: 8333569 - DNA, 23 bp, Homo sapiens
ctccccagtgtcctcatgcatct

SEQ ID NO: 8333570 - DNA, 22 bp, Homo sapiens
ctcctccagtgggtccctcagg

SEQ ID NO: 8333571 - DNA, 22 bp, Homo sapiens
ctctccaggagctcagagtcta

SEQ ID NO: 8333572 - DNA, 22 bp, Homo sapiens
ctctccaggcgaggtcctactg

SEQ ID NO: 8333573 - DNA, 22 bp, Homo sapiens
ctctccaggctgggacaggacc

SEQ ID NO: 8333574 - DNA, 22 bp, Homo sapiens
ctctccaggttagagcacttat

SEQ ID NO: 8333575 - DNA, 22 bp, Homo sapiens
ctctccaggggtagatgccttc

SEQ ID NO: 8333576 - DNA, 22 bp, Homo sapiens
ctctccagggcatgagttccac

SEQ ID NO: 8333577 - DNA, 22 bp, Homo sapiens
ctcccaggcacagggaggagcc

SEQ ID NO: 8333578 - DNA, 22 bp, Homo sapiens
ctcccaggactcagaggagaag

SEQ ID NO: 8333579 - DNA, 22 bp, Homo sapiens
tccctctccctattgcctggag

SEQ ID NO: 8333580 - DNA, 22 bp, Homo sapiens
tccaggagatacactgcaccag

SEQ ID NO: 8333581 - DNA, 22 bp, Homo sapiens
ccctctcctggctgcatggagc

SEQ ID NO: 8333582 - DNA, 22 bp, Homo sapiens
ccctctccctgcagaatgtggc

SEQ ID NO: 8333583 - DNA, 22 bp, Homo sapiens
cccttctctttcactcactatt

SEQ ID NO: 8333584 - DNA, 20 bp, Homo sapiens
cctctgcctttctagtctga

SEQ ID NO: 8333585 - DNA, 22 bp, Homo sapiens
ccagtctcttccctcctgccag

SEQ ID NO: 8333586 - DNA, 22 bp, Homo sapiens
ccaggtgctgaccggtcagatt

SEQ ID NO: 8333587 - DNA, 22 bp, Homo sapiens
ccaggtgctcttgccagggctg

SEQ ID NO: 8333588 - DNA, 22 bp, Homo sapiens
ccagctgctctcttctccgcca

SEQ ID NO: 8333589 - DNA, 22 bp, Homo sapiens
tcccctctggttgacccaggag

SEQ ID NO: 8333590 - DNA, 22 bp, Homo sapiens
ggcaaggggtcaggctgagaca

SEQ ID NO: 8333591 - DNA, 22 bp, Homo sapiens
ggccagggaggagaggcccctg

SEQ ID NO: 8333592 - DNA, 22 bp, Homo sapiens
cactgcactccagcctgggcaa

SEQ ID NO: 8333593 - DNA, 22 bp, Homo sapiens
gctgggcttgtggccagctggg

SEQ ID NO: 8333594 - DNA, 22 bp, Homo sapiens
gctgccctgtctgcagcaggac

SEQ ID NO: 8333595 - DNA, 22 bp, Homo sapiens
gctgccctcccagggcaagctt

SEQ ID NO: 8333596 - DNA, 22 bp, Homo sapiens
gctgccctgacaagctactccc

SEQ ID NO: 8333597 - DNA, 22 bp, Homo sapiens
cttctccctggcttctgcacac

SEQ ID NO: 8333598 - DNA, 22 bp, Homo sapiens
gaatttcctctaaacccctgag

SEQ ID NO: 8333599 - DNA, 22 bp, Homo sapiens
atgcaggttgtatctgaagcca

SEQ ID NO: 8333600 - DNA, 22 bp, Homo sapiens
gctccccaggctggtcccctcg

SEQ ID NO: 8333601 - DNA, 22 bp, Homo sapiens
agggagaagagaacaaagccct

SEQ ID NO: 8333602 - DNA, 22 bp, Homo sapiens
cctccccatgacccggtgctgg

SEQ ID NO: 8333603 - DNA, 16 bp, Homo sapiens
agggccagaagcatca

SEQ ID NO: 8333604 - DNA, 22 bp, Homo sapiens
cctgaggatattcaccagcatg

SEQ ID NO: 8333605 - DNA, 22 bp, Homo sapiens
cctgaggacatcagcatcacct

SEQ ID NO: 8333606 - DNA, 22 bp, Homo sapiens
cctgaggacacacgctgcagga

SEQ ID NO: 8333607 - DNA, 22 bp, Homo sapiens
ccatgcacaccagcaggcagac

SEQ ID NO: 8333608 - DNA, 22 bp, Homo sapiens
aggcaggggagctggaagggta

SEQ ID NO: 8333609 - DNA, 22 bp, Homo sapiens
aggagggagcttaagccaggca

SEQ ID NO: 8333610 - DNA, 19 bp, Homo sapiens
aggagaagtagcagaaatt

SEQ ID NO: 8333611 - DNA, 22 bp, Homo sapiens
aggagaagtaaggctagatgat

SEQ ID NO: 8333612 - DNA, 22 bp, Homo sapiens
caggaagagaacatggaggctg

SEQ ID NO: 8333613 - DNA, 22 bp, Homo sapiens
caggaggacatactggctcaca

SEQ ID NO: 8333614 - DNA, 21 bp, Homo sapiens
aggtgcagagccagggaccag

SEQ ID NO: 8333615 - DNA, 22 bp, Homo sapiens
ctccagggagctgcgggagcca

SEQ ID NO: 8333616 - DNA, 22 bp, Homo sapiens
ctcccaggttacatctgagcct

SEQ ID NO: 8333617 - DNA, 22 bp, Homo sapiens
ctcccagggtctaggctgctgg

SEQ ID NO: 8333618 - DNA, 22 bp, Homo sapiens
ctcccagggtagggagagacta

SEQ ID NO: 8333619 - DNA, 22 bp, Homo sapiens
atctccagcagtgcttttgagc

SEQ ID NO: 8333620 - DNA, 22 bp, Homo sapiens
ctgtccagcttggctcctgggg

SEQ ID NO: 8333621 - DNA, 22 bp, Homo sapiens
ctgtccagcacatgtctgcccc

SEQ ID NO: 8333622 - DNA, 22 bp, Homo sapiens
ctgccctggtcccatggctgat

SEQ ID NO: 8333623 - DNA, 22 bp, Homo sapiens
acagtccccataccacctgtcc

SEQ ID NO: 8333624 - DNA, 22 bp, Homo sapiens
aggaagaacctaagaaagtctc

SEQ ID NO: 8333625 - DNA, 22 bp, Homo sapiens
aggccagggcactgctctttag

SEQ ID NO: 8333626 - DNA, 22 bp, Homo sapiens
aggccagggtcccacactcgca

SEQ ID NO: 8333627 - DNA, 22 bp, Homo sapiens
agggggaggctgtgctgcgtct

SEQ ID NO: 8333628 - DNA, 22 bp, Homo sapiens
acctgccaagcatcagtggcag

SEQ ID NO: 8333629 - DNA, 22 bp, Homo sapiens
cagcagctcaggctgcttccca

SEQ ID NO: 8333630 - DNA, 22 bp, Homo sapiens
agcaggctccttccttctctgg

SEQ ID NO: 8333631 - DNA, 22 bp, Homo sapiens
agcaggctccaggctggccatc

SEQ ID NO: 8333632 - DNA, 22 bp, Homo sapiens
agcaggctgatgggcatgcttg

SEQ ID NO: 8333633 - DNA, 23 bp, Homo sapiens
agcaggctgcttctccacagctg

SEQ ID NO: 8333634 - DNA, 22 bp, Homo sapiens
agcaggggctcctccacagcca

SEQ ID NO: 8333635 - DNA, 22 bp, Homo sapiens
agaggaagctgagatgcctctt

SEQ ID NO: 8333636 - DNA, 22 bp, Homo sapiens
atgcactgggtgaggaaggaga

SEQ ID NO: 8333637 - DNA, 22 bp, Homo sapiens
acactgcagcatcagctacgga

SEQ ID NO: 8333638 - DNA, 22 bp, Homo sapiens
acactgcatttcaacaaggccc

SEQ ID NO: 8333639 - DNA, 21 bp, Homo sapiens
acactgcaggtgaagtgcact

SEQ ID NO: 8333640 - DNA, 22 bp, Homo sapiens
gtctccagggctgctggcgcct

SEQ ID NO: 8333641 - DNA, 22 bp, Homo sapiens
gtgccaggcccagggagcgggg

SEQ ID NO: 8333642 - DNA, 22 bp, Homo sapiens
gtgccagggagtggaggagctt

SEQ ID NO: 8333643 - DNA, 20 bp, Homo sapiens
gtgccaggcaagacaggtgg

SEQ ID NO: 8333644 - DNA, 18 bp, Homo sapiens
gtgccaggaggcgcagcc

SEQ ID NO: 8333645 - DNA, 22 bp, Homo sapiens
gggcttctccctaaggactctg

SEQ ID NO: 8333646 - DNA, 22 bp, Homo sapiens
ggggccagcaatgttgaggaat

SEQ ID NO: 8333647 - DNA, 22 bp, Homo sapiens
ggggccagtaggagtgatgtac

SEQ ID NO: 8333648 - DNA, 22 bp, Homo sapiens
ggctcactgcaacttccgcctc

SEQ ID NO: 8333649 - DNA, 22 bp, Homo sapiens
ggctcaccatggcctccctgct

SEQ ID NO: 8333650 - DNA, 22 bp, Homo sapiens
ggctcaccattttcactctctg

SEQ ID NO: 8333651 - DNA, 18 bp, Homo sapiens
gggctcacacaggtcatc

SEQ ID NO: 8333652 - DNA, 22 bp, Homo sapiens
gctcagggagagagggcagccg

SEQ ID NO: 8333653 - DNA, 20 bp, Homo sapiens
gctcagggcctgggtctgga

SEQ ID NO: 8333654 - DNA, 22 bp, Homo sapiens
gctcagggcgcgagggacgtgg

SEQ ID NO: 8333655 - DNA, 22 bp, Homo sapiens
gctctccaggtctcatgcactg

SEQ ID NO: 8333656 - DNA, 22 bp, Homo sapiens
ggagccagggaagctgcttcct

SEQ ID NO: 8333657 - DNA, 22 bp, Homo sapiens
ggagccaggcatatcggggcac

SEQ ID NO: 8333658 - DNA, 22 bp, Homo sapiens
gcaaggagcctggaggtgagtg

SEQ ID NO: 8333659 - DNA, 22 bp, Homo sapiens
gcaggtgaatgatggactagga

SEQ ID NO: 8333660 - DNA, 17 bp, Homo sapiens
gcagccagtgcagcagg

SEQ ID NO: 8333661 - DNA, 22 bp, Homo sapiens
gccaccctgacgccgcagaccc

SEQ ID NO: 8333662 - DNA, 22 bp, Homo sapiens
tccctcagcttgtctccatgca

SEQ ID NO: 8333663 - DNA, 22 bp, Homo sapiens
tccctcagatgagctcctagca

SEQ ID NO: 8333664 - DNA, 22 bp, Homo sapiens
gagaaggaagttgagccagcat

SEQ ID NO: 8333665 - DNA, 22 bp, Homo sapiens
ctggtaggggtgactgttatcg

SEQ ID NO: 8333666 - DNA, 22 bp, Homo sapiens
ccttttgctctcccatccagaa

SEQ ID NO: 8333667 - DNA, 23 bp, Homo sapiens
cggggccagggtcaggaccggtc

SEQ ID NO: 8333668 - DNA, 22 bp, Homo sapiens
ctccagagggtcagactctgag

SEQ ID NO: 8333669 - DNA, 22 bp, Homo sapiens
ctccaggaccagggctcctgga

SEQ ID NO: 8333670 - DNA, 22 bp, Homo sapiens
ctcaggagtagttcagcagctg

SEQ ID NO: 8333671 - DNA, 22 bp, Homo sapiens
ctccaggagctgtgtctttctt

SEQ ID NO: 8333672 - DNA, 22 bp, Homo sapiens
ctccaggagggcttcctgtgat

SEQ ID NO: 8333673 - DNA, 22 bp, Homo sapiens
ctccaggaggttgctgcttcct

SEQ ID NO: 8333674 - DNA, 22 bp, Homo sapiens
ctctgcaccttgtaggaggcaa

SEQ ID NO: 8333675 - DNA, 22 bp, Homo sapiens
ctctgcacctacacaacaggaa

SEQ ID NO: 8333676 - DNA, 22 bp, Homo sapiens
ctgcgcaggggtggcgccagaa

SEQ ID NO: 8333677 - DNA, 22 bp, Homo sapiens
ctgcaggagtgaaagcaggcct

SEQ ID NO: 8333678 - DNA, 22 bp, Homo sapiens
ctgcaggactgaaagatgaggt

SEQ ID NO: 8333679 - DNA, 22 bp, Homo sapiens
tggcctcggcatccagcaagag

SEQ ID NO: 8333680 - DNA, 22 bp, Homo sapiens
cctgccaggcgagtctaggcca

SEQ ID NO: 8333681 - DNA, 22 bp, Homo sapiens
cctgccaggccagtgagcttcc

SEQ ID NO: 8333682 - DNA, 22 bp, Homo sapiens
cctgccaggctttgggcttctg

SEQ ID NO: 8333683 - DNA, 18 bp, Homo sapiens
cctgccagtctggagcag

SEQ ID NO: 8333684 - DNA, 22 bp, Homo sapiens
tgggccagcaattgctgctcag

SEQ ID NO: 8333685 - DNA, 22 bp, Homo sapiens
tgggccagaagtatgcatgttt

SEQ ID NO: 8333686 - DNA, 21 bp, Homo sapiens
tgggccagatctgagtttcta

SEQ ID NO: 8333687 - DNA, 22 bp, Homo sapiens
cctgccaggagctggtgctgca

SEQ ID NO: 8333688 - DNA, 22 bp, Homo sapiens
cctgccagacgcaccagggggc

SEQ ID NO: 8333689 - DNA, 22 bp, Homo sapiens
cctgaggccctggctgtgctga

SEQ ID NO: 8333690 - DNA, 22 bp, Homo sapiens
ccaggctcacctggagcccctg

SEQ ID NO: 8333691 - DNA, 22 bp, Homo sapiens
tctccctctgtaagatcagggg

SEQ ID NO: 8333692 - DNA, 22 bp, Homo sapiens
tcctctccatgtctcacgccac

SEQ ID NO: 8333693 - DNA, 22 bp, Homo sapiens
ttggagatatcacaccttcaca

SEQ ID NO: 8333694 - DNA, 22 bp, Homo sapiens
ttctctgctacatactagggct

SEQ ID NO: 8333695 - DNA, 22 bp, Homo sapiens
ttctccagacaggcagagggaa

SEQ ID NO: 8333696 - DNA, 22 bp, Homo sapiens
ttctccagaccctcctgcagac

SEQ ID NO: 8333697 - DNA, 22 bp, Homo sapiens
ttctccagaccactgcctctgt

SEQ ID NO: 8333698 - DNA, 22 bp, Homo sapiens
gggggagctgttattggcaggg

SEQ ID NO: 8333699 - DNA, 22 bp, Homo sapiens
cagagcagcagagcttccatgg

SEQ ID NO: 8333700 - DNA, 22 bp, Homo sapiens
ggaacagcgtggggctctcctg

SEQ ID NO: 8333701 - DNA, 18 bp, Homo sapiens
ggagagtgacagagtcgt

SEQ ID NO: 8333702 - DNA, 22 bp, Homo sapiens
ggaggtggaggttgcagtgagc

SEQ ID NO: 8333703 - DNA, 22 bp, Homo sapiens
ggctgctcacgcagccctccct

SEQ ID NO: 8333704 - DNA, 18 bp, Homo sapiens
ggctgctcgctctccccg

SEQ ID NO: 8333705 - DNA, 22 bp, Homo sapiens
gaggaaggctaaggggcttaga

SEQ ID NO: 8333706 - DNA, 22 bp, Homo sapiens
gaggaaggaatgcagtgtatgc

SEQ ID NO: 8333707 - DNA, 22 bp, Homo sapiens
gaggaaggagggaaagcgcgcg

SEQ ID NO: 8333708 - DNA, 22 bp, Homo sapiens
gagcagctgagctggaatgaga

SEQ ID NO: 8333709 - DNA, 22 bp, Homo sapiens
gagcagctcgagaaggaagcag

SEQ ID NO: 8333710 - DNA, 22 bp, Homo sapiens
gcagccaggctacagcgggctt

SEQ ID NO: 8333711 - DNA, 22 bp, Homo sapiens
gcagccagggctaagctgggga

SEQ ID NO: 8333712 - DNA, 22 bp, Homo sapiens
gcactcaggactctcatcagta

SEQ ID NO: 8333713 - DNA, 22 bp, Homo sapiens
gcactcagtaccaggtcactgc

SEQ ID NO: 8333714 - DNA, 21 bp, Homo sapiens
gccactgcactccagcctggg

SEQ ID NO: 8333715 - DNA, 22 bp, Homo sapiens
gctcagggctaaggctgagggg

SEQ ID NO: 8333716 - DNA, 22 bp, Homo sapiens
gctcgcagatcacctgggggcg

SEQ ID NO: 8333717 - DNA, 22 bp, Homo sapiens
aggctagaggcttctggcttca

SEQ ID NO: 8333718 - DNA, 22 bp, Homo sapiens
ccagggctcaggctcccagtgg

SEQ ID NO: 8333719 - DNA, 22 bp, Homo sapiens
agggcgacaatggagagcgttt

SEQ ID NO: 8333720 - DNA, 22 bp, Homo sapiens
cagtgaggagtccagggcagag

SEQ ID NO: 8333721 - DNA, 22 bp, Homo sapiens
agctgggcaccccgctgcgtct

SEQ ID NO: 8333722 - DNA, 22 bp, Homo sapiens
aggaagagggtggcagataatc

SEQ ID NO: 8333723 - DNA, 17 bp, Homo sapiens
aggtgcagaggcagagc

SEQ ID NO: 8333724 - DNA, 22 bp, Homo sapiens
ctgagctctaatgtcagccttg

SEQ ID NO: 8333725 - DNA, 22 bp, Homo sapiens
ctcaccacaccgtcggcctcct

SEQ ID NO: 8333726 - DNA, 22 bp, Homo sapiens
ctcaccacagagcctgtccagc

SEQ ID NO: 8333727 - DNA, 22 bp, Homo sapiens
agtgctctgggtccactccaga

SEQ ID NO: 8333728 - DNA, 22 bp, Homo sapiens
actgccagtcattccacaattt

SEQ ID NO: 8333729 - DNA, 22 bp, Homo sapiens
accaggaggtgtttgctcaagt

SEQ ID NO: 8333730 - DNA, 19 bp, Homo sapiens
accaggagtatcagagctg

SEQ ID NO: 8333731 - DNA, 22 bp, Homo sapiens
aggaggggcatagaaatgtaat

SEQ ID NO: 8333732 - DNA, 22 bp, Homo sapiens
aggaggggttctcgggtgctga

SEQ ID NO: 8333733 - DNA, 22 bp, Homo sapiens
atgcaggttgggcaagtgtggg

SEQ ID NO: 8333734 - DNA, 22 bp, Homo sapiens
atgcaggtaaccacacttcaca

SEQ ID NO: 8333735 - DNA, 22 bp, Homo sapiens
atgcaggttggatcctatgccc

SEQ ID NO: 8333736 - DNA, 17 bp, Homo sapiens
atgcaggtgtgaggggc

SEQ ID NO: 8333737 - DNA, 22 bp, Homo sapiens
attggccatttgcatgtattat

SEQ ID NO: 8333738 - DNA, 22 bp, Homo sapiens
agcatgcaggaaccacatggca

SEQ ID NO: 8333739 - DNA, 22 bp, Homo sapiens
agcagtcttgagggatgctaga

SEQ ID NO: 8333740 - DNA, 22 bp, Homo sapiens
agcagctcaacagtgtctctat

SEQ ID NO: 8333741 - DNA, 21 bp, Homo sapiens
agcaggaggcagtcacagctc

SEQ ID NO: 8333742 - DNA, 22 bp, Homo sapiens
aagtggctaacagtccttgcct

SEQ ID NO: 8333743 - DNA, 22 bp, Homo sapiens
tccactgcagcttctgatggaa

SEQ ID NO: 8333744 - DNA, 20 bp, Homo sapiens
tccactgccggaccggggtt

SEQ ID NO: 8333745 - DNA, 23 bp, Homo sapiens
tccaggagaacccctgtctgtcc

SEQ ID NO: 8333746 - DNA, 22 bp, Homo sapiens
tccctgcatttgggagagtgtc

SEQ ID NO: 8333747 - DNA, 22 bp, Homo sapiens
tccctgcagtaggcagccctcc

SEQ ID NO: 8333748 - DNA, 20 bp, Homo sapiens
tcagccattccttacctttc

SEQ ID NO: 8333749 - DNA, 22 bp, Homo sapiens
tcaggagcagggggaagctctg

SEQ ID NO: 8333750 - DNA, 22 bp, Homo sapiens
gttactcttgagaggctgaggt

SEQ ID NO: 8333751 - DNA, 22 bp, Homo sapiens
tagatgcatagagcacagcaca

SEQ ID NO: 8333752 - DNA, 22 bp, Homo sapiens
gctctccagctacccctttagc

SEQ ID NO: 8333753 - DNA, 22 bp, Homo sapiens
gctgcacttgagcctgggagaa

SEQ ID NO: 8333754 - DNA, 22 bp, Homo sapiens
gctgcactttgactgctggggt

SEQ ID NO: 8333755 - DNA, 22 bp, Homo sapiens
gcagggctcagccgctcccacc

SEQ ID NO: 8333756 - DNA, 22 bp, Homo sapiens
gcaggctccaactggaggagtt

SEQ ID NO: 8333757 - DNA, 22 bp, Homo sapiens
ggccaggagctgcacagggctc

SEQ ID NO: 8333758 - DNA, 22 bp, Homo sapiens
ggccaggaggcaggggctcaat

SEQ ID NO: 8333759 - DNA, 22 bp, Homo sapiens
ggccaggagcaagccaggctct

SEQ ID NO: 8333760 - DNA, 22 bp, Homo sapiens
gggcactctgctcccagtgttt

SEQ ID NO: 8333761 - DNA, 22 bp, Homo sapiens
gggcactcagctgtagagcagg

SEQ ID NO: 8333762 - DNA, 22 bp, Homo sapiens
ggggcagaaagcccacagagtg

SEQ ID NO: 8333763 - DNA, 22 bp, Homo sapiens
gggggccatcttcaaggatgtg

SEQ ID NO: 8333764 - DNA, 20 bp, Homo sapiens
gggggccagcagcagacgcc

SEQ ID NO: 8333765 - DNA, 22 bp, Homo sapiens
gggctctctttttggcctgccc

SEQ ID NO: 8333766 - DNA, 21 bp, Homo sapiens
gggctctcctgaggccatgaa

SEQ ID NO: 8333767 - DNA, 22 bp, Homo sapiens
gggctctcgattagaccctggg

SEQ ID NO: 8333768 - DNA, 22 bp, Homo sapiens
gggctctcaaggcagggcccca

SEQ ID NO: 8333769 - DNA, 19 bp, Homo sapiens
gggctctactctcagtctt

SEQ ID NO: 8333770 - DNA, 22 bp, Homo sapiens
cggctgggttcggctgcaggcc

SEQ ID NO: 8333771 - DNA, 20 bp, Homo sapiens
ctgctccacccggctctcag

SEQ ID NO: 8333772 - DNA, 22 bp, Homo sapiens
ctgccctgggagtacctgtcct

SEQ ID NO: 8333773 - DNA, 22 bp, Homo sapiens
ctgccctgagggcctgtgtgtt

SEQ ID NO: 8333774 - DNA, 22 bp, Homo sapiens
ctgcaggttaggagcactcctt

SEQ ID NO: 8333775 - DNA, 22 bp, Homo sapiens
ctgcagtgaaatcaggaagcaa

SEQ ID NO: 8333776 - DNA, 22 bp, Homo sapiens
ctcccttcaggagaggctcaca

SEQ ID NO: 8333777 - DNA, 22 bp, Homo sapiens
ctcccagggccatcgagtcact

SEQ ID NO: 8333778 - DNA, 22 bp, Homo sapiens
ctccccaccttcgcggtccctg

SEQ ID NO: 8333779 - DNA, 22 bp, Homo sapiens
gactgccagaatgtgaggcctg

SEQ ID NO: 8333780 - DNA, 21 bp, Homo sapiens
gagcatctccttcctcctgct

SEQ ID NO: 8333781 - DNA, 22 bp, Homo sapiens
ctgggcacttgctcacagctct

SEQ ID NO: 8333782 - DNA, 22 bp, Homo sapiens
ctgggcactttggggagcctac

SEQ ID NO: 8333783 - DNA, 22 bp, Homo sapiens
cctctccagcggcctcagggcc

SEQ ID NO: 8333784 - DNA, 22 bp, Homo sapiens
cctctccagttttaacgtgacc

SEQ ID NO: 8333785 - DNA, 22 bp, Homo sapiens
cctgcagggaatcgaggcagaa

SEQ ID NO: 8333786 - DNA, 22 bp, Homo sapiens
tgcaggaattttttgcagaaag

SEQ ID NO: 8333787 - DNA, 22 bp, Homo sapiens
tcttgcacttcatgaatatgtt

SEQ ID NO: 8333788 - DNA, 22 bp, Homo sapiens
ccagggctctgcttctgccatg

SEQ ID NO: 8333789 - DNA, 22 bp, Homo sapiens
ccaggagcctgggccaggctgg

SEQ ID NO: 8333790 - DNA, 22 bp, Homo sapiens
ccaggagcaccaggcctgtgcc

SEQ ID NO: 8333791 - DNA, 22 bp, Homo sapiens
ccaggagcaggagctgcagctg

SEQ ID NO: 8333792 - DNA, 22 bp, Homo sapiens
tccagggcagtgactacagcgg

SEQ ID NO: 8333793 - DNA, 22 bp, Homo sapiens
tccagggcatgctcagactcag

SEQ ID NO: 8333794 - DNA, 22 bp, Homo sapiens
ttgccagggaacagggagaggc

SEQ ID NO: 8333795 - DNA, 22 bp, Homo sapiens
ttgccaggcttgtttctaggct

SEQ ID NO: 8333796 - DNA, 22 bp, Homo sapiens
ttgccaggagacatctggagcc

SEQ ID NO: 8333797 - DNA, 22 bp, Homo sapiens
ttgccaggagacaaagtgggcc

SEQ ID NO: 8333798 - DNA, 22 bp, Homo sapiens
ttgccagggtcaggatgagatc

SEQ ID NO: 8333799 - DNA, 22 bp, Homo sapiens
ttgccaggggacatctggagcc

SEQ ID NO: 8333800 - DNA, 22 bp, Homo sapiens
ttgccagggctttggtggcatc

SEQ ID NO: 8333801 - DNA, 22 bp, Homo sapiens
ttctccagctcatcagggaggg

SEQ ID NO: 8333802 - DNA, 19 bp, Homo sapiens
ttctccagcctgacctgag

SEQ ID NO: 8333803 - DNA, 22 bp, Homo sapiens
ttctccagcctattggcctatc

SEQ ID NO: 8333804 - DNA, 22 bp, Homo sapiens
ttctccaggcttgggccaggtc

SEQ ID NO: 8333805 - DNA, 22 bp, Homo sapiens
ttctccagtcactgacttcgag

SEQ ID NO: 8333806 - DNA, 20 bp, Homo sapiens
ttctccagtgcggtagccat

SEQ ID NO: 8333807 - DNA, 22 bp, Homo sapiens
atttattgagagggaggggaat

SEQ ID NO: 8333808 - DNA, 22 bp, Homo sapiens
gccaggagtgtgtggctatgtt

SEQ ID NO: 8333809 - DNA, 22 bp, Homo sapiens
gcctctcctggagaaggcaggg

SEQ ID NO: 8333810 - DNA, 22 bp, Homo sapiens
gcctctccgagccactgcctct

SEQ ID NO: 8333811 - DNA, 21 bp, Homo sapiens
gcctctccaaatcctgccttc

SEQ ID NO: 8333812 - DNA, 22 bp, Homo sapiens
gagctgggcctgcgagtgctgc

SEQ ID NO: 8333813 - DNA, 22 bp, Homo sapiens
gagaggaagccagggggtgttg

SEQ ID NO: 8333814 - DNA, 22 bp, Homo sapiens
cactggcattagtcacgaggca

SEQ ID NO: 8333815 - DNA, 22 bp, Homo sapiens
ggatgttctggggttctcttgt

SEQ ID NO: 8333816 - DNA, 22 bp, Homo sapiens
ggcactgggaatgcagtgatga

SEQ ID NO: 8333817 - DNA, 22 bp, Homo sapiens
ggcatagatttctttaggttta

SEQ ID NO: 8333818 - DNA, 21 bp, Homo sapiens
cactgcagccttgacctgggc

SEQ ID NO: 8333819 - DNA, 22 bp, Homo sapiens
ggctagggatctagaccaggac

SEQ ID NO: 8333820 - DNA, 22 bp, Homo sapiens
cactgcagtaactctaggactg

SEQ ID NO: 8333821 - DNA, 22 bp, Homo sapiens
ctgggcacagtggctcacgcct

SEQ ID NO: 8333822 - DNA, 22 bp, Homo sapiens
ctgggcacagcgttgggctctt

SEQ ID NO: 8333823 - DNA, 21 bp, Homo sapiens
ctgctctggggaccggctgtg

SEQ ID NO: 8333824 - DNA, 22 bp, Homo sapiens
ctgccaggcactgggctctgca

SEQ ID NO: 8333825 - DNA, 22 bp, Homo sapiens
ctgccaggcacgtgcagcatca

SEQ ID NO: 8333826 - DNA, 22 bp, Homo sapiens
ctgccaggactgacgtcttcag

SEQ ID NO: 8333827 - DNA, 21 bp, Homo sapiens
ctgccaggatagcatgcaggc

SEQ ID NO: 8333828 - DNA, 22 bp, Homo sapiens
ctgccaggcagggagatggctg

SEQ ID NO: 8333829 - DNA, 22 bp, Homo sapiens
ctgccaggcagcagagggagaa

SEQ ID NO: 8333830 - DNA, 22 bp, Homo sapiens
ctgccaggcctcatcccagcca

SEQ ID NO: 8333831 - DNA, 22 bp, Homo sapiens
cctctgccacctcccacgaggc

SEQ ID NO: 8333832 - DNA, 22 bp, Homo sapiens
cctctgcagcagagagccagag

SEQ ID NO: 8333833 - DNA, 19 bp, Homo sapiens
cctctgcatggaaacagct

SEQ ID NO: 8333834 - DNA, 22 bp, Homo sapiens
ctctccatctgtgtgacctccc

SEQ ID NO: 8333835 - DNA, 22 bp, Homo sapiens
ctctccattccctacagttttc

SEQ ID NO: 8333836 - DNA, 22 bp, Homo sapiens
agtggctttttagtggcagatg

SEQ ID NO: 8333837 - DNA, 22 bp, Homo sapiens
agggcagcctctcagcctaggt

SEQ ID NO: 8333838 - DNA, 22 bp, Homo sapiens
agggccagggaagctgtatttt

SEQ ID NO: 8333839 - DNA, 22 bp, Homo sapiens
agggccagggaaacgatcagca

SEQ ID NO: 8333840 - DNA, 22 bp, Homo sapiens
agggccagctagagccctcgcc

SEQ ID NO: 8333841 - DNA, 22 bp, Homo sapiens
agggccagccgacttccagcct

SEQ ID NO: 8333842 - DNA, 19 bp, Homo sapiens
agggccaggattctggaac

SEQ ID NO: 8333843 - DNA, 22 bp, Homo sapiens
cctccccacccacggctggtgg

SEQ ID NO: 8333844 - DNA, 22 bp, Homo sapiens
aggctccatggttctccctcag

SEQ ID NO: 8333845 - DNA, 22 bp, Homo sapiens
ccaggctctatccctccttctt

SEQ ID NO: 8333846 - DNA, 22 bp, Homo sapiens
aggccaggaatccttgtcccag

SEQ ID NO: 8333847 - DNA, 22 bp, Homo sapiens
aggccaggaccattagcccaga

SEQ ID NO: 8333848 - DNA, 22 bp, Homo sapiens
catgcactttgatggagagcgt

SEQ ID NO: 8333849 - DNA, 23 bp, Homo sapiens
aggagaagagatttccacatgca

SEQ ID NO: 8333850 - DNA, 21 bp, Homo sapiens
aggaggagagcttggcctacc

SEQ ID NO: 8333851 - DNA, 22 bp, Homo sapiens
caggacagacagaatgcctaac

SEQ ID NO: 8333852 - DNA, 22 bp, Homo sapiens
agagggagtgaaatggaataga

SEQ ID NO: 8333853 - DNA, 22 bp, Homo sapiens
agccaggatggtctcgatcggc

SEQ ID NO: 8333854 - DNA, 22 bp, Homo sapiens
agcaggagacatgggggtggtg

SEQ ID NO: 8333855 - DNA, 22 bp, Homo sapiens
agggaagaggaccagagtctct

SEQ ID NO: 8333856 - DNA, 23 bp, Homo sapiens
agctgggcaaggatccgggctcc

SEQ ID NO: 8333857 - DNA, 22 bp, Homo sapiens
aagagggctgcaatcttattgc

SEQ ID NO: 8333858 - DNA, 22 bp, Homo sapiens
agaggctctggtgcagcatgca

SEQ ID NO: 8333859 - DNA, 22 bp, Homo sapiens
agaggctctaataccagcatgg

SEQ ID NO: 8333860 - DNA, 22 bp, Homo sapiens
acactcagtaaacgacaatggg

SEQ ID NO: 8333861 - DNA, 18 bp, Homo sapiens
agcagagagtgaatggga

SEQ ID NO: 8333862 - DNA, 22 bp, Homo sapiens
actctccagggatttaggatgg

SEQ ID NO: 8333863 - DNA, 22 bp, Homo sapiens
actctccacccactcactctgt

SEQ ID NO: 8333864 - DNA, 22 bp, Homo sapiens
aagtctctggtgatgcaggaaa

SEQ ID NO: 8333865 - DNA, 22 bp, Homo sapiens
actgcactccagcctgggcggc

SEQ ID NO: 8333866 - DNA, 22 bp, Homo sapiens
actgcactccagcctgggcgac

SEQ ID NO: 8333867 - DNA, 22 bp, Homo sapiens
aaggctcaaagaagctaagtga

SEQ ID NO: 8333868 - DNA, 22 bp, Homo sapiens
accctgcagggcagaggctggt

SEQ ID NO: 8333869 - DNA, 22 bp, Homo sapiens
gttcaagaccagcctggccaac

SEQ ID NO: 8333870 - DNA, 22 bp, Homo sapiens
ggccatggtcatgggtgagctt

SEQ ID NO: 8333871 - DNA, 20 bp, Homo sapiens
ggctcatcttgtctgctgac

SEQ ID NO: 8333872 - DNA, 22 bp, Homo sapiens
ggctgctctgccttccagctgg

SEQ ID NO: 8333873 - DNA, 19 bp, Homo sapiens
ggctctcccttgagagagc

SEQ ID NO: 8333874 - DNA, 22 bp, Homo sapiens
gggacgagccccaggctggagg

SEQ ID NO: 8333875 - DNA, 19 bp, Homo sapiens
gggcccagcatggagggtt

SEQ ID NO: 8333876 - DNA, 22 bp, Homo sapiens
gggcagcctcggtgcctgctgc

SEQ ID NO: 8333877 - DNA, 22 bp, Homo sapiens
gggccaggtggaccccagcctc

SEQ ID NO: 8333878 - DNA, 22 bp, Homo sapiens
ggagagggtgtggaaagttatc

SEQ ID NO: 8333879 - DNA, 22 bp, Homo sapiens
ggaggccagcctgaggctgagg

SEQ ID NO: 8333880 - DNA, 22 bp, Homo sapiens
ggaggaagggtagcataatgta

SEQ ID NO: 8333881 - DNA, 16 bp, Homo sapiens
ggaggaaggcatagtg

SEQ ID NO: 8333882 - DNA, 22 bp, Homo sapiens
ggaaggggtgggtgagcctcag

SEQ ID NO: 8333883 - DNA, 22 bp, Homo sapiens
ggagggggaattcagccccagc

SEQ ID NO: 8333884 - DNA, 22 bp, Homo sapiens
ggagggggaagaagctaaagac

SEQ ID NO: 8333885 - DNA, 22 bp, Homo sapiens
ggcagaggaagctggaagtggg

SEQ ID NO: 8333886 - DNA, 22 bp, Homo sapiens
gagctgggacatgggtcctctc

SEQ ID NO: 8333887 - DNA, 22 bp, Homo sapiens
gaggaaggtcccatcagaattt

SEQ ID NO: 8333888 - DNA, 22 bp, Homo sapiens
gaggaagggctgcctgccgggc

SEQ ID NO: 8333889 - DNA, 20 bp, Homo sapiens
gacaggagagttaggtaggt

SEQ ID NO: 8333890 - DNA, 22 bp, Homo sapiens
gagagctccttcaggaagcttc

SEQ ID NO: 8333891 - DNA, 22 bp, Homo sapiens
gcaggagaacaaagcaagctgc

SEQ ID NO: 8333892 - DNA, 20 bp, Homo sapiens
gccagaggccggcaggggct

SEQ ID NO: 8333893 - DNA, 19 bp, Homo sapiens
gccatgggctggcagcaga

SEQ ID NO: 8333894 - DNA, 22 bp, Homo sapiens
ctccaggggccagaagcctggc

SEQ ID NO: 8333895 - DNA, 22 bp, Homo sapiens
ctcctctccatcagcgccaccc

SEQ ID NO: 8333896 - DNA, 22 bp, Homo sapiens
ctctccagcctttagcccacgc

SEQ ID NO: 8333897 - DNA, 19 bp, Homo sapiens
ctctccagctccagtagct

SEQ ID NO: 8333898 - DNA, 22 bp, Homo sapiens
ctctccagcagatgtagtctgt

SEQ ID NO: 8333899 - DNA, 22 bp, Homo sapiens
ctctccagatctgctgagccag

SEQ ID NO: 8333900 - DNA, 22 bp, Homo sapiens
ctctcctccaggaactcacagt

SEQ ID NO: 8333901 - DNA, 22 bp, Homo sapiens
ctctccctatgcctcccaggag

SEQ ID NO: 8333902 - DNA, 22 bp, Homo sapiens
ctctccaggactttggcccaat

SEQ ID NO: 8333903 - DNA, 22 bp, Homo sapiens
ctctccaggagagcactttgag

SEQ ID NO: 8333904 - DNA, 22 bp, Homo sapiens
ctgcctggccacaacccagggt

SEQ ID NO: 8333905 - DNA, 22 bp, Homo sapiens
ctgccagggcatcctgtggtgg

SEQ ID NO: 8333906 - DNA, 22 bp, Homo sapiens
ctgccaggctgtcccaggtccg

SEQ ID NO: 8333907 - DNA, 22 bp, Homo sapiens
ctgccaggcctccgctgtcccc

SEQ ID NO: 8333908 - DNA, 22 bp, Homo sapiens
ctgccaggcctggggtgctgtc

SEQ ID NO: 8333909 - DNA, 22 bp, Homo sapiens
ctgccatgcagttagtccctca

SEQ ID NO: 8333910 - DNA, 22 bp, Homo sapiens
ctgccaggtgagctccaggcct

SEQ ID NO: 8333911 - DNA, 22 bp, Homo sapiens
ctgccaggttggcgctcgctct

SEQ ID NO: 8333912 - DNA, 22 bp, Homo sapiens
ctgccaggtgccagggcgcggc

SEQ ID NO: 8333913 - DNA, 22 bp, Homo sapiens
ctgccaggtgcctttgtgcagt

SEQ ID NO: 8333914 - DNA, 22 bp, Homo sapiens
tgtctggtgggttgacaggcag

SEQ ID NO: 8333915 - DNA, 22 bp, Homo sapiens
ccctccaggcactgccctcttc

SEQ ID NO: 8333916 - DNA, 22 bp, Homo sapiens
cctcggggcaccgcggcctgct

SEQ ID NO: 8333917 - DNA, 22 bp, Homo sapiens
cctcggtttccacatctgtaca

SEQ ID NO: 8333918 - DNA, 23 bp, Homo sapiens
cctctccagacactgggccttgt

SEQ ID NO: 8333919 - DNA, 22 bp, Homo sapiens
caggaagctgatgtctagtcat

SEQ ID NO: 8333920 - DNA, 22 bp, Homo sapiens
caggaagctgagctgcactgca

SEQ ID NO: 8333921 - DNA, 22 bp, Homo sapiens
caggaagcatctggctagctaa

SEQ ID NO: 8333922 - DNA, 22 bp, Homo sapiens
caggaggaagaactctgcaaca

SEQ ID NO: 8333923 - DNA, 22 bp, Homo sapiens
cagctggggagagacatggcag

SEQ ID NO: 8333924 - DNA, 22 bp, Homo sapiens
tctccagtgaatctcctcctgg

SEQ ID NO: 8333925 - DNA, 22 bp, Homo sapiens
tctccagtatctttccaatgaa

SEQ ID NO: 8333926 - DNA, 22 bp, Homo sapiens
ccagaggacttgggggctgaat

SEQ ID NO: 8333927 - DNA, 22 bp, Homo sapiens
tctgccagaagccagggtctgg

SEQ ID NO: 8333928 - DNA, 22 bp, Homo sapiens
tctgccagctctgtgggtctcg

SEQ ID NO: 8333929 - DNA, 22 bp, Homo sapiens
ccaggaactcagctctgcactt

SEQ ID NO: 8333930 - DNA, 22 bp, Homo sapiens
caggggcaggtgtgagatcatc

SEQ ID NO: 8333931 - DNA, 22 bp, Homo sapiens
tggtatgaccgtggtgcaagca

SEQ ID NO: 8333932 - DNA, 22 bp, Homo sapiens
tgggcgaggcccagggctgcgt

SEQ ID NO: 8333933 - DNA, 23 bp, Homo sapiens
tgggcgaggcaggagtggagcac

SEQ ID NO: 8333934 - DNA, 22 bp, Homo sapiens
tgggccaggggcctcttctgat

SEQ ID NO: 8333935 - DNA, 22 bp, Homo sapiens
tgggccaggcatgtgatcagca

SEQ ID NO: 8333936 - DNA, 22 bp, Homo sapiens
tgggccagggcacccagtccag

SEQ ID NO: 8333937 - DNA, 22 bp, Homo sapiens
tggtgcaaaactaattgcggtt

SEQ ID NO: 8333938 - DNA, 23 bp, Homo sapiens
tggccagggtactacacccaccc

SEQ ID NO: 8333939 - DNA, 22 bp, Homo sapiens
tgaggccaatgaccctgggcag

SEQ ID NO: 8333940 - DNA, 22 bp, Homo sapiens
tgaggaagtggttgtatggttt

SEQ ID NO: 8333941 - DNA, 22 bp, Homo sapiens
tgaggaagggtgtgacggcacc

SEQ ID NO: 8333942 - DNA, 22 bp, Homo sapiens
tgcagaggagctggaaggctgg

SEQ ID NO: 8333943 - DNA, 21 bp, Homo sapiens
tgcacagggcccaggagagcc

SEQ ID NO: 8333944 - DNA, 19 bp, Homo sapiens
tgcaggaggactgagcaga

SEQ ID NO: 8333945 - DNA, 22 bp, Homo sapiens
tgcaggctcacctgccagggcc

SEQ ID NO: 8333946 - DNA, 21 bp, Homo sapiens
tgcaggctacttctgactcta

SEQ ID NO: 8333947 - DNA, 22 bp, Homo sapiens
tgcagcctctctgcttcaggaa

SEQ ID NO: 8333948 - DNA, 21 bp, Homo sapiens
tgcaggctgtgcgctcctgcc

SEQ ID NO: 8333949 - DNA, 22 bp, Homo sapiens
tgcaggctgggaagagggacaa

SEQ ID NO: 8333950 - DNA, 22 bp, Homo sapiens
tgcaggctgccttcacagagcc

SEQ ID NO: 8333951 - DNA, 22 bp, Homo sapiens
tgcaggctgcacccctgccctg

SEQ ID NO: 8333952 - DNA, 22 bp, Homo sapiens
tgcaggctgcagtctcaggtgg

SEQ ID NO: 8333953 - DNA, 22 bp, Homo sapiens
tgcaggctccatgaggacaggc

SEQ ID NO: 8333954 - DNA, 22 bp, Homo sapiens
tgcaggctctctgctgccagat

SEQ ID NO: 8333955 - DNA, 20 bp, Homo sapiens
tgcaggtgttggagaaggta

SEQ ID NO: 8333956 - DNA, 22 bp, Homo sapiens
tgcaggtgtgggcaggggagca

SEQ ID NO: 8333957 - DNA, 22 bp, Homo sapiens
tgcaggtgtctccagggcaggt

SEQ ID NO: 8333958 - DNA, 20 bp, Homo sapiens
tgccagggccagcagaggct

SEQ ID NO: 8333959 - DNA, 22 bp, Homo sapiens
tgccagggtcctgagggccttg

SEQ ID NO: 8333960 - DNA, 22 bp, Homo sapiens
tgccagggctgctactggctga

SEQ ID NO: 8333961 - DNA, 22 bp, Homo sapiens
tgcctagggcctaaccagagcc

SEQ ID NO: 8333962 - DNA, 19 bp, Homo sapiens
tgccctgcccgcagccttg

SEQ ID NO: 8333963 - DNA, 22 bp, Homo sapiens
tctcacagtgcaggtctgtctc

SEQ ID NO: 8333964 - DNA, 19 bp, Homo sapiens
tctcacagtttccttgcct

SEQ ID NO: 8333965 - DNA, 22 bp, Homo sapiens
tctcacaggtgcacgtggctgt

SEQ ID NO: 8333966 - DNA, 22 bp, Homo sapiens
tctccaggaagccctccctgac

SEQ ID NO: 8333967 - DNA, 22 bp, Homo sapiens
tctcccaggcaggagtgcagtg

SEQ ID NO: 8333968 - DNA, 22 bp, Homo sapiens
tctcccaggctggagtgcagtg

SEQ ID NO: 8333969 - DNA, 22 bp, Homo sapiens
tctccccaaccatggcactcac

SEQ ID NO: 8333970 - DNA, 22 bp, Homo sapiens
tctcccagaagtcctcagtaca

SEQ ID NO: 8333971 - DNA, 21 bp, Homo sapiens
tctccagtatccttctctgag

SEQ ID NO: 8333972 - DNA, 22 bp, Homo sapiens
tctctcagcattactcttacta

SEQ ID NO: 8333973 - DNA, 22 bp, Homo sapiens
tctcacagccatttctccctct

SEQ ID NO: 8333974 - DNA, 20 bp, Homo sapiens
tctcacagacatcgtctcat

SEQ ID NO: 8333975 - DNA, 22 bp, Homo sapiens
tctacctggagtccgttgttaa

SEQ ID NO: 8333976 - DNA, 22 bp, Homo sapiens
tcgttatagaacattcttgggt

SEQ ID NO: 8333977 - DNA, 22 bp, Homo sapiens
tcctttgcttctgtcattctcc

SEQ ID NO: 8333978 - DNA, 22 bp, Homo sapiens
tctgggtctttacccatggaat

SEQ ID NO: 8333979 - DNA, 23 bp, Homo sapiens
tctgcaagataatgaagatgata

SEQ ID NO: 8333980 - DNA, 21 bp, Homo sapiens
tctgccagtttctcttacttt

SEQ ID NO: 8333981 - DNA, 22 bp, Homo sapiens
tctgccagtggtttggccctga

SEQ ID NO: 8333982 - DNA, 22 bp, Homo sapiens
tctgccagtggattcttattct

SEQ ID NO: 8333983 - DNA, 22 bp, Homo sapiens
tctgcaggcttggagtggcagc

SEQ ID NO: 8333984 - DNA, 22 bp, Homo sapiens
tctgcaggctctagatgaggtt

SEQ ID NO: 8333985 - DNA, 22 bp, Homo sapiens
tctgcaggctgtacaggaagca

SEQ ID NO: 8333986 - DNA, 22 bp, Homo sapiens
tctgcaggcttataggatgggt

SEQ ID NO: 8333987 - DNA, 22 bp, Homo sapiens
tctgcaggtagagctcaggaat

SEQ ID NO: 8333988 - DNA, 22 bp, Homo sapiens
tctgcactgggagcatgtctgg

SEQ ID NO: 8333989 - DNA, 22 bp, Homo sapiens
tctgcaaggttcaggaaacctt

SEQ ID NO: 8333990 - DNA, 19 bp, Homo sapiens
tctgcaagtgtcagaggcg

SEQ ID NO: 8333991 - DNA, 22 bp, Homo sapiens
accctgccaaggatggccccga

SEQ ID NO: 8333992 - DNA, 22 bp, Homo sapiens
accctgccaaggatggccccga

SEQ ID NO: 8333993 - DNA, 22 bp, Homo sapiens
accctgccgtgggctgcttgtg

SEQ ID NO: 8333994 - DNA, 22 bp, Homo sapiens
accctgcctctgcttcctgtag

SEQ ID NO: 8333995 - DNA, 22 bp, Homo sapiens
accctgccgtgggctgcttgtg

SEQ ID NO: 8333996 - DNA, 20 bp, Homo sapiens
accctgccaggcatgtgaat

SEQ ID NO: 8333997 - DNA, 20 bp, Homo sapiens
accctgccaggcatgtgaat

SEQ ID NO: 8333998 - DNA, 22 bp, Homo sapiens
accctgccctctccagctcagg

SEQ ID NO: 8333999 - DNA, 22 bp, Homo sapiens
accctgccctctccagctcagg

SEQ ID NO: 8334000 - DNA, 22 bp, Homo sapiens
accctgagaatgagtgtctcct

SEQ ID NO: 8334001 - DNA, 22 bp, Homo sapiens
acccagagtcatggcacttagc

SEQ ID NO: 8334002 - DNA, 22 bp, Homo sapiens
accagggcacaggagtctgaag

SEQ ID NO: 8334003 - DNA, 22 bp, Homo sapiens
accagggcaaatgtttgtactc

SEQ ID NO: 8334004 - DNA, 22 bp, Homo sapiens
aagggctggtctagaaagggag

SEQ ID NO: 8334005 - DNA, 19 bp, Homo sapiens
acccagagccctttgcagg

SEQ ID NO: 8334006 - DNA, 22 bp, Homo sapiens
acattttacaccaagacttctt

SEQ ID NO: 8334007 - DNA, 22 bp, Homo sapiens
acattttacagttgtctggcta

SEQ ID NO: 8334008 - DNA, 22 bp, Homo sapiens
acatttgtgggggaacaggata

SEQ ID NO: 8334009 - DNA, 22 bp, Homo sapiens
acattttgagaaatgacaagct

SEQ ID NO: 8334010 - DNA, 22 bp, Homo sapiens
accaggcccaccgcatgctcct

SEQ ID NO: 8334011 - DNA, 22 bp, Homo sapiens
acattttgagaaatgacaagct

SEQ ID NO: 8334012 - DNA, 21 bp, Homo sapiens
acattttctgttttaggaagt

SEQ ID NO: 8334013 - DNA, 22 bp, Homo sapiens
aaggcgacacaggcagcaggcc

SEQ ID NO: 8334014 - DNA, 22 bp, Homo sapiens
aaggcggggggatcacgaggtc

SEQ ID NO: 8334015 - DNA, 22 bp, Homo sapiens
aaggcctgggaggcctctcttc

SEQ ID NO: 8334016 - DNA, 20 bp, Homo sapiens
aaggcagagtgggttggagc

SEQ ID NO: 8334017 - DNA, 22 bp, Homo sapiens
acatttctcttgatgtctctat

SEQ ID NO: 8334018 - DNA, 22 bp, Homo sapiens
acatttctgagcagggagctgt

SEQ ID NO: 8334019 - DNA, 22 bp, Homo sapiens
aaggctgggaaacatgcaggcc

SEQ ID NO: 8334020 - DNA, 22 bp, Homo sapiens
acatttcatgttttccagagca

SEQ ID NO: 8334021 - DNA, 22 bp, Homo sapiens
acatttcttcctaattatccct

SEQ ID NO: 8334022 - DNA, 22 bp, Homo sapiens
acatttgtgcaacgtatccaca

SEQ ID NO: 8334023 - DNA, 22 bp, Homo sapiens
acatttgtgcaacgtatccaca

SEQ ID NO: 8334024 - DNA, 22 bp, Homo sapiens
acatttcttccctttagcagaa

SEQ ID NO: 8334025 - DNA, 22 bp, Homo sapiens
acatttcttccacatgctgctg

SEQ ID NO: 8334026 - DNA, 22 bp, Homo sapiens
acatttctgctagaataggtga

SEQ ID NO: 8334027 - DNA, 22 bp, Homo sapiens
acatttctggagtttctcaaca

SEQ ID NO: 8334028 - DNA, 22 bp, Homo sapiens
acatttaaatacctatgtttct

SEQ ID NO: 8334029 - DNA, 22 bp, Homo sapiens
acatttaaatatgccttatatt

SEQ ID NO: 8334030 - DNA, 21 bp, Homo sapiens
aaggctggagatgcaggtctg

SEQ ID NO: 8334031 - DNA, 21 bp, Homo sapiens
aaggctggagatgcaggtctg

SEQ ID NO: 8334032 - DNA, 22 bp, Homo sapiens
aaggcagagggctggatcagag

SEQ ID NO: 8334033 - DNA, 22 bp, Homo sapiens
aaggcagagtctatcttggaag

SEQ ID NO: 8334034 - DNA, 22 bp, Homo sapiens
acatatgcatacccaaagcagt

SEQ ID NO: 8334035 - DNA, 20 bp, Homo sapiens
acatatgaatgatagagcca

SEQ ID NO: 8334036 - DNA, 22 bp, Homo sapiens
acatatgagtactatacagtgc

SEQ ID NO: 8334037 - DNA, 22 bp, Homo sapiens
acatatgagtactatacagtgc

SEQ ID NO: 8334038 - DNA, 19 bp, Homo sapiens
acatatgtggatatacatg

SEQ ID NO: 8334039 - DNA, 20 bp, Homo sapiens
acatatgtgtgcatatcttt

SEQ ID NO: 8334040 - DNA, 22 bp, Homo sapiens
acatatgtgcttatatccatga

SEQ ID NO: 8334041 - DNA, 22 bp, Homo sapiens
acatagaacctggcacatagta

SEQ ID NO: 8334042 - DNA, 22 bp, Homo sapiens
acatatgaggtgttattctatg

SEQ ID NO: 8334043 - DNA, 22 bp, Homo sapiens
acatatgaggtgttattctatg

SEQ ID NO: 8334044 - DNA, 22 bp, Homo sapiens
acatatgaggtgttattctatg

SEQ ID NO: 8334045 - DNA, 22 bp, Homo sapiens
acatatgaggtgttattctatg

SEQ ID NO: 8334046 - DNA, 22 bp, Homo sapiens
acatagaacttcccagtgagca

SEQ ID NO: 8334047 - DNA, 22 bp, Homo sapiens
acatagaacctggcacatagta

SEQ ID NO: 8334048 - DNA, 22 bp, Homo sapiens
aaggaggcaccctgagcctgcc

SEQ ID NO: 8334049 - DNA, 22 bp, Homo sapiens
acagtgtttggcaatgcatgca

SEQ ID NO: 8334050 - DNA, 22 bp, Homo sapiens
acagtgttgaggtgcttgtttc

SEQ ID NO: 8334051 - DNA, 22 bp, Homo sapiens
acagtgttgtatttagtttgat

SEQ ID NO: 8334052 - DNA, 22 bp, Homo sapiens
aaggagaggttgtccgtgttgt

SEQ ID NO: 8334053 - DNA, 22 bp, Homo sapiens
aaggagagtacaggagttggta

SEQ ID NO: 8334054 - DNA, 22 bp, Homo sapiens
aaggagagagctttgctggaac

SEQ ID NO: 8334055 - DNA, 22 bp, Homo sapiens
aaggagaatttggcttgtgatg

SEQ ID NO: 8334056 - DNA, 18 bp, Homo sapiens
aagctctggctaggaaaa

SEQ ID NO: 8334057 - DNA, 22 bp, Homo sapiens
aagctgctctcacaacactgtt

SEQ ID NO: 8334058 - DNA, 19 bp, Homo sapiens
acagggcagcaataggata

SEQ ID NO: 8334059 - DNA, 22 bp, Homo sapiens
aagcattttgttttaagaatga

SEQ ID NO: 8334060 - DNA, 22 bp, Homo sapiens
aagcatttttcacagcaacagc

SEQ ID NO: 8334061 - DNA, 22 bp, Homo sapiens
aagcatttttcacagcaacagc

SEQ ID NO: 8334062 - DNA, 22 bp, Homo sapiens
aagcattttagtaatgaacttg

SEQ ID NO: 8334063 - DNA, 22 bp, Homo sapiens
acagccttctctattggcctca

SEQ ID NO: 8334064 - DNA, 21 bp, Homo sapiens
acagcctgtcatctcatggtc

SEQ ID NO: 8334065 - DNA, 21 bp, Homo sapiens
acagcctgtcatctcatggtc

SEQ ID NO: 8334066 - DNA, 22 bp, Homo sapiens
aagctagattggcattcatttc

SEQ ID NO: 8334067 - DNA, 22 bp, Homo sapiens
aagctagataacttttatattt

SEQ ID NO: 8334068 - DNA, 22 bp, Homo sapiens
aagctagatgacgttatttttt

SEQ ID NO: 8334069 - DNA, 22 bp, Homo sapiens
aagcgcccatgcctgagagcgt

SEQ ID NO: 8334070 - DNA, 22 bp, Homo sapiens
aagcctttctctctgggaagga

SEQ ID NO: 8334071 - DNA, 22 bp, Homo sapiens
aagcatttttgaaatggtagga

SEQ ID NO: 8334072 - DNA, 22 bp, Homo sapiens
aagccaaagtgggcatgcctca

SEQ ID NO: 8334073 - DNA, 22 bp, Homo sapiens
aagccaaggagaatggcctcag

SEQ ID NO: 8334074 - DNA, 22 bp, Homo sapiens
actgagtatcacttcttatttt

SEQ ID NO: 8334075 - DNA, 22 bp, Homo sapiens
actgatattaaacacaatttaa

SEQ ID NO: 8334076 - DNA, 22 bp, Homo sapiens
actctgcttccacttttgctaa

SEQ ID NO: 8334077 - DNA, 22 bp, Homo sapiens
actggaggcccctcccagtgaa

SEQ ID NO: 8334078 - DNA, 20 bp, Homo sapiens
actggagccatctcagccta

SEQ ID NO: 8334079 - DNA, 22 bp, Homo sapiens
actggagcccgtggaggcgcag

SEQ ID NO: 8334080 - DNA, 22 bp, Homo sapiens
actgcgggaacccgcggccggc

SEQ ID NO: 8334081 - DNA, 22 bp, Homo sapiens
actgcgggaacccgcggccggc

SEQ ID NO: 8334082 - DNA, 22 bp, Homo sapiens
aatacagaggaaacatttaata

SEQ ID NO: 8334083 - DNA, 22 bp, Homo sapiens
aatacagaggaaacatttaata

SEQ ID NO: 8334084 - DNA, 22 bp, Homo sapiens
actggctcagagttcctagaga

SEQ ID NO: 8334085 - DNA, 22 bp, Homo sapiens
actacacagggatgtgactacc

SEQ ID NO: 8334086 - DNA, 22 bp, Homo sapiens
acgtagcactgagagatgcagg

SEQ ID NO: 8334087 - DNA, 22 bp, Homo sapiens
acgtgcatatgtatacacacat

SEQ ID NO: 8334088 - DNA, 22 bp, Homo sapiens
accgggctaatttttgtatctt

SEQ ID NO: 8334089 - DNA, 22 bp, Homo sapiens
acctagaaactgacagaatatt

SEQ ID NO: 8334090 - DNA, 23 bp, Homo sapiens
actctcaggttctttccagcagg

SEQ ID NO: 8334091 - DNA, 22 bp, Homo sapiens
actctattttctcattttgcat

SEQ ID NO: 8334092 - DNA, 19 bp, Homo sapiens
actctacagtgtgtacaac

SEQ ID NO: 8334093 - DNA, 22 bp, Homo sapiens
actctacagaatgaatacctgt

SEQ ID NO: 8334094 - DNA, 22 bp, Homo sapiens
actctaatgctaatagtatttt

SEQ ID NO: 8334095 - DNA, 22 bp, Homo sapiens
actctaaattgtgccaatatgc

SEQ ID NO: 8334096 - DNA, 22 bp, Homo sapiens
actatacagtatgtacgtgcac

SEQ ID NO: 8334097 - DNA, 22 bp, Homo sapiens
actcactttccattcaagcacc

SEQ ID NO: 8334098 - DNA, 22 bp, Homo sapiens
actatacaccaaaatattaagg

SEQ ID NO: 8334099 - DNA, 22 bp, Homo sapiens
actacagaagtcttattagaga

SEQ ID NO: 8334100 - DNA, 22 bp, Homo sapiens
aatcagaaagaggtcatgttgc

SEQ ID NO: 8334101 - DNA, 22 bp, Homo sapiens
aatcacatgaaaactgtgtgtt

SEQ ID NO: 8334102 - DNA, 22 bp, Homo sapiens
aatcagaaagaggtcatgttgc

SEQ ID NO: 8334103 - DNA, 22 bp, Homo sapiens
actttcttcttatgcattaagg

SEQ ID NO: 8334104 - DNA, 22 bp, Homo sapiens
actttcttctactacttggaga

SEQ ID NO: 8334105 - DNA, 22 bp, Homo sapiens
actttcttaggctgtataaatg

SEQ ID NO: 8334106 - DNA, 22 bp, Homo sapiens
actgttcttcatttagcaaaga

SEQ ID NO: 8334107 - DNA, 22 bp, Homo sapiens
actgttcttcatttagcaaaga

SEQ ID NO: 8334108 - DNA, 22 bp, Homo sapiens
actgttcttgtaacacttaaat

SEQ ID NO: 8334109 - DNA, 22 bp, Homo sapiens
actgttctgcatgctgtgaggg

SEQ ID NO: 8334110 - DNA, 22 bp, Homo sapiens
actgttctgcatgtacctgagg

SEQ ID NO: 8334111 - DNA, 19 bp, Homo sapiens
actgttctgtatgttgatt

SEQ ID NO: 8334112 - DNA, 19 bp, Homo sapiens
actgttctaacttgcagct

SEQ ID NO: 8334113 - DNA, 22 bp, Homo sapiens
aatactgagatcccacaaagca

SEQ ID NO: 8334114 - DNA, 22 bp, Homo sapiens
actgggctgtggacacccagcg

SEQ ID NO: 8334115 - DNA, 22 bp, Homo sapiens
aatatagcattgtatgactgtg

SEQ ID NO: 8334116 - DNA, 22 bp, Homo sapiens
aatatagatttactcaagagaa

SEQ ID NO: 8334117 - DNA, 22 bp, Homo sapiens
aatatagttctagaaatatttt

SEQ ID NO: 8334118 - DNA, 22 bp, Homo sapiens
aatcaggaactcaagtgcattg

SEQ ID NO: 8334119 - DNA, 22 bp, Homo sapiens
aatcagcaaatgcttactcagg

SEQ ID NO: 8334120 - DNA, 22 bp, Homo sapiens
aatcagcagttggaattagata

SEQ ID NO: 8334121 - DNA, 22 bp, Homo sapiens
aatcagagccctctgagcttca

SEQ ID NO: 8334122 - DNA, 22 bp, Homo sapiens
aatcagagcaagacatggaaca

SEQ ID NO: 8334123 - DNA, 22 bp, Homo sapiens
aatcagagaagtttcctatgcc

SEQ ID NO: 8334124 - DNA, 22 bp, Homo sapiens
aatcagcaaaggtcagctctaa

SEQ ID NO: 8334125 - DNA, 22 bp, Homo sapiens
aatcagagtcccaagatctgta

SEQ ID NO: 8334126 - DNA, 21 bp, Homo sapiens
aatcagaggcttcctagttgg

SEQ ID NO: 8334127 - DNA, 22 bp, Homo sapiens
aatcagaggaagtcaacggatc

SEQ ID NO: 8334128 - DNA, 22 bp, Homo sapiens
aatcagtgcaaaggagagggta

SEQ ID NO: 8334129 - DNA, 22 bp, Homo sapiens
aatcagtggttcccagcccagg

SEQ ID NO: 8334130 - DNA, 22 bp, Homo sapiens
aatcagtgtggtgacttgtctg

SEQ ID NO: 8334131 - DNA, 22 bp, Homo sapiens
aatcagtgtgtaaagtggctgc

SEQ ID NO: 8334132 - DNA, 22 bp, Homo sapiens
aatcagttaaatattgagtaca

SEQ ID NO: 8334133 - DNA, 22 bp, Homo sapiens
aatcagtcattagctctgacct

SEQ ID NO: 8334134 - DNA, 22 bp, Homo sapiens
aatcagtattggtatagaatga

SEQ ID NO: 8334135 - DNA, 19 bp, Homo sapiens
aatcaggctgaagtgtgtt

SEQ ID NO: 8334136 - DNA, 22 bp, Homo sapiens
aatcaggccaagtgaagtggga

SEQ ID NO: 8334137 - DNA, 22 bp, Homo sapiens
aatcaggcaaggaaaggagtta

SEQ ID NO: 8334138 - DNA, 22 bp, Homo sapiens
aatcaggccatggagaagagat

SEQ ID NO: 8334139 - DNA, 22 bp, Homo sapiens
aatcataattcaaataagctta

SEQ ID NO: 8334140 - DNA, 22 bp, Homo sapiens
aatcagttgttcactctgaaaa

SEQ ID NO: 8334141 - DNA, 22 bp, Homo sapiens
aatcagtttcttggcaagttta

SEQ ID NO: 8334142 - DNA, 22 bp, Homo sapiens
aatcagttagaaggaagagaat

SEQ ID NO: 8334143 - DNA, 22 bp, Homo sapiens
aatcagttagggtgttaatgag

SEQ ID NO: 8334144 - DNA, 22 bp, Homo sapiens
aatcagttctacatcttatcca

SEQ ID NO: 8334145 - DNA, 22 bp, Homo sapiens
aatcagttgtccaaagttcaca

SEQ ID NO: 8334146 - DNA, 20 bp, Homo sapiens
agaacaagtactaaaggaga

SEQ ID NO: 8334147 - DNA, 22 bp, Homo sapiens
agaacaatgaggtatggatgga

SEQ ID NO: 8334148 - DNA, 22 bp, Homo sapiens
agaaattatgcagtagttttat

SEQ ID NO: 8334149 - DNA, 22 bp, Homo sapiens
agaaatgacacacatgagacat

SEQ ID NO: 8334150 - DNA, 22 bp, Homo sapiens
aatgatttggcaaaggaatcca

SEQ ID NO: 8334151 - DNA, 22 bp, Homo sapiens
aatgatttcccctacacagaag

SEQ ID NO: 8334152 - DNA, 22 bp, Homo sapiens
agaagcagaaactgggcttgtg

SEQ ID NO: 8334153 - DNA, 22 bp, Homo sapiens
agaagcagaaggaagcagggcc

SEQ ID NO: 8334154 - DNA, 22 bp, Homo sapiens
aatgatggtcatggcaactttt

SEQ ID NO: 8334155 - DNA, 22 bp, Homo sapiens
aatgatggtattgatgagctaa

SEQ ID NO: 8334156 - DNA, 22 bp, Homo sapiens
aatgatgggaaggagaaaagca

SEQ ID NO: 8334157 - DNA, 22 bp, Homo sapiens
aatgatggatttagacaagctg

SEQ ID NO: 8334158 - DNA, 22 bp, Homo sapiens
aatgatggtttcatcacttgaa

SEQ ID NO: 8334159 - DNA, 22 bp, Homo sapiens
aatgatggttaaacactggagg

SEQ ID NO: 8334160 - DNA, 23 bp, Homo sapiens
aatgatttcatgatgatagcagc

SEQ ID NO: 8334161 - DNA, 22 bp, Homo sapiens
agcagagcagaatgtgaaggtg

SEQ ID NO: 8334162 - DNA, 22 bp, Homo sapiens
agcagagcagaatgtgaaggtg

SEQ ID NO: 8334163 - DNA, 19 bp, Homo sapiens
agcagagcagggccgtggg

SEQ ID NO: 8334164 - DNA, 22 bp, Homo sapiens
agcagagcatggtgggaagggc

SEQ ID NO: 8334165 - DNA, 21 bp, Homo sapiens
acaatgcatggaactcatggc

SEQ ID NO: 8334166 - DNA, 22 bp, Homo sapiens
agcagcaaagccaggggatggg

SEQ ID NO: 8334167 - DNA, 22 bp, Homo sapiens
agcagagcccttccatggcctt

SEQ ID NO: 8334168 - DNA, 22 bp, Homo sapiens
agcagagcctgggctaggggtg

SEQ ID NO: 8334169 - DNA, 20 bp, Homo sapiens
acacagagtgagtctgcttg

SEQ ID NO: 8334170 - DNA, 22 bp, Homo sapiens
acacagagtccttactgaggta

SEQ ID NO: 8334171 - DNA, 22 bp, Homo sapiens
acacagagtatttagaaggggt

SEQ ID NO: 8334172 - DNA, 22 bp, Homo sapiens
acacagagtggtttgtagaata

SEQ ID NO: 8334173 - DNA, 22 bp, Homo sapiens
acacagagttattatgtgaact

SEQ ID NO: 8334174 - DNA, 22 bp, Homo sapiens
acacagaggctccagagataga

SEQ ID NO: 8334175 - DNA, 22 bp, Homo sapiens
agcagctgagccccagctgtga

SEQ ID NO: 8334176 - DNA, 22 bp, Homo sapiens
acacagatgctatttagtctct

SEQ ID NO: 8334177 - DNA, 22 bp, Homo sapiens
acacagataatgctcatatagg

SEQ ID NO: 8334178 - DNA, 22 bp, Homo sapiens
acacagatattgtacttgatcc

SEQ ID NO: 8334179 - DNA, 22 bp, Homo sapiens
acacagatattgtacttgatcc

SEQ ID NO: 8334180 - DNA, 22 bp, Homo sapiens
acacagatattttgaatacata

SEQ ID NO: 8334181 - DNA, 22 bp, Homo sapiens
agcagctggtgagcaagctcag

SEQ ID NO: 8334182 - DNA, 22 bp, Homo sapiens
agcagctggtgagcaagctcag

SEQ ID NO: 8334183 - DNA, 22 bp, Homo sapiens
acactcagtaaacgacaatggg

SEQ ID NO: 8334184 - DNA, 22 bp, Homo sapiens
acactatacttccattgctggt

SEQ ID NO: 8334185 - DNA, 22 bp, Homo sapiens
acactgaataattgagagttga

SEQ ID NO: 8334186 - DNA, 22 bp, Homo sapiens
acactgaatatacaatgaatat

SEQ ID NO: 8334187 - DNA, 22 bp, Homo sapiens
acactgaagagcactttcaaag

SEQ ID NO: 8334188 - DNA, 22 bp, Homo sapiens
acacccaggaataaggactggg

SEQ ID NO: 8334189 - DNA, 22 bp, Homo sapiens
acacattatagagagtataata

SEQ ID NO: 8334190 - DNA, 22 bp, Homo sapiens
acacattaggcagtgcttaaat

SEQ ID NO: 8334191 - DNA, 22 bp, Homo sapiens
acacattataggcaatcaaaag

SEQ ID NO: 8334192 - DNA, 22 bp, Homo sapiens
acactgagttttaccaggcaca

SEQ ID NO: 8334193 - DNA, 22 bp, Homo sapiens
acactgagtgtagaaatagcca

SEQ ID NO: 8334194 - DNA, 21 bp, Homo sapiens
acactgagtgaattagcacat

SEQ ID NO: 8334195 - DNA, 22 bp, Homo sapiens
acactgagattttcctgacacc

SEQ ID NO: 8334196 - DNA, 22 bp, Homo sapiens
acactgagctgagcattcttgt

SEQ ID NO: 8334197 - DNA, 22 bp, Homo sapiens
acactgagccatacaactggaa

SEQ ID NO: 8334198 - DNA, 22 bp, Homo sapiens
acactgagcatctctagaggca

SEQ ID NO: 8334199 - DNA, 22 bp, Homo sapiens
acactgagaggtgacagcgtgc

SEQ ID NO: 8334200 - DNA, 19 bp, Homo sapiens
acactgaatgtagaattgg

SEQ ID NO: 8334201 - DNA, 22 bp, Homo sapiens
acactgaatgtttaagaacttg

SEQ ID NO: 8334202 - DNA, 22 bp, Homo sapiens
acactgaatgctgtttagaaat

SEQ ID NO: 8334203 - DNA, 22 bp, Homo sapiens
acactgaatgctgtttagaaat

SEQ ID NO: 8334204 - DNA, 17 bp, Homo sapiens
acacagggagagggagc

SEQ ID NO: 8334205 - DNA, 22 bp, Homo sapiens
acacagggatatttcaggtggt

SEQ ID NO: 8334206 - DNA, 22 bp, Homo sapiens
acacagggaggaggtgctgtgc

SEQ ID NO: 8334207 - DNA, 22 bp, Homo sapiens
acacatgtaaaacacttagcaa

SEQ ID NO: 8334208 - DNA, 22 bp, Homo sapiens
acacagggcggaaagcatgaga

SEQ ID NO: 8334209 - DNA, 19 bp, Homo sapiens
acacagggatcagagggtt

SEQ ID NO: 8334210 - DNA, 22 bp, Homo sapiens
acacagggcagagagctggctc

SEQ ID NO: 8334211 - DNA, 22 bp, Homo sapiens
acacagggcaatgctttgacct

SEQ ID NO: 8334212 - DNA, 22 bp, Homo sapiens
acagatgatttttatgaaaaca

SEQ ID NO: 8334213 - DNA, 22 bp, Homo sapiens
acagatgagttagaataggcag

SEQ ID NO: 8334214 - DNA, 22 bp, Homo sapiens
acagatgagttaaagcagagtg

SEQ ID NO: 8334215 - DNA, 22 bp, Homo sapiens
acagatgaggcccatcagtctg

SEQ ID NO: 8334216 - DNA, 22 bp, Homo sapiens
acagatatttggggaaagacgt

SEQ ID NO: 8334217 - DNA, 22 bp, Homo sapiens
acagatatttggggaaagacgt

SEQ ID NO: 8334218 - DNA, 20 bp, Homo sapiens
acagatatttgattttcagt

SEQ ID NO: 8334219 - DNA, 20 bp, Homo sapiens
acagatatttgattttcagt

SEQ ID NO: 8334220 - DNA, 22 bp, Homo sapiens
agcctctgactgtcagcaaggt

SEQ ID NO: 8334221 - DNA, 22 bp, Homo sapiens
agcctctgactgtcagcaaggt

SEQ ID NO: 8334222 - DNA, 22 bp, Homo sapiens
agcctctctttctggtggctaa

SEQ ID NO: 8334223 - DNA, 20 bp, Homo sapiens
agccctgtttcctggagaga

SEQ ID NO: 8334224 - DNA, 21 bp, Homo sapiens
acagatgggatgagcacactg

SEQ ID NO: 8334225 - DNA, 22 bp, Homo sapiens
acagatggtagcattatgttgg

SEQ ID NO: 8334226 - DNA, 22 bp, Homo sapiens
acagatgtaatctattcacatt

SEQ ID NO: 8334227 - DNA, 22 bp, Homo sapiens
acagattatggatatatgtgga

SEQ ID NO: 8334228 - DNA, 22 bp, Homo sapiens
acagattatggatatatgtgga

SEQ ID NO: 8334229 - DNA, 21 bp, Homo sapiens
acagatgtgatatgcagtctt

SEQ ID NO: 8334230 - DNA, 22 bp, Homo sapiens
acagatgtaccttagtgatggg

SEQ ID NO: 8334231 - DNA, 21 bp, Homo sapiens
acagattagcacaatgcaggc

SEQ ID NO: 8334232 - DNA, 21 bp, Homo sapiens
acagattagcacaatgcaggc

SEQ ID NO: 8334233 - DNA, 22 bp, Homo sapiens
agctcctgcccaggaaggctct

SEQ ID NO: 8334234 - DNA, 22 bp, Homo sapiens
acagaattaggagatcctcttg

SEQ ID NO: 8334235 - DNA, 22 bp, Homo sapiens
acagaattaatgaaaattacaa

SEQ ID NO: 8334236 - DNA, 22 bp, Homo sapiens
acagacagaggctccatgagga

SEQ ID NO: 8334237 - DNA, 18 bp, Homo sapiens
acagacacttagtatgag

SEQ ID NO: 8334238 - DNA, 22 bp, Homo sapiens
acacttttgtttgaagtctcca

SEQ ID NO: 8334239 - DNA, 22 bp, Homo sapiens
acagaaacccagaaaacctctc

SEQ ID NO: 8334240 - DNA, 22 bp, Homo sapiens
acagagactgggagcaagaggc

SEQ ID NO: 8334241 - DNA, 22 bp, Homo sapiens
acagactgtcccaccacatgga

SEQ ID NO: 8334242 - DNA, 22 bp, Homo sapiens
acagagaaagtgggctgaagat

SEQ ID NO: 8334243 - DNA, 19 bp, Homo sapiens
agccagggtgagaaggagc

SEQ ID NO: 8334244 - DNA, 19 bp, Homo sapiens
agccagggtccagacatgt

SEQ ID NO: 8334245 - DNA, 19 bp, Homo sapiens
agccagggtccagacatgt

SEQ ID NO: 8334246 - DNA, 22 bp, Homo sapiens
agaggctgaatgatgtcatcat

SEQ ID NO: 8334247 - DNA, 22 bp, Homo sapiens
agaggctgagaaaccctcttct

SEQ ID NO: 8334248 - DNA, 22 bp, Homo sapiens
agaggccctctctctcctgatg

SEQ ID NO: 8334249 - DNA, 22 bp, Homo sapiens
aattcttcaagtgctttggaga

SEQ ID NO: 8334250 - DNA, 22 bp, Homo sapiens
aattctgtgcaggcagagctat

SEQ ID NO: 8334251 - DNA, 19 bp, Homo sapiens
aattctgtttcagcagatc

SEQ ID NO: 8334252 - DNA, 22 bp, Homo sapiens
agagggggtgtcagcactgcag

SEQ ID NO: 8334253 - DNA, 22 bp, Homo sapiens
agagggggtgttccagaagcat

SEQ ID NO: 8334254 - DNA, 22 bp, Homo sapiens
agagggggaaaatagaggtgtt

SEQ ID NO: 8334255 - DNA, 22 bp, Homo sapiens
agaggctgtgcccaccaggcaa

SEQ ID NO: 8334256 - DNA, 22 bp, Homo sapiens
agaggctgttacactcccagat

SEQ ID NO: 8334257 - DNA, 22 bp, Homo sapiens
agaggctgtgcccaccaggcaa

SEQ ID NO: 8334258 - DNA, 22 bp, Homo sapiens
acaagatgtgtttatacaagct

SEQ ID NO: 8334259 - DNA, 23 bp, Homo sapiens
acaagcagcccagtgctctgcct

SEQ ID NO: 8334260 - DNA, 22 bp, Homo sapiens
acaatgaaccaaatttaccaat

SEQ ID NO: 8334261 - DNA, 22 bp, Homo sapiens
acaatgaaaaaatttactgtgg

SEQ ID NO: 8334262 - DNA, 19 bp, Homo sapiens
acaatgaatgtgttctctt

SEQ ID NO: 8334263 - DNA, 22 bp, Homo sapiens
acaatgaatttaataccttatt

SEQ ID NO: 8334264 - DNA, 22 bp, Homo sapiens
agataatgaatgccatgacatt

SEQ ID NO: 8334265 - DNA, 22 bp, Homo sapiens
agataagctgtttttcaagaat

SEQ ID NO: 8334266 - DNA, 17 bp, Homo sapiens
agataagcttcagagct

SEQ ID NO: 8334267 - DNA, 22 bp, Homo sapiens
acaagagattatctacagatga

SEQ ID NO: 8334268 - DNA, 22 bp, Homo sapiens
acaagagattatctacagatga

SEQ ID NO: 8334269 - DNA, 22 bp, Homo sapiens
acaagagacaagaggttcttct

SEQ ID NO: 8334270 - DNA, 22 bp, Homo sapiens
acaagaattatttctagttaac

SEQ ID NO: 8334271 - DNA, 22 bp, Homo sapiens
acaagactgtgctctaagagtg

SEQ ID NO: 8334272 - DNA, 22 bp, Homo sapiens
agaggggtgggcacagcgccca

SEQ ID NO: 8334273 - DNA, 22 bp, Homo sapiens
agaggggtggtgctctcctgga

SEQ ID NO: 8334274 - DNA, 19 bp, Homo sapiens
acaaattggcaaaatgcaa

SEQ ID NO: 8334275 - DNA, 20 bp, Homo sapiens
acaaattggcagaatgacaa

SEQ ID NO: 8334276 - DNA, 22 bp, Homo sapiens
acaacagagctggactgagagg

SEQ ID NO: 8334277 - DNA, 22 bp, Homo sapiens
agagcctgcatctagcctcaga

SEQ ID NO: 8334278 - DNA, 22 bp, Homo sapiens
agagcctgcatctagcctcaga

SEQ ID NO: 8334279 - DNA, 22 bp, Homo sapiens
agagcctggacctgagctacaa

SEQ ID NO: 8334280 - DNA, 22 bp, Homo sapiens
agagacaggatatctgctcatg

SEQ ID NO: 8334281 - DNA, 22 bp, Homo sapiens
agagacagggttttgccatgtt

SEQ ID NO: 8334282 - DNA, 22 bp, Homo sapiens
agagacagggttttgccatgtt

SEQ ID NO: 8334283 - DNA, 22 bp, Homo sapiens
agagccaggcggctgggcacct

SEQ ID NO: 8334284 - DNA, 22 bp, Homo sapiens
agagccaggctctacctgggtt

SEQ ID NO: 8334285 - DNA, 22 bp, Homo sapiens
aattaaattggtttagagagga

SEQ ID NO: 8334286 - DNA, 22 bp, Homo sapiens
aattaaatgacaggggaagatg

SEQ ID NO: 8334287 - DNA, 22 bp, Homo sapiens
aattaacagagggcttattact

SEQ ID NO: 8334288 - DNA, 22 bp, Homo sapiens
agagacaggatatctgctcatg

SEQ ID NO: 8334289 - DNA, 22 bp, Homo sapiens
aatgttttaaaagagattgaga

SEQ ID NO: 8334290 - DNA, 22 bp, Homo sapiens
aatgttttaaaagagattgaga

SEQ ID NO: 8334291 - DNA, 22 bp, Homo sapiens
agaccctgtcagtgttaggaaa

SEQ ID NO: 8334292 - DNA, 22 bp, Homo sapiens
agaccctctccatgcccactgc

SEQ ID NO: 8334293 - DNA, 20 bp, Homo sapiens
agaccctctggactgggccc

SEQ ID NO: 8334294 - DNA, 22 bp, Homo sapiens
agaccctggagaatgaaagtgc

SEQ ID NO: 8334295 - DNA, 22 bp, Homo sapiens
agaccctggagaatgaaagtgc

SEQ ID NO: 8334296 - DNA, 22 bp, Homo sapiens
agaccctggggaaagtcacttc

SEQ ID NO: 8334297 - DNA, 22 bp, Homo sapiens
aatgggaggtagtatgggaggt

SEQ ID NO: 8334298 - DNA, 22 bp, Homo sapiens
aatggagaggctgtgagtgaga

SEQ ID NO: 8334299 - DNA, 22 bp, Homo sapiens
aatggagatgtctagagggtgc

SEQ ID NO: 8334300 - DNA, 22 bp, Homo sapiens
aatggagactgacacaaagata

SEQ ID NO: 8334301 - DNA, 22 bp, Homo sapiens
aatggagactgacacaaagata

SEQ ID NO: 8334302 - DNA, 22 bp, Homo sapiens
aatggcacctgctatatactga

SEQ ID NO: 8334303 - DNA, 22 bp, Homo sapiens
aatggcacaagagtaaactgtt

SEQ ID NO: 8334304 - DNA, 22 bp, Homo sapiens
aatggcacccgtaataccaaag

SEQ ID NO: 8334305 - DNA, 22 bp, Homo sapiens
aatggcaaaaggataacaagga

SEQ ID NO: 8334306 - DNA, 22 bp, Homo sapiens
aatggagtggttcttgccctct

SEQ ID NO: 8334307 - DNA, 22 bp, Homo sapiens
agacaatatgtatattaagaat

SEQ ID NO: 8334308 - DNA, 20 bp, Homo sapiens
agacaatgagtgacagagtt

SEQ ID NO: 8334309 - DNA, 22 bp, Homo sapiens
agaagcagactctgaggcaagg

SEQ ID NO: 8334310 - DNA, 22 bp, Homo sapiens
aatggtttgatggacaaaatga

SEQ ID NO: 8334311 - DNA, 22 bp, Homo sapiens
aatggtttagttaagactgagt

SEQ ID NO: 8334312 - DNA, 22 bp, Homo sapiens
aatggtaatatttcatagttgt

SEQ ID NO: 8334313 - DNA, 22 bp, Homo sapiens
aatggtaaatgtaacagcattc

SEQ ID NO: 8334314 - DNA, 22 bp, Homo sapiens
aatggtaatatttcatagttgt

SEQ ID NO: 8334315 - DNA, 22 bp, Homo sapiens
aatgtgagccaatgcccgtggg

SEQ ID NO: 8334316 - DNA, 22 bp, Homo sapiens
aatgtgaggccttggtagttat

SEQ ID NO: 8334317 - DNA, 22 bp, Homo sapiens
aatgtggacatctttgccttgt

SEQ ID NO: 8334318 - DNA, 22 bp, Homo sapiens
aatgtgctttgttcagccattt

SEQ ID NO: 8334319 - DNA, 22 bp, Homo sapiens
aatgtgaatcttcctttttgat

SEQ ID NO: 8334320 - DNA, 22 bp, Homo sapiens
aatgtaaaatatcttgtacttg

SEQ ID NO: 8334321 - DNA, 18 bp, Homo sapiens
aagaggaggagcaggttg

SEQ ID NO: 8334322 - DNA, 22 bp, Homo sapiens
aagaggaggatgctttacagct

SEQ ID NO: 8334323 - DNA, 22 bp, Homo sapiens
aaagtttggatccagcaaaaga

SEQ ID NO: 8334324 - DNA, 22 bp, Homo sapiens
aaagtttcctgctaagtgctat

SEQ ID NO: 8334325 - DNA, 22 bp, Homo sapiens
aaagtttccaagttacaccatt

SEQ ID NO: 8334326 - DNA, 22 bp, Homo sapiens
aaagtttcccaaagtaatgtga

SEQ ID NO: 8334327 - DNA, 22 bp, Homo sapiens
aaagtttcaatagaggaagtgg

SEQ ID NO: 8334328 - DNA, 22 bp, Homo sapiens
aagatatattttggtgatttca

SEQ ID NO: 8334329 - DNA, 19 bp, Homo sapiens
aaatactgaagttgttcat

SEQ ID NO: 8334330 - DNA, 22 bp, Homo sapiens
aaatactggcaagtgctaattc

SEQ ID NO: 8334331 - DNA, 22 bp, Homo sapiens
aaatactagaattcagagttga

SEQ ID NO: 8334332 - DNA, 17 bp, Homo sapiens
aagaggtaactgtacta

SEQ ID NO: 8334333 - DNA, 22 bp, Homo sapiens
aagactgaatttgcatagttgg

SEQ ID NO: 8334334 - DNA, 22 bp, Homo sapiens
aagactgaatttgcatagttgg

SEQ ID NO: 8334335 - DNA, 22 bp, Homo sapiens
aagactgagttcaaatcacagc

SEQ ID NO: 8334336 - DNA, 22 bp, Homo sapiens
aagactgtctgggacaagatga

SEQ ID NO: 8334337 - DNA, 22 bp, Homo sapiens
aagactgtatgagacaatataa

SEQ ID NO: 8334338 - DNA, 22 bp, Homo sapiens
aagactataccatcttagttac

SEQ ID NO: 8334339 - DNA, 22 bp, Homo sapiens
aagaccttgtctaaacatgtag

SEQ ID NO: 8334340 - DNA, 22 bp, Homo sapiens
aaagtgaattgatttaagggga

SEQ ID NO: 8334341 - DNA, 22 bp, Homo sapiens
aaatctcaggcctctatttact

SEQ ID NO: 8334342 - DNA, 22 bp, Homo sapiens
aaatctctgaacttaataatgc

SEQ ID NO: 8334343 - DNA, 22 bp, Homo sapiens
aagcaggcattccagagacaat

SEQ ID NO: 8334344 - DNA, 22 bp, Homo sapiens
aaatctcaatttgaattgtagc

SEQ ID NO: 8334345 - DNA, 22 bp, Homo sapiens
aaatctttccctttactatcca

SEQ ID NO: 8334346 - DNA, 22 bp, Homo sapiens
aaatctggccccttgcctattt

SEQ ID NO: 8334347 - DNA, 22 bp, Homo sapiens
aaatctgggagcagctcggcca

SEQ ID NO: 8334348 - DNA, 22 bp, Homo sapiens
aaatctgggtcaaggtggagtg

SEQ ID NO: 8334349 - DNA, 22 bp, Homo sapiens
aaatctggttcagtaagtcctc

SEQ ID NO: 8334350 - DNA, 22 bp, Homo sapiens
aaatctcactgtagtcaaagtg

SEQ ID NO: 8334351 - DNA, 22 bp, Homo sapiens
aaatctctgcaggcaaatgtga

SEQ ID NO: 8334352 - DNA, 22 bp, Homo sapiens
aaatgcatggctgttttaaagc

SEQ ID NO: 8334353 - DNA, 22 bp, Homo sapiens
aagcctccttattaaaggatat

SEQ ID NO: 8334354 - DNA, 22 bp, Homo sapiens
aagcctgtgtttctgctagtct

SEQ ID NO: 8334355 - DNA, 22 bp, Homo sapiens
aagccgggcctgagaaatgaca

SEQ ID NO: 8334356 - DNA, 21 bp, Homo sapiens
aagcccttgaaatagatatat

SEQ ID NO: 8334357 - DNA, 14 bp, Homo sapiens
aagatcaccttcct

SEQ ID NO: 8334358 - DNA, 22 bp, Homo sapiens
aagatcagaactttatacagga

SEQ ID NO: 8334359 - DNA, 22 bp, Homo sapiens
aagcaggcaaggttgtggggca

SEQ ID NO: 8334360 - DNA, 22 bp, Homo sapiens
aagcaggagagcctgggtgagc

SEQ ID NO: 8334361 - DNA, 22 bp, Homo sapiens
aacatagagacaggaagtgctt

SEQ ID NO: 8334362 - DNA, 22 bp, Homo sapiens
aacatataaactcttaagttca

SEQ ID NO: 8334363 - DNA, 22 bp, Homo sapiens
aacatacagtgagcagtggact

SEQ ID NO: 8334364 - DNA, 22 bp, Homo sapiens
aacatacgagcagtttatagag

SEQ ID NO: 8334365 - DNA, 22 bp, Homo sapiens
aacatacttatactaaataatg

SEQ ID NO: 8334366 - DNA, 22 bp, Homo sapiens
aacatagaatggctccagagct

SEQ ID NO: 8334367 - DNA, 22 bp, Homo sapiens
aacatagaattgttatattttc

SEQ ID NO: 8334368 - DNA, 22 bp, Homo sapiens
aacataagggagcttcaaaact

SEQ ID NO: 8334369 - DNA, 22 bp, Homo sapiens
aacagtgaggtgaatatgctcc

SEQ ID NO: 8334370 - DNA, 23 bp, Homo sapiens
aacacttgcatgaacagctacac

SEQ ID NO: 8334371 - DNA, 22 bp, Homo sapiens
aaagcactctatcctttgtaga

SEQ ID NO: 8334372 - DNA, 22 bp, Homo sapiens
aaagatttatgaagttcaatta

SEQ ID NO: 8334373 - DNA, 22 bp, Homo sapiens
aaagatttaagaataatttgtg

SEQ ID NO: 8334374 - DNA, 22 bp, Homo sapiens
aaagatttgaaattaggcatca

SEQ ID NO: 8334375 - DNA, 22 bp, Homo sapiens
aaagatttcacatcccaagcct

SEQ ID NO: 8334376 - DNA, 22 bp, Homo sapiens
aaagatttcagaagcctgtgcc

SEQ ID NO: 8334377 - DNA, 22 bp, Homo sapiens
aaagatttgagttctgcttata

SEQ ID NO: 8334378 - DNA, 22 bp, Homo sapiens
aaagatttgaaattaggcatca

SEQ ID NO: 8334379 - DNA, 22 bp, Homo sapiens
aaagatttgaaattaggcatca

SEQ ID NO: 8334380 - DNA, 22 bp, Homo sapiens
aaagatttgaaattaggcatca

SEQ ID NO: 8334381 - DNA, 23 bp, Homo sapiens
aacaccaaggctcagagagataa

SEQ ID NO: 8334382 - DNA, 22 bp, Homo sapiens
aaagcaagatgcatccgtcaag

SEQ ID NO: 8334383 - DNA, 23 bp, Homo sapiens
aaagcaaggaattggcaacagag

SEQ ID NO: 8334384 - DNA, 22 bp, Homo sapiens
aacactgtggtcttttcagtaa

SEQ ID NO: 8334385 - DNA, 22 bp, Homo sapiens
aactgtaatgaattgttcatga

SEQ ID NO: 8334386 - DNA, 22 bp, Homo sapiens
aaagtaattaagaagctggaca

SEQ ID NO: 8334387 - DNA, 22 bp, Homo sapiens
aaagtaagatttgcatttcaga

SEQ ID NO: 8334388 - DNA, 22 bp, Homo sapiens
aaagtaattgcagtttctgcca

SEQ ID NO: 8334389 - DNA, 22 bp, Homo sapiens
aagaacagttgggaggtgagcc

SEQ ID NO: 8334390 - DNA, 22 bp, Homo sapiens
aagaacataacagaagctgtgt

SEQ ID NO: 8334391 - DNA, 22 bp, Homo sapiens
aagaacatgaacacaatgttta

SEQ ID NO: 8334392 - DNA, 22 bp, Homo sapiens
aagaacatgaacctcttctaac

SEQ ID NO: 8334393 - DNA, 22 bp, Homo sapiens
aagaacatgaagtcacaaatgc

SEQ ID NO: 8334394 - DNA, 22 bp, Homo sapiens
aaagccttggtcatctggttcc

SEQ ID NO: 8334395 - DNA, 22 bp, Homo sapiens
aaagccttgggatttgtgatca

SEQ ID NO: 8334396 - DNA, 22 bp, Homo sapiens
aacatttgtttggcttcaatta

SEQ ID NO: 8334397 - DNA, 22 bp, Homo sapiens
aaagccttgagatcctatagtt

SEQ ID NO: 8334398 - DNA, 22 bp, Homo sapiens
aaagccttgcccgtcactggga

SEQ ID NO: 8334399 - DNA, 22 bp, Homo sapiens
aaagccttcaagtagatgtaag

SEQ ID NO: 8334400 - DNA, 22 bp, Homo sapiens
aaagcctcccaggttatgagta

SEQ ID NO: 8334401 - DNA, 22 bp, Homo sapiens
aacccaggaggcagaggctgca

SEQ ID NO: 8334402 - DNA, 22 bp, Homo sapiens
aacccaggagttggaggctgtg

SEQ ID NO: 8334403 - DNA, 22 bp, Homo sapiens
aacccgagggccccaggctcgg

SEQ ID NO: 8334404 - DNA, 22 bp, Homo sapiens
aacccatgttggaagcttatca

SEQ ID NO: 8334405 - DNA, 22 bp, Homo sapiens
aaaaggctaatccagagcaact

SEQ ID NO: 8334406 - DNA, 22 bp, Homo sapiens
aaaaagtattggccatggttga

SEQ ID NO: 8334407 - DNA, 22 bp, Homo sapiens
aaaaatacttcacttctgggtg

SEQ ID NO: 8334408 - DNA, 22 bp, Homo sapiens
aaaatgttcaagcatgctggtt

SEQ ID NO: 8334409 - DNA, 21 bp, Homo sapiens
aaaatgtttccttgttggtta

SEQ ID NO: 8334410 - DNA, 22 bp, Homo sapiens
aaaattcatggcttgggaaaag

SEQ ID NO: 8334411 - DNA, 22 bp, Homo sapiens
aaaaggttttgagtacaaatat

SEQ ID NO: 8334412 - DNA, 22 bp, Homo sapiens
aaaagtaattgcaattttgtag

SEQ ID NO: 8334413 - DNA, 22 bp, Homo sapiens
aaaaggtagttgccaaataagg

SEQ ID NO: 8334414 - DNA, 22 bp, Homo sapiens
aaaaggtagattctccttctat

SEQ ID NO: 8334415 - DNA, 22 bp, Homo sapiens
aaaattgagagtcttgtgcaag

SEQ ID NO: 8334416 - DNA, 22 bp, Homo sapiens
aaaattctgtcattaaattgtg

SEQ ID NO: 8334417 - DNA, 17 bp, Homo sapiens
aaaattctgtaaagagg

SEQ ID NO: 8334418 - DNA, 22 bp, Homo sapiens
aaacaccaagagctagctatta

SEQ ID NO: 8334419 - DNA, 22 bp, Homo sapiens
aaacactagcaggaagcactga

SEQ ID NO: 8334420 - DNA, 22 bp, Homo sapiens
aaacaccagtcccagtatacac

SEQ ID NO: 8334421 - DNA, 22 bp, Homo sapiens
aaacagtattatcaatatattt

SEQ ID NO: 8334422 - DNA, 22 bp, Homo sapiens
aaacaggcgcttactaagaaaa

SEQ ID NO: 8334423 - DNA, 22 bp, Homo sapiens
aaaatatgaagttgtcagtatg

SEQ ID NO: 8334424 - DNA, 20 bp, Homo sapiens
aaaatatgtataactcttct

SEQ ID NO: 8334425 - DNA, 20 bp, Homo sapiens
aaaatatgtataactcttct

SEQ ID NO: 8334426 - DNA, 20 bp, Homo sapiens
aaaatatgtataactcttct

SEQ ID NO: 8334427 - DNA, 22 bp, Homo sapiens
aaaatatggggtgagcccagag

SEQ ID NO: 8334428 - DNA, 22 bp, Homo sapiens
aaaatattttagggccaggaga

SEQ ID NO: 8334429 - DNA, 22 bp, Homo sapiens
aaacattcaaagcaggatgtgt

SEQ ID NO: 8334430 - DNA, 22 bp, Homo sapiens
aaacattcacatttgctagtaa

SEQ ID NO: 8334431 - DNA, 22 bp, Homo sapiens
aaacattcactctcaattttag

SEQ ID NO: 8334432 - DNA, 22 bp, Homo sapiens
aaacattccatttctatgtaag

SEQ ID NO: 8334433 - DNA, 22 bp, Homo sapiens
aaacattccatatataccttgt

SEQ ID NO: 8334434 - DNA, 20 bp, Homo sapiens
aaacattcatgtacaagtga

SEQ ID NO: 8334435 - DNA, 22 bp, Homo sapiens
aaacatgctggatttagaatat

SEQ ID NO: 8334436 - DNA, 22 bp, Homo sapiens
aaacatgctggatttagaatat

SEQ ID NO: 8334437 - DNA, 22 bp, Homo sapiens
aaactgtaaacacagcagtaca

SEQ ID NO: 8334438 - DNA, 22 bp, Homo sapiens
aaactgtaaatactagtaagtg

SEQ ID NO: 8334439 - DNA, 22 bp, Homo sapiens
aaacattgctaaataatgctgc

SEQ ID NO: 8334440 - DNA, 22 bp, Homo sapiens
aaacattgatgggaagtttaat

SEQ ID NO: 8334441 - DNA, 22 bp, Homo sapiens
aaacattgagtgcctttggtat

SEQ ID NO: 8334442 - DNA, 22 bp, Homo sapiens
aaacattctcagccctgcttgc

SEQ ID NO: 8334443 - DNA, 22 bp, Homo sapiens
aaacattccctaatgtgtccgt

SEQ ID NO: 8334444 - DNA, 22 bp, Homo sapiens
aaactgtaagagaataaactac

SEQ ID NO: 8334445 - DNA, 22 bp, Homo sapiens
aaactgtatagggaaaagtaga

SEQ ID NO: 8334446 - DNA, 22 bp, Homo sapiens
aaactgtcacctaatgtatttt

SEQ ID NO: 8334447 - DNA, 22 bp, Homo sapiens
aaactgtattccatcctcatca

SEQ ID NO: 8334448 - DNA, 18 bp, Homo sapiens
aaactgtatttctttcta

SEQ ID NO: 8334449 - DNA, 22 bp, Homo sapiens
aaacactgaagacctatctggt

SEQ ID NO: 8334450 - DNA, 22 bp, Homo sapiens
aaacagagtttggtaaatagcc

SEQ ID NO: 8334451 - DNA, 22 bp, Homo sapiens
aaacagataatgctataaatgg

SEQ ID NO: 8334452 - DNA, 22 bp, Homo sapiens
aaacactgtgggacatcttact

SEQ ID NO: 8334453 - DNA, 22 bp, Homo sapiens
aaagccagctctgagctgcacc

SEQ ID NO: 8334454 - DNA, 22 bp, Homo sapiens
aaacagatgagttataatagcc

SEQ ID NO: 8334455 - DNA, 22 bp, Homo sapiens
aaacagctaagtacattcaagg

SEQ ID NO: 8334456 - DNA, 22 bp, Homo sapiens
aaacagctacttctgtataatg

SEQ ID NO: 8334457 - DNA, 22 bp, Homo sapiens
aaacagctcaagaagttactct

SEQ ID NO: 8334458 - DNA, 22 bp, Homo sapiens
aaacatctcaaagaggtatttg

SEQ ID NO: 8334459 - DNA, 21 bp, Homo sapiens
aaacatctctgcttttgtgtc

SEQ ID NO: 8334460 - DNA, 22 bp, Homo sapiens
aaacttttcctgctcttgtcct

SEQ ID NO: 8334461 - DNA, 22 bp, Homo sapiens
aaacttttcctgctcttgtcct

SEQ ID NO: 8334462 - DNA, 22 bp, Homo sapiens
aaatataatttctgcctcaata

SEQ ID NO: 8334463 - DNA, 22 bp, Homo sapiens
aaatagttgtttggatcaataa

SEQ ID NO: 8334464 - DNA, 20 bp, Homo sapiens
aaactgtctgtcagtatcta

SEQ ID NO: 8334465 - DNA, 22 bp, Homo sapiens
aaactgtcattttatatagtta

SEQ ID NO: 8334466 - DNA, 22 bp, Homo sapiens
aaagaaatacctttctcagctt

SEQ ID NO: 8334467 - DNA, 22 bp, Homo sapiens
aaagaacaaatgatatatggtt

SEQ ID NO: 8334468 - DNA, 22 bp, Homo sapiens
aaacttttttaggttcataggc

SEQ ID NO: 8334469 - DNA, 21 bp, Homo sapiens
aaagaacaggcagatgttctt

SEQ ID NO: 8334470 - DNA, 22 bp, Homo sapiens
aaagactagcatttatatgtac

SEQ ID NO: 8334471 - DNA, 22 bp, Homo sapiens
aaagactttaggttagaggcat

SEQ ID NO: 8334472 - DNA, 22 bp, Homo sapiens
aaagacttggcttatgatttgc

SEQ ID NO: 8334473 - DNA, 22 bp, Homo sapiens
aaagacttggcttatgatttgc

SEQ ID NO: 8334474 - DNA, 22 bp, Homo sapiens
aaagacttgggagcagtatgct

SEQ ID NO: 8334475 - DNA, 22 bp, Homo sapiens
aaagacttgggtgaagtaattt

SEQ ID NO: 8334476 - DNA, 22 bp, Homo sapiens
aaagactggtgtgttacatata

SEQ ID NO: 8334477 - DNA, 22 bp, Homo sapiens
aaagactggaaggtgaggctgt

SEQ ID NO: 8334478 - DNA, 23 bp, Homo sapiens
aaagactgctgagaattttagga

SEQ ID NO: 8334479 - DNA, 23 bp, Homo sapiens
aaagactgctgagaattttagga

SEQ ID NO: 8334480 - DNA, 23 bp, Homo sapiens
aaagactgaggaaagtctctgtc

SEQ ID NO: 8334481 - DNA, 22 bp, Homo sapiens
aaagagaaacttagaagcctga

SEQ ID NO: 8334482 - DNA, 22 bp, Homo sapiens
acacatttacatgtttacgtat

SEQ ID NO: 8334483 - DNA, 22 bp, Homo sapiens
acacatttatggatcgcagaaa

SEQ ID NO: 8334484 - DNA, 22 bp, Homo sapiens
acacatttatggatcgcagaaa

SEQ ID NO: 8334485 - DNA, 22 bp, Homo sapiens
acacatttattacatgcatgtg

SEQ ID NO: 8334486 - DNA, 22 bp, Homo sapiens
acacatgctgataagaatataa

SEQ ID NO: 8334487 - DNA, 22 bp, Homo sapiens
acacatgctccagtctccagga

SEQ ID NO: 8334488 - DNA, 22 bp, Homo sapiens
acacatttacatgtttacgtat

SEQ ID NO: 8334489 - DNA, 22 bp, Homo sapiens
acacatttaaaaaggaacatat

SEQ ID NO: 8334490 - DNA, 22 bp, Homo sapiens
acacatgagaaacatcagttgt

SEQ ID NO: 8334491 - DNA, 22 bp, Homo sapiens
acacatgagttctcatcttgtg

SEQ ID NO: 8334492 - DNA, 22 bp, Homo sapiens
acacatgagttctcatcttgtg

SEQ ID NO: 8334493 - DNA, 22 bp, Homo sapiens
acacatgataagaaagtttaaa

SEQ ID NO: 8334494 - DNA, 22 bp, Homo sapiens
acacatgcataagccttccctt

SEQ ID NO: 8334495 - DNA, 22 bp, Homo sapiens
acacatgcaggtatacatgttc

SEQ ID NO: 8334496 - DNA, 22 bp, Homo sapiens
acacatgcgatagagaggtagg

SEQ ID NO: 8334497 - DNA, 20 bp, Homo sapiens
acacatgcattcatgtgggc

SEQ ID NO: 8334498 - DNA, 22 bp, Homo sapiens
acacatgctcataaataaatag

SEQ ID NO: 8334499 - DNA, 22 bp, Homo sapiens
acacatgcacaacagttctttc

SEQ ID NO: 8334500 - DNA, 22 bp, Homo sapiens
aagcaatacaagtggtcattga

SEQ ID NO: 8334501 - DNA, 23 bp, Homo sapiens
aagcaataccaggtgtgggccct

SEQ ID NO: 8334502 - DNA, 22 bp, Homo sapiens
aagcaataagccagatttggat

SEQ ID NO: 8334503 - DNA, 22 bp, Homo sapiens
aagcaataatcccaaagtgctg

SEQ ID NO: 8334504 - DNA, 22 bp, Homo sapiens
aagatgatggtatatagggtat

SEQ ID NO: 8334505 - DNA, 22 bp, Homo sapiens
aagatgattaggatgaaagcaa

SEQ ID NO: 8334506 - DNA, 21 bp, Homo sapiens
aagatgatattttatctgtag

SEQ ID NO: 8334507 - DNA, 22 bp, Homo sapiens
aagatgataggacttgcttaag

SEQ ID NO: 8334508 - DNA, 22 bp, Homo sapiens
aagatgatagatctgtcaatgt

SEQ ID NO: 8334509 - DNA, 22 bp, Homo sapiens
aagatgacagatgcttagagtc

SEQ ID NO: 8334510 - DNA, 22 bp, Homo sapiens
aagatgcagctttacaataagg

SEQ ID NO: 8334511 - DNA, 22 bp, Homo sapiens
aagatgcatgctgaagctggct

SEQ ID NO: 8334512 - DNA, 22 bp, Homo sapiens
aagcaatatactgatatgatta

SEQ ID NO: 8334513 - DNA, 20 bp, Homo sapiens
aagcaatatagtgcaaatgt

SEQ ID NO: 8334514 - DNA, 22 bp, Homo sapiens
aagcacacatctctggctgggt

SEQ ID NO: 8334515 - DNA, 22 bp, Homo sapiens
aagcacactcagatattgactc

SEQ ID NO: 8334516 - DNA, 22 bp, Homo sapiens
aagcaattgtcctgtctctaca

SEQ ID NO: 8334517 - DNA, 22 bp, Homo sapiens
aagcagagcaagcgtatttatt

SEQ ID NO: 8334518 - DNA, 22 bp, Homo sapiens
aagcagagaccggctaatggag

SEQ ID NO: 8334519 - DNA, 22 bp, Homo sapiens
acagcagagaactttagagggt

SEQ ID NO: 8334520 - DNA, 22 bp, Homo sapiens
acagcagactttctacagctca

SEQ ID NO: 8334521 - DNA, 22 bp, Homo sapiens
acagcagactttctacagctca

SEQ ID NO: 8334522 - DNA, 22 bp, Homo sapiens
acagcagagacactcaggaggc

SEQ ID NO: 8334523 - DNA, 22 bp, Homo sapiens
acagcagagccagtggctctag

SEQ ID NO: 8334524 - DNA, 22 bp, Homo sapiens
acagcagagcaccagggccact

SEQ ID NO: 8334525 - DNA, 22 bp, Homo sapiens
acagcagagccagtggctctag

SEQ ID NO: 8334526 - DNA, 22 bp, Homo sapiens
acagcagaccccagtgccatgg

SEQ ID NO: 8334527 - DNA, 22 bp, Homo sapiens
acagcctggactggctctctgc

SEQ ID NO: 8334528 - DNA, 22 bp, Homo sapiens
acagcctggactggctctctgc

SEQ ID NO: 8334529 - DNA, 22 bp, Homo sapiens
acagccagggcattgtcgccga

SEQ ID NO: 8334530 - DNA, 22 bp, Homo sapiens
aagcagctgcaggttcaaagga

SEQ ID NO: 8334531 - DNA, 22 bp, Homo sapiens
acagcagagcctggtacttact

SEQ ID NO: 8334532 - DNA, 22 bp, Homo sapiens
acagcagagcctagcttaatct

SEQ ID NO: 8334533 - DNA, 22 bp, Homo sapiens
acagcagaggaaaagtctgata

SEQ ID NO: 8334534 - DNA, 22 bp, Homo sapiens
acagcagaggaaaagtctgata

SEQ ID NO: 8334535 - DNA, 22 bp, Homo sapiens
acagcagaggaaaagtctgata

SEQ ID NO: 8334536 - DNA, 20 bp, Homo sapiens
aagagaagaagtctttgaaa

SEQ ID NO: 8334537 - DNA, 22 bp, Homo sapiens
aatttccaaatttctgtcacac

SEQ ID NO: 8334538 - DNA, 22 bp, Homo sapiens
aattttaagcatatgactggtt

SEQ ID NO: 8334539 - DNA, 22 bp, Homo sapiens
aattttaatcagtggtgctgag

SEQ ID NO: 8334540 - DNA, 21 bp, Homo sapiens
aatttcagacccattttgcct

SEQ ID NO: 8334541 - DNA, 22 bp, Homo sapiens
aagagcaacttggaaacactca

SEQ ID NO: 8334542 - DNA, 22 bp, Homo sapiens
acacaaattgtaggataattgc

SEQ ID NO: 8334543 - DNA, 22 bp, Homo sapiens
aagagaatgacaaggagaacct

SEQ ID NO: 8334544 - DNA, 22 bp, Homo sapiens
aactttctgttacgtccccaga

SEQ ID NO: 8334545 - DNA, 22 bp, Homo sapiens
aatgggaagccagaagacaagg

SEQ ID NO: 8334546 - DNA, 22 bp, Homo sapiens
aatggctttgacattttcaaat

SEQ ID NO: 8334547 - DNA, 22 bp, Homo sapiens
aactggaactggtagtgttggt

SEQ ID NO: 8334548 - DNA, 22 bp, Homo sapiens
aagaaactggaatatagagagc

SEQ ID NO: 8334549 - DNA, 22 bp, Homo sapiens
aagaaaagatgtttggttttca

SEQ ID NO: 8334550 - DNA, 22 bp, Homo sapiens
aagaaaagatgtttggttttca

SEQ ID NO: 8334551 - DNA, 22 bp, Homo sapiens
aagaaaatcagttctggtcagt

SEQ ID NO: 8334552 - DNA, 22 bp, Homo sapiens
aagaaaagaaacctgaggcttt

SEQ ID NO: 8334553 - DNA, 22 bp, Homo sapiens
aagaaaagaaacctgaggcttt

SEQ ID NO: 8334554 - DNA, 22 bp, Homo sapiens
aagaaaagaaacctgaggcttt

SEQ ID NO: 8334555 - DNA, 22 bp, Homo sapiens
aagaaaacatgatctaatttaa

SEQ ID NO: 8334556 - DNA, 22 bp, Homo sapiens
aagaaaacaatgacttgccagc

SEQ ID NO: 8334557 - DNA, 22 bp, Homo sapiens
aattctcaggaatttcatctgt

SEQ ID NO: 8334558 - DNA, 22 bp, Homo sapiens
aattctagcattgtgaaaatat

SEQ ID NO: 8334559 - DNA, 22 bp, Homo sapiens
aattcctgtcttaacagttctg

SEQ ID NO: 8334560 - DNA, 22 bp, Homo sapiens
aattctaaatgtaatttagaat

SEQ ID NO: 8334561 - DNA, 22 bp, Homo sapiens
aattctaaatgtaatttagaat

SEQ ID NO: 8334562 - DNA, 22 bp, Homo sapiens
aagaacaactgctttaaaagca

SEQ ID NO: 8334563 - DNA, 22 bp, Homo sapiens
aagaaatgtgaatattgaatag

SEQ ID NO: 8334564 - DNA, 22 bp, Homo sapiens
aagaaatggcttcatctgagta

SEQ ID NO: 8334565 - DNA, 22 bp, Homo sapiens
aagaaatgtagagcctagtaaa

SEQ ID NO: 8334566 - DNA, 22 bp, Homo sapiens
aacagaaaaggtaggtggcttt

SEQ ID NO: 8334567 - DNA, 22 bp, Homo sapiens
aacagaatagttgatgtacagt

SEQ ID NO: 8334568 - DNA, 22 bp, Homo sapiens
aacagagctctgctctcagatt

SEQ ID NO: 8334569 - DNA, 22 bp, Homo sapiens
aacagagatcttaattcctgta

SEQ ID NO: 8334570 - DNA, 22 bp, Homo sapiens
aacactttttagtaaagattga

SEQ ID NO: 8334571 - DNA, 22 bp, Homo sapiens
aacactttttatatattgtatc

SEQ ID NO: 8334572 - DNA, 22 bp, Homo sapiens
aacacagttttccaaaatagag

SEQ ID NO: 8334573 - DNA, 22 bp, Homo sapiens
aacacagtttctctatgagagt

SEQ ID NO: 8334574 - DNA, 22 bp, Homo sapiens
aacacagtttctctatgagagt

SEQ ID NO: 8334575 - DNA, 22 bp, Homo sapiens
aacacagtttctgcattggtag

SEQ ID NO: 8334576 - DNA, 22 bp, Homo sapiens
aacacagttttccaaaatagag

SEQ ID NO: 8334577 - DNA, 20 bp, Homo sapiens
aacacagggttaccatcaga

SEQ ID NO: 8334578 - DNA, 22 bp, Homo sapiens
aacacaggttcattctgtgagg

SEQ ID NO: 8334579 - DNA, 22 bp, Homo sapiens
aacacagtcagttcctggatca

SEQ ID NO: 8334580 - DNA, 22 bp, Homo sapiens
aacacaggtttgtggtaaataa

SEQ ID NO: 8334581 - DNA, 22 bp, Homo sapiens
aacacaggttgctgggcctcac

SEQ ID NO: 8334582 - DNA, 22 bp, Homo sapiens
aacacagtcctgctcacttatt

SEQ ID NO: 8334583 - DNA, 22 bp, Homo sapiens
aaattttaaggctggaacttaa

SEQ ID NO: 8334584 - DNA, 22 bp, Homo sapiens
aaatttctaagtcaagaagaac

SEQ ID NO: 8334585 - DNA, 22 bp, Homo sapiens
aaggctggttccatccctggtg

SEQ ID NO: 8334586 - DNA, 22 bp, Homo sapiens
aaggctggttccatccctggtg

SEQ ID NO: 8334587 - DNA, 22 bp, Homo sapiens
aaggctggtggattatgaggtc

SEQ ID NO: 8334588 - DNA, 22 bp, Homo sapiens
aaggctggtcagatgtggtgaa

SEQ ID NO: 8334589 - DNA, 22 bp, Homo sapiens
aaggctggtcagatgtggtgaa

SEQ ID NO: 8334590 - DNA, 22 bp, Homo sapiens
aacacaggaaattggtaaatgg

SEQ ID NO: 8334591 - DNA, 22 bp, Homo sapiens
aacacaggccagcctgtgcagt

SEQ ID NO: 8334592 - DNA, 22 bp, Homo sapiens
aacacaggccagcctgtgcagt

SEQ ID NO: 8334593 - DNA, 22 bp, Homo sapiens
aacacaggcatactggctccag

SEQ ID NO: 8334594 - DNA, 22 bp, Homo sapiens
aacacaggaggctatgttttct

SEQ ID NO: 8334595 - DNA, 22 bp, Homo sapiens
aacacaggggcgtggctcttac

SEQ ID NO: 8334596 - DNA, 22 bp, Homo sapiens
aacacagggactcccaggagaa

SEQ ID NO: 8334597 - DNA, 22 bp, Homo sapiens
aacacagaagtgccaagagcca

SEQ ID NO: 8334598 - DNA, 22 bp, Homo sapiens
aaatgtcaaggtgatagatgca

SEQ ID NO: 8334599 - DNA, 22 bp, Homo sapiens
aaatgtcagaaaacatggagtg

SEQ ID NO: 8334600 - DNA, 22 bp, Homo sapiens
aaggaagaggcaggttttgctg

SEQ ID NO: 8334601 - DNA, 22 bp, Homo sapiens
aaggaagaggcaggttttgctg

SEQ ID NO: 8334602 - DNA, 22 bp, Homo sapiens
aaggaagagtctagaacaggca

SEQ ID NO: 8334603 - DNA, 22 bp, Homo sapiens
aaggaagatgaggtgctgctta

SEQ ID NO: 8334604 - DNA, 22 bp, Homo sapiens
aaggaaagacaggacggaattc

SEQ ID NO: 8334605 - DNA, 22 bp, Homo sapiens
aaggaagacttgagaaggttcc

SEQ ID NO: 8334606 - DNA, 22 bp, Homo sapiens
aaggaagacacagatgaagtga

SEQ ID NO: 8334607 - DNA, 22 bp, Homo sapiens
aaattcaattaactttcatgct

SEQ ID NO: 8334608 - DNA, 23 bp, Homo sapiens
aaattattgctcttcaattgcct

SEQ ID NO: 8334609 - DNA, 18 bp, Homo sapiens
aaattattcttccttttc

SEQ ID NO: 8334610 - DNA, 18 bp, Homo sapiens
aaattattcttccttttc

SEQ ID NO: 8334611 - DNA, 22 bp, Homo sapiens
aaattattctcatgtgtttctt

SEQ ID NO: 8334612 - DNA, 22 bp, Homo sapiens
aaggctggggtgcagacggcct

SEQ ID NO: 8334613 - DNA, 22 bp, Homo sapiens
aaggctgggtaacctgtccact

SEQ ID NO: 8334614 - DNA, 22 bp, Homo sapiens
aaggctgggtaacctgtccact

SEQ ID NO: 8334615 - DNA, 19 bp, Homo sapiens
aaggctggtaccataggtt

SEQ ID NO: 8334616 - DNA, 22 bp, Homo sapiens
aaggctgggtttgggatgtgat

SEQ ID NO: 8334617 - DNA, 22 bp, Homo sapiens
aaggcagccagatcctttgggt

SEQ ID NO: 8334618 - DNA, 22 bp, Homo sapiens
aaggcagcagaggaaaggtgct

SEQ ID NO: 8334619 - DNA, 22 bp, Homo sapiens
aaggcagcaagaattccaggtt

SEQ ID NO: 8334620 - DNA, 22 bp, Homo sapiens
aaggcacttaacgtgggaggat

SEQ ID NO: 8334621 - DNA, 22 bp, Homo sapiens
aaggcagcaactaatggatctc

SEQ ID NO: 8334622 - DNA, 22 bp, Homo sapiens
aactagaacgtctagttgctgg

SEQ ID NO: 8334623 - DNA, 18 bp, Homo sapiens
aactagagggctgtcaat

SEQ ID NO: 8334624 - DNA, 22 bp, Homo sapiens
aactagtaaaagcaacagtata

SEQ ID NO: 8334625 - DNA, 23 bp, Homo sapiens
aatgacaggcaatgtaattgtgt

SEQ ID NO: 8334626 - DNA, 23 bp, Homo sapiens
aatgacagtgtgtgattgaagaa

SEQ ID NO: 8334627 - DNA, 22 bp, Homo sapiens
aactagaaaaagactttctgag

SEQ ID NO: 8334628 - DNA, 20 bp, Homo sapiens
aactagaaagcacccatgga

SEQ ID NO: 8334629 - DNA, 19 bp, Homo sapiens
aactagaaaggttttgaga

SEQ ID NO: 8334630 - DNA, 22 bp, Homo sapiens
aactagaaagaacatatttcca

SEQ ID NO: 8334631 - DNA, 22 bp, Homo sapiens
aactagaaaacaagatgctgat

SEQ ID NO: 8334632 - DNA, 22 bp, Homo sapiens
aactagaaatcactacaggtat

SEQ ID NO: 8334633 - DNA, 22 bp, Homo sapiens
aactagaaccacttgtatttcc

SEQ ID NO: 8334634 - DNA, 22 bp, Homo sapiens
aactagaacctgcattttaaca

SEQ ID NO: 8334635 - DNA, 22 bp, Homo sapiens
aactagaaagaacatatttcca

SEQ ID NO: 8334636 - DNA, 22 bp, Homo sapiens
aactagaacgagaaagctgaac

SEQ ID NO: 8334637 - DNA, 22 bp, Homo sapiens
aaccttcttgtgcagaactgta

SEQ ID NO: 8334638 - DNA, 22 bp, Homo sapiens
aaccattgatacatgcaacaat

SEQ ID NO: 8334639 - DNA, 22 bp, Homo sapiens
aacatgttgctttaataatatt

SEQ ID NO: 8334640 - DNA, 22 bp, Homo sapiens
aaccatttgccattatcttaag

SEQ ID NO: 8334641 - DNA, 22 bp, Homo sapiens
aaccatttgcagttactgagac

SEQ ID NO: 8334642 - DNA, 22 bp, Homo sapiens
aacatgttgagttgaaagtagc

SEQ ID NO: 8334643 - DNA, 22 bp, Homo sapiens
aaccctgattttacaaatgtct

SEQ ID NO: 8334644 - DNA, 22 bp, Homo sapiens
aacctcataggacttgaacata

SEQ ID NO: 8334645 - DNA, 22 bp, Homo sapiens
aacatctttgataaacttagtg

SEQ ID NO: 8334646 - DNA, 19 bp, Homo sapiens
aacatctttccagtagagg

SEQ ID NO: 8334647 - DNA, 22 bp, Homo sapiens
aacatctttgtagtgttctcct

SEQ ID NO: 8334648 - DNA, 22 bp, Homo sapiens
aacatctttgccaaattgctat

SEQ ID NO: 8334649 - DNA, 22 bp, Homo sapiens
aacatctaggttctcatcgata

SEQ ID NO: 8334650 - DNA, 22 bp, Homo sapiens
aacatctgtgtttgaatctcaa

SEQ ID NO: 8334651 - DNA, 22 bp, Homo sapiens
aacatcttgtactgcacatttt

SEQ ID NO: 8334652 - DNA, 22 bp, Homo sapiens
aacatcttgaagattgggaaag

SEQ ID NO: 8334653 - DNA, 22 bp, Homo sapiens
aacatcttgtccttagattaaa

SEQ ID NO: 8334654 - DNA, 22 bp, Homo sapiens
aacatcttgtctaatgtcagct

SEQ ID NO: 8334655 - DNA, 22 bp, Homo sapiens
aacatgtaaccagcattcatct

SEQ ID NO: 8334656 - DNA, 22 bp, Homo sapiens
aatagattcatggttaagagca

SEQ ID NO: 8334657 - DNA, 22 bp, Homo sapiens
aatagactttgtataatttccc

SEQ ID NO: 8334658 - DNA, 22 bp, Homo sapiens
aatagactttctttttagaaca

SEQ ID NO: 8334659 - DNA, 22 bp, Homo sapiens
aagtggtggtatgaaccgaggg

SEQ ID NO: 8334660 - DNA, 22 bp, Homo sapiens
aagtggtgtgttggaagaaatc

SEQ ID NO: 8334661 - DNA, 22 bp, Homo sapiens
aacatcagaatatccatgttgg

SEQ ID NO: 8334662 - DNA, 22 bp, Homo sapiens
aacatcagaagtagaagactca

SEQ ID NO: 8334663 - DNA, 22 bp, Homo sapiens
aacatcagtattctcatctgta

SEQ ID NO: 8334664 - DNA, 22 bp, Homo sapiens
aacatatttggctgatattccc

SEQ ID NO: 8334665 - DNA, 22 bp, Homo sapiens
aacagctgttcgcagatgtagg

SEQ ID NO: 8334666 - DNA, 22 bp, Homo sapiens
aacagcttactcaatggtgatt

SEQ ID NO: 8334667 - DNA, 23 bp, Homo sapiens
agctgggcaaggatccgggctcc

SEQ ID NO: 8334668 - DNA, 22 bp, Homo sapiens
acagctgccaagacagagcagg

SEQ ID NO: 8334669 - DNA, 22 bp, Homo sapiens
agctggggctgcagagaacagg

SEQ ID NO: 8334670 - DNA, 19 bp, Homo sapiens
agctggggcggtgtgtgtt

SEQ ID NO: 8334671 - DNA, 22 bp, Homo sapiens
acagctgcattcttaacaggaa

SEQ ID NO: 8334672 - DNA, 22 bp, Homo sapiens
agctgggggttggataagggta

SEQ ID NO: 8334673 - DNA, 22 bp, Homo sapiens
agctggggttgcacacattttg

SEQ ID NO: 8334674 - DNA, 22 bp, Homo sapiens
agctggggctgcagagaacagg

SEQ ID NO: 8334675 - DNA, 22 bp, Homo sapiens
agctggggctgtggttgtgatt

SEQ ID NO: 8334676 - DNA, 22 bp, Homo sapiens
agctgggggtagtgagaaataa

SEQ ID NO: 8334677 - DNA, 22 bp, Homo sapiens
acagctcctactgaagccatgt

SEQ ID NO: 8334678 - DNA, 22 bp, Homo sapiens
acagctactctgcagataaatc

SEQ ID NO: 8334679 - DNA, 22 bp, Homo sapiens
acagctaggtcttcagcacttt

SEQ ID NO: 8334680 - DNA, 21 bp, Homo sapiens
acagccttgtgatggagacag

SEQ ID NO: 8334681 - DNA, 22 bp, Homo sapiens
acagcagaataatgagtaatag

SEQ ID NO: 8334682 - DNA, 22 bp, Homo sapiens
acagcagacagtcggcttcctg

SEQ ID NO: 8334683 - DNA, 22 bp, Homo sapiens
acagcagacattgggtgattga

SEQ ID NO: 8334684 - DNA, 22 bp, Homo sapiens
acagcagaccactactagtagg

SEQ ID NO: 8334685 - DNA, 22 bp, Homo sapiens
agctgccatctgaagaactgca

SEQ ID NO: 8334686 - DNA, 22 bp, Homo sapiens
agctgctagttcctgttctcac

SEQ ID NO: 8334687 - DNA, 22 bp, Homo sapiens
agctgctactgctctgccagag

SEQ ID NO: 8334688 - DNA, 22 bp, Homo sapiens
acagcctgctgcctgcttcttg

SEQ ID NO: 8334689 - DNA, 22 bp, Homo sapiens
agctgctatgagaaaggcactg

SEQ ID NO: 8334690 - DNA, 22 bp, Homo sapiens
acagccttgtagcatcttagcc

SEQ ID NO: 8334691 - DNA, 22 bp, Homo sapiens
acagccttgatattaattgtct

SEQ ID NO: 8334692 - DNA, 23 bp, Homo sapiens
acagccttctggggcttctgggc

SEQ ID NO: 8334693 - DNA, 21 bp, Homo sapiens
acaggctctggggatgctggg

SEQ ID NO: 8334694 - DNA, 19 bp, Homo sapiens
aggaatggaattaattctg

SEQ ID NO: 8334695 - DNA, 22 bp, Homo sapiens
acagcttaatcagtatgagcct

SEQ ID NO: 8334696 - DNA, 22 bp, Homo sapiens
acagcttagccagtcaagctct

SEQ ID NO: 8334697 - DNA, 22 bp, Homo sapiens
acaggcctacgaagtcaggtgc

SEQ ID NO: 8334698 - DNA, 22 bp, Homo sapiens
acagttttttcaacattggaat

SEQ ID NO: 8334699 - DNA, 22 bp, Homo sapiens
acataaaggtgactaacatctt

SEQ ID NO: 8334700 - DNA, 22 bp, Homo sapiens
acagtttgtgttggccatgggc

SEQ ID NO: 8334701 - DNA, 17 bp, Homo sapiens
acagtttgtcattctaa

SEQ ID NO: 8334702 - DNA, 22 bp, Homo sapiens
acagtttgttccttttcattgc

SEQ ID NO: 8334703 - DNA, 22 bp, Homo sapiens
acagtttggttgctacagtaaa

SEQ ID NO: 8334704 - DNA, 22 bp, Homo sapiens
aggcaggcactccggaagtgtc

SEQ ID NO: 8334705 - DNA, 22 bp, Homo sapiens
aggcaggcaaccacctgggaag

SEQ ID NO: 8334706 - DNA, 22 bp, Homo sapiens
aggcagcatccagaggagaatg

SEQ ID NO: 8334707 - DNA, 22 bp, Homo sapiens
acagtttgccctgacattctcc

SEQ ID NO: 8334708 - DNA, 22 bp, Homo sapiens
acagtttgccctgacattctcc

SEQ ID NO: 8334709 - DNA, 22 bp, Homo sapiens
acagtttggcagtttcttacta

SEQ ID NO: 8334710 - DNA, 22 bp, Homo sapiens
acagtttgccctgacattctcc

SEQ ID NO: 8334711 - DNA, 22 bp, Homo sapiens
acagtttggcgtgattgatagt

SEQ ID NO: 8334712 - DNA, 22 bp, Homo sapiens
acagtttggcaaatgtcccaca

SEQ ID NO: 8334713 - DNA, 22 bp, Homo sapiens
acagtttggcagtttcttacta

SEQ ID NO: 8334714 - DNA, 17 bp, Homo sapiens
acagtttgtcattctaa

SEQ ID NO: 8334715 - DNA, 17 bp, Homo sapiens
acagtttgtcattctaa

SEQ ID NO: 8334716 - DNA, 18 bp, Homo sapiens
acagtgattgttctatgc

SEQ ID NO: 8334717 - DNA, 22 bp, Homo sapiens
acagtgattggggtatctgcag

SEQ ID NO: 8334718 - DNA, 22 bp, Homo sapiens
acagtgatttcatccttctggg

SEQ ID NO: 8334719 - DNA, 22 bp, Homo sapiens
acagtgattattagttggtggt

SEQ ID NO: 8334720 - DNA, 22 bp, Homo sapiens
acagtgataaaatttcacatgt

SEQ ID NO: 8334721 - DNA, 22 bp, Homo sapiens
acagtgatcagttactgtctgt

SEQ ID NO: 8334722 - DNA, 22 bp, Homo sapiens
acagttaccacttagcagttac

SEQ ID NO: 8334723 - DNA, 22 bp, Homo sapiens
acagttaattaacattaagggg

SEQ ID NO: 8334724 - DNA, 22 bp, Homo sapiens
acagttacatcacttactgaca

SEQ ID NO: 8334725 - DNA, 22 bp, Homo sapiens
acagttaataagtagtaagtca

SEQ ID NO: 8334726 - DNA, 22 bp, Homo sapiens
acagttcactttttatatcaaa

SEQ ID NO: 8334727 - DNA, 22 bp, Homo sapiens
acagttcaagcaagtttctgtt

SEQ ID NO: 8334728 - DNA, 22 bp, Homo sapiens
acagttcaagacatcagtatga

SEQ ID NO: 8334729 - DNA, 23 bp, Homo sapiens
acagttatagctgtgaataacat

SEQ ID NO: 8334730 - DNA, 22 bp, Homo sapiens
acagttatctttgaaatagaga

SEQ ID NO: 8334731 - DNA, 22 bp, Homo sapiens
acagttatatacatgtagctgt

SEQ ID NO: 8334732 - DNA, 22 bp, Homo sapiens
acagttattctttatgcaacca

SEQ ID NO: 8334733 - DNA, 22 bp, Homo sapiens
acagttatttactgcataaact

SEQ ID NO: 8334734 - DNA, 22 bp, Homo sapiens
acaggtggtagagtggaaagag

SEQ ID NO: 8334735 - DNA, 22 bp, Homo sapiens
aggagctgttttgttcagcaaa

SEQ ID NO: 8334736 - DNA, 21 bp, Homo sapiens
aggagctgtgttagctggtcg

SEQ ID NO: 8334737 - DNA, 22 bp, Homo sapiens
acagggtggggatggtgagctt

SEQ ID NO: 8334738 - DNA, 22 bp, Homo sapiens
acagggattatgactgacagcc

SEQ ID NO: 8334739 - DNA, 21 bp, Homo sapiens
aggaggaacccgtggctgggc

SEQ ID NO: 8334740 - DNA, 22 bp, Homo sapiens
acagtaagggtaaataagaaca

SEQ ID NO: 8334741 - DNA, 22 bp, Homo sapiens
acagtgaggacagggactgtgt

SEQ ID NO: 8334742 - DNA, 20 bp, Homo sapiens
aggagtccctgtgctctctc

SEQ ID NO: 8334743 - DNA, 22 bp, Homo sapiens
aggagtcattgagaggggtcct

SEQ ID NO: 8334744 - DNA, 20 bp, Homo sapiens
aggagtccctgtgctctctc

SEQ ID NO: 8334745 - DNA, 22 bp, Homo sapiens
aggagtctgaactggtcccctg

SEQ ID NO: 8334746 - DNA, 22 bp, Homo sapiens
acagtacaagcatgatacataa

SEQ ID NO: 8334747 - DNA, 22 bp, Homo sapiens
acagtacaagcatgatacataa

SEQ ID NO: 8334748 - DNA, 22 bp, Homo sapiens
aggagtcataaatgtgaacaaa

SEQ ID NO: 8334749 - DNA, 22 bp, Homo sapiens
aggagtcaggaccaaatggaaa

SEQ ID NO: 8334750 - DNA, 22 bp, Homo sapiens
aggagtcagatatgggaaagtt

SEQ ID NO: 8334751 - DNA, 22 bp, Homo sapiens
aggagggtgatccgggctggtc

SEQ ID NO: 8334752 - DNA, 22 bp, Homo sapiens
aggctggcagccacctcagcag

SEQ ID NO: 8334753 - DNA, 22 bp, Homo sapiens
aggctggcaaggcagatgtgtg

SEQ ID NO: 8334754 - DNA, 22 bp, Homo sapiens
aggctggatttatggggacttc

SEQ ID NO: 8334755 - DNA, 20 bp, Homo sapiens
aggctggcactcctggccag

SEQ ID NO: 8334756 - DNA, 20 bp, Homo sapiens
aggctggcactcctggccag

SEQ ID NO: 8334757 - DNA, 22 bp, Homo sapiens
aggctggagtgtgcagtggcgc

SEQ ID NO: 8334758 - DNA, 22 bp, Homo sapiens
aggctggagtgtgcagtggcgc

SEQ ID NO: 8334759 - DNA, 22 bp, Homo sapiens
acattttttagagtcccacatt

SEQ ID NO: 8334760 - DNA, 22 bp, Homo sapiens
accaggcccatgtggattacta

SEQ ID NO: 8334761 - DNA, 22 bp, Homo sapiens
accaggcccgctgctatggtgg

SEQ ID NO: 8334762 - DNA, 20 bp, Homo sapiens
accaggcccggtgtctcctc

SEQ ID NO: 8334763 - DNA, 20 bp, Homo sapiens
accaggccccgggccctgca

SEQ ID NO: 8334764 - DNA, 23 bp, Homo sapiens
agggagctaaaaggctggagcag

SEQ ID NO: 8334765 - DNA, 22 bp, Homo sapiens
accaggcctagcaagtacatta

SEQ ID NO: 8334766 - DNA, 22 bp, Homo sapiens
accaggccctccagctgcgtgg

SEQ ID NO: 8334767 - DNA, 19 bp, Homo sapiens
accaggcctcagaggccct

SEQ ID NO: 8334768 - DNA, 22 bp, Homo sapiens
accattgcactctagcctgggc

SEQ ID NO: 8334769 - DNA, 22 bp, Homo sapiens
accatcagagcacagtccgtgc

SEQ ID NO: 8334770 - DNA, 22 bp, Homo sapiens
accatcagtcacatgtagagaa

SEQ ID NO: 8334771 - DNA, 22 bp, Homo sapiens
accatcagtactggatgctgac

SEQ ID NO: 8334772 - DNA, 22 bp, Homo sapiens
agggagctctgggggcacacgg

SEQ ID NO: 8334773 - DNA, 22 bp, Homo sapiens
agggagctcacagtccagtaga

SEQ ID NO: 8334774 - DNA, 22 bp, Homo sapiens
agggagctctaagtagagggac

SEQ ID NO: 8334775 - DNA, 22 bp, Homo sapiens
acccaagacacgtgtcctcagc

SEQ ID NO: 8334776 - DNA, 22 bp, Homo sapiens
acccaattctgcccaattttgt

SEQ ID NO: 8334777 - DNA, 22 bp, Homo sapiens
agggcagttcagccacaggctc

SEQ ID NO: 8334778 - DNA, 22 bp, Homo sapiens
agggcatcaggtattttatgct

SEQ ID NO: 8334779 - DNA, 22 bp, Homo sapiens
accctagacattgaactagggt

SEQ ID NO: 8334780 - DNA, 22 bp, Homo sapiens
accctcagacagctgtggccag

SEQ ID NO: 8334781 - DNA, 22 bp, Homo sapiens
accctcagacatattccatcat

SEQ ID NO: 8334782 - DNA, 22 bp, Homo sapiens
agggcctgggtctgtactcctc

SEQ ID NO: 8334783 - DNA, 22 bp, Homo sapiens
aggcgcagacatacagggtctg

SEQ ID NO: 8334784 - DNA, 22 bp, Homo sapiens
aggcgcagaaggccaggggcct

SEQ ID NO: 8334785 - DNA, 22 bp, Homo sapiens
aggcctgttccaggcccctttt

SEQ ID NO: 8334786 - DNA, 22 bp, Homo sapiens
aggccttcctcggagacaggga

SEQ ID NO: 8334787 - DNA, 22 bp, Homo sapiens
acatttaaccaaactgtttaat

SEQ ID NO: 8334788 - DNA, 22 bp, Homo sapiens
acatttaatgatcctactgtga

SEQ ID NO: 8334789 - DNA, 22 bp, Homo sapiens
acatttaagttaaaacctcagt

SEQ ID NO: 8334790 - DNA, 22 bp, Homo sapiens
aggctaggaatcaagcctttct

SEQ ID NO: 8334791 - DNA, 22 bp, Homo sapiens
aggctgatgctggctgaggctg

SEQ ID NO: 8334792 - DNA, 22 bp, Homo sapiens
acatttaggatgttttgagaga

SEQ ID NO: 8334793 - DNA, 22 bp, Homo sapiens
acatttacattttctctggcct

SEQ ID NO: 8334794 - DNA, 22 bp, Homo sapiens
acatttacagtgctagacaatc

SEQ ID NO: 8334795 - DNA, 22 bp, Homo sapiens
acatttacttatcaaaagtcag

SEQ ID NO: 8334796 - DNA, 22 bp, Homo sapiens
acatttacttatcaaaagtcag

SEQ ID NO: 8334797 - DNA, 22 bp, Homo sapiens
acatttacctagttaagtcaat

SEQ ID NO: 8334798 - DNA, 22 bp, Homo sapiens
acatttaccctggaacattgga

SEQ ID NO: 8334799 - DNA, 22 bp, Homo sapiens
acatttatataactcactagga

SEQ ID NO: 8334800 - DNA, 22 bp, Homo sapiens
acatggaaaactaactgctttt

SEQ ID NO: 8334801 - DNA, 22 bp, Homo sapiens
aggccctgttgtagcattttgg

SEQ ID NO: 8334802 - DNA, 22 bp, Homo sapiens
aggccctgttatgagccactgt

SEQ ID NO: 8334803 - DNA, 22 bp, Homo sapiens
aggccgaagtggatgggcatct

SEQ ID NO: 8334804 - DNA, 21 bp, Homo sapiens
acatggaagagaaattaacca

SEQ ID NO: 8334805 - DNA, 22 bp, Homo sapiens
acatggaagataaaaatactca

SEQ ID NO: 8334806 - DNA, 22 bp, Homo sapiens
acatggagactctaccagaaaa

SEQ ID NO: 8334807 - DNA, 22 bp, Homo sapiens
acatggatgaattgtctagtgg

SEQ ID NO: 8334808 - DNA, 22 bp, Homo sapiens
aggccctgtccatggtgctgaa

SEQ ID NO: 8334809 - DNA, 20 bp, Homo sapiens
aggccctgtgcatcttgttt

SEQ ID NO: 8334810 - DNA, 20 bp, Homo sapiens
aggccctgtgcatcttgttt

SEQ ID NO: 8334811 - DNA, 22 bp, Homo sapiens
aggccctgcccagagctcctcg

SEQ ID NO: 8334812 - DNA, 22 bp, Homo sapiens
aggccctggtcaggtctggctg

SEQ ID NO: 8334813 - DNA, 22 bp, Homo sapiens
aggccctgtaaggtgtggagat

SEQ ID NO: 8334814 - DNA, 22 bp, Homo sapiens
aggccctgtaaggtgtggagat

SEQ ID NO: 8334815 - DNA, 22 bp, Homo sapiens
acatgcaggaaaatgcacagat

SEQ ID NO: 8334816 - DNA, 20 bp, Homo sapiens
aggccctgccagggacggag

SEQ ID NO: 8334817 - DNA, 22 bp, Homo sapiens
acatgcagacgggatcctggca

SEQ ID NO: 8334818 - DNA, 22 bp, Homo sapiens
acatgatattaatgtcttattt

SEQ ID NO: 8334819 - DNA, 22 bp, Homo sapiens
acatgatttttctttgactcta

SEQ ID NO: 8334820 - DNA, 22 bp, Homo sapiens
acatgactgctcctgctctaac

SEQ ID NO: 8334821 - DNA, 17 bp, Homo sapiens
aggcaggcagagcggga

SEQ ID NO: 8334822 - DNA, 22 bp, Homo sapiens
aggcaggcactccggaagtgtc

SEQ ID NO: 8334823 - DNA, 17 bp, Homo sapiens
aggcaggcagagcggga

SEQ ID NO: 8334824 - DNA, 22 bp, Homo sapiens
actagtgtccttatataagagg

SEQ ID NO: 8334825 - DNA, 22 bp, Homo sapiens
actaaatagttttgacagaaca

SEQ ID NO: 8334826 - DNA, 22 bp, Homo sapiens
actatgaatccacattgatttt

SEQ ID NO: 8334827 - DNA, 22 bp, Homo sapiens
actatgaaagtataatattgaa

SEQ ID NO: 8334828 - DNA, 22 bp, Homo sapiens
actatgaatagccagatagtga

SEQ ID NO: 8334829 - DNA, 22 bp, Homo sapiens
actatgctcattgttaatattt

SEQ ID NO: 8334830 - DNA, 22 bp, Homo sapiens
actatatacacattatcttgtt

SEQ ID NO: 8334831 - DNA, 22 bp, Homo sapiens
actatatgtgaaggtagaattt

SEQ ID NO: 8334832 - DNA, 22 bp, Homo sapiens
actcatttaaacatttactgaa

SEQ ID NO: 8334833 - DNA, 23 bp, Homo sapiens
actcacaaagcaggatcatgttg

SEQ ID NO: 8334834 - DNA, 23 bp, Homo sapiens
actcacaaagcaggatcatgttg

SEQ ID NO: 8334835 - DNA, 22 bp, Homo sapiens
actattagcatatcatgaatgg

SEQ ID NO: 8334836 - DNA, 19 bp, Homo sapiens
actaaagcaataactattt

SEQ ID NO: 8334837 - DNA, 22 bp, Homo sapiens
actaaaaactactgccaatagc

SEQ ID NO: 8334838 - DNA, 22 bp, Homo sapiens
acgttttcagccttaatgtaga

SEQ ID NO: 8334839 - DNA, 22 bp, Homo sapiens
acgttttctagagaatatgcag

SEQ ID NO: 8334840 - DNA, 22 bp, Homo sapiens
acgttttcagtgactgtgcttc

SEQ ID NO: 8334841 - DNA, 22 bp, Homo sapiens
acgggctgggacggggaagctc

SEQ ID NO: 8334842 - DNA, 20 bp, Homo sapiens
acgggctgggacccatgcac

SEQ ID NO: 8334843 - DNA, 22 bp, Homo sapiens
acgtgttcaatttccatctgac

SEQ ID NO: 8334844 - DNA, 22 bp, Homo sapiens
accttagatttggcttactatg

SEQ ID NO: 8334845 - DNA, 22 bp, Homo sapiens
accttcaagaaacatttccttg

SEQ ID NO: 8334846 - DNA, 22 bp, Homo sapiens
agggctggtatgtccatgaaag

SEQ ID NO: 8334847 - DNA, 22 bp, Homo sapiens
accctcagagtaggcactgctg

SEQ ID NO: 8334848 - DNA, 22 bp, Homo sapiens
agggtgggctagactcttcccc

SEQ ID NO: 8334849 - DNA, 20 bp, Homo sapiens
agggtgtgggccttagccat

SEQ ID NO: 8334850 - DNA, 22 bp, Homo sapiens
agggttaattggtgtcctgagg

SEQ ID NO: 8334851 - DNA, 20 bp, Homo sapiens
agggtggggacgttctgact

SEQ ID NO: 8334852 - DNA, 22 bp, Homo sapiens
agggtggggtgctacatcttta

SEQ ID NO: 8334853 - DNA, 22 bp, Homo sapiens
aggtagaggcctccaggcagca

SEQ ID NO: 8334854 - DNA, 22 bp, Homo sapiens
aggtacatttgataaaaatagc

SEQ ID NO: 8334855 - DNA, 22 bp, Homo sapiens
aggtacatgttccagatacgta

SEQ ID NO: 8334856 - DNA, 22 bp, Homo sapiens
aggtacatttgataaaaatagc

SEQ ID NO: 8334857 - DNA, 21 bp, Homo sapiens
aggtactaatgaaaagtgatt

SEQ ID NO: 8334858 - DNA, 22 bp, Homo sapiens
aggtacatggggtgtgtgcacg

SEQ ID NO: 8334859 - DNA, 22 bp, Homo sapiens
aggtacataggaaagtggagct

SEQ ID NO: 8334860 - DNA, 22 bp, Homo sapiens
aggtacataatgatggtgatga

SEQ ID NO: 8334861 - DNA, 22 bp, Homo sapiens
aggtacatctatggggatagaa

SEQ ID NO: 8334862 - DNA, 22 bp, Homo sapiens
acctgcccggggacattccttt

SEQ ID NO: 8334863 - DNA, 22 bp, Homo sapiens
acctgcccatgaaaatggggag

SEQ ID NO: 8334864 - DNA, 22 bp, Homo sapiens
acctgcccagactcagatccta

SEQ ID NO: 8334865 - DNA, 22 bp, Homo sapiens
acctgcccacttcccatgacat

SEQ ID NO: 8334866 - DNA, 22 bp, Homo sapiens
acctgcccacatatatatgtat

SEQ ID NO: 8334867 - DNA, 22 bp, Homo sapiens
agtggctgctggagtggagatg

SEQ ID NO: 8334868 - DNA, 22 bp, Homo sapiens
actgctgattatgaaagtgaca

SEQ ID NO: 8334869 - DNA, 22 bp, Homo sapiens
actgctgagcacacaagagtgt

SEQ ID NO: 8334870 - DNA, 23 bp, Homo sapiens
actgctgtctttgaagtgcttga

SEQ ID NO: 8334871 - DNA, 22 bp, Homo sapiens
actgctccaccctggggcccag

SEQ ID NO: 8334872 - DNA, 22 bp, Homo sapiens
actgctcacgcattacttgagc

SEQ ID NO: 8334873 - DNA, 22 bp, Homo sapiens
actgctccaccctggggcccag

SEQ ID NO: 8334874 - DNA, 22 bp, Homo sapiens
actgctcaaggatctggtaggg

SEQ ID NO: 8334875 - DNA, 22 bp, Homo sapiens
actgctttagacctagagctct

SEQ ID NO: 8334876 - DNA, 22 bp, Homo sapiens
agtggctgatgtaggcagtggg

SEQ ID NO: 8334877 - DNA, 22 bp, Homo sapiens
agtggctgagtgactgtgactc

SEQ ID NO: 8334878 - DNA, 20 bp, Homo sapiens
actgatcttgttcttactcc

SEQ ID NO: 8334879 - DNA, 22 bp, Homo sapiens
actgatctgcctgtatgtagct

SEQ ID NO: 8334880 - DNA, 22 bp, Homo sapiens
actgatctgttttcagattctg

SEQ ID NO: 8334881 - DNA, 22 bp, Homo sapiens
actgatcacatagatatattcc

SEQ ID NO: 8334882 - DNA, 22 bp, Homo sapiens
actgaaggtctcagcaaggatg

SEQ ID NO: 8334883 - DNA, 19 bp, Homo sapiens
actgaagttacccaaatgg

SEQ ID NO: 8334884 - DNA, 22 bp, Homo sapiens
actgaatagtgctgcattgtac

SEQ ID NO: 8334885 - DNA, 22 bp, Homo sapiens
actgcaacctccgcctgccagg

SEQ ID NO: 8334886 - DNA, 22 bp, Homo sapiens
actgatttcagggatgagaaga

SEQ ID NO: 8334887 - DNA, 22 bp, Homo sapiens
actgcaacctccacctcctggg

SEQ ID NO: 8334888 - DNA, 22 bp, Homo sapiens
actgcaacacctcctgggttca

SEQ ID NO: 8334889 - DNA, 22 bp, Homo sapiens
actgaaatgaaatctatcatct

SEQ ID NO: 8334890 - DNA, 22 bp, Homo sapiens
actgaaagataaatcagttagc

SEQ ID NO: 8334891 - DNA, 22 bp, Homo sapiens
actgaaggctttcccaaggtca

SEQ ID NO: 8334892 - DNA, 22 bp, Homo sapiens
actgaaggcttaactctttcat

SEQ ID NO: 8334893 - DNA, 22 bp, Homo sapiens
actgaagggtaatgtgggagcc

SEQ ID NO: 8334894 - DNA, 22 bp, Homo sapiens
actgaaggaagcgggcaggggt

SEQ ID NO: 8334895 - DNA, 22 bp, Homo sapiens
actgaaggaaagcctttgcatg

SEQ ID NO: 8334896 - DNA, 22 bp, Homo sapiens
actgaaggaaacttttgtgttt

SEQ ID NO: 8334897 - DNA, 22 bp, Homo sapiens
actgaagccagagggaggacat

SEQ ID NO: 8334898 - DNA, 22 bp, Homo sapiens
agtctgggtggctgagctacag

SEQ ID NO: 8334899 - DNA, 22 bp, Homo sapiens
agtctctggggaggagtggaaa

SEQ ID NO: 8334900 - DNA, 20 bp, Homo sapiens
agtctctgtagtgcctgaga

SEQ ID NO: 8334901 - DNA, 20 bp, Homo sapiens
agtctctgtagtgcctgaga

SEQ ID NO: 8334902 - DNA, 22 bp, Homo sapiens
agtctctgtcgtagatcagcgt

SEQ ID NO: 8334903 - DNA, 22 bp, Homo sapiens
agtctctgttccagggcttcag

SEQ ID NO: 8334904 - DNA, 22 bp, Homo sapiens
agtctctgcatgatgcagcaca

SEQ ID NO: 8334905 - DNA, 22 bp, Homo sapiens
agtctctgcatgatgcagcaca

SEQ ID NO: 8334906 - DNA, 22 bp, Homo sapiens
agtctacaaagaaaagttattg

SEQ ID NO: 8334907 - DNA, 19 bp, Homo sapiens
agtctctgaggcctaagtt

SEQ ID NO: 8334908 - DNA, 22 bp, Homo sapiens
actccagggctccatcccttgt

SEQ ID NO: 8334909 - DNA, 22 bp, Homo sapiens
actccagggcttctatgatggt

SEQ ID NO: 8334910 - DNA, 22 bp, Homo sapiens
actccagggctccaccccagat

SEQ ID NO: 8334911 - DNA, 22 bp, Homo sapiens
actccagaggcagctgtgctga

SEQ ID NO: 8334912 - DNA, 22 bp, Homo sapiens
actccaggaaacttaggggaaa

SEQ ID NO: 8334913 - DNA, 22 bp, Homo sapiens
actccaggatgtagaatcagag

SEQ ID NO: 8334914 - DNA, 22 bp, Homo sapiens
actcatttttactgcaattgag

SEQ ID NO: 8334915 - DNA, 22 bp, Homo sapiens
actcattttataacactgtagt

SEQ ID NO: 8334916 - DNA, 22 bp, Homo sapiens
actcatttgacactttaaactg

SEQ ID NO: 8334917 - DNA, 22 bp, Homo sapiens
actcatttaaacatttactgaa

SEQ ID NO: 8334918 - DNA, 22 bp, Homo sapiens
atataattgttctgaagtgttt

SEQ ID NO: 8334919 - DNA, 22 bp, Homo sapiens
atataattctcaggtttgacta

SEQ ID NO: 8334920 - DNA, 22 bp, Homo sapiens
acttggtcttcaaatgcatgat

SEQ ID NO: 8334921 - DNA, 22 bp, Homo sapiens
atatacacatgtgtatacattt

SEQ ID NO: 8334922 - DNA, 22 bp, Homo sapiens
actttgtaaacatctcaaggtc

SEQ ID NO: 8334923 - DNA, 22 bp, Homo sapiens
actttgtaataactcctgagtt

SEQ ID NO: 8334924 - DNA, 22 bp, Homo sapiens
actttgtaaattgttgtgactc

SEQ ID NO: 8334925 - DNA, 22 bp, Homo sapiens
actttgtataagacaataaaga

SEQ ID NO: 8334926 - DNA, 22 bp, Homo sapiens
atatataacctggataaggctt

SEQ ID NO: 8334927 - DNA, 22 bp, Homo sapiens
atatattcttaaagaatctgac

SEQ ID NO: 8334928 - DNA, 22 bp, Homo sapiens
atatgaaaagaagtcaccattg

SEQ ID NO: 8334929 - DNA, 22 bp, Homo sapiens
atatcttttagagcaagcttgt

SEQ ID NO: 8334930 - DNA, 22 bp, Homo sapiens
atatgaaaatgttttagctgta

SEQ ID NO: 8334931 - DNA, 22 bp, Homo sapiens
agaaaataatttcttggctggt

SEQ ID NO: 8334932 - DNA, 22 bp, Homo sapiens
agaaaattagattttactgtgt

SEQ ID NO: 8334933 - DNA, 22 bp, Homo sapiens
agaaaattagattttactgtgt

SEQ ID NO: 8334934 - DNA, 22 bp, Homo sapiens
agaaacagaaccaggtgtcatt

SEQ ID NO: 8334935 - DNA, 22 bp, Homo sapiens
agaaaatttattcatgttagtt

SEQ ID NO: 8334936 - DNA, 22 bp, Homo sapiens
agaaaatttattcatgttagtt

SEQ ID NO: 8334937 - DNA, 22 bp, Homo sapiens
agaaaatttaaagagacacaca

SEQ ID NO: 8334938 - DNA, 22 bp, Homo sapiens
atatattttgaatagcctctgt

SEQ ID NO: 8334939 - DNA, 22 bp, Homo sapiens
atatccagcagcaggtgagtat

SEQ ID NO: 8334940 - DNA, 22 bp, Homo sapiens
atatatttactctcctgttgca

SEQ ID NO: 8334941 - DNA, 22 bp, Homo sapiens
atatatttgagaatattcatga

SEQ ID NO: 8334942 - DNA, 22 bp, Homo sapiens
agaaacatcttggcaactggaa

SEQ ID NO: 8334943 - DNA, 22 bp, Homo sapiens
agaaacatttagattatatgtc

SEQ ID NO: 8334944 - DNA, 22 bp, Homo sapiens
agaaacagcattagcatcaatt

SEQ ID NO: 8334945 - DNA, 22 bp, Homo sapiens
agaaacagaagggaaagctttt

SEQ ID NO: 8334946 - DNA, 22 bp, Homo sapiens
agaaacagaagggaaagctttt

SEQ ID NO: 8334947 - DNA, 22 bp, Homo sapiens
agaaacatcctgctttccattt

SEQ ID NO: 8334948 - DNA, 22 bp, Homo sapiens
agaaacatcattgtttggtatt

SEQ ID NO: 8334949 - DNA, 22 bp, Homo sapiens
atcacgtcatggtttgatctgg

SEQ ID NO: 8334950 - DNA, 22 bp, Homo sapiens
atcactgcacacctgaggtata

SEQ ID NO: 8334951 - DNA, 22 bp, Homo sapiens
atcagcaaaaatgccttcagaa

SEQ ID NO: 8334952 - DNA, 21 bp, Homo sapiens
atcagcaaatgcctgtctccc

SEQ ID NO: 8334953 - DNA, 20 bp, Homo sapiens
atcagcaactgccactcagt

SEQ ID NO: 8334954 - DNA, 22 bp, Homo sapiens
atcagcaagactaggggaatac

SEQ ID NO: 8334955 - DNA, 22 bp, Homo sapiens
atcagcaagatgtaatttctat

SEQ ID NO: 8334956 - DNA, 22 bp, Homo sapiens
atcagcaagcatggttaggtgt

SEQ ID NO: 8334957 - DNA, 22 bp, Homo sapiens
atcagcaagattgtgtcttgta

SEQ ID NO: 8334958 - DNA, 22 bp, Homo sapiens
atcagcaagcatttattgagtg

SEQ ID NO: 8334959 - DNA, 22 bp, Homo sapiens
atcagcaaggcaatcactgcag

SEQ ID NO: 8334960 - DNA, 19 bp, Homo sapiens
atcagcaaggtaggatgtg

SEQ ID NO: 8334961 - DNA, 22 bp, Homo sapiens
atcagcaagtcctgttaattct

SEQ ID NO: 8334962 - DNA, 22 bp, Homo sapiens
atcatttacaaactcagcattg

SEQ ID NO: 8334963 - DNA, 22 bp, Homo sapiens
atcattgggctccattactaga

SEQ ID NO: 8334964 - DNA, 22 bp, Homo sapiens
atccacttgccactgtatagtt

SEQ ID NO: 8334965 - DNA, 22 bp, Homo sapiens
atccacttcactggaatgtagg

SEQ ID NO: 8334966 - DNA, 22 bp, Homo sapiens
atcatttgcctcaagtgaaagt

SEQ ID NO: 8334967 - DNA, 22 bp, Homo sapiens
atcatttggggaattgtggaca

SEQ ID NO: 8334968 - DNA, 22 bp, Homo sapiens
atcatttgcctcaagtgaaagt

SEQ ID NO: 8334969 - DNA, 19 bp, Homo sapiens
acttcaaatcttagagaaa

SEQ ID NO: 8334970 - DNA, 22 bp, Homo sapiens
actgttatgttattacccatgt

SEQ ID NO: 8334971 - DNA, 22 bp, Homo sapiens
actgttatgggtgtcagcttaa

SEQ ID NO: 8334972 - DNA, 22 bp, Homo sapiens
actgttatgatttacacagtcc

SEQ ID NO: 8334973 - DNA, 22 bp, Homo sapiens
actgttatagttcacttttccc

SEQ ID NO: 8334974 - DNA, 21 bp, Homo sapiens
acttggcagaacgcagaaggc

SEQ ID NO: 8334975 - DNA, 22 bp, Homo sapiens
acttggagagataatcccatat

SEQ ID NO: 8334976 - DNA, 22 bp, Homo sapiens
acttgcaggatcctctgcctga

SEQ ID NO: 8334977 - DNA, 22 bp, Homo sapiens
acttcatttcatttgcacagtg

SEQ ID NO: 8334978 - DNA, 22 bp, Homo sapiens
actgtaaaacaggtttcatcat

SEQ ID NO: 8334979 - DNA, 22 bp, Homo sapiens
agtttatagcccagattcatgg

SEQ ID NO: 8334980 - DNA, 22 bp, Homo sapiens
agtttataaaacattgcgtggc

SEQ ID NO: 8334981 - DNA, 22 bp, Homo sapiens
agtttacacttttgattcttat

SEQ ID NO: 8334982 - DNA, 21 bp, Homo sapiens
agttgcataggccagccatcc

SEQ ID NO: 8334983 - DNA, 18 bp, Homo sapiens
agttgctagatgctgtag

SEQ ID NO: 8334984 - DNA, 22 bp, Homo sapiens
actgtcttccaggtctggaggt

SEQ ID NO: 8334985 - DNA, 22 bp, Homo sapiens
agcaggagagcagtgcgtggtc

SEQ ID NO: 8334986 - DNA, 22 bp, Homo sapiens
agcaggagacatgggggtggtg

SEQ ID NO: 8334987 - DNA, 22 bp, Homo sapiens
agcaggagaacactgtggctct

SEQ ID NO: 8334988 - DNA, 22 bp, Homo sapiens
cacagggccttgtgtgactgca

SEQ ID NO: 8334989 - DNA, 22 bp, Homo sapiens
cacagggctttgatggctgagt

SEQ ID NO: 8334990 - DNA, 22 bp, Homo sapiens
cacagggcagtgctgcccactc

SEQ ID NO: 8334991 - DNA, 19 bp, Homo sapiens
cacagggcaggtctcatgt

SEQ ID NO: 8334992 - DNA, 22 bp, Homo sapiens
cacagggcctggggcagctgct

SEQ ID NO: 8334993 - DNA, 22 bp, Homo sapiens
cacagggccactttcccagtaa

SEQ ID NO: 8334994 - DNA, 22 bp, Homo sapiens
cacaggagctgtggggcagtgt

SEQ ID NO: 8334995 - DNA, 22 bp, Homo sapiens
cacaggagccctgaggcctccc

SEQ ID NO: 8334996 - DNA, 22 bp, Homo sapiens
agcagttttagggagacacatt

SEQ ID NO: 8334997 - DNA, 22 bp, Homo sapiens
agcataattcctgacacacaag

SEQ ID NO: 8334998 - DNA, 22 bp, Homo sapiens
caccaggtgctggaggacatca

SEQ ID NO: 8334999 - DNA, 22 bp, Homo sapiens
caccagggtacaatttcgcaga

SEQ ID NO: 8335000 - DNA, 22 bp, Homo sapiens
caccagggccccaggctgtgcc

SEQ ID NO: 8335001 - DNA, 22 bp, Homo sapiens
caccagggacaatgctaggggt

SEQ ID NO: 8335002 - DNA, 22 bp, Homo sapiens
caccagggacaatgctaggggt

SEQ ID NO: 8335003 - DNA, 22 bp, Homo sapiens
cacagtcaatgtagaaatatga

SEQ ID NO: 8335004 - DNA, 22 bp, Homo sapiens
cacagtatttgtttttctgagt

SEQ ID NO: 8335005 - DNA, 22 bp, Homo sapiens
agcagggcctctggcactggtc

SEQ ID NO: 8335006 - DNA, 22 bp, Homo sapiens
agcagggcctgagtgacctaac

SEQ ID NO: 8335007 - DNA, 22 bp, Homo sapiens
cacatgaacatgctggaaaagc

SEQ ID NO: 8335008 - DNA, 22 bp, Homo sapiens
cacatgaacatgctggaaaagc

SEQ ID NO: 8335009 - DNA, 22 bp, Homo sapiens
cacatcttcttaactccaaagt

SEQ ID NO: 8335010 - DNA, 22 bp, Homo sapiens
cacatctgacttccagtgcagg

SEQ ID NO: 8335011 - DNA, 22 bp, Homo sapiens
caatgaaaatttaagttgcagc

SEQ ID NO: 8335012 - DNA, 22 bp, Homo sapiens
caatgaaagcaactgcctataa

SEQ ID NO: 8335013 - DNA, 22 bp, Homo sapiens
caatctgagttgggaatgtatt

SEQ ID NO: 8335014 - DNA, 22 bp, Homo sapiens
agcagcaggtgacctcgatgcc

SEQ ID NO: 8335015 - DNA, 22 bp, Homo sapiens
agcagcaaggaacagaatggac

SEQ ID NO: 8335016 - DNA, 22 bp, Homo sapiens
agcagcaagcagtgcacgggtt

SEQ ID NO: 8335017 - DNA, 22 bp, Homo sapiens
agcagcagaagggagacccagg

SEQ ID NO: 8335018 - DNA, 22 bp, Homo sapiens
agcagcacctggctatctgatc

SEQ ID NO: 8335019 - DNA, 22 bp, Homo sapiens
agcagacaccaggagtaaagaa

SEQ ID NO: 8335020 - DNA, 22 bp, Homo sapiens
agcagacaattgcctggatgga

SEQ ID NO: 8335021 - DNA, 22 bp, Homo sapiens
caactgttataaatcaacagag

SEQ ID NO: 8335022 - DNA, 22 bp, Homo sapiens
caaatgcatagaaagatgaaac

SEQ ID NO: 8335023 - DNA, 17 bp, Homo sapiens
agcagaagtcagaggga

SEQ ID NO: 8335024 - DNA, 22 bp, Homo sapiens
attttctctttgtatatgctag

SEQ ID NO: 8335025 - DNA, 22 bp, Homo sapiens
attttctatgttgtaattgtta

SEQ ID NO: 8335026 - DNA, 22 bp, Homo sapiens
attttctatgttgtaattgtta

SEQ ID NO: 8335027 - DNA, 22 bp, Homo sapiens
attttctatgttgtaattgtta

SEQ ID NO: 8335028 - DNA, 22 bp, Homo sapiens
attttctattctgctggtttag

SEQ ID NO: 8335029 - DNA, 22 bp, Homo sapiens
attttctgtaactatttctata

SEQ ID NO: 8335030 - DNA, 22 bp, Homo sapiens
agcacagatttgtcaacataga

SEQ ID NO: 8335031 - DNA, 22 bp, Homo sapiens
agcacagagttgctcactgccg

SEQ ID NO: 8335032 - DNA, 22 bp, Homo sapiens
agcacagagttgcagagagcgt

SEQ ID NO: 8335033 - DNA, 22 bp, Homo sapiens
agcacagagctaggagtggagg

SEQ ID NO: 8335034 - DNA, 22 bp, Homo sapiens
agcacagagaaactaagacatt

SEQ ID NO: 8335035 - DNA, 22 bp, Homo sapiens
agccaggacgttgctcagctcc

SEQ ID NO: 8335036 - DNA, 22 bp, Homo sapiens
cagaagaaagtggggagacaag

SEQ ID NO: 8335037 - DNA, 22 bp, Homo sapiens
cagaagaatggtgtctgagctc

SEQ ID NO: 8335038 - DNA, 22 bp, Homo sapiens
cagaagcctgcctcagatgcac

SEQ ID NO: 8335039 - DNA, 22 bp, Homo sapiens
cagaagctgaggagtgaggcaa

SEQ ID NO: 8335040 - DNA, 22 bp, Homo sapiens
cagaaatgacaaagtaagagga

SEQ ID NO: 8335041 - DNA, 22 bp, Homo sapiens
agccacagcgaacctctcttcc

SEQ ID NO: 8335042 - DNA, 22 bp, Homo sapiens
cagaaccaggaactgatggaga

SEQ ID NO: 8335043 - DNA, 22 bp, Homo sapiens
agccacagcctgacttaactgt

SEQ ID NO: 8335044 - DNA, 23 bp, Homo sapiens
agccacagccagagctatctcca

SEQ ID NO: 8335045 - DNA, 22 bp, Homo sapiens
agccacagcacattgtaagaaa

SEQ ID NO: 8335046 - DNA, 22 bp, Homo sapiens
agccacagcaacaagtgcaatt

SEQ ID NO: 8335047 - DNA, 22 bp, Homo sapiens
agccacagagcaggagaccttt

SEQ ID NO: 8335048 - DNA, 22 bp, Homo sapiens
agccacagagagggagctgcaa

SEQ ID NO: 8335049 - DNA, 19 bp, Homo sapiens
agccacagaacttgcagga

SEQ ID NO: 8335050 - DNA, 22 bp, Homo sapiens
cactctgtgattgcagcattcc

SEQ ID NO: 8335051 - DNA, 22 bp, Homo sapiens
agccacaatgccaacctctact

SEQ ID NO: 8335052 - DNA, 22 bp, Homo sapiens
agccacacctgtcctgccagct

SEQ ID NO: 8335053 - DNA, 22 bp, Homo sapiens
agccagtgatgaagactctgga

SEQ ID NO: 8335054 - DNA, 22 bp, Homo sapiens
cagagattattataactaatta

SEQ ID NO: 8335055 - DNA, 22 bp, Homo sapiens
cagagagggcggccctggcttc

SEQ ID NO: 8335056 - DNA, 20 bp, Homo sapiens
agccagggttctggatgcac

SEQ ID NO: 8335057 - DNA, 22 bp, Homo sapiens
agccagggttagaagatagtca

SEQ ID NO: 8335058 - DNA, 22 bp, Homo sapiens
cagacagacctgcaagggcaca

SEQ ID NO: 8335059 - DNA, 22 bp, Homo sapiens
cagacagagctcacaagtcttt

SEQ ID NO: 8335060 - DNA, 22 bp, Homo sapiens
agcccggcttccccggttgcta

SEQ ID NO: 8335061 - DNA, 19 bp, Homo sapiens
agcccccagacagcaggcc

SEQ ID NO: 8335062 - DNA, 22 bp, Homo sapiens
agcccctgtttttccagtcaga

SEQ ID NO: 8335063 - DNA, 23 bp, Homo sapiens
cagagctggctcagagctgcctg

SEQ ID NO: 8335064 - DNA, 22 bp, Homo sapiens
cagagctggagggaaccctggc

SEQ ID NO: 8335065 - DNA, 22 bp, Homo sapiens
agcccaggaagttgaggcttgc

SEQ ID NO: 8335066 - DNA, 22 bp, Homo sapiens
agcccaggagtttgaggctgtg

SEQ ID NO: 8335067 - DNA, 22 bp, Homo sapiens
cagagctggacttaaatatatt

SEQ ID NO: 8335068 - DNA, 22 bp, Homo sapiens
cagagctggagcttgaatggag

SEQ ID NO: 8335069 - DNA, 22 bp, Homo sapiens
agcctcagcacgcagctctgtg

SEQ ID NO: 8335070 - DNA, 22 bp, Homo sapiens
cagaggctaagatgagtgggtg

SEQ ID NO: 8335071 - DNA, 22 bp, Homo sapiens
cagcacagcacagcggtgactc

SEQ ID NO: 8335072 - DNA, 22 bp, Homo sapiens
cagcagaggttttgctccatga

SEQ ID NO: 8335073 - DNA, 22 bp, Homo sapiens
cagcagcattgctctggattcc

SEQ ID NO: 8335074 - DNA, 22 bp, Homo sapiens
cagcagaggcacgtctgtgaat

SEQ ID NO: 8335075 - DNA, 20 bp, Homo sapiens
cagcagaaatggggtgggaa

SEQ ID NO: 8335076 - DNA, 22 bp, Homo sapiens
agctcacattctcatcagatgt

SEQ ID NO: 8335077 - DNA, 22 bp, Homo sapiens
agctcacagtgtccttcctcaa

SEQ ID NO: 8335078 - DNA, 22 bp, Homo sapiens
agctcacagtgtccttcctcaa

SEQ ID NO: 8335079 - DNA, 22 bp, Homo sapiens
agctcaccacaacctccgcctc

SEQ ID NO: 8335080 - DNA, 22 bp, Homo sapiens
agctcagaaatgccagtaggta

SEQ ID NO: 8335081 - DNA, 22 bp, Homo sapiens
agctcacagaaatcctgcagga

SEQ ID NO: 8335082 - DNA, 22 bp, Homo sapiens
agctcacaagactccctcccct

SEQ ID NO: 8335083 - DNA, 22 bp, Homo sapiens
agccttgaatgcgctgcattgg

SEQ ID NO: 8335084 - DNA, 22 bp, Homo sapiens
agccttgatcttggtaacagga

SEQ ID NO: 8335085 - DNA, 22 bp, Homo sapiens
agccttctctgattctcctagt

SEQ ID NO: 8335086 - DNA, 23 bp, Homo sapiens
agccttggaggttgaggctgcag

SEQ ID NO: 8335087 - DNA, 22 bp, Homo sapiens
cagcaggaggcatggcttccct

SEQ ID NO: 8335088 - DNA, 22 bp, Homo sapiens
cagcaggaggcatggcttccct

SEQ ID NO: 8335089 - DNA, 22 bp, Homo sapiens
cagcaggacccaggaatcctgc

SEQ ID NO: 8335090 - DNA, 22 bp, Homo sapiens
agctccctgagatgccacagca

SEQ ID NO: 8335091 - DNA, 22 bp, Homo sapiens
agctcccattatcttctgaaac

SEQ ID NO: 8335092 - DNA, 22 bp, Homo sapiens
agctcccagtctcctctccatg

SEQ ID NO: 8335093 - DNA, 22 bp, Homo sapiens
cagccagatcaaactcagatgt

SEQ ID NO: 8335094 - DNA, 22 bp, Homo sapiens
cagccagctgaatgtaccatga

SEQ ID NO: 8335095 - DNA, 22 bp, Homo sapiens
agctccctgcacgaccctgccc

SEQ ID NO: 8335096 - DNA, 19 bp, Homo sapiens
agctcctcacctctcgcgg

SEQ ID NO: 8335097 - DNA, 22 bp, Homo sapiens
agctcctcctgagtgtctggga

SEQ ID NO: 8335098 - DNA, 20 bp, Homo sapiens
agctcctcatcactggaggt

SEQ ID NO: 8335099 - DNA, 20 bp, Homo sapiens
agctcctctgcccattcttc

SEQ ID NO: 8335100 - DNA, 22 bp, Homo sapiens
cagccctgggagttggggccga

SEQ ID NO: 8335101 - DNA, 22 bp, Homo sapiens
cagccctggcgcccccagatct

SEQ ID NO: 8335102 - DNA, 22 bp, Homo sapiens
agagggataatatgtattgtaa

SEQ ID NO: 8335103 - DNA, 22 bp, Homo sapiens
agagggatggccccgtaactca

SEQ ID NO: 8335104 - DNA, 22 bp, Homo sapiens
agaggggctcaagcagtggtct

SEQ ID NO: 8335105 - DNA, 22 bp, Homo sapiens
agaggggctcatatcctgtcat

SEQ ID NO: 8335106 - DNA, 22 bp, Homo sapiens
agagggtcaaccaggagcgtca

SEQ ID NO: 8335107 - DNA, 22 bp, Homo sapiens
attctgtatggaaaagcactat

SEQ ID NO: 8335108 - DNA, 22 bp, Homo sapiens
attctgtatttctaataagatc

SEQ ID NO: 8335109 - DNA, 22 bp, Homo sapiens
attctggccttggctctgtcac

SEQ ID NO: 8335110 - DNA, 22 bp, Homo sapiens
attctggattatcagtccacca

SEQ ID NO: 8335111 - DNA, 22 bp, Homo sapiens
attcacagttcattagctgtaa

SEQ ID NO: 8335112 - DNA, 22 bp, Homo sapiens
attcagagtctgcacaacagca

SEQ ID NO: 8335113 - DNA, 22 bp, Homo sapiens
attcagatcatatttatagctt

SEQ ID NO: 8335114 - DNA, 22 bp, Homo sapiens
attcacagttactgctgaacca

SEQ ID NO: 8335115 - DNA, 22 bp, Homo sapiens
attcacagtatggacgaaatga

SEQ ID NO: 8335116 - DNA, 22 bp, Homo sapiens
atgttaactgaagccattctcg

SEQ ID NO: 8335117 - DNA, 22 bp, Homo sapiens
atgttacaatccaacaaaatta

SEQ ID NO: 8335118 - DNA, 22 bp, Homo sapiens
atgttacaaatcctacaggtag

SEQ ID NO: 8335119 - DNA, 22 bp, Homo sapiens
atgttaaatggtttattattaa

SEQ ID NO: 8335120 - DNA, 22 bp, Homo sapiens
atgttaaatggtttattattaa

SEQ ID NO: 8335121 - DNA, 22 bp, Homo sapiens
atgttaaatagccatttgtttg

SEQ ID NO: 8335122 - DNA, 22 bp, Homo sapiens
atgttaaataatcccttaaagc

SEQ ID NO: 8335123 - DNA, 22 bp, Homo sapiens
atgtttctgtcctacgagataa

SEQ ID NO: 8335124 - DNA, 22 bp, Homo sapiens
atgtttgcttaattggagaaat

SEQ ID NO: 8335125 - DNA, 22 bp, Homo sapiens
atgtttctgaagtttacagata

SEQ ID NO: 8335126 - DNA, 22 bp, Homo sapiens
atgttacaatccaacaaaatta

SEQ ID NO: 8335127 - DNA, 19 bp, Homo sapiens
atgtgtgagaagcattata

SEQ ID NO: 8335128 - DNA, 22 bp, Homo sapiens
atgtgtggtttgtaaatgattt

SEQ ID NO: 8335129 - DNA, 22 bp, Homo sapiens
atgttaaagatggtgggaaatt

SEQ ID NO: 8335130 - DNA, 22 bp, Homo sapiens
attaaagctatccagtcatgaa

SEQ ID NO: 8335131 - DNA, 22 bp, Homo sapiens
atgtttgttgatcatttatgaa

SEQ ID NO: 8335132 - DNA, 22 bp, Homo sapiens
attaaagttgaaattgaactga

SEQ ID NO: 8335133 - DNA, 22 bp, Homo sapiens
attagatgtgtttaagtagaga

SEQ ID NO: 8335134 - DNA, 22 bp, Homo sapiens
attagcaaattctaattcacta

SEQ ID NO: 8335135 - DNA, 22 bp, Homo sapiens
attagcaattgccctgtgcaat

SEQ ID NO: 8335136 - DNA, 22 bp, Homo sapiens
atttagcacctccatctcaaca

SEQ ID NO: 8335137 - DNA, 22 bp, Homo sapiens
atttagtcatcactcatgtgtt

SEQ ID NO: 8335138 - DNA, 22 bp, Homo sapiens
atttagtctcccttatcaagga

SEQ ID NO: 8335139 - DNA, 22 bp, Homo sapiens
atttattgaacactgactatgt

SEQ ID NO: 8335140 - DNA, 22 bp, Homo sapiens
atttagcaaaaaatgatgaagc

SEQ ID NO: 8335141 - DNA, 17 bp, Homo sapiens
atttagcaagtagacag

SEQ ID NO: 8335142 - DNA, 22 bp, Homo sapiens
atttagcaagagtacaaaataa

SEQ ID NO: 8335143 - DNA, 22 bp, Homo sapiens
agagtggggacagggcctgtcc

SEQ ID NO: 8335144 - DNA, 22 bp, Homo sapiens
agagtggggacagggcctgtcc

SEQ ID NO: 8335145 - DNA, 22 bp, Homo sapiens
agagtgggacacgggcgctgtc

SEQ ID NO: 8335146 - DNA, 22 bp, Homo sapiens
agagggtggtgaggcctggttc

SEQ ID NO: 8335147 - DNA, 22 bp, Homo sapiens
agaggtatggtatattggaaga

SEQ ID NO: 8335148 - DNA, 22 bp, Homo sapiens
agaggtatgggcatggtgctgt

SEQ ID NO: 8335149 - DNA, 22 bp, Homo sapiens
agaggtatgtgaagtgatacca

SEQ ID NO: 8335150 - DNA, 22 bp, Homo sapiens
agaggtagaggttgcagtgagc

SEQ ID NO: 8335151 - DNA, 23 bp, Homo sapiens
attcttcattatcttctagaaaa

SEQ ID NO: 8335152 - DNA, 22 bp, Homo sapiens
attcttcctcatcaatctgtag

SEQ ID NO: 8335153 - DNA, 22 bp, Homo sapiens
attcttcatttactgttacttg

SEQ ID NO: 8335154 - DNA, 22 bp, Homo sapiens
atttaagattgcgtattcatgt

SEQ ID NO: 8335155 - DNA, 22 bp, Homo sapiens
atttaagactgacttcaccagt

SEQ ID NO: 8335156 - DNA, 22 bp, Homo sapiens
atttaacaagacagagaactgg

SEQ ID NO: 8335157 - DNA, 22 bp, Homo sapiens
atttaataccacttggtgcttt

SEQ ID NO: 8335158 - DNA, 22 bp, Homo sapiens
agagtggctctgctgggcacag

SEQ ID NO: 8335159 - DNA, 22 bp, Homo sapiens
agatttcaggttggggcagaag

SEQ ID NO: 8335160 - DNA, 22 bp, Homo sapiens
agatttccatctttttcatgtg

SEQ ID NO: 8335161 - DNA, 17 bp, Homo sapiens
agcaaaagtatcaaagc

SEQ ID NO: 8335162 - DNA, 22 bp, Homo sapiens
agatttcagatgctcggcagtt

SEQ ID NO: 8335163 - DNA, 22 bp, Homo sapiens
agatttcacatgctgctctatt

SEQ ID NO: 8335164 - DNA, 22 bp, Homo sapiens
agcaaacagtgtgctaagaaat

SEQ ID NO: 8335165 - DNA, 20 bp, Homo sapiens
agcaaacaggctccaccaga

SEQ ID NO: 8335166 - DNA, 22 bp, Homo sapiens
atttgcttgtgctatgaaagtt

SEQ ID NO: 8335167 - DNA, 22 bp, Homo sapiens
agatgtctcactcagttctcat

SEQ ID NO: 8335168 - DNA, 22 bp, Homo sapiens
agatgtgactgggcaagttact

SEQ ID NO: 8335169 - DNA, 23 bp, Homo sapiens
agatgtcttagaaactgaagctg

SEQ ID NO: 8335170 - DNA, 22 bp, Homo sapiens
agatgtgagaatcaagtgacca

SEQ ID NO: 8335171 - DNA, 22 bp, Homo sapiens
agatgtgagtggctgtacagtg

SEQ ID NO: 8335172 - DNA, 23 bp, Homo sapiens
agatgaaagcttcccatcacagt

SEQ ID NO: 8335173 - DNA, 22 bp, Homo sapiens
agatgaataatttgttagcttt

SEQ ID NO: 8335174 - DNA, 22 bp, Homo sapiens
atttcattgaagttaattcttc

SEQ ID NO: 8335175 - DNA, 22 bp, Homo sapiens
agatgaaaagataagcagcaat

SEQ ID NO: 8335176 - DNA, 22 bp, Homo sapiens
agatgaaaatacgtgactttaa

SEQ ID NO: 8335177 - DNA, 22 bp, Homo sapiens
agatgaaaatacgtgactttaa

SEQ ID NO: 8335178 - DNA, 22 bp, Homo sapiens
agatgaaagatttttatagaga

SEQ ID NO: 8335179 - DNA, 22 bp, Homo sapiens
atttccacataagggaaataag

SEQ ID NO: 8335180 - DNA, 22 bp, Homo sapiens
agatgtaccaggtattacagga

SEQ ID NO: 8335181 - DNA, 22 bp, Homo sapiens
agaattcagaatgcatttctaa

SEQ ID NO: 8335182 - DNA, 19 bp, Homo sapiens
agacacacttgatatgtgt

SEQ ID NO: 8335183 - DNA, 22 bp, Homo sapiens
agacacagcagtgcctgcctca

SEQ ID NO: 8335184 - DNA, 22 bp, Homo sapiens
agacacagatggtacctgagcc

SEQ ID NO: 8335185 - DNA, 22 bp, Homo sapiens
agacacagatggtacctgagcc

SEQ ID NO: 8335186 - DNA, 22 bp, Homo sapiens
agacacagaagttgctgttggg

SEQ ID NO: 8335187 - DNA, 22 bp, Homo sapiens
agacacagaagttgctgttggg

SEQ ID NO: 8335188 - DNA, 22 bp, Homo sapiens
agaatgtaagaatgcaaagatt

SEQ ID NO: 8335189 - DNA, 22 bp, Homo sapiens
agaatgctccagagctgaaaga

SEQ ID NO: 8335190 - DNA, 22 bp, Homo sapiens
agaatgtgaagattttgaatta

SEQ ID NO: 8335191 - DNA, 22 bp, Homo sapiens
agaatgttgatagcacctattt

SEQ ID NO: 8335192 - DNA, 22 bp, Homo sapiens
agaatgattttggacaatatgg

SEQ ID NO: 8335193 - DNA, 22 bp, Homo sapiens
agaatgaattaatcaactggaa

SEQ ID NO: 8335194 - DNA, 21 bp, Homo sapiens
agacagtaactcttctactcc

SEQ ID NO: 8335195 - DNA, 22 bp, Homo sapiens
agacagtatgatatatgaatac

SEQ ID NO: 8335196 - DNA, 22 bp, Homo sapiens
agacagtaataaaataggtaag

SEQ ID NO: 8335197 - DNA, 22 bp, Homo sapiens
agacagtatgatatatgaatac

SEQ ID NO: 8335198 - DNA, 22 bp, Homo sapiens
agacagtgacttagtgaccaga

SEQ ID NO: 8335199 - DNA, 22 bp, Homo sapiens
atgcagggaggtaagaggtgcc

SEQ ID NO: 8335200 - DNA, 22 bp, Homo sapiens
agacacagctaccataatacca

SEQ ID NO: 8335201 - DNA, 21 bp, Homo sapiens
agacacaggggttgctggggt

SEQ ID NO: 8335202 - DNA, 21 bp, Homo sapiens
agacacaggggttgctggggt

SEQ ID NO: 8335203 - DNA, 22 bp, Homo sapiens
agacacaggattctgcatttct

SEQ ID NO: 8335204 - DNA, 22 bp, Homo sapiens
agacacaggattctgcatttct

SEQ ID NO: 8335205 - DNA, 22 bp, Homo sapiens
agacacagtctgtctggaggag

SEQ ID NO: 8335206 - DNA, 22 bp, Homo sapiens
agacacagtctgtctggaggag

SEQ ID NO: 8335207 - DNA, 22 bp, Homo sapiens
agacacagctgcaggaggtggg

SEQ ID NO: 8335208 - DNA, 22 bp, Homo sapiens
agacacaggtgtaatttctgct

SEQ ID NO: 8335209 - DNA, 22 bp, Homo sapiens
agacacagtgctgggtgctgag

SEQ ID NO: 8335210 - DNA, 19 bp, Homo sapiens
agacacatcacatttctcc

SEQ ID NO: 8335211 - DNA, 23 bp, Homo sapiens
agacacataggagcagctattgg

SEQ ID NO: 8335212 - DNA, 22 bp, Homo sapiens
agacacagtttgggatgggttg

SEQ ID NO: 8335213 - DNA, 22 bp, Homo sapiens
agaatacaattgttcagtaata

SEQ ID NO: 8335214 - DNA, 22 bp, Homo sapiens
agaatacagtatgcaaaaagat

SEQ ID NO: 8335215 - DNA, 23 bp, Homo sapiens
agaatacaggctttgtataggca

SEQ ID NO: 8335216 - DNA, 22 bp, Homo sapiens
atctttgtcactctactgtcta

SEQ ID NO: 8335217 - DNA, 22 bp, Homo sapiens
atctttgtgaatctcaacttgg

SEQ ID NO: 8335218 - DNA, 22 bp, Homo sapiens
agaatagtggcaatgactgcac

SEQ ID NO: 8335219 - DNA, 22 bp, Homo sapiens
agaatagagaaaaaggttattt

SEQ ID NO: 8335220 - DNA, 22 bp, Homo sapiens
agaatataaagataattctgtt

SEQ ID NO: 8335221 - DNA, 22 bp, Homo sapiens
agaatataaagataattctgtt

SEQ ID NO: 8335222 - DNA, 22 bp, Homo sapiens
agaatactaggcttcagaaagg

SEQ ID NO: 8335223 - DNA, 22 bp, Homo sapiens
agaatagaattctcatagaatt

SEQ ID NO: 8335224 - DNA, 22 bp, Homo sapiens
agaatacatcaatctattttct

SEQ ID NO: 8335225 - DNA, 22 bp, Homo sapiens
agaagaatacttgatgttcatg

SEQ ID NO: 8335226 - DNA, 22 bp, Homo sapiens
agaagaaatgtgaaggccactg

SEQ ID NO: 8335227 - DNA, 22 bp, Homo sapiens
agaagaatacttgatgttcatg

SEQ ID NO: 8335228 - DNA, 22 bp, Homo sapiens
agaagagccactgttgacggca

SEQ ID NO: 8335229 - DNA, 22 bp, Homo sapiens
agaagagcctggggaccatggc

SEQ ID NO: 8335230 - DNA, 19 bp, Homo sapiens
atctttagcaactttcaaa

SEQ ID NO: 8335231 - DNA, 22 bp, Homo sapiens
atggtttgtgtggcccagatga

SEQ ID NO: 8335232 - DNA, 22 bp, Homo sapiens
atggtttgtaacccaatactcc

SEQ ID NO: 8335233 - DNA, 22 bp, Homo sapiens
atgtaaacaaggttattgtcca

SEQ ID NO: 8335234 - DNA, 22 bp, Homo sapiens
atgtaaaagattattttcctgt

SEQ ID NO: 8335235 - DNA, 22 bp, Homo sapiens
atgtacacacacatctttgcgt

SEQ ID NO: 8335236 - DNA, 22 bp, Homo sapiens
atgtacacacaagtttgcacgc

SEQ ID NO: 8335237 - DNA, 22 bp, Homo sapiens
atgtaaactcacattttcttca

SEQ ID NO: 8335238 - DNA, 22 bp, Homo sapiens
atgtaaaggcagactttaattt

SEQ ID NO: 8335239 - DNA, 22 bp, Homo sapiens
atgtaaactactgactacacta

SEQ ID NO: 8335240 - DNA, 22 bp, Homo sapiens
atgtaaactcacattttcttca

SEQ ID NO: 8335241 - DNA, 22 bp, Homo sapiens
atgggaggatgctcgggtgctc

SEQ ID NO: 8335242 - DNA, 22 bp, Homo sapiens
atgtctgtacgagttacaatgg

SEQ ID NO: 8335243 - DNA, 19 bp, Homo sapiens
atgtctgttgaatttcata

SEQ ID NO: 8335244 - DNA, 19 bp, Homo sapiens
atgtctgttgaatttcata

SEQ ID NO: 8335245 - DNA, 22 bp, Homo sapiens
atgtctgttttcatatcagata

SEQ ID NO: 8335246 - DNA, 22 bp, Homo sapiens
atgtacataaaatgtataatga

SEQ ID NO: 8335247 - DNA, 22 bp, Homo sapiens
atgtacagtttctagactcaaa

SEQ ID NO: 8335248 - DNA, 22 bp, Homo sapiens
atggctggctgagcctggttat

SEQ ID NO: 8335249 - DNA, 22 bp, Homo sapiens
atggctggctttacttgctttg

SEQ ID NO: 8335250 - DNA, 22 bp, Homo sapiens
agactccaggagggaggctgct

SEQ ID NO: 8335251 - DNA, 22 bp, Homo sapiens
agactccaaaagtttggtggaa

SEQ ID NO: 8335252 - DNA, 22 bp, Homo sapiens
agactacatatgccacatgaag

SEQ ID NO: 8335253 - DNA, 22 bp, Homo sapiens
agactacagaatggcattgttt

SEQ ID NO: 8335254 - DNA, 22 bp, Homo sapiens
atggaaatatctttagagctta

SEQ ID NO: 8335255 - DNA, 19 bp, Homo sapiens
atggaaaatgccagactga

SEQ ID NO: 8335256 - DNA, 23 bp, Homo sapiens
atgcagggttacagggctgactt

SEQ ID NO: 8335257 - DNA, 22 bp, Homo sapiens
atgcaggggccgcctggccagg

SEQ ID NO: 8335258 - DNA, 22 bp, Homo sapiens
caggacagaccaagatcgtgct

SEQ ID NO: 8335259 - DNA, 21 bp, Homo sapiens
caggaaaagcggaagtctagc

SEQ ID NO: 8335260 - DNA, 21 bp, Homo sapiens
caggaaaagcggaagtctagc

SEQ ID NO: 8335261 - DNA, 22 bp, Homo sapiens
caggaaaaatgccaggagtcag

SEQ ID NO: 8335262 - DNA, 22 bp, Homo sapiens
agctgctccctatcctttcctt

SEQ ID NO: 8335263 - DNA, 22 bp, Homo sapiens
agctgctcctttcctgcaggcg

SEQ ID NO: 8335264 - DNA, 22 bp, Homo sapiens
agctgctctgagccctgattct

SEQ ID NO: 8335265 - DNA, 22 bp, Homo sapiens
agctgctcttgggtgacttcaa

SEQ ID NO: 8335266 - DNA, 22 bp, Homo sapiens
agctgctgaatgacactgcaag

SEQ ID NO: 8335267 - DNA, 22 bp, Homo sapiens
caggaggttgtaagagcaggcc

SEQ ID NO: 8335268 - DNA, 22 bp, Homo sapiens
caggaggttggtagcagtagat

SEQ ID NO: 8335269 - DNA, 22 bp, Homo sapiens
caggagggtgtggaaaactggg

SEQ ID NO: 8335270 - DNA, 22 bp, Homo sapiens
agctggccagatgtcccaaaga

SEQ ID NO: 8335271 - DNA, 22 bp, Homo sapiens
agctggctggccccttcctgcc

SEQ ID NO: 8335272 - DNA, 22 bp, Homo sapiens
caggagtccctctggccagcat

SEQ ID NO: 8335273 - DNA, 22 bp, Homo sapiens
caggagtctctcttgagcccag

SEQ ID NO: 8335274 - DNA, 22 bp, Homo sapiens
agctgcagtcaagctgggccac

SEQ ID NO: 8335275 - DNA, 21 bp, Homo sapiens
cagctttgtctgtcttcgggg

SEQ ID NO: 8335276 - DNA, 22 bp, Homo sapiens
cagctttttagaatctagggca

SEQ ID NO: 8335277 - DNA, 22 bp, Homo sapiens
agctgcagtatgaggctggtgg

SEQ ID NO: 8335278 - DNA, 22 bp, Homo sapiens
agctgcagggcttgggtttccc

SEQ ID NO: 8335279 - DNA, 22 bp, Homo sapiens
cagcttgcagtacttgtttttg

SEQ ID NO: 8335280 - DNA, 22 bp, Homo sapiens
agctgcaggcctctcctgggga

SEQ ID NO: 8335281 - DNA, 21 bp, Homo sapiens
cagcttcttctgtgacctggt

SEQ ID NO: 8335282 - DNA, 22 bp, Homo sapiens
cagctctgaagaaaggtgtcta

SEQ ID NO: 8335283 - DNA, 22 bp, Homo sapiens
cagctcctgcctgggcagctgt

SEQ ID NO: 8335284 - DNA, 22 bp, Homo sapiens
cagctcctgggccatctcctag

SEQ ID NO: 8335285 - DNA, 23 bp, Homo sapiens
agctctgctcgggcatgccctgc

SEQ ID NO: 8335286 - DNA, 22 bp, Homo sapiens
agctctgctactctgtggggtg

SEQ ID NO: 8335287 - DNA, 22 bp, Homo sapiens
agctctgcctaggttccacgat

SEQ ID NO: 8335288 - DNA, 21 bp, Homo sapiens
caggccccaggcctggggtgc

SEQ ID NO: 8335289 - DNA, 22 bp, Homo sapiens
caggccggtgattctggatgta

SEQ ID NO: 8335290 - DNA, 22 bp, Homo sapiens
caggcctcaccagcggagctgc

SEQ ID NO: 8335291 - DNA, 22 bp, Homo sapiens
caggcctcaccagcggagctgc

SEQ ID NO: 8335292 - DNA, 22 bp, Homo sapiens
caggcctcccggtgcacactga

SEQ ID NO: 8335293 - DNA, 22 bp, Homo sapiens
agcttaatggaacttgctcaaa

SEQ ID NO: 8335294 - DNA, 22 bp, Homo sapiens
agcttgggtgtgcctgcgagct

SEQ ID NO: 8335295 - DNA, 22 bp, Homo sapiens
agcttgtagaaggccacgagca

SEQ ID NO: 8335296 - DNA, 22 bp, Homo sapiens
cagggccagccgcagcatccac

SEQ ID NO: 8335297 - DNA, 22 bp, Homo sapiens
cagggccagagagggctggctg

SEQ ID NO: 8335298 - DNA, 22 bp, Homo sapiens
aggaactctgtctccagagttg

SEQ ID NO: 8335299 - DNA, 22 bp, Homo sapiens
aggaacagaagagcaatgcagg

SEQ ID NO: 8335300 - DNA, 22 bp, Homo sapiens
aggaaccagaggttgagcaact

SEQ ID NO: 8335301 - DNA, 23 bp, Homo sapiens
aggaaccttagaattcactgcca

SEQ ID NO: 8335302 - DNA, 19 bp, Homo sapiens
aggaaccttcattgctccc

SEQ ID NO: 8335303 - DNA, 22 bp, Homo sapiens
aggaagctccatgaaggcagag

SEQ ID NO: 8335304 - DNA, 22 bp, Homo sapiens
aggaacacatggacatttctga

SEQ ID NO: 8335305 - DNA, 22 bp, Homo sapiens
aggaacacaacttcctgagagc

SEQ ID NO: 8335306 - DNA, 22 bp, Homo sapiens
aggaaaggggtaggtgtggacg

SEQ ID NO: 8335307 - DNA, 22 bp, Homo sapiens
aggaggaggctggagtacaccc

SEQ ID NO: 8335308 - DNA, 22 bp, Homo sapiens
aggaggaggtgggacacagtga

SEQ ID NO: 8335309 - DNA, 20 bp, Homo sapiens
aggagctgaattagagggtt

SEQ ID NO: 8335310 - DNA, 22 bp, Homo sapiens
aggagctgaagtctctgcactc

SEQ ID NO: 8335311 - DNA, 22 bp, Homo sapiens
aggagctgagtcagcccgacag

SEQ ID NO: 8335312 - DNA, 22 bp, Homo sapiens
aggagagttcacactggtcaga

SEQ ID NO: 8335313 - DNA, 22 bp, Homo sapiens
aggagagtcttgagtcactggt

SEQ ID NO: 8335314 - DNA, 22 bp, Homo sapiens
aggagagtaccattgggccgca

SEQ ID NO: 8335315 - DNA, 18 bp, Homo sapiens
aggagcggctgcggctgc

SEQ ID NO: 8335316 - DNA, 22 bp, Homo sapiens
aggagctcagccattcatttga

SEQ ID NO: 8335317 - DNA, 22 bp, Homo sapiens
cagtctctgccacttctaagct

SEQ ID NO: 8335318 - DNA, 22 bp, Homo sapiens
cagtctctctccttgcaggcgt

SEQ ID NO: 8335319 - DNA, 22 bp, Homo sapiens
cagtctcttttcagctccatcc

SEQ ID NO: 8335320 - DNA, 22 bp, Homo sapiens
cagtctctggcagctgctggcc

SEQ ID NO: 8335321 - DNA, 21 bp, Homo sapiens
aggacaggaactggctgaata

SEQ ID NO: 8335322 - DNA, 22 bp, Homo sapiens
aggacagcagttggtgaggttc

SEQ ID NO: 8335323 - DNA, 22 bp, Homo sapiens
cagtcctgctggccttccctgg

SEQ ID NO: 8335324 - DNA, 22 bp, Homo sapiens
cagtcctggagcccttcttggc

SEQ ID NO: 8335325 - DNA, 22 bp, Homo sapiens
cagtcctgggcacagccctggg

SEQ ID NO: 8335326 - DNA, 22 bp, Homo sapiens
cagtcctgcccaggctgacaga

SEQ ID NO: 8335327 - DNA, 22 bp, Homo sapiens
cagtcctgagctcctgggctga

SEQ ID NO: 8335328 - DNA, 22 bp, Homo sapiens
cagtcctctggagtgagggtga

SEQ ID NO: 8335329 - DNA, 22 bp, Homo sapiens
cagtccagtgatttttccagtt

SEQ ID NO: 8335330 - DNA, 22 bp, Homo sapiens
catgcagataattatattgtgt

SEQ ID NO: 8335331 - DNA, 22 bp, Homo sapiens
catgcaggcctatggagcagtg

SEQ ID NO: 8335332 - DNA, 22 bp, Homo sapiens
catgccatgtgtgaggagagga

SEQ ID NO: 8335333 - DNA, 23 bp, Homo sapiens
catgccagtttgtgcaggcagat

SEQ ID NO: 8335334 - DNA, 22 bp, Homo sapiens
aggcacaggcctcagcacccag

SEQ ID NO: 8335335 - DNA, 22 bp, Homo sapiens
aggcacaggaggtggtaagaag

SEQ ID NO: 8335336 - DNA, 22 bp, Homo sapiens
aggcacagcctcccttcacatg

SEQ ID NO: 8335337 - DNA, 22 bp, Homo sapiens
catgaaagcaggaatggtttta

SEQ ID NO: 8335338 - DNA, 22 bp, Homo sapiens
catgaaatattagtaactgttt

SEQ ID NO: 8335339 - DNA, 22 bp, Homo sapiens
catgaaaatgtcaagttctgct

SEQ ID NO: 8335340 - DNA, 22 bp, Homo sapiens
aggaggcactcactctcagggt

SEQ ID NO: 8335341 - DNA, 22 bp, Homo sapiens
catgaaatgtgttaatctcttg

SEQ ID NO: 8335342 - DNA, 22 bp, Homo sapiens
catgaaatctgagtatgtttcc

SEQ ID NO: 8335343 - DNA, 22 bp, Homo sapiens
catgaaattcagcaggtgagta

SEQ ID NO: 8335344 - DNA, 22 bp, Homo sapiens
catgaaatgttagaattagaca

SEQ ID NO: 8335345 - DNA, 22 bp, Homo sapiens
catgaaatgttagaattagaca

SEQ ID NO: 8335346 - DNA, 22 bp, Homo sapiens
aggaggtgttgatagaaggttt

SEQ ID NO: 8335347 - DNA, 22 bp, Homo sapiens
catgcacttacctgaaattcaa

SEQ ID NO: 8335348 - DNA, 22 bp, Homo sapiens
catgcactttatctttcagcca

SEQ ID NO: 8335349 - DNA, 22 bp, Homo sapiens
catgcacttacctgaaattcaa

SEQ ID NO: 8335350 - DNA, 22 bp, Homo sapiens
aggaggtggcctgagcgtgccc

SEQ ID NO: 8335351 - DNA, 22 bp, Homo sapiens
aggaggtggcctgagcgtgccc

SEQ ID NO: 8335352 - DNA, 22 bp, Homo sapiens
aggaggtgctagagaagatgtt

SEQ ID NO: 8335353 - DNA, 22 bp, Homo sapiens
catttacataacagtaacgctg

SEQ ID NO: 8335354 - DNA, 21 bp, Homo sapiens
catttacatgacagattggtt

SEQ ID NO: 8335355 - DNA, 22 bp, Homo sapiens
catttacagtgagagtttttac

SEQ ID NO: 8335356 - DNA, 22 bp, Homo sapiens
catttacagtgagagtttttac

SEQ ID NO: 8335357 - DNA, 22 bp, Homo sapiens
catttacagtgagagtttttac

SEQ ID NO: 8335358 - DNA, 22 bp, Homo sapiens
aggcagcagaaaacaaatggtt

SEQ ID NO: 8335359 - DNA, 22 bp, Homo sapiens
aggcagcagaggttgaggaaag

SEQ ID NO: 8335360 - DNA, 22 bp, Homo sapiens
catttacatttaaggttaatat

SEQ ID NO: 8335361 - DNA, 22 bp, Homo sapiens
aggcagcagtcatgaggaaaga

SEQ ID NO: 8335362 - DNA, 22 bp, Homo sapiens
aggcagccagatggcagcctgc

SEQ ID NO: 8335363 - DNA, 22 bp, Homo sapiens
aggcagccatccaggaggctca

SEQ ID NO: 8335364 - DNA, 22 bp, Homo sapiens
aggcagccaatcagaggctgac

SEQ ID NO: 8335365 - DNA, 22 bp, Homo sapiens
aggcagcatttgaatccaggtc

SEQ ID NO: 8335366 - DNA, 22 bp, Homo sapiens
aggcagcatttgaatccaggtc

SEQ ID NO: 8335367 - DNA, 21 bp, Homo sapiens
cattaagtaccagggcactgt

SEQ ID NO: 8335368 - DNA, 22 bp, Homo sapiens
catggccctcttctggagcaat

SEQ ID NO: 8335369 - DNA, 22 bp, Homo sapiens
catggcctgcctcctcctggtg

SEQ ID NO: 8335370 - DNA, 22 bp, Homo sapiens
catggccttcacctcccctgcc

SEQ ID NO: 8335371 - DNA, 22 bp, Homo sapiens
catggcctctctcctggaatgg

SEQ ID NO: 8335372 - DNA, 22 bp, Homo sapiens
cattatgtgagtgattaattca

SEQ ID NO: 8335373 - DNA, 22 bp, Homo sapiens
cattatgttcagtagcttaaaa

SEQ ID NO: 8335374 - DNA, 22 bp, Homo sapiens
cattatgtgcgtacatgtatct

SEQ ID NO: 8335375 - DNA, 22 bp, Homo sapiens
cattcccacgtgttctttgctt

SEQ ID NO: 8335376 - DNA, 22 bp, Homo sapiens
cattcccatgactcctgctcag

SEQ ID NO: 8335377 - DNA, 22 bp, Homo sapiens
aggccagcttctaccctctgtt

SEQ ID NO: 8335378 - DNA, 22 bp, Homo sapiens
aggccagcttctaccctctgtt

SEQ ID NO: 8335379 - DNA, 22 bp, Homo sapiens
aggccagcttccagaggggcag

SEQ ID NO: 8335380 - DNA, 22 bp, Homo sapiens
aggcccagctgggccaggaaca

SEQ ID NO: 8335381 - DNA, 22 bp, Homo sapiens
aggccaggatagcatggatcag

SEQ ID NO: 8335382 - DNA, 22 bp, Homo sapiens
aggcccagtgtggcttcctgga

SEQ ID NO: 8335383 - DNA, 20 bp, Homo sapiens
aggccccaggaaactctcag

SEQ ID NO: 8335384 - DNA, 22 bp, Homo sapiens
aggcccatagtagctctgggca

SEQ ID NO: 8335385 - DNA, 22 bp, Homo sapiens
aggccggcgcttcccaggaggc

SEQ ID NO: 8335386 - DNA, 22 bp, Homo sapiens
aggccctgggttagggcccact

SEQ ID NO: 8335387 - DNA, 22 bp, Homo sapiens
aggccctgacctgggagatcta

SEQ ID NO: 8335388 - DNA, 22 bp, Homo sapiens
aggccctgaagtcggcccctca

SEQ ID NO: 8335389 - DNA, 22 bp, Homo sapiens
aggccctctcattccagaggca

SEQ ID NO: 8335390 - DNA, 20 bp, Homo sapiens
aggccctccccactgttgct

SEQ ID NO: 8335391 - DNA, 18 bp, Homo sapiens
aggcccgttgtgtggaat

SEQ ID NO: 8335392 - DNA, 22 bp, Homo sapiens
aggccagcctcaggcagggacc

SEQ ID NO: 8335393 - DNA, 22 bp, Homo sapiens
aggccagcctcaggcagggacc

SEQ ID NO: 8335394 - DNA, 22 bp, Homo sapiens
aggccagcgctgctagctcccg

SEQ ID NO: 8335395 - DNA, 22 bp, Homo sapiens
aggccagctatgactctgctcc

SEQ ID NO: 8335396 - DNA, 23 bp, Homo sapiens
aggccagcgcagacaccgagcac

SEQ ID NO: 8335397 - DNA, 22 bp, Homo sapiens
aggccagctcaccctggctcct

SEQ ID NO: 8335398 - DNA, 22 bp, Homo sapiens
aggccagctctacccttggact

SEQ ID NO: 8335399 - DNA, 22 bp, Homo sapiens
aggccagctctacccttggact

SEQ ID NO: 8335400 - DNA, 22 bp, Homo sapiens
aggccagcttccagaggggcag

SEQ ID NO: 8335401 - DNA, 22 bp, Homo sapiens
aggccagctgccacccggtccg

SEQ ID NO: 8335402 - DNA, 22 bp, Homo sapiens
aggccaagtgaacaatgctagt

SEQ ID NO: 8335403 - DNA, 22 bp, Homo sapiens
aggccaagtagctagcattgaa

SEQ ID NO: 8335404 - DNA, 22 bp, Homo sapiens
ccactggctgtcagcaggactc

SEQ ID NO: 8335405 - DNA, 21 bp, Homo sapiens
ccactgctcttccctagggcc

SEQ ID NO: 8335406 - DNA, 22 bp, Homo sapiens
aggcagccctgtgctggatgct

SEQ ID NO: 8335407 - DNA, 22 bp, Homo sapiens
aggcagtgctgtgccctgaacc

SEQ ID NO: 8335408 - DNA, 22 bp, Homo sapiens
aggcagtctatctctggagcct

SEQ ID NO: 8335409 - DNA, 22 bp, Homo sapiens
ccaggctctgcgctggacatgg

SEQ ID NO: 8335410 - DNA, 22 bp, Homo sapiens
ccaggctctgagcctcactctt

SEQ ID NO: 8335411 - DNA, 22 bp, Homo sapiens
ccaggcctcacctgcccaccta

SEQ ID NO: 8335412 - DNA, 22 bp, Homo sapiens
ccaggccctgctcctcacacca

SEQ ID NO: 8335413 - DNA, 22 bp, Homo sapiens
ccaggcccgttcccttctccag

SEQ ID NO: 8335414 - DNA, 22 bp, Homo sapiens
ccaggcccttgcaagtcccacc

SEQ ID NO: 8335415 - DNA, 22 bp, Homo sapiens
aggcctcagtttgtcatctgta

SEQ ID NO: 8335416 - DNA, 22 bp, Homo sapiens
aggcctcagtttgtcatctgta

SEQ ID NO: 8335417 - DNA, 22 bp, Homo sapiens
aggcctcatagtagacctgccc

SEQ ID NO: 8335418 - DNA, 22 bp, Homo sapiens
aggcctcatgtcaaagcagcaa

SEQ ID NO: 8335419 - DNA, 22 bp, Homo sapiens
aggcctcagtgatcatcatcag

SEQ ID NO: 8335420 - DNA, 22 bp, Homo sapiens
aggcctcactctcagagcttct

SEQ ID NO: 8335421 - DNA, 22 bp, Homo sapiens
aggcctcagcctgccaggcctg

SEQ ID NO: 8335422 - DNA, 22 bp, Homo sapiens
aggcctcacacaacagatgcat

SEQ ID NO: 8335423 - DNA, 22 bp, Homo sapiens
aggcctcacacaacagatgcat

SEQ ID NO: 8335424 - DNA, 23 bp, Homo sapiens
ccaggcagtagctattgaagtga

SEQ ID NO: 8335425 - DNA, 22 bp, Homo sapiens
ccaggcagtcagggttgtgtgt

SEQ ID NO: 8335426 - DNA, 22 bp, Homo sapiens
ccaggccaaattcagtcagcag

SEQ ID NO: 8335427 - DNA, 22 bp, Homo sapiens
ccagtcacaggtgtgtttatat

SEQ ID NO: 8335428 - DNA, 22 bp, Homo sapiens
ccagtcactggaaaatgggaat

SEQ ID NO: 8335429 - DNA, 23 bp, Homo sapiens
aggctgagctctcccagcttcag

SEQ ID NO: 8335430 - DNA, 22 bp, Homo sapiens
aggctgagcctgggcgtggtgg

SEQ ID NO: 8335431 - DNA, 22 bp, Homo sapiens
ccagtgagaatgaagataaggc

SEQ ID NO: 8335432 - DNA, 22 bp, Homo sapiens
aggctctgatcaggtggctgtg

SEQ ID NO: 8335433 - DNA, 22 bp, Homo sapiens
aggctctgagtctggtgtctgc

SEQ ID NO: 8335434 - DNA, 22 bp, Homo sapiens
aggctctgaggcagattttcgt

SEQ ID NO: 8335435 - DNA, 19 bp, Homo sapiens
aggctctgagctcctggag

SEQ ID NO: 8335436 - DNA, 22 bp, Homo sapiens
aggctctgcagtgctggaggac

SEQ ID NO: 8335437 - DNA, 22 bp, Homo sapiens
aggctctgcatccaggctttat

SEQ ID NO: 8335438 - DNA, 22 bp, Homo sapiens
aggctctgcatccaggctttat

SEQ ID NO: 8335439 - DNA, 22 bp, Homo sapiens
aggctctgcagtccatcccgtg

SEQ ID NO: 8335440 - DNA, 22 bp, Homo sapiens
aggctctgcagtgctggaggac

SEQ ID NO: 8335441 - DNA, 22 bp, Homo sapiens
aggctctgcagtgctggaggac

SEQ ID NO: 8335442 - DNA, 22 bp, Homo sapiens
aggctctgcagaccccagctgt

SEQ ID NO: 8335443 - DNA, 22 bp, Homo sapiens
aggctctgcaggtatttcttga

SEQ ID NO: 8335444 - DNA, 22 bp, Homo sapiens
aggctctgatgcaagcccaggg

SEQ ID NO: 8335445 - DNA, 20 bp, Homo sapiens
aggctctgcctgcaggccca

SEQ ID NO: 8335446 - DNA, 22 bp, Homo sapiens
aggctctgttattctagagggc

SEQ ID NO: 8335447 - DNA, 22 bp, Homo sapiens
aggctctgttattctagagggc

SEQ ID NO: 8335448 - DNA, 20 bp, Homo sapiens
aggctctgcatttctgagtg

SEQ ID NO: 8335449 - DNA, 22 bp, Homo sapiens
aggctgagccacggggctggct

SEQ ID NO: 8335450 - DNA, 22 bp, Homo sapiens
cctctccttgcacccgtcccgc

SEQ ID NO: 8335451 - DNA, 22 bp, Homo sapiens
cctcccatccctgcaagagagc

SEQ ID NO: 8335452 - DNA, 22 bp, Homo sapiens
cctcccagtgccggggccggct

SEQ ID NO: 8335453 - DNA, 22 bp, Homo sapiens
cctccccacaggccaaataggc

SEQ ID NO: 8335454 - DNA, 22 bp, Homo sapiens
cctccccacagcccaggagact

SEQ ID NO: 8335455 - DNA, 22 bp, Homo sapiens
cctccccacagcccaggagact

SEQ ID NO: 8335456 - DNA, 21 bp, Homo sapiens
cctccaggagcagagccctga

SEQ ID NO: 8335457 - DNA, 21 bp, Homo sapiens
cctccaggagcagagccctga

SEQ ID NO: 8335458 - DNA, 23 bp, Homo sapiens
cctcccaggctgcgagtcccgag

SEQ ID NO: 8335459 - DNA, 22 bp, Homo sapiens
cctccaggaggaaatggaacac

SEQ ID NO: 8335460 - DNA, 22 bp, Homo sapiens
cctccaggataagtcagggcct

SEQ ID NO: 8335461 - DNA, 20 bp, Homo sapiens
cctccaggcacacccatgtg

SEQ ID NO: 8335462 - DNA, 22 bp, Homo sapiens
cctagaattataaacttattag

SEQ ID NO: 8335463 - DNA, 22 bp, Homo sapiens
cctagaatgtgcagacttaggg

SEQ ID NO: 8335464 - DNA, 22 bp, Homo sapiens
ccctggggctgagggatggccg

SEQ ID NO: 8335465 - DNA, 19 bp, Homo sapiens
ccctgggggtttctggtac

SEQ ID NO: 8335466 - DNA, 19 bp, Homo sapiens
ccctgggggtttctggtac

SEQ ID NO: 8335467 - DNA, 18 bp, Homo sapiens
cctcacagacttccatgt

SEQ ID NO: 8335468 - DNA, 22 bp, Homo sapiens
cctcagacacagtcaagctttt

SEQ ID NO: 8335469 - DNA, 22 bp, Homo sapiens
cctcagacccctgctgagcttc

SEQ ID NO: 8335470 - DNA, 22 bp, Homo sapiens
agggccaggatcacagccaaga

SEQ ID NO: 8335471 - DNA, 22 bp, Homo sapiens
agggccaggaacacctgaaggg

SEQ ID NO: 8335472 - DNA, 18 bp, Homo sapiens
agggccagctgtgagtag

SEQ ID NO: 8335473 - DNA, 22 bp, Homo sapiens
agggccagccgacttccagcct

SEQ ID NO: 8335474 - DNA, 22 bp, Homo sapiens
agggccagccgacttccagcct

SEQ ID NO: 8335475 - DNA, 22 bp, Homo sapiens
agggccagctagagccctcgcc

SEQ ID NO: 8335476 - DNA, 22 bp, Homo sapiens
agggccagctagagccctcgcc

SEQ ID NO: 8335477 - DNA, 22 bp, Homo sapiens
agggccagggaaacgatcagca

SEQ ID NO: 8335478 - DNA, 22 bp, Homo sapiens
agggccagggaaacgatcagca

SEQ ID NO: 8335479 - DNA, 22 bp, Homo sapiens
agggccaggctcccatgtcagg

SEQ ID NO: 8335480 - DNA, 22 bp, Homo sapiens
agggccaggctcccatgtcagg

SEQ ID NO: 8335481 - DNA, 22 bp, Homo sapiens
ccctggcccctcactccgaggc

SEQ ID NO: 8335482 - DNA, 22 bp, Homo sapiens
ccctggggctgagggatggccg

SEQ ID NO: 8335483 - DNA, 22 bp, Homo sapiens
ccctggggagcaggcgaaggag

SEQ ID NO: 8335484 - DNA, 22 bp, Homo sapiens
ccctggggagcaggcgaaggag

SEQ ID NO: 8335485 - DNA, 22 bp, Homo sapiens
ccctgggattgccttggccttg

SEQ ID NO: 8335486 - DNA, 22 bp, Homo sapiens
agggccagagtctgtgtagata

SEQ ID NO: 8335487 - DNA, 22 bp, Homo sapiens
agggccagccccaccctctctg

SEQ ID NO: 8335488 - DNA, 22 bp, Homo sapiens
agggccagccccaccctctctg

SEQ ID NO: 8335489 - DNA, 22 bp, Homo sapiens
agggcagcagctgtccctgaga

SEQ ID NO: 8335490 - DNA, 22 bp, Homo sapiens
agggcagcagctcctcctagct

SEQ ID NO: 8335491 - DNA, 22 bp, Homo sapiens
agggcagcccttctgggagggc

SEQ ID NO: 8335492 - DNA, 22 bp, Homo sapiens
agggcagccattgagggattct

SEQ ID NO: 8335493 - DNA, 22 bp, Homo sapiens
agggcagagggtgcctcacctg

SEQ ID NO: 8335494 - DNA, 22 bp, Homo sapiens
ccataatattaaatgcttttgt

SEQ ID NO: 8335495 - DNA, 22 bp, Homo sapiens
ccataaggtttggggccatgca

SEQ ID NO: 8335496 - DNA, 22 bp, Homo sapiens
ccataaggttgaaaactgtaca

SEQ ID NO: 8335497 - DNA, 22 bp, Homo sapiens
ccataaggagccagacattcca

SEQ ID NO: 8335498 - DNA, 22 bp, Homo sapiens
ccagtttttccagtgctttctg

SEQ ID NO: 8335499 - DNA, 22 bp, Homo sapiens
ccagtttgaggaagaagtagat

SEQ ID NO: 8335500 - DNA, 22 bp, Homo sapiens
ccatgaattcactccatgctag

SEQ ID NO: 8335501 - DNA, 22 bp, Homo sapiens
cccagcagttgttggtgcacat

SEQ ID NO: 8335502 - DNA, 22 bp, Homo sapiens
cccagcctcagctttacttcca

SEQ ID NO: 8335503 - DNA, 22 bp, Homo sapiens
cccagcagtgacccagtgatac

SEQ ID NO: 8335504 - DNA, 18 bp, Homo sapiens
cccagcctctcctttcta

SEQ ID NO: 8335505 - DNA, 22 bp, Homo sapiens
cccagcctctggattctgccct

SEQ ID NO: 8335506 - DNA, 22 bp, Homo sapiens
cccagcctctggattctgccct

SEQ ID NO: 8335507 - DNA, 22 bp, Homo sapiens
cccagcctctgggctcacccaa

SEQ ID NO: 8335508 - DNA, 22 bp, Homo sapiens
cccagcctctgggctcacccaa

SEQ ID NO: 8335509 - DNA, 22 bp, Homo sapiens
cccagcctctggattctgccct

SEQ ID NO: 8335510 - DNA, 22 bp, Homo sapiens
cccagcctctgggttctgccgg

SEQ ID NO: 8335511 - DNA, 22 bp, Homo sapiens
cccagcctctgggttctgccgg

SEQ ID NO: 8335512 - DNA, 22 bp, Homo sapiens
cccagcctctgggttctgccgg

SEQ ID NO: 8335513 - DNA, 22 bp, Homo sapiens
cccagcctctgtttgctcctct

SEQ ID NO: 8335514 - DNA, 22 bp, Homo sapiens
cccagcctctgtttgctcctct

SEQ ID NO: 8335515 - DNA, 22 bp, Homo sapiens
aggctgtgtttaagtggtaatg

SEQ ID NO: 8335516 - DNA, 22 bp, Homo sapiens
agggaagggcagggtctatgca

SEQ ID NO: 8335517 - DNA, 19 bp, Homo sapiens
agggaatccggctgaggga

SEQ ID NO: 8335518 - DNA, 22 bp, Homo sapiens
agggaaggaggttagaacccac

SEQ ID NO: 8335519 - DNA, 22 bp, Homo sapiens
ccccagcagactcagggcaggt

SEQ ID NO: 8335520 - DNA, 22 bp, Homo sapiens
ccccatgaagtagggtctctga

SEQ ID NO: 8335521 - DNA, 22 bp, Homo sapiens
ccccatcatctttgaggtcatt

SEQ ID NO: 8335522 - DNA, 22 bp, Homo sapiens
agggagctttttcatgtgtcta

SEQ ID NO: 8335523 - DNA, 22 bp, Homo sapiens
agtggctgtttataggtgggta

SEQ ID NO: 8335524 - DNA, 22 bp, Homo sapiens
agtgggagagaagcaagtagta

SEQ ID NO: 8335525 - DNA, 22 bp, Homo sapiens
ctctggggttagatctgatgct

SEQ ID NO: 8335526 - DNA, 19 bp, Homo sapiens
ctctggagaacaatagtgc

SEQ ID NO: 8335527 - DNA, 22 bp, Homo sapiens
ctctggacactggcatggggtc

SEQ ID NO: 8335528 - DNA, 20 bp, Homo sapiens
ctctctccatctcagtggcc

SEQ ID NO: 8335529 - DNA, 19 bp, Homo sapiens
ctctggagcagacactgga

SEQ ID NO: 8335530 - DNA, 23 bp, Homo sapiens
ctctggagatcctctgcctgggt

SEQ ID NO: 8335531 - DNA, 22 bp, Homo sapiens
agtggtgtcgtgggagtggaag

SEQ ID NO: 8335532 - DNA, 22 bp, Homo sapiens
agtggtgcccacctgagcctga

SEQ ID NO: 8335533 - DNA, 22 bp, Homo sapiens
agtggtggagagatgaggacac

SEQ ID NO: 8335534 - DNA, 22 bp, Homo sapiens
ctctgtcctatgcttgatagaa

SEQ ID NO: 8335535 - DNA, 22 bp, Homo sapiens
ctctgtcctccacctgctttca

SEQ ID NO: 8335536 - DNA, 22 bp, Homo sapiens
ctctgtcctggtttatactggc

SEQ ID NO: 8335537 - DNA, 22 bp, Homo sapiens
ctctgtcctggtttatactggc

SEQ ID NO: 8335538 - DNA, 22 bp, Homo sapiens
ctctgtcccagacccacctctc

SEQ ID NO: 8335539 - DNA, 22 bp, Homo sapiens
ctctgtccttgcacagttccta

SEQ ID NO: 8335540 - DNA, 22 bp, Homo sapiens
ctctgtctatcccattctgtgc

SEQ ID NO: 8335541 - DNA, 22 bp, Homo sapiens
ctctgtctatcccattctgtgc

SEQ ID NO: 8335542 - DNA, 22 bp, Homo sapiens
ctctgtgattctcatgtaccac

SEQ ID NO: 8335543 - DNA, 21 bp, Homo sapiens
ctcttgtctttgctcagtagc

SEQ ID NO: 8335544 - DNA, 22 bp, Homo sapiens
ctcttgggagtgctctggagaa

SEQ ID NO: 8335545 - DNA, 22 bp, Homo sapiens
ctcttgaagcaggggccagttc

SEQ ID NO: 8335546 - DNA, 21 bp, Homo sapiens
ctcttgctgatgtctccttta

SEQ ID NO: 8335547 - DNA, 22 bp, Homo sapiens
ctcttgccagagatgagactct

SEQ ID NO: 8335548 - DNA, 22 bp, Homo sapiens
ctcttctttccatccctagcca

SEQ ID NO: 8335549 - DNA, 22 bp, Homo sapiens
ctcttagtaatgccatgaagca

SEQ ID NO: 8335550 - DNA, 22 bp, Homo sapiens
ctcttagtttatctttgacaaa

SEQ ID NO: 8335551 - DNA, 23 bp, Homo sapiens
ctctccaccttcccacccaggga

SEQ ID NO: 8335552 - DNA, 19 bp, Homo sapiens
ctctccacctaacaggtat

SEQ ID NO: 8335553 - DNA, 22 bp, Homo sapiens
agtgctgggctatctactgcta

SEQ ID NO: 8335554 - DNA, 22 bp, Homo sapiens
agtgctggcccatagctgctgg

SEQ ID NO: 8335555 - DNA, 22 bp, Homo sapiens
ctcgggcaccctggttctggtg

SEQ ID NO: 8335556 - DNA, 22 bp, Homo sapiens
ctctctaagctccacatttcct

SEQ ID NO: 8335557 - DNA, 22 bp, Homo sapiens
ctctctaagaacttgatcttgt

SEQ ID NO: 8335558 - DNA, 20 bp, Homo sapiens
ctctcccagcacagcttcct

SEQ ID NO: 8335559 - DNA, 20 bp, Homo sapiens
ctctcccagcacagcttcct

SEQ ID NO: 8335560 - DNA, 22 bp, Homo sapiens
ctctcccagtcaggctcaggat

SEQ ID NO: 8335561 - DNA, 22 bp, Homo sapiens
ctctccccacaccctctgcatg

SEQ ID NO: 8335562 - DNA, 22 bp, Homo sapiens
agtgctggattacaggcgtgag

SEQ ID NO: 8335563 - DNA, 22 bp, Homo sapiens
ctccagagagtccagctctggg

SEQ ID NO: 8335564 - DNA, 22 bp, Homo sapiens
ctcctgcagtatgtttctctat

SEQ ID NO: 8335565 - DNA, 22 bp, Homo sapiens
ctcgcctgcctgtgtctctccc

SEQ ID NO: 8335566 - DNA, 22 bp, Homo sapiens
ctcgcggcgcccgaagcccttg

SEQ ID NO: 8335567 - DNA, 22 bp, Homo sapiens
ctcggaggtttgttaagtggct

SEQ ID NO: 8335568 - DNA, 22 bp, Homo sapiens
ctcagaatctgccaagttcagg

SEQ ID NO: 8335569 - DNA, 22 bp, Homo sapiens
agtcccagcccagtcctgtaag

SEQ ID NO: 8335570 - DNA, 22 bp, Homo sapiens
ctcagagtccatagtttacagt

SEQ ID NO: 8335571 - DNA, 22 bp, Homo sapiens
ctcagagtccccacatctgggt

SEQ ID NO: 8335572 - DNA, 22 bp, Homo sapiens
ctcagagtccccagtgggtttg

SEQ ID NO: 8335573 - DNA, 22 bp, Homo sapiens
ctcagagtcccttccctcgtgg

SEQ ID NO: 8335574 - DNA, 22 bp, Homo sapiens
ctcagagtctgcatttctgtca

SEQ ID NO: 8335575 - DNA, 22 bp, Homo sapiens
ctcagagtggggctccctgagg

SEQ ID NO: 8335576 - DNA, 22 bp, Homo sapiens
ctcagagttctcctgggaggtg

SEQ ID NO: 8335577 - DNA, 17 bp, Homo sapiens
ctcagagttgctttgtc

SEQ ID NO: 8335578 - DNA, 22 bp, Homo sapiens
ctcagagaaaaggagcaagggt

SEQ ID NO: 8335579 - DNA, 22 bp, Homo sapiens
ctcagacccccagagctgctaa

SEQ ID NO: 8335580 - DNA, 22 bp, Homo sapiens
cgggggagttgaggcacatggg

SEQ ID NO: 8335581 - DNA, 22 bp, Homo sapiens
agtatcatgttggaattaatca

SEQ ID NO: 8335582 - DNA, 22 bp, Homo sapiens
agtatcatctccatttcactga

SEQ ID NO: 8335583 - DNA, 21 bp, Homo sapiens
agtatcataatgaatagttct

SEQ ID NO: 8335584 - DNA, 22 bp, Homo sapiens
cgggtggagacagagggcataa

SEQ ID NO: 8335585 - DNA, 21 bp, Homo sapiens
cgggtgagttgagcaggacac

SEQ ID NO: 8335586 - DNA, 22 bp, Homo sapiens
cgggttcacgccattctcctgc

SEQ ID NO: 8335587 - DNA, 22 bp, Homo sapiens
cggggtgggaatagacctgtct

SEQ ID NO: 8335588 - DNA, 22 bp, Homo sapiens
cgggtaggaacaaagagctgca

SEQ ID NO: 8335589 - DNA, 22 bp, Homo sapiens
cggggtggcactctaaatagaa

SEQ ID NO: 8335590 - DNA, 22 bp, Homo sapiens
ctatttatgtgctattttgtat

SEQ ID NO: 8335591 - DNA, 22 bp, Homo sapiens
ctatttatgtccaagtgtttta

SEQ ID NO: 8335592 - DNA, 22 bp, Homo sapiens
ctcaagaatctagggaggattc

SEQ ID NO: 8335593 - DNA, 22 bp, Homo sapiens
ctcaagaagagggagacctaca

SEQ ID NO: 8335594 - DNA, 22 bp, Homo sapiens
ctcaagaaggatgagctattgc

SEQ ID NO: 8335595 - DNA, 22 bp, Homo sapiens
agtctcagcaagcatggctagt

SEQ ID NO: 8335596 - DNA, 22 bp, Homo sapiens
agtctcagagtacctgagggac

SEQ ID NO: 8335597 - DNA, 18 bp, Homo sapiens
agtctcagcggaggagta

SEQ ID NO: 8335598 - DNA, 22 bp, Homo sapiens
agtctcagccacacagacctat

SEQ ID NO: 8335599 - DNA, 22 bp, Homo sapiens
agtctcagctacttgggaggct

SEQ ID NO: 8335600 - DNA, 22 bp, Homo sapiens
ctcagctccctccacccagacc

SEQ ID NO: 8335601 - DNA, 22 bp, Homo sapiens
ctcagctcattgtggatccggt

SEQ ID NO: 8335602 - DNA, 22 bp, Homo sapiens
ctcagctccagccctcagcagc

SEQ ID NO: 8335603 - DNA, 22 bp, Homo sapiens
ctcagctagtaacgtacatgtc

SEQ ID NO: 8335604 - DNA, 22 bp, Homo sapiens
ctcagccccaatttgccctctt

SEQ ID NO: 8335605 - DNA, 22 bp, Homo sapiens
ctcagccctccccggggaataa

SEQ ID NO: 8335606 - DNA, 22 bp, Homo sapiens
ctcagggagtagcacatgtgga

SEQ ID NO: 8335607 - DNA, 21 bp, Homo sapiens
ctcaggcatttgaggagagtc

SEQ ID NO: 8335608 - DNA, 22 bp, Homo sapiens
agtctctaggatcagacaccca

SEQ ID NO: 8335609 - DNA, 23 bp, Homo sapiens
agtctcagctggaaacatgtgtc

SEQ ID NO: 8335610 - DNA, 22 bp, Homo sapiens
agtctcaggcagaggaaggcta

SEQ ID NO: 8335611 - DNA, 22 bp, Homo sapiens
agtctcagggccacccggggaa

SEQ ID NO: 8335612 - DNA, 19 bp, Homo sapiens
agtctcagtgtacagaggc

SEQ ID NO: 8335613 - DNA, 22 bp, Homo sapiens
ctcagtgggcccatggcgtcct

SEQ ID NO: 8335614 - DNA, 17 bp, Homo sapiens
agtgaaatttacattgc

SEQ ID NO: 8335615 - DNA, 20 bp, Homo sapiens
agtgacagagactgtgtggc

SEQ ID NO: 8335616 - DNA, 22 bp, Homo sapiens
agtgacacggagagacagcatg

SEQ ID NO: 8335617 - DNA, 22 bp, Homo sapiens
agtgacaaaacggaacatacag

SEQ ID NO: 8335618 - DNA, 22 bp, Homo sapiens
ctccagaaggtgggggagccac

SEQ ID NO: 8335619 - DNA, 22 bp, Homo sapiens
ctccagagagaaaggaggccgc

SEQ ID NO: 8335620 - DNA, 22 bp, Homo sapiens
cctctgagttagagatctagat

SEQ ID NO: 8335621 - DNA, 22 bp, Homo sapiens
cctctgagtgacagcctcctct

SEQ ID NO: 8335622 - DNA, 22 bp, Homo sapiens
cctctgagtcctttgggctctc

SEQ ID NO: 8335623 - DNA, 22 bp, Homo sapiens
cctctctccttcctttgccaaa

SEQ ID NO: 8335624 - DNA, 22 bp, Homo sapiens
cctctgccacctcccacgaggc

SEQ ID NO: 8335625 - DNA, 22 bp, Homo sapiens
cctgcccaggagtctctctgtg

SEQ ID NO: 8335626 - DNA, 22 bp, Homo sapiens
cctgcccctcaaggcctggtgc

SEQ ID NO: 8335627 - DNA, 22 bp, Homo sapiens
cctgcccctcaaggcctggtgc

SEQ ID NO: 8335628 - DNA, 22 bp, Homo sapiens
cctgcccagggtcaccacagag

SEQ ID NO: 8335629 - DNA, 22 bp, Homo sapiens
cctgcccatcccgtccttggcc

SEQ ID NO: 8335630 - DNA, 22 bp, Homo sapiens
cctgcccatactgacctctaat

SEQ ID NO: 8335631 - DNA, 22 bp, Homo sapiens
cctgcccatactgacctctaat

SEQ ID NO: 8335632 - DNA, 22 bp, Homo sapiens
cctgccctatgaccagcttcac

SEQ ID NO: 8335633 - DNA, 22 bp, Homo sapiens
cctgccctgctcactgtcggta

SEQ ID NO: 8335634 - DNA, 22 bp, Homo sapiens
cctgccctagagatgacacaat

SEQ ID NO: 8335635 - DNA, 22 bp, Homo sapiens
cctgccctagagatgacacaat

SEQ ID NO: 8335636 - DNA, 22 bp, Homo sapiens
cctgccctaatccagagactag

SEQ ID NO: 8335637 - DNA, 22 bp, Homo sapiens
agggtctgttgtttgttctgga

SEQ ID NO: 8335638 - DNA, 22 bp, Homo sapiens
agggtctgtttaccacctcttt

SEQ ID NO: 8335639 - DNA, 22 bp, Homo sapiens
agggtctgtggatgcatctggg

SEQ ID NO: 8335640 - DNA, 22 bp, Homo sapiens
agggtctgtgcaagaacacgcc

SEQ ID NO: 8335641 - DNA, 22 bp, Homo sapiens
agggtctgtatttctggcaagc

SEQ ID NO: 8335642 - DNA, 22 bp, Homo sapiens
agggtctgtgcaagaacacgcc

SEQ ID NO: 8335643 - DNA, 22 bp, Homo sapiens
agggtgaatctcacaactctta

SEQ ID NO: 8335644 - DNA, 20 bp, Homo sapiens
agggtgagacatgagcctcc

SEQ ID NO: 8335645 - DNA, 22 bp, Homo sapiens
agggtctgacaatgtgacttag

SEQ ID NO: 8335646 - DNA, 22 bp, Homo sapiens
agggtctgaccaccagtaggga

SEQ ID NO: 8335647 - DNA, 22 bp, Homo sapiens
agggtctgactcctctggcaag

SEQ ID NO: 8335648 - DNA, 20 bp, Homo sapiens
agggtctgatgtggtggccc

SEQ ID NO: 8335649 - DNA, 23 bp, Homo sapiens
agggtctgctcagtgtcgttcaa

SEQ ID NO: 8335650 - DNA, 22 bp, Homo sapiens
agggtctgcagggatcttctgg

SEQ ID NO: 8335651 - DNA, 22 bp, Homo sapiens
agggtctggtgtagaagttctc

SEQ ID NO: 8335652 - DNA, 20 bp, Homo sapiens
agggtcagagagcgtgagtg

SEQ ID NO: 8335653 - DNA, 22 bp, Homo sapiens
agggtcagagtcaggtgcagta

SEQ ID NO: 8335654 - DNA, 22 bp, Homo sapiens
cctggaaagaggaaggaagcct

SEQ ID NO: 8335655 - DNA, 19 bp, Homo sapiens
cctgctgaagtgatgcagc

SEQ ID NO: 8335656 - DNA, 22 bp, Homo sapiens
cctgctctccatacactttcta

SEQ ID NO: 8335657 - DNA, 22 bp, Homo sapiens
cctggacagggccaggccatgc

SEQ ID NO: 8335658 - DNA, 22 bp, Homo sapiens
cctggaccaaacactggcctgg

SEQ ID NO: 8335659 - DNA, 20 bp, Homo sapiens
cctggaagagctccccaggc

SEQ ID NO: 8335660 - DNA, 22 bp, Homo sapiens
cctggaagattcaccactacca

SEQ ID NO: 8335661 - DNA, 22 bp, Homo sapiens
cctggcagcgtgccgagctgcg

SEQ ID NO: 8335662 - DNA, 22 bp, Homo sapiens
cctggcagcccagagcgccgct

SEQ ID NO: 8335663 - DNA, 22 bp, Homo sapiens
cctggctcttcagaggttccta

SEQ ID NO: 8335664 - DNA, 22 bp, Homo sapiens
ccttttatatggctcatcacag

SEQ ID NO: 8335665 - DNA, 22 bp, Homo sapiens
ccttttatagatcagtgtgtta

SEQ ID NO: 8335666 - DNA, 22 bp, Homo sapiens
cgagcatgatgacggctgtggc

SEQ ID NO: 8335667 - DNA, 22 bp, Homo sapiens
ccttttatgaacttgagcaggt

SEQ ID NO: 8335668 - DNA, 22 bp, Homo sapiens
cgaggcaggcaggcggaggata

SEQ ID NO: 8335669 - DNA, 22 bp, Homo sapiens
cgaggaggaaacgcggagaact

SEQ ID NO: 8335670 - DNA, 22 bp, Homo sapiens
cgaggaggaaacgcggagaact

SEQ ID NO: 8335671 - DNA, 22 bp, Homo sapiens
cctttgtaagatgtgaagactg

SEQ ID NO: 8335672 - DNA, 22 bp, Homo sapiens
cctttgtatacagttcttgtga

SEQ ID NO: 8335673 - DNA, 22 bp, Homo sapiens
cctttgtatttacctagtctca

SEQ ID NO: 8335674 - DNA, 22 bp, Homo sapiens
cctttgtaccttaaatcctgtg

SEQ ID NO: 8335675 - DNA, 22 bp, Homo sapiens
cctttgtactctggtccaaact

SEQ ID NO: 8335676 - DNA, 22 bp, Homo sapiens
aggtgggggctgtgtccttgac

SEQ ID NO: 8335677 - DNA, 22 bp, Homo sapiens
aggtggggtgagctgcagacta

SEQ ID NO: 8335678 - DNA, 22 bp, Homo sapiens
cggaggggatacattttctgaa

SEQ ID NO: 8335679 - DNA, 22 bp, Homo sapiens
cggaggggtttgaacagaggag

SEQ ID NO: 8335680 - DNA, 22 bp, Homo sapiens
cggagctgcctgccaagcctgc

SEQ ID NO: 8335681 - DNA, 22 bp, Homo sapiens
cggagcgctgggggactctgca

SEQ ID NO: 8335682 - DNA, 22 bp, Homo sapiens
cggagcagaaggcgccgccggc

SEQ ID NO: 8335683 - DNA, 22 bp, Homo sapiens
cggctcactgcagctccgcctc

SEQ ID NO: 8335684 - DNA, 22 bp, Homo sapiens
cggccctgaccagaccttagtt

SEQ ID NO: 8335685 - DNA, 22 bp, Homo sapiens
cggccctgctgagcttgtctgg

SEQ ID NO: 8335686 - DNA, 22 bp, Homo sapiens
cggccctggcggaggcgggaga

SEQ ID NO: 8335687 - DNA, 22 bp, Homo sapiens
cggcgcaggcagaccgcgggct

SEQ ID NO: 8335688 - DNA, 22 bp, Homo sapiens
agtatattgctcttaatcatag

SEQ ID NO: 8335689 - DNA, 22 bp, Homo sapiens
agtatatatgaggaaccacaaa

SEQ ID NO: 8335690 - DNA, 22 bp, Homo sapiens
agtatatttgttaagattattc

SEQ ID NO: 8335691 - DNA, 21 bp, Homo sapiens
aggtggggctgcacctctgct

SEQ ID NO: 8335692 - DNA, 22 bp, Homo sapiens
ccttggccctagcctcaggcaa

SEQ ID NO: 8335693 - DNA, 22 bp, Homo sapiens
aggtggctgcctccccgcgcgg

SEQ ID NO: 8335694 - DNA, 22 bp, Homo sapiens
aggtggctggtccaggctgcag

SEQ ID NO: 8335695 - DNA, 22 bp, Homo sapiens
aggtggctgtattcagctgtaa

SEQ ID NO: 8335696 - DNA, 22 bp, Homo sapiens
aggtggcttctggccaggtgtg

SEQ ID NO: 8335697 - DNA, 22 bp, Homo sapiens
aggtgggacccgtggggtgcga

SEQ ID NO: 8335698 - DNA, 21 bp, Homo sapiens
aggtgggagaccatgtaggtc

SEQ ID NO: 8335699 - DNA, 22 bp, Homo sapiens
aggtgctgggcagcagtcattg

SEQ ID NO: 8335700 - DNA, 22 bp, Homo sapiens
aggtgctgttggcagcgggcag

SEQ ID NO: 8335701 - DNA, 22 bp, Homo sapiens
aggtgctgaactggtgaggtct

SEQ ID NO: 8335702 - DNA, 22 bp, Homo sapiens
aggtgctgccccgagaaggatg

SEQ ID NO: 8335703 - DNA, 17 bp, Homo sapiens
aggtgctggagcatcag

SEQ ID NO: 8335704 - DNA, 17 bp, Homo sapiens
aggtgctggagcatcag

SEQ ID NO: 8335705 - DNA, 22 bp, Homo sapiens
aggtgctggcgccccaggagac

SEQ ID NO: 8335706 - DNA, 22 bp, Homo sapiens
aggtgctggcgccccaggagac

SEQ ID NO: 8335707 - DNA, 19 bp, Homo sapiens
cctgggacttaggctgggt

SEQ ID NO: 8335708 - DNA, 22 bp, Homo sapiens
cctgggagaactgctgggttgg

SEQ ID NO: 8335709 - DNA, 23 bp, Homo sapiens
aggtgcccagaccccaccctctt

SEQ ID NO: 8335710 - DNA, 22 bp, Homo sapiens
aggtgccagctctcaggcagga

SEQ ID NO: 8335711 - DNA, 18 bp, Homo sapiens
aggtgccctccttacact

SEQ ID NO: 8335712 - DNA, 22 bp, Homo sapiens
aggtgcccatcacctcacagtc

SEQ ID NO: 8335713 - DNA, 22 bp, Homo sapiens
aggtgctctaggtatctacttt

SEQ ID NO: 8335714 - DNA, 22 bp, Homo sapiens
ctgccaggcctcatcccagcca

SEQ ID NO: 8335715 - DNA, 22 bp, Homo sapiens
ctgccaggactgacgtcttcag

SEQ ID NO: 8335716 - DNA, 22 bp, Homo sapiens
ctgcatttccacctggccacag

SEQ ID NO: 8335717 - DNA, 20 bp, Homo sapiens
ataaaataactgccacaaga

SEQ ID NO: 8335718 - DNA, 20 bp, Homo sapiens
ataaaataactgccacaaga

SEQ ID NO: 8335719 - DNA, 22 bp, Homo sapiens
agtttaagctggttataggcaa

SEQ ID NO: 8335720 - DNA, 22 bp, Homo sapiens
agtttaagggattttcaatggt

SEQ ID NO: 8335721 - DNA, 22 bp, Homo sapiens
agtttggcagagcttgggtggt

SEQ ID NO: 8335722 - DNA, 22 bp, Homo sapiens
agtttgtaaacttgagctagcc

SEQ ID NO: 8335723 - DNA, 22 bp, Homo sapiens
agtttgtaaaatgtggcctgga

SEQ ID NO: 8335724 - DNA, 19 bp, Homo sapiens
agtttgaggaagttaagaa

SEQ ID NO: 8335725 - DNA, 20 bp, Homo sapiens
agtttgagaggaagtcagtg

SEQ ID NO: 8335726 - DNA, 22 bp, Homo sapiens
ctctttggctttgactcccatt

SEQ ID NO: 8335727 - DNA, 22 bp, Homo sapiens
agttctttaacgagtaagattt

SEQ ID NO: 8335728 - DNA, 21 bp, Homo sapiens
agttggaggcagtttggcaat

SEQ ID NO: 8335729 - DNA, 22 bp, Homo sapiens
agttgcttccctattcttagca

SEQ ID NO: 8335730 - DNA, 22 bp, Homo sapiens
agttggtgggtgtgagctggac

SEQ ID NO: 8335731 - DNA, 22 bp, Homo sapiens
ctgaggggtatccaaggggtaa

SEQ ID NO: 8335732 - DNA, 22 bp, Homo sapiens
ctgaggctggggaagggaagtg

SEQ ID NO: 8335733 - DNA, 18 bp, Homo sapiens
ctgaggcttagagaggtt

SEQ ID NO: 8335734 - DNA, 22 bp, Homo sapiens
ctgaggcctctgttcaccagaa

SEQ ID NO: 8335735 - DNA, 21 bp, Homo sapiens
ctgctctggggaccggctgtg

SEQ ID NO: 8335736 - DNA, 22 bp, Homo sapiens
ctgctctggggaagccagatgt

SEQ ID NO: 8335737 - DNA, 22 bp, Homo sapiens
ctgctctggcgtactcggcatc

SEQ ID NO: 8335738 - DNA, 22 bp, Homo sapiens
ctgctctggctgtgtacttcag

SEQ ID NO: 8335739 - DNA, 22 bp, Homo sapiens
ataatacatggttgatcttttc

SEQ ID NO: 8335740 - DNA, 22 bp, Homo sapiens
ataatacatggttgatcttttc

SEQ ID NO: 8335741 - DNA, 22 bp, Homo sapiens
ctgctctgctgatcagtgtctc

SEQ ID NO: 8335742 - DNA, 22 bp, Homo sapiens
ctgctctgcagcttggactccc

SEQ ID NO: 8335743 - DNA, 22 bp, Homo sapiens
ctgctctgagaggctcttccta

SEQ ID NO: 8335744 - DNA, 22 bp, Homo sapiens
ctgcccacagttctctgccatg

SEQ ID NO: 8335745 - DNA, 22 bp, Homo sapiens
ataaatatcactgttgtccctc

SEQ ID NO: 8335746 - DNA, 22 bp, Homo sapiens
ctgcccaccacacctgctcctg

SEQ ID NO: 8335747 - DNA, 22 bp, Homo sapiens
ctgcccaccgtgtgcacgtgcg

SEQ ID NO: 8335748 - DNA, 19 bp, Homo sapiens
ctgctcaggtcagtctgtc

SEQ ID NO: 8335749 - DNA, 22 bp, Homo sapiens
ctgcccagaatcactcactcga

SEQ ID NO: 8335750 - DNA, 22 bp, Homo sapiens
ctgcccagaatcactcactcga

SEQ ID NO: 8335751 - DNA, 22 bp, Homo sapiens
ctgcccacttggccaccttcta

SEQ ID NO: 8335752 - DNA, 22 bp, Homo sapiens
ctgctgtgtgaccatggacagg

SEQ ID NO: 8335753 - DNA, 22 bp, Homo sapiens
ataatatttgcattactgtgat

SEQ ID NO: 8335754 - DNA, 22 bp, Homo sapiens
atacaagatcactccagaaaat

SEQ ID NO: 8335755 - DNA, 20 bp, Homo sapiens
atacaagatgagtaatttct

SEQ ID NO: 8335756 - DNA, 20 bp, Homo sapiens
atacaagatgagtaatttct

SEQ ID NO: 8335757 - DNA, 18 bp, Homo sapiens
atacaagcagcagagatt

SEQ ID NO: 8335758 - DNA, 22 bp, Homo sapiens
atacaagactcagcacagacgg

SEQ ID NO: 8335759 - DNA, 18 bp, Homo sapiens
atacaagatcaagtgttc

SEQ ID NO: 8335760 - DNA, 19 bp, Homo sapiens
atacaagagagcagttgag

SEQ ID NO: 8335761 - DNA, 19 bp, Homo sapiens
atacaagactagcatttac

SEQ ID NO: 8335762 - DNA, 21 bp, Homo sapiens
atacaagaagatggcagtctg

SEQ ID NO: 8335763 - DNA, 22 bp, Homo sapiens
ctggagcccaggcctggtgtct

SEQ ID NO: 8335764 - DNA, 22 bp, Homo sapiens
atacaagttaatgagaatgaca

SEQ ID NO: 8335765 - DNA, 22 bp, Homo sapiens
ctggagagaccgaaagaggctg

SEQ ID NO: 8335766 - DNA, 22 bp, Homo sapiens
ctggagccactgggtcttgtat

SEQ ID NO: 8335767 - DNA, 22 bp, Homo sapiens
atacagatgaaatactaagcta

SEQ ID NO: 8335768 - DNA, 22 bp, Homo sapiens
atacagatcccacagcatgtga

SEQ ID NO: 8335769 - DNA, 20 bp, Homo sapiens
atacagatggttccagctgg

SEQ ID NO: 8335770 - DNA, 22 bp, Homo sapiens
ctggagggagttaggacccgga

SEQ ID NO: 8335771 - DNA, 22 bp, Homo sapiens
atacttctttaagagtaagtct

SEQ ID NO: 8335772 - DNA, 22 bp, Homo sapiens
ctggcagctctactcagagcct

SEQ ID NO: 8335773 - DNA, 22 bp, Homo sapiens
ctggagtgactttgttcctttt

SEQ ID NO: 8335774 - DNA, 22 bp, Homo sapiens
ctggagggctgcagcgaggctg

SEQ ID NO: 8335775 - DNA, 22 bp, Homo sapiens
ctggagtgaggtctgggagcct

SEQ ID NO: 8335776 - DNA, 22 bp, Homo sapiens
atacttatgataaataattgct

SEQ ID NO: 8335777 - DNA, 22 bp, Homo sapiens
ctgggcacaggggagcagagtc

SEQ ID NO: 8335778 - DNA, 19 bp, Homo sapiens
ctgggaggtgttcagagaa

SEQ ID NO: 8335779 - DNA, 23 bp, Homo sapiens
ctgggcacccagtacctaggccc

SEQ ID NO: 8335780 - DNA, 22 bp, Homo sapiens
ctgggcaccaggcatgacaggg

SEQ ID NO: 8335781 - DNA, 22 bp, Homo sapiens
atatatatgctgatggctgcca

SEQ ID NO: 8335782 - DNA, 22 bp, Homo sapiens
ctgggagacaagagagggctga

SEQ ID NO: 8335783 - DNA, 22 bp, Homo sapiens
ctgggagacaagagagggctga

SEQ ID NO: 8335784 - DNA, 22 bp, Homo sapiens
atatatagagctagatgttaaa

SEQ ID NO: 8335785 - DNA, 22 bp, Homo sapiens
atatatatcgagttcatgtctc

SEQ ID NO: 8335786 - DNA, 22 bp, Homo sapiens
atatatatcgagttcatgtctc

SEQ ID NO: 8335787 - DNA, 22 bp, Homo sapiens
atatataagctgatgagccaca

SEQ ID NO: 8335788 - DNA, 22 bp, Homo sapiens
atatatacaactagattaaaag

SEQ ID NO: 8335789 - DNA, 22 bp, Homo sapiens
atataacatacatacagaaaag

SEQ ID NO: 8335790 - DNA, 22 bp, Homo sapiens
ctgggaaggggaaggtcctctc

SEQ ID NO: 8335791 - DNA, 22 bp, Homo sapiens
ctggcagcttagcactctggtt

SEQ ID NO: 8335792 - DNA, 22 bp, Homo sapiens
ctggcagcttagcactctggtt

SEQ ID NO: 8335793 - DNA, 22 bp, Homo sapiens
ctgggaagcatggtgatggtat

SEQ ID NO: 8335794 - DNA, 22 bp, Homo sapiens
atatatggttaggaatctatga

SEQ ID NO: 8335795 - DNA, 19 bp, Homo sapiens
atatatgtatacaatgtgg

SEQ ID NO: 8335796 - DNA, 22 bp, Homo sapiens
atatatattgcccaggctggtt

SEQ ID NO: 8335797 - DNA, 22 bp, Homo sapiens
atatgacataaaatcatttttg

SEQ ID NO: 8335798 - DNA, 22 bp, Homo sapiens
atatgacataaaatcatttttg

SEQ ID NO: 8335799 - DNA, 22 bp, Homo sapiens
atatgagagaggaaagatttta

SEQ ID NO: 8335800 - DNA, 22 bp, Homo sapiens
atatgacagcggattcacatat

SEQ ID NO: 8335801 - DNA, 22 bp, Homo sapiens
atatgcaagcacatagaatact

SEQ ID NO: 8335802 - DNA, 22 bp, Homo sapiens
atatgattccactattgtatgg

SEQ ID NO: 8335803 - DNA, 22 bp, Homo sapiens
ctgggcaggagggctctatgga

SEQ ID NO: 8335804 - DNA, 22 bp, Homo sapiens
ctgggcagtgcagctatagaac

SEQ ID NO: 8335805 - DNA, 20 bp, Homo sapiens
ctgggcaggtgtttgatctc

SEQ ID NO: 8335806 - DNA, 22 bp, Homo sapiens
ctgggcagtatgaatattcaaa

SEQ ID NO: 8335807 - DNA, 22 bp, Homo sapiens
ctgggcaggtatacaaaaaatg

SEQ ID NO: 8335808 - DNA, 22 bp, Homo sapiens
ctgggcaggatacttcatggga

SEQ ID NO: 8335809 - DNA, 22 bp, Homo sapiens
ctgggcagtgggcaagttgtat

SEQ ID NO: 8335810 - DNA, 22 bp, Homo sapiens
ctgggcagtggtggcatctttg

SEQ ID NO: 8335811 - DNA, 22 bp, Homo sapiens
ctgggcagtggtggcccttccc

SEQ ID NO: 8335812 - DNA, 22 bp, Homo sapiens
atatgggggggcgtgcagagga

SEQ ID NO: 8335813 - DNA, 22 bp, Homo sapiens
atatgtatgtacgcacatattc

SEQ ID NO: 8335814 - DNA, 22 bp, Homo sapiens
atatgtcgctacatcattagat

SEQ ID NO: 8335815 - DNA, 23 bp, Homo sapiens
atatgttgtgaaattttagtagc

SEQ ID NO: 8335816 - DNA, 22 bp, Homo sapiens
atatgttagggaacaatttgag

SEQ ID NO: 8335817 - DNA, 22 bp, Homo sapiens
atatttagataaaaatgggctt

SEQ ID NO: 8335818 - DNA, 22 bp, Homo sapiens
atatttataagcaagcaggact

SEQ ID NO: 8335819 - DNA, 22 bp, Homo sapiens
atatttctctcagacatggaag

SEQ ID NO: 8335820 - DNA, 20 bp, Homo sapiens
atatttcttaagaactttca

SEQ ID NO: 8335821 - DNA, 22 bp, Homo sapiens
atatttgcaggaaactagtttt

SEQ ID NO: 8335822 - DNA, 22 bp, Homo sapiens
atatttgtagtgggtaagaagt

SEQ ID NO: 8335823 - DNA, 22 bp, Homo sapiens
atatttggaaagaaaatcattg

SEQ ID NO: 8335824 - DNA, 22 bp, Homo sapiens
atatttgtaaaattctgtgtct

SEQ ID NO: 8335825 - DNA, 22 bp, Homo sapiens
atcatgcagcaacaagcaaggc

SEQ ID NO: 8335826 - DNA, 22 bp, Homo sapiens
atcatgcaataaggtgaggcct

SEQ ID NO: 8335827 - DNA, 22 bp, Homo sapiens
atcatgcattgtattgagttga

SEQ ID NO: 8335828 - DNA, 18 bp, Homo sapiens
ctgtcttttttctctcca

SEQ ID NO: 8335829 - DNA, 22 bp, Homo sapiens
ctgtcttttactatcatttact

SEQ ID NO: 8335830 - DNA, 22 bp, Homo sapiens
ctgtctttggtcctgtctgtta

SEQ ID NO: 8335831 - DNA, 22 bp, Homo sapiens
ctgtctttagtacaaaaaatgt

SEQ ID NO: 8335832 - DNA, 22 bp, Homo sapiens
ctgtctgttttaccttctccag

SEQ ID NO: 8335833 - DNA, 22 bp, Homo sapiens
ctgtctgtttctgattcaacct

SEQ ID NO: 8335834 - DNA, 22 bp, Homo sapiens
ctgtcctctgtcctcagcagga

SEQ ID NO: 8335835 - DNA, 22 bp, Homo sapiens
ctgtcctccagacgacagtccc

SEQ ID NO: 8335836 - DNA, 22 bp, Homo sapiens
atcacatctcaccactgcaacc

SEQ ID NO: 8335837 - DNA, 22 bp, Homo sapiens
atcacatcacaggttgagctag

SEQ ID NO: 8335838 - DNA, 22 bp, Homo sapiens
atatttgttagagtctatgtgt

SEQ ID NO: 8335839 - DNA, 22 bp, Homo sapiens
atatttgtggtttttggctcct

SEQ ID NO: 8335840 - DNA, 22 bp, Homo sapiens
ctgtccgccgacttggccaggc

SEQ ID NO: 8335841 - DNA, 22 bp, Homo sapiens
ctgtccggtgcccgggcctccc

SEQ ID NO: 8335842 - DNA, 22 bp, Homo sapiens
ctgtccagtcagaacgtcatta

SEQ ID NO: 8335843 - DNA, 22 bp, Homo sapiens
atcatttttaagagactcttct

SEQ ID NO: 8335844 - DNA, 22 bp, Homo sapiens
atccaacaggacaaagaaagga

SEQ ID NO: 8335845 - DNA, 22 bp, Homo sapiens
atcatgttttaattagcaaact

SEQ ID NO: 8335846 - DNA, 22 bp, Homo sapiens
atcatgttgtatgtaatctttt

SEQ ID NO: 8335847 - DNA, 23 bp, Homo sapiens
ctgtggacttccttcattctact

SEQ ID NO: 8335848 - DNA, 22 bp, Homo sapiens
ctgtggaggtaggagcaggaca

SEQ ID NO: 8335849 - DNA, 22 bp, Homo sapiens
ctgtggagtggggagtactggt

SEQ ID NO: 8335850 - DNA, 22 bp, Homo sapiens
atccccaggggcattcaagctt

SEQ ID NO: 8335851 - DNA, 22 bp, Homo sapiens
atccccttatcccaggctgagc

SEQ ID NO: 8335852 - DNA, 22 bp, Homo sapiens
atccccctgtatctggaagaat

SEQ ID NO: 8335853 - DNA, 22 bp, Homo sapiens
atccccttcacaccctctgcat

SEQ ID NO: 8335854 - DNA, 17 bp, Homo sapiens
atccccagcatctagaa

SEQ ID NO: 8335855 - DNA, 22 bp, Homo sapiens
atccacagggtgtgttaagatg

SEQ ID NO: 8335856 - DNA, 22 bp, Homo sapiens
atcctcagcatctagcatgaag

SEQ ID NO: 8335857 - DNA, 22 bp, Homo sapiens
atcctcagtgtttctgacatct

SEQ ID NO: 8335858 - DNA, 22 bp, Homo sapiens
atcctccagctcctgcttctgc

SEQ ID NO: 8335859 - DNA, 23 bp, Homo sapiens
atcctctctccatcccactgtgc

SEQ ID NO: 8335860 - DNA, 22 bp, Homo sapiens
atcctcacatttgggcaggtga

SEQ ID NO: 8335861 - DNA, 20 bp, Homo sapiens
atcctcaccctcagtcctag

SEQ ID NO: 8335862 - DNA, 22 bp, Homo sapiens
atcctcacaacactgcaagatg

SEQ ID NO: 8335863 - DNA, 22 bp, Homo sapiens
atcctcacaataaaatcagcct

SEQ ID NO: 8335864 - DNA, 22 bp, Homo sapiens
atcctcacattctcaggacaac

SEQ ID NO: 8335865 - DNA, 22 bp, Homo sapiens
atcctagaatcagcccttgctg

SEQ ID NO: 8335866 - DNA, 22 bp, Homo sapiens
atccggggttcattttcactga

SEQ ID NO: 8335867 - DNA, 23 bp, Homo sapiens
atcccttctccagtgtggtgagg

SEQ ID NO: 8335868 - DNA, 22 bp, Homo sapiens
cactgcatggatgatggctgta

SEQ ID NO: 8335869 - DNA, 22 bp, Homo sapiens
cactgcatggatgatggctgta

SEQ ID NO: 8335870 - DNA, 20 bp, Homo sapiens
cactggacctctctgagcct

SEQ ID NO: 8335871 - DNA, 21 bp, Homo sapiens
cactggaattttctgtgacat

SEQ ID NO: 8335872 - DNA, 22 bp, Homo sapiens
cactgctttcacagtttgttcc

SEQ ID NO: 8335873 - DNA, 22 bp, Homo sapiens
cactgcctggaaggagagacat

SEQ ID NO: 8335874 - DNA, 22 bp, Homo sapiens
cactgcttttttggctatgtac

SEQ ID NO: 8335875 - DNA, 22 bp, Homo sapiens
cactggaatggatagagcagag

SEQ ID NO: 8335876 - DNA, 22 bp, Homo sapiens
cactggaaccatccacatagtg

SEQ ID NO: 8335877 - DNA, 22 bp, Homo sapiens
cactgcactccatcctgggaaa

SEQ ID NO: 8335878 - DNA, 22 bp, Homo sapiens
ggcctctcatgcccagagccaa

SEQ ID NO: 8335879 - DNA, 22 bp, Homo sapiens
cactgagccttgccagcttggt

SEQ ID NO: 8335880 - DNA, 19 bp, Homo sapiens
cactgagctctgttcacta

SEQ ID NO: 8335881 - DNA, 22 bp, Homo sapiens
cactgaagctttcattctcttg

SEQ ID NO: 8335882 - DNA, 22 bp, Homo sapiens
cactgaaggaaggactactgca

SEQ ID NO: 8335883 - DNA, 22 bp, Homo sapiens
cactgaaggaaggactactgca

SEQ ID NO: 8335884 - DNA, 22 bp, Homo sapiens
cactgaagcctgggagtaagac

SEQ ID NO: 8335885 - DNA, 22 bp, Homo sapiens
cactgaagccactggaagagga

SEQ ID NO: 8335886 - DNA, 22 bp, Homo sapiens
cactgaagccactggaagagga

SEQ ID NO: 8335887 - DNA, 22 bp, Homo sapiens
cactgaagatgcgactagtgct

SEQ ID NO: 8335888 - DNA, 22 bp, Homo sapiens
cactgaagatgcgactagtgct

SEQ ID NO: 8335889 - DNA, 22 bp, Homo sapiens
cactgaatctcaaggggagggt

SEQ ID NO: 8335890 - DNA, 22 bp, Homo sapiens
cactgaaggtaggaccaaggct

SEQ ID NO: 8335891 - DNA, 22 bp, Homo sapiens
cactgaaggctgcagctcagcc

SEQ ID NO: 8335892 - DNA, 22 bp, Homo sapiens
cactgaaggtaggaccaaggct

SEQ ID NO: 8335893 - DNA, 22 bp, Homo sapiens
cactgaaggctaggattagatg

SEQ ID NO: 8335894 - DNA, 22 bp, Homo sapiens
cactgaaggacagtaggaaggg

SEQ ID NO: 8335895 - DNA, 22 bp, Homo sapiens
cactgaaggctgcagctcagcc

SEQ ID NO: 8335896 - DNA, 22 bp, Homo sapiens
cacccaggctggaatgcagtgg

SEQ ID NO: 8335897 - DNA, 22 bp, Homo sapiens
caccccagtctaaaaccagcct

SEQ ID NO: 8335898 - DNA, 22 bp, Homo sapiens
caccctcaagcagtggcacgtg

SEQ ID NO: 8335899 - DNA, 20 bp, Homo sapiens
cactgaagacttcttgctca

SEQ ID NO: 8335900 - DNA, 22 bp, Homo sapiens
caccctggctggaggtgcagtg

SEQ ID NO: 8335901 - DNA, 22 bp, Homo sapiens
caccctggctggaggtgcagtg

SEQ ID NO: 8335902 - DNA, 22 bp, Homo sapiens
caccctggcctcgctctctgca

SEQ ID NO: 8335903 - DNA, 18 bp, Homo sapiens
caccctccgcggctgccc

SEQ ID NO: 8335904 - DNA, 22 bp, Homo sapiens
caccatcagcagcaggtgtcaa

SEQ ID NO: 8335905 - DNA, 22 bp, Homo sapiens
caccaggctggagtgcagtggc

SEQ ID NO: 8335906 - DNA, 22 bp, Homo sapiens
ggcagctgagatcatgctgttg

SEQ ID NO: 8335907 - DNA, 22 bp, Homo sapiens
caccattgttgttactgggaga

SEQ ID NO: 8335908 - DNA, 22 bp, Homo sapiens
caccatttaagaaagccaaatt

SEQ ID NO: 8335909 - DNA, 22 bp, Homo sapiens
cacccagagggcttgctgaaca

SEQ ID NO: 8335910 - DNA, 22 bp, Homo sapiens
cacccagagcagacactgtcca

SEQ ID NO: 8335911 - DNA, 22 bp, Homo sapiens
ggcagagcattcgatggacctg

SEQ ID NO: 8335912 - DNA, 22 bp, Homo sapiens
ggcactgcttcctgagcctgag

SEQ ID NO: 8335913 - DNA, 20 bp, Homo sapiens
ggcacagtttttgcacctgc

SEQ ID NO: 8335914 - DNA, 22 bp, Homo sapiens
ggcacatggagacttggcatca

SEQ ID NO: 8335915 - DNA, 22 bp, Homo sapiens
ggcactgctgtaggcagtgagg

SEQ ID NO: 8335916 - DNA, 22 bp, Homo sapiens
ggcactggaagtcccattgtct

SEQ ID NO: 8335917 - DNA, 22 bp, Homo sapiens
cacagggcaggccccaggcctc

SEQ ID NO: 8335918 - DNA, 22 bp, Homo sapiens
cacagggcagagacctgggtgc

SEQ ID NO: 8335919 - DNA, 22 bp, Homo sapiens
cacagggcagagggtccgtggc

SEQ ID NO: 8335920 - DNA, 22 bp, Homo sapiens
ggcacagggagccgcagttgca

SEQ ID NO: 8335921 - DNA, 22 bp, Homo sapiens
ggcacagggagaggcggatttt

SEQ ID NO: 8335922 - DNA, 22 bp, Homo sapiens
ggcacaggagtcacagcatttc

SEQ ID NO: 8335923 - DNA, 22 bp, Homo sapiens
ggcacagggtgatgttgcagtt

SEQ ID NO: 8335924 - DNA, 22 bp, Homo sapiens
ggcacagggggctgaggactag

SEQ ID NO: 8335925 - DNA, 22 bp, Homo sapiens
ggcacagggaggccctggtgtg

SEQ ID NO: 8335926 - DNA, 16 bp, Homo sapiens
cacagtgctgctgctc

SEQ ID NO: 8335927 - DNA, 22 bp, Homo sapiens
cacagtggaaacagctaagcct

SEQ ID NO: 8335928 - DNA, 22 bp, Homo sapiens
cacagtggaaacagctaagcct

SEQ ID NO: 8335929 - DNA, 22 bp, Homo sapiens
ggcagatggaagaggctgggtc

SEQ ID NO: 8335930 - DNA, 22 bp, Homo sapiens
ggcagatggaaggacagacgga

SEQ ID NO: 8335931 - DNA, 22 bp, Homo sapiens
ggcagcagttacaaatgtgcag

SEQ ID NO: 8335932 - DNA, 22 bp, Homo sapiens
ggcagcagttacaaatgtgcag

SEQ ID NO: 8335933 - DNA, 22 bp, Homo sapiens
cacagtgtgactgaccttcagc

SEQ ID NO: 8335934 - DNA, 22 bp, Homo sapiens
cacagtgtctgtgcttcagtgt

SEQ ID NO: 8335935 - DNA, 22 bp, Homo sapiens
cacagtgtggcaaatttcaact

SEQ ID NO: 8335936 - DNA, 22 bp, Homo sapiens
cacagtgtagttaatgtgacat

SEQ ID NO: 8335937 - DNA, 22 bp, Homo sapiens
ggatgggcagacaggacggcac

SEQ ID NO: 8335938 - DNA, 22 bp, Homo sapiens
ggatgggcccgggacggcgctg

SEQ ID NO: 8335939 - DNA, 22 bp, Homo sapiens
ggatgggcagacaggacggcac

SEQ ID NO: 8335940 - DNA, 22 bp, Homo sapiens
cacagggaggacatcaacagtg

SEQ ID NO: 8335941 - DNA, 22 bp, Homo sapiens
cacagggaggcagccatgctcc

SEQ ID NO: 8335942 - DNA, 22 bp, Homo sapiens
cacagggaggcagccatgctcc

SEQ ID NO: 8335943 - DNA, 19 bp, Homo sapiens
cacagggagaccacatgtc

SEQ ID NO: 8335944 - DNA, 23 bp, Homo sapiens
cacagggagggaaactctttcag

SEQ ID NO: 8335945 - DNA, 23 bp, Homo sapiens
ggatgggcaagcctagtgcctac

SEQ ID NO: 8335946 - DNA, 23 bp, Homo sapiens
ggatgggcaagcctagtgcctac

SEQ ID NO: 8335947 - DNA, 22 bp, Homo sapiens
ggatccttaactatcacagtga

SEQ ID NO: 8335948 - DNA, 22 bp, Homo sapiens
ggatccttctttgacctcacag

SEQ ID NO: 8335949 - DNA, 22 bp, Homo sapiens
ggaggcggaggctgcagtgagc

SEQ ID NO: 8335950 - DNA, 22 bp, Homo sapiens
ggaggcggaggctgcagtgagc

SEQ ID NO: 8335951 - DNA, 22 bp, Homo sapiens
ggaggcgcggctcggctgtgcc

SEQ ID NO: 8335952 - DNA, 20 bp, Homo sapiens
ggaggcgctgggctcgcgct

SEQ ID NO: 8335953 - DNA, 22 bp, Homo sapiens
ggaggcggaagttgcagtgagc

SEQ ID NO: 8335954 - DNA, 22 bp, Homo sapiens
ggaggcggaagttgcagtgagc

SEQ ID NO: 8335955 - DNA, 22 bp, Homo sapiens
ggaggcggagcttgcagtgagc

SEQ ID NO: 8335956 - DNA, 22 bp, Homo sapiens
ggaggcggagcttgcagtgagc

SEQ ID NO: 8335957 - DNA, 22 bp, Homo sapiens
ggaggcggacacaggtagtgtt

SEQ ID NO: 8335958 - DNA, 22 bp, Homo sapiens
ggaggcggacacaggtagtgtt

SEQ ID NO: 8335959 - DNA, 22 bp, Homo sapiens
cacagcttctccttgatatcgc

SEQ ID NO: 8335960 - DNA, 22 bp, Homo sapiens
cacagctgtgagaagggagcct

SEQ ID NO: 8335961 - DNA, 22 bp, Homo sapiens
cacagctgtatccaggagatcc

SEQ ID NO: 8335962 - DNA, 22 bp, Homo sapiens
cacagctgttttctccaggcag

SEQ ID NO: 8335963 - DNA, 22 bp, Homo sapiens
cacagctggtgacagagcccag

SEQ ID NO: 8335964 - DNA, 22 bp, Homo sapiens
cacagctggtgcactagctctg

SEQ ID NO: 8335965 - DNA, 22 bp, Homo sapiens
cacagctgaagtagccatgtgg

SEQ ID NO: 8335966 - DNA, 22 bp, Homo sapiens
cacagctgaagtagccatgtgg

SEQ ID NO: 8335967 - DNA, 22 bp, Homo sapiens
cacactagtctatccattagct

SEQ ID NO: 8335968 - DNA, 22 bp, Homo sapiens
gctgtggccgggcccaggccgc

SEQ ID NO: 8335969 - DNA, 22 bp, Homo sapiens
gctgtggcctccagcactcccc

SEQ ID NO: 8335970 - DNA, 22 bp, Homo sapiens
gctgtggcctggcgcagagctg

SEQ ID NO: 8335971 - DNA, 22 bp, Homo sapiens
gcttctcctcccgctcccaggc

SEQ ID NO: 8335972 - DNA, 22 bp, Homo sapiens
gcttctcctcccgctcccaggc

SEQ ID NO: 8335973 - DNA, 22 bp, Homo sapiens
caaggcaatctcatggcttctt

SEQ ID NO: 8335974 - DNA, 22 bp, Homo sapiens
gctgtaatattcattctatgaa

SEQ ID NO: 8335975 - DNA, 22 bp, Homo sapiens
caaggcagctattgtctccata

SEQ ID NO: 8335976 - DNA, 22 bp, Homo sapiens
gctgtgctgtttccacctctct

SEQ ID NO: 8335977 - DNA, 22 bp, Homo sapiens
cacacatcaacctagacattgt

SEQ ID NO: 8335978 - DNA, 22 bp, Homo sapiens
cacaattgtatcagaaaatagt

SEQ ID NO: 8335979 - DNA, 22 bp, Homo sapiens
cacaattattatctctttctac

SEQ ID NO: 8335980 - DNA, 22 bp, Homo sapiens
cacacctgtaatcctagcactt

SEQ ID NO: 8335981 - DNA, 22 bp, Homo sapiens
cacacctgcctgccgtgtgctg

SEQ ID NO: 8335982 - DNA, 22 bp, Homo sapiens
cacaccctcgtgctccctcccg

SEQ ID NO: 8335983 - DNA, 22 bp, Homo sapiens
cacacccaaatttctctctcag

SEQ ID NO: 8335984 - DNA, 22 bp, Homo sapiens
cacaatgcgtacatatatcaaa

SEQ ID NO: 8335985 - DNA, 22 bp, Homo sapiens
cacaattacttttgcaccaaca

SEQ ID NO: 8335986 - DNA, 22 bp, Homo sapiens
cacaattagcagctctttattt

SEQ ID NO: 8335987 - DNA, 22 bp, Homo sapiens
ggaaaatactgattcatgccat

SEQ ID NO: 8335988 - DNA, 22 bp, Homo sapiens
ggaaaaggccacagggacacat

SEQ ID NO: 8335989 - DNA, 22 bp, Homo sapiens
ggaaaaggccattgtttctctg

SEQ ID NO: 8335990 - DNA, 18 bp, Homo sapiens
ggaaaaggagtgtctagc

SEQ ID NO: 8335991 - DNA, 17 bp, Homo sapiens
ggaaaaggatgatacag

SEQ ID NO: 8335992 - DNA, 23 bp, Homo sapiens
cacaaaggttccattctctcacc

SEQ ID NO: 8335993 - DNA, 17 bp, Homo sapiens
ggaaaagaagagtagga

SEQ ID NO: 8335994 - DNA, 22 bp, Homo sapiens
ggaaaagaaagggactgattgg

SEQ ID NO: 8335995 - DNA, 22 bp, Homo sapiens
ggaaaagaattgcagtgaagta

SEQ ID NO: 8335996 - DNA, 22 bp, Homo sapiens
caacagtatagcttttgactgc

SEQ ID NO: 8335997 - DNA, 22 bp, Homo sapiens
caacagtatagcttttgactgc

SEQ ID NO: 8335998 - DNA, 19 bp, Homo sapiens
caacagtactggtttgtcc

SEQ ID NO: 8335999 - DNA, 23 bp, Homo sapiens
gctgccacagggctcaggcaggt

SEQ ID NO: 8336000 - DNA, 22 bp, Homo sapiens
gctgcagccctgcggatcactt

SEQ ID NO: 8336001 - DNA, 22 bp, Homo sapiens
caacatttgagtaaagaaatgg

SEQ ID NO: 8336002 - DNA, 22 bp, Homo sapiens
caacatttcaaggtctttagga

SEQ ID NO: 8336003 - DNA, 22 bp, Homo sapiens
caacattttcatggccagggag

SEQ ID NO: 8336004 - DNA, 22 bp, Homo sapiens
caacatttgtgatgagcaaact

SEQ ID NO: 8336005 - DNA, 22 bp, Homo sapiens
caacatttgtgatgagcaaact

SEQ ID NO: 8336006 - DNA, 22 bp, Homo sapiens
caacattcttatcactataagc

SEQ ID NO: 8336007 - DNA, 22 bp, Homo sapiens
caacattcaaccaacatttatg

SEQ ID NO: 8336008 - DNA, 22 bp, Homo sapiens
caacatctttgtgtatgtgaga

SEQ ID NO: 8336009 - DNA, 20 bp, Homo sapiens
caacatgagcaagtgaactg

SEQ ID NO: 8336010 - DNA, 22 bp, Homo sapiens
caacagtttatagtgttatctt

SEQ ID NO: 8336011 - DNA, 22 bp, Homo sapiens
caacagttctcatagcagattc

SEQ ID NO: 8336012 - DNA, 22 bp, Homo sapiens
caacagttctcatagcagattc

SEQ ID NO: 8336013 - DNA, 22 bp, Homo sapiens
caacatatgattttgtatataa

SEQ ID NO: 8336014 - DNA, 22 bp, Homo sapiens
caaagtaatatggtcccagtga

SEQ ID NO: 8336015 - DNA, 22 bp, Homo sapiens
gctcctgcaggacccaggagac

SEQ ID NO: 8336016 - DNA, 22 bp, Homo sapiens
gctcctgcagagatgttccatg

SEQ ID NO: 8336017 - DNA, 22 bp, Homo sapiens
caagatgaaattgtgatatttt

SEQ ID NO: 8336018 - DNA, 22 bp, Homo sapiens
caagatgaagtgaagattagaa

SEQ ID NO: 8336019 - DNA, 22 bp, Homo sapiens
caagatgaatgatgaagtgtgt

SEQ ID NO: 8336020 - DNA, 22 bp, Homo sapiens
caagatcacacaggtaacaagt

SEQ ID NO: 8336021 - DNA, 22 bp, Homo sapiens
caagataatttattctgagttt

SEQ ID NO: 8336022 - DNA, 22 bp, Homo sapiens
caagatgatccctgaaggcagc

SEQ ID NO: 8336023 - DNA, 22 bp, Homo sapiens
caagctgcttattctctgctct

SEQ ID NO: 8336024 - DNA, 22 bp, Homo sapiens
caaggaggaagatgcaggggac

SEQ ID NO: 8336025 - DNA, 22 bp, Homo sapiens
caaggagataaaatgttgagct

SEQ ID NO: 8336026 - DNA, 22 bp, Homo sapiens
caaggagagtaattgaatgaga

SEQ ID NO: 8336027 - DNA, 22 bp, Homo sapiens
caaggagaaaacggcttctgaa

SEQ ID NO: 8336028 - DNA, 22 bp, Homo sapiens
caactacaggaaaagtcattca

SEQ ID NO: 8336029 - DNA, 22 bp, Homo sapiens
caacctatgggggaaggacttt

SEQ ID NO: 8336030 - DNA, 22 bp, Homo sapiens
caaccccactacacgttggaga

SEQ ID NO: 8336031 - DNA, 22 bp, Homo sapiens
caacctctatcggtcaggaagc

SEQ ID NO: 8336032 - DNA, 22 bp, Homo sapiens
gggaaagagaggtggacgcagg

SEQ ID NO: 8336033 - DNA, 22 bp, Homo sapiens
gggaaagagaggtggacgcagg

SEQ ID NO: 8336034 - DNA, 22 bp, Homo sapiens
gggacagagcaacttgggatgg

SEQ ID NO: 8336035 - DNA, 22 bp, Homo sapiens
gggacagacccatgggccaggt

SEQ ID NO: 8336036 - DNA, 22 bp, Homo sapiens
gggacagaggcaaactagcaga

SEQ ID NO: 8336037 - DNA, 22 bp, Homo sapiens
gggacagaaggaagtgagcaca

SEQ ID NO: 8336038 - DNA, 21 bp, Homo sapiens
gggacaccaactccagggctt

SEQ ID NO: 8336039 - DNA, 19 bp, Homo sapiens
gggacaccagaagaacaag

SEQ ID NO: 8336040 - DNA, 22 bp, Homo sapiens
gggactggcacagggctgggag

SEQ ID NO: 8336041 - DNA, 22 bp, Homo sapiens
gggactctgagagcctgagggt

SEQ ID NO: 8336042 - DNA, 22 bp, Homo sapiens
gggaaggacattctgggctcag

SEQ ID NO: 8336043 - DNA, 22 bp, Homo sapiens
gggacacagagaaactggagaa

SEQ ID NO: 8336044 - DNA, 18 bp, Homo sapiens
gggaagccgggaagccgg

SEQ ID NO: 8336045 - DNA, 22 bp, Homo sapiens
gggaaggaaagttattagcaga

SEQ ID NO: 8336046 - DNA, 22 bp, Homo sapiens
gggagcacatctgagcacccgg

SEQ ID NO: 8336047 - DNA, 22 bp, Homo sapiens
gggagcaggagcctgcctgcca

SEQ ID NO: 8336048 - DNA, 22 bp, Homo sapiens
gggagcaggacataatagcaat

SEQ ID NO: 8336049 - DNA, 19 bp, Homo sapiens
gggagcaggaaagctgtgg

SEQ ID NO: 8336050 - DNA, 22 bp, Homo sapiens
gggagcagcctgcctcccacct

SEQ ID NO: 8336051 - DNA, 22 bp, Homo sapiens
gggagcactaaggcagtcgctt

SEQ ID NO: 8336052 - DNA, 22 bp, Homo sapiens
cagacagaaggctccttgaggt

SEQ ID NO: 8336053 - DNA, 22 bp, Homo sapiens
gggaggggttgcatgtttgagt

SEQ ID NO: 8336054 - DNA, 22 bp, Homo sapiens
gggagggccagtgctctctaga

SEQ ID NO: 8336055 - DNA, 22 bp, Homo sapiens
gggagggccaggctcacccagg

SEQ ID NO: 8336056 - DNA, 20 bp, Homo sapiens
gggaggcattggtccctcac

SEQ ID NO: 8336057 - DNA, 22 bp, Homo sapiens
gggaggggttgcatgtttgagt

SEQ ID NO: 8336058 - DNA, 22 bp, Homo sapiens
gggagggtctgagagctgcacc

SEQ ID NO: 8336059 - DNA, 22 bp, Homo sapiens
gggagggtctgccatgctccct

SEQ ID NO: 8336060 - DNA, 22 bp, Homo sapiens
gggagggtctgccatgctccct

SEQ ID NO: 8336061 - DNA, 22 bp, Homo sapiens
gggagggtgttctcccaagaac

SEQ ID NO: 8336062 - DNA, 22 bp, Homo sapiens
gggagggtgttctcccaagaac

SEQ ID NO: 8336063 - DNA, 22 bp, Homo sapiens
gggaggtcctaaaggggaccag

SEQ ID NO: 8336064 - DNA, 22 bp, Homo sapiens
gggaggtcagggtgcctgctgg

SEQ ID NO: 8336065 - DNA, 22 bp, Homo sapiens
gggaggtgaaaggtcatgtgtg

SEQ ID NO: 8336066 - DNA, 22 bp, Homo sapiens
gggcacaccttgtctgagcaca

SEQ ID NO: 8336067 - DNA, 20 bp, Homo sapiens
gggcaaggaaacagccccca

SEQ ID NO: 8336068 - DNA, 22 bp, Homo sapiens
gggcaagcagtgaggacagcac

SEQ ID NO: 8336069 - DNA, 22 bp, Homo sapiens
cagaggcctggcttggacacct

SEQ ID NO: 8336070 - DNA, 22 bp, Homo sapiens
gggtgctcatggataaggcgaa

SEQ ID NO: 8336071 - DNA, 22 bp, Homo sapiens
gggtgcggtccccacagcccgt

SEQ ID NO: 8336072 - DNA, 22 bp, Homo sapiens
gggtgctcctggcggcctcttt

SEQ ID NO: 8336073 - DNA, 22 bp, Homo sapiens
gggtgctgaggaagacagcagg

SEQ ID NO: 8336074 - DNA, 23 bp, Homo sapiens
gggtgctgcctgtagtcatgctg

SEQ ID NO: 8336075 - DNA, 22 bp, Homo sapiens
gggtgctgactggggcctgaaa

SEQ ID NO: 8336076 - DNA, 22 bp, Homo sapiens
gggtgctcttgggaaacgtagt

SEQ ID NO: 8336077 - DNA, 22 bp, Homo sapiens
cagaggtgttggtgaatggaga

SEQ ID NO: 8336078 - DNA, 22 bp, Homo sapiens
cagaggctgtgtaggcagactg

SEQ ID NO: 8336079 - DNA, 22 bp, Homo sapiens
cagaggctgggacctcaggcat

SEQ ID NO: 8336080 - DNA, 22 bp, Homo sapiens
cagaggccaggctgcctgactg

SEQ ID NO: 8336081 - DNA, 22 bp, Homo sapiens
cagaggccagggggctcacaaa

SEQ ID NO: 8336082 - DNA, 22 bp, Homo sapiens
cagaggccagtggacaagggcc

SEQ ID NO: 8336083 - DNA, 22 bp, Homo sapiens
cagaggccatatttcttcactc

SEQ ID NO: 8336084 - DNA, 22 bp, Homo sapiens
cagaggccccagaactagctct

SEQ ID NO: 8336085 - DNA, 21 bp, Homo sapiens
cagaggcctatcacagactcc

SEQ ID NO: 8336086 - DNA, 22 bp, Homo sapiens
cagaggcctggcttggacacct

SEQ ID NO: 8336087 - DNA, 21 bp, Homo sapiens
cagaggcctcatgctctgtgc

SEQ ID NO: 8336088 - DNA, 22 bp, Homo sapiens
cagaggcctcacttccagccag

SEQ ID NO: 8336089 - DNA, 20 bp, Homo sapiens
ggggaagaaaaggatgtgat

SEQ ID NO: 8336090 - DNA, 22 bp, Homo sapiens
cagaggccacctgtggccactg

SEQ ID NO: 8336091 - DNA, 22 bp, Homo sapiens
cagagctgtatttatctttcca

SEQ ID NO: 8336092 - DNA, 22 bp, Homo sapiens
gggctgtgtactatgaggaggg

SEQ ID NO: 8336093 - DNA, 22 bp, Homo sapiens
cagagctgctcatggtggccag

SEQ ID NO: 8336094 - DNA, 22 bp, Homo sapiens
cagagctgcgctttttcctggt

SEQ ID NO: 8336095 - DNA, 22 bp, Homo sapiens
cagagctgcagattgaaggcat

SEQ ID NO: 8336096 - DNA, 22 bp, Homo sapiens
cagagctgagtcttcaaggttg

SEQ ID NO: 8336097 - DNA, 22 bp, Homo sapiens
cagagctgattggatccagaga

SEQ ID NO: 8336098 - DNA, 22 bp, Homo sapiens
cagagctgcagattgaaggcat

SEQ ID NO: 8336099 - DNA, 22 bp, Homo sapiens
cagagctgcagattgaaggcat

SEQ ID NO: 8336100 - DNA, 22 bp, Homo sapiens
cagagctgcaaatgcccctccg

SEQ ID NO: 8336101 - DNA, 22 bp, Homo sapiens
gggcgcagccaatcctggccct

SEQ ID NO: 8336102 - DNA, 22 bp, Homo sapiens
gggcgccgtgggaaacagccgg

SEQ ID NO: 8336103 - DNA, 22 bp, Homo sapiens
cagagctgacccaaggattgaa

SEQ ID NO: 8336104 - DNA, 21 bp, Homo sapiens
cagagctctttctgcttgctg

SEQ ID NO: 8336105 - DNA, 22 bp, Homo sapiens
gggcgagggcgaaagcgagagc

SEQ ID NO: 8336106 - DNA, 21 bp, Homo sapiens
gggcgaggcctgatgtggctc

SEQ ID NO: 8336107 - DNA, 22 bp, Homo sapiens
gggcgaggactgactctgggca

SEQ ID NO: 8336108 - DNA, 21 bp, Homo sapiens
gggcgaggcctgatgtggctc

SEQ ID NO: 8336109 - DNA, 22 bp, Homo sapiens
gggcgaggactgactctgggca

SEQ ID NO: 8336110 - DNA, 22 bp, Homo sapiens
gggccttctagttagccccaat

SEQ ID NO: 8336111 - DNA, 22 bp, Homo sapiens
gggccttccgactcccaaggcc

SEQ ID NO: 8336112 - DNA, 22 bp, Homo sapiens
gggccttcagccttggactgag

SEQ ID NO: 8336113 - DNA, 22 bp, Homo sapiens
gggcagagaaatggacagttgg

SEQ ID NO: 8336114 - DNA, 22 bp, Homo sapiens
cagagcccatggcacatgtgga

SEQ ID NO: 8336115 - DNA, 22 bp, Homo sapiens
gggcacagaagtctaagacatc

SEQ ID NO: 8336116 - DNA, 22 bp, Homo sapiens
gggcactgtgctaggtgctgag

SEQ ID NO: 8336117 - DNA, 22 bp, Homo sapiens
ggttgctctttggaccctgctg

SEQ ID NO: 8336118 - DNA, 22 bp, Homo sapiens
ggttggacactaggtaggagcg

SEQ ID NO: 8336119 - DNA, 22 bp, Homo sapiens
ggttcctgtgcccatgtcatgg

SEQ ID NO: 8336120 - DNA, 22 bp, Homo sapiens
cagcaataatgtctacaaatct

SEQ ID NO: 8336121 - DNA, 22 bp, Homo sapiens
cagcaataaggtaagcttctcc

SEQ ID NO: 8336122 - DNA, 19 bp, Homo sapiens
cagcaataatgccagatgg

SEQ ID NO: 8336123 - DNA, 22 bp, Homo sapiens
cagcaataatgtctacaaatct

SEQ ID NO: 8336124 - DNA, 22 bp, Homo sapiens
cagcaataagccaggttagaca

SEQ ID NO: 8336125 - DNA, 22 bp, Homo sapiens
cagcaataactcaaagccattt

SEQ ID NO: 8336126 - DNA, 23 bp, Homo sapiens
cagcaagtgaattccaagagaga

SEQ ID NO: 8336127 - DNA, 22 bp, Homo sapiens
cagcaagtcagtgagtagaaga

SEQ ID NO: 8336128 - DNA, 22 bp, Homo sapiens
cagcaatagtgtgtttgtttca

SEQ ID NO: 8336129 - DNA, 22 bp, Homo sapiens
cagcaatatacacagtctatgg

SEQ ID NO: 8336130 - DNA, 22 bp, Homo sapiens
ggtgggtcttgtggggcagctt

SEQ ID NO: 8336131 - DNA, 22 bp, Homo sapiens
ggtgggtcttgcggggcagctt

SEQ ID NO: 8336132 - DNA, 22 bp, Homo sapiens
ggtggggctgcaagcagttcgg

SEQ ID NO: 8336133 - DNA, 22 bp, Homo sapiens
ggtgggagagctctgtctccag

SEQ ID NO: 8336134 - DNA, 22 bp, Homo sapiens
ggtggggctaggacctcaggat

SEQ ID NO: 8336135 - DNA, 22 bp, Homo sapiens
gggtgggagtctggccctcaaa

SEQ ID NO: 8336136 - DNA, 22 bp, Homo sapiens
ggtgggacaggtaggagtggct

SEQ ID NO: 8336137 - DNA, 21 bp, Homo sapiens
gggtgggaggacacagcaggc

SEQ ID NO: 8336138 - DNA, 20 bp, Homo sapiens
gggtgggagagtctgagggt

SEQ ID NO: 8336139 - DNA, 22 bp, Homo sapiens
cagagtacataggagcaaatca

SEQ ID NO: 8336140 - DNA, 19 bp, Homo sapiens
cagagtacaccagatagga

SEQ ID NO: 8336141 - DNA, 22 bp, Homo sapiens
cagagtactgggagaacagaag

SEQ ID NO: 8336142 - DNA, 22 bp, Homo sapiens
gggtgggactctttggcctgag

SEQ ID NO: 8336143 - DNA, 22 bp, Homo sapiens
cagcagcaacaatagcggtcac

SEQ ID NO: 8336144 - DNA, 22 bp, Homo sapiens
cagcagatcaatgtagaatatt

SEQ ID NO: 8336145 - DNA, 22 bp, Homo sapiens
cagcagatcaatgtagaatatt

SEQ ID NO: 8336146 - DNA, 22 bp, Homo sapiens
cagcagcaaggtgagggtggag

SEQ ID NO: 8336147 - DNA, 22 bp, Homo sapiens
gtatattttgatcaccctctat

SEQ ID NO: 8336148 - DNA, 22 bp, Homo sapiens
gtatctatgatcctttatatct

SEQ ID NO: 8336149 - DNA, 22 bp, Homo sapiens
gtatctttatccctcgttggag

SEQ ID NO: 8336150 - DNA, 22 bp, Homo sapiens
gtatctttccacatcttcagta

SEQ ID NO: 8336151 - DNA, 22 bp, Homo sapiens
gtatgaaaattgtaaagttctt

SEQ ID NO: 8336152 - DNA, 22 bp, Homo sapiens
gtatgaaagcatcattcctgct

SEQ ID NO: 8336153 - DNA, 22 bp, Homo sapiens
gtatctttgtcttcatgttgga

SEQ ID NO: 8336154 - DNA, 22 bp, Homo sapiens
cagcaggaccattgaggcatca

SEQ ID NO: 8336155 - DNA, 22 bp, Homo sapiens
cagcagctacttggagcagcag

SEQ ID NO: 8336156 - DNA, 22 bp, Homo sapiens
cagcagcctggagggggccacg

SEQ ID NO: 8336157 - DNA, 22 bp, Homo sapiens
cagcagcctgccttgggagctt

SEQ ID NO: 8336158 - DNA, 22 bp, Homo sapiens
cagcaggcaggtgggccaagtc

SEQ ID NO: 8336159 - DNA, 22 bp, Homo sapiens
cagcaggattggatacatctca

SEQ ID NO: 8336160 - DNA, 22 bp, Homo sapiens
cagcaggcccaggtgctggtga

SEQ ID NO: 8336161 - DNA, 22 bp, Homo sapiens
cagcattttccatagaaagaag

SEQ ID NO: 8336162 - DNA, 22 bp, Homo sapiens
cagcatttagaatttgaagtgt

SEQ ID NO: 8336163 - DNA, 22 bp, Homo sapiens
cagcattgggttacctttgttt

SEQ ID NO: 8336164 - DNA, 22 bp, Homo sapiens
gtattttactgctcaaagctct

SEQ ID NO: 8336165 - DNA, 22 bp, Homo sapiens
gtatttgtagtagcatagaatt

SEQ ID NO: 8336166 - DNA, 22 bp, Homo sapiens
gtatttgtagtagcatagaatt

SEQ ID NO: 8336167 - DNA, 17 bp, Homo sapiens
cagccagtcccttcatt

SEQ ID NO: 8336168 - DNA, 22 bp, Homo sapiens
cagcccagagccagttcccgct

SEQ ID NO: 8336169 - DNA, 22 bp, Homo sapiens
cagccactggtgccaggctgtt

SEQ ID NO: 8336170 - DNA, 22 bp, Homo sapiens
cagccacgtagcccttggccgt

SEQ ID NO: 8336171 - DNA, 22 bp, Homo sapiens
cagccacagctgggtgcctgac

SEQ ID NO: 8336172 - DNA, 22 bp, Homo sapiens
cagccaagaaagcagtgctcca

SEQ ID NO: 8336173 - DNA, 22 bp, Homo sapiens
gagagctgtgttcattctacca

SEQ ID NO: 8336174 - DNA, 22 bp, Homo sapiens
atggcagttgtatgggctgtat

SEQ ID NO: 8336175 - DNA, 22 bp, Homo sapiens
gagagctgtccggctgagcagc

SEQ ID NO: 8336176 - DNA, 22 bp, Homo sapiens
atggcagtgtttcagtttttgg

SEQ ID NO: 8336177 - DNA, 22 bp, Homo sapiens
gagaacagagataattttactt

SEQ ID NO: 8336178 - DNA, 23 bp, Homo sapiens
gagaacagccacagagagctgtg

SEQ ID NO: 8336179 - DNA, 22 bp, Homo sapiens
gagaacagatttttctgctgtc

SEQ ID NO: 8336180 - DNA, 22 bp, Homo sapiens
gagccagccttcttctgaggtc

SEQ ID NO: 8336181 - DNA, 22 bp, Homo sapiens
atggccctggcccagaccccac

SEQ ID NO: 8336182 - DNA, 22 bp, Homo sapiens
atggccctgccaggaggaacaa

SEQ ID NO: 8336183 - DNA, 22 bp, Homo sapiens
gagccaggcaccttctgtgttg

SEQ ID NO: 8336184 - DNA, 22 bp, Homo sapiens
gagccaggcccgtacttgctgt

SEQ ID NO: 8336185 - DNA, 22 bp, Homo sapiens
gagccagggagggtctggtata

SEQ ID NO: 8336186 - DNA, 22 bp, Homo sapiens
gagccagctgagctgcactgtc

SEQ ID NO: 8336187 - DNA, 22 bp, Homo sapiens
gagccagctgagctgcactgtc

SEQ ID NO: 8336188 - DNA, 22 bp, Homo sapiens
gagccagcgccttgcctctggg

SEQ ID NO: 8336189 - DNA, 22 bp, Homo sapiens
gagccagctacatggtctgcaa

SEQ ID NO: 8336190 - DNA, 22 bp, Homo sapiens
gagccaggagatacctaagggg

SEQ ID NO: 8336191 - DNA, 22 bp, Homo sapiens
gagccaggaggcagagactgca

SEQ ID NO: 8336192 - DNA, 22 bp, Homo sapiens
atggaaatggagggtgctagaa

SEQ ID NO: 8336193 - DNA, 22 bp, Homo sapiens
atggaaatgttccatatattga

SEQ ID NO: 8336194 - DNA, 22 bp, Homo sapiens
atggaaatgttccatatattga

SEQ ID NO: 8336195 - DNA, 22 bp, Homo sapiens
atggaaattaagatttgtctca

SEQ ID NO: 8336196 - DNA, 22 bp, Homo sapiens
atggaaattaagatttgtctca

SEQ ID NO: 8336197 - DNA, 22 bp, Homo sapiens
atggaaattaagatttgtctca

SEQ ID NO: 8336198 - DNA, 22 bp, Homo sapiens
atgccactgcgctctagcctgg

SEQ ID NO: 8336199 - DNA, 22 bp, Homo sapiens
atggaaatggagggtgctagaa

SEQ ID NO: 8336200 - DNA, 22 bp, Homo sapiens
atggaaatgatggaacattaaa

SEQ ID NO: 8336201 - DNA, 22 bp, Homo sapiens
atgccactgcacttcagcttgg

SEQ ID NO: 8336202 - DNA, 22 bp, Homo sapiens
atgccactgcgctccagcctgg

SEQ ID NO: 8336203 - DNA, 22 bp, Homo sapiens
gacagaggtgtccttgagtcca

SEQ ID NO: 8336204 - DNA, 22 bp, Homo sapiens
gacagaggctggagcacctcct

SEQ ID NO: 8336205 - DNA, 22 bp, Homo sapiens
gacagagttgttgatgtatgct

SEQ ID NO: 8336206 - DNA, 22 bp, Homo sapiens
gagaaatgctagcttaggaatc

SEQ ID NO: 8336207 - DNA, 22 bp, Homo sapiens
gagaaatgagtgattcactttt

SEQ ID NO: 8336208 - DNA, 22 bp, Homo sapiens
gagaaatgagtgattcactttt

SEQ ID NO: 8336209 - DNA, 22 bp, Homo sapiens
gagaaatatggctcagttccac

SEQ ID NO: 8336210 - DNA, 20 bp, Homo sapiens
atggaggaagggcaagagaa

SEQ ID NO: 8336211 - DNA, 22 bp, Homo sapiens
atggaagacagataaggcagaa

SEQ ID NO: 8336212 - DNA, 22 bp, Homo sapiens
atggaagactaacagaaacatg

SEQ ID NO: 8336213 - DNA, 22 bp, Homo sapiens
atggacagtgtgtctgtttcca

SEQ ID NO: 8336214 - DNA, 22 bp, Homo sapiens
gagctgggcctgcgagtgctgc

SEQ ID NO: 8336215 - DNA, 22 bp, Homo sapiens
gagctgggcctgcgagtgctgc

SEQ ID NO: 8336216 - DNA, 22 bp, Homo sapiens
gagctgggcctgcgagtgctgc

SEQ ID NO: 8336217 - DNA, 22 bp, Homo sapiens
gagctgggcctcagaacacagt

SEQ ID NO: 8336218 - DNA, 21 bp, Homo sapiens
gagctgggcgaggctccgggg

SEQ ID NO: 8336219 - DNA, 21 bp, Homo sapiens
gagctgggcgaggctccgggg

SEQ ID NO: 8336220 - DNA, 22 bp, Homo sapiens
atgtacatctttataacaagct

SEQ ID NO: 8336221 - DNA, 22 bp, Homo sapiens
gagctgggctggcttcctccct

SEQ ID NO: 8336222 - DNA, 22 bp, Homo sapiens
atggtattgcaacaactgtcat

SEQ ID NO: 8336223 - DNA, 22 bp, Homo sapiens
atggtattcctttatgtagaag

SEQ ID NO: 8336224 - DNA, 22 bp, Homo sapiens
atggtacaatgtgtgtatcttt

SEQ ID NO: 8336225 - DNA, 22 bp, Homo sapiens
atggtacaaaatgtataaagtc

SEQ ID NO: 8336226 - DNA, 22 bp, Homo sapiens
atggtacagtgcactgaatgga

SEQ ID NO: 8336227 - DNA, 22 bp, Homo sapiens
atggggctctgcggctgctccc

SEQ ID NO: 8336228 - DNA, 22 bp, Homo sapiens
atggggctgaaacatggaagag

SEQ ID NO: 8336229 - DNA, 22 bp, Homo sapiens
atggggctgggattctcctcgg

SEQ ID NO: 8336230 - DNA, 22 bp, Homo sapiens
atgggttcaagtgattctcctg

SEQ ID NO: 8336231 - DNA, 22 bp, Homo sapiens
atggggctctgcggctgctccc

SEQ ID NO: 8336232 - DNA, 22 bp, Homo sapiens
gaggccaggggcctggagatga

SEQ ID NO: 8336233 - DNA, 22 bp, Homo sapiens
gaggccaggggcctggagatga

SEQ ID NO: 8336234 - DNA, 22 bp, Homo sapiens
gaggccagggatgcaatgagag

SEQ ID NO: 8336235 - DNA, 22 bp, Homo sapiens
gaggccaccctatgggtcccag

SEQ ID NO: 8336236 - DNA, 23 bp, Homo sapiens
gaggccacattcccctgcttgag

SEQ ID NO: 8336237 - DNA, 22 bp, Homo sapiens
atgtacatttgtagtaatatca

SEQ ID NO: 8336238 - DNA, 22 bp, Homo sapiens
atgtacattttcctaatgtttt

SEQ ID NO: 8336239 - DNA, 18 bp, Homo sapiens
atgtacatttgctaaagc

SEQ ID NO: 8336240 - DNA, 22 bp, Homo sapiens
atgtacatttagatcatttctg

SEQ ID NO: 8336241 - DNA, 22 bp, Homo sapiens
atgtacattctaagtatgtgta

SEQ ID NO: 8336242 - DNA, 18 bp, Homo sapiens
atgtacatgtactcacac

SEQ ID NO: 8336243 - DNA, 22 bp, Homo sapiens
atgtacatgtttaagtgaagga

SEQ ID NO: 8336244 - DNA, 22 bp, Homo sapiens
atgtacattattcgagtgatgg

SEQ ID NO: 8336245 - DNA, 22 bp, Homo sapiens
atgtagaaagttattttactct

SEQ ID NO: 8336246 - DNA, 22 bp, Homo sapiens
atgtagaaagttattgtcactg

SEQ ID NO: 8336247 - DNA, 22 bp, Homo sapiens
gaggagctctgctccatccttc

SEQ ID NO: 8336248 - DNA, 22 bp, Homo sapiens
atgtgtcaattttcaaatgctt

SEQ ID NO: 8336249 - DNA, 22 bp, Homo sapiens
gaggcctggctgggaggaggtg

SEQ ID NO: 8336250 - DNA, 22 bp, Homo sapiens
gaggcctggctgggaggaggtg

SEQ ID NO: 8336251 - DNA, 22 bp, Homo sapiens
gaggcctgggttacctactcgt

SEQ ID NO: 8336252 - DNA, 22 bp, Homo sapiens
atgtctttattaatatcatgcc

SEQ ID NO: 8336253 - DNA, 22 bp, Homo sapiens
atgtcttttatggagatgtcat

SEQ ID NO: 8336254 - DNA, 22 bp, Homo sapiens
atgtgaaaaatttcttattaca

SEQ ID NO: 8336255 - DNA, 22 bp, Homo sapiens
atgtcttttatggagatgtcat

SEQ ID NO: 8336256 - DNA, 22 bp, Homo sapiens
atgtctttgccatagttcatat

SEQ ID NO: 8336257 - DNA, 22 bp, Homo sapiens
atgtgaaaatccaatggcagca

SEQ ID NO: 8336258 - DNA, 22 bp, Homo sapiens
atgtgaaacctgtgagtagagt

SEQ ID NO: 8336259 - DNA, 22 bp, Homo sapiens
gaggctgccccttcctcagctg

SEQ ID NO: 8336260 - DNA, 22 bp, Homo sapiens
gaggctgcggggaggagcctgc

SEQ ID NO: 8336261 - DNA, 22 bp, Homo sapiens
atgcaaaattaccattctgttc

SEQ ID NO: 8336262 - DNA, 22 bp, Homo sapiens
atgcaaacatgaagagaaagag

SEQ ID NO: 8336263 - DNA, 22 bp, Homo sapiens
atgcaaaagtagttgcagtttt

SEQ ID NO: 8336264 - DNA, 22 bp, Homo sapiens
atgcaaaataaggcagaaacat

SEQ ID NO: 8336265 - DNA, 22 bp, Homo sapiens
atgcacagtatgtagggtctat

SEQ ID NO: 8336266 - DNA, 22 bp, Homo sapiens
atgcagaatgagttcacgatct

SEQ ID NO: 8336267 - DNA, 22 bp, Homo sapiens
atgcacagtacaaactggaaac

SEQ ID NO: 8336268 - DNA, 22 bp, Homo sapiens
atgcacttgcgtgtttgcaaat

SEQ ID NO: 8336269 - DNA, 22 bp, Homo sapiens
atgcattctgtagagcatttat

SEQ ID NO: 8336270 - DNA, 22 bp, Homo sapiens
atgcattctggaaagtagcaat

SEQ ID NO: 8336271 - DNA, 22 bp, Homo sapiens
atgcattctggaaagtagcaat

SEQ ID NO: 8336272 - DNA, 21 bp, Homo sapiens
atgcattcctcccctttcctc

SEQ ID NO: 8336273 - DNA, 22 bp, Homo sapiens
atgcattcattcattctttcta

SEQ ID NO: 8336274 - DNA, 22 bp, Homo sapiens
atgcattctagcctggacaaca

SEQ ID NO: 8336275 - DNA, 22 bp, Homo sapiens
atgcatttatgtgtgtacattg

SEQ ID NO: 8336276 - DNA, 22 bp, Homo sapiens
atgcatttatgtgtgtacattg

SEQ ID NO: 8336277 - DNA, 22 bp, Homo sapiens
atgcatgtgtgagagcaagagg

SEQ ID NO: 8336278 - DNA, 22 bp, Homo sapiens
atgcattcagcggaatgcttag

SEQ ID NO: 8336279 - DNA, 22 bp, Homo sapiens
atgcattcatgaagattgcaca

SEQ ID NO: 8336280 - DNA, 22 bp, Homo sapiens
atgcattcatgaagattgcaca

SEQ ID NO: 8336281 - DNA, 22 bp, Homo sapiens
gaaagcaagttgactgcagaat

SEQ ID NO: 8336282 - DNA, 18 bp, Homo sapiens
gaaagatgaacttttttc

SEQ ID NO: 8336283 - DNA, 22 bp, Homo sapiens
gaaagcacagttctgaccatgt

SEQ ID NO: 8336284 - DNA, 22 bp, Homo sapiens
gaaagcacagttcatgagacaa

SEQ ID NO: 8336285 - DNA, 21 bp, Homo sapiens
gaaagcacagaaaggactctt

SEQ ID NO: 8336286 - DNA, 22 bp, Homo sapiens
gaaagcacaggctcaggaacag

SEQ ID NO: 8336287 - DNA, 22 bp, Homo sapiens
gaaagcactaaaagagaatcct

SEQ ID NO: 8336288 - DNA, 22 bp, Homo sapiens
gaaagcacgatagtagcaaaag

SEQ ID NO: 8336289 - DNA, 22 bp, Homo sapiens
gaaagcacccaagatttccttc

SEQ ID NO: 8336290 - DNA, 22 bp, Homo sapiens
gaaagcacatactataaatcac

SEQ ID NO: 8336291 - DNA, 22 bp, Homo sapiens
atgaagcagactcaggtggtgc

SEQ ID NO: 8336292 - DNA, 22 bp, Homo sapiens
gaaagcactgtgagatcttgtt

SEQ ID NO: 8336293 - DNA, 22 bp, Homo sapiens
atgagtaaaaccactatttaca

SEQ ID NO: 8336294 - DNA, 22 bp, Homo sapiens
atgagtaagataggcaatgtgt

SEQ ID NO: 8336295 - DNA, 22 bp, Homo sapiens
atgagtaagaccataatttttg

SEQ ID NO: 8336296 - DNA, 22 bp, Homo sapiens
atgaggttcagtgtttatttcc

SEQ ID NO: 8336297 - DNA, 22 bp, Homo sapiens
atgaggttcagtgtttatttcc

SEQ ID NO: 8336298 - DNA, 22 bp, Homo sapiens
atgcaaaaactgcacttacgct

SEQ ID NO: 8336299 - DNA, 22 bp, Homo sapiens
atgattttttctaacacagtcg

SEQ ID NO: 8336300 - DNA, 22 bp, Homo sapiens
atgcaaaagtaattgcaatttt

SEQ ID NO: 8336301 - DNA, 22 bp, Homo sapiens
atgcaaaagtaactgtgatttt

SEQ ID NO: 8336302 - DNA, 22 bp, Homo sapiens
atgcaaaagactatttgttgct

SEQ ID NO: 8336303 - DNA, 20 bp, Homo sapiens
atgattttgcactaacttca

SEQ ID NO: 8336304 - DNA, 22 bp, Homo sapiens
atgatttttcagcagaggatct

SEQ ID NO: 8336305 - DNA, 22 bp, Homo sapiens
atgattttttctaacacagtcg

SEQ ID NO: 8336306 - DNA, 23 bp, Homo sapiens
atgataatgccattaactttgat

SEQ ID NO: 8336307 - DNA, 20 bp, Homo sapiens
atgagtttaaacattcagag

SEQ ID NO: 8336308 - DNA, 22 bp, Homo sapiens
atgatacaagcaaaactaatca

SEQ ID NO: 8336309 - DNA, 22 bp, Homo sapiens
atgaaatgaagttggcctggct

SEQ ID NO: 8336310 - DNA, 22 bp, Homo sapiens
atgaaatgagtcaatgcgacta

SEQ ID NO: 8336311 - DNA, 23 bp, Homo sapiens
atgaaatgatactttattcactg

SEQ ID NO: 8336312 - DNA, 22 bp, Homo sapiens
atgaaatgtaagtagagagttt

SEQ ID NO: 8336313 - DNA, 22 bp, Homo sapiens
atgaaatgtattcagatatgta

SEQ ID NO: 8336314 - DNA, 22 bp, Homo sapiens
atgaaatgtattcagatatgta

SEQ ID NO: 8336315 - DNA, 22 bp, Homo sapiens
atgaaatggtggttttccattt

SEQ ID NO: 8336316 - DNA, 23 bp, Homo sapiens
atgaaatgctggctcagggaggt

SEQ ID NO: 8336317 - DNA, 22 bp, Homo sapiens
atgaaatgattgaaatctttac

SEQ ID NO: 8336318 - DNA, 22 bp, Homo sapiens
atgaaatgctattttggctaga

SEQ ID NO: 8336319 - DNA, 22 bp, Homo sapiens
cttttattttgaattaagggct

SEQ ID NO: 8336320 - DNA, 22 bp, Homo sapiens
atgaaattaatcaacacataca

SEQ ID NO: 8336321 - DNA, 22 bp, Homo sapiens
atgaaatgttggtcccaatcgc

SEQ ID NO: 8336322 - DNA, 22 bp, Homo sapiens
cttttcagagctgagatcaccg

SEQ ID NO: 8336323 - DNA, 22 bp, Homo sapiens
atgaaatatcttgaagaaattc

SEQ ID NO: 8336324 - DNA, 22 bp, Homo sapiens
atgaaatatcttgaagaaattc

SEQ ID NO: 8336325 - DNA, 22 bp, Homo sapiens
cttgttctgtgcttcttacatt

SEQ ID NO: 8336326 - DNA, 18 bp, Homo sapiens
cttgttcttctcttggcg

SEQ ID NO: 8336327 - DNA, 22 bp, Homo sapiens
atgaaaagcataaacgctgaag

SEQ ID NO: 8336328 - DNA, 22 bp, Homo sapiens
cttgttaaaatgccgattctga

SEQ ID NO: 8336329 - DNA, 22 bp, Homo sapiens
cttgttatctgaaccaaaatta

SEQ ID NO: 8336330 - DNA, 22 bp, Homo sapiens
cttgttattggaaatgtcatgc

SEQ ID NO: 8336331 - DNA, 22 bp, Homo sapiens
atctttttatctgtttggaaca

SEQ ID NO: 8336332 - DNA, 22 bp, Homo sapiens
atcttttctgtttgctatgtct

SEQ ID NO: 8336333 - DNA, 22 bp, Homo sapiens
atcttgcaatgacctatttagg

SEQ ID NO: 8336334 - DNA, 22 bp, Homo sapiens
atctagaagtggcatgaattac

SEQ ID NO: 8336335 - DNA, 22 bp, Homo sapiens
atctagattaggtataagagct

SEQ ID NO: 8336336 - DNA, 22 bp, Homo sapiens
atctacaatgtctggctgcact

SEQ ID NO: 8336337 - DNA, 22 bp, Homo sapiens
atctacataaaacgaatacata

SEQ ID NO: 8336338 - DNA, 22 bp, Homo sapiens
atctatactcagagttaatatc

SEQ ID NO: 8336339 - DNA, 22 bp, Homo sapiens
atctatgtgcctttgtatagaa

SEQ ID NO: 8336340 - DNA, 22 bp, Homo sapiens
cttgcctgtggctagttggctc

SEQ ID NO: 8336341 - DNA, 23 bp, Homo sapiens
cttgcctggcctctctgcccaga

SEQ ID NO: 8336342 - DNA, 19 bp, Homo sapiens
cttgcctgttcctacagct

SEQ ID NO: 8336343 - DNA, 22 bp, Homo sapiens
cttgcctttgtcttcaaaggct

SEQ ID NO: 8336344 - DNA, 22 bp, Homo sapiens
cttgctcttttcactgtaatat

SEQ ID NO: 8336345 - DNA, 22 bp, Homo sapiens
cttgctctttgatgaattttcc

SEQ ID NO: 8336346 - DNA, 22 bp, Homo sapiens
cttgctcattaagtagctcaca

SEQ ID NO: 8336347 - DNA, 18 bp, Homo sapiens
cttgctgagggcctcatt

SEQ ID NO: 8336348 - DNA, 22 bp, Homo sapiens
cttgggtgtgaccttggcattg

SEQ ID NO: 8336349 - DNA, 22 bp, Homo sapiens
cttggtaaattgtcttataaat

SEQ ID NO: 8336350 - DNA, 18 bp, Homo sapiens
cttggtaagtaaaacagc

SEQ ID NO: 8336351 - DNA, 22 bp, Homo sapiens
cttggtcaggcttttgtaactg

SEQ ID NO: 8336352 - DNA, 22 bp, Homo sapiens
cttggtcatgcaagatatcgat

SEQ ID NO: 8336353 - DNA, 22 bp, Homo sapiens
cttggtcagctcgagagtttgt

SEQ ID NO: 8336354 - DNA, 22 bp, Homo sapiens
cttggcagctacacaggtaaga

SEQ ID NO: 8336355 - DNA, 22 bp, Homo sapiens
cttgctggaaactctctctgcc

SEQ ID NO: 8336356 - DNA, 22 bp, Homo sapiens
cttgtaatagataggatcaaat

SEQ ID NO: 8336357 - DNA, 22 bp, Homo sapiens
atcttctgggcagtgaaaattg

SEQ ID NO: 8336358 - DNA, 20 bp, Homo sapiens
atcttcttggccagcttgct

SEQ ID NO: 8336359 - DNA, 22 bp, Homo sapiens
cttggtgcccagcaggtggctg

SEQ ID NO: 8336360 - DNA, 22 bp, Homo sapiens
cttgtaaatgcagattctgatt

SEQ ID NO: 8336361 - DNA, 21 bp, Homo sapiens
gcctctccaaatcctgccttc

SEQ ID NO: 8336362 - DNA, 21 bp, Homo sapiens
gcctctccaaatcctgccttc

SEQ ID NO: 8336363 - DNA, 22 bp, Homo sapiens
gcctctccgagccactgcctct

SEQ ID NO: 8336364 - DNA, 22 bp, Homo sapiens
gcctccccaagcagcagggatt

SEQ ID NO: 8336365 - DNA, 22 bp, Homo sapiens
gcctccccaaagtgctgacagc

SEQ ID NO: 8336366 - DNA, 22 bp, Homo sapiens
gcctccagggtagaggaggaag

SEQ ID NO: 8336367 - DNA, 22 bp, Homo sapiens
gcctccagggtagaggaggaag

SEQ ID NO: 8336368 - DNA, 22 bp, Homo sapiens
atttctcactgagcagataaaa

SEQ ID NO: 8336369 - DNA, 22 bp, Homo sapiens
atttctcagaccagagaggtgt

SEQ ID NO: 8336370 - DNA, 22 bp, Homo sapiens
atttctcagcacttcctatctc

SEQ ID NO: 8336371 - DNA, 22 bp, Homo sapiens
atttctcaagtaaatgagtcat

SEQ ID NO: 8336372 - DNA, 22 bp, Homo sapiens
atttctcaagtaaatgagtcat

SEQ ID NO: 8336373 - DNA, 22 bp, Homo sapiens
atttctcaaccaggtcaaaaag

SEQ ID NO: 8336374 - DNA, 22 bp, Homo sapiens
atttctcactcacagtccatgt

SEQ ID NO: 8336375 - DNA, 22 bp, Homo sapiens
atttctcacaaagttgcttatc

SEQ ID NO: 8336376 - DNA, 22 bp, Homo sapiens
atttctcagtgtacattatgtt

SEQ ID NO: 8336377 - DNA, 22 bp, Homo sapiens
atttctcagtgtacattatgtt

SEQ ID NO: 8336378 - DNA, 22 bp, Homo sapiens
atttctcagtaggtgcacagtg

SEQ ID NO: 8336379 - DNA, 22 bp, Homo sapiens
atttctcagtgaaatgacaggc

SEQ ID NO: 8336380 - DNA, 22 bp, Homo sapiens
atttctcagtgaaatgacaggc

SEQ ID NO: 8336381 - DNA, 22 bp, Homo sapiens
atttctcagtgaaatgacaggc

SEQ ID NO: 8336382 - DNA, 21 bp, Homo sapiens
gcctcaccatgtcaagccagg

SEQ ID NO: 8336383 - DNA, 21 bp, Homo sapiens
gcctccagccagatggcctcc

SEQ ID NO: 8336384 - DNA, 22 bp, Homo sapiens
gcctggagctcatgtgggcatt

SEQ ID NO: 8336385 - DNA, 22 bp, Homo sapiens
gcctggagctcggctgagggcg

SEQ ID NO: 8336386 - DNA, 22 bp, Homo sapiens
gcctggagctcggctgagggcg

SEQ ID NO: 8336387 - DNA, 22 bp, Homo sapiens
gcctgggagcacatcggggtcc

SEQ ID NO: 8336388 - DNA, 22 bp, Homo sapiens
gcctgggagatgcgttgtggcc

SEQ ID NO: 8336389 - DNA, 22 bp, Homo sapiens
gcctgctggaggagcctcaggg

SEQ ID NO: 8336390 - DNA, 22 bp, Homo sapiens
caaactgagcatcagaaagttt

SEQ ID NO: 8336391 - DNA, 22 bp, Homo sapiens
caaactgagcatcagaaagttt

SEQ ID NO: 8336392 - DNA, 22 bp, Homo sapiens
caaactgaacacgaaagtcttt

SEQ ID NO: 8336393 - DNA, 22 bp, Homo sapiens
caaactattgttcacaagacaa

SEQ ID NO: 8336394 - DNA, 22 bp, Homo sapiens
gcgagtgccgagagggcagggc

SEQ ID NO: 8336395 - DNA, 22 bp, Homo sapiens
gcgagggcacgcggttgaaggc

SEQ ID NO: 8336396 - DNA, 22 bp, Homo sapiens
gcgagtccactggggggcgcag

SEQ ID NO: 8336397 - DNA, 22 bp, Homo sapiens
gcgaggaggggtgctgggcccc

SEQ ID NO: 8336398 - DNA, 22 bp, Homo sapiens
gcgagggcacgcggttgaaggc

SEQ ID NO: 8336399 - DNA, 22 bp, Homo sapiens
gcgcagagtagcagagtgctga

SEQ ID NO: 8336400 - DNA, 22 bp, Homo sapiens
gcgcactgggcgcacgcgtagg

SEQ ID NO: 8336401 - DNA, 22 bp, Homo sapiens
gctcaggatcagccacctcttt

SEQ ID NO: 8336402 - DNA, 22 bp, Homo sapiens
gctcaggagctcttggtggcgc

SEQ ID NO: 8336403 - DNA, 22 bp, Homo sapiens
gctcaggactggaggagcgggg

SEQ ID NO: 8336404 - DNA, 22 bp, Homo sapiens
gctcaggagctgacagcctcaa

SEQ ID NO: 8336405 - DNA, 22 bp, Homo sapiens
gctcaggatttcatccatgtgt

SEQ ID NO: 8336406 - DNA, 22 bp, Homo sapiens
gctcaggatcccaggggtgtgc

SEQ ID NO: 8336407 - DNA, 22 bp, Homo sapiens
gctcaggcaaatttctggtgaa

SEQ ID NO: 8336408 - DNA, 22 bp, Homo sapiens
caaacttttgaggagttcagga

SEQ ID NO: 8336409 - DNA, 22 bp, Homo sapiens
gctcaggaaaacagtctagtaa

SEQ ID NO: 8336410 - DNA, 22 bp, Homo sapiens
gctcaggaaacagcagggcttg

SEQ ID NO: 8336411 - DNA, 22 bp, Homo sapiens
gctcaggaaatagtttagtgtt

SEQ ID NO: 8336412 - DNA, 22 bp, Homo sapiens
gctcaggaaggctcaaccagga

SEQ ID NO: 8336413 - DNA, 22 bp, Homo sapiens
gctcaggacccaggtgtgacct

SEQ ID NO: 8336414 - DNA, 22 bp, Homo sapiens
gctcaggaccgaggggtgggaa

SEQ ID NO: 8336415 - DNA, 22 bp, Homo sapiens
caaaagaagctcttggggctag

SEQ ID NO: 8336416 - DNA, 22 bp, Homo sapiens
gcgagcctctggagtcctctgg

SEQ ID NO: 8336417 - DNA, 22 bp, Homo sapiens
caaaacattctctgcagcaggg

SEQ ID NO: 8336418 - DNA, 22 bp, Homo sapiens
gcctgtgctgttccctctgcca

SEQ ID NO: 8336419 - DNA, 22 bp, Homo sapiens
caaaacattcagagagctcact

SEQ ID NO: 8336420 - DNA, 22 bp, Homo sapiens
caaaaagcttaggtaacaagcc

SEQ ID NO: 8336421 - DNA, 22 bp, Homo sapiens
gcctgtcctatacaggcggctg

SEQ ID NO: 8336422 - DNA, 22 bp, Homo sapiens
gcctgtgcctcagcctgcagcc

SEQ ID NO: 8336423 - DNA, 23 bp, Homo sapiens
gcctgtgcctatgcccagctctg

SEQ ID NO: 8336424 - DNA, 22 bp, Homo sapiens
gcctgtccactaaacagccaag

SEQ ID NO: 8336425 - DNA, 22 bp, Homo sapiens
gcctgggagtgcacagtgaggt

SEQ ID NO: 8336426 - DNA, 22 bp, Homo sapiens
gccaggagtgtgtggctatgtt

SEQ ID NO: 8336427 - DNA, 23 bp, Homo sapiens
gccaggagtgggtagactaatgc

SEQ ID NO: 8336428 - DNA, 20 bp, Homo sapiens
gccaggagggtgtgatgagc

SEQ ID NO: 8336429 - DNA, 22 bp, Homo sapiens
gccaggaggggagagtgtgtca

SEQ ID NO: 8336430 - DNA, 22 bp, Homo sapiens
atttagaaattccaaaagtatt

SEQ ID NO: 8336431 - DNA, 22 bp, Homo sapiens
atttagaaattccaaaagtatt

SEQ ID NO: 8336432 - DNA, 22 bp, Homo sapiens
atttagaactttgtttgccaat

SEQ ID NO: 8336433 - DNA, 22 bp, Homo sapiens
atttagaactttgtttgccaat

SEQ ID NO: 8336434 - DNA, 22 bp, Homo sapiens
atttagaagctaatttttcaga

SEQ ID NO: 8336435 - DNA, 22 bp, Homo sapiens
atttacagaaacttaatcatag

SEQ ID NO: 8336436 - DNA, 22 bp, Homo sapiens
atttacacttggtttactagag

SEQ ID NO: 8336437 - DNA, 22 bp, Homo sapiens
atttacagaaacttaatcatag

SEQ ID NO: 8336438 - DNA, 22 bp, Homo sapiens
atttacactggttctcagagct

SEQ ID NO: 8336439 - DNA, 22 bp, Homo sapiens
atttacaccttcttcgattctc

SEQ ID NO: 8336440 - DNA, 22 bp, Homo sapiens
atttacactaaaggaaggagga

SEQ ID NO: 8336441 - DNA, 22 bp, Homo sapiens
atttacacattcataagatttc

SEQ ID NO: 8336442 - DNA, 19 bp, Homo sapiens
gccaggagggctctggctg

SEQ ID NO: 8336443 - DNA, 22 bp, Homo sapiens
attgcttttgagctagaatttt

SEQ ID NO: 8336444 - DNA, 22 bp, Homo sapiens
attggaaatacagtagaaaaat

SEQ ID NO: 8336445 - DNA, 22 bp, Homo sapiens
attggaaatactgagagataaa

SEQ ID NO: 8336446 - DNA, 22 bp, Homo sapiens
attggaaaatatggtttctgga

SEQ ID NO: 8336447 - DNA, 22 bp, Homo sapiens
attggaaagttcttaagggata

SEQ ID NO: 8336448 - DNA, 22 bp, Homo sapiens
atttaatgtcgagctattgtag

SEQ ID NO: 8336449 - DNA, 21 bp, Homo sapiens
attggcagatctctggattgt

SEQ ID NO: 8336450 - DNA, 21 bp, Homo sapiens
attggcacaccttttattgga

SEQ ID NO: 8336451 - DNA, 21 bp, Homo sapiens
atttagaaggaaattttgcaa

SEQ ID NO: 8336452 - DNA, 22 bp, Homo sapiens
gccaggccactcccgggtcctg

SEQ ID NO: 8336453 - DNA, 22 bp, Homo sapiens
atttcacaaaccatcctgattt

SEQ ID NO: 8336454 - DNA, 22 bp, Homo sapiens
gccaggcctgcaagtgctggtg

SEQ ID NO: 8336455 - DNA, 19 bp, Homo sapiens
gccaggcctggacctgcag

SEQ ID NO: 8336456 - DNA, 22 bp, Homo sapiens
gccaggcctgcaagtgctggtg

SEQ ID NO: 8336457 - DNA, 22 bp, Homo sapiens
gccaggccactcccgggtcctg

SEQ ID NO: 8336458 - DNA, 22 bp, Homo sapiens
gccaggccctgggcacttcgtg

SEQ ID NO: 8336459 - DNA, 22 bp, Homo sapiens
atttcagattcagaaatgtagg

SEQ ID NO: 8336460 - DNA, 22 bp, Homo sapiens
atttcagatgaccaaatggaaa

SEQ ID NO: 8336461 - DNA, 22 bp, Homo sapiens
atttcagattcagaaatgtagg

SEQ ID NO: 8336462 - DNA, 22 bp, Homo sapiens
atttcagatgaccaaatggaaa

SEQ ID NO: 8336463 - DNA, 22 bp, Homo sapiens
atttcagagtgagagtgctcaa

SEQ ID NO: 8336464 - DNA, 21 bp, Homo sapiens
atttcagagcacacaagtaaa

SEQ ID NO: 8336465 - DNA, 22 bp, Homo sapiens
atttcagagctttgcagctaat

SEQ ID NO: 8336466 - DNA, 22 bp, Homo sapiens
atttcagagaatgaacctaatc

SEQ ID NO: 8336467 - DNA, 21 bp, Homo sapiens
atttcagagcacacaagtaaa

SEQ ID NO: 8336468 - DNA, 22 bp, Homo sapiens
atttcagagaatgaacctaatc

SEQ ID NO: 8336469 - DNA, 22 bp, Homo sapiens
atttcagactgtgttggaaaat

SEQ ID NO: 8336470 - DNA, 22 bp, Homo sapiens
atttcagcaaagttttgattgg

SEQ ID NO: 8336471 - DNA, 22 bp, Homo sapiens
atttcagtgttggttagcaagc

SEQ ID NO: 8336472 - DNA, 22 bp, Homo sapiens
atttcagtgagaaagcaatcaa

SEQ ID NO: 8336473 - DNA, 22 bp, Homo sapiens
atttcatgagttattatagtgg

SEQ ID NO: 8336474 - DNA, 22 bp, Homo sapiens
atttctataggaggacagtatt

SEQ ID NO: 8336475 - DNA, 22 bp, Homo sapiens
atttctcaaaggaatagagtga

SEQ ID NO: 8336476 - DNA, 22 bp, Homo sapiens
atttctactgtgagaaacatga

SEQ ID NO: 8336477 - DNA, 22 bp, Homo sapiens
atttctactgtgagaaacatga

SEQ ID NO: 8336478 - DNA, 22 bp, Homo sapiens
atttctacagtacacatgcatt

SEQ ID NO: 8336479 - DNA, 22 bp, Homo sapiens
atttcctagcctctcttgcagt

SEQ ID NO: 8336480 - DNA, 22 bp, Homo sapiens
atttccttgcaagtttctgtaa

SEQ ID NO: 8336481 - DNA, 22 bp, Homo sapiens
gcaagaaaaaggcttcatgaac

SEQ ID NO: 8336482 - DNA, 22 bp, Homo sapiens
gcaagaaaaaggcttcatgaac

SEQ ID NO: 8336483 - DNA, 22 bp, Homo sapiens
attacaagatgcatccatattt

SEQ ID NO: 8336484 - DNA, 22 bp, Homo sapiens
attacaaaagaagggagaaggt

SEQ ID NO: 8336485 - DNA, 22 bp, Homo sapiens
attaatttttctgacagccaca

SEQ ID NO: 8336486 - DNA, 22 bp, Homo sapiens
attacaaaagaagggagaaggt

SEQ ID NO: 8336487 - DNA, 22 bp, Homo sapiens
attaattttacctttgtaaaca

SEQ ID NO: 8336488 - DNA, 18 bp, Homo sapiens
attaatcataaaatgctg

SEQ ID NO: 8336489 - DNA, 22 bp, Homo sapiens
attaatgacgcagataataatt

SEQ ID NO: 8336490 - DNA, 22 bp, Homo sapiens
attaatgacgcagataataatt

SEQ ID NO: 8336491 - DNA, 22 bp, Homo sapiens
gatgatggacaaagcattggtg

SEQ ID NO: 8336492 - DNA, 22 bp, Homo sapiens
gatgatgaggccatgaggcagg

SEQ ID NO: 8336493 - DNA, 22 bp, Homo sapiens
attaatattggttcattagctg

SEQ ID NO: 8336494 - DNA, 22 bp, Homo sapiens
attattcaacacttgagaaatt

SEQ ID NO: 8336495 - DNA, 22 bp, Homo sapiens
attattcaatgttatttcagtg

SEQ ID NO: 8336496 - DNA, 22 bp, Homo sapiens
attattcaatcatattaaaagt

SEQ ID NO: 8336497 - DNA, 22 bp, Homo sapiens
attattcatggtcttccacaat

SEQ ID NO: 8336498 - DNA, 22 bp, Homo sapiens
attattcattggtaggcaagct

SEQ ID NO: 8336499 - DNA, 22 bp, Homo sapiens
attattcagtcttgtaaggagt

SEQ ID NO: 8336500 - DNA, 20 bp, Homo sapiens
attattcatacatgtgtgac

SEQ ID NO: 8336501 - DNA, 22 bp, Homo sapiens
attattctttgataaatggcag

SEQ ID NO: 8336502 - DNA, 22 bp, Homo sapiens
attattcttgaggtgtttattg

SEQ ID NO: 8336503 - DNA, 22 bp, Homo sapiens
attagaatgaagtataggattt

SEQ ID NO: 8336504 - DNA, 22 bp, Homo sapiens
attagaatgcagggttcattgt

SEQ ID NO: 8336505 - DNA, 22 bp, Homo sapiens
attagacatcatatgattcagc

SEQ ID NO: 8336506 - DNA, 22 bp, Homo sapiens
attagaattatgcttgctaatg

SEQ ID NO: 8336507 - DNA, 23 bp, Homo sapiens
attagacactttgggttgtcttc

SEQ ID NO: 8336508 - DNA, 22 bp, Homo sapiens
gcaagtagtgggaaagaagatg

SEQ ID NO: 8336509 - DNA, 22 bp, Homo sapiens
gatgagtgaggacagggtggca

SEQ ID NO: 8336510 - DNA, 22 bp, Homo sapiens
gatgaggcagctcagggggaaa

SEQ ID NO: 8336511 - DNA, 22 bp, Homo sapiens
gatgaggctgtagagggtggca

SEQ ID NO: 8336512 - DNA, 22 bp, Homo sapiens
gatgaggctagagacatgtgta

SEQ ID NO: 8336513 - DNA, 22 bp, Homo sapiens
gatgaggccacacggggtgggc

SEQ ID NO: 8336514 - DNA, 22 bp, Homo sapiens
attaaatgttggcatattttgt

SEQ ID NO: 8336515 - DNA, 22 bp, Homo sapiens
attaaatggtggtcattcattt

SEQ ID NO: 8336516 - DNA, 22 bp, Homo sapiens
attaaaattccaaggtatgcca

SEQ ID NO: 8336517 - DNA, 22 bp, Homo sapiens
attaaatgttccttaaattata

SEQ ID NO: 8336518 - DNA, 22 bp, Homo sapiens
attaaatgatggcatgtcttat

SEQ ID NO: 8336519 - DNA, 22 bp, Homo sapiens
atgtttttgagatacaaacaga

SEQ ID NO: 8336520 - DNA, 22 bp, Homo sapiens
atgtttttaaatagacttacag

SEQ ID NO: 8336521 - DNA, 22 bp, Homo sapiens
atgtgttttggtggatcattca

SEQ ID NO: 8336522 - DNA, 22 bp, Homo sapiens
atgtgtttttattctggcatgt

SEQ ID NO: 8336523 - DNA, 22 bp, Homo sapiens
atgtgtttttattctggcatgt

SEQ ID NO: 8336524 - DNA, 22 bp, Homo sapiens
atgtgtttgtcctgcagaaata

SEQ ID NO: 8336525 - DNA, 22 bp, Homo sapiens
atgtgtttgtcctgcagaaata

SEQ ID NO: 8336526 - DNA, 22 bp, Homo sapiens
atgtgtttaccaggggaacatg

SEQ ID NO: 8336527 - DNA, 22 bp, Homo sapiens
atgttttctccatgttatgctt

SEQ ID NO: 8336528 - DNA, 22 bp, Homo sapiens
atgttttctttcagacttccct

SEQ ID NO: 8336529 - DNA, 22 bp, Homo sapiens
atgttttcaaagtaaacttgta

SEQ ID NO: 8336530 - DNA, 22 bp, Homo sapiens
atgttttattaccaacttgtac

SEQ ID NO: 8336531 - DNA, 22 bp, Homo sapiens
attctgttacttggtgatcttc

SEQ ID NO: 8336532 - DNA, 22 bp, Homo sapiens
attcttcacactaaccctgtga

SEQ ID NO: 8336533 - DNA, 22 bp, Homo sapiens
attcttcactgtttcagaatga

SEQ ID NO: 8336534 - DNA, 22 bp, Homo sapiens
attctaggcttgaaacatgaag

SEQ ID NO: 8336535 - DNA, 22 bp, Homo sapiens
attctagcagatattggaaatt

SEQ ID NO: 8336536 - DNA, 22 bp, Homo sapiens
attctcaaacaagtggtttgat

SEQ ID NO: 8336537 - DNA, 19 bp, Homo sapiens
attcttcagcagtgagacc

SEQ ID NO: 8336538 - DNA, 22 bp, Homo sapiens
attgaaattgatgaaattcttg

SEQ ID NO: 8336539 - DNA, 22 bp, Homo sapiens
attcttcagcaggggacactat

SEQ ID NO: 8336540 - DNA, 20 bp, Homo sapiens
attgaaatttttctgagatt

SEQ ID NO: 8336541 - DNA, 22 bp, Homo sapiens
attgaacagaaaccatcagagt

SEQ ID NO: 8336542 - DNA, 22 bp, Homo sapiens
attgaagatcagggaaagattc

SEQ ID NO: 8336543 - DNA, 22 bp, Homo sapiens
attgaagacttggtatccgtgg

SEQ ID NO: 8336544 - DNA, 22 bp, Homo sapiens
attgacaaatggatgttgacat

SEQ ID NO: 8336545 - DNA, 22 bp, Homo sapiens
attgacaagcagtatgtcttag

SEQ ID NO: 8336546 - DNA, 22 bp, Homo sapiens
attgacaagacaatggctctta

SEQ ID NO: 8336547 - DNA, 22 bp, Homo sapiens
attgacaaggaaactataccag

SEQ ID NO: 8336548 - DNA, 22 bp, Homo sapiens
attgacaagtgagctgggctgc

SEQ ID NO: 8336549 - DNA, 22 bp, Homo sapiens
attgacaatctactatgttctg

SEQ ID NO: 8336550 - DNA, 22 bp, Homo sapiens
attgacaatgtatttgtatctg

SEQ ID NO: 8336551 - DNA, 22 bp, Homo sapiens
attgacaattagcccttaggtg

SEQ ID NO: 8336552 - DNA, 22 bp, Homo sapiens
attgacagaaaagatgttggat

SEQ ID NO: 8336553 - DNA, 22 bp, Homo sapiens
attgacattaactatattagcc

SEQ ID NO: 8336554 - DNA, 22 bp, Homo sapiens
attatttcagtcagacactggc

SEQ ID NO: 8336555 - DNA, 22 bp, Homo sapiens
attatttatcctcttggtctat

SEQ ID NO: 8336556 - DNA, 22 bp, Homo sapiens
attatttatcctcttggtctat

SEQ ID NO: 8336557 - DNA, 22 bp, Homo sapiens
attattgttttaatagtagaga

SEQ ID NO: 8336558 - DNA, 22 bp, Homo sapiens
attatttacagtgtgctcgaag

SEQ ID NO: 8336559 - DNA, 18 bp, Homo sapiens
gcagagctgggattccca

SEQ ID NO: 8336560 - DNA, 22 bp, Homo sapiens
attcagttaaaaactgtacttc

SEQ ID NO: 8336561 - DNA, 22 bp, Homo sapiens
gcagcaggcttttcataccttg

SEQ ID NO: 8336562 - DNA, 22 bp, Homo sapiens
gcagcaggcatggccgccctgg

SEQ ID NO: 8336563 - DNA, 22 bp, Homo sapiens
gcagcagggagcaggggtgtca

SEQ ID NO: 8336564 - DNA, 22 bp, Homo sapiens
attctactcattgatctatata

SEQ ID NO: 8336565 - DNA, 22 bp, Homo sapiens
attctacacaacatgatgatgg

SEQ ID NO: 8336566 - DNA, 22 bp, Homo sapiens
attctacacaacatgatgatgg

SEQ ID NO: 8336567 - DNA, 22 bp, Homo sapiens
caggggcaggtgtgagatcatc

SEQ ID NO: 8336568 - DNA, 22 bp, Homo sapiens
caggggccaagggtccagacct

SEQ ID NO: 8336569 - DNA, 22 bp, Homo sapiens
caggggcagtctgtgtgcgtgg

SEQ ID NO: 8336570 - DNA, 22 bp, Homo sapiens
caggggccggctgtccgtgccc

SEQ ID NO: 8336571 - DNA, 22 bp, Homo sapiens
caggggcctggctgtctaggaa

SEQ ID NO: 8336572 - DNA, 22 bp, Homo sapiens
caggggcctggctgtctaggaa

SEQ ID NO: 8336573 - DNA, 22 bp, Homo sapiens
caggggcctgtcctggcttctg

SEQ ID NO: 8336574 - DNA, 22 bp, Homo sapiens
cagggtgcttccgtggagctgt

SEQ ID NO: 8336575 - DNA, 22 bp, Homo sapiens
cagggtggaaaagctagttgga

SEQ ID NO: 8336576 - DNA, 22 bp, Homo sapiens
cagggtgcttccgtggagctgt

SEQ ID NO: 8336577 - DNA, 22 bp, Homo sapiens
tataagaaattgccaacctgtt

SEQ ID NO: 8336578 - DNA, 22 bp, Homo sapiens
tataagaaacaaggcaaatttt

SEQ ID NO: 8336579 - DNA, 22 bp, Homo sapiens
tataagaaacaaggcaaatttt

SEQ ID NO: 8336580 - DNA, 22 bp, Homo sapiens
tataagaagtgaagaagagtta

SEQ ID NO: 8336581 - DNA, 22 bp, Homo sapiens
tataagatacttggcatagtgc

SEQ ID NO: 8336582 - DNA, 22 bp, Homo sapiens
tacatgttatttcactattggt

SEQ ID NO: 8336583 - DNA, 22 bp, Homo sapiens
tacatgttatttcactattggt

SEQ ID NO: 8336584 - DNA, 22 bp, Homo sapiens
tataatctcctgagttaggtag

SEQ ID NO: 8336585 - DNA, 22 bp, Homo sapiens
tatacagtcttttgctatattc

SEQ ID NO: 8336586 - DNA, 22 bp, Homo sapiens
tatacagtatcttttgaaggca

SEQ ID NO: 8336587 - DNA, 21 bp, Homo sapiens
tatacagtaattaagtggtat

SEQ ID NO: 8336588 - DNA, 22 bp, Homo sapiens
cagggtggcacatcacagcatt

SEQ ID NO: 8336589 - DNA, 22 bp, Homo sapiens
tatacagatggaaagatacaca

SEQ ID NO: 8336590 - DNA, 22 bp, Homo sapiens
cagggtggaatggaatgctggc

SEQ ID NO: 8336591 - DNA, 22 bp, Homo sapiens
cagggtggaagctgtagagtgg

SEQ ID NO: 8336592 - DNA, 22 bp, Homo sapiens
cagggtggaatggaatgctggc

SEQ ID NO: 8336593 - DNA, 22 bp, Homo sapiens
caggtctgaagagtcacatgcc

SEQ ID NO: 8336594 - DNA, 22 bp, Homo sapiens
caggtctctcccaagctacaat

SEQ ID NO: 8336595 - DNA, 22 bp, Homo sapiens
tatacagtttgagttcttgcat

SEQ ID NO: 8336596 - DNA, 22 bp, Homo sapiens
tatggctgtattctatgttact

SEQ ID NO: 8336597 - DNA, 22 bp, Homo sapiens
caggtctgtttccatcagtgct

SEQ ID NO: 8336598 - DNA, 22 bp, Homo sapiens
caggtctgtgtgccatttccaa

SEQ ID NO: 8336599 - DNA, 22 bp, Homo sapiens
tatctctttattgacaataaaa

SEQ ID NO: 8336600 - DNA, 22 bp, Homo sapiens
tatctctttcattttagagtca

SEQ ID NO: 8336601 - DNA, 17 bp, Homo sapiens
tatctctgcttcatggt

SEQ ID NO: 8336602 - DNA, 22 bp, Homo sapiens
tatctctgttccaagccttatc

SEQ ID NO: 8336603 - DNA, 17 bp, Homo sapiens
tatctcatacaattata

SEQ ID NO: 8336604 - DNA, 22 bp, Homo sapiens
tatctccagtttctgagcctca

SEQ ID NO: 8336605 - DNA, 22 bp, Homo sapiens
tatctcattttattgcaaatgt

SEQ ID NO: 8336606 - DNA, 22 bp, Homo sapiens
tatggcaagagaatcaactgaa

SEQ ID NO: 8336607 - DNA, 22 bp, Homo sapiens
tatggactattgtatgacagag

SEQ ID NO: 8336608 - DNA, 22 bp, Homo sapiens
tattaaatatatctgttagttg

SEQ ID NO: 8336609 - DNA, 22 bp, Homo sapiens
tattaaagagagaatcatcatc

SEQ ID NO: 8336610 - DNA, 22 bp, Homo sapiens
tattgcttattcttgagagtca

SEQ ID NO: 8336611 - DNA, 22 bp, Homo sapiens
tattgctgttctttaaatgaag

SEQ ID NO: 8336612 - DNA, 23 bp, Homo sapiens
tatgtgcatatgtgtaagaatac

SEQ ID NO: 8336613 - DNA, 22 bp, Homo sapiens
tatgtgtatgtacatacataca

SEQ ID NO: 8336614 - DNA, 22 bp, Homo sapiens
tatgttttaggaattaattgtt

SEQ ID NO: 8336615 - DNA, 22 bp, Homo sapiens
tatgttttaggaattaattgtt

SEQ ID NO: 8336616 - DNA, 22 bp, Homo sapiens
cagtcctgtgttaaacaagagc

SEQ ID NO: 8336617 - DNA, 22 bp, Homo sapiens
cagtcctgtgtcccttggtggg

SEQ ID NO: 8336618 - DNA, 20 bp, Homo sapiens
cagtcctgtccctgctgccc

SEQ ID NO: 8336619 - DNA, 22 bp, Homo sapiens
cagtcctctctgtgtctgcacc

SEQ ID NO: 8336620 - DNA, 20 bp, Homo sapiens
tatttacaacttagagcctc

SEQ ID NO: 8336621 - DNA, 22 bp, Homo sapiens
tattggatcttttattgctcag

SEQ ID NO: 8336622 - DNA, 19 bp, Homo sapiens
tatttacttcttgattgca

SEQ ID NO: 8336623 - DNA, 22 bp, Homo sapiens
tatttagaacagacaatagaaa

SEQ ID NO: 8336624 - DNA, 20 bp, Homo sapiens
tatttagattcaagtatgga

SEQ ID NO: 8336625 - DNA, 22 bp, Homo sapiens
tatttagtgatagaagcaagga

SEQ ID NO: 8336626 - DNA, 22 bp, Homo sapiens
cagtctagatgctagaaaatat

SEQ ID NO: 8336627 - DNA, 22 bp, Homo sapiens
cagtgaggtagacagctttttc

SEQ ID NO: 8336628 - DNA, 22 bp, Homo sapiens
cagtgaggtggatggatggcct

SEQ ID NO: 8336629 - DNA, 22 bp, Homo sapiens
cagtgatatttatcctactcac

SEQ ID NO: 8336630 - DNA, 22 bp, Homo sapiens
cagtgcagacgtggagggggca

SEQ ID NO: 8336631 - DNA, 22 bp, Homo sapiens
tcactcaagcatctacagggat

SEQ ID NO: 8336632 - DNA, 22 bp, Homo sapiens
tcactcaatggtatcaggaggt

SEQ ID NO: 8336633 - DNA, 22 bp, Homo sapiens
tcactcagatgttaaagggctt

SEQ ID NO: 8336634 - DNA, 22 bp, Homo sapiens
tcacccaagaccatcggaagtg

SEQ ID NO: 8336635 - DNA, 22 bp, Homo sapiens
tcactccaaaccccaggcttgt

SEQ ID NO: 8336636 - DNA, 22 bp, Homo sapiens
tcactcatattatctctccaca

SEQ ID NO: 8336637 - DNA, 18 bp, Homo sapiens
tcactcatagacatctat

SEQ ID NO: 8336638 - DNA, 22 bp, Homo sapiens
tcactccatctttgctactggt

SEQ ID NO: 8336639 - DNA, 22 bp, Homo sapiens
tcactcaggctggagtgcagtg

SEQ ID NO: 8336640 - DNA, 22 bp, Homo sapiens
tcactcaggctggagtgcagtg

SEQ ID NO: 8336641 - DNA, 22 bp, Homo sapiens
tcacttccctcttcagctccca

SEQ ID NO: 8336642 - DNA, 22 bp, Homo sapiens
tcaccagtctttcttaccattg

SEQ ID NO: 8336643 - DNA, 22 bp, Homo sapiens
cagtgctggctgttaggacagt

SEQ ID NO: 8336644 - DNA, 22 bp, Homo sapiens
cagtgcagaggccagggaggat

SEQ ID NO: 8336645 - DNA, 19 bp, Homo sapiens
cagtgcccaccctagcaca

SEQ ID NO: 8336646 - DNA, 22 bp, Homo sapiens
cagtgctgagagcctggccagg

SEQ ID NO: 8336647 - DNA, 22 bp, Homo sapiens
catgattttgtcttgtgttaat

SEQ ID NO: 8336648 - DNA, 22 bp, Homo sapiens
tcattttcacacataaatagca

SEQ ID NO: 8336649 - DNA, 22 bp, Homo sapiens
tcattttgcctgccatttgagt

SEQ ID NO: 8336650 - DNA, 18 bp, Homo sapiens
tcattttgtctgcctttg

SEQ ID NO: 8336651 - DNA, 22 bp, Homo sapiens
catgggaataaagttatttcaa

SEQ ID NO: 8336652 - DNA, 22 bp, Homo sapiens
tccagccatatcttgtagccct

SEQ ID NO: 8336653 - DNA, 22 bp, Homo sapiens
catgtacatgcctactatcaat

SEQ ID NO: 8336654 - DNA, 22 bp, Homo sapiens
catgtgcagactctgacaggct

SEQ ID NO: 8336655 - DNA, 23 bp, Homo sapiens
catgtgcaggaactgtgcttttg

SEQ ID NO: 8336656 - DNA, 22 bp, Homo sapiens
catgtctttcaaaccacacagt

SEQ ID NO: 8336657 - DNA, 22 bp, Homo sapiens
catgataattgttaacaaagta

SEQ ID NO: 8336658 - DNA, 22 bp, Homo sapiens
catgagaaggttttggcatata

SEQ ID NO: 8336659 - DNA, 22 bp, Homo sapiens
tcatgtaagtatagaaagcagt

SEQ ID NO: 8336660 - DNA, 22 bp, Homo sapiens
tcatgtcagtttcttctataaa

SEQ ID NO: 8336661 - DNA, 18 bp, Homo sapiens
tcatttgttttgcatgaa

SEQ ID NO: 8336662 - DNA, 18 bp, Homo sapiens
tcatttgttttgcatgaa

SEQ ID NO: 8336663 - DNA, 22 bp, Homo sapiens
tcatttgttgctgttacctgag

SEQ ID NO: 8336664 - DNA, 22 bp, Homo sapiens
tcatttgttgaactttagtgcg

SEQ ID NO: 8336665 - DNA, 22 bp, Homo sapiens
tcatttgttctcattctctact

SEQ ID NO: 8336666 - DNA, 21 bp, Homo sapiens
tcagttctctgcctgtgcttg

SEQ ID NO: 8336667 - DNA, 22 bp, Homo sapiens
tcagttcttagtaatgcagtct

SEQ ID NO: 8336668 - DNA, 22 bp, Homo sapiens
catctttcagtttataagtctg

SEQ ID NO: 8336669 - DNA, 22 bp, Homo sapiens
tcaggtgggacctgctaggaca

SEQ ID NO: 8336670 - DNA, 22 bp, Homo sapiens
tcaggtgggagtagaatgctag

SEQ ID NO: 8336671 - DNA, 22 bp, Homo sapiens
catccccagagcagttccacta

SEQ ID NO: 8336672 - DNA, 22 bp, Homo sapiens
tcaggtggctggttgctggcta

SEQ ID NO: 8336673 - DNA, 22 bp, Homo sapiens
tcaggtggcttcggggagtggc

SEQ ID NO: 8336674 - DNA, 22 bp, Homo sapiens
catataattacctaccagctgg

SEQ ID NO: 8336675 - DNA, 22 bp, Homo sapiens
catatacacttccacctctgtg

SEQ ID NO: 8336676 - DNA, 22 bp, Homo sapiens
catataatgtttgaagatgtgg

SEQ ID NO: 8336677 - DNA, 22 bp, Homo sapiens
catagacagatggtaagaagct

SEQ ID NO: 8336678 - DNA, 22 bp, Homo sapiens
catagaatgtaataaagagtag

SEQ ID NO: 8336679 - DNA, 22 bp, Homo sapiens
catagaatgtaataaagagtag

SEQ ID NO: 8336680 - DNA, 22 bp, Homo sapiens
catagacaaagatcagaagagt

SEQ ID NO: 8336681 - DNA, 22 bp, Homo sapiens
catatatctacctgcaattgca

SEQ ID NO: 8336682 - DNA, 22 bp, Homo sapiens
catatattatggactgcagaat

SEQ ID NO: 8336683 - DNA, 22 bp, Homo sapiens
catatattatggactgcagaat

SEQ ID NO: 8336684 - DNA, 22 bp, Homo sapiens
catatattctggttttcactgg

SEQ ID NO: 8336685 - DNA, 20 bp, Homo sapiens
catatatacctagaagtgga

SEQ ID NO: 8336686 - DNA, 22 bp, Homo sapiens
catatacttttctatagctttc

SEQ ID NO: 8336687 - DNA, 20 bp, Homo sapiens
catatatacctagaagtgga

SEQ ID NO: 8336688 - DNA, 23 bp, Homo sapiens
catatgaattttagaggcagttt

SEQ ID NO: 8336689 - DNA, 22 bp, Homo sapiens
catatgaagatgtctttttgta

SEQ ID NO: 8336690 - DNA, 22 bp, Homo sapiens
catatgaagttcaacagagatg

SEQ ID NO: 8336691 - DNA, 22 bp, Homo sapiens
catatgaaatatgagttgaaca

SEQ ID NO: 8336692 - DNA, 22 bp, Homo sapiens
catatcccattggccaggacat

SEQ ID NO: 8336693 - DNA, 22 bp, Homo sapiens
catatccaggtttctttggttt

SEQ ID NO: 8336694 - DNA, 22 bp, Homo sapiens
tcagggccatcttttgcctcaa

SEQ ID NO: 8336695 - DNA, 22 bp, Homo sapiens
tcagggccatcttttgcctcaa

SEQ ID NO: 8336696 - DNA, 22 bp, Homo sapiens
catcacaaatgtaataatgtct

SEQ ID NO: 8336697 - DNA, 20 bp, Homo sapiens
tcagggcatgggacagcccc

SEQ ID NO: 8336698 - DNA, 22 bp, Homo sapiens
tcagggccacaacaccagagtc

SEQ ID NO: 8336699 - DNA, 22 bp, Homo sapiens
catatgtatttctcataattag

SEQ ID NO: 8336700 - DNA, 22 bp, Homo sapiens
catagaaaagagtaggtaatgt

SEQ ID NO: 8336701 - DNA, 22 bp, Homo sapiens
catagaaaagagtaggtaatgt

SEQ ID NO: 8336702 - DNA, 22 bp, Homo sapiens
catacatttatacacatctatg

SEQ ID NO: 8336703 - DNA, 22 bp, Homo sapiens
tcagctgcagcaggcaccattt

SEQ ID NO: 8336704 - DNA, 20 bp, Homo sapiens
tcagctctgtgcctgggatg

SEQ ID NO: 8336705 - DNA, 22 bp, Homo sapiens
tcagccctgggcttcctcatgg

SEQ ID NO: 8336706 - DNA, 22 bp, Homo sapiens
tcagccctagcctcagtccagg

SEQ ID NO: 8336707 - DNA, 20 bp, Homo sapiens
tcagccctgagtccaggctg

SEQ ID NO: 8336708 - DNA, 22 bp, Homo sapiens
cagtttcttagtgacacaaatc

SEQ ID NO: 8336709 - DNA, 22 bp, Homo sapiens
cagtttcttcaattcagacact

SEQ ID NO: 8336710 - DNA, 22 bp, Homo sapiens
tcagcagtggctctcatgcagt

SEQ ID NO: 8336711 - DNA, 22 bp, Homo sapiens
tcagcagtgcagggtgaggcag

SEQ ID NO: 8336712 - DNA, 22 bp, Homo sapiens
cagtttctgtctgttcttatcc

SEQ ID NO: 8336713 - DNA, 22 bp, Homo sapiens
tcagaagtcacttaggaaaggg

SEQ ID NO: 8336714 - DNA, 22 bp, Homo sapiens
tcagaaggtacagaagggaggt

SEQ ID NO: 8336715 - DNA, 22 bp, Homo sapiens
ccaggaaatggcttgcttcttt

SEQ ID NO: 8336716 - DNA, 22 bp, Homo sapiens
ccaggaaccgatgatcagaggg

SEQ ID NO: 8336717 - DNA, 22 bp, Homo sapiens
ccaggaacaaagccccatccac

SEQ ID NO: 8336718 - DNA, 22 bp, Homo sapiens
ccagcttcggcaagcagacttt

SEQ ID NO: 8336719 - DNA, 22 bp, Homo sapiens
ccaggaaagaggaagaacgcat

SEQ ID NO: 8336720 - DNA, 22 bp, Homo sapiens
ccaggaaaataccaagctttaa

SEQ ID NO: 8336721 - DNA, 22 bp, Homo sapiens
ccaggaggcagaagttgcagtg

SEQ ID NO: 8336722 - DNA, 22 bp, Homo sapiens
ccaggaggcaatatcaagtcca

SEQ ID NO: 8336723 - DNA, 21 bp, Homo sapiens
ccaggaaggactgagctccct

SEQ ID NO: 8336724 - DNA, 22 bp, Homo sapiens
tctgtcagcccctcagctgtca

SEQ ID NO: 8336725 - DNA, 22 bp, Homo sapiens
ccaggaggcggaggttgcagcg

SEQ ID NO: 8336726 - DNA, 22 bp, Homo sapiens
ccaggaggcggaaggtacagtg

SEQ ID NO: 8336727 - DNA, 22 bp, Homo sapiens
ccaggaggcagaggttacagtg

SEQ ID NO: 8336728 - DNA, 22 bp, Homo sapiens
ccaggaggcagaggttgtagtg

SEQ ID NO: 8336729 - DNA, 22 bp, Homo sapiens
tctgtctgtagttttacatgat

SEQ ID NO: 8336730 - DNA, 22 bp, Homo sapiens
tctgtcatcaaatatgctttct

SEQ ID NO: 8336731 - DNA, 22 bp, Homo sapiens
tctgtcttagcatctttgctca

SEQ ID NO: 8336732 - DNA, 22 bp, Homo sapiens
tctgtggcacgattgcactgca

SEQ ID NO: 8336733 - DNA, 22 bp, Homo sapiens
tctggctttattccttcactga

SEQ ID NO: 8336734 - DNA, 22 bp, Homo sapiens
tctggctcatctctccaggtaa

SEQ ID NO: 8336735 - DNA, 22 bp, Homo sapiens
tctggctcataggaaggccatt

SEQ ID NO: 8336736 - DNA, 22 bp, Homo sapiens
tctggagctggagggcaaggca

SEQ ID NO: 8336737 - DNA, 21 bp, Homo sapiens
tctggagctgcaggctgggca

SEQ ID NO: 8336738 - DNA, 22 bp, Homo sapiens
tctggagctgggggcttagtat

SEQ ID NO: 8336739 - DNA, 22 bp, Homo sapiens
tctggctcatacaagcctgcaa

SEQ ID NO: 8336740 - DNA, 22 bp, Homo sapiens
ccagctggttaaaatagagaaa

SEQ ID NO: 8336741 - DNA, 19 bp, Homo sapiens
ccagctggcctgggacctc

SEQ ID NO: 8336742 - DNA, 22 bp, Homo sapiens
ccagctgggattaagggaaaat

SEQ ID NO: 8336743 - DNA, 22 bp, Homo sapiens
ccagctggggaagtggggcata

SEQ ID NO: 8336744 - DNA, 22 bp, Homo sapiens
tctgcgtgaaactagatggcag

SEQ ID NO: 8336745 - DNA, 22 bp, Homo sapiens
tctgcgtgggactgaggaggct

SEQ ID NO: 8336746 - DNA, 22 bp, Homo sapiens
tctgcgtgatgagggtgcagca

SEQ ID NO: 8336747 - DNA, 22 bp, Homo sapiens
tctgcgctgccttgatccttgg

SEQ ID NO: 8336748 - DNA, 22 bp, Homo sapiens
tctgccacttttgcttactggg

SEQ ID NO: 8336749 - DNA, 20 bp, Homo sapiens
tctgccactttttctgtcac

SEQ ID NO: 8336750 - DNA, 22 bp, Homo sapiens
tctgcctcgctaacagcagcca

SEQ ID NO: 8336751 - DNA, 22 bp, Homo sapiens
ccagctccaggactgggagctg

SEQ ID NO: 8336752 - DNA, 22 bp, Homo sapiens
ccagctccaggactgggagctg

SEQ ID NO: 8336753 - DNA, 22 bp, Homo sapiens
ccagctccaggactgggagctg

SEQ ID NO: 8336754 - DNA, 22 bp, Homo sapiens
ccagctcctcttcccagtgtca

SEQ ID NO: 8336755 - DNA, 22 bp, Homo sapiens
ccagctcctcttgtctctagca

SEQ ID NO: 8336756 - DNA, 22 bp, Homo sapiens
ccagctcctgggtcttagtcag

SEQ ID NO: 8336757 - DNA, 22 bp, Homo sapiens
ccagctcctgagcatggtttcc

SEQ ID NO: 8336758 - DNA, 22 bp, Homo sapiens
tctgccaccacctacactagta

SEQ ID NO: 8336759 - DNA, 22 bp, Homo sapiens
ccagctccttctgtctgtggag

SEQ ID NO: 8336760 - DNA, 22 bp, Homo sapiens
ccagctctagccccatgtggct

SEQ ID NO: 8336761 - DNA, 22 bp, Homo sapiens
tctgataagacagctgatttga

SEQ ID NO: 8336762 - DNA, 22 bp, Homo sapiens
tctgataaatgccatctttttg

SEQ ID NO: 8336763 - DNA, 22 bp, Homo sapiens
tctgataaataacatttggaaa

SEQ ID NO: 8336764 - DNA, 22 bp, Homo sapiens
tctgagtgatgttgagtcagaa

SEQ ID NO: 8336765 - DNA, 22 bp, Homo sapiens
tctgagtgagggtgtgagatat

SEQ ID NO: 8336766 - DNA, 22 bp, Homo sapiens
tctgagtgggaactctcatgac

SEQ ID NO: 8336767 - DNA, 23 bp, Homo sapiens
tctgagtgattagcctctggggt

SEQ ID NO: 8336768 - DNA, 22 bp, Homo sapiens
tctgagtgcactaggaggggca

SEQ ID NO: 8336769 - DNA, 22 bp, Homo sapiens
ccagcctggagggcagtggtgg

SEQ ID NO: 8336770 - DNA, 22 bp, Homo sapiens
tctgataatggacttctcatct

SEQ ID NO: 8336771 - DNA, 22 bp, Homo sapiens
tctgataatggacttctcatct

SEQ ID NO: 8336772 - DNA, 22 bp, Homo sapiens
ccagctccaagtttgggcatca

SEQ ID NO: 8336773 - DNA, 22 bp, Homo sapiens
ccagctccactgtcagatgaga

SEQ ID NO: 8336774 - DNA, 22 bp, Homo sapiens
ccagctccagcatagccaccat

SEQ ID NO: 8336775 - DNA, 21 bp, Homo sapiens
ccagctccaggaccttggatc

SEQ ID NO: 8336776 - DNA, 22 bp, Homo sapiens
ccagccttctgagctgcctgga

SEQ ID NO: 8336777 - DNA, 22 bp, Homo sapiens
ccagccttcacctgctctggtc

SEQ ID NO: 8336778 - DNA, 19 bp, Homo sapiens
ccagcctttccagtgattg

SEQ ID NO: 8336779 - DNA, 22 bp, Homo sapiens
ccagccttgaatcagttgctgc

SEQ ID NO: 8336780 - DNA, 22 bp, Homo sapiens
ccagccagtcccgcatgaccgc

SEQ ID NO: 8336781 - DNA, 22 bp, Homo sapiens
ccagccagtcccgcatgaccgc

SEQ ID NO: 8336782 - DNA, 17 bp, Homo sapiens
tctcttgttcactgctg

SEQ ID NO: 8336783 - DNA, 22 bp, Homo sapiens
tctcttgtggttttgtagttga

SEQ ID NO: 8336784 - DNA, 22 bp, Homo sapiens
tctgaaataggaaagcaaatgg

SEQ ID NO: 8336785 - DNA, 22 bp, Homo sapiens
tctcttggaggttcttcctgtt

SEQ ID NO: 8336786 - DNA, 22 bp, Homo sapiens
tctgaggcaaacagaggagtgt

SEQ ID NO: 8336787 - DNA, 22 bp, Homo sapiens
ccagccctcactgaggcctctc

SEQ ID NO: 8336788 - DNA, 22 bp, Homo sapiens
ccagaggacttgggggctgaat

SEQ ID NO: 8336789 - DNA, 22 bp, Homo sapiens
ccagaggacttgggggctgaat

SEQ ID NO: 8336790 - DNA, 22 bp, Homo sapiens
tctctagggtttagcacagata

SEQ ID NO: 8336791 - DNA, 22 bp, Homo sapiens
tctctaggtgcagtcactgctc

SEQ ID NO: 8336792 - DNA, 22 bp, Homo sapiens
ccagaggtgccacagaaagagc

SEQ ID NO: 8336793 - DNA, 23 bp, Homo sapiens
tctccagtgtctcttcattgagt

SEQ ID NO: 8336794 - DNA, 22 bp, Homo sapiens
tctctaaagcctggaagaggag

SEQ ID NO: 8336795 - DNA, 22 bp, Homo sapiens
tctctaaagtagaaaagacccc

SEQ ID NO: 8336796 - DNA, 20 bp, Homo sapiens
tctctaaagcacctggacta

SEQ ID NO: 8336797 - DNA, 22 bp, Homo sapiens
tctctaaagcactttaaccaca

SEQ ID NO: 8336798 - DNA, 22 bp, Homo sapiens
tctctaaataacacttattgaa

SEQ ID NO: 8336799 - DNA, 22 bp, Homo sapiens
tctctaaatacagatgtcatgg

SEQ ID NO: 8336800 - DNA, 22 bp, Homo sapiens
tctctaaatgttgggggaaatg

SEQ ID NO: 8336801 - DNA, 20 bp, Homo sapiens
tctctaacatgaatgctatc

SEQ ID NO: 8336802 - DNA, 22 bp, Homo sapiens
tctctaaatgctctcccatccc

SEQ ID NO: 8336803 - DNA, 19 bp, Homo sapiens
tctctaaatggtctttcac

SEQ ID NO: 8336804 - DNA, 22 bp, Homo sapiens
tctctaaatgattgtgtactcc

SEQ ID NO: 8336805 - DNA, 22 bp, Homo sapiens
tctctaaatctggttcacttgc

SEQ ID NO: 8336806 - DNA, 22 bp, Homo sapiens
ccagacaggaacacacatctcc

SEQ ID NO: 8336807 - DNA, 22 bp, Homo sapiens
ccagacaggaacacacatctcc

SEQ ID NO: 8336808 - DNA, 22 bp, Homo sapiens
ccactgaggaacatgggctcca

SEQ ID NO: 8336809 - DNA, 22 bp, Homo sapiens
ccactgccagccgcccggaggc

SEQ ID NO: 8336810 - DNA, 22 bp, Homo sapiens
ccactgccgatgttccatcttg

SEQ ID NO: 8336811 - DNA, 22 bp, Homo sapiens
ccactgccagccgcccggaggc

SEQ ID NO: 8336812 - DNA, 22 bp, Homo sapiens
ccactgcctctccagggccatc

SEQ ID NO: 8336813 - DNA, 22 bp, Homo sapiens
ccactgccgtgggccttgggga

SEQ ID NO: 8336814 - DNA, 22 bp, Homo sapiens
ccactgcctatttgcagggccc

SEQ ID NO: 8336815 - DNA, 22 bp, Homo sapiens
ccagaataggagtaataaaacc

SEQ ID NO: 8336816 - DNA, 22 bp, Homo sapiens
ccagaagagatcacagttcttg

SEQ ID NO: 8336817 - DNA, 22 bp, Homo sapiens
ccagaagcaaaacagacagttt

SEQ ID NO: 8336818 - DNA, 21 bp, Homo sapiens
ccagaagctgcttgcaggcta

SEQ ID NO: 8336819 - DNA, 22 bp, Homo sapiens
ccagaagcttctacacaggaga

SEQ ID NO: 8336820 - DNA, 22 bp, Homo sapiens
tcctggggagggttctggctcc

SEQ ID NO: 8336821 - DNA, 22 bp, Homo sapiens
ccacagggtcagccactctgca

SEQ ID NO: 8336822 - DNA, 22 bp, Homo sapiens
ccacagtcctggcttctgtctg

SEQ ID NO: 8336823 - DNA, 17 bp, Homo sapiens
ccactgactctgacttc

SEQ ID NO: 8336824 - DNA, 22 bp, Homo sapiens
ccactgaaggtcaacatagagc

SEQ ID NO: 8336825 - DNA, 22 bp, Homo sapiens
ccactgaaaaatttgagatgga

SEQ ID NO: 8336826 - DNA, 22 bp, Homo sapiens
ccactcttgaatcaagagctca

SEQ ID NO: 8336827 - DNA, 22 bp, Homo sapiens
catttagttatactaaaacatt

SEQ ID NO: 8336828 - DNA, 22 bp, Homo sapiens
catttagagaagattacaagga

SEQ ID NO: 8336829 - DNA, 19 bp, Homo sapiens
catttagaagtacatatta

SEQ ID NO: 8336830 - DNA, 22 bp, Homo sapiens
catttacagcagactgatgaaa

SEQ ID NO: 8336831 - DNA, 22 bp, Homo sapiens
catttacttaaatctttacaag

SEQ ID NO: 8336832 - DNA, 22 bp, Homo sapiens
catttattagttagttcgatgt

SEQ ID NO: 8336833 - DNA, 22 bp, Homo sapiens
catttatataaaatgtccagaa

SEQ ID NO: 8336834 - DNA, 22 bp, Homo sapiens
catttatgaagcactttagagt

SEQ ID NO: 8336835 - DNA, 22 bp, Homo sapiens
tcccagggcttttctcatgctt

SEQ ID NO: 8336836 - DNA, 22 bp, Homo sapiens
ccaaagtgatatgtgctgtaag

SEQ ID NO: 8336837 - DNA, 20 bp, Homo sapiens
tccctgccttttactgctgg

SEQ ID NO: 8336838 - DNA, 19 bp, Homo sapiens
tccctgcgtttcggcccac

SEQ ID NO: 8336839 - DNA, 22 bp, Homo sapiens
catttgaacctggatgttctta

SEQ ID NO: 8336840 - DNA, 22 bp, Homo sapiens
catttgaactaataactgtgct

SEQ ID NO: 8336841 - DNA, 22 bp, Homo sapiens
catttgaagaagaaacgtacta

SEQ ID NO: 8336842 - DNA, 22 bp, Homo sapiens
catttgaatggcatttcacttt

SEQ ID NO: 8336843 - DNA, 22 bp, Homo sapiens
catttgcagagggtgacactct

SEQ ID NO: 8336844 - DNA, 22 bp, Homo sapiens
catttgattcctttactcttat

SEQ ID NO: 8336845 - DNA, 22 bp, Homo sapiens
catttgctctgtgtcagtggca

SEQ ID NO: 8336846 - DNA, 22 bp, Homo sapiens
catttgctgaggccttcagagg

SEQ ID NO: 8336847 - DNA, 22 bp, Homo sapiens
tccctgcctgacagcacccacc

SEQ ID NO: 8336848 - DNA, 20 bp, Homo sapiens
tccctgccttttactgctgg

SEQ ID NO: 8336849 - DNA, 22 bp, Homo sapiens
tccctgcctctcagacttcctt

SEQ ID NO: 8336850 - DNA, 22 bp, Homo sapiens
catttgctggggtcttgggagt

SEQ ID NO: 8336851 - DNA, 22 bp, Homo sapiens
tccctgcctctcagacttcctt

SEQ ID NO: 8336852 - DNA, 22 bp, Homo sapiens
catttgcttcctgggtcttgaa

SEQ ID NO: 8336853 - DNA, 22 bp, Homo sapiens
tcctgcagttacatcccagcca

SEQ ID NO: 8336854 - DNA, 22 bp, Homo sapiens
tcctgcagtgtgtctcctgcac

SEQ ID NO: 8336855 - DNA, 22 bp, Homo sapiens
ccacaattctgctttaatttct

SEQ ID NO: 8336856 - DNA, 22 bp, Homo sapiens
ccaaatattaacaaagtaattt

SEQ ID NO: 8336857 - DNA, 22 bp, Homo sapiens
ccaaatcaggggccacaagcat

SEQ ID NO: 8336858 - DNA, 22 bp, Homo sapiens
tcctccccaaagcccagcctgg

SEQ ID NO: 8336859 - DNA, 20 bp, Homo sapiens
tcctcccccacctttgcagc

SEQ ID NO: 8336860 - DNA, 20 bp, Homo sapiens
ccaaatgtggagaaaaagta

SEQ ID NO: 8336861 - DNA, 22 bp, Homo sapiens
tcctgcccacagctgctggaca

SEQ ID NO: 8336862 - DNA, 22 bp, Homo sapiens
tcctgccagcccacagactcat

SEQ ID NO: 8336863 - DNA, 22 bp, Homo sapiens
tcctgccaaagcatgtactggg

SEQ ID NO: 8336864 - DNA, 22 bp, Homo sapiens
tcctgccacctgcacagctccc

SEQ ID NO: 8336865 - DNA, 22 bp, Homo sapiens
tcctgccaaaatatccctacct

SEQ ID NO: 8336866 - DNA, 19 bp, Homo sapiens
tcctgcccaccagccaggg

SEQ ID NO: 8336867 - DNA, 22 bp, Homo sapiens
ccacagaggacaactgcctggc

SEQ ID NO: 8336868 - DNA, 22 bp, Homo sapiens
ccacagagtcttccttctcttc

SEQ ID NO: 8336869 - DNA, 22 bp, Homo sapiens
ccacagccattccagggaggct

SEQ ID NO: 8336870 - DNA, 22 bp, Homo sapiens
ccacagctagggcaatctgatt

SEQ ID NO: 8336871 - DNA, 22 bp, Homo sapiens
ccacagagttacaaaacagtca

SEQ ID NO: 8336872 - DNA, 22 bp, Homo sapiens
ccacagagttacaaaacagtca

SEQ ID NO: 8336873 - DNA, 22 bp, Homo sapiens
ccacagagttgatgcaataaga

SEQ ID NO: 8336874 - DNA, 22 bp, Homo sapiens
ccacagcaggactggagccgcc

SEQ ID NO: 8336875 - DNA, 22 bp, Homo sapiens
cagctggggagagacatggcag

SEQ ID NO: 8336876 - DNA, 22 bp, Homo sapiens
cagctggggagagacatggcag

SEQ ID NO: 8336877 - DNA, 22 bp, Homo sapiens
cagctgggctaagagtagaggc

SEQ ID NO: 8336878 - DNA, 22 bp, Homo sapiens
cagctgggagctccattagata

SEQ ID NO: 8336879 - DNA, 22 bp, Homo sapiens
cagctggggcagccacgtgcgg

SEQ ID NO: 8336880 - DNA, 22 bp, Homo sapiens
cagctggggagagacatggcag

SEQ ID NO: 8336881 - DNA, 22 bp, Homo sapiens
cagctggggcagccacgtgcgg

SEQ ID NO: 8336882 - DNA, 22 bp, Homo sapiens
cagctggggcagccacgtgcgg

SEQ ID NO: 8336883 - DNA, 22 bp, Homo sapiens
gtgtggccaattatgggcattc

SEQ ID NO: 8336884 - DNA, 23 bp, Homo sapiens
gtgtggccccagggcctcctcgc

SEQ ID NO: 8336885 - DNA, 22 bp, Homo sapiens
gtgtggccctgcgtcctgagtc

SEQ ID NO: 8336886 - DNA, 22 bp, Homo sapiens
gtgtggccgccacttggggcag

SEQ ID NO: 8336887 - DNA, 22 bp, Homo sapiens
gtgtggccgtgtatccatggct

SEQ ID NO: 8336888 - DNA, 22 bp, Homo sapiens
gtgtgcgcgcgcgtcccgggtg

SEQ ID NO: 8336889 - DNA, 22 bp, Homo sapiens
gtgtgaaattagtcactgggaa

SEQ ID NO: 8336890 - DNA, 22 bp, Homo sapiens
gtgtgaaagcttgtcctctgta

SEQ ID NO: 8336891 - DNA, 22 bp, Homo sapiens
gtgtcttttgaggctgaccagt

SEQ ID NO: 8336892 - DNA, 18 bp, Homo sapiens
gtgtcttattacagtggg

SEQ ID NO: 8336893 - DNA, 22 bp, Homo sapiens
gtgtctttattcctctatgttt

SEQ ID NO: 8336894 - DNA, 22 bp, Homo sapiens
gtgtcttaatgaagtagattat

SEQ ID NO: 8336895 - DNA, 22 bp, Homo sapiens
gtgtacttctgctgagccatgg

SEQ ID NO: 8336896 - DNA, 22 bp, Homo sapiens
gtggggagggagatgctgaagt

SEQ ID NO: 8336897 - DNA, 22 bp, Homo sapiens
gtggggcagtggcctgggagca

SEQ ID NO: 8336898 - DNA, 22 bp, Homo sapiens
gtggggcagtggcctgggagca

SEQ ID NO: 8336899 - DNA, 22 bp, Homo sapiens
gtggggcctgtggcttccgtgg

SEQ ID NO: 8336900 - DNA, 22 bp, Homo sapiens
gtggggctaaaaactgtgcagt

SEQ ID NO: 8336901 - DNA, 22 bp, Homo sapiens
gtggggcggcagatgctccctg

SEQ ID NO: 8336902 - DNA, 22 bp, Homo sapiens
gtggggctcccatctcctggct

SEQ ID NO: 8336903 - DNA, 22 bp, Homo sapiens
cagctgatttgagaaagaatga

SEQ ID NO: 8336904 - DNA, 22 bp, Homo sapiens
gtggggctgagtggagccagaa

SEQ ID NO: 8336905 - DNA, 22 bp, Homo sapiens
gtggggctgagtggagccagaa

SEQ ID NO: 8336906 - DNA, 22 bp, Homo sapiens
cagctgcagtgggggaccacaa

SEQ ID NO: 8336907 - DNA, 22 bp, Homo sapiens
gtgggtggaggcgtcgagggca

SEQ ID NO: 8336908 - DNA, 22 bp, Homo sapiens
gtgggtggatggctcacctcca

SEQ ID NO: 8336909 - DNA, 22 bp, Homo sapiens
gtgggtggatcatgaggtcagg

SEQ ID NO: 8336910 - DNA, 22 bp, Homo sapiens
cagctgctgagaagcctccctt

SEQ ID NO: 8336911 - DNA, 22 bp, Homo sapiens
cagctgctgagaagcctccctt

SEQ ID NO: 8336912 - DNA, 22 bp, Homo sapiens
cagctgctgatggcctgacaga

SEQ ID NO: 8336913 - DNA, 22 bp, Homo sapiens
cagctgctgatggcctgacaga

SEQ ID NO: 8336914 - DNA, 22 bp, Homo sapiens
cagctgcttctcctccagagct

SEQ ID NO: 8336915 - DNA, 22 bp, Homo sapiens
cagctgcttctcctccagagct

SEQ ID NO: 8336916 - DNA, 22 bp, Homo sapiens
cagctgcttctcctccagagct

SEQ ID NO: 8336917 - DNA, 22 bp, Homo sapiens
cagctgctgttcagttttgttt

SEQ ID NO: 8336918 - DNA, 22 bp, Homo sapiens
cagctgctgcccttggctgcag

SEQ ID NO: 8336919 - DNA, 22 bp, Homo sapiens
cagctgctgcccttggctgcag

SEQ ID NO: 8336920 - DNA, 22 bp, Homo sapiens
cagcccagccgagggcctggct

SEQ ID NO: 8336921 - DNA, 22 bp, Homo sapiens
cagcccaggccgacagttcctc

SEQ ID NO: 8336922 - DNA, 22 bp, Homo sapiens
gtggcaggtcccattggagcag

SEQ ID NO: 8336923 - DNA, 22 bp, Homo sapiens
gtggccaggcgtccgcgcggct

SEQ ID NO: 8336924 - DNA, 22 bp, Homo sapiens
cagctctgctggtggtgccagg

SEQ ID NO: 8336925 - DNA, 22 bp, Homo sapiens
cagctctggctattgaggacca

SEQ ID NO: 8336926 - DNA, 22 bp, Homo sapiens
cagctctggcgtcagggagcga

SEQ ID NO: 8336927 - DNA, 22 bp, Homo sapiens
cagctctggcagagcccaaccc

SEQ ID NO: 8336928 - DNA, 22 bp, Homo sapiens
cagctctggccagatctatcct

SEQ ID NO: 8336929 - DNA, 22 bp, Homo sapiens
cagctctgtgcaggcctgggga

SEQ ID NO: 8336930 - DNA, 22 bp, Homo sapiens
cagctctgtgcaggcctgggga

SEQ ID NO: 8336931 - DNA, 22 bp, Homo sapiens
cagctctgggagtcccacccct

SEQ ID NO: 8336932 - DNA, 22 bp, Homo sapiens
cagctctggctttggggagctt

SEQ ID NO: 8336933 - DNA, 20 bp, Homo sapiens
cagctctgggaaagaggcca

SEQ ID NO: 8336934 - DNA, 22 bp, Homo sapiens
cagctctggctattgaggacca

SEQ ID NO: 8336935 - DNA, 22 bp, Homo sapiens
cagctctggctttggggagctt

SEQ ID NO: 8336936 - DNA, 22 bp, Homo sapiens
gtggccttggcttctaccctga

SEQ ID NO: 8336937 - DNA, 22 bp, Homo sapiens
gtggccttgggcactgaccttg

SEQ ID NO: 8336938 - DNA, 22 bp, Homo sapiens
gtggcttgaccatccctgctac

SEQ ID NO: 8336939 - DNA, 22 bp, Homo sapiens
gtgggaagagccaattggggta

SEQ ID NO: 8336940 - DNA, 22 bp, Homo sapiens
gtgggcaggccctaggcgattt

SEQ ID NO: 8336941 - DNA, 22 bp, Homo sapiens
gtgggcagggttgctttctccg

SEQ ID NO: 8336942 - DNA, 22 bp, Homo sapiens
gtgggcaggtaggcaccagcta

SEQ ID NO: 8336943 - DNA, 22 bp, Homo sapiens
gtgggcagtcatgaaatctaga

SEQ ID NO: 8336944 - DNA, 22 bp, Homo sapiens
gtgggcagtgcctgacggatga

SEQ ID NO: 8336945 - DNA, 22 bp, Homo sapiens
gtgggcagtggggtcttctgcc

SEQ ID NO: 8336946 - DNA, 22 bp, Homo sapiens
gtgggcagtgcctgacggatga

SEQ ID NO: 8336947 - DNA, 22 bp, Homo sapiens
gtgggcaggaggccctgccctg

SEQ ID NO: 8336948 - DNA, 22 bp, Homo sapiens
gtgggcaggccctaggcgattt

SEQ ID NO: 8336949 - DNA, 22 bp, Homo sapiens
gtgggcaggagtgagcaacagg

SEQ ID NO: 8336950 - DNA, 22 bp, Homo sapiens
gtgggcaggccccaaagcaggg

SEQ ID NO: 8336951 - DNA, 22 bp, Homo sapiens
cagctgaacatgtagagcatct

SEQ ID NO: 8336952 - DNA, 22 bp, Homo sapiens
cagctctgttgccctggaaacg

SEQ ID NO: 8336953 - DNA, 22 bp, Homo sapiens
cagctctgttgccaaagtgggc

SEQ ID NO: 8336954 - DNA, 22 bp, Homo sapiens
cagctctgttcaaactatccag

SEQ ID NO: 8336955 - DNA, 18 bp, Homo sapiens
cagctgaggaccaaactg

SEQ ID NO: 8336956 - DNA, 22 bp, Homo sapiens
cagctgaggaatactagatgta

SEQ ID NO: 8336957 - DNA, 22 bp, Homo sapiens
gtttacattaagtattagcatc

SEQ ID NO: 8336958 - DNA, 22 bp, Homo sapiens
gtttattattcaacttcatgtt

SEQ ID NO: 8336959 - DNA, 22 bp, Homo sapiens
gtttcaaagcacagctcacatt

SEQ ID NO: 8336960 - DNA, 22 bp, Homo sapiens
gtttcaaaatgatgctgtaact

SEQ ID NO: 8336961 - DNA, 22 bp, Homo sapiens
gtttcaaaatgatgctgtaact

SEQ ID NO: 8336962 - DNA, 22 bp, Homo sapiens
gtttgcatttattagtcttctg

SEQ ID NO: 8336963 - DNA, 22 bp, Homo sapiens
gtttgcatttcttgaactatat

SEQ ID NO: 8336964 - DNA, 22 bp, Homo sapiens
gtttacatgcagaaaatcaatg

SEQ ID NO: 8336965 - DNA, 18 bp, Homo sapiens
gtttacacattctagaaa

SEQ ID NO: 8336966 - DNA, 22 bp, Homo sapiens
gtttacactccaggctggggtg

SEQ ID NO: 8336967 - DNA, 22 bp, Homo sapiens
gtttacacataactcctatcaa

SEQ ID NO: 8336968 - DNA, 22 bp, Homo sapiens
caggaagattagaccaagagct

SEQ ID NO: 8336969 - DNA, 22 bp, Homo sapiens
caggaacaggctgatgggcagg

SEQ ID NO: 8336970 - DNA, 22 bp, Homo sapiens
caggaacagggtgtcctggcag

SEQ ID NO: 8336971 - DNA, 22 bp, Homo sapiens
caggaagaggtatcaccgagca

SEQ ID NO: 8336972 - DNA, 22 bp, Homo sapiens
gttcttaaagattcatcaagca

SEQ ID NO: 8336973 - DNA, 22 bp, Homo sapiens
gttcttcaaagtgacaactaaa

SEQ ID NO: 8336974 - DNA, 22 bp, Homo sapiens
gttcttcacatttcattgagga

SEQ ID NO: 8336975 - DNA, 19 bp, Homo sapiens
gttccgggagtaggccggg

SEQ ID NO: 8336976 - DNA, 22 bp, Homo sapiens
gttcctatatagccttaaggat

SEQ ID NO: 8336977 - DNA, 22 bp, Homo sapiens
gttcctcacgtggacagatgat

SEQ ID NO: 8336978 - DNA, 22 bp, Homo sapiens
gttcctcaaaaaggagagcccc

SEQ ID NO: 8336979 - DNA, 22 bp, Homo sapiens
gttcccatacagtatcagtgct

SEQ ID NO: 8336980 - DNA, 22 bp, Homo sapiens
caggaacaactcccagcatctc

SEQ ID NO: 8336981 - DNA, 22 bp, Homo sapiens
caggaaattttgtgatctgttc

SEQ ID NO: 8336982 - DNA, 22 bp, Homo sapiens
caggaaattgcaacagtctgag

SEQ ID NO: 8336983 - DNA, 22 bp, Homo sapiens
gttggcagaaagctttcgatcg

SEQ ID NO: 8336984 - DNA, 22 bp, Homo sapiens
caggaaaggtgtgtcatgatgg

SEQ ID NO: 8336985 - DNA, 22 bp, Homo sapiens
gttacaaatgtaaattctgggg

SEQ ID NO: 8336986 - DNA, 22 bp, Homo sapiens
gttacaaatgccaaagctgaga

SEQ ID NO: 8336987 - DNA, 22 bp, Homo sapiens
gttacacaggaaaacattagca

SEQ ID NO: 8336988 - DNA, 22 bp, Homo sapiens
cagctgtgtaaacacatgtgta

SEQ ID NO: 8336989 - DNA, 22 bp, Homo sapiens
cagctgtgctagaagccacgaa

SEQ ID NO: 8336990 - DNA, 22 bp, Homo sapiens
cagcttcatgacaaacagtttt

SEQ ID NO: 8336991 - DNA, 22 bp, Homo sapiens
gttacataggtgtgttcagttt

SEQ ID NO: 8336992 - DNA, 22 bp, Homo sapiens
gttattcaacttgtgtctctta

SEQ ID NO: 8336993 - DNA, 22 bp, Homo sapiens
gttattatttctctccttgcta

SEQ ID NO: 8336994 - DNA, 22 bp, Homo sapiens
gttattcaatggcttataagga

SEQ ID NO: 8336995 - DNA, 22 bp, Homo sapiens
cagcttctaccatcaggaaatt

SEQ ID NO: 8336996 - DNA, 22 bp, Homo sapiens
gttattcttttatagcaataca

SEQ ID NO: 8336997 - DNA, 22 bp, Homo sapiens
gttattctaccactatgtacag

SEQ ID NO: 8336998 - DNA, 22 bp, Homo sapiens
cagcttctccattcttctggct

SEQ ID NO: 8336999 - DNA, 22 bp, Homo sapiens
cagcttgctaattttgacttca

SEQ ID NO: 8337000 - DNA, 20 bp, Homo sapiens
cagcttggatgagaggctga

SEQ ID NO: 8337001 - DNA, 20 bp, Homo sapiens
cagcttggatgagaggctga

SEQ ID NO: 8337002 - DNA, 22 bp, Homo sapiens
caggaaactgtgggcttaaatc

SEQ ID NO: 8337003 - DNA, 22 bp, Homo sapiens
caggaaaatgtcaatggaaagc

SEQ ID NO: 8337004 - DNA, 22 bp, Homo sapiens
cagctttgattctttctgccat

SEQ ID NO: 8337005 - DNA, 22 bp, Homo sapiens
cagctttgagcagccagtggca

SEQ ID NO: 8337006 - DNA, 22 bp, Homo sapiens
caggaggcagcgctctcaggac

SEQ ID NO: 8337007 - DNA, 22 bp, Homo sapiens
caggaggcagtttcagaagtca

SEQ ID NO: 8337008 - DNA, 22 bp, Homo sapiens
caggaggcagaggttgcagtga

SEQ ID NO: 8337009 - DNA, 22 bp, Homo sapiens
caggaggcagaggatgcccagt

SEQ ID NO: 8337010 - DNA, 22 bp, Homo sapiens
caggaggcagaggttgcagcga

SEQ ID NO: 8337011 - DNA, 22 bp, Homo sapiens
taaatgtagtcaaaggagcctc

SEQ ID NO: 8337012 - DNA, 22 bp, Homo sapiens
taaatgtataggcactaaacct

SEQ ID NO: 8337013 - DNA, 22 bp, Homo sapiens
taaatgtcaatgtgatttataa

SEQ ID NO: 8337014 - DNA, 22 bp, Homo sapiens
taaatgtactgaggcaacagga

SEQ ID NO: 8337015 - DNA, 22 bp, Homo sapiens
taaatgtaccttctgccttact

SEQ ID NO: 8337016 - DNA, 22 bp, Homo sapiens
taaatgtaaatggcgtcttgcg

SEQ ID NO: 8337017 - DNA, 22 bp, Homo sapiens
taaatgtgcacaggttagaagg

SEQ ID NO: 8337018 - DNA, 22 bp, Homo sapiens
caggaggcatatttaaatccaa

SEQ ID NO: 8337019 - DNA, 22 bp, Homo sapiens
caggaggcatcatggagcggac

SEQ ID NO: 8337020 - DNA, 22 bp, Homo sapiens
caggaggcccaaagggcgcaga

SEQ ID NO: 8337021 - DNA, 22 bp, Homo sapiens
caggaggcccggccacagccca

SEQ ID NO: 8337022 - DNA, 20 bp, Homo sapiens
caggagggacatttcagcat

SEQ ID NO: 8337023 - DNA, 22 bp, Homo sapiens
caggagggggtggagtttcgcc

SEQ ID NO: 8337024 - DNA, 22 bp, Homo sapiens
caggagggcccgagactcttcc

SEQ ID NO: 8337025 - DNA, 22 bp, Homo sapiens
caggaggctttgggatccaagt

SEQ ID NO: 8337026 - DNA, 22 bp, Homo sapiens
caggataacagaaaatagctga

SEQ ID NO: 8337027 - DNA, 22 bp, Homo sapiens
caggagctcttaaggatgtgat

SEQ ID NO: 8337028 - DNA, 22 bp, Homo sapiens
caggagctctcatcgtcagggc

SEQ ID NO: 8337029 - DNA, 22 bp, Homo sapiens
caggagctggataggaccacaa

SEQ ID NO: 8337030 - DNA, 22 bp, Homo sapiens
caggagctcagatgacatctca

SEQ ID NO: 8337031 - DNA, 22 bp, Homo sapiens
caggagagatatgagtccccac

SEQ ID NO: 8337032 - DNA, 23 bp, Homo sapiens
caggagatggctgctgtgtcagc

SEQ ID NO: 8337033 - DNA, 22 bp, Homo sapiens
caggagatgtaagacttctgtt

SEQ ID NO: 8337034 - DNA, 22 bp, Homo sapiens
caggagcaaggagcagtgggat

SEQ ID NO: 8337035 - DNA, 22 bp, Homo sapiens
taaagtcatctttacatctttg

SEQ ID NO: 8337036 - DNA, 22 bp, Homo sapiens
taaagccatactgaaagccact

SEQ ID NO: 8337037 - DNA, 22 bp, Homo sapiens
taaagctacacattattaatcc

SEQ ID NO: 8337038 - DNA, 22 bp, Homo sapiens
taaagctacacattattaatcc

SEQ ID NO: 8337039 - DNA, 22 bp, Homo sapiens
taaagccaatatacctagcata

SEQ ID NO: 8337040 - DNA, 22 bp, Homo sapiens
taaatatgcatgtatccttatc

SEQ ID NO: 8337041 - DNA, 22 bp, Homo sapiens
taaatcaagaatatcagcttgt

SEQ ID NO: 8337042 - DNA, 22 bp, Homo sapiens
taaatatcagtccagctcttcc

SEQ ID NO: 8337043 - DNA, 22 bp, Homo sapiens
taaatcacaaattttctcattt

SEQ ID NO: 8337044 - DNA, 22 bp, Homo sapiens
taaatcacattcgtctgctcct

SEQ ID NO: 8337045 - DNA, 22 bp, Homo sapiens
caggaagccacaggacaggtag

SEQ ID NO: 8337046 - DNA, 22 bp, Homo sapiens
caggaagccttccttgtctgct

SEQ ID NO: 8337047 - DNA, 22 bp, Homo sapiens
caggaagctagattttgttgct

SEQ ID NO: 8337048 - DNA, 21 bp, Homo sapiens
gtttgtaaggcactgtgttct

SEQ ID NO: 8337049 - DNA, 22 bp, Homo sapiens
gtttggtgagcagcttgggtat

SEQ ID NO: 8337050 - DNA, 22 bp, Homo sapiens
gtttggcataggatgtgggtta

SEQ ID NO: 8337051 - DNA, 22 bp, Homo sapiens
caggaagctgccggtgagcgag

SEQ ID NO: 8337052 - DNA, 22 bp, Homo sapiens
caggacaattttgagccacctg

SEQ ID NO: 8337053 - DNA, 22 bp, Homo sapiens
caggacaatctcgtcgggtcct

SEQ ID NO: 8337054 - DNA, 22 bp, Homo sapiens
taaacatttgttattcttgttt

SEQ ID NO: 8337055 - DNA, 22 bp, Homo sapiens
taaaccttatttgaataccaac

SEQ ID NO: 8337056 - DNA, 22 bp, Homo sapiens
taaaccttggtagcatcttgct

SEQ ID NO: 8337057 - DNA, 22 bp, Homo sapiens
caggaccaggcgttctgggctg

SEQ ID NO: 8337058 - DNA, 22 bp, Homo sapiens
caggaccattgcaactgcccct

SEQ ID NO: 8337059 - DNA, 22 bp, Homo sapiens
caggagacaagttagcagctga

SEQ ID NO: 8337060 - DNA, 22 bp, Homo sapiens
taaaatagcatgtgcagtgaaa

SEQ ID NO: 8337061 - DNA, 22 bp, Homo sapiens
taaaatagcatgtgcagtgaaa

SEQ ID NO: 8337062 - DNA, 22 bp, Homo sapiens
taaaatagccagtgcccctctg

SEQ ID NO: 8337063 - DNA, 22 bp, Homo sapiens
taaaatagccagtgcccctctg

SEQ ID NO: 8337064 - DNA, 22 bp, Homo sapiens
taaaatagcttatgtcttttga

SEQ ID NO: 8337065 - DNA, 22 bp, Homo sapiens
taaaatagcttatgtcttttga

SEQ ID NO: 8337066 - DNA, 22 bp, Homo sapiens
taaaaagtagtgagaatggcgc

SEQ ID NO: 8337067 - DNA, 22 bp, Homo sapiens
gttttccttctcagccattgcc

SEQ ID NO: 8337068 - DNA, 22 bp, Homo sapiens
gttttctaagtaggtagcacca

SEQ ID NO: 8337069 - DNA, 22 bp, Homo sapiens
gttttctaccagggaagagagt

SEQ ID NO: 8337070 - DNA, 22 bp, Homo sapiens
gttttctaggatcccctccaag

SEQ ID NO: 8337071 - DNA, 22 bp, Homo sapiens
tacaagtttatccatcattgtt

SEQ ID NO: 8337072 - DNA, 22 bp, Homo sapiens
tacagctggactggtagctgtg

SEQ ID NO: 8337073 - DNA, 22 bp, Homo sapiens
tacagggcatgtgcagacacat

SEQ ID NO: 8337074 - DNA, 22 bp, Homo sapiens
tacaggtagagtctctagttta

SEQ ID NO: 8337075 - DNA, 22 bp, Homo sapiens
tacaagtccgtaaagggcagat

SEQ ID NO: 8337076 - DNA, 22 bp, Homo sapiens
tacaaggcaaatccatgatgtc

SEQ ID NO: 8337077 - DNA, 20 bp, Homo sapiens
tacaagtacattatagttat

SEQ ID NO: 8337078 - DNA, 22 bp, Homo sapiens
tacaagtaaattgtagatacca

SEQ ID NO: 8337079 - DNA, 22 bp, Homo sapiens
tacaagtactgtggctttgaat

SEQ ID NO: 8337080 - DNA, 22 bp, Homo sapiens
tacaagtatgttttaaaatgtt

SEQ ID NO: 8337081 - DNA, 22 bp, Homo sapiens
tacaagtatattctagtgatat

SEQ ID NO: 8337082 - DNA, 22 bp, Homo sapiens
tacaaatgtattttattttggt

SEQ ID NO: 8337083 - DNA, 22 bp, Homo sapiens
tacaaatggttgaatggatgaa

SEQ ID NO: 8337084 - DNA, 22 bp, Homo sapiens
tacaaatgggttaaaatatagt

SEQ ID NO: 8337085 - DNA, 22 bp, Homo sapiens
tacaaggaaaatcttgaagtac

SEQ ID NO: 8337086 - DNA, 20 bp, Homo sapiens
tacaaattttccatgtttcc

SEQ ID NO: 8337087 - DNA, 22 bp, Homo sapiens
tacaaatgagttgtatgaacca

SEQ ID NO: 8337088 - DNA, 22 bp, Homo sapiens
tacaaatgaccatagccactta

SEQ ID NO: 8337089 - DNA, 22 bp, Homo sapiens
tacaaatgcctgacacacagat

SEQ ID NO: 8337090 - DNA, 22 bp, Homo sapiens
tacaaatgaaccaactttgatg

SEQ ID NO: 8337091 - DNA, 22 bp, Homo sapiens
caggccctgctgctgagacctt

SEQ ID NO: 8337092 - DNA, 22 bp, Homo sapiens
caggccctgggcaggatcagcc

SEQ ID NO: 8337093 - DNA, 22 bp, Homo sapiens
tacagtttgttacattgttagt

SEQ ID NO: 8337094 - DNA, 22 bp, Homo sapiens
caggccctgggcaggcacagag

SEQ ID NO: 8337095 - DNA, 22 bp, Homo sapiens
tacatatgaactttataacttg

SEQ ID NO: 8337096 - DNA, 22 bp, Homo sapiens
tacatatgaactttataacttg

SEQ ID NO: 8337097 - DNA, 22 bp, Homo sapiens
tacatatgagttcgttctatgc

SEQ ID NO: 8337098 - DNA, 22 bp, Homo sapiens
tacatatgtaaacatgtataaa

SEQ ID NO: 8337099 - DNA, 22 bp, Homo sapiens
tacatatgtaaacatgtataaa

SEQ ID NO: 8337100 - DNA, 22 bp, Homo sapiens
tacatcatgaaagcatacatca

SEQ ID NO: 8337101 - DNA, 21 bp, Homo sapiens
tacatcatgctacttctctga

SEQ ID NO: 8337102 - DNA, 22 bp, Homo sapiens
tacatcatggcttcatgctgca

SEQ ID NO: 8337103 - DNA, 22 bp, Homo sapiens
caggcagagcaactggtccaga

SEQ ID NO: 8337104 - DNA, 22 bp, Homo sapiens
caggcagagccaatcgtggggt

SEQ ID NO: 8337105 - DNA, 22 bp, Homo sapiens
taatttaattccatggattcta

SEQ ID NO: 8337106 - DNA, 22 bp, Homo sapiens
caggcagactttgagaatgatg

SEQ ID NO: 8337107 - DNA, 22 bp, Homo sapiens
caggcagagcaactggtccaga

SEQ ID NO: 8337108 - DNA, 22 bp, Homo sapiens
caggcagaagaagtggaaggac

SEQ ID NO: 8337109 - DNA, 22 bp, Homo sapiens
caggcagaaggaagtaccaggc

SEQ ID NO: 8337110 - DNA, 17 bp, Homo sapiens
caggcagacatgtaagc

SEQ ID NO: 8337111 - DNA, 22 bp, Homo sapiens
caggcagaatgaccgacctcgc

SEQ ID NO: 8337112 - DNA, 22 bp, Homo sapiens
taacaagatgtcactcctgtcc

SEQ ID NO: 8337113 - DNA, 22 bp, Homo sapiens
taacaagaaatacattggttct

SEQ ID NO: 8337114 - DNA, 22 bp, Homo sapiens
taacaacatgcaatttaacctt

SEQ ID NO: 8337115 - DNA, 22 bp, Homo sapiens
taacagaagaaaacatattgga

SEQ ID NO: 8337116 - DNA, 22 bp, Homo sapiens
taacagaagatgaaacttcttt

SEQ ID NO: 8337117 - DNA, 22 bp, Homo sapiens
taacagaaatagaaatgagagt

SEQ ID NO: 8337118 - DNA, 22 bp, Homo sapiens
taacattcttaacttagaaaca

SEQ ID NO: 8337119 - DNA, 22 bp, Homo sapiens
taacattgttatgaatcaggtc

SEQ ID NO: 8337120 - DNA, 22 bp, Homo sapiens
taacattcctcaaagttttcag

SEQ ID NO: 8337121 - DNA, 22 bp, Homo sapiens
taacagaagttgttcattgtgg

SEQ ID NO: 8337122 - DNA, 22 bp, Homo sapiens
taacagaagttgttcattgtgg

SEQ ID NO: 8337123 - DNA, 22 bp, Homo sapiens
taacattaggtagacataagcc

SEQ ID NO: 8337124 - DNA, 22 bp, Homo sapiens
taactttatgacatgtcttgct

SEQ ID NO: 8337125 - DNA, 22 bp, Homo sapiens
taactttatgacatgtcttgct

SEQ ID NO: 8337126 - DNA, 21 bp, Homo sapiens
taacttttgtgcctatcttgt

SEQ ID NO: 8337127 - DNA, 21 bp, Homo sapiens
taacttttgtgcctatcttgt

SEQ ID NO: 8337128 - DNA, 22 bp, Homo sapiens
taacttttacttaccatctgag

SEQ ID NO: 8337129 - DNA, 22 bp, Homo sapiens
taacttttctaggtgtgataat

SEQ ID NO: 8337130 - DNA, 22 bp, Homo sapiens
taacttttctaggtgtgataat

SEQ ID NO: 8337131 - DNA, 22 bp, Homo sapiens
taacttgagctctcagtgctat

SEQ ID NO: 8337132 - DNA, 16 bp, Homo sapiens
taacatttttaaaagg

SEQ ID NO: 8337133 - DNA, 16 bp, Homo sapiens
taacatttttaaaagg

SEQ ID NO: 8337134 - DNA, 22 bp, Homo sapiens
taacatttaaatttttcacata

SEQ ID NO: 8337135 - DNA, 22 bp, Homo sapiens
taacatttaaatttttcacata

SEQ ID NO: 8337136 - DNA, 22 bp, Homo sapiens
taacatttagaaagtgtccatt

SEQ ID NO: 8337137 - DNA, 22 bp, Homo sapiens
taacatttcggtgacagtggga

SEQ ID NO: 8337138 - DNA, 22 bp, Homo sapiens
taacatttgctgtctcctatgt

SEQ ID NO: 8337139 - DNA, 22 bp, Homo sapiens
caggatgaggtagaggcagata

SEQ ID NO: 8337140 - DNA, 22 bp, Homo sapiens
caggatgaagggcaaaggcaag

SEQ ID NO: 8337141 - DNA, 22 bp, Homo sapiens
caggatcctggctgcatggacg

SEQ ID NO: 8337142 - DNA, 22 bp, Homo sapiens
caggatccccaggtcgccgtcc

SEQ ID NO: 8337143 - DNA, 22 bp, Homo sapiens
caggatccctggcctccgccca

SEQ ID NO: 8337144 - DNA, 20 bp, Homo sapiens
caggatgattggacacgatg

SEQ ID NO: 8337145 - DNA, 22 bp, Homo sapiens
caggcacagtggggtcctctct

SEQ ID NO: 8337146 - DNA, 22 bp, Homo sapiens
caggcacagagttattcattta

SEQ ID NO: 8337147 - DNA, 22 bp, Homo sapiens
caggatgttgctcccatgtccc

SEQ ID NO: 8337148 - DNA, 22 bp, Homo sapiens
caggcaacgtccttagagatgc

SEQ ID NO: 8337149 - DNA, 22 bp, Homo sapiens
caggcaagcaaggggtcttgaa

SEQ ID NO: 8337150 - DNA, 22 bp, Homo sapiens
caggcaagattagagatgagca

SEQ ID NO: 8337151 - DNA, 22 bp, Homo sapiens
caggcaaggactctggtaattt

SEQ ID NO: 8337152 - DNA, 22 bp, Homo sapiens
caggcaaggagctggctcaagt

SEQ ID NO: 8337153 - DNA, 22 bp, Homo sapiens
caggcaagttcatttccaggca

SEQ ID NO: 8337154 - DNA, 22 bp, Homo sapiens
caggcaaggaggcactgaggga

SEQ ID NO: 8337155 - DNA, 22 bp, Homo sapiens
taaggcacacagttgctgcatg

SEQ ID NO: 8337156 - DNA, 22 bp, Homo sapiens
taaggcacacagttgctgcatg

SEQ ID NO: 8337157 - DNA, 22 bp, Homo sapiens
taaggcacccgtgagctgccag

SEQ ID NO: 8337158 - DNA, 22 bp, Homo sapiens
taaggcacccgtgagctgccag

SEQ ID NO: 8337159 - DNA, 22 bp, Homo sapiens
taaggcaccataatatatttaa

SEQ ID NO: 8337160 - DNA, 22 bp, Homo sapiens
taaggcacccatgttcatacag

SEQ ID NO: 8337161 - DNA, 22 bp, Homo sapiens
taaggcacgcggtgaatgccaa

SEQ ID NO: 8337162 - DNA, 22 bp, Homo sapiens
taaggcacttcaatgtttagaa

SEQ ID NO: 8337163 - DNA, 22 bp, Homo sapiens
taaggcacgcggtgaatgccaa

SEQ ID NO: 8337164 - DNA, 22 bp, Homo sapiens
taaggcacctgtccaggctggg

SEQ ID NO: 8337165 - DNA, 22 bp, Homo sapiens
taaggcacctgtccaggctggg

SEQ ID NO: 8337166 - DNA, 22 bp, Homo sapiens
taaggcacgcataagagggggc

SEQ ID NO: 8337167 - DNA, 22 bp, Homo sapiens
taaggcacccttctgagtagag

SEQ ID NO: 8337168 - DNA, 22 bp, Homo sapiens
caggcactagcagaatgaggct

SEQ ID NO: 8337169 - DNA, 22 bp, Homo sapiens
taagcaaaggattttgatcttt

SEQ ID NO: 8337170 - DNA, 19 bp, Homo sapiens
taagacagattcctagagt

SEQ ID NO: 8337171 - DNA, 22 bp, Homo sapiens
taagatgtacaaccacttctct

SEQ ID NO: 8337172 - DNA, 22 bp, Homo sapiens
taagacacatgcgtacaagata

SEQ ID NO: 8337173 - DNA, 22 bp, Homo sapiens
cctctcatcattatcgctttgt

SEQ ID NO: 8337174 - DNA, 22 bp, Homo sapiens
cctctcatagtctgtatccttt

SEQ ID NO: 8337175 - DNA, 22 bp, Homo sapiens
cctctaaattgtttgaagttgg

SEQ ID NO: 8337176 - DNA, 22 bp, Homo sapiens
cctctaggatgtggctggagga

SEQ ID NO: 8337177 - DNA, 22 bp, Homo sapiens
cctctaggatgtggctggagga

SEQ ID NO: 8337178 - DNA, 22 bp, Homo sapiens
tggctgcctgaatgcaagacag

SEQ ID NO: 8337179 - DNA, 22 bp, Homo sapiens
cctctcccgggtgccgctgggc

SEQ ID NO: 8337180 - DNA, 22 bp, Homo sapiens
cctctctgtaagggtccctccc

SEQ ID NO: 8337181 - DNA, 20 bp, Homo sapiens
cctctctgccctgcaaggcc

SEQ ID NO: 8337182 - DNA, 22 bp, Homo sapiens
cctctctgtgtggcctctccat

SEQ ID NO: 8337183 - DNA, 22 bp, Homo sapiens
cctctgagaccagctctgcacc

SEQ ID NO: 8337184 - DNA, 22 bp, Homo sapiens
cctctgagaccagctctgcacc

SEQ ID NO: 8337185 - DNA, 22 bp, Homo sapiens
cctctgagagaaggccttcagc

SEQ ID NO: 8337186 - DNA, 22 bp, Homo sapiens
cctctctttcctacaccttgga

SEQ ID NO: 8337187 - DNA, 22 bp, Homo sapiens
cctctgaggtgagcccagctgg

SEQ ID NO: 8337188 - DNA, 22 bp, Homo sapiens
cctctgggggcttccttaccct

SEQ ID NO: 8337189 - DNA, 22 bp, Homo sapiens
cctctgggctgcctgcacgggt

SEQ ID NO: 8337190 - DNA, 22 bp, Homo sapiens
cctctgtcctggggagtggagc

SEQ ID NO: 8337191 - DNA, 22 bp, Homo sapiens
cctctgtgacaaacagtcctgg

SEQ ID NO: 8337192 - DNA, 22 bp, Homo sapiens
cctctgtgatttctgagccaat

SEQ ID NO: 8337193 - DNA, 22 bp, Homo sapiens
cctctgtgacttctaccttcac

SEQ ID NO: 8337194 - DNA, 22 bp, Homo sapiens
cctcggggcaccgcggcctgct

SEQ ID NO: 8337195 - DNA, 22 bp, Homo sapiens
cctcgtccacaatccttgcaca

SEQ ID NO: 8337196 - DNA, 23 bp, Homo sapiens
cctcctcatatctttgactagtg

SEQ ID NO: 8337197 - DNA, 22 bp, Homo sapiens
tggctgagggggcagttcagga

SEQ ID NO: 8337198 - DNA, 22 bp, Homo sapiens
cctccacaggagctgcagtgct

SEQ ID NO: 8337199 - DNA, 22 bp, Homo sapiens
cctccactgcttcccagctttg

SEQ ID NO: 8337200 - DNA, 22 bp, Homo sapiens
cctccagactttggccatcctc

SEQ ID NO: 8337201 - DNA, 22 bp, Homo sapiens
cctccagagggtttcccatgaa

SEQ ID NO: 8337202 - DNA, 22 bp, Homo sapiens
tggctcagtttgggggattgaa

SEQ ID NO: 8337203 - DNA, 22 bp, Homo sapiens
tggctcagtttctgcccagctg

SEQ ID NO: 8337204 - DNA, 22 bp, Homo sapiens
tggctcagtttctgcccagctg

SEQ ID NO: 8337205 - DNA, 22 bp, Homo sapiens
tggctcagtttcagtcctggtt

SEQ ID NO: 8337206 - DNA, 22 bp, Homo sapiens
tggctcagtttcagtcctggtt

SEQ ID NO: 8337207 - DNA, 22 bp, Homo sapiens
tggctcagtttagcagctcagt

SEQ ID NO: 8337208 - DNA, 21 bp, Homo sapiens
tggctcagttgctgggcacag

SEQ ID NO: 8337209 - DNA, 22 bp, Homo sapiens
tggctcagctgtcacagcctgg

SEQ ID NO: 8337210 - DNA, 22 bp, Homo sapiens
tggccctgctgtatcatctgct

SEQ ID NO: 8337211 - DNA, 22 bp, Homo sapiens
tggccctgctgtatcatctgct

SEQ ID NO: 8337212 - DNA, 22 bp, Homo sapiens
tggccctgctgggtcagagctg

SEQ ID NO: 8337213 - DNA, 22 bp, Homo sapiens
tggccctgctggccaaaggcta

SEQ ID NO: 8337214 - DNA, 22 bp, Homo sapiens
tggccctgctgggtcagagctg

SEQ ID NO: 8337215 - DNA, 22 bp, Homo sapiens
tggcccagtgcttatgctctga

SEQ ID NO: 8337216 - DNA, 22 bp, Homo sapiens
tggcccagcagttctgccccag

SEQ ID NO: 8337217 - DNA, 22 bp, Homo sapiens
tggcccagccctgctctagggc

SEQ ID NO: 8337218 - DNA, 20 bp, Homo sapiens
tggcccagtggggcagggtg

SEQ ID NO: 8337219 - DNA, 22 bp, Homo sapiens
tggccccatcaagggatgagtt

SEQ ID NO: 8337220 - DNA, 22 bp, Homo sapiens
tggccccattttacagatgaaa

SEQ ID NO: 8337221 - DNA, 22 bp, Homo sapiens
tggccctgccgccacgacgtct

SEQ ID NO: 8337222 - DNA, 22 bp, Homo sapiens
tggccctgctatgatcctgcaa

SEQ ID NO: 8337223 - DNA, 22 bp, Homo sapiens
tggccctgctatgatcctgcaa

SEQ ID NO: 8337224 - DNA, 22 bp, Homo sapiens
tggccctgctggccaaaggcta

SEQ ID NO: 8337225 - DNA, 22 bp, Homo sapiens
tggccctgctggacacgcctgc

SEQ ID NO: 8337226 - DNA, 22 bp, Homo sapiens
tggccctgctggacacgcctgc

SEQ ID NO: 8337227 - DNA, 22 bp, Homo sapiens
tggcccgaagatccgagggtca

SEQ ID NO: 8337228 - DNA, 22 bp, Homo sapiens
ccctccagctcaaagcaaccgg

SEQ ID NO: 8337229 - DNA, 22 bp, Homo sapiens
ccctccaggcctgtcatgttcc

SEQ ID NO: 8337230 - DNA, 22 bp, Homo sapiens
ccctccagggagccatgctggg

SEQ ID NO: 8337231 - DNA, 22 bp, Homo sapiens
ccctggactgttcagggcctga

SEQ ID NO: 8337232 - DNA, 22 bp, Homo sapiens
ccctcatgccagacagcatgca

SEQ ID NO: 8337233 - DNA, 19 bp, Homo sapiens
ccctcaggtctgagcagtc

SEQ ID NO: 8337234 - DNA, 22 bp, Homo sapiens
ccctccagagcttgacctgctg

SEQ ID NO: 8337235 - DNA, 22 bp, Homo sapiens
ccctccagccatggacccaggt

SEQ ID NO: 8337236 - DNA, 22 bp, Homo sapiens
ccctggagcatctctgctgtct

SEQ ID NO: 8337237 - DNA, 22 bp, Homo sapiens
tggagctgagagccaggctggc

SEQ ID NO: 8337238 - DNA, 22 bp, Homo sapiens
tggagctgagaagtggagctct

SEQ ID NO: 8337239 - DNA, 22 bp, Homo sapiens
tggagctgagaagtggagctct

SEQ ID NO: 8337240 - DNA, 22 bp, Homo sapiens
tggatctggcagaatatatgta

SEQ ID NO: 8337241 - DNA, 22 bp, Homo sapiens
tggatcctcttaatgtgtaagg

SEQ ID NO: 8337242 - DNA, 22 bp, Homo sapiens
tggatctcggcaatgcgggact

SEQ ID NO: 8337243 - DNA, 22 bp, Homo sapiens
tggatgagggctgagcactggg

SEQ ID NO: 8337244 - DNA, 22 bp, Homo sapiens
tggatgagattaaagtgaggtt

SEQ ID NO: 8337245 - DNA, 22 bp, Homo sapiens
tggatgagattaaagtgaggtt

SEQ ID NO: 8337246 - DNA, 22 bp, Homo sapiens
tggatcttcacaagagagggcg

SEQ ID NO: 8337247 - DNA, 22 bp, Homo sapiens
tggatgagtctgagattgggca

SEQ ID NO: 8337248 - DNA, 22 bp, Homo sapiens
ccctggcccctcactccgaggc

SEQ ID NO: 8337249 - DNA, 22 bp, Homo sapiens
ccctggcctacaggcccagaga

SEQ ID NO: 8337250 - DNA, 20 bp, Homo sapiens
ccctggcctgtttcatgccc

SEQ ID NO: 8337251 - DNA, 22 bp, Homo sapiens
cctatacaggcttctttacatg

SEQ ID NO: 8337252 - DNA, 22 bp, Homo sapiens
cctatgcctgtcactctgcgct

SEQ ID NO: 8337253 - DNA, 21 bp, Homo sapiens
cctagtgttaaaacagtttaa

SEQ ID NO: 8337254 - DNA, 22 bp, Homo sapiens
cctaggtcctatatgacctagc

SEQ ID NO: 8337255 - DNA, 22 bp, Homo sapiens
cctagtcttccgcgtccccacc

SEQ ID NO: 8337256 - DNA, 22 bp, Homo sapiens
cctaggccctaggcttccatca

SEQ ID NO: 8337257 - DNA, 22 bp, Homo sapiens
tggcagctttttgtttcaggct

SEQ ID NO: 8337258 - DNA, 22 bp, Homo sapiens
tggccagctgtaggttgtgcag

SEQ ID NO: 8337259 - DNA, 22 bp, Homo sapiens
tggccacacccacctagaggag

SEQ ID NO: 8337260 - DNA, 22 bp, Homo sapiens
tggcaagtggcttgtatacgcc

SEQ ID NO: 8337261 - DNA, 21 bp, Homo sapiens
tggcagcacccacaccctctg

SEQ ID NO: 8337262 - DNA, 20 bp, Homo sapiens
tgctgcagacagggccattg

SEQ ID NO: 8337263 - DNA, 22 bp, Homo sapiens
tgctgaccttgttctgtgagga

SEQ ID NO: 8337264 - DNA, 22 bp, Homo sapiens
tgctgagaagagggccgaccca

SEQ ID NO: 8337265 - DNA, 22 bp, Homo sapiens
tgctgagaggaaggtgcactgg

SEQ ID NO: 8337266 - DNA, 22 bp, Homo sapiens
tgctgagagccagggctggcat

SEQ ID NO: 8337267 - DNA, 22 bp, Homo sapiens
cccagggaggcccaggctctgc

SEQ ID NO: 8337268 - DNA, 22 bp, Homo sapiens
tgctctggagtggcttgtgcac

SEQ ID NO: 8337269 - DNA, 22 bp, Homo sapiens
tgctcccacactactcggaggc

SEQ ID NO: 8337270 - DNA, 22 bp, Homo sapiens
tgctcccagctcctgcagcaac

SEQ ID NO: 8337271 - DNA, 20 bp, Homo sapiens
tgctccatctaaagtgatta

SEQ ID NO: 8337272 - DNA, 22 bp, Homo sapiens
tgctccagtgcctgccccacag

SEQ ID NO: 8337273 - DNA, 22 bp, Homo sapiens
tgctccattctctagccagtgc

SEQ ID NO: 8337274 - DNA, 22 bp, Homo sapiens
tgctccagtgagctggccatcc

SEQ ID NO: 8337275 - DNA, 22 bp, Homo sapiens
tgctccaggtgtgcctctcatg

SEQ ID NO: 8337276 - DNA, 22 bp, Homo sapiens
tgctccagggctgccagaccct

SEQ ID NO: 8337277 - DNA, 22 bp, Homo sapiens
tgctccaggtgtgcctctcatg

SEQ ID NO: 8337278 - DNA, 23 bp, Homo sapiens
tgctccaggtacagaactccagg

SEQ ID NO: 8337279 - DNA, 22 bp, Homo sapiens
ccccagctcagtgcagggacat

SEQ ID NO: 8337280 - DNA, 22 bp, Homo sapiens
ccccagccagcaggacctctga

SEQ ID NO: 8337281 - DNA, 22 bp, Homo sapiens
ccccagcagcacctggggcagt

SEQ ID NO: 8337282 - DNA, 22 bp, Homo sapiens
tgctgcagaaattctgtgagga

SEQ ID NO: 8337283 - DNA, 22 bp, Homo sapiens
tgctgcagacgaagcccatgcc

SEQ ID NO: 8337284 - DNA, 22 bp, Homo sapiens
tgctgcagatcagctgagtcct

SEQ ID NO: 8337285 - DNA, 22 bp, Homo sapiens
tgctgcagctaaggtgaggtgc

SEQ ID NO: 8337286 - DNA, 22 bp, Homo sapiens
cccctccctgacctggttgggc

SEQ ID NO: 8337287 - DNA, 22 bp, Homo sapiens
cccctccctgacctggttgggc

SEQ ID NO: 8337288 - DNA, 22 bp, Homo sapiens
cccctcctgcagcacctttctt

SEQ ID NO: 8337289 - DNA, 22 bp, Homo sapiens
cccctcctggccacactgtcag

SEQ ID NO: 8337290 - DNA, 22 bp, Homo sapiens
cccctctgcaaatagccaggct

SEQ ID NO: 8337291 - DNA, 22 bp, Homo sapiens
cccctctggtcaaccagtcaca

SEQ ID NO: 8337292 - DNA, 22 bp, Homo sapiens
cccccactaagttgagggccct

SEQ ID NO: 8337293 - DNA, 22 bp, Homo sapiens
cccccaaggccaggctgagacc

SEQ ID NO: 8337294 - DNA, 22 bp, Homo sapiens
cccccaaagtttgcacggataa

SEQ ID NO: 8337295 - DNA, 22 bp, Homo sapiens
cccccatccatgtcaggagagg

SEQ ID NO: 8337296 - DNA, 22 bp, Homo sapiens
ccccctgcgcccggcacgtcat

SEQ ID NO: 8337297 - DNA, 22 bp, Homo sapiens
cccctaggaggcgatggtggaa

SEQ ID NO: 8337298 - DNA, 22 bp, Homo sapiens
cccagctcaagcagagagctaa

SEQ ID NO: 8337299 - DNA, 22 bp, Homo sapiens
tgcagggaggccccgcagccct

SEQ ID NO: 8337300 - DNA, 22 bp, Homo sapiens
cccagcctgtctttcccaatga

SEQ ID NO: 8337301 - DNA, 22 bp, Homo sapiens
cccagcctgtgacagccgtcct

SEQ ID NO: 8337302 - DNA, 22 bp, Homo sapiens
cccagcctactctgccatagca

SEQ ID NO: 8337303 - DNA, 20 bp, Homo sapiens
tctgtggcaggtggcgcttg

SEQ ID NO: 8337304 - DNA, 22 bp, Homo sapiens
tgcattaaatataatctgttga

SEQ ID NO: 8337305 - DNA, 22 bp, Homo sapiens
tgcatgttttataccaaagctt

SEQ ID NO: 8337306 - DNA, 22 bp, Homo sapiens
tgcatgtttgtgtctgagaact

SEQ ID NO: 8337307 - DNA, 19 bp, Homo sapiens
cccagcttgaccacctgct

SEQ ID NO: 8337308 - DNA, 23 bp, Homo sapiens
cccagctgcagacaagggagggt

SEQ ID NO: 8337309 - DNA, 17 bp, Homo sapiens
cccagctgcgtctgagg

SEQ ID NO: 8337310 - DNA, 18 bp, Homo sapiens
cccagctggtgggtcagt

SEQ ID NO: 8337311 - DNA, 22 bp, Homo sapiens
tgcattcagttggtcagctttt

SEQ ID NO: 8337312 - DNA, 22 bp, Homo sapiens
tgcattcatcatttgaaagccc

SEQ ID NO: 8337313 - DNA, 22 bp, Homo sapiens
tgcattcacgtgattggggtag

SEQ ID NO: 8337314 - DNA, 22 bp, Homo sapiens
tgcattcaatgtgccagggaaa

SEQ ID NO: 8337315 - DNA, 22 bp, Homo sapiens
tgcattcaatacagtaagaata

SEQ ID NO: 8337316 - DNA, 22 bp, Homo sapiens
tgcattcaaatctccaggctca

SEQ ID NO: 8337317 - DNA, 22 bp, Homo sapiens
tgcattcaaatcctgatcctgc

SEQ ID NO: 8337318 - DNA, 22 bp, Homo sapiens
tgcattatgctacccagaagct

SEQ ID NO: 8337319 - DNA, 22 bp, Homo sapiens
tgccacacattgtcaggttagt

SEQ ID NO: 8337320 - DNA, 22 bp, Homo sapiens
tgccacactcccctgctgcagt

SEQ ID NO: 8337321 - DNA, 22 bp, Homo sapiens
cccaggagggtggcctctgccc

SEQ ID NO: 8337322 - DNA, 22 bp, Homo sapiens
cccaggaggtggaggttgcagt

SEQ ID NO: 8337323 - DNA, 22 bp, Homo sapiens
cccaggaggtggaggctgcagt

SEQ ID NO: 8337324 - DNA, 22 bp, Homo sapiens
cccaggaggtggaggttgcagc

SEQ ID NO: 8337325 - DNA, 22 bp, Homo sapiens
cccaggaggttgaggctgcagt

SEQ ID NO: 8337326 - DNA, 22 bp, Homo sapiens
cccaggcagggacgtgctctgg

SEQ ID NO: 8337327 - DNA, 22 bp, Homo sapiens
tgtctgtaaggtgtttatgtta

SEQ ID NO: 8337328 - DNA, 22 bp, Homo sapiens
tgtctgtctgcaagccagaaag

SEQ ID NO: 8337329 - DNA, 22 bp, Homo sapiens
tgtctgtctgcacagctcatgg

SEQ ID NO: 8337330 - DNA, 22 bp, Homo sapiens
tgtctgtcagtataggcaggtg

SEQ ID NO: 8337331 - DNA, 22 bp, Homo sapiens
tgtctgtccatctgtctgggac

SEQ ID NO: 8337332 - DNA, 22 bp, Homo sapiens
tgtctgtcagcagtgggtcagg

SEQ ID NO: 8337333 - DNA, 23 bp, Homo sapiens
cctggctgacctgaaggtgtagt

SEQ ID NO: 8337334 - DNA, 22 bp, Homo sapiens
tgtgaggcctagacagcctggg

SEQ ID NO: 8337335 - DNA, 22 bp, Homo sapiens
tgtgaggcctctgcaggagcag

SEQ ID NO: 8337336 - DNA, 22 bp, Homo sapiens
tgtgaggatgtgagcgtgaacc

SEQ ID NO: 8337337 - DNA, 22 bp, Homo sapiens
tgtgaggctacctgccagggtc

SEQ ID NO: 8337338 - DNA, 22 bp, Homo sapiens
tgtgaggctggcaggggccagg

SEQ ID NO: 8337339 - DNA, 22 bp, Homo sapiens
tgtgaggcgaggccagtgagct

SEQ ID NO: 8337340 - DNA, 22 bp, Homo sapiens
tgtgaggacattggaggactca

SEQ ID NO: 8337341 - DNA, 22 bp, Homo sapiens
tgtctttagttttactgtctgg

SEQ ID NO: 8337342 - DNA, 22 bp, Homo sapiens
tgtctttgattgataggctatg

SEQ ID NO: 8337343 - DNA, 22 bp, Homo sapiens
tgtgaagcgtgtgcaggggaca

SEQ ID NO: 8337344 - DNA, 23 bp, Homo sapiens
tgtgaagccgctcataggggtcc

SEQ ID NO: 8337345 - DNA, 22 bp, Homo sapiens
tgtgaaggcagcagctctgtcc

SEQ ID NO: 8337346 - DNA, 22 bp, Homo sapiens
cctgggagagtctgtggtctcc

SEQ ID NO: 8337347 - DNA, 22 bp, Homo sapiens
cctgggagagccatctgtggcc

SEQ ID NO: 8337348 - DNA, 22 bp, Homo sapiens
cctgggagagtctgtggtctcc

SEQ ID NO: 8337349 - DNA, 21 bp, Homo sapiens
cctgggagaattgggtgtggc

SEQ ID NO: 8337350 - DNA, 22 bp, Homo sapiens
cctgggagagccatctgtggcc

SEQ ID NO: 8337351 - DNA, 22 bp, Homo sapiens
tgtgccaggcacttgcccaggc

SEQ ID NO: 8337352 - DNA, 21 bp, Homo sapiens
cctgggagatcagctgccttc

SEQ ID NO: 8337353 - DNA, 22 bp, Homo sapiens
cctggctgtcgttttgtgaaat

SEQ ID NO: 8337354 - DNA, 22 bp, Homo sapiens
cctggctgcattttgctggatg

SEQ ID NO: 8337355 - DNA, 22 bp, Homo sapiens
cctggggaagtcacttctcttt

SEQ ID NO: 8337356 - DNA, 22 bp, Homo sapiens
cctgggctttgctggcaaggcc

SEQ ID NO: 8337357 - DNA, 22 bp, Homo sapiens
tgtgtgggtggtaaggaaggcc

SEQ ID NO: 8337358 - DNA, 22 bp, Homo sapiens
cctgggcctcacccagctcttg

SEQ ID NO: 8337359 - DNA, 19 bp, Homo sapiens
cctgggcctccatcacccc

SEQ ID NO: 8337360 - DNA, 22 bp, Homo sapiens
cctggggctccagagcagcgga

SEQ ID NO: 8337361 - DNA, 22 bp, Homo sapiens
cctggggctcaagatggcgccg

SEQ ID NO: 8337362 - DNA, 22 bp, Homo sapiens
tgtgttcctgcctggctctggt

SEQ ID NO: 8337363 - DNA, 22 bp, Homo sapiens
cctgggtgatgtgctgccctcg

SEQ ID NO: 8337364 - DNA, 22 bp, Homo sapiens
cctgggtgaaatagtcctcaag

SEQ ID NO: 8337365 - DNA, 22 bp, Homo sapiens
cctgggtgaaatctctcctgca

SEQ ID NO: 8337366 - DNA, 22 bp, Homo sapiens
cctgggtcttcagtctgctggt

SEQ ID NO: 8337367 - DNA, 22 bp, Homo sapiens
cctgggtcccatcccagagtga

SEQ ID NO: 8337368 - DNA, 19 bp, Homo sapiens
cctgggtctgcagcattca

SEQ ID NO: 8337369 - DNA, 22 bp, Homo sapiens
tgtggggctgtcaggcaactgg

SEQ ID NO: 8337370 - DNA, 22 bp, Homo sapiens
tgtggggctccctggcagcctg

SEQ ID NO: 8337371 - DNA, 22 bp, Homo sapiens
tgtggggctccctggcagcctg

SEQ ID NO: 8337372 - DNA, 22 bp, Homo sapiens
tgtggggcctcgtgctagctgg

SEQ ID NO: 8337373 - DNA, 22 bp, Homo sapiens
tgtggggcctcgtgctagctgg

SEQ ID NO: 8337374 - DNA, 22 bp, Homo sapiens
tgtggggccaaagcccagccac

SEQ ID NO: 8337375 - DNA, 22 bp, Homo sapiens
tgtggggccaaagcccagccac

SEQ ID NO: 8337376 - DNA, 22 bp, Homo sapiens
tgtggggcagctagccggcctg

SEQ ID NO: 8337377 - DNA, 22 bp, Homo sapiens
tgtggggcagctagccggcctg

SEQ ID NO: 8337378 - DNA, 19 bp, Homo sapiens
tgtggggagtcagggggct

SEQ ID NO: 8337379 - DNA, 21 bp, Homo sapiens
tgtgtgggcatatctgctgca

SEQ ID NO: 8337380 - DNA, 22 bp, Homo sapiens
tgtggggcttacaaaggcagat

SEQ ID NO: 8337381 - DNA, 22 bp, Homo sapiens
tgtggggctgtggtgttcttct

SEQ ID NO: 8337382 - DNA, 22 bp, Homo sapiens
tgtggggctgtggtgttcttct

SEQ ID NO: 8337383 - DNA, 22 bp, Homo sapiens
cctgggaggcggaggttgcagg

SEQ ID NO: 8337384 - DNA, 19 bp, Homo sapiens
cctgggaggcggaggttgc

SEQ ID NO: 8337385 - DNA, 22 bp, Homo sapiens
cctgggcatctcatgcacctgc

SEQ ID NO: 8337386 - DNA, 22 bp, Homo sapiens
cctgggcaatatagtgaggccc

SEQ ID NO: 8337387 - DNA, 22 bp, Homo sapiens
cctgggaggcggaggttgcagt

SEQ ID NO: 8337388 - DNA, 22 bp, Homo sapiens
cctgggaggctgaggctgcagt

SEQ ID NO: 8337389 - DNA, 22 bp, Homo sapiens
cctgggcatcaacaagcagaga

SEQ ID NO: 8337390 - DNA, 22 bp, Homo sapiens
cctgggccaggcttgggaatgc

SEQ ID NO: 8337391 - DNA, 21 bp, Homo sapiens
cctgggccaaattccctggac

SEQ ID NO: 8337392 - DNA, 22 bp, Homo sapiens
cctgggccctcaccgccggtgg

SEQ ID NO: 8337393 - DNA, 22 bp, Homo sapiens
cctgggcctatcctagaaccaa

SEQ ID NO: 8337394 - DNA, 22 bp, Homo sapiens
cctgggaggcagaggttgcagt

SEQ ID NO: 8337395 - DNA, 22 bp, Homo sapiens
cctgggagctgtggaaaggctg

SEQ ID NO: 8337396 - DNA, 22 bp, Homo sapiens
tgtgggaaatgggagtggaaga

SEQ ID NO: 8337397 - DNA, 22 bp, Homo sapiens
tgtggcagggatactgaggcag

SEQ ID NO: 8337398 - DNA, 22 bp, Homo sapiens
tgtggcaggcattctgaggctg

SEQ ID NO: 8337399 - DNA, 20 bp, Homo sapiens
tgtggcaggatgagggcgga

SEQ ID NO: 8337400 - DNA, 20 bp, Homo sapiens
tgtggaaaaacagaagcaga

SEQ ID NO: 8337401 - DNA, 22 bp, Homo sapiens
tgtggcaggaagagcttctgag

SEQ ID NO: 8337402 - DNA, 22 bp, Homo sapiens
tgtggcagctggaggtggagaa

SEQ ID NO: 8337403 - DNA, 22 bp, Homo sapiens
tgtggcagctggaggtggagaa

SEQ ID NO: 8337404 - DNA, 22 bp, Homo sapiens
tgtattatcaagtaaatacatg

SEQ ID NO: 8337405 - DNA, 22 bp, Homo sapiens
tgtattatcaagtaaatacatg

SEQ ID NO: 8337406 - DNA, 21 bp, Homo sapiens
tgtcagctccctgtcctgtgt

SEQ ID NO: 8337407 - DNA, 22 bp, Homo sapiens
tgtattcaacttcttaaaaatt

SEQ ID NO: 8337408 - DNA, 22 bp, Homo sapiens
tgtcatgtgttcttaaatacat

SEQ ID NO: 8337409 - DNA, 22 bp, Homo sapiens
tgtcatgcttatgttacatact

SEQ ID NO: 8337410 - DNA, 22 bp, Homo sapiens
tgtcatgcttatgttacatact

SEQ ID NO: 8337411 - DNA, 22 bp, Homo sapiens
tgtcatgcccaggagcaaggta

SEQ ID NO: 8337412 - DNA, 22 bp, Homo sapiens
tgtcatgccaggaaatagtccc

SEQ ID NO: 8337413 - DNA, 22 bp, Homo sapiens
tgtcatgccatttaaaatgttt

SEQ ID NO: 8337414 - DNA, 20 bp, Homo sapiens
tgtcatgcattagatgaaga

SEQ ID NO: 8337415 - DNA, 22 bp, Homo sapiens
tgtcatgccaccgtttcccaga

SEQ ID NO: 8337416 - DNA, 22 bp, Homo sapiens
tgtcaggagccaccagcactcc

SEQ ID NO: 8337417 - DNA, 22 bp, Homo sapiens
tgtaaactgagggtagctgatt

SEQ ID NO: 8337418 - DNA, 22 bp, Homo sapiens
cctggagaggcgctgcagagga

SEQ ID NO: 8337419 - DNA, 22 bp, Homo sapiens
cctggagcacagcccagtccca

SEQ ID NO: 8337420 - DNA, 22 bp, Homo sapiens
cctggagcacagcccagtccca

SEQ ID NO: 8337421 - DNA, 22 bp, Homo sapiens
cctggagacctgatggcagcgg

SEQ ID NO: 8337422 - DNA, 22 bp, Homo sapiens
cctggagagctcgggccaggca

SEQ ID NO: 8337423 - DNA, 22 bp, Homo sapiens
cctggaaagagaatgaatgagc

SEQ ID NO: 8337424 - DNA, 22 bp, Homo sapiens
cctggaaacacatgatgatgaa

SEQ ID NO: 8337425 - DNA, 22 bp, Homo sapiens
cctggagacccacttctgccaa

SEQ ID NO: 8337426 - DNA, 22 bp, Homo sapiens
tggtggcttctgaggatggcga

SEQ ID NO: 8337427 - DNA, 22 bp, Homo sapiens
tggtgctgccaggctcctgcca

SEQ ID NO: 8337428 - DNA, 21 bp, Homo sapiens
cctctgtgctaaagggctccc

SEQ ID NO: 8337429 - DNA, 22 bp, Homo sapiens
cctctgtgctttgtccagcctc

SEQ ID NO: 8337430 - DNA, 22 bp, Homo sapiens
cctctgtgcctcagtttcatgt

SEQ ID NO: 8337431 - DNA, 18 bp, Homo sapiens
tggtccagttcagatata

SEQ ID NO: 8337432 - DNA, 22 bp, Homo sapiens
tggtccgggatggacgcgggct

SEQ ID NO: 8337433 - DNA, 18 bp, Homo sapiens
cctgccagtctggagcag

SEQ ID NO: 8337434 - DNA, 22 bp, Homo sapiens
tggtcttctttgttgctattat

SEQ ID NO: 8337435 - DNA, 19 bp, Homo sapiens
tggtgcgcccggcccttct

SEQ ID NO: 8337436 - DNA, 22 bp, Homo sapiens
tggtgctcttatgttttcatca

SEQ ID NO: 8337437 - DNA, 22 bp, Homo sapiens
tggtgctcccaagattgttcta

SEQ ID NO: 8337438 - DNA, 22 bp, Homo sapiens
tggtgctccctggagttgtgca

SEQ ID NO: 8337439 - DNA, 22 bp, Homo sapiens
tgtcctcatcttttccagaaat

SEQ ID NO: 8337440 - DNA, 22 bp, Homo sapiens
tgtcctcatcctccagtctgtc

SEQ ID NO: 8337441 - DNA, 22 bp, Homo sapiens
cctggcagactgtgagggcagg

SEQ ID NO: 8337442 - DNA, 18 bp, Homo sapiens
cctggcagccatgcgcgc

SEQ ID NO: 8337443 - DNA, 22 bp, Homo sapiens
cctggcagtcaggggagtcctt

SEQ ID NO: 8337444 - DNA, 22 bp, Homo sapiens
cctggctctctgcagatcctgg

SEQ ID NO: 8337445 - DNA, 22 bp, Homo sapiens
cctggctccctgcacagggctc

SEQ ID NO: 8337446 - DNA, 22 bp, Homo sapiens
cctggctccggttcaagggaaa

SEQ ID NO: 8337447 - DNA, 22 bp, Homo sapiens
cctggcctggcactccctctgc

SEQ ID NO: 8337448 - DNA, 22 bp, Homo sapiens
cctggcctcctggccttctcat

SEQ ID NO: 8337449 - DNA, 19 bp, Homo sapiens
cctggccctgctgcgcggg

SEQ ID NO: 8337450 - DNA, 22 bp, Homo sapiens
cctggccctggaatagggcagg

SEQ ID NO: 8337451 - DNA, 22 bp, Homo sapiens
tgtcctgcaactgaaggagaag

SEQ ID NO: 8337452 - DNA, 22 bp, Homo sapiens
tgtcctcttccagtgctccttc

SEQ ID NO: 8337453 - DNA, 22 bp, Homo sapiens
tgtcctctaattggcctcttgc

SEQ ID NO: 8337454 - DNA, 22 bp, Homo sapiens
tgtcctctccaacagcctctgt

SEQ ID NO: 8337455 - DNA, 22 bp, Homo sapiens
tgtctcagaatggctcataata

SEQ ID NO: 8337456 - DNA, 22 bp, Homo sapiens
tgtcctggccaaggccttgctt

SEQ ID NO: 8337457 - DNA, 22 bp, Homo sapiens
tgtctcagaggcaggaagagcc

SEQ ID NO: 8337458 - DNA, 22 bp, Homo sapiens
tgtctcagagtatccctgaact

SEQ ID NO: 8337459 - DNA, 22 bp, Homo sapiens
tgtctcagatacgccatcaagg

SEQ ID NO: 8337460 - DNA, 22 bp, Homo sapiens
tgtctcagggcagcagcagggg

SEQ ID NO: 8337461 - DNA, 22 bp, Homo sapiens
tgtctcaggggcattgaaataa

SEQ ID NO: 8337462 - DNA, 22 bp, Homo sapiens
tgtctcaggcccaagccagtaa

SEQ ID NO: 8337463 - DNA, 18 bp, Homo sapiens
tgtctcaggctgaaacag

SEQ ID NO: 8337464 - DNA, 19 bp, Homo sapiens
tgtctcagtgtcccttcct

SEQ ID NO: 8337465 - DNA, 22 bp, Homo sapiens
tgtctcagttcccttctctgga

SEQ ID NO: 8337466 - DNA, 22 bp, Homo sapiens
tgtctcagtacactccgatgtt

SEQ ID NO: 8337467 - DNA, 22 bp, Homo sapiens
tgtctcagtatacgaaacactt

SEQ ID NO: 8337468 - DNA, 22 bp, Homo sapiens
tgtctctggcccatgagcagag

SEQ ID NO: 8337469 - DNA, 22 bp, Homo sapiens
tgtctctggctgcagcctgttc

SEQ ID NO: 8337470 - DNA, 22 bp, Homo sapiens
tgtctctgtgagatctgacgat

SEQ ID NO: 8337471 - DNA, 22 bp, Homo sapiens
tgtctcttcagcccatggcttc

SEQ ID NO: 8337472 - DNA, 22 bp, Homo sapiens
tgtctcttctgcctccagctgt

SEQ ID NO: 8337473 - DNA, 22 bp, Homo sapiens
tgtctcttggattgcttgctct

SEQ ID NO: 8337474 - DNA, 22 bp, Homo sapiens
tgtctcttggctctatcactta

SEQ ID NO: 8337475 - DNA, 22 bp, Homo sapiens
cctggcccacatggcttctccc

SEQ ID NO: 8337476 - DNA, 22 bp, Homo sapiens
cctggcccacatggcttctccc

SEQ ID NO: 8337477 - DNA, 22 bp, Homo sapiens
tgtctcttgagctgcctgatgc

SEQ ID NO: 8337478 - DNA, 22 bp, Homo sapiens
ctgccatcctcaccagagcagc

SEQ ID NO: 8337479 - DNA, 22 bp, Homo sapiens
ctgccgttgtgaagctcttaga

SEQ ID NO: 8337480 - DNA, 22 bp, Homo sapiens
ctgcctagaaaaccaggctcct

SEQ ID NO: 8337481 - DNA, 22 bp, Homo sapiens
ctgcctccaggctcaccttgac

SEQ ID NO: 8337482 - DNA, 22 bp, Homo sapiens
ctgcctcatgctgcctgcagcc

SEQ ID NO: 8337483 - DNA, 22 bp, Homo sapiens
ctgcctcatgctgcctgcagcc

SEQ ID NO: 8337484 - DNA, 22 bp, Homo sapiens
ctgcctcatgctgcctgcagcc

SEQ ID NO: 8337485 - DNA, 22 bp, Homo sapiens
ctgccaggcctggggtgctgtc

SEQ ID NO: 8337486 - DNA, 22 bp, Homo sapiens
ctgcagagctaggctgagtgaa

SEQ ID NO: 8337487 - DNA, 22 bp, Homo sapiens
ctgcagaggcctcgcctcctct

SEQ ID NO: 8337488 - DNA, 22 bp, Homo sapiens
ctgcagaggtcttgctgatggt

SEQ ID NO: 8337489 - DNA, 22 bp, Homo sapiens
ctgcagcagggcttgcccacct

SEQ ID NO: 8337490 - DNA, 22 bp, Homo sapiens
ctgatcttaagtaacattattt

SEQ ID NO: 8337491 - DNA, 22 bp, Homo sapiens
ctgaggtttgtccatccttggt

SEQ ID NO: 8337492 - DNA, 22 bp, Homo sapiens
ctgattaactgaactgaattta

SEQ ID NO: 8337493 - DNA, 22 bp, Homo sapiens
ctgcagaacaattcctgctgtt

SEQ ID NO: 8337494 - DNA, 22 bp, Homo sapiens
ctgatttcatgctatcaatgtt

SEQ ID NO: 8337495 - DNA, 22 bp, Homo sapiens
ctgattttcaaaatgtgttaaa

SEQ ID NO: 8337496 - DNA, 22 bp, Homo sapiens
ctgatttctacatggaccacat

SEQ ID NO: 8337497 - DNA, 22 bp, Homo sapiens
ctgatttctcagttctaggaag

SEQ ID NO: 8337498 - DNA, 22 bp, Homo sapiens
ctgattcctgattcatgctctt

SEQ ID NO: 8337499 - DNA, 22 bp, Homo sapiens
ctgattctccttgtctggtata

SEQ ID NO: 8337500 - DNA, 22 bp, Homo sapiens
ctgattccagagtctgtgttct

SEQ ID NO: 8337501 - DNA, 22 bp, Homo sapiens
ctgattccaaagccaaagctat

SEQ ID NO: 8337502 - DNA, 22 bp, Homo sapiens
ctgagagatcaagccacaggat

SEQ ID NO: 8337503 - DNA, 22 bp, Homo sapiens
ctgaggagaaatgggatggttc

SEQ ID NO: 8337504 - DNA, 22 bp, Homo sapiens
ctgaggagctgaaggccctcca

SEQ ID NO: 8337505 - DNA, 22 bp, Homo sapiens
ctgaggagtgggtgggcagtga

SEQ ID NO: 8337506 - DNA, 22 bp, Homo sapiens
ttttgttttcttagaaacctgg

SEQ ID NO: 8337507 - DNA, 22 bp, Homo sapiens
tttttaagagtctggaaatagt

SEQ ID NO: 8337508 - DNA, 22 bp, Homo sapiens
ctcttttacaccaaaaggccta

SEQ ID NO: 8337509 - DNA, 22 bp, Homo sapiens
ctcttttcaaacctgtttatgg

SEQ ID NO: 8337510 - DNA, 22 bp, Homo sapiens
ctctttgtagcctttgcatatt

SEQ ID NO: 8337511 - DNA, 22 bp, Homo sapiens
ctcttttaattgtcataacaac

SEQ ID NO: 8337512 - DNA, 22 bp, Homo sapiens
ctctggtcttcaaggccacctc

SEQ ID NO: 8337513 - DNA, 22 bp, Homo sapiens
ctgaagagaaatgtacacatgg

SEQ ID NO: 8337514 - DNA, 22 bp, Homo sapiens
ctgaagaagtctctaggctatt

SEQ ID NO: 8337515 - DNA, 22 bp, Homo sapiens
ctgaacttattgagtgcttgct

SEQ ID NO: 8337516 - DNA, 22 bp, Homo sapiens
ctgagaaagtttatgtttattt

SEQ ID NO: 8337517 - DNA, 22 bp, Homo sapiens
ctgagaaatacccaagtctggt

SEQ ID NO: 8337518 - DNA, 22 bp, Homo sapiens
ctgagaaatttattggttggaa

SEQ ID NO: 8337519 - DNA, 22 bp, Homo sapiens
ctgactgtgagagcaggaatgg

SEQ ID NO: 8337520 - DNA, 22 bp, Homo sapiens
ctgaagaggacgcagcagcaag

SEQ ID NO: 8337521 - DNA, 22 bp, Homo sapiens
tttgtcttggccaaggttctga

SEQ ID NO: 8337522 - DNA, 22 bp, Homo sapiens
tttgtgaacttaggcaattagg

SEQ ID NO: 8337523 - DNA, 19 bp, Homo sapiens
tttgtgaagaaaatgatgc

SEQ ID NO: 8337524 - DNA, 22 bp, Homo sapiens
tttgtgaataggttggcttcca

SEQ ID NO: 8337525 - DNA, 22 bp, Homo sapiens
ctctggctggcattgctggact

SEQ ID NO: 8337526 - DNA, 22 bp, Homo sapiens
ctctggcttctaccttgcagtt

SEQ ID NO: 8337527 - DNA, 22 bp, Homo sapiens
ctctggcttctaccttgcagtt

SEQ ID NO: 8337528 - DNA, 22 bp, Homo sapiens
ctctggcttctaccttgcagtt

SEQ ID NO: 8337529 - DNA, 23 bp, Homo sapiens
ttttattgatatgtagctgttgt

SEQ ID NO: 8337530 - DNA, 22 bp, Homo sapiens
ttttattctcaagacaatggga

SEQ ID NO: 8337531 - DNA, 22 bp, Homo sapiens
ttttattcaaatagttcacact

SEQ ID NO: 8337532 - DNA, 22 bp, Homo sapiens
ttttagttgctcaggtattctc

SEQ ID NO: 8337533 - DNA, 22 bp, Homo sapiens
ctctgggccaccgctggtgtat

SEQ ID NO: 8337534 - DNA, 22 bp, Homo sapiens
ctctgggatgaggcctaggcac

SEQ ID NO: 8337535 - DNA, 22 bp, Homo sapiens
ctctgggcaggaccagtggacc

SEQ ID NO: 8337536 - DNA, 22 bp, Homo sapiens
ctctgggcaggaccagtggacc

SEQ ID NO: 8337537 - DNA, 17 bp, Homo sapiens
ctgcctggagtcccatc

SEQ ID NO: 8337538 - DNA, 22 bp, Homo sapiens
ctgcctgctcaccagggctctg

SEQ ID NO: 8337539 - DNA, 22 bp, Homo sapiens
ctgcctggaaggagcaagggga

SEQ ID NO: 8337540 - DNA, 22 bp, Homo sapiens
ctgcctggaatgccagcttctc

SEQ ID NO: 8337541 - DNA, 22 bp, Homo sapiens
ctgcctggaccggcagccctcc

SEQ ID NO: 8337542 - DNA, 22 bp, Homo sapiens
ctgcctggagcattctgaaggt

SEQ ID NO: 8337543 - DNA, 22 bp, Homo sapiens
ctgcctgggccatgcccagtcc

SEQ ID NO: 8337544 - DNA, 22 bp, Homo sapiens
ctgcctgggccatgcccagtcc

SEQ ID NO: 8337545 - DNA, 22 bp, Homo sapiens
ctgctttatattgagcttgaaa

SEQ ID NO: 8337546 - DNA, 21 bp, Homo sapiens
ctgctttacttcagaggatct

SEQ ID NO: 8337547 - DNA, 22 bp, Homo sapiens
ctggacagtgctgcttgagatg

SEQ ID NO: 8337548 - DNA, 22 bp, Homo sapiens
ctgctttgtggaatcacactgg

SEQ ID NO: 8337549 - DNA, 17 bp, Homo sapiens
ctgctttgtgcaacgct

SEQ ID NO: 8337550 - DNA, 22 bp, Homo sapiens
ctgctttgtaaaatagacataa

SEQ ID NO: 8337551 - DNA, 22 bp, Homo sapiens
ctgctttggctcagtgacatca

SEQ ID NO: 8337552 - DNA, 22 bp, Homo sapiens
ctgctttgaaaataaacttgtc

SEQ ID NO: 8337553 - DNA, 22 bp, Homo sapiens
ctgctttgcatagctgccagag

SEQ ID NO: 8337554 - DNA, 22 bp, Homo sapiens
ctgctttgaggggctctgtata

SEQ ID NO: 8337555 - DNA, 22 bp, Homo sapiens
ctgctttgattagaagagtaca

SEQ ID NO: 8337556 - DNA, 22 bp, Homo sapiens
ctggaaaatgaagaagcagagg

SEQ ID NO: 8337557 - DNA, 20 bp, Homo sapiens
ctggaaaccctgctgatggt

SEQ ID NO: 8337558 - DNA, 22 bp, Homo sapiens
ctggaaagatttacacggggaa

SEQ ID NO: 8337559 - DNA, 22 bp, Homo sapiens
ctggaaagctgcaggacccaga

SEQ ID NO: 8337560 - DNA, 22 bp, Homo sapiens
ctggaaagacagagggcatggg

SEQ ID NO: 8337561 - DNA, 22 bp, Homo sapiens
ctggaaagagatggcagggttt

SEQ ID NO: 8337562 - DNA, 22 bp, Homo sapiens
ctggaccctgtttccctaggtc

SEQ ID NO: 8337563 - DNA, 22 bp, Homo sapiens
ctggagctcttctgagtgtgct

SEQ ID NO: 8337564 - DNA, 22 bp, Homo sapiens
ctggagctcttctgagtgtgct

SEQ ID NO: 8337565 - DNA, 22 bp, Homo sapiens
ctggaggaccacagaagctggt

SEQ ID NO: 8337566 - DNA, 22 bp, Homo sapiens
ctggaggcaaagcagaggcatg

SEQ ID NO: 8337567 - DNA, 22 bp, Homo sapiens
ctggaggcaaagcagaggcatg

SEQ ID NO: 8337568 - DNA, 22 bp, Homo sapiens
ctggaggagcatggactggagt

SEQ ID NO: 8337569 - DNA, 22 bp, Homo sapiens
ctggaggacccctgcctggaag

SEQ ID NO: 8337570 - DNA, 22 bp, Homo sapiens
ctggaggaccacagaagctggt

SEQ ID NO: 8337571 - DNA, 21 bp, Homo sapiens
ctggaggcaggtggtgccagg

SEQ ID NO: 8337572 - DNA, 22 bp, Homo sapiens
ctggaggcagttgccccagtca

SEQ ID NO: 8337573 - DNA, 22 bp, Homo sapiens
ctggaggcacccttagagaggc

SEQ ID NO: 8337574 - DNA, 22 bp, Homo sapiens
ctggaggctgagttgggtctcc

SEQ ID NO: 8337575 - DNA, 22 bp, Homo sapiens
ctggaggctggcttcccctggc

SEQ ID NO: 8337576 - DNA, 22 bp, Homo sapiens
ctggaggctggcttcccctggc

SEQ ID NO: 8337577 - DNA, 22 bp, Homo sapiens
ctggaggctggcttcccctggc

SEQ ID NO: 8337578 - DNA, 22 bp, Homo sapiens
ctggaggctgagttgggtctcc

SEQ ID NO: 8337579 - DNA, 22 bp, Homo sapiens
ctggaggcagttgccccagtca

SEQ ID NO: 8337580 - DNA, 20 bp, Homo sapiens
ctggagtgtagcagtggctg

SEQ ID NO: 8337581 - DNA, 22 bp, Homo sapiens
ctggagttttggaaaaatgctt

SEQ ID NO: 8337582 - DNA, 22 bp, Homo sapiens
ctggagttcgactgagttgaat

SEQ ID NO: 8337583 - DNA, 22 bp, Homo sapiens
ctggaggtgggggcaagagtgt

SEQ ID NO: 8337584 - DNA, 22 bp, Homo sapiens
ctggaggtgcttcgctggccac

SEQ ID NO: 8337585 - DNA, 22 bp, Homo sapiens
ctggaggtgcctagatgagctc

SEQ ID NO: 8337586 - DNA, 22 bp, Homo sapiens
ctggaggtgcctagatgagctc

SEQ ID NO: 8337587 - DNA, 22 bp, Homo sapiens
ctggaggttgggtccaggccag

SEQ ID NO: 8337588 - DNA, 22 bp, Homo sapiens
ctggagtaagttaagatgttcc

SEQ ID NO: 8337589 - DNA, 22 bp, Homo sapiens
ctggagggcttctgcaggttac

SEQ ID NO: 8337590 - DNA, 22 bp, Homo sapiens
ctggaggggccatccacagtct

SEQ ID NO: 8337591 - DNA, 22 bp, Homo sapiens
ctggaggggccatccacagtct

SEQ ID NO: 8337592 - DNA, 22 bp, Homo sapiens
ctggagggggaaatgttcattg

SEQ ID NO: 8337593 - DNA, 22 bp, Homo sapiens
ctggaggggctggcatggtagc

SEQ ID NO: 8337594 - DNA, 22 bp, Homo sapiens
ctggaggtcatgtaatatggaa

SEQ ID NO: 8337595 - DNA, 22 bp, Homo sapiens
ctggaggtagatggtggtaatg

SEQ ID NO: 8337596 - DNA, 21 bp, Homo sapiens
ctggagggtagagttgggctg

SEQ ID NO: 8337597 - DNA, 21 bp, Homo sapiens
ctggagggtagagttgggctg

SEQ ID NO: 8337598 - DNA, 22 bp, Homo sapiens
ctggatggtcccatgagcagct

SEQ ID NO: 8337599 - DNA, 22 bp, Homo sapiens
ctggatgcttcctctctgctag

SEQ ID NO: 8337600 - DNA, 20 bp, Homo sapiens
ctggatgctaaaacacacac

SEQ ID NO: 8337601 - DNA, 22 bp, Homo sapiens
ctggatgctgagaggtaccaag

SEQ ID NO: 8337602 - DNA, 22 bp, Homo sapiens
ctggatgcttcctctctgctag

SEQ ID NO: 8337603 - DNA, 22 bp, Homo sapiens
ctggcagacttaccatcagaca

SEQ ID NO: 8337604 - DNA, 22 bp, Homo sapiens
ctggccacccatgcctccctga

SEQ ID NO: 8337605 - DNA, 22 bp, Homo sapiens
ctggccacccatgcctccctga

SEQ ID NO: 8337606 - DNA, 23 bp, Homo sapiens
ctggccaccatctttctggcttc

SEQ ID NO: 8337607 - DNA, 22 bp, Homo sapiens
ctggcagtttgccaggagctcg

SEQ ID NO: 8337608 - DNA, 22 bp, Homo sapiens
ctggcagttggcattggcatct

SEQ ID NO: 8337609 - DNA, 22 bp, Homo sapiens
ctggcagtgacattgcaggtgc

SEQ ID NO: 8337610 - DNA, 22 bp, Homo sapiens
ctggcagcattaacagagagca

SEQ ID NO: 8337611 - DNA, 22 bp, Homo sapiens
ctggcccttctcttgcttcctg

SEQ ID NO: 8337612 - DNA, 22 bp, Homo sapiens
ctggcccttctcttgcttcctg

SEQ ID NO: 8337613 - DNA, 22 bp, Homo sapiens
ctggccctgtggcctaaggact

SEQ ID NO: 8337614 - DNA, 22 bp, Homo sapiens
ctggcctgagcacagcggctgc

SEQ ID NO: 8337615 - DNA, 22 bp, Homo sapiens
ctggctccctctccctgagtca

SEQ ID NO: 8337616 - DNA, 23 bp, Homo sapiens
ctggctccgaagactccaggatc

SEQ ID NO: 8337617 - DNA, 22 bp, Homo sapiens
ctggctccctggacatggggcc

SEQ ID NO: 8337618 - DNA, 22 bp, Homo sapiens
ctggctcctccaaggcctggag

SEQ ID NO: 8337619 - DNA, 22 bp, Homo sapiens
ctggctcctcaggactgcggga

SEQ ID NO: 8337620 - DNA, 22 bp, Homo sapiens
ctggctccactccctgcctgac

SEQ ID NO: 8337621 - DNA, 22 bp, Homo sapiens
ctggctccaccccaggaggatg

SEQ ID NO: 8337622 - DNA, 22 bp, Homo sapiens
ctggctccaggtcatgcactca

SEQ ID NO: 8337623 - DNA, 22 bp, Homo sapiens
ctggctccaggtcatgcactca

SEQ ID NO: 8337624 - DNA, 22 bp, Homo sapiens
ctggctcctgaggcttggcccc

SEQ ID NO: 8337625 - DNA, 22 bp, Homo sapiens
ctctccagttacctaggtctga

SEQ ID NO: 8337626 - DNA, 22 bp, Homo sapiens
ctctcccccacagcagccttct

SEQ ID NO: 8337627 - DNA, 22 bp, Homo sapiens
ctctccccggtacgagcggccg

SEQ ID NO: 8337628 - DNA, 22 bp, Homo sapiens
ctctcctccaacagccctgccg

SEQ ID NO: 8337629 - DNA, 22 bp, Homo sapiens
ctctcctccaacagccctgccg

SEQ ID NO: 8337630 - DNA, 22 bp, Homo sapiens
ctctcccttgggtgggctttgg

SEQ ID NO: 8337631 - DNA, 22 bp, Homo sapiens
ctctccagcagatgtagtctgt

SEQ ID NO: 8337632 - DNA, 22 bp, Homo sapiens
ctcctgggctgtcggcgctctg

SEQ ID NO: 8337633 - DNA, 22 bp, Homo sapiens
ctcctgggctgtcggcgctctg

SEQ ID NO: 8337634 - DNA, 18 bp, Homo sapiens
ctcctgggctgcagatgc

SEQ ID NO: 8337635 - DNA, 18 bp, Homo sapiens
ctcctgggctgcagatgc

SEQ ID NO: 8337636 - DNA, 22 bp, Homo sapiens
ctctccactcagcgtcatgtcc

SEQ ID NO: 8337637 - DNA, 22 bp, Homo sapiens
ctcctgggctatgtctgcttgg

SEQ ID NO: 8337638 - DNA, 22 bp, Homo sapiens
ctcctctccatcagcgccaccc

SEQ ID NO: 8337639 - DNA, 22 bp, Homo sapiens
ctcctcccaattgccaagtgct

SEQ ID NO: 8337640 - DNA, 22 bp, Homo sapiens
tttagacacactttgtatattt

SEQ ID NO: 8337641 - DNA, 22 bp, Homo sapiens
tttagacatagctgaaatcatt

SEQ ID NO: 8337642 - DNA, 22 bp, Homo sapiens
tttagacaggggcaaaataagg

SEQ ID NO: 8337643 - DNA, 22 bp, Homo sapiens
ctcctggctcgcccccagctga

SEQ ID NO: 8337644 - DNA, 22 bp, Homo sapiens
tttacatagtgctttcccacta

SEQ ID NO: 8337645 - DNA, 22 bp, Homo sapiens
tttacatttccctctgtcagtt

SEQ ID NO: 8337646 - DNA, 22 bp, Homo sapiens
tttacatttccctctgtcagtt

SEQ ID NO: 8337647 - DNA, 17 bp, Homo sapiens
tttacattgctcgcagt

SEQ ID NO: 8337648 - DNA, 22 bp, Homo sapiens
tttaaaaccaaagaaagcctct

SEQ ID NO: 8337649 - DNA, 22 bp, Homo sapiens
tttaaaaccaaagaaagcctct

SEQ ID NO: 8337650 - DNA, 22 bp, Homo sapiens
ctccagggcagcatggcagtgg

SEQ ID NO: 8337651 - DNA, 20 bp, Homo sapiens
ctccaggggaagagccttcc

SEQ ID NO: 8337652 - DNA, 22 bp, Homo sapiens
ctccagggatgagacagagtag

SEQ ID NO: 8337653 - DNA, 22 bp, Homo sapiens
ttgtatttgattgtcatatcgt

SEQ ID NO: 8337654 - DNA, 22 bp, Homo sapiens
ttgtatttctccactttctgtt

SEQ ID NO: 8337655 - DNA, 22 bp, Homo sapiens
ttgtatttctccactttctgtt

SEQ ID NO: 8337656 - DNA, 22 bp, Homo sapiens
ttggtacaaaaccatgaaagaa

SEQ ID NO: 8337657 - DNA, 22 bp, Homo sapiens
ctccagggagctgtggaggttt

SEQ ID NO: 8337658 - DNA, 22 bp, Homo sapiens
ttggtagaagaatatgagtatt

SEQ ID NO: 8337659 - DNA, 22 bp, Homo sapiens
ttgtattttgttatgctactgc

SEQ ID NO: 8337660 - DNA, 22 bp, Homo sapiens
ctccagtgcacccagaggattt

SEQ ID NO: 8337661 - DNA, 22 bp, Homo sapiens
ctccagtgagcgcggggcatgg

SEQ ID NO: 8337662 - DNA, 22 bp, Homo sapiens
ctccagtatctgtaggaaaagg

SEQ ID NO: 8337663 - DNA, 22 bp, Homo sapiens
ctcataaagtgagaatatgacc

SEQ ID NO: 8337664 - DNA, 22 bp, Homo sapiens
ctcataaacattattcattatt

SEQ ID NO: 8337665 - DNA, 22 bp, Homo sapiens
ctcataaacaattctttgaggt

SEQ ID NO: 8337666 - DNA, 22 bp, Homo sapiens
ctcataaaagctttgtttacac

SEQ ID NO: 8337667 - DNA, 22 bp, Homo sapiens
ttgggcaaagtgtttctggagc

SEQ ID NO: 8337668 - DNA, 22 bp, Homo sapiens
ttgggagttcctactgcggttt

SEQ ID NO: 8337669 - DNA, 22 bp, Homo sapiens
ttgggcagaggccaggaggatg

SEQ ID NO: 8337670 - DNA, 22 bp, Homo sapiens
ttgggcagaggctgtgcagagg

SEQ ID NO: 8337671 - DNA, 22 bp, Homo sapiens
ttgggcaggctggcagactgct

SEQ ID NO: 8337672 - DNA, 22 bp, Homo sapiens
ttgggcaggatgacaccacttg

SEQ ID NO: 8337673 - DNA, 22 bp, Homo sapiens
ttgggcaggcacatagagttta

SEQ ID NO: 8337674 - DNA, 22 bp, Homo sapiens
ttgggcagcattgcagttccct

SEQ ID NO: 8337675 - DNA, 22 bp, Homo sapiens
ttgggcagatgtttcctgtgga

SEQ ID NO: 8337676 - DNA, 23 bp, Homo sapiens
ttgggcaggagagtaatgtgatc

SEQ ID NO: 8337677 - DNA, 22 bp, Homo sapiens
ttgggcaggaacagatgcttga

SEQ ID NO: 8337678 - DNA, 22 bp, Homo sapiens
ttgatatgttaggaagactgat

SEQ ID NO: 8337679 - DNA, 22 bp, Homo sapiens
ttgatattcccgatttaaggta

SEQ ID NO: 8337680 - DNA, 22 bp, Homo sapiens
ctcagtttctgacattaaaatc

SEQ ID NO: 8337681 - DNA, 22 bp, Homo sapiens
ctcagtttcttcatattgtagg

SEQ ID NO: 8337682 - DNA, 22 bp, Homo sapiens
ttggaaaaattgcctgatgtct

SEQ ID NO: 8337683 - DNA, 22 bp, Homo sapiens
ttgcttttaattaatcattgct

SEQ ID NO: 8337684 - DNA, 22 bp, Homo sapiens
ttgcttttccctgtctctgatt

SEQ ID NO: 8337685 - DNA, 17 bp, Homo sapiens
ttgcttttgaaattgtc

SEQ ID NO: 8337686 - DNA, 22 bp, Homo sapiens
ttgcttttaatctttgtacatc

SEQ ID NO: 8337687 - DNA, 22 bp, Homo sapiens
ttgctttgtggtggttcttcca

SEQ ID NO: 8337688 - DNA, 22 bp, Homo sapiens
ttcattcttgtctttgtatagt

SEQ ID NO: 8337689 - DNA, 22 bp, Homo sapiens
ttcattcttgggatcagagagt

SEQ ID NO: 8337690 - DNA, 19 bp, Homo sapiens
ttcattctcttattgttgt

SEQ ID NO: 8337691 - DNA, 22 bp, Homo sapiens
ttcattctgcagttctcagctc

SEQ ID NO: 8337692 - DNA, 22 bp, Homo sapiens
ttcagaaaggtaaatggatttc

SEQ ID NO: 8337693 - DNA, 22 bp, Homo sapiens
ttcattcccttatattagcatt

SEQ ID NO: 8337694 - DNA, 22 bp, Homo sapiens
ttcattcccaagagtaaacata

SEQ ID NO: 8337695 - DNA, 22 bp, Homo sapiens
ttcattccttctgtaccttgcc

SEQ ID NO: 8337696 - DNA, 22 bp, Homo sapiens
ttcattcctgagcccatattta

SEQ ID NO: 8337697 - DNA, 22 bp, Homo sapiens
ttcattccttccctaagcaact

SEQ ID NO: 8337698 - DNA, 22 bp, Homo sapiens
ttcagaaacccattgggtctct

SEQ ID NO: 8337699 - DNA, 21 bp, Homo sapiens
cggctcagtgcctgctccttc

SEQ ID NO: 8337700 - DNA, 22 bp, Homo sapiens
cggctctgtcctcagcactgct

SEQ ID NO: 8337701 - DNA, 22 bp, Homo sapiens
cggctctgtcctcagcactgct

SEQ ID NO: 8337702 - DNA, 22 bp, Homo sapiens
cggctgggtagaggtgccgggt

SEQ ID NO: 8337703 - DNA, 22 bp, Homo sapiens
cggctggggctgtccccatgac

SEQ ID NO: 8337704 - DNA, 22 bp, Homo sapiens
cggctggaagctggacaggccg

SEQ ID NO: 8337705 - DNA, 22 bp, Homo sapiens
ttcacataggagcatggttttt

SEQ ID NO: 8337706 - DNA, 22 bp, Homo sapiens
ttcacataatcctccagtggca

SEQ ID NO: 8337707 - DNA, 22 bp, Homo sapiens
ttcacataaatagatcacatca

SEQ ID NO: 8337708 - DNA, 22 bp, Homo sapiens
ttcacataaatagatcacatca

SEQ ID NO: 8337709 - DNA, 22 bp, Homo sapiens
ttcacataaatagatcacatca

SEQ ID NO: 8337710 - DNA, 22 bp, Homo sapiens
cctgggtggttccggcaaggag

SEQ ID NO: 8337711 - DNA, 22 bp, Homo sapiens
cctgggtgtcatgggcagctgg

SEQ ID NO: 8337712 - DNA, 22 bp, Homo sapiens
ttcacattacaaggccatattt

SEQ ID NO: 8337713 - DNA, 22 bp, Homo sapiens
cgctgggggaacagcgagggtg

SEQ ID NO: 8337714 - DNA, 22 bp, Homo sapiens
cgctggggctttttgcttgaga

SEQ ID NO: 8337715 - DNA, 22 bp, Homo sapiens
cgctggggctttttgcttgaga

SEQ ID NO: 8337716 - DNA, 22 bp, Homo sapiens
cgctgggggaacttcagccaat

SEQ ID NO: 8337717 - DNA, 22 bp, Homo sapiens
cggacaggctcctggagctcct

SEQ ID NO: 8337718 - DNA, 21 bp, Homo sapiens
cggacacctgtgatgtgcctg

SEQ ID NO: 8337719 - DNA, 22 bp, Homo sapiens
cggctcaggccacaggacggca

SEQ ID NO: 8337720 - DNA, 22 bp, Homo sapiens
ttcccaaagctttgtctgtgaa

SEQ ID NO: 8337721 - DNA, 22 bp, Homo sapiens
ttccaaagtcatgttgctgata

SEQ ID NO: 8337722 - DNA, 22 bp, Homo sapiens
ttcccttaaattatggcatcta

SEQ ID NO: 8337723 - DNA, 22 bp, Homo sapiens
ttccggggatagtgtttcccat

SEQ ID NO: 8337724 - DNA, 22 bp, Homo sapiens
ctaatttttgttctgcattgaa

SEQ ID NO: 8337725 - DNA, 22 bp, Homo sapiens
ctacaaaagtaattgtggtttt

SEQ ID NO: 8337726 - DNA, 20 bp, Homo sapiens
ctaatattctactctaagga

SEQ ID NO: 8337727 - DNA, 22 bp, Homo sapiens
ctacaaatataaaacacagata

SEQ ID NO: 8337728 - DNA, 22 bp, Homo sapiens
ctacaaatatgttaaggtgttt

SEQ ID NO: 8337729 - DNA, 22 bp, Homo sapiens
ctacaaatccacaaggcacttt

SEQ ID NO: 8337730 - DNA, 22 bp, Homo sapiens
ctacaaatataaaacacagata

SEQ ID NO: 8337731 - DNA, 22 bp, Homo sapiens
ttcttgtttattaagatataaa

SEQ ID NO: 8337732 - DNA, 22 bp, Homo sapiens
ctattttctgtctctatagagt

SEQ ID NO: 8337733 - DNA, 22 bp, Homo sapiens
ctattttgcctgcctagaaatc

SEQ ID NO: 8337734 - DNA, 22 bp, Homo sapiens
ctattttccgcagcaggaagta

SEQ ID NO: 8337735 - DNA, 22 bp, Homo sapiens
ttcttgtctttgttatgtagga

SEQ ID NO: 8337736 - DNA, 22 bp, Homo sapiens
ttcttgttctcctcatttagag

SEQ ID NO: 8337737 - DNA, 22 bp, Homo sapiens
ttcttgttctggttctgttagc

SEQ ID NO: 8337738 - DNA, 22 bp, Homo sapiens
ttcttgggtcctgtcgttgccc

SEQ ID NO: 8337739 - DNA, 22 bp, Homo sapiens
ctcagcagagaccagggaggaa

SEQ ID NO: 8337740 - DNA, 17 bp, Homo sapiens
ctcagcagggctcactt

SEQ ID NO: 8337741 - DNA, 22 bp, Homo sapiens
ctatttttctgtaccctaattt

SEQ ID NO: 8337742 - DNA, 22 bp, Homo sapiens
ctatttttctgtaccctaattt

SEQ ID NO: 8337743 - DNA, 22 bp, Homo sapiens
ctattttgtccttagtgcaggg

SEQ ID NO: 8337744 - DNA, 22 bp, Homo sapiens
ctatttttctgtaccctaattt

SEQ ID NO: 8337745 - DNA, 17 bp, Homo sapiens
ctattttggagattaaa

SEQ ID NO: 8337746 - DNA, 17 bp, Homo sapiens
ctattttggagattaaa

SEQ ID NO: 8337747 - DNA, 22 bp, Homo sapiens
ttgactttatgtcaacttgcct

SEQ ID NO: 8337748 - DNA, 22 bp, Homo sapiens
ttgagaaaacattgagggccat

SEQ ID NO: 8337749 - DNA, 22 bp, Homo sapiens
ttgagcttgaggagttatttga

SEQ ID NO: 8337750 - DNA, 22 bp, Homo sapiens
ttgagaaacatctaatctttgt

SEQ ID NO: 8337751 - DNA, 20 bp, Homo sapiens
ttgagcttttagtacagaca

SEQ ID NO: 8337752 - DNA, 22 bp, Homo sapiens
ttccttctaattttacacctga

SEQ ID NO: 8337753 - DNA, 22 bp, Homo sapiens
ttccttctaattttacacctga

SEQ ID NO: 8337754 - DNA, 22 bp, Homo sapiens
ctaggcagatggagaagtggct

SEQ ID NO: 8337755 - DNA, 22 bp, Homo sapiens
ctaggctgtaaagagctaggag

SEQ ID NO: 8337756 - DNA, 23 bp, Homo sapiens
ctaggcaggattgtaggcgggta

SEQ ID NO: 8337757 - DNA, 22 bp, Homo sapiens
ctaggcagctttgggtgtgaag

SEQ ID NO: 8337758 - DNA, 22 bp, Homo sapiens
ttctgtatttagtttgaggaca

SEQ ID NO: 8337759 - DNA, 22 bp, Homo sapiens
ttctgtatacgttacaattgag

SEQ ID NO: 8337760 - DNA, 22 bp, Homo sapiens
ctagggagtggcagagctggga

SEQ ID NO: 8337761 - DNA, 22 bp, Homo sapiens
ctagggctccaaagctgagaag

SEQ ID NO: 8337762 - DNA, 19 bp, Homo sapiens
gccatgggctggcagcaga

SEQ ID NO: 8337763 - DNA, 22 bp, Homo sapiens
gccatggggacttcatggattt

SEQ ID NO: 8337764 - DNA, 22 bp, Homo sapiens
gccatgggcaaatgcagagctg

SEQ ID NO: 8337765 - DNA, 22 bp, Homo sapiens
gccatgggtctgctggctcagc

SEQ ID NO: 8337766 - DNA, 21 bp, Homo sapiens
gccattgttttctacctggag

SEQ ID NO: 8337767 - DNA, 22 bp, Homo sapiens
gcccaggctggagtgcagtagc

SEQ ID NO: 8337768 - DNA, 22 bp, Homo sapiens
gcccaggctggagtgcagtggc

SEQ ID NO: 8337769 - DNA, 22 bp, Homo sapiens
gccagggaaactgcagaccagc

SEQ ID NO: 8337770 - DNA, 22 bp, Homo sapiens
gccagtgggacccgctgtgggc

SEQ ID NO: 8337771 - DNA, 22 bp, Homo sapiens
gccagtggtcagtgggagggtg

SEQ ID NO: 8337772 - DNA, 22 bp, Homo sapiens
gccaggctgccttatctctagc

SEQ ID NO: 8337773 - DNA, 22 bp, Homo sapiens
gccctctgctggcctcacctcg

SEQ ID NO: 8337774 - DNA, 22 bp, Homo sapiens
gccctctggcacagagatgcag

SEQ ID NO: 8337775 - DNA, 22 bp, Homo sapiens
gccctctgatgctcaccgagga

SEQ ID NO: 8337776 - DNA, 22 bp, Homo sapiens
gccctctgcacagctctgagca

SEQ ID NO: 8337777 - DNA, 22 bp, Homo sapiens
gccctctgccacaggacgccag

SEQ ID NO: 8337778 - DNA, 22 bp, Homo sapiens
gcccttggaacagcctcctgct

SEQ ID NO: 8337779 - DNA, 22 bp, Homo sapiens
gcccttccaacccagagggcaa

SEQ ID NO: 8337780 - DNA, 22 bp, Homo sapiens
gcccttccttagacagcaggat

SEQ ID NO: 8337781 - DNA, 21 bp, Homo sapiens
gcccttgaaaagctcacaggc

SEQ ID NO: 8337782 - DNA, 22 bp, Homo sapiens
gccctcagcatcctcagggcca

SEQ ID NO: 8337783 - DNA, 22 bp, Homo sapiens
gcccaggctggagtgcagtggc

SEQ ID NO: 8337784 - DNA, 22 bp, Homo sapiens
gcccaggctggagtgcagtggt

SEQ ID NO: 8337785 - DNA, 22 bp, Homo sapiens
gccctctcggcatagcaggggc

SEQ ID NO: 8337786 - DNA, 22 bp, Homo sapiens
gccctctcggcatagcaggggc

SEQ ID NO: 8337787 - DNA, 22 bp, Homo sapiens
gccctctcttctgcagcctcca

SEQ ID NO: 8337788 - DNA, 22 bp, Homo sapiens
gcctcctgtcccaggctgagga

SEQ ID NO: 8337789 - DNA, 22 bp, Homo sapiens
gcctcctgttatgccatgtgcc

SEQ ID NO: 8337790 - DNA, 22 bp, Homo sapiens
gccgtgggtgtcatggcccata

SEQ ID NO: 8337791 - DNA, 22 bp, Homo sapiens
gccgtggggagagagggtgcgt

SEQ ID NO: 8337792 - DNA, 22 bp, Homo sapiens
gccgtgtcatctgcgggtggca

SEQ ID NO: 8337793 - DNA, 22 bp, Homo sapiens
gccgtggggagagagggtgcgt

SEQ ID NO: 8337794 - DNA, 19 bp, Homo sapiens
gccgggggcgccccgctct

SEQ ID NO: 8337795 - DNA, 22 bp, Homo sapiens
gccgggttcaagccattctcct

SEQ ID NO: 8337796 - DNA, 22 bp, Homo sapiens
gccggtggcttttgtctcccct

SEQ ID NO: 8337797 - DNA, 22 bp, Homo sapiens
gccgtccccgaggccggaggga

SEQ ID NO: 8337798 - DNA, 22 bp, Homo sapiens
gccggggctggggagagacatg

SEQ ID NO: 8337799 - DNA, 19 bp, Homo sapiens
gccgggcccgggttggccg

SEQ ID NO: 8337800 - DNA, 22 bp, Homo sapiens
gccgaggctctgcccagctgct

SEQ ID NO: 8337801 - DNA, 22 bp, Homo sapiens
gccgcgtcgatgccctctagtt

SEQ ID NO: 8337802 - DNA, 22 bp, Homo sapiens
gcctctgcaactccgccttggt

SEQ ID NO: 8337803 - DNA, 22 bp, Homo sapiens
gcctctgcaattacattgtgcc

SEQ ID NO: 8337804 - DNA, 22 bp, Homo sapiens
gcctctgcatgctcagcaccca

SEQ ID NO: 8337805 - DNA, 22 bp, Homo sapiens
gcctctgcatcttcgccgcact

SEQ ID NO: 8337806 - DNA, 22 bp, Homo sapiens
gcctctgccaagggggctgcgg

SEQ ID NO: 8337807 - DNA, 22 bp, Homo sapiens
gcctctgcatgctcagcaccca

SEQ ID NO: 8337808 - DNA, 22 bp, Homo sapiens
gcctctgcggggcccgagcccg

SEQ ID NO: 8337809 - DNA, 22 bp, Homo sapiens
gcctctgctcggactttgcctc

SEQ ID NO: 8337810 - DNA, 22 bp, Homo sapiens
gcctctgctcggactttgcctc

SEQ ID NO: 8337811 - DNA, 22 bp, Homo sapiens
gcctctgcggagctgtacatca

SEQ ID NO: 8337812 - DNA, 22 bp, Homo sapiens
gcctctgcgcctcagccgacct

SEQ ID NO: 8337813 - DNA, 17 bp, Homo sapiens
gcctctgcttgtgtcat

SEQ ID NO: 8337814 - DNA, 20 bp, Homo sapiens
gcctctggagccaaggacca

SEQ ID NO: 8337815 - DNA, 18 bp, Homo sapiens
gcctgccaactcctgatc

SEQ ID NO: 8337816 - DNA, 22 bp, Homo sapiens
gcctgctgttgagggaagagct

SEQ ID NO: 8337817 - DNA, 22 bp, Homo sapiens
gcctggaaattgaggcacagtt

SEQ ID NO: 8337818 - DNA, 22 bp, Homo sapiens
gcctggaagacgtcttggcttc

SEQ ID NO: 8337819 - DNA, 22 bp, Homo sapiens
gcctggaagacgtcttggcttc

SEQ ID NO: 8337820 - DNA, 22 bp, Homo sapiens
gcctggaagtccagagtacatt

SEQ ID NO: 8337821 - DNA, 22 bp, Homo sapiens
gcctggaggggccagggtggta

SEQ ID NO: 8337822 - DNA, 22 bp, Homo sapiens
gcctggaggggacagtctctgg

SEQ ID NO: 8337823 - DNA, 20 bp, Homo sapiens
gcctggaggcaatgggaaga

SEQ ID NO: 8337824 - DNA, 22 bp, Homo sapiens
gcctggaatcatgcaggggtta

SEQ ID NO: 8337825 - DNA, 22 bp, Homo sapiens
gcctgggaaatggtggggtcag

SEQ ID NO: 8337826 - DNA, 21 bp, Homo sapiens
gcctgggaaatctgggaagcc

SEQ ID NO: 8337827 - DNA, 22 bp, Homo sapiens
gcctggggaacttgatcctgtc

SEQ ID NO: 8337828 - DNA, 22 bp, Homo sapiens
gcctgtggggctgaggctgcct

SEQ ID NO: 8337829 - DNA, 23 bp, Homo sapiens
gcctgggactggtagtgtgacct

SEQ ID NO: 8337830 - DNA, 23 bp, Homo sapiens
gcctgggactcaggaggagctca

SEQ ID NO: 8337831 - DNA, 19 bp, Homo sapiens
gcctgggatgggcagaact

SEQ ID NO: 8337832 - DNA, 22 bp, Homo sapiens
gctcagagatgttcagtagctt

SEQ ID NO: 8337833 - DNA, 22 bp, Homo sapiens
gctcagagatgtctgctgcctt

SEQ ID NO: 8337834 - DNA, 22 bp, Homo sapiens
gctcagagatgtctgctgcctt

SEQ ID NO: 8337835 - DNA, 22 bp, Homo sapiens
gctcagagatggggaatgaaaa

SEQ ID NO: 8337836 - DNA, 22 bp, Homo sapiens
gctcagagcatcccagtgaatg

SEQ ID NO: 8337837 - DNA, 22 bp, Homo sapiens
gctcagagcatcccagtgaatg

SEQ ID NO: 8337838 - DNA, 22 bp, Homo sapiens
gctcctggccagcacagggccc

SEQ ID NO: 8337839 - DNA, 22 bp, Homo sapiens
gctcctggctccaggcagccaa

SEQ ID NO: 8337840 - DNA, 22 bp, Homo sapiens
gctccaggagctcacagctcgc

SEQ ID NO: 8337841 - DNA, 22 bp, Homo sapiens
gctccagcacctagagcaggtc

SEQ ID NO: 8337842 - DNA, 22 bp, Homo sapiens
gctccagatgaatgcacttgtt

SEQ ID NO: 8337843 - DNA, 22 bp, Homo sapiens
gctccagctccggctccgaagc

SEQ ID NO: 8337844 - DNA, 22 bp, Homo sapiens
gctccagccacatggtagaagg

SEQ ID NO: 8337845 - DNA, 22 bp, Homo sapiens
gctccagatgaatgcacttgtt

SEQ ID NO: 8337846 - DNA, 22 bp, Homo sapiens
gctccagagtgtggcatctggg

SEQ ID NO: 8337847 - DNA, 22 bp, Homo sapiens
gctccagagtgtggcatctggg

SEQ ID NO: 8337848 - DNA, 22 bp, Homo sapiens
gctccagatgaaaggccagagg

SEQ ID NO: 8337849 - DNA, 22 bp, Homo sapiens
gctccagctctgttctggggaa

SEQ ID NO: 8337850 - DNA, 22 bp, Homo sapiens
gctccagctcgtggctcccagc

SEQ ID NO: 8337851 - DNA, 22 bp, Homo sapiens
gctccagctcgtggctcccagc

SEQ ID NO: 8337852 - DNA, 22 bp, Homo sapiens
gctccaggagagggaagcagat

SEQ ID NO: 8337853 - DNA, 22 bp, Homo sapiens
gctccagagcagagactaggtt

SEQ ID NO: 8337854 - DNA, 22 bp, Homo sapiens
gctccagaaatgccgtgatcct

SEQ ID NO: 8337855 - DNA, 22 bp, Homo sapiens
gctctgccaaggacccattctc

SEQ ID NO: 8337856 - DNA, 22 bp, Homo sapiens
gctctgccaaggacccattctc

SEQ ID NO: 8337857 - DNA, 23 bp, Homo sapiens
gctctgccacttaatagctgtgt

SEQ ID NO: 8337858 - DNA, 22 bp, Homo sapiens
gctctgccaacagtttgggcaa

SEQ ID NO: 8337859 - DNA, 22 bp, Homo sapiens
gctctgccaacagtttgggcaa

SEQ ID NO: 8337860 - DNA, 22 bp, Homo sapiens
gctctgccaacagtttgggcaa

SEQ ID NO: 8337861 - DNA, 18 bp, Homo sapiens
gctctgcagctgaggctt

SEQ ID NO: 8337862 - DNA, 23 bp, Homo sapiens
gctctgaggaagttgggcacggg

SEQ ID NO: 8337863 - DNA, 22 bp, Homo sapiens
gctcctgggtgtggctgcccct

SEQ ID NO: 8337864 - DNA, 22 bp, Homo sapiens
gctcctggctctggccaaggga

SEQ ID NO: 8337865 - DNA, 22 bp, Homo sapiens
gctgagagtgggtgcagtgctt

SEQ ID NO: 8337866 - DNA, 22 bp, Homo sapiens
gctctgccagacactgtggcca

SEQ ID NO: 8337867 - DNA, 22 bp, Homo sapiens
gctctgccagacactgtggcca

SEQ ID NO: 8337868 - DNA, 20 bp, Homo sapiens
gctctgccacttagaagctg

SEQ ID NO: 8337869 - DNA, 21 bp, Homo sapiens
gctctgccacttaccagattt

SEQ ID NO: 8337870 - DNA, 22 bp, Homo sapiens
gctctgccagacactgtggcca

SEQ ID NO: 8337871 - DNA, 22 bp, Homo sapiens
gctctgccagcccaaggcgcag

SEQ ID NO: 8337872 - DNA, 22 bp, Homo sapiens
gctctgccagcccaaggcgcag

SEQ ID NO: 8337873 - DNA, 19 bp, Homo sapiens
gctctgccagtggtaacat

SEQ ID NO: 8337874 - DNA, 17 bp, Homo sapiens
gctctgccaggaaagag

SEQ ID NO: 8337875 - DNA, 22 bp, Homo sapiens
gctctgcccaaagctgtggctg

SEQ ID NO: 8337876 - DNA, 22 bp, Homo sapiens
gctctgcccaaagctgtggctg

SEQ ID NO: 8337877 - DNA, 22 bp, Homo sapiens
gctctgcccaaagctgtggctg

SEQ ID NO: 8337878 - DNA, 22 bp, Homo sapiens
gctctgcccaatgtccctacac

SEQ ID NO: 8337879 - DNA, 22 bp, Homo sapiens
gctctgcccaatgtccctacac

SEQ ID NO: 8337880 - DNA, 22 bp, Homo sapiens
gctctgtgttttgcccaggaga

SEQ ID NO: 8337881 - DNA, 22 bp, Homo sapiens
gctctgtgttgtcagaggcacc

SEQ ID NO: 8337882 - DNA, 22 bp, Homo sapiens
gctctgtttctccatgctgtgg

SEQ ID NO: 8337883 - DNA, 22 bp, Homo sapiens
gctgctgcctgtagccagggtg

SEQ ID NO: 8337884 - DNA, 22 bp, Homo sapiens
gctgctgccgcggccgctggga

SEQ ID NO: 8337885 - DNA, 22 bp, Homo sapiens
gctgctgccgcggccgctggga

SEQ ID NO: 8337886 - DNA, 22 bp, Homo sapiens
gctgctgctggtctggggccac

SEQ ID NO: 8337887 - DNA, 21 bp, Homo sapiens
gctggagagccaggcaggggc

SEQ ID NO: 8337888 - DNA, 21 bp, Homo sapiens
gctgctgcccctagtgaggcc

SEQ ID NO: 8337889 - DNA, 22 bp, Homo sapiens
gctgctgcaagagccagctctt

SEQ ID NO: 8337890 - DNA, 22 bp, Homo sapiens
gctgctctgttaattgctgtaa

SEQ ID NO: 8337891 - DNA, 21 bp, Homo sapiens
gctgctcgagatccagtgctt

SEQ ID NO: 8337892 - DNA, 21 bp, Homo sapiens
gctgctcgagatccagtgctt

SEQ ID NO: 8337893 - DNA, 22 bp, Homo sapiens
gctgctctacccatgcatctgt

SEQ ID NO: 8337894 - DNA, 22 bp, Homo sapiens
gctgctctggctctgcagtgtc

SEQ ID NO: 8337895 - DNA, 22 bp, Homo sapiens
gctgctctccatggccgtgagt

SEQ ID NO: 8337896 - DNA, 22 bp, Homo sapiens
gctgagctagctatctcagtct

SEQ ID NO: 8337897 - DNA, 22 bp, Homo sapiens
gctgggcaagtgccttgggttt

SEQ ID NO: 8337898 - DNA, 22 bp, Homo sapiens
gctgggcaagtgccttgggttt

SEQ ID NO: 8337899 - DNA, 22 bp, Homo sapiens
gctgggcaatgccagagaggag

SEQ ID NO: 8337900 - DNA, 22 bp, Homo sapiens
gctgggcaccggagagacccca

SEQ ID NO: 8337901 - DNA, 22 bp, Homo sapiens
gctgggcacctctcccagattg

SEQ ID NO: 8337902 - DNA, 22 bp, Homo sapiens
gctgggcactgtcccataggct

SEQ ID NO: 8337903 - DNA, 22 bp, Homo sapiens
gctgggcagcccctacagagag

SEQ ID NO: 8337904 - DNA, 22 bp, Homo sapiens
gctgggcagcaggctctccggg

SEQ ID NO: 8337905 - DNA, 22 bp, Homo sapiens
gctgggcagcctggccgctgcc

SEQ ID NO: 8337906 - DNA, 22 bp, Homo sapiens
gctgggcaggcctcgtgagggc

SEQ ID NO: 8337907 - DNA, 22 bp, Homo sapiens
gctgggcaggcctcgtgagggc

SEQ ID NO: 8337908 - DNA, 22 bp, Homo sapiens
gctgggcagctgaggcctctca

SEQ ID NO: 8337909 - DNA, 22 bp, Homo sapiens
gctgggagttactgtctccttt

SEQ ID NO: 8337910 - DNA, 22 bp, Homo sapiens
gctggcggcagtggtgtctctg

SEQ ID NO: 8337911 - DNA, 22 bp, Homo sapiens
gctggcctttgaggaagctgcg

SEQ ID NO: 8337912 - DNA, 22 bp, Homo sapiens
gctggcctgacctgaggctggg

SEQ ID NO: 8337913 - DNA, 22 bp, Homo sapiens
gctggcctctggagaagggctt

SEQ ID NO: 8337914 - DNA, 22 bp, Homo sapiens
gctggagccttctgctctgttg

SEQ ID NO: 8337915 - DNA, 22 bp, Homo sapiens
gctggagcgggttcgggccgct

SEQ ID NO: 8337916 - DNA, 22 bp, Homo sapiens
gccacaggctccagcatcagta

SEQ ID NO: 8337917 - DNA, 22 bp, Homo sapiens
gccacaggctccagcatcagta

SEQ ID NO: 8337918 - DNA, 20 bp, Homo sapiens
gccagaggccggcaggggct

SEQ ID NO: 8337919 - DNA, 22 bp, Homo sapiens
gccacagctccagtcaggtgac

SEQ ID NO: 8337920 - DNA, 22 bp, Homo sapiens
gccacaggaaagcaccctggag

SEQ ID NO: 8337921 - DNA, 22 bp, Homo sapiens
gccagcagccacagaagtcact

SEQ ID NO: 8337922 - DNA, 19 bp, Homo sapiens
gccagcagaatgatgaggc

SEQ ID NO: 8337923 - DNA, 22 bp, Homo sapiens
gccagcagccacagaagtcact

SEQ ID NO: 8337924 - DNA, 22 bp, Homo sapiens
gccagcagctgtggggtggcca

SEQ ID NO: 8337925 - DNA, 22 bp, Homo sapiens
gccagcagctcttgggcgggca

SEQ ID NO: 8337926 - DNA, 22 bp, Homo sapiens
gccagcagcttcttctcatcct

SEQ ID NO: 8337927 - DNA, 22 bp, Homo sapiens
gccagcagggaagccttgggct

SEQ ID NO: 8337928 - DNA, 22 bp, Homo sapiens
gccacagcccgagcaccatgag

SEQ ID NO: 8337929 - DNA, 22 bp, Homo sapiens
gcatggtggagtctgagcaggg

SEQ ID NO: 8337930 - DNA, 22 bp, Homo sapiens
gcatggtggccttagggtagcc

SEQ ID NO: 8337931 - DNA, 22 bp, Homo sapiens
gcatggtggggagatggcagcc

SEQ ID NO: 8337932 - DNA, 22 bp, Homo sapiens
gcagtgggcaacaagagctgga

SEQ ID NO: 8337933 - DNA, 22 bp, Homo sapiens
gcagtgggcctgaggaagggtg

SEQ ID NO: 8337934 - DNA, 22 bp, Homo sapiens
gcagtgggcctgaggaagggtg

SEQ ID NO: 8337935 - DNA, 22 bp, Homo sapiens
gcagtggggcgctgggagttgg

SEQ ID NO: 8337936 - DNA, 22 bp, Homo sapiens
gcagtggggaatgctggggaga

SEQ ID NO: 8337937 - DNA, 22 bp, Homo sapiens
gcagtggggcaatcatagctca

SEQ ID NO: 8337938 - DNA, 22 bp, Homo sapiens
gcagtggggaatgctggggaga

SEQ ID NO: 8337939 - DNA, 19 bp, Homo sapiens
gcagtgtcatggtaggagc

SEQ ID NO: 8337940 - DNA, 22 bp, Homo sapiens
gcagtgtcagtgcctgggtggt

SEQ ID NO: 8337941 - DNA, 22 bp, Homo sapiens
gcagtgtccagggtggtctgca

SEQ ID NO: 8337942 - DNA, 22 bp, Homo sapiens
gcaggtgtcttcagcaggatga

SEQ ID NO: 8337943 - DNA, 22 bp, Homo sapiens
gcagtagaacgtgttgaatcaa

SEQ ID NO: 8337944 - DNA, 22 bp, Homo sapiens
gcagtagaactgtcatgatgtt

SEQ ID NO: 8337945 - DNA, 22 bp, Homo sapiens
gcagtagaaggtgctttctgga

SEQ ID NO: 8337946 - DNA, 22 bp, Homo sapiens
gcagtagagaagccaggctgta

SEQ ID NO: 8337947 - DNA, 20 bp, Homo sapiens
gcagtagaccatgcttggaa

SEQ ID NO: 8337948 - DNA, 22 bp, Homo sapiens
gcagtagagcagagattttcct

SEQ ID NO: 8337949 - DNA, 22 bp, Homo sapiens
gcagtagagcttcttttgatga

SEQ ID NO: 8337950 - DNA, 22 bp, Homo sapiens
gcagtaatctcatatcaatttc

SEQ ID NO: 8337951 - DNA, 22 bp, Homo sapiens
gcagtagaaatttcattgctct

SEQ ID NO: 8337952 - DNA, 22 bp, Homo sapiens
gcagtgggagcttaggcagtgc

SEQ ID NO: 8337953 - DNA, 22 bp, Homo sapiens
gcagtgggcaacaagagctgga

SEQ ID NO: 8337954 - DNA, 22 bp, Homo sapiens
gcagtatacactgatacatgag

SEQ ID NO: 8337955 - DNA, 22 bp, Homo sapiens
gcagtagatctggaagagaatt

SEQ ID NO: 8337956 - DNA, 18 bp, Homo sapiens
gcagtaggcgcgcaggac

SEQ ID NO: 8337957 - DNA, 22 bp, Homo sapiens
gcagggtgacgttgcccacctc

SEQ ID NO: 8337958 - DNA, 22 bp, Homo sapiens
gcagggtgatagtgaggctcag

SEQ ID NO: 8337959 - DNA, 22 bp, Homo sapiens
gcagggtgccgacttcagggat

SEQ ID NO: 8337960 - DNA, 22 bp, Homo sapiens
gcagggtgccgacttcagggat

SEQ ID NO: 8337961 - DNA, 22 bp, Homo sapiens
gcagggtgatagtgaggctcag

SEQ ID NO: 8337962 - DNA, 22 bp, Homo sapiens
gcagggtgatagtgaggctcag

SEQ ID NO: 8337963 - DNA, 22 bp, Homo sapiens
gcagggtgccgacttcagggat

SEQ ID NO: 8337964 - DNA, 22 bp, Homo sapiens
gcagggtggatggcagggccag

SEQ ID NO: 8337965 - DNA, 22 bp, Homo sapiens
gcagggtggatggcagggccag

SEQ ID NO: 8337966 - DNA, 22 bp, Homo sapiens
gcagggtggatggcagggccag

SEQ ID NO: 8337967 - DNA, 19 bp, Homo sapiens
gcagggtggcagagctctt

SEQ ID NO: 8337968 - DNA, 22 bp, Homo sapiens
gcaggtggggctgctaccagaa

SEQ ID NO: 8337969 - DNA, 22 bp, Homo sapiens
gcaggtggggctgctaccagaa

SEQ ID NO: 8337970 - DNA, 22 bp, Homo sapiens
gcaggtgggagccgctgcctga

SEQ ID NO: 8337971 - DNA, 22 bp, Homo sapiens
gcaggtggtccccgtggagtgg

SEQ ID NO: 8337972 - DNA, 22 bp, Homo sapiens
gcaggtggtcactcatccccag

SEQ ID NO: 8337973 - DNA, 22 bp, Homo sapiens
gcaggtggtggcgcgcgccctg

SEQ ID NO: 8337974 - DNA, 22 bp, Homo sapiens
gcaggtggttaaggtcccatgt

SEQ ID NO: 8337975 - DNA, 22 bp, Homo sapiens
gcaggtggtgggggagccgttc

SEQ ID NO: 8337976 - DNA, 22 bp, Homo sapiens
gcaggtggtgggggagccgttc

SEQ ID NO: 8337977 - DNA, 22 bp, Homo sapiens
gcaggacaggcgttggtccagt

SEQ ID NO: 8337978 - DNA, 22 bp, Homo sapiens
gcaggagccaggccgagctggt

SEQ ID NO: 8337979 - DNA, 22 bp, Homo sapiens
gcaggagccacttcagggatgc

SEQ ID NO: 8337980 - DNA, 19 bp, Homo sapiens
gcaggcacagccctgggtg

SEQ ID NO: 8337981 - DNA, 22 bp, Homo sapiens
gcaggagttcaattgcccatga

SEQ ID NO: 8337982 - DNA, 22 bp, Homo sapiens
gcagagcggtgatcaggcgcag

SEQ ID NO: 8337983 - DNA, 22 bp, Homo sapiens
gcagagcctgacgggatttttc

SEQ ID NO: 8337984 - DNA, 22 bp, Homo sapiens
gcagagcctgggggtctgcgga

SEQ ID NO: 8337985 - DNA, 22 bp, Homo sapiens
gcagagccttgcgtcatgtgcc

SEQ ID NO: 8337986 - DNA, 22 bp, Homo sapiens
gcagctctgagactctacagaa

SEQ ID NO: 8337987 - DNA, 22 bp, Homo sapiens
gcagctctcctctgtgaggaac

SEQ ID NO: 8337988 - DNA, 22 bp, Homo sapiens
gcagctcctcctgggctggaga

SEQ ID NO: 8337989 - DNA, 22 bp, Homo sapiens
gcagctcacacagcaagttttg

SEQ ID NO: 8337990 - DNA, 22 bp, Homo sapiens
gcaggctggggtagccccactt

SEQ ID NO: 8337991 - DNA, 22 bp, Homo sapiens
gcaggctggaggctgttctggg

SEQ ID NO: 8337992 - DNA, 22 bp, Homo sapiens
gcaggctgccctcttgtgttga

SEQ ID NO: 8337993 - DNA, 22 bp, Homo sapiens
gcaggcagagaggggtttccag

SEQ ID NO: 8337994 - DNA, 21 bp, Homo sapiens
gcaggcactctagaggagctg

SEQ ID NO: 8337995 - DNA, 22 bp, Homo sapiens
gcagggcagacctccagcctat

SEQ ID NO: 8337996 - DNA, 22 bp, Homo sapiens
gcagggcacagacagtgccaag

SEQ ID NO: 8337997 - DNA, 22 bp, Homo sapiens
gcagggcacacaagaatgataa

SEQ ID NO: 8337998 - DNA, 22 bp, Homo sapiens
gcagggggatggagttgaaatg

SEQ ID NO: 8337999 - DNA, 22 bp, Homo sapiens
gcagggggtcattcacgctggc

SEQ ID NO: 8338000 - DNA, 22 bp, Homo sapiens
gcagggtgacgttgcccacctc

SEQ ID NO: 8338001 - DNA, 22 bp, Homo sapiens
gcaggggctactctgagcttcc

SEQ ID NO: 8338002 - DNA, 22 bp, Homo sapiens
gcaggggcaggagatctcaggc

SEQ ID NO: 8338003 - DNA, 22 bp, Homo sapiens
gatttcaagcccccagagattc

SEQ ID NO: 8338004 - DNA, 22 bp, Homo sapiens
gatttcaaggatgttagaggtg

SEQ ID NO: 8338005 - DNA, 22 bp, Homo sapiens
gatttcaaggagttttcacagt

SEQ ID NO: 8338006 - DNA, 22 bp, Homo sapiens
gatttcacccacttcccagtgt

SEQ ID NO: 8338007 - DNA, 22 bp, Homo sapiens
gatttcaatccagctttcttct

SEQ ID NO: 8338008 - DNA, 22 bp, Homo sapiens
gatttcaagtatcttgggcgag

SEQ ID NO: 8338009 - DNA, 22 bp, Homo sapiens
gatttcacctgatcttgtcatc

SEQ ID NO: 8338010 - DNA, 22 bp, Homo sapiens
gattttctgagccttcaaattt

SEQ ID NO: 8338011 - DNA, 22 bp, Homo sapiens
gattttcattatagctagtttc

SEQ ID NO: 8338012 - DNA, 22 bp, Homo sapiens
gattttcatgataaacttgtga

SEQ ID NO: 8338013 - DNA, 22 bp, Homo sapiens
gattttatatggcatactgtgg

SEQ ID NO: 8338014 - DNA, 22 bp, Homo sapiens
gcaaactgatttccaagtccgt

SEQ ID NO: 8338015 - DNA, 22 bp, Homo sapiens
gcaaactgcattctatagcttg

SEQ ID NO: 8338016 - DNA, 22 bp, Homo sapiens
gcaaactggcaaacctgtctgt

SEQ ID NO: 8338017 - DNA, 22 bp, Homo sapiens
gcaaacatctttatttggcaag

SEQ ID NO: 8338018 - DNA, 22 bp, Homo sapiens
gattttgaatattaaagaagag

SEQ ID NO: 8338019 - DNA, 22 bp, Homo sapiens
gcaaaaaatgcttgttgcttag

SEQ ID NO: 8338020 - DNA, 22 bp, Homo sapiens
gcacaaatacaaagttgagaaa

SEQ ID NO: 8338021 - DNA, 22 bp, Homo sapiens
gcaatgatattgaagtgatgaa

SEQ ID NO: 8338022 - DNA, 22 bp, Homo sapiens
gcacccagtttgtctcagggtt

SEQ ID NO: 8338023 - DNA, 22 bp, Homo sapiens
gcacctgctggggctgatgaga

SEQ ID NO: 8338024 - DNA, 22 bp, Homo sapiens
gcacctgcaggatgagccaggg

SEQ ID NO: 8338025 - DNA, 22 bp, Homo sapiens
gcaccctgctctatccttgcta

SEQ ID NO: 8338026 - DNA, 22 bp, Homo sapiens
gcagaagctgttcgaaggccgc

SEQ ID NO: 8338027 - DNA, 22 bp, Homo sapiens
gcagagccccattgctggcggg

SEQ ID NO: 8338028 - DNA, 22 bp, Homo sapiens
gcagagcccctcaagccagcct

SEQ ID NO: 8338029 - DNA, 22 bp, Homo sapiens
gcagagccagaatggccaggac

SEQ ID NO: 8338030 - DNA, 22 bp, Homo sapiens
gcagaagaccatggtggaaaga

SEQ ID NO: 8338031 - DNA, 22 bp, Homo sapiens
gcagaagctgggcagcgaggtg

SEQ ID NO: 8338032 - DNA, 22 bp, Homo sapiens
gcagaagcagggcaggggcaaa

SEQ ID NO: 8338033 - DNA, 22 bp, Homo sapiens
gcagaagcagcagatgggcgca

SEQ ID NO: 8338034 - DNA, 22 bp, Homo sapiens
gcactttgcccctcctttggca

SEQ ID NO: 8338035 - DNA, 22 bp, Homo sapiens
gatggctaggggactggagtta

SEQ ID NO: 8338036 - DNA, 22 bp, Homo sapiens
gatggcggtcgtcgacggtcct

SEQ ID NO: 8338037 - DNA, 22 bp, Homo sapiens
gatgcgggcccgctccactgcc

SEQ ID NO: 8338038 - DNA, 22 bp, Homo sapiens
gatgccctgcatgagtcctgct

SEQ ID NO: 8338039 - DNA, 22 bp, Homo sapiens
gatgctgggaccacagagtgtt

SEQ ID NO: 8338040 - DNA, 22 bp, Homo sapiens
gatggggatgagaagtgagcag

SEQ ID NO: 8338041 - DNA, 22 bp, Homo sapiens
gatgggggccagggcctgcttt

SEQ ID NO: 8338042 - DNA, 22 bp, Homo sapiens
gatgtaaatggtctttggcaga

SEQ ID NO: 8338043 - DNA, 22 bp, Homo sapiens
gatgtaaatggtctttggcaga

SEQ ID NO: 8338044 - DNA, 22 bp, Homo sapiens
gatgtacaatgtcactatgacc

SEQ ID NO: 8338045 - DNA, 22 bp, Homo sapiens
gatgtaaaaactcctttcgaaa

SEQ ID NO: 8338046 - DNA, 22 bp, Homo sapiens
gatggtttggtaaaagtatgtt

SEQ ID NO: 8338047 - DNA, 22 bp, Homo sapiens
gatggtttggaatgaagtagct

SEQ ID NO: 8338048 - DNA, 22 bp, Homo sapiens
gatggtttatgatagatgggaa

SEQ ID NO: 8338049 - DNA, 20 bp, Homo sapiens
gatttcaaagcagagtggcc

SEQ ID NO: 8338050 - DNA, 22 bp, Homo sapiens
gatttcaaaggttctgcatgcc

SEQ ID NO: 8338051 - DNA, 22 bp, Homo sapiens
gatttcaacctaacagtatgac

SEQ ID NO: 8338052 - DNA, 22 bp, Homo sapiens
gatttcaaaagtagatccatca

SEQ ID NO: 8338053 - DNA, 22 bp, Homo sapiens
gatttagagcaggaatgcatgg

SEQ ID NO: 8338054 - DNA, 21 bp, Homo sapiens
gatttagtggctgttctacct

SEQ ID NO: 8338055 - DNA, 22 bp, Homo sapiens
gatttacaggttaggtcctgta

SEQ ID NO: 8338056 - DNA, 22 bp, Homo sapiens
gatttacagctatacccaatgg

SEQ ID NO: 8338057 - DNA, 22 bp, Homo sapiens
gatttacagatctaagggtcac

SEQ ID NO: 8338058 - DNA, 22 bp, Homo sapiens
gatttacagatctaagggtcac

SEQ ID NO: 8338059 - DNA, 22 bp, Homo sapiens
gatttaaagtagacctttgttt

SEQ ID NO: 8338060 - DNA, 22 bp, Homo sapiens
gatttacaaagctctctagtgt

SEQ ID NO: 8338061 - DNA, 19 bp, Homo sapiens
gatttaaacgtggctctat

SEQ ID NO: 8338062 - DNA, 21 bp, Homo sapiens
gattggttcactcatgttgac

SEQ ID NO: 8338063 - DNA, 22 bp, Homo sapiens
gattggttgaaagtagaatact

SEQ ID NO: 8338064 - DNA, 22 bp, Homo sapiens
gatgttttttaggatctcagca

SEQ ID NO: 8338065 - DNA, 22 bp, Homo sapiens
gattaagtaactgaacactttg

SEQ ID NO: 8338066 - DNA, 22 bp, Homo sapiens
gattaagtggaatgagtatttg

SEQ ID NO: 8338067 - DNA, 22 bp, Homo sapiens
gattaagtccttctcagccgcc

SEQ ID NO: 8338068 - DNA, 22 bp, Homo sapiens
gattacaaaactcatctatgac

SEQ ID NO: 8338069 - DNA, 22 bp, Homo sapiens
gattacattctccttgtattag

SEQ ID NO: 8338070 - DNA, 22 bp, Homo sapiens
gatgttttttaggatctcagca

SEQ ID NO: 8338071 - DNA, 22 bp, Homo sapiens
gattcaatgttgcagatggaat

SEQ ID NO: 8338072 - DNA, 22 bp, Homo sapiens
gattctttactcagattttgtt

SEQ ID NO: 8338073 - DNA, 22 bp, Homo sapiens
gattctttggcctttattgaca

SEQ ID NO: 8338074 - DNA, 22 bp, Homo sapiens
gattattttgtgcaataatcgg

SEQ ID NO: 8338075 - DNA, 22 bp, Homo sapiens
gattattttgtgcaataatcgg

SEQ ID NO: 8338076 - DNA, 22 bp, Homo sapiens
gattatataatggaagctcttg

SEQ ID NO: 8338077 - DNA, 22 bp, Homo sapiens
gagacagatctcggctccatgc

SEQ ID NO: 8338078 - DNA, 22 bp, Homo sapiens
gagagctgcagccgagaggggg

SEQ ID NO: 8338079 - DNA, 22 bp, Homo sapiens
gagagctgatagatgagctact

SEQ ID NO: 8338080 - DNA, 22 bp, Homo sapiens
gagagctgggggactgtggatg

SEQ ID NO: 8338081 - DNA, 22 bp, Homo sapiens
gagagctgggggactgtggatg

SEQ ID NO: 8338082 - DNA, 22 bp, Homo sapiens
gagagctgggaaagccgtggag

SEQ ID NO: 8338083 - DNA, 20 bp, Homo sapiens
gagagctggggatgaggctg

SEQ ID NO: 8338084 - DNA, 22 bp, Homo sapiens
gagaaaatcttgggtcaagaat

SEQ ID NO: 8338085 - DNA, 22 bp, Homo sapiens
gagaaaatagcatgtgtagtat

SEQ ID NO: 8338086 - DNA, 22 bp, Homo sapiens
gactttgtgccaaacgccagaa

SEQ ID NO: 8338087 - DNA, 22 bp, Homo sapiens
gagaaaatgtcagacttggtcg

SEQ ID NO: 8338088 - DNA, 22 bp, Homo sapiens
gagaaacaacacttgatgcctt

SEQ ID NO: 8338089 - DNA, 22 bp, Homo sapiens
gagacacaggtggttcctgtca

SEQ ID NO: 8338090 - DNA, 22 bp, Homo sapiens
gagacacaggtggttcctgtca

SEQ ID NO: 8338091 - DNA, 22 bp, Homo sapiens
gagacacagttatcaggcatac

SEQ ID NO: 8338092 - DNA, 22 bp, Homo sapiens
gagacacaagacgcaactctgt

SEQ ID NO: 8338093 - DNA, 18 bp, Homo sapiens
gagacacaagggcctgga

SEQ ID NO: 8338094 - DNA, 22 bp, Homo sapiens
gagacacagagaggctgtgtga

SEQ ID NO: 8338095 - DNA, 22 bp, Homo sapiens
gagacacacattctggagagaa

SEQ ID NO: 8338096 - DNA, 22 bp, Homo sapiens
gagacacacacaggaggtggca

SEQ ID NO: 8338097 - DNA, 17 bp, Homo sapiens
gacttcaacttctgctg

SEQ ID NO: 8338098 - DNA, 22 bp, Homo sapiens
gacccagggtttctgcacaggg

SEQ ID NO: 8338099 - DNA, 22 bp, Homo sapiens
gactggaaagcctgtcctcaga

SEQ ID NO: 8338100 - DNA, 22 bp, Homo sapiens
gactgtggcaggctcagcactg

SEQ ID NO: 8338101 - DNA, 22 bp, Homo sapiens
gactgtggatagaacactgcag

SEQ ID NO: 8338102 - DNA, 22 bp, Homo sapiens
gacccaggaagctacttctggt

SEQ ID NO: 8338103 - DNA, 22 bp, Homo sapiens
gacaggaggcagagctcaggtg

SEQ ID NO: 8338104 - DNA, 19 bp, Homo sapiens
gacaggaaggctaccagta

SEQ ID NO: 8338105 - DNA, 22 bp, Homo sapiens
gacacaggtagaataaagtact

SEQ ID NO: 8338106 - DNA, 22 bp, Homo sapiens
gacacaggggggcgctagaaga

SEQ ID NO: 8338107 - DNA, 20 bp, Homo sapiens
gacacaggcagtcctcagag

SEQ ID NO: 8338108 - DNA, 22 bp, Homo sapiens
gacacaggattcctggctctgc

SEQ ID NO: 8338109 - DNA, 23 bp, Homo sapiens
gacacaggagcacccagctgagc

SEQ ID NO: 8338110 - DNA, 22 bp, Homo sapiens
gacacaggaaaagctccagccc

SEQ ID NO: 8338111 - DNA, 22 bp, Homo sapiens
gacacagataatttagttaaaa

SEQ ID NO: 8338112 - DNA, 22 bp, Homo sapiens
gacacagatatctctgagatta

SEQ ID NO: 8338113 - DNA, 22 bp, Homo sapiens
gacacagatgatcaggtgtgga

SEQ ID NO: 8338114 - DNA, 22 bp, Homo sapiens
gacacagcttgatgagggcttt

SEQ ID NO: 8338115 - DNA, 22 bp, Homo sapiens
gacacagcactgtacaaggaat

SEQ ID NO: 8338116 - DNA, 22 bp, Homo sapiens
gaattacatgaccctgagtaga

SEQ ID NO: 8338117 - DNA, 19 bp, Homo sapiens
gaattatttttatgggatg

SEQ ID NO: 8338118 - DNA, 22 bp, Homo sapiens
gaattcagttatctaattcaag

SEQ ID NO: 8338119 - DNA, 22 bp, Homo sapiens
gaatttaaatttaaatctacca

SEQ ID NO: 8338120 - DNA, 22 bp, Homo sapiens
gaattgtatgcagttacttgga

SEQ ID NO: 8338121 - DNA, 21 bp, Homo sapiens
gaattgtgccccttggtgttg

SEQ ID NO: 8338122 - DNA, 22 bp, Homo sapiens
gaattctaaccattaagccaag

SEQ ID NO: 8338123 - DNA, 22 bp, Homo sapiens
gaattcttttctttctgaaagt

SEQ ID NO: 8338124 - DNA, 22 bp, Homo sapiens
gaagtacaaaggacatggaaac

SEQ ID NO: 8338125 - DNA, 19 bp, Homo sapiens
gaaggctgaaatgaagcac

SEQ ID NO: 8338126 - DNA, 22 bp, Homo sapiens
gaaggctgagcagacaggccaa

SEQ ID NO: 8338127 - DNA, 22 bp, Homo sapiens
gaaggctgcgaggggagtgccg

SEQ ID NO: 8338128 - DNA, 19 bp, Homo sapiens
gaaggagagctgagttagg

SEQ ID NO: 8338129 - DNA, 22 bp, Homo sapiens
gaaggagaccctgaagatgctg

SEQ ID NO: 8338130 - DNA, 22 bp, Homo sapiens
gaaggcggacgccagggggtcg

SEQ ID NO: 8338131 - DNA, 22 bp, Homo sapiens
gaaggaagtcattagtgcagac

SEQ ID NO: 8338132 - DNA, 22 bp, Homo sapiens
gaaggaagctgtctggatgtgt

SEQ ID NO: 8338133 - DNA, 22 bp, Homo sapiens
gaaggaagggctggctgtcttg

SEQ ID NO: 8338134 - DNA, 22 bp, Homo sapiens
ctttgttttactcagaggcatg

SEQ ID NO: 8338135 - DNA, 22 bp, Homo sapiens
ctttgtttatatttctcctcga

SEQ ID NO: 8338136 - DNA, 22 bp, Homo sapiens
ctttgttctgcacacacagaca

SEQ ID NO: 8338137 - DNA, 22 bp, Homo sapiens
ctttgtctcctaagaactctca

SEQ ID NO: 8338138 - DNA, 22 bp, Homo sapiens
gaaaacatccagagatagacct

SEQ ID NO: 8338139 - DNA, 22 bp, Homo sapiens
gaaaaggaaatttatagagatc

SEQ ID NO: 8338140 - DNA, 22 bp, Homo sapiens
gaaaaggattggtaaaatatct

SEQ ID NO: 8338141 - DNA, 22 bp, Homo sapiens
gaaaaggattggtaaaatatct

SEQ ID NO: 8338142 - DNA, 22 bp, Homo sapiens
gaaaagtatgtttattttgact

SEQ ID NO: 8338143 - DNA, 22 bp, Homo sapiens
gaaaagggcaagagagagggca

SEQ ID NO: 8338144 - DNA, 18 bp, Homo sapiens
gaaaatactctgggctca

SEQ ID NO: 8338145 - DNA, 22 bp, Homo sapiens
gaaaatacttcagtgttctggc

SEQ ID NO: 8338146 - DNA, 21 bp, Homo sapiens
gaaaatacaatgagcttgacc

SEQ ID NO: 8338147 - DNA, 22 bp, Homo sapiens
gaaaagttcatcatatattcag

SEQ ID NO: 8338148 - DNA, 22 bp, Homo sapiens
gaaaatacaaatagccttgaaa

SEQ ID NO: 8338149 - DNA, 22 bp, Homo sapiens
gaaagttatatcatgattttag

SEQ ID NO: 8338150 - DNA, 22 bp, Homo sapiens
gaaagttcacacatccacatgg

SEQ ID NO: 8338151 - DNA, 22 bp, Homo sapiens
gaaaggtcagttccacttccat

SEQ ID NO: 8338152 - DNA, 22 bp, Homo sapiens
gaaaggtcttccggtcttccag

SEQ ID NO: 8338153 - DNA, 21 bp, Homo sapiens
gaaaggtcttaacttacagag

SEQ ID NO: 8338154 - DNA, 17 bp, Homo sapiens
gaaaggtcctagaaatc

SEQ ID NO: 8338155 - DNA, 22 bp, Homo sapiens
gaaatttacaactttctcatgg

SEQ ID NO: 8338156 - DNA, 22 bp, Homo sapiens
gaaatttattatctacatcatt

SEQ ID NO: 8338157 - DNA, 22 bp, Homo sapiens
gaaataatttagaaggtattcc

SEQ ID NO: 8338158 - DNA, 22 bp, Homo sapiens
gaaatacaaagccagccatttt

SEQ ID NO: 8338159 - DNA, 22 bp, Homo sapiens
gaaatacaaatgcctagatcct

SEQ ID NO: 8338160 - DNA, 22 bp, Homo sapiens
gaaatacaaatgcctagatcct

SEQ ID NO: 8338161 - DNA, 22 bp, Homo sapiens
gaaataagagtccatgccaggt

SEQ ID NO: 8338162 - DNA, 22 bp, Homo sapiens
gaaataagagtccatgccaggt

SEQ ID NO: 8338163 - DNA, 22 bp, Homo sapiens
gaaataagagtccatgccaggt

SEQ ID NO: 8338164 - DNA, 22 bp, Homo sapiens
gaacccagtccaggtgcagcct

SEQ ID NO: 8338165 - DNA, 23 bp, Homo sapiens
gaacccagctctgccacttgcca

SEQ ID NO: 8338166 - DNA, 22 bp, Homo sapiens
gaacccaggaggttgcagtgag

SEQ ID NO: 8338167 - DNA, 21 bp, Homo sapiens
gaacccagcagcagtgctctg

SEQ ID NO: 8338168 - DNA, 22 bp, Homo sapiens
gaacccagccagactccctaca

SEQ ID NO: 8338169 - DNA, 22 bp, Homo sapiens
gaacagatgcctgattcatagg

SEQ ID NO: 8338170 - DNA, 22 bp, Homo sapiens
gaacagagttgaaacaaggctg

SEQ ID NO: 8338171 - DNA, 22 bp, Homo sapiens
gaacagagctgactacaaggca

SEQ ID NO: 8338172 - DNA, 22 bp, Homo sapiens
gaactctaggtaaatgagatat

SEQ ID NO: 8338173 - DNA, 22 bp, Homo sapiens
gaactatatgtcttaaagcttt

SEQ ID NO: 8338174 - DNA, 22 bp, Homo sapiens
ctggctgtgaaatggcagtgtc

SEQ ID NO: 8338175 - DNA, 22 bp, Homo sapiens
cttgaaagatttggcctctgtg

SEQ ID NO: 8338176 - DNA, 22 bp, Homo sapiens
cttgaaagtcacatgcagccct

SEQ ID NO: 8338177 - DNA, 22 bp, Homo sapiens
cttgaaagctttgcgtcttcta

SEQ ID NO: 8338178 - DNA, 21 bp, Homo sapiens
cttgaaaggtagagtctacag

SEQ ID NO: 8338179 - DNA, 22 bp, Homo sapiens
cttctttgtgcctattggtgac

SEQ ID NO: 8338180 - DNA, 22 bp, Homo sapiens
cttctcttcccagggacacagg

SEQ ID NO: 8338181 - DNA, 22 bp, Homo sapiens
ctttggcagacattaggggtga

SEQ ID NO: 8338182 - DNA, 22 bp, Homo sapiens
ctttgtatttaatagctgtctt

SEQ ID NO: 8338183 - DNA, 22 bp, Homo sapiens
ctttgtcattttgtctctcagt

SEQ ID NO: 8338184 - DNA, 22 bp, Homo sapiens
ctttgtatggtggcacttccgt

SEQ ID NO: 8338185 - DNA, 22 bp, Homo sapiens
ctttgtagtcaaactgatacat

SEQ ID NO: 8338186 - DNA, 22 bp, Homo sapiens
ctttgtagctgcttctgattta

SEQ ID NO: 8338187 - DNA, 22 bp, Homo sapiens
ctttggcatggtcctcactata

SEQ ID NO: 8338188 - DNA, 22 bp, Homo sapiens
ctttagaatttgatataatcaa

SEQ ID NO: 8338189 - DNA, 22 bp, Homo sapiens
ctttagatttctatgtatcact

SEQ ID NO: 8338190 - DNA, 22 bp, Homo sapiens
cttggattcctcatatgcacag

SEQ ID NO: 8338191 - DNA, 21 bp, Homo sapiens
cttggagttggttgaggatgc

SEQ ID NO: 8338192 - DNA, 22 bp, Homo sapiens
cttggatgccagcggcctccta

SEQ ID NO: 8338193 - DNA, 22 bp, Homo sapiens
cttggcaccaccaagtggccat

SEQ ID NO: 8338194 - DNA, 22 bp, Homo sapiens
cttggcacgtgataggtgttga

SEQ ID NO: 8338195 - DNA, 22 bp, Homo sapiens
cttgaagttgcaaaacattaat

SEQ ID NO: 8338196 - DNA, 22 bp, Homo sapiens
cttggctgtctataggaaagag

SEQ ID NO: 8338197 - DNA, 22 bp, Homo sapiens
cttggggctgtcactctggcat

SEQ ID NO: 8338198 - DNA, 22 bp, Homo sapiens
cttggggcagcccaggctgagc

SEQ ID NO: 8338199 - DNA, 22 bp, Homo sapiens
cttgggccagcccagggggcat

SEQ ID NO: 8338200 - DNA, 22 bp, Homo sapiens
gaggaagggctgcctgccgggc

SEQ ID NO: 8338201 - DNA, 22 bp, Homo sapiens
gaggaagatggttgagtggtcc

SEQ ID NO: 8338202 - DNA, 22 bp, Homo sapiens
gagctgggagttatagcatgtt

SEQ ID NO: 8338203 - DNA, 23 bp, Homo sapiens
gagctgggatacaggcttactgc

SEQ ID NO: 8338204 - DNA, 22 bp, Homo sapiens
gaggaagagcatggccagtttc

SEQ ID NO: 8338205 - DNA, 22 bp, Homo sapiens
gaggaagagagctctgccttgt

SEQ ID NO: 8338206 - DNA, 22 bp, Homo sapiens
gagctgggagctgggatttgga

SEQ ID NO: 8338207 - DNA, 22 bp, Homo sapiens
gagctgggacttggaatccaca

SEQ ID NO: 8338208 - DNA, 22 bp, Homo sapiens
gaggaagtttacaaagcatctg

SEQ ID NO: 8338209 - DNA, 22 bp, Homo sapiens
gagctgggacatgggtcctctc

SEQ ID NO: 8338210 - DNA, 22 bp, Homo sapiens
gagctgggacatgggtcctctc

SEQ ID NO: 8338211 - DNA, 22 bp, Homo sapiens
gagctgggacatgggtcctctc

SEQ ID NO: 8338212 - DNA, 22 bp, Homo sapiens
gagctggctgtggttgagtgca

SEQ ID NO: 8338213 - DNA, 22 bp, Homo sapiens
gagctgggaagatagcttgagc

SEQ ID NO: 8338214 - DNA, 22 bp, Homo sapiens
gagctggcaatgacttgtgtat

SEQ ID NO: 8338215 - DNA, 22 bp, Homo sapiens
gagatcatggcttctgctgata

SEQ ID NO: 8338216 - DNA, 22 bp, Homo sapiens
gagatccataagtgatagaaat

SEQ ID NO: 8338217 - DNA, 22 bp, Homo sapiens
gagctggaggcagtgctgaggt

SEQ ID NO: 8338218 - DNA, 22 bp, Homo sapiens
gagctggaggaccaggactggg

SEQ ID NO: 8338219 - DNA, 22 bp, Homo sapiens
gagatatgttggcagctggtat

SEQ ID NO: 8338220 - DNA, 22 bp, Homo sapiens
gagatatattaacattaatctt

SEQ ID NO: 8338221 - DNA, 22 bp, Homo sapiens
gagagtgaaggcttcccagcaa

SEQ ID NO: 8338222 - DNA, 22 bp, Homo sapiens
gagagtgagatcctcctgggga

SEQ ID NO: 8338223 - DNA, 22 bp, Homo sapiens
gagagtgagataatttcacata

SEQ ID NO: 8338224 - DNA, 22 bp, Homo sapiens
gagagtgaggcatcaggggcag

SEQ ID NO: 8338225 - DNA, 22 bp, Homo sapiens
gagagtgaggcctgggaatcta

SEQ ID NO: 8338226 - DNA, 22 bp, Homo sapiens
gagagtgatgaatggttaaaca

SEQ ID NO: 8338227 - DNA, 22 bp, Homo sapiens
gagagtgattccctcccataga

SEQ ID NO: 8338228 - DNA, 22 bp, Homo sapiens
gagagtgtcgggggccccagga

SEQ ID NO: 8338229 - DNA, 17 bp, Homo sapiens
gagagtgtattggatgc

SEQ ID NO: 8338230 - DNA, 22 bp, Homo sapiens
gagagtggatggagctgcgaag

SEQ ID NO: 8338231 - DNA, 22 bp, Homo sapiens
gaggcctctgtcccaccaggga

SEQ ID NO: 8338232 - DNA, 21 bp, Homo sapiens
gaggcctcagcctcagctcct

SEQ ID NO: 8338233 - DNA, 22 bp, Homo sapiens
gaggcctgaggctgcctggagc

SEQ ID NO: 8338234 - DNA, 20 bp, Homo sapiens
gaggcctcagcctcagctcc

SEQ ID NO: 8338235 - DNA, 22 bp, Homo sapiens
gaggccctgaagacagctgggg

SEQ ID NO: 8338236 - DNA, 22 bp, Homo sapiens
gaggcagctgggctggtggttt

SEQ ID NO: 8338237 - DNA, 22 bp, Homo sapiens
gaggcagctgaaggagtgacag

SEQ ID NO: 8338238 - DNA, 22 bp, Homo sapiens
gaggcccagcagcgcaggtctt

SEQ ID NO: 8338239 - DNA, 22 bp, Homo sapiens
gaggcagcaggctgaggaggat

SEQ ID NO: 8338240 - DNA, 22 bp, Homo sapiens
gaggcagcagaacatggaagag

SEQ ID NO: 8338241 - DNA, 22 bp, Homo sapiens
gaggcagcaggctgaggaggat

SEQ ID NO: 8338242 - DNA, 22 bp, Homo sapiens
gaggcagcgggtcaggaccgtg

SEQ ID NO: 8338243 - DNA, 18 bp, Homo sapiens
gaggcagctagcaatttt

SEQ ID NO: 8338244 - DNA, 18 bp, Homo sapiens
gaggcagctagcaatttt

SEQ ID NO: 8338245 - DNA, 22 bp, Homo sapiens
gaggagggagaattaggcttaa

SEQ ID NO: 8338246 - DNA, 22 bp, Homo sapiens
gaggaggcttccgggaggcacg

SEQ ID NO: 8338247 - DNA, 22 bp, Homo sapiens
gaggagggagctggaagctctt

SEQ ID NO: 8338248 - DNA, 22 bp, Homo sapiens
gaggaggcttccgggaggcacg

SEQ ID NO: 8338249 - DNA, 22 bp, Homo sapiens
gaggaggctgtttctctgcatt

SEQ ID NO: 8338250 - DNA, 22 bp, Homo sapiens
gaggaggctggcgccgcctgcc

SEQ ID NO: 8338251 - DNA, 22 bp, Homo sapiens
gaggaggctggcgccgcctgcc

SEQ ID NO: 8338252 - DNA, 22 bp, Homo sapiens
gaggaggctgaacaatgccctg

SEQ ID NO: 8338253 - DNA, 22 bp, Homo sapiens
gaggaggctgaacaatgccctg

SEQ ID NO: 8338254 - DNA, 22 bp, Homo sapiens
gaggagggttggccttaggtag

SEQ ID NO: 8338255 - DNA, 22 bp, Homo sapiens
gaggagggttggccttaggtag

SEQ ID NO: 8338256 - DNA, 22 bp, Homo sapiens
gaggaggtggaattccaggaat

SEQ ID NO: 8338257 - DNA, 22 bp, Homo sapiens
gaggcagcaataaaaagaattt

SEQ ID NO: 8338258 - DNA, 22 bp, Homo sapiens
gagtcacattaatttaatttta

SEQ ID NO: 8338259 - DNA, 22 bp, Homo sapiens
gagtcacaaagcctttcttatt

SEQ ID NO: 8338260 - DNA, 22 bp, Homo sapiens
gaggtgggtgtatcacaggtca

SEQ ID NO: 8338261 - DNA, 19 bp, Homo sapiens
gaggtgggtccccgcagcc

SEQ ID NO: 8338262 - DNA, 19 bp, Homo sapiens
gaggtgggtccccgcagcc

SEQ ID NO: 8338263 - DNA, 22 bp, Homo sapiens
gaggtggggttttgttcttgaa

SEQ ID NO: 8338264 - DNA, 22 bp, Homo sapiens
gaggtgggtgtatcacaggtca

SEQ ID NO: 8338265 - DNA, 22 bp, Homo sapiens
gagtcctcaacggggagaggcg

SEQ ID NO: 8338266 - DNA, 22 bp, Homo sapiens
gagtccctgctgtcaggtgctg

SEQ ID NO: 8338267 - DNA, 22 bp, Homo sapiens
gagtcagtaatggatatgtcat

SEQ ID NO: 8338268 - DNA, 22 bp, Homo sapiens
gagtccacttaagtatctgcag

SEQ ID NO: 8338269 - DNA, 22 bp, Homo sapiens
gaggtccactgaggcaacaggg

SEQ ID NO: 8338270 - DNA, 22 bp, Homo sapiens
gaggtgggagggcagtccctaa

SEQ ID NO: 8338271 - DNA, 22 bp, Homo sapiens
gaggtgggatgtgtgtgctact

SEQ ID NO: 8338272 - DNA, 22 bp, Homo sapiens
gaggtgggcggatcacaaggtc

SEQ ID NO: 8338273 - DNA, 22 bp, Homo sapiens
gaggtgggcggatcacaaggtc

SEQ ID NO: 8338274 - DNA, 22 bp, Homo sapiens
gaggggccggcatgtgcctctc

SEQ ID NO: 8338275 - DNA, 22 bp, Homo sapiens
gaggggcagttgattgtgctat

SEQ ID NO: 8338276 - DNA, 22 bp, Homo sapiens
gaggggcgtcctgagtgggcct

SEQ ID NO: 8338277 - DNA, 22 bp, Homo sapiens
gaggggcgctgtcgggtcacct

SEQ ID NO: 8338278 - DNA, 22 bp, Homo sapiens
gaggggcgtcctgagtgggcct

SEQ ID NO: 8338279 - DNA, 22 bp, Homo sapiens
gaggtaggtgtaggaggcctgc

SEQ ID NO: 8338280 - DNA, 22 bp, Homo sapiens
gaggtaggtgtaggaggcctgc

SEQ ID NO: 8338281 - DNA, 22 bp, Homo sapiens
gaggtaacactgttcagtgggc

SEQ ID NO: 8338282 - DNA, 22 bp, Homo sapiens
gaggtcaataatatgtgcttta

SEQ ID NO: 8338283 - DNA, 22 bp, Homo sapiens
gagggccaactagcaccacttt

SEQ ID NO: 8338284 - DNA, 22 bp, Homo sapiens
gagggccaactagcaccacttt

SEQ ID NO: 8338285 - DNA, 22 bp, Homo sapiens
gagggcagtagcctcgtaccct

SEQ ID NO: 8338286 - DNA, 22 bp, Homo sapiens
gaggggagtgtcctccgggccc

SEQ ID NO: 8338287 - DNA, 22 bp, Homo sapiens
gaggggagtgtcctccgggccc

SEQ ID NO: 8338288 - DNA, 22 bp, Homo sapiens
gaggggcacagtaaagggtccc

SEQ ID NO: 8338289 - DNA, 22 bp, Homo sapiens
gaggggcacagcagctgttgca

SEQ ID NO: 8338290 - DNA, 22 bp, Homo sapiens
gaggggcagaatgtgatcaggg

SEQ ID NO: 8338291 - DNA, 22 bp, Homo sapiens
gaggggcagaatgtgatcaggg

SEQ ID NO: 8338292 - DNA, 22 bp, Homo sapiens
gaggggcagtgcacccgggccc

SEQ ID NO: 8338293 - DNA, 22 bp, Homo sapiens
gaggctgcccaactggagtgga

SEQ ID NO: 8338294 - DNA, 22 bp, Homo sapiens
gaggctgcccacacctgcgccg

SEQ ID NO: 8338295 - DNA, 22 bp, Homo sapiens
gaggctggaatattagaaatgt

SEQ ID NO: 8338296 - DNA, 22 bp, Homo sapiens
gaggcctgctttggcactctgg

SEQ ID NO: 8338297 - DNA, 22 bp, Homo sapiens
gaggctggaggtcaaagatgaa

SEQ ID NO: 8338298 - DNA, 22 bp, Homo sapiens
gaggctggacgtgcatttctac

SEQ ID NO: 8338299 - DNA, 22 bp, Homo sapiens
gaggctggaggtcaaagatgaa

SEQ ID NO: 8338300 - DNA, 22 bp, Homo sapiens
gaggctggcagaaaagcacagg

SEQ ID NO: 8338301 - DNA, 22 bp, Homo sapiens
gaggctgggggctgccttcctc

SEQ ID NO: 8338302 - DNA, 16 bp, Homo sapiens
gagggcagaggcggaa

SEQ ID NO: 8338303 - DNA, 22 bp, Homo sapiens
gaggctgggaagtccaagatca

SEQ ID NO: 8338304 - DNA, 22 bp, Homo sapiens
gaggctgggaagtccaagatca

SEQ ID NO: 8338305 - DNA, 22 bp, Homo sapiens
gaggctgggaagtccaatatca

SEQ ID NO: 8338306 - DNA, 22 bp, Homo sapiens
gaggctgggggctgccttcctc

SEQ ID NO: 8338307 - DNA, 16 bp, Homo sapiens
gaggctggcagatgtc

SEQ ID NO: 8338308 - DNA, 22 bp, Homo sapiens
gaggctgggaagtccaagacca

SEQ ID NO: 8338309 - DNA, 22 bp, Homo sapiens
gaggctgggaagtccaagacca

SEQ ID NO: 8338310 - DNA, 22 bp, Homo sapiens
gatcttttcaggtttctctagt

SEQ ID NO: 8338311 - DNA, 22 bp, Homo sapiens
gatcttttcagtcttggtagtt

SEQ ID NO: 8338312 - DNA, 22 bp, Homo sapiens
gatctttcaagttttactgttt

SEQ ID NO: 8338313 - DNA, 22 bp, Homo sapiens
gatctttcatctatgtatttag

SEQ ID NO: 8338314 - DNA, 22 bp, Homo sapiens
gatcttttcagaatttatcagt

SEQ ID NO: 8338315 - DNA, 22 bp, Homo sapiens
gatgaaatagaattaatttagg

SEQ ID NO: 8338316 - DNA, 22 bp, Homo sapiens
gatgaaattcagaattgagggg

SEQ ID NO: 8338317 - DNA, 22 bp, Homo sapiens
gatgaaatagaattaatttagg

SEQ ID NO: 8338318 - DNA, 22 bp, Homo sapiens
gatgaaatagcaaaggcatttg

SEQ ID NO: 8338319 - DNA, 20 bp, Homo sapiens
gatgaaatcactgggcagcc

SEQ ID NO: 8338320 - DNA, 22 bp, Homo sapiens
gatgaaatagcaaaggcatttg

SEQ ID NO: 8338321 - DNA, 22 bp, Homo sapiens
gatcattttatagctatagcaa

SEQ ID NO: 8338322 - DNA, 22 bp, Homo sapiens
gatccagcttctacacagagct

SEQ ID NO: 8338323 - DNA, 22 bp, Homo sapiens
gatccccagggcaggcctcccg

SEQ ID NO: 8338324 - DNA, 22 bp, Homo sapiens
gatccctgccctcagcctggac

SEQ ID NO: 8338325 - DNA, 22 bp, Homo sapiens
gatctggtctttgattagacac

SEQ ID NO: 8338326 - DNA, 22 bp, Homo sapiens
gatgcactgcagtatatactgt

SEQ ID NO: 8338327 - DNA, 22 bp, Homo sapiens
gatgcagggcagctctgggaca

SEQ ID NO: 8338328 - DNA, 22 bp, Homo sapiens
gatgcacttgcccctcctcaga

SEQ ID NO: 8338329 - DNA, 22 bp, Homo sapiens
gatgcactttcttttcaacagt

SEQ ID NO: 8338330 - DNA, 22 bp, Homo sapiens
gatgattttatgtcttgtcatt

SEQ ID NO: 8338331 - DNA, 22 bp, Homo sapiens
gatgattttagttgactaaact

SEQ ID NO: 8338332 - DNA, 22 bp, Homo sapiens
gatgatttaagtggccaaagta

SEQ ID NO: 8338333 - DNA, 22 bp, Homo sapiens
gatgattttgatgcagtaaaga

SEQ ID NO: 8338334 - DNA, 22 bp, Homo sapiens
gatgattttgttggtgattcaa

SEQ ID NO: 8338335 - DNA, 22 bp, Homo sapiens
gatgatttttgccagtgtgatg

SEQ ID NO: 8338336 - DNA, 22 bp, Homo sapiens
gatgacatgatggacactcagt

SEQ ID NO: 8338337 - DNA, 22 bp, Homo sapiens
gatgatgggcgctgtttactgg

SEQ ID NO: 8338338 - DNA, 22 bp, Homo sapiens
gatgaggaatgctcagctcaat

SEQ ID NO: 8338339 - DNA, 20 bp, Homo sapiens
gatgagacccatgcatgaga

SEQ ID NO: 8338340 - DNA, 22 bp, Homo sapiens
gatgagacagaatagcccaagg

SEQ ID NO: 8338341 - DNA, 22 bp, Homo sapiens
gatgaggaaaccaaggctcagg

SEQ ID NO: 8338342 - DNA, 22 bp, Homo sapiens
gatgaaatttgggcaggttaaa

SEQ ID NO: 8338343 - DNA, 22 bp, Homo sapiens
gatgaagaggcactgacatatt

SEQ ID NO: 8338344 - DNA, 22 bp, Homo sapiens
gataatacttattaagcactta

SEQ ID NO: 8338345 - DNA, 22 bp, Homo sapiens
gataacattttgaagtgctagt

SEQ ID NO: 8338346 - DNA, 22 bp, Homo sapiens
gataactgaacagattcacaaa

SEQ ID NO: 8338347 - DNA, 22 bp, Homo sapiens
gatacacacccttgataggact

SEQ ID NO: 8338348 - DNA, 22 bp, Homo sapiens
gatacacatgcatgtgcatgta

SEQ ID NO: 8338349 - DNA, 22 bp, Homo sapiens
gatacattccatttctacttaa

SEQ ID NO: 8338350 - DNA, 22 bp, Homo sapiens
gatagaaaggtgttgaaatcca

SEQ ID NO: 8338351 - DNA, 22 bp, Homo sapiens
gatagaaagaatatagattcca

SEQ ID NO: 8338352 - DNA, 22 bp, Homo sapiens
gatagaaagaatatagattcca

SEQ ID NO: 8338353 - DNA, 22 bp, Homo sapiens
gatactcttcaggtcttgcaga

SEQ ID NO: 8338354 - DNA, 19 bp, Homo sapiens
gatataaagagatggtgaa

SEQ ID NO: 8338355 - DNA, 22 bp, Homo sapiens
gatataaattaatcaagtgcaa

SEQ ID NO: 8338356 - DNA, 22 bp, Homo sapiens
gatcattagcttttcaaaggag

SEQ ID NO: 8338357 - DNA, 22 bp, Homo sapiens
gatcattaacaaccttaccctt

SEQ ID NO: 8338358 - DNA, 22 bp, Homo sapiens
gatcaccagttgtaggtatttt

SEQ ID NO: 8338359 - DNA, 22 bp, Homo sapiens
gatcacagtattttagatgtgt

SEQ ID NO: 8338360 - DNA, 22 bp, Homo sapiens
gatcaacaacttttgaatagct

SEQ ID NO: 8338361 - DNA, 22 bp, Homo sapiens
gatatttttgcagacacctggg

SEQ ID NO: 8338362 - DNA, 22 bp, Homo sapiens
gatatttttaggtgatgcaggc

SEQ ID NO: 8338363 - DNA, 22 bp, Homo sapiens
gatattttgagaaatcctatga

SEQ ID NO: 8338364 - DNA, 22 bp, Homo sapiens
gatatttacattaagcacattg

SEQ ID NO: 8338365 - DNA, 22 bp, Homo sapiens
gatatttattaagtggttggta

SEQ ID NO: 8338366 - DNA, 22 bp, Homo sapiens
gatattttcagtctcctttcaa

SEQ ID NO: 8338367 - DNA, 21 bp, Homo sapiens
gatatttatgactcattcctt

SEQ ID NO: 8338368 - DNA, 18 bp, Homo sapiens
gatatataggaggaaagt

SEQ ID NO: 8338369 - DNA, 22 bp, Homo sapiens
gataaaattcttattttacccg

SEQ ID NO: 8338370 - DNA, 22 bp, Homo sapiens
gagtggggggtccgtctcagtg

SEQ ID NO: 8338371 - DNA, 22 bp, Homo sapiens
gagtggggtctgggcatcagtc

SEQ ID NO: 8338372 - DNA, 22 bp, Homo sapiens
gagtgggtccacagaggtgaca

SEQ ID NO: 8338373 - DNA, 22 bp, Homo sapiens
gagtgtctgtattttgggcaag

SEQ ID NO: 8338374 - DNA, 22 bp, Homo sapiens
gagtggtagtttctagaggtgt

SEQ ID NO: 8338375 - DNA, 22 bp, Homo sapiens
gagtggtaggcagtgttaggaa

SEQ ID NO: 8338376 - DNA, 22 bp, Homo sapiens
gagtgtggtgaacaggagcacc

SEQ ID NO: 8338377 - DNA, 23 bp, Homo sapiens
gagtgttcatagcaggctcttgc

SEQ ID NO: 8338378 - DNA, 22 bp, Homo sapiens
gagtgttccagaaactggccct

SEQ ID NO: 8338379 - DNA, 22 bp, Homo sapiens
gagtgttcccacaccccagttg

SEQ ID NO: 8338380 - DNA, 22 bp, Homo sapiens
gagtgtctgtggggcatggaca

SEQ ID NO: 8338381 - DNA, 22 bp, Homo sapiens
gagtgtgcttagagagctgcat

SEQ ID NO: 8338382 - DNA, 22 bp, Homo sapiens
gagtgtggtatgctctgaggct

SEQ ID NO: 8338383 - DNA, 19 bp, Homo sapiens
gagtcctgtgctccttgtt

SEQ ID NO: 8338384 - DNA, 22 bp, Homo sapiens
gagtcctgggtcacggcctctt

SEQ ID NO: 8338385 - DNA, 22 bp, Homo sapiens
gagtctctcatgcagttacagt

SEQ ID NO: 8338386 - DNA, 22 bp, Homo sapiens
gagtctctgaccagggtgccaa

SEQ ID NO: 8338387 - DNA, 22 bp, Homo sapiens
gagtgaaaaaggaagggccata

SEQ ID NO: 8338388 - DNA, 22 bp, Homo sapiens
gagtctggtcattttctctccc

SEQ ID NO: 8338389 - DNA, 22 bp, Homo sapiens
gagtgagggccaacatccagct

SEQ ID NO: 8338390 - DNA, 22 bp, Homo sapiens
gagtgaggctggaatcatggct

SEQ ID NO: 8338391 - DNA, 19 bp, Homo sapiens
gagtgatggatctccttgc

SEQ ID NO: 8338392 - DNA, 22 bp, Homo sapiens
gagtgcagtatgagaggctgct

SEQ ID NO: 8338393 - DNA, 22 bp, Homo sapiens
gagtgctccgtcttggacaggg

SEQ ID NO: 8338394 - DNA, 22 bp, Homo sapiens
gagtgctcctggatggatttcc

SEQ ID NO: 8338395 - DNA, 22 bp, Homo sapiens
gagtgctcgggtgtcccgcggg

SEQ ID NO: 8338396 - DNA, 22 bp, Homo sapiens
gagtgctcgggcctctgcctgc

SEQ ID NO: 8338397 - DNA, 18 bp, Homo sapiens
gagtgcggtggtgcacac

SEQ ID NO: 8338398 - DNA, 22 bp, Homo sapiens
gagtgcatcgtggccattttaa

SEQ ID NO: 8338399 - DNA, 22 bp, Homo sapiens
gagtgctggaggtgtgagtggg

SEQ ID NO: 8338400 - DNA, 22 bp, Homo sapiens
gagtgctgcttgggatagtgag

SEQ ID NO: 8338401 - DNA, 22 bp, Homo sapiens
gagtgctggaggtgtgagtggg

SEQ ID NO: 8338402 - DNA, 22 bp, Homo sapiens
gagtgctgtaggactgagccct

SEQ ID NO: 8338403 - DNA, 17 bp, Homo sapiens
gagtgctggtggagctc

SEQ ID NO: 8338404 - DNA, 21 bp, Homo sapiens
gagtgggacatgggagtggtt

SEQ ID NO: 8338405 - DNA, 22 bp, Homo sapiens
gagtggctttggagaagtaggg

SEQ ID NO: 8338406 - DNA, 22 bp, Homo sapiens
gagtggagcaaaagaggtagat

SEQ ID NO: 8338407 - DNA, 20 bp, Homo sapiens
ggcagctctagtcgaggccc

SEQ ID NO: 8338408 - DNA, 22 bp, Homo sapiens
ggcagctgcacgttgtcccgtc

SEQ ID NO: 8338409 - DNA, 23 bp, Homo sapiens
ggcagctgggcagcactcatggg

SEQ ID NO: 8338410 - DNA, 19 bp, Homo sapiens
ggcagctggacgctgttca

SEQ ID NO: 8338411 - DNA, 22 bp, Homo sapiens
ggcagctggggcagtgccctgt

SEQ ID NO: 8338412 - DNA, 22 bp, Homo sapiens
ggcagctgtaagatgagtgaat

SEQ ID NO: 8338413 - DNA, 22 bp, Homo sapiens
ggcaggtgaggcatgtgcctgg

SEQ ID NO: 8338414 - DNA, 17 bp, Homo sapiens
ggcaggtgcggggccgc

SEQ ID NO: 8338415 - DNA, 17 bp, Homo sapiens
ggcaggtgcggggccgc

SEQ ID NO: 8338416 - DNA, 22 bp, Homo sapiens
ggcaggtgctaagagaggtaaa

SEQ ID NO: 8338417 - DNA, 20 bp, Homo sapiens
ggcaggtgctcgcttggtct

SEQ ID NO: 8338418 - DNA, 20 bp, Homo sapiens
ggcaggtgctcgcttggtct

SEQ ID NO: 8338419 - DNA, 16 bp, Homo sapiens
ggcaggcgcggagccc

SEQ ID NO: 8338420 - DNA, 22 bp, Homo sapiens
ggcaggcgtggtggcctcagaa

SEQ ID NO: 8338421 - DNA, 22 bp, Homo sapiens
ggcaggctccaagcatcctatg

SEQ ID NO: 8338422 - DNA, 18 bp, Homo sapiens
ggcaggctctctgggtca

SEQ ID NO: 8338423 - DNA, 22 bp, Homo sapiens
ggagtgggcagcactgccctgt

SEQ ID NO: 8338424 - DNA, 22 bp, Homo sapiens
ggagtgggcagcactgccctgt

SEQ ID NO: 8338425 - DNA, 22 bp, Homo sapiens
ggagtggctatttgtgctggtt

SEQ ID NO: 8338426 - DNA, 22 bp, Homo sapiens
ggagtggcagctaggctgtcag

SEQ ID NO: 8338427 - DNA, 22 bp, Homo sapiens
ggagtgtgattgttctctgtta

SEQ ID NO: 8338428 - DNA, 22 bp, Homo sapiens
ggcacacaggcagatggagtgt

SEQ ID NO: 8338429 - DNA, 22 bp, Homo sapiens
ggcacacatagatctgcactgg

SEQ ID NO: 8338430 - DNA, 22 bp, Homo sapiens
ggcacagcactgtaggcctggg

SEQ ID NO: 8338431 - DNA, 18 bp, Homo sapiens
ggcagacgcgaggggcgg

SEQ ID NO: 8338432 - DNA, 22 bp, Homo sapiens
ggaggggctcctgttcgccccc

SEQ ID NO: 8338433 - DNA, 22 bp, Homo sapiens
ggaggggctgagcaactttcag

SEQ ID NO: 8338434 - DNA, 22 bp, Homo sapiens
ggaggggctcctgttcgccccc

SEQ ID NO: 8338435 - DNA, 22 bp, Homo sapiens
ggaggggagtctcccaaagccg

SEQ ID NO: 8338436 - DNA, 22 bp, Homo sapiens
ggaggggagatgtttgggctca

SEQ ID NO: 8338437 - DNA, 22 bp, Homo sapiens
ggaggggtggaaggagtgcctg

SEQ ID NO: 8338438 - DNA, 22 bp, Homo sapiens
ggaggggtgagaatggctgcct

SEQ ID NO: 8338439 - DNA, 22 bp, Homo sapiens
ggaggggtctctagcgaggaga

SEQ ID NO: 8338440 - DNA, 22 bp, Homo sapiens
ggaggggtctctagcgaggaga

SEQ ID NO: 8338441 - DNA, 22 bp, Homo sapiens
ggaggggtggtcgcgaagagca

SEQ ID NO: 8338442 - DNA, 22 bp, Homo sapiens
ggagggtgcagaccctttgcaa

SEQ ID NO: 8338443 - DNA, 22 bp, Homo sapiens
ggagggtccccagcagcatgaa

SEQ ID NO: 8338444 - DNA, 22 bp, Homo sapiens
ggagggtgcattttaccctgtg

SEQ ID NO: 8338445 - DNA, 22 bp, Homo sapiens
ggagtagctgcattccgagcac

SEQ ID NO: 8338446 - DNA, 22 bp, Homo sapiens
ggaggtgggagcctccagtggt

SEQ ID NO: 8338447 - DNA, 22 bp, Homo sapiens
ggaggtgggattaggacctaaa

SEQ ID NO: 8338448 - DNA, 22 bp, Homo sapiens
ggaggtggcctgaaaatgtggc

SEQ ID NO: 8338449 - DNA, 22 bp, Homo sapiens
ggaggtgggagacataggcggc

SEQ ID NO: 8338450 - DNA, 22 bp, Homo sapiens
ggaggtgggagacataggcggc

SEQ ID NO: 8338451 - DNA, 22 bp, Homo sapiens
ggagggtggcagcgtcctgggc

SEQ ID NO: 8338452 - DNA, 22 bp, Homo sapiens
ggaggtggaggttgcagtgagc

SEQ ID NO: 8338453 - DNA, 22 bp, Homo sapiens
ggaggctgagaggtcgcagtgg

SEQ ID NO: 8338454 - DNA, 22 bp, Homo sapiens
ggaggctgaggcaggcggatca

SEQ ID NO: 8338455 - DNA, 22 bp, Homo sapiens
ggaggctgaggcaggcggatca

SEQ ID NO: 8338456 - DNA, 22 bp, Homo sapiens
ggaggctgaggcccctcacagg

SEQ ID NO: 8338457 - DNA, 22 bp, Homo sapiens
ggaggctgaggcccctcacagg

SEQ ID NO: 8338458 - DNA, 22 bp, Homo sapiens
ggaggctgctgcctcacgtggg

SEQ ID NO: 8338459 - DNA, 22 bp, Homo sapiens
ggaggctgctgcctcacgtggg

SEQ ID NO: 8338460 - DNA, 22 bp, Homo sapiens
ggaggctgagaagtccaagatc

SEQ ID NO: 8338461 - DNA, 22 bp, Homo sapiens
ggaggctcttgagaggggagta

SEQ ID NO: 8338462 - DNA, 22 bp, Homo sapiens
ggaggctgagaagtccaagatc

SEQ ID NO: 8338463 - DNA, 22 bp, Homo sapiens
ggaggcccagaaggaagcccag

SEQ ID NO: 8338464 - DNA, 22 bp, Homo sapiens
ggaggcccagaaggaagcccag

SEQ ID NO: 8338465 - DNA, 22 bp, Homo sapiens
ggaggccttgaggccaggagct

SEQ ID NO: 8338466 - DNA, 22 bp, Homo sapiens
ggaggcggaggttgcagtgagc

SEQ ID NO: 8338467 - DNA, 22 bp, Homo sapiens
ggaggcctagccagctccagtt

SEQ ID NO: 8338468 - DNA, 22 bp, Homo sapiens
ggaggcctcctgggggaggttc

SEQ ID NO: 8338469 - DNA, 22 bp, Homo sapiens
ggaggcctcctgggggaggttc

SEQ ID NO: 8338470 - DNA, 22 bp, Homo sapiens
ggaggctccatgagctcctgca

SEQ ID NO: 8338471 - DNA, 22 bp, Homo sapiens
ggaggcggggaaggcatcccat

SEQ ID NO: 8338472 - DNA, 22 bp, Homo sapiens
ggaggcggggaaggcatcccat

SEQ ID NO: 8338473 - DNA, 22 bp, Homo sapiens
ggaggctcagactccatcctca

SEQ ID NO: 8338474 - DNA, 22 bp, Homo sapiens
ggaggcggaggttgcagtgagc

SEQ ID NO: 8338475 - DNA, 22 bp, Homo sapiens
ggaggcggaggttgcagtgagt

SEQ ID NO: 8338476 - DNA, 22 bp, Homo sapiens
ggaggcggaggttgcagtgagt

SEQ ID NO: 8338477 - DNA, 22 bp, Homo sapiens
ggagggctgagactggggtctg

SEQ ID NO: 8338478 - DNA, 22 bp, Homo sapiens
ggagggctgccaggtggagcgg

SEQ ID NO: 8338479 - DNA, 18 bp, Homo sapiens
ggagggctttggggactg

SEQ ID NO: 8338480 - DNA, 22 bp, Homo sapiens
ggagggctgtagaggagacctg

SEQ ID NO: 8338481 - DNA, 22 bp, Homo sapiens
ggagggctgccacccgctcacg

SEQ ID NO: 8338482 - DNA, 22 bp, Homo sapiens
ggagggcccctccagtgggcag

SEQ ID NO: 8338483 - DNA, 22 bp, Homo sapiens
ggagggccatcttgggtgtgat

SEQ ID NO: 8338484 - DNA, 22 bp, Homo sapiens
ggagggcatcaatcaggcctgg

SEQ ID NO: 8338485 - DNA, 22 bp, Homo sapiens
ggaaggggtgggtgagcctcag

SEQ ID NO: 8338486 - DNA, 21 bp, Homo sapiens
ggaaggggtcctcccaacagt

SEQ ID NO: 8338487 - DNA, 22 bp, Homo sapiens
ggaagaaatctggttaagagat

SEQ ID NO: 8338488 - DNA, 22 bp, Homo sapiens
ggaaggggttaggggtccctga

SEQ ID NO: 8338489 - DNA, 22 bp, Homo sapiens
ggaaggggtgtcgcccatggat

SEQ ID NO: 8338490 - DNA, 17 bp, Homo sapiens
ggaagaaaaggatcatc

SEQ ID NO: 8338491 - DNA, 22 bp, Homo sapiens
ggaagaaaatgggcaacaggtg

SEQ ID NO: 8338492 - DNA, 22 bp, Homo sapiens
ggaagaaaggtggacaacaggt

SEQ ID NO: 8338493 - DNA, 22 bp, Homo sapiens
ggaaagaatcaagtgatcctgt

SEQ ID NO: 8338494 - DNA, 22 bp, Homo sapiens
ggaaagaaagtgtgaacaactt

SEQ ID NO: 8338495 - DNA, 22 bp, Homo sapiens
ggaaagaaccctggatggctgg

SEQ ID NO: 8338496 - DNA, 21 bp, Homo sapiens
ggaaagaaggcaaggctcagg

SEQ ID NO: 8338497 - DNA, 22 bp, Homo sapiens
ggaaagaatagagactttatca

SEQ ID NO: 8338498 - DNA, 22 bp, Homo sapiens
ggaaaactgaggctctcagcag

SEQ ID NO: 8338499 - DNA, 22 bp, Homo sapiens
ggaaaacaagagaatgatgttt

SEQ ID NO: 8338500 - DNA, 22 bp, Homo sapiens
gcttctggcagtgcagccacca

SEQ ID NO: 8338501 - DNA, 22 bp, Homo sapiens
ggaaacagctctttggggctgt

SEQ ID NO: 8338502 - DNA, 22 bp, Homo sapiens
ggaaacagagggcacctgagcc

SEQ ID NO: 8338503 - DNA, 19 bp, Homo sapiens
ggaaacaggggccagagga

SEQ ID NO: 8338504 - DNA, 22 bp, Homo sapiens
ggaaaccaggactgcaccgtct

SEQ ID NO: 8338505 - DNA, 22 bp, Homo sapiens
gcttcagaaatgaacactgtct

SEQ ID NO: 8338506 - DNA, 22 bp, Homo sapiens
gcttcagatttatgtatcattg

SEQ ID NO: 8338507 - DNA, 22 bp, Homo sapiens
gcttcagagatttcactagttt

SEQ ID NO: 8338508 - DNA, 22 bp, Homo sapiens
gcttcctgggacaggctatgtg

SEQ ID NO: 8338509 - DNA, 22 bp, Homo sapiens
gcttcattactgacagtctgtg

SEQ ID NO: 8338510 - DNA, 22 bp, Homo sapiens
gcttcctggagggagagagctg

SEQ ID NO: 8338511 - DNA, 17 bp, Homo sapiens
gcttcctgtgctgggga

SEQ ID NO: 8338512 - DNA, 22 bp, Homo sapiens
gcttcctgtccctcagccatga

SEQ ID NO: 8338513 - DNA, 22 bp, Homo sapiens
gcttcctgtccaggccccacat

SEQ ID NO: 8338514 - DNA, 22 bp, Homo sapiens
gcttcctgtaggcaggtccaag

SEQ ID NO: 8338515 - DNA, 22 bp, Homo sapiens
gcttcctgtatcctcctgtacc

SEQ ID NO: 8338516 - DNA, 22 bp, Homo sapiens
gcttctgcgcctagcctcaggt

SEQ ID NO: 8338517 - DNA, 22 bp, Homo sapiens
gcttctgcagggtcctcgctgt

SEQ ID NO: 8338518 - DNA, 22 bp, Homo sapiens
gcttctgcagggtcctcgctgt

SEQ ID NO: 8338519 - DNA, 22 bp, Homo sapiens
gctgggcatgtgaccaacagaa

SEQ ID NO: 8338520 - DNA, 22 bp, Homo sapiens
gcttagtcaattataaataggc

SEQ ID NO: 8338521 - DNA, 22 bp, Homo sapiens
gcttagctgcatgcatgttctt

SEQ ID NO: 8338522 - DNA, 22 bp, Homo sapiens
gcttattttatcctattcacta

SEQ ID NO: 8338523 - DNA, 22 bp, Homo sapiens
ggaggaagggcccaggctttat

SEQ ID NO: 8338524 - DNA, 22 bp, Homo sapiens
ggaggaagcacacggcttgtat

SEQ ID NO: 8338525 - DNA, 22 bp, Homo sapiens
ggaggagcatgagagggtagtg

SEQ ID NO: 8338526 - DNA, 22 bp, Homo sapiens
ggagctgagcagcgatggcgga

SEQ ID NO: 8338527 - DNA, 22 bp, Homo sapiens
ggagctgaggtaacagtgagtg

SEQ ID NO: 8338528 - DNA, 22 bp, Homo sapiens
ggagctgatgacgtcaccatgg

SEQ ID NO: 8338529 - DNA, 22 bp, Homo sapiens
ggagctgatggtagaagaatga

SEQ ID NO: 8338530 - DNA, 22 bp, Homo sapiens
ggagctgcacgctctgaagcct

SEQ ID NO: 8338531 - DNA, 22 bp, Homo sapiens
ggagctcctggcagtgacagag

SEQ ID NO: 8338532 - DNA, 22 bp, Homo sapiens
ggaggccacctgacctgctgtt

SEQ ID NO: 8338533 - DNA, 22 bp, Homo sapiens
ggaggccacctgacctgctgtt

SEQ ID NO: 8338534 - DNA, 22 bp, Homo sapiens
ggaggaggcaagtaccagatgc

SEQ ID NO: 8338535 - DNA, 22 bp, Homo sapiens
ggaggaggcaagtaccagatgc

SEQ ID NO: 8338536 - DNA, 22 bp, Homo sapiens
ggaggcagaatagagtgtgggt

SEQ ID NO: 8338537 - DNA, 22 bp, Homo sapiens
ggaggcagaatagagtgtgggt

SEQ ID NO: 8338538 - DNA, 22 bp, Homo sapiens
ggaggccaggaagagccgccct

SEQ ID NO: 8338539 - DNA, 22 bp, Homo sapiens
ggaggccatcagggagggcatt

SEQ ID NO: 8338540 - DNA, 22 bp, Homo sapiens
ggaggccagtcctggccgggct

SEQ ID NO: 8338541 - DNA, 22 bp, Homo sapiens
ggagagggtaggggtcctgccc

SEQ ID NO: 8338542 - DNA, 22 bp, Homo sapiens
ggagaggtgtattcagtgggtc

SEQ ID NO: 8338543 - DNA, 17 bp, Homo sapiens
ggagatctggcagaggg

SEQ ID NO: 8338544 - DNA, 22 bp, Homo sapiens
ggagatcttgcttgaaggcatg

SEQ ID NO: 8338545 - DNA, 22 bp, Homo sapiens
ggagatctttaggagttggact

SEQ ID NO: 8338546 - DNA, 22 bp, Homo sapiens
ggagaggtgaatggctgctcta

SEQ ID NO: 8338547 - DNA, 22 bp, Homo sapiens
ggagcggcagatggagtgggag

SEQ ID NO: 8338548 - DNA, 22 bp, Homo sapiens
ggagatctttgttatcttttga

SEQ ID NO: 8338549 - DNA, 22 bp, Homo sapiens
ggagatgacacaatttatttat

SEQ ID NO: 8338550 - DNA, 22 bp, Homo sapiens
ggagacagcaggaagaaatatc

SEQ ID NO: 8338551 - DNA, 22 bp, Homo sapiens
ggaagtggtagagccatgagtg

SEQ ID NO: 8338552 - DNA, 22 bp, Homo sapiens
gggccaggtggaccccagcctc

SEQ ID NO: 8338553 - DNA, 22 bp, Homo sapiens
gggccagtctgactctgctggt

SEQ ID NO: 8338554 - DNA, 22 bp, Homo sapiens
gggccagtagcacctgtgtgga

SEQ ID NO: 8338555 - DNA, 22 bp, Homo sapiens
gggccacaggccttgcccgcag

SEQ ID NO: 8338556 - DNA, 22 bp, Homo sapiens
gggcagcctcggtgcctgctgc

SEQ ID NO: 8338557 - DNA, 20 bp, Homo sapiens
gggcagcctcgggagtgggt

SEQ ID NO: 8338558 - DNA, 22 bp, Homo sapiens
gggcagcctcggtgcctgctgc

SEQ ID NO: 8338559 - DNA, 20 bp, Homo sapiens
gggcagctcccctcattctg

SEQ ID NO: 8338560 - DNA, 22 bp, Homo sapiens
gggcagaggggcgcttccctct

SEQ ID NO: 8338561 - DNA, 22 bp, Homo sapiens
gggcagaggttcaacttcaaca

SEQ ID NO: 8338562 - DNA, 18 bp, Homo sapiens
gggcagcacagcagcctc

SEQ ID NO: 8338563 - DNA, 22 bp, Homo sapiens
gggcagcacgtttcaggaggat

SEQ ID NO: 8338564 - DNA, 22 bp, Homo sapiens
gggcagcagaattggacagaaa

SEQ ID NO: 8338565 - DNA, 22 bp, Homo sapiens
gggcagcagaattggacagaaa

SEQ ID NO: 8338566 - DNA, 20 bp, Homo sapiens
gggcagcctcgggagtgggt

SEQ ID NO: 8338567 - DNA, 19 bp, Homo sapiens
gggcccagcatggagggtt

SEQ ID NO: 8338568 - DNA, 22 bp, Homo sapiens
gggcccagcactggctgggatc

SEQ ID NO: 8338569 - DNA, 22 bp, Homo sapiens
gggcccagccctctgctcactg

SEQ ID NO: 8338570 - DNA, 22 bp, Homo sapiens
gggcctggtgcttctgactcct

SEQ ID NO: 8338571 - DNA, 22 bp, Homo sapiens
gggcccagcactggctgggatc

SEQ ID NO: 8338572 - DNA, 23 bp, Homo sapiens
gggcccagcacaggacctggcag

SEQ ID NO: 8338573 - DNA, 22 bp, Homo sapiens
gggccagtgggacctgggtctc

SEQ ID NO: 8338574 - DNA, 22 bp, Homo sapiens
gggcgtggatggtcagtgcagg

SEQ ID NO: 8338575 - DNA, 22 bp, Homo sapiens
gggcgtcctggaccctcccctg

SEQ ID NO: 8338576 - DNA, 22 bp, Homo sapiens
gggcggtgcctgtctccgaagc

SEQ ID NO: 8338577 - DNA, 22 bp, Homo sapiens
gggcgtcctggaccctcccctg

SEQ ID NO: 8338578 - DNA, 22 bp, Homo sapiens
gggcggtgcctgtctccgaagc

SEQ ID NO: 8338579 - DNA, 22 bp, Homo sapiens
gggcggggtggctcatgcctgt

SEQ ID NO: 8338580 - DNA, 22 bp, Homo sapiens
gggcggggggagctggaatgaa

SEQ ID NO: 8338581 - DNA, 22 bp, Homo sapiens
gggcggggggagctggaatgaa

SEQ ID NO: 8338582 - DNA, 22 bp, Homo sapiens
gggcggggcttccgtcctccac

SEQ ID NO: 8338583 - DNA, 22 bp, Homo sapiens
gggcggatcacctgaggtcagg

SEQ ID NO: 8338584 - DNA, 22 bp, Homo sapiens
gggcggatcatttgaggtcagg

SEQ ID NO: 8338585 - DNA, 22 bp, Homo sapiens
gggacgggcacggagggccctc

SEQ ID NO: 8338586 - DNA, 22 bp, Homo sapiens
gggacgggcacggagggccctc

SEQ ID NO: 8338587 - DNA, 22 bp, Homo sapiens
gggacgggcagtccaaggggtc

SEQ ID NO: 8338588 - DNA, 22 bp, Homo sapiens
gggacgggcagtccaaggggtc

SEQ ID NO: 8338589 - DNA, 22 bp, Homo sapiens
gggacctcgcatgcacgaagcc

SEQ ID NO: 8338590 - DNA, 20 bp, Homo sapiens
gggagaagggctgatgagag

SEQ ID NO: 8338591 - DNA, 22 bp, Homo sapiens
gggagaaggaggactgtgctgt

SEQ ID NO: 8338592 - DNA, 20 bp, Homo sapiens
gggaggcgagggctgagcag

SEQ ID NO: 8338593 - DNA, 22 bp, Homo sapiens
gggaggctgccatccttcagga

SEQ ID NO: 8338594 - DNA, 22 bp, Homo sapiens
gggaggctcagtggtgtcctct

SEQ ID NO: 8338595 - DNA, 22 bp, Homo sapiens
gggaggcgccgagggtagctaa

SEQ ID NO: 8338596 - DNA, 22 bp, Homo sapiens
gggaggcgccgagggtagctaa

SEQ ID NO: 8338597 - DNA, 22 bp, Homo sapiens
gggatctgacttgctggtgggt

SEQ ID NO: 8338598 - DNA, 21 bp, Homo sapiens
gggatctgaggcaagtctcct

SEQ ID NO: 8338599 - DNA, 22 bp, Homo sapiens
gggatgaggatcaatcagggag

SEQ ID NO: 8338600 - DNA, 22 bp, Homo sapiens
gggatctgatgcactgctgaaa

SEQ ID NO: 8338601 - DNA, 22 bp, Homo sapiens
gggatctgagttgtcaggaagg

SEQ ID NO: 8338602 - DNA, 22 bp, Homo sapiens
gggaggctggctctggccacag

SEQ ID NO: 8338603 - DNA, 22 bp, Homo sapiens
gggaggctgccatccttcagga

SEQ ID NO: 8338604 - DNA, 22 bp, Homo sapiens
gggaggcttgagccatactgcc

SEQ ID NO: 8338605 - DNA, 22 bp, Homo sapiens
gggatggggagctggaaagggg

SEQ ID NO: 8338606 - DNA, 22 bp, Homo sapiens
gggatggctttgtggctgactc

SEQ ID NO: 8338607 - DNA, 22 bp, Homo sapiens
gggctctggtacttcctggctc

SEQ ID NO: 8338608 - DNA, 22 bp, Homo sapiens
gggctctggtcctgaactgaag

SEQ ID NO: 8338609 - DNA, 22 bp, Homo sapiens
gggctctggtacttcctggctc

SEQ ID NO: 8338610 - DNA, 22 bp, Homo sapiens
gggctctggtgctattgacgaa

SEQ ID NO: 8338611 - DNA, 22 bp, Homo sapiens
gggctctggtgccttcacagaa

SEQ ID NO: 8338612 - DNA, 20 bp, Homo sapiens
gggctctgtaaggttgaaag

SEQ ID NO: 8338613 - DNA, 20 bp, Homo sapiens
gggctctgtaaggttgaaag

SEQ ID NO: 8338614 - DNA, 22 bp, Homo sapiens
gggctctgtccattccttcata

SEQ ID NO: 8338615 - DNA, 22 bp, Homo sapiens
gggctctgtccattccttcata

SEQ ID NO: 8338616 - DNA, 22 bp, Homo sapiens
gggctctgtggatgtgagagct

SEQ ID NO: 8338617 - DNA, 22 bp, Homo sapiens
gggctctgtggcttccttctta

SEQ ID NO: 8338618 - DNA, 22 bp, Homo sapiens
gggctctgtggcttccttctta

SEQ ID NO: 8338619 - DNA, 22 bp, Homo sapiens
gggctctgtggatgtgagagct

SEQ ID NO: 8338620 - DNA, 22 bp, Homo sapiens
gggctagcctcttccctgctcc

SEQ ID NO: 8338621 - DNA, 22 bp, Homo sapiens
gggctctgggtcgtgtctccat

SEQ ID NO: 8338622 - DNA, 22 bp, Homo sapiens
gggctctggggtgccctggcat

SEQ ID NO: 8338623 - DNA, 22 bp, Homo sapiens
gggctctgggtcgtgtctccat

SEQ ID NO: 8338624 - DNA, 22 bp, Homo sapiens
gggctctgtgttctagctctcg

SEQ ID NO: 8338625 - DNA, 22 bp, Homo sapiens
gggctctgtggttgtgctttgt

SEQ ID NO: 8338626 - DNA, 22 bp, Homo sapiens
gggctctgtggcttccttctta

SEQ ID NO: 8338627 - DNA, 22 bp, Homo sapiens
gggctggacatctaaggtagct

SEQ ID NO: 8338628 - DNA, 22 bp, Homo sapiens
gggctggaagacaggaaatgct

SEQ ID NO: 8338629 - DNA, 22 bp, Homo sapiens
gggctgcttggaggaggcgctc

SEQ ID NO: 8338630 - DNA, 22 bp, Homo sapiens
gggctgctgtgttcctgaggca

SEQ ID NO: 8338631 - DNA, 22 bp, Homo sapiens
gggctggatgtttgatgacgaa

SEQ ID NO: 8338632 - DNA, 22 bp, Homo sapiens
gggctggatctcctgcaggcag

SEQ ID NO: 8338633 - DNA, 22 bp, Homo sapiens
gggctggcatcagttgccgaga

SEQ ID NO: 8338634 - DNA, 22 bp, Homo sapiens
gggctggcaggacctgggctga

SEQ ID NO: 8338635 - DNA, 22 bp, Homo sapiens
gggctggactgcattgcctcgc

SEQ ID NO: 8338636 - DNA, 22 bp, Homo sapiens
gggctggagcctggcggtggtt

SEQ ID NO: 8338637 - DNA, 16 bp, Homo sapiens
ggggaaggcaagaggg

SEQ ID NO: 8338638 - DNA, 22 bp, Homo sapiens
ggggaaggattgagttgaccca

SEQ ID NO: 8338639 - DNA, 23 bp, Homo sapiens
ggggacagttcccactggggtct

SEQ ID NO: 8338640 - DNA, 22 bp, Homo sapiens
gggtctggacggctgcaggaag

SEQ ID NO: 8338641 - DNA, 21 bp, Homo sapiens
gggtctgaatatctggtgctg

SEQ ID NO: 8338642 - DNA, 22 bp, Homo sapiens
gggtctctcctccccagctgtg

SEQ ID NO: 8338643 - DNA, 22 bp, Homo sapiens
gggtgacatttcccaatgagcc

SEQ ID NO: 8338644 - DNA, 22 bp, Homo sapiens
gggtgggccactgagcagcgtg

SEQ ID NO: 8338645 - DNA, 22 bp, Homo sapiens
gggtgggccccaggtatctgta

SEQ ID NO: 8338646 - DNA, 22 bp, Homo sapiens
gggtgggcccagcccagagaag

SEQ ID NO: 8338647 - DNA, 22 bp, Homo sapiens
gggtgggatggcaggagccgct

SEQ ID NO: 8338648 - DNA, 22 bp, Homo sapiens
gggtgggatggcaggagccgct

SEQ ID NO: 8338649 - DNA, 23 bp, Homo sapiens
gggtgggccaaattaggtagcct

SEQ ID NO: 8338650 - DNA, 17 bp, Homo sapiens
gggtgggcactgctggc

SEQ ID NO: 8338651 - DNA, 22 bp, Homo sapiens
gggtgaggagctgccagtcatg

SEQ ID NO: 8338652 - DNA, 22 bp, Homo sapiens
gggtgaggagctgccagtcatg

SEQ ID NO: 8338653 - DNA, 22 bp, Homo sapiens
gggggctctgactccctcagct

SEQ ID NO: 8338654 - DNA, 22 bp, Homo sapiens
ggggacgcagaaagagtggcag

SEQ ID NO: 8338655 - DNA, 22 bp, Homo sapiens
ggggacgggacttagcatgagt

SEQ ID NO: 8338656 - DNA, 22 bp, Homo sapiens
ggggactctgcttctgggatca

SEQ ID NO: 8338657 - DNA, 16 bp, Homo sapiens
gggggctgcaagcttc

SEQ ID NO: 8338658 - DNA, 22 bp, Homo sapiens
gggggctgatcatttactgggc

SEQ ID NO: 8338659 - DNA, 22 bp, Homo sapiens
gggggctgatcatttactgggc

SEQ ID NO: 8338660 - DNA, 22 bp, Homo sapiens
gggggctggaatatccatcaac

SEQ ID NO: 8338661 - DNA, 22 bp, Homo sapiens
gggggctggactttcccacaca

SEQ ID NO: 8338662 - DNA, 23 bp, Homo sapiens
gggggctggttgactctctgcag

SEQ ID NO: 8338663 - DNA, 23 bp, Homo sapiens
gggggctggttgactctctgcag

SEQ ID NO: 8338664 - DNA, 23 bp, Homo sapiens
gggggctggttgactctctgcag

SEQ ID NO: 8338665 - DNA, 22 bp, Homo sapiens
gggggctgtcctgtgcattgta

SEQ ID NO: 8338666 - DNA, 22 bp, Homo sapiens
gggggtgagcctgccaggccca

SEQ ID NO: 8338667 - DNA, 22 bp, Homo sapiens
gggggtgagcctgccaggccca

SEQ ID NO: 8338668 - DNA, 22 bp, Homo sapiens
gggggtggttctaagtcctata

SEQ ID NO: 8338669 - DNA, 22 bp, Homo sapiens
gggtccagggccagtggctgag

SEQ ID NO: 8338670 - DNA, 20 bp, Homo sapiens
ggggggcttcagggcctgtg

SEQ ID NO: 8338671 - DNA, 22 bp, Homo sapiens
ggggggcagctgtcctggccat

SEQ ID NO: 8338672 - DNA, 22 bp, Homo sapiens
gggggtgacgatggcagctggt

SEQ ID NO: 8338673 - DNA, 22 bp, Homo sapiens
ggctgatctcgtgtgaccttgt

SEQ ID NO: 8338674 - DNA, 22 bp, Homo sapiens
ggctgcagagctggtgccctgg

SEQ ID NO: 8338675 - DNA, 22 bp, Homo sapiens
ggctgcagaggcccccagtggg

SEQ ID NO: 8338676 - DNA, 22 bp, Homo sapiens
ggctgcagaggcgatctgaggt

SEQ ID NO: 8338677 - DNA, 19 bp, Homo sapiens
ggctgcagagccccggcgc

SEQ ID NO: 8338678 - DNA, 22 bp, Homo sapiens
ggctgcagagctgggtgggcct

SEQ ID NO: 8338679 - DNA, 22 bp, Homo sapiens
ggctcctggaaagccctcgctc

SEQ ID NO: 8338680 - DNA, 22 bp, Homo sapiens
ggctcctgggcagctgctccct

SEQ ID NO: 8338681 - DNA, 23 bp, Homo sapiens
ggctccttgcccatccagcagcc

SEQ ID NO: 8338682 - DNA, 22 bp, Homo sapiens
ggctcctggggaggtgagcttg

SEQ ID NO: 8338683 - DNA, 19 bp, Homo sapiens
ggctcctgtggctgcagcc

SEQ ID NO: 8338684 - DNA, 22 bp, Homo sapiens
ggctgctcttcttggcgacctc

SEQ ID NO: 8338685 - DNA, 22 bp, Homo sapiens
ggctgctcggcagctcctgagc

SEQ ID NO: 8338686 - DNA, 22 bp, Homo sapiens
ggctgctctccatcccaggcct

SEQ ID NO: 8338687 - DNA, 22 bp, Homo sapiens
ggctgctcggagcctcctgtga

SEQ ID NO: 8338688 - DNA, 22 bp, Homo sapiens
ggctggcctctacagggaggca

SEQ ID NO: 8338689 - DNA, 22 bp, Homo sapiens
ggctggcctcagggtcctcgct

SEQ ID NO: 8338690 - DNA, 22 bp, Homo sapiens
ggctgctgaacaagggaaccct

SEQ ID NO: 8338691 - DNA, 23 bp, Homo sapiens
ggctggcccggggctgctcctga

SEQ ID NO: 8338692 - DNA, 22 bp, Homo sapiens
ggctgcaggaacgacggagggg

SEQ ID NO: 8338693 - DNA, 22 bp, Homo sapiens
ggctgcaggatgcccagccgtg

SEQ ID NO: 8338694 - DNA, 22 bp, Homo sapiens
ggctgcaggcagaggctgtctg

SEQ ID NO: 8338695 - DNA, 22 bp, Homo sapiens
ggctgtgtccccacctgagcag

SEQ ID NO: 8338696 - DNA, 21 bp, Homo sapiens
ggctgtgttcagggcatgcgg

SEQ ID NO: 8338697 - DNA, 22 bp, Homo sapiens
ggcttcccaaggagccaggatg

SEQ ID NO: 8338698 - DNA, 22 bp, Homo sapiens
ggcttcccagcagagggcgcac

SEQ ID NO: 8338699 - DNA, 22 bp, Homo sapiens
ggcttccccacagtcctgagct

SEQ ID NO: 8338700 - DNA, 22 bp, Homo sapiens
ggctgtggtctgggtgctcccc

SEQ ID NO: 8338701 - DNA, 22 bp, Homo sapiens
ggctggctggctggtagacaag

SEQ ID NO: 8338702 - DNA, 22 bp, Homo sapiens
ggctggctggcttagcagagga

SEQ ID NO: 8338703 - DNA, 22 bp, Homo sapiens
ggctggctgataaagggttgag

SEQ ID NO: 8338704 - DNA, 22 bp, Homo sapiens
ggctggctcagggcttgagaga

SEQ ID NO: 8338705 - DNA, 22 bp, Homo sapiens
ggctggctcatgcaaagggtga

SEQ ID NO: 8338706 - DNA, 22 bp, Homo sapiens
gggaaatctcgtcctctattta

SEQ ID NO: 8338707 - DNA, 23 bp, Homo sapiens
gggaaatcaaaagatatttcttc

SEQ ID NO: 8338708 - DNA, 21 bp, Homo sapiens
gggaaattaggattgctcatc

SEQ ID NO: 8338709 - DNA, 19 bp, Homo sapiens
gggaaattcacttgcttcc

SEQ ID NO: 8338710 - DNA, 22 bp, Homo sapiens
gggaaattgtgtgagatctttg

SEQ ID NO: 8338711 - DNA, 22 bp, Homo sapiens
gggaaattgtcaacactctcaa

SEQ ID NO: 8338712 - DNA, 22 bp, Homo sapiens
gggaagaagacatggtgaaggc

SEQ ID NO: 8338713 - DNA, 22 bp, Homo sapiens
gggaacagagtgccagactgac

SEQ ID NO: 8338714 - DNA, 22 bp, Homo sapiens
ggctcaggtttccttcccagct

SEQ ID NO: 8338715 - DNA, 22 bp, Homo sapiens
ggctcaggtttccttcccagct

SEQ ID NO: 8338716 - DNA, 22 bp, Homo sapiens
ggctcaggcctgtaatcctagc

SEQ ID NO: 8338717 - DNA, 22 bp, Homo sapiens
ggctcaggtttccttcccagct

SEQ ID NO: 8338718 - DNA, 21 bp, Homo sapiens
ggctcctgctttgtgaggggc

SEQ ID NO: 8338719 - DNA, 22 bp, Homo sapiens
ggctcctgcacctgtccctctg

SEQ ID NO: 8338720 - DNA, 22 bp, Homo sapiens
ggctccaccctgcttccagaag

SEQ ID NO: 8338721 - DNA, 22 bp, Homo sapiens
ggctcaggacctgggattgcca

SEQ ID NO: 8338722 - DNA, 22 bp, Homo sapiens
ggctcaggactgcagcgtagag

SEQ ID NO: 8338723 - DNA, 22 bp, Homo sapiens
ggctcagcttatctgggcaggc

SEQ ID NO: 8338724 - DNA, 22 bp, Homo sapiens
ggctcaggacacagtggtttag

SEQ ID NO: 8338725 - DNA, 22 bp, Homo sapiens
ggctcagcttggtgcgcagaaa

SEQ ID NO: 8338726 - DNA, 22 bp, Homo sapiens
ggctcaggagaggggctaaaag

SEQ ID NO: 8338727 - DNA, 22 bp, Homo sapiens
ggctcaggagaggggctaaaag

SEQ ID NO: 8338728 - DNA, 22 bp, Homo sapiens
ggctcaggatgagccttctcat

SEQ ID NO: 8338729 - DNA, 22 bp, Homo sapiens
ggctcaggccagaccacgactc

SEQ ID NO: 8338730 - DNA, 22 bp, Homo sapiens
ggctcaggatgagccttctcat

SEQ ID NO: 8338731 - DNA, 22 bp, Homo sapiens
ggctcaggatgagccttctcat

SEQ ID NO: 8338732 - DNA, 20 bp, Homo sapiens
ggccttggcctctttgcagc

SEQ ID NO: 8338733 - DNA, 22 bp, Homo sapiens
ggccttggcctagccctccagg

SEQ ID NO: 8338734 - DNA, 22 bp, Homo sapiens
ggccttgggaggagggtcagaa

SEQ ID NO: 8338735 - DNA, 22 bp, Homo sapiens
ggctcagcgcgctgggagggag

SEQ ID NO: 8338736 - DNA, 22 bp, Homo sapiens
ggctcagcacagggctggcatc

SEQ ID NO: 8338737 - DNA, 18 bp, Homo sapiens
ggctcagcaggctctctc

SEQ ID NO: 8338738 - DNA, 22 bp, Homo sapiens
ggccctgcaaggtacccaggcc

SEQ ID NO: 8338739 - DNA, 22 bp, Homo sapiens
ggccctgcatgagattaaggtt

SEQ ID NO: 8338740 - DNA, 22 bp, Homo sapiens
ggccctgcgattaggtggcagg

SEQ ID NO: 8338741 - DNA, 22 bp, Homo sapiens
ggccctgagcacagctcctctc

SEQ ID NO: 8338742 - DNA, 22 bp, Homo sapiens
ggccctgagtctagctgctctt

SEQ ID NO: 8338743 - DNA, 22 bp, Homo sapiens
ggccctgagtctagctgctctt

SEQ ID NO: 8338744 - DNA, 22 bp, Homo sapiens
ggccctctgtggctgccatgga

SEQ ID NO: 8338745 - DNA, 22 bp, Homo sapiens
ggccctcttttatccatcataa

SEQ ID NO: 8338746 - DNA, 22 bp, Homo sapiens
ggccctctgctcacttcctatt

SEQ ID NO: 8338747 - DNA, 22 bp, Homo sapiens
ggccctccctgagccaggtggg

SEQ ID NO: 8338748 - DNA, 22 bp, Homo sapiens
ggccttccagggaagacagggc

SEQ ID NO: 8338749 - DNA, 22 bp, Homo sapiens
ggccttgctgcttccagaaggt

SEQ ID NO: 8338750 - DNA, 22 bp, Homo sapiens
ggccttgcggaacgctcaggcg

SEQ ID NO: 8338751 - DNA, 22 bp, Homo sapiens
ggcccagcccgagtcagccttc

SEQ ID NO: 8338752 - DNA, 21 bp, Homo sapiens
ggccccgcagacccagcacgt

SEQ ID NO: 8338753 - DNA, 22 bp, Homo sapiens
ggccccagttcactcctggccg

SEQ ID NO: 8338754 - DNA, 22 bp, Homo sapiens
ggcccctcagcatctgagtcag

SEQ ID NO: 8338755 - DNA, 22 bp, Homo sapiens
ggcccagcctcagacatgccct

SEQ ID NO: 8338756 - DNA, 22 bp, Homo sapiens
ggcccagccggcgagtctcgcg

SEQ ID NO: 8338757 - DNA, 22 bp, Homo sapiens
ggcccagcgaggccacctacag

SEQ ID NO: 8338758 - DNA, 22 bp, Homo sapiens
ggccccagcagaccctcctctg

SEQ ID NO: 8338759 - DNA, 22 bp, Homo sapiens
ggccccaggtctgaacacgctg

SEQ ID NO: 8338760 - DNA, 22 bp, Homo sapiens
ggccagaaagttaagctgtggc

SEQ ID NO: 8338761 - DNA, 20 bp, Homo sapiens
ggcaggtgctcgcttggtct

SEQ ID NO: 8338762 - DNA, 22 bp, Homo sapiens
ggcaggtgctgggagcatctca

SEQ ID NO: 8338763 - DNA, 22 bp, Homo sapiens
ggcaggtgcttgtcgaaggcct

SEQ ID NO: 8338764 - DNA, 22 bp, Homo sapiens
ggcaggtgcttgtcgaaggcct

SEQ ID NO: 8338765 - DNA, 20 bp, Homo sapiens
ggcaggtgctgtcccctcct

SEQ ID NO: 8338766 - DNA, 22 bp, Homo sapiens
ggcaggtggaaggtctccattc

SEQ ID NO: 8338767 - DNA, 18 bp, Homo sapiens
ggccagagggagggtccc

SEQ ID NO: 8338768 - DNA, 22 bp, Homo sapiens
ggccagaggtggtacatagctt

SEQ ID NO: 8338769 - DNA, 17 bp, Homo sapiens
ggccagaggcggggctg

SEQ ID NO: 8338770 - DNA, 22 bp, Homo sapiens
ggccagagggagggcacaaatc

SEQ ID NO: 8338771 - DNA, 22 bp, Homo sapiens
ggccagaggacctctcatagcc

SEQ ID NO: 8338772 - DNA, 22 bp, Homo sapiens
gttcaagaccagcctggccaac

SEQ ID NO: 8338773 - DNA, 22 bp, Homo sapiens
gttcaagaccagcctggccaac

SEQ ID NO: 8338774 - DNA, 22 bp, Homo sapiens
gttcaaattgagatggtataaa

SEQ ID NO: 8338775 - DNA, 22 bp, Homo sapiens
gttcaaattgattttggtaaag

SEQ ID NO: 8338776 - DNA, 22 bp, Homo sapiens
gttcaaattttctaggtgggtg

SEQ ID NO: 8338777 - DNA, 21 bp, Homo sapiens
gttcaaatcctgacactacac

SEQ ID NO: 8338778 - DNA, 22 bp, Homo sapiens
gttcaaatctcaggacttcaga

SEQ ID NO: 8338779 - DNA, 21 bp, Homo sapiens
gttcaaatgggtagattcaca

SEQ ID NO: 8338780 - DNA, 18 bp, Homo sapiens
gttcaagccaacatcaag

SEQ ID NO: 8338781 - DNA, 22 bp, Homo sapiens
gttattttcattggctcagact

SEQ ID NO: 8338782 - DNA, 22 bp, Homo sapiens
gttgtcttagtcagaaatatgc

SEQ ID NO: 8338783 - DNA, 22 bp, Homo sapiens
gttctccattcagcttcctgtg

SEQ ID NO: 8338784 - DNA, 22 bp, Homo sapiens
gttctctagggctgtagactgg

SEQ ID NO: 8338785 - DNA, 22 bp, Homo sapiens
gtgtggggtcttctcttggcct

SEQ ID NO: 8338786 - DNA, 22 bp, Homo sapiens
gtgtgggggcagctctgatatg

SEQ ID NO: 8338787 - DNA, 22 bp, Homo sapiens
gtgtggtcgaagttctcccgga

SEQ ID NO: 8338788 - DNA, 22 bp, Homo sapiens
gtgtggtggccctccttcaggc

SEQ ID NO: 8338789 - DNA, 22 bp, Homo sapiens
gtgtgcagtagagaaagagcag

SEQ ID NO: 8338790 - DNA, 18 bp, Homo sapiens
gtgtgggctcctccgagt

SEQ ID NO: 8338791 - DNA, 22 bp, Homo sapiens
gtgtgggctatgtgcgtgggca

SEQ ID NO: 8338792 - DNA, 22 bp, Homo sapiens
gtgtgggcagggccgtgctccc

SEQ ID NO: 8338793 - DNA, 22 bp, Homo sapiens
gtgtggggagctgcagccacat

SEQ ID NO: 8338794 - DNA, 22 bp, Homo sapiens
gtgtggggccaggatcagggct

SEQ ID NO: 8338795 - DNA, 22 bp, Homo sapiens
gtgtcattaaccaccatgcaaa

SEQ ID NO: 8338796 - DNA, 21 bp, Homo sapiens
gtgtcatggttgactttggca

SEQ ID NO: 8338797 - DNA, 22 bp, Homo sapiens
gtgtcatgtagaaattgatgaa

SEQ ID NO: 8338798 - DNA, 22 bp, Homo sapiens
gtgtcatgggagtcagaagtga

SEQ ID NO: 8338799 - DNA, 22 bp, Homo sapiens
gtgtcatggaaaattgcaatgg

SEQ ID NO: 8338800 - DNA, 22 bp, Homo sapiens
gtgtcatggggtttgttataca

SEQ ID NO: 8338801 - DNA, 22 bp, Homo sapiens
gtgtcatgcacactcagtgttg

SEQ ID NO: 8338802 - DNA, 22 bp, Homo sapiens
gtgtccatcagcagccactgtg

SEQ ID NO: 8338803 - DNA, 22 bp, Homo sapiens
gtgtccttttatgtgactggtt

SEQ ID NO: 8338804 - DNA, 22 bp, Homo sapiens
gtgtccttttgagggtccacag

SEQ ID NO: 8338805 - DNA, 22 bp, Homo sapiens
gtgtcctgttcagaagcttggg

SEQ ID NO: 8338806 - DNA, 22 bp, Homo sapiens
gtgtccttgcagtttgaagaaa

SEQ ID NO: 8338807 - DNA, 22 bp, Homo sapiens
gtgtccttaagtcggttctcct

SEQ ID NO: 8338808 - DNA, 22 bp, Homo sapiens
gtgtcctgcaggccaggaatgg

SEQ ID NO: 8338809 - DNA, 22 bp, Homo sapiens
gtgtcctcttattgctcttggc

SEQ ID NO: 8338810 - DNA, 22 bp, Homo sapiens
gtggggtgtccagcagcgagct

SEQ ID NO: 8338811 - DNA, 22 bp, Homo sapiens
gtggggtgtccagcagcgagct

SEQ ID NO: 8338812 - DNA, 22 bp, Homo sapiens
gtggggggagctgcaagctgga

SEQ ID NO: 8338813 - DNA, 22 bp, Homo sapiens
gtgggggctggctcgtcctgtg

SEQ ID NO: 8338814 - DNA, 22 bp, Homo sapiens
gtgggggctggctcgtcctgtg

SEQ ID NO: 8338815 - DNA, 22 bp, Homo sapiens
gtgggggtggaaaggcaagttg

SEQ ID NO: 8338816 - DNA, 22 bp, Homo sapiens
gtgggggtttcattaagacaat

SEQ ID NO: 8338817 - DNA, 22 bp, Homo sapiens
gtggtcagcagcagtgggagtg

SEQ ID NO: 8338818 - DNA, 22 bp, Homo sapiens
gtggtcaggcagtgggagagaa

SEQ ID NO: 8338819 - DNA, 22 bp, Homo sapiens
gtgggtggaggcgtcgagggca

SEQ ID NO: 8338820 - DNA, 22 bp, Homo sapiens
gtgggtggagactgggtgcaag

SEQ ID NO: 8338821 - DNA, 21 bp, Homo sapiens
gtggttctagagaaacagaat

SEQ ID NO: 8338822 - DNA, 22 bp, Homo sapiens
gtggtggtcaccaaattgaggg

SEQ ID NO: 8338823 - DNA, 22 bp, Homo sapiens
gtggtcctgtcctgacggcttc

SEQ ID NO: 8338824 - DNA, 22 bp, Homo sapiens
gtggtccttacaggaggcttac

SEQ ID NO: 8338825 - DNA, 22 bp, Homo sapiens
gtggtcctttagaggatgtaat

SEQ ID NO: 8338826 - DNA, 22 bp, Homo sapiens
gtgtaaacaacagtggtttgaa

SEQ ID NO: 8338827 - DNA, 22 bp, Homo sapiens
gtgtaaggtgaaatcaacaaat

SEQ ID NO: 8338828 - DNA, 22 bp, Homo sapiens
gtgtaagaaccttctagagccc

SEQ ID NO: 8338829 - DNA, 22 bp, Homo sapiens
gtgtaaggccccaggttcttta

SEQ ID NO: 8338830 - DNA, 22 bp, Homo sapiens
gtggtttgttttattcctggaa

SEQ ID NO: 8338831 - DNA, 22 bp, Homo sapiens
gtggggagcagccttagcccct

SEQ ID NO: 8338832 - DNA, 22 bp, Homo sapiens
gtgggcttttgacagtgcctgg

SEQ ID NO: 8338833 - DNA, 22 bp, Homo sapiens
gtggggaggcctaagcaagttg

SEQ ID NO: 8338834 - DNA, 22 bp, Homo sapiens
gtgggggatgctgagttggaaa

SEQ ID NO: 8338835 - DNA, 22 bp, Homo sapiens
gtgggggatgctgagttggaaa

SEQ ID NO: 8338836 - DNA, 22 bp, Homo sapiens
gtgggggcaggcagtgctagga

SEQ ID NO: 8338837 - DNA, 22 bp, Homo sapiens
gtgggggctggaaatcttgcca

SEQ ID NO: 8338838 - DNA, 22 bp, Homo sapiens
gtgggggcagtgggcttcgagc

SEQ ID NO: 8338839 - DNA, 22 bp, Homo sapiens
gtgggcgatcatctcagccgtc

SEQ ID NO: 8338840 - DNA, 22 bp, Homo sapiens
gtgggctcaggcctctgtgggg

SEQ ID NO: 8338841 - DNA, 22 bp, Homo sapiens
gtgggctcccctggcatgtcca

SEQ ID NO: 8338842 - DNA, 22 bp, Homo sapiens
gtgggccaggcgtctaggccct

SEQ ID NO: 8338843 - DNA, 22 bp, Homo sapiens
gtgggctgttgttccctgttct

SEQ ID NO: 8338844 - DNA, 22 bp, Homo sapiens
gtgggctggaccctcctgctcc

SEQ ID NO: 8338845 - DNA, 22 bp, Homo sapiens
gtgggctggatttgcttgcaga

SEQ ID NO: 8338846 - DNA, 22 bp, Homo sapiens
gtgggctgcttcctccttccac

SEQ ID NO: 8338847 - DNA, 22 bp, Homo sapiens
gtgggcagacatgatagaagga

SEQ ID NO: 8338848 - DNA, 20 bp, Homo sapiens
gtgggcagagcaccacctgg

SEQ ID NO: 8338849 - DNA, 22 bp, Homo sapiens
gtgggcagagcaagggaactca

SEQ ID NO: 8338850 - DNA, 22 bp, Homo sapiens
gtgggcaaggtccctgccagct

SEQ ID NO: 8338851 - DNA, 22 bp, Homo sapiens
gtgggcagaacatttgtaggct

SEQ ID NO: 8338852 - DNA, 22 bp, Homo sapiens
gtgggcagaacatttgtaggct

SEQ ID NO: 8338853 - DNA, 22 bp, Homo sapiens
gtgggcagaattgaatctttaa

SEQ ID NO: 8338854 - DNA, 22 bp, Homo sapiens
gtgggcagacagtgctttgcag

SEQ ID NO: 8338855 - DNA, 20 bp, Homo sapiens
gtgggcagcaggcatactgg

SEQ ID NO: 8338856 - DNA, 22 bp, Homo sapiens
gtgggcagattatagatgatgc

SEQ ID NO: 8338857 - DNA, 22 bp, Homo sapiens
gtgggcagcaccagggaagtgt

SEQ ID NO: 8338858 - DNA, 22 bp, Homo sapiens
gtgggcagcaccagggaagtgt

SEQ ID NO: 8338859 - DNA, 20 bp, Homo sapiens
gtgggcagatgtgtgcatgg

SEQ ID NO: 8338860 - DNA, 20 bp, Homo sapiens
gtgggcagatgtgtgcatgg

SEQ ID NO: 8338861 - DNA, 22 bp, Homo sapiens
gtgggcagaggagagaacatta

SEQ ID NO: 8338862 - DNA, 22 bp, Homo sapiens
gtgggcagatacatttgatatg

SEQ ID NO: 8338863 - DNA, 22 bp, Homo sapiens
gtgggcagattaatttctcaat

SEQ ID NO: 8338864 - DNA, 22 bp, Homo sapiens
gtgggcagttcaattctgggag

SEQ ID NO: 8338865 - DNA, 22 bp, Homo sapiens
gtgggcagttggtgattctcgt

SEQ ID NO: 8338866 - DNA, 22 bp, Homo sapiens
gtgggccaggacccgctgtccg

SEQ ID NO: 8338867 - DNA, 22 bp, Homo sapiens
gtgggcagccccttcaaggcca

SEQ ID NO: 8338868 - DNA, 22 bp, Homo sapiens
gtgggcagcctcctttattttc

SEQ ID NO: 8338869 - DNA, 22 bp, Homo sapiens
gtgggcagcctgtccggagacc

SEQ ID NO: 8338870 - DNA, 22 bp, Homo sapiens
gtgggcagtgtgtcagtatctt

SEQ ID NO: 8338871 - DNA, 22 bp, Homo sapiens
gtgggcagtggtttgcgcggtc

SEQ ID NO: 8338872 - DNA, 19 bp, Homo sapiens
gtttttcccagacgaggca

SEQ ID NO: 8338873 - DNA, 21 bp, Homo sapiens
gtttttcagccctgaggtgag

SEQ ID NO: 8338874 - DNA, 22 bp, Homo sapiens
gtttttccttgctgaggacccg

SEQ ID NO: 8338875 - DNA, 22 bp, Homo sapiens
gtttttcctgctgacttgggtc

SEQ ID NO: 8338876 - DNA, 22 bp, Homo sapiens
gtttaaagtagcttccttttgg

SEQ ID NO: 8338877 - DNA, 22 bp, Homo sapiens
gttgttttgctgtctgtcttag

SEQ ID NO: 8338878 - DNA, 19 bp, Homo sapiens
gttgtttttcttattatgg

SEQ ID NO: 8338879 - DNA, 19 bp, Homo sapiens
gttgtttttcttattatgg

SEQ ID NO: 8338880 - DNA, 22 bp, Homo sapiens
gttttttcatgagtagttatct

SEQ ID NO: 8338881 - DNA, 22 bp, Homo sapiens
taaaacactcagcacctagcaa

SEQ ID NO: 8338882 - DNA, 22 bp, Homo sapiens
taaaacagcagggcagagaagt

SEQ ID NO: 8338883 - DNA, 22 bp, Homo sapiens
taaagcaggtgctcagtgacca

SEQ ID NO: 8338884 - DNA, 22 bp, Homo sapiens
taaagctgttcagtgcagaaag

SEQ ID NO: 8338885 - DNA, 22 bp, Homo sapiens
taaagcagtatgatggaaggat

SEQ ID NO: 8338886 - DNA, 22 bp, Homo sapiens
taacagaatagcagaaacagaa

SEQ ID NO: 8338887 - DNA, 22 bp, Homo sapiens
taacactgtccaaagaattcca

SEQ ID NO: 8338888 - DNA, 22 bp, Homo sapiens
taacactgtggtgttctttgtc

SEQ ID NO: 8338889 - DNA, 22 bp, Homo sapiens
taacagaggtagaattcaaggt

SEQ ID NO: 8338890 - DNA, 22 bp, Homo sapiens
taacagagatagaaatgtaaag

SEQ ID NO: 8338891 - DNA, 22 bp, Homo sapiens
taaatgagggctgacatgattg

SEQ ID NO: 8338892 - DNA, 22 bp, Homo sapiens
taaatgacattcttaagtcttg

SEQ ID NO: 8338893 - DNA, 22 bp, Homo sapiens
taaatgagatgtacataactca

SEQ ID NO: 8338894 - DNA, 22 bp, Homo sapiens
taacactgatttgttctcaggg

SEQ ID NO: 8338895 - DNA, 22 bp, Homo sapiens
taacactgatttgttctcaggg

SEQ ID NO: 8338896 - DNA, 22 bp, Homo sapiens
taacactgcttcattttggaga

SEQ ID NO: 8338897 - DNA, 22 bp, Homo sapiens
taacactggtatttcatttagt

SEQ ID NO: 8338898 - DNA, 22 bp, Homo sapiens
taacactggcttttgctgaggc

SEQ ID NO: 8338899 - DNA, 22 bp, Homo sapiens
taacactggagagttggttgtg

SEQ ID NO: 8338900 - DNA, 22 bp, Homo sapiens
taaatgaaagggtttaatttat

SEQ ID NO: 8338901 - DNA, 22 bp, Homo sapiens
taaatgaagaaatggagattgt

SEQ ID NO: 8338902 - DNA, 22 bp, Homo sapiens
taaatctcaataaagtctgtgg

SEQ ID NO: 8338903 - DNA, 22 bp, Homo sapiens
taaatctcactgggtatattgg

SEQ ID NO: 8338904 - DNA, 22 bp, Homo sapiens
taaatcactcctaataatcagt

SEQ ID NO: 8338905 - DNA, 22 bp, Homo sapiens
taaatcacccatctcctaatct

SEQ ID NO: 8338906 - DNA, 22 bp, Homo sapiens
taaatcagtttctcttattggt

SEQ ID NO: 8338907 - DNA, 22 bp, Homo sapiens
taaatcagggagtcatctgcga

SEQ ID NO: 8338908 - DNA, 22 bp, Homo sapiens
taaatcaggaaggaaacttgga

SEQ ID NO: 8338909 - DNA, 22 bp, Homo sapiens
taaatcagtaaggcatattctc

SEQ ID NO: 8338910 - DNA, 22 bp, Homo sapiens
gtcctgggtccccgcaggtcag

SEQ ID NO: 8338911 - DNA, 22 bp, Homo sapiens
gtcctgggtccccgcaggtcag

SEQ ID NO: 8338912 - DNA, 22 bp, Homo sapiens
gtcccataagtagtgcaacttg

SEQ ID NO: 8338913 - DNA, 22 bp, Homo sapiens
gtcccagggaggttcagggctt

SEQ ID NO: 8338914 - DNA, 18 bp, Homo sapiens
gtccatccaggcagtgtc

SEQ ID NO: 8338915 - DNA, 22 bp, Homo sapiens
gtcaggactctgacccgtcccg

SEQ ID NO: 8338916 - DNA, 22 bp, Homo sapiens
gtcaggcagcctggagattcag

SEQ ID NO: 8338917 - DNA, 18 bp, Homo sapiens
gtcaggcatgaatctggg

SEQ ID NO: 8338918 - DNA, 22 bp, Homo sapiens
gtcaggcatttaggatgagttc

SEQ ID NO: 8338919 - DNA, 22 bp, Homo sapiens
gtccttggaaagtctaatctct

SEQ ID NO: 8338920 - DNA, 22 bp, Homo sapiens
gtcggccacgcaggtgcggtag

SEQ ID NO: 8338921 - DNA, 22 bp, Homo sapiens
gtccttggcttgaggcacctca

SEQ ID NO: 8338922 - DNA, 22 bp, Homo sapiens
gtccttccccagccagctctgg

SEQ ID NO: 8338923 - DNA, 22 bp, Homo sapiens
gtctcttttatggtgagttgat

SEQ ID NO: 8338924 - DNA, 19 bp, Homo sapiens
gtctctgctccagggtctc

SEQ ID NO: 8338925 - DNA, 20 bp, Homo sapiens
gtctgcagtaagagggaata

SEQ ID NO: 8338926 - DNA, 22 bp, Homo sapiens
gtctgcatacaggacatgcaca

SEQ ID NO: 8338927 - DNA, 22 bp, Homo sapiens
gtctgcattgaccctactagtc

SEQ ID NO: 8338928 - DNA, 22 bp, Homo sapiens
gtctgatatcagaaaaagtaaa

SEQ ID NO: 8338929 - DNA, 22 bp, Homo sapiens
gtctggggcagcaaggcgcgcg

SEQ ID NO: 8338930 - DNA, 22 bp, Homo sapiens
gtctggggaagtcagggcatca

SEQ ID NO: 8338931 - DNA, 22 bp, Homo sapiens
gtctggggcagcaaggcgcgcg

SEQ ID NO: 8338932 - DNA, 22 bp, Homo sapiens
gtctgggggtccgggtgcctgc

SEQ ID NO: 8338933 - DNA, 22 bp, Homo sapiens
gtaaactatgggctttggagga

SEQ ID NO: 8338934 - DNA, 22 bp, Homo sapiens
gtaaagaaggcaacctggttat

SEQ ID NO: 8338935 - DNA, 22 bp, Homo sapiens
gtaaagaagtttttgaatgcat

SEQ ID NO: 8338936 - DNA, 22 bp, Homo sapiens
gtaaataactggtaattggggt

SEQ ID NO: 8338937 - DNA, 22 bp, Homo sapiens
gtacagaaggatttctagtagt

SEQ ID NO: 8338938 - DNA, 22 bp, Homo sapiens
gtacagaggttgctggaggctc

SEQ ID NO: 8338939 - DNA, 22 bp, Homo sapiens
gtaaatattaaaggctgctaga

SEQ ID NO: 8338940 - DNA, 22 bp, Homo sapiens
gtaaatataaatgctagctgcc

SEQ ID NO: 8338941 - DNA, 22 bp, Homo sapiens
gtacatatggcacatgctattt

SEQ ID NO: 8338942 - DNA, 22 bp, Homo sapiens
gtacatatggcacatgctattt

SEQ ID NO: 8338943 - DNA, 22 bp, Homo sapiens
gtacatatcctttacgttttgt

SEQ ID NO: 8338944 - DNA, 22 bp, Homo sapiens
gtacatattaaaggtctataaa

SEQ ID NO: 8338945 - DNA, 22 bp, Homo sapiens
gtacatatggcacatgctattt

SEQ ID NO: 8338946 - DNA, 22 bp, Homo sapiens
gtacatattaaaggtctataaa

SEQ ID NO: 8338947 - DNA, 22 bp, Homo sapiens
gtacatattacagacaaagctt

SEQ ID NO: 8338948 - DNA, 22 bp, Homo sapiens
gtacagtaaatgtaaatggatt

SEQ ID NO: 8338949 - DNA, 22 bp, Homo sapiens
gtacagtagtaaaagtgaatga

SEQ ID NO: 8338950 - DNA, 22 bp, Homo sapiens
gtacagtagtaaaagtgaatga

SEQ ID NO: 8338951 - DNA, 22 bp, Homo sapiens
gtacatattataaaatacagct

SEQ ID NO: 8338952 - DNA, 22 bp, Homo sapiens
gtacatgtatgagatatgtgta

SEQ ID NO: 8338953 - DNA, 22 bp, Homo sapiens
gtacatctgtcttgttctgttg

SEQ ID NO: 8338954 - DNA, 22 bp, Homo sapiens
gtacatattataaaatacagct

SEQ ID NO: 8338955 - DNA, 22 bp, Homo sapiens
gtacatattacagacaaagctt

SEQ ID NO: 8338956 - DNA, 22 bp, Homo sapiens
gtacatattataaaatacagct

SEQ ID NO: 8338957 - DNA, 22 bp, Homo sapiens
gtacatgttggttgtttccagt

SEQ ID NO: 8338958 - DNA, 22 bp, Homo sapiens
gtatagaacctcatcatgccca

SEQ ID NO: 8338959 - DNA, 22 bp, Homo sapiens
gtatagaacttttggaggctgc

SEQ ID NO: 8338960 - DNA, 22 bp, Homo sapiens
gtatagaagctttgctctctct

SEQ ID NO: 8338961 - DNA, 22 bp, Homo sapiens
gtatagaaacccagaaagatag

SEQ ID NO: 8338962 - DNA, 22 bp, Homo sapiens
gtatatatgtgtgaacatgtat

SEQ ID NO: 8338963 - DNA, 22 bp, Homo sapiens
gtatatatgtgtgaacatgtat

SEQ ID NO: 8338964 - DNA, 22 bp, Homo sapiens
gtatatatcggcactattttaa

SEQ ID NO: 8338965 - DNA, 22 bp, Homo sapiens
gtatatatcggcactattttaa

SEQ ID NO: 8338966 - DNA, 22 bp, Homo sapiens
gtatatatcggcactattttaa

SEQ ID NO: 8338967 - DNA, 22 bp, Homo sapiens
gtatataaggtaaagcgattgt

SEQ ID NO: 8338968 - DNA, 22 bp, Homo sapiens
gtatatcaccccaagcagctga

SEQ ID NO: 8338969 - DNA, 18 bp, Homo sapiens
gtatatctgcacatatac

SEQ ID NO: 8338970 - DNA, 22 bp, Homo sapiens
gtatatattggataaaccagag

SEQ ID NO: 8338971 - DNA, 22 bp, Homo sapiens
ggtgattttcgagtttcatgtt

SEQ ID NO: 8338972 - DNA, 22 bp, Homo sapiens
ggtgatccaccagcctcggcct

SEQ ID NO: 8338973 - DNA, 22 bp, Homo sapiens
ggtggcagagaggaggtagttt

SEQ ID NO: 8338974 - DNA, 22 bp, Homo sapiens
ggtggcagagaggaggtagttt

SEQ ID NO: 8338975 - DNA, 22 bp, Homo sapiens
gggtggggtgtatcggatccta

SEQ ID NO: 8338976 - DNA, 22 bp, Homo sapiens
gggtgggcctgtctggccatgt

SEQ ID NO: 8338977 - DNA, 22 bp, Homo sapiens
ggtgaggggctcctctgcccgg

SEQ ID NO: 8338978 - DNA, 22 bp, Homo sapiens
ggtgaggggcgcctctgcccgg

SEQ ID NO: 8338979 - DNA, 22 bp, Homo sapiens
ggtgaggggcgcctctgcccag

SEQ ID NO: 8338980 - DNA, 22 bp, Homo sapiens
ggtgaggggcacctctgcccgg

SEQ ID NO: 8338981 - DNA, 22 bp, Homo sapiens
ggtggcaggccctgagcatccc

SEQ ID NO: 8338982 - DNA, 22 bp, Homo sapiens
ggtggccataggaccagcctgg

SEQ ID NO: 8338983 - DNA, 22 bp, Homo sapiens
ggtgtaactgagcatccacgtg

SEQ ID NO: 8338984 - DNA, 22 bp, Homo sapiens
ggtgtaagatgtcagctgagca

SEQ ID NO: 8338985 - DNA, 22 bp, Homo sapiens
ggtgtcagtgagagcacagtac

SEQ ID NO: 8338986 - DNA, 22 bp, Homo sapiens
gtggcccaggcttggcgctggc

SEQ ID NO: 8338987 - DNA, 22 bp, Homo sapiens
gtggcccaggttggagtgcagt

SEQ ID NO: 8338988 - DNA, 22 bp, Homo sapiens
gtggcccaggctggagtgcagt

SEQ ID NO: 8338989 - DNA, 21 bp, Homo sapiens
gtggccctgccgcagtgtcca

SEQ ID NO: 8338990 - DNA, 22 bp, Homo sapiens
gtggccctggagttgtgacact

SEQ ID NO: 8338991 - DNA, 22 bp, Homo sapiens
gtggccctctgatagggtcagg

SEQ ID NO: 8338992 - DNA, 22 bp, Homo sapiens
gtggccagcaagtgctgcctct

SEQ ID NO: 8338993 - DNA, 22 bp, Homo sapiens
gtgggagctgctacctccttcc

SEQ ID NO: 8338994 - DNA, 22 bp, Homo sapiens
gtgggagctttggcatcaggct

SEQ ID NO: 8338995 - DNA, 22 bp, Homo sapiens
gtgggagctgcggaggcctggg

SEQ ID NO: 8338996 - DNA, 22 bp, Homo sapiens
gtgggagtggggaagcagagtg

SEQ ID NO: 8338997 - DNA, 22 bp, Homo sapiens
gtgggagtttgaacttcatgtt

SEQ ID NO: 8338998 - DNA, 22 bp, Homo sapiens
gtgggagccctcagggaggtgc

SEQ ID NO: 8338999 - DNA, 22 bp, Homo sapiens
gtgggagcatggtcccagtgcc

SEQ ID NO: 8339000 - DNA, 22 bp, Homo sapiens
gtggctgcagagggcacagcat

SEQ ID NO: 8339001 - DNA, 22 bp, Homo sapiens
gtggctgcatcggggtgaccag

SEQ ID NO: 8339002 - DNA, 22 bp, Homo sapiens
gtggctgctcgggctccggccc

SEQ ID NO: 8339003 - DNA, 22 bp, Homo sapiens
gtggctgctacagagctggagg

SEQ ID NO: 8339004 - DNA, 22 bp, Homo sapiens
gtggctgcatcggggtgaccag

SEQ ID NO: 8339005 - DNA, 22 bp, Homo sapiens
gtggctggtttcctgcatgcaa

SEQ ID NO: 8339006 - DNA, 22 bp, Homo sapiens
gtggctggtttcctgcatgcaa

SEQ ID NO: 8339007 - DNA, 21 bp, Homo sapiens
gtggctctgccaggactgaaa

SEQ ID NO: 8339008 - DNA, 22 bp, Homo sapiens
gtggctctgtaaaatgcctgca

SEQ ID NO: 8339009 - DNA, 22 bp, Homo sapiens
gtggctgcagagccagcaagct

SEQ ID NO: 8339010 - DNA, 22 bp, Homo sapiens
gtggctctggctttccaggcgg

SEQ ID NO: 8339011 - DNA, 20 bp, Homo sapiens
gtggcccttaaagagggaag

SEQ ID NO: 8339012 - DNA, 22 bp, Homo sapiens
gtggaaattttaggatcatctt

SEQ ID NO: 8339013 - DNA, 22 bp, Homo sapiens
gtggaaatgcccccaaatagtg

SEQ ID NO: 8339014 - DNA, 22 bp, Homo sapiens
gtggaaatgcccccaaatagtg

SEQ ID NO: 8339015 - DNA, 22 bp, Homo sapiens
gtggaaatagtttggttataga

SEQ ID NO: 8339016 - DNA, 22 bp, Homo sapiens
gtggaaagaacacaaaattagg

SEQ ID NO: 8339017 - DNA, 22 bp, Homo sapiens
gtggaaaagaaagtcttccttg

SEQ ID NO: 8339018 - DNA, 22 bp, Homo sapiens
gtgcgcaccctcccggcatccc

SEQ ID NO: 8339019 - DNA, 22 bp, Homo sapiens
gtgcgggggttcccagcagccg

SEQ ID NO: 8339020 - DNA, 18 bp, Homo sapiens
gtgacagctgctagctca

SEQ ID NO: 8339021 - DNA, 22 bp, Homo sapiens
gtgacaggcatggggtcatgca

SEQ ID NO: 8339022 - DNA, 22 bp, Homo sapiens
gtgcctgccccactcctcagca

SEQ ID NO: 8339023 - DNA, 22 bp, Homo sapiens
gtgcctgctgcagagtcgctgt

SEQ ID NO: 8339024 - DNA, 22 bp, Homo sapiens
gtggagggtgattgccggctgt

SEQ ID NO: 8339025 - DNA, 22 bp, Homo sapiens
gtggaggagaggcgccttgcgg

SEQ ID NO: 8339026 - DNA, 22 bp, Homo sapiens
gtggatggacatgggcaagagg

SEQ ID NO: 8339027 - DNA, 22 bp, Homo sapiens
gtggagctggacccaggcctct

SEQ ID NO: 8339028 - DNA, 22 bp, Homo sapiens
gtggagctggacccaggcctct

SEQ ID NO: 8339029 - DNA, 22 bp, Homo sapiens
gtggactgcgcttgagggggcc

SEQ ID NO: 8339030 - DNA, 22 bp, Homo sapiens
gtggagacttctactagagacc

SEQ ID NO: 8339031 - DNA, 22 bp, Homo sapiens
gtggagagagataagcctggtc

SEQ ID NO: 8339032 - DNA, 22 bp, Homo sapiens
gtggatggtggtccagtatcat

SEQ ID NO: 8339033 - DNA, 22 bp, Homo sapiens
gtggattacaagacagttgaga

SEQ ID NO: 8339034 - DNA, 22 bp, Homo sapiens
gtggatggattttgaggaatgg

SEQ ID NO: 8339035 - DNA, 22 bp, Homo sapiens
gtggatggagctggaagccatt

SEQ ID NO: 8339036 - DNA, 22 bp, Homo sapiens
gtggcagagccaaggctggagc

SEQ ID NO: 8339037 - DNA, 18 bp, Homo sapiens
gtggcagcctttggcttt

SEQ ID NO: 8339038 - DNA, 19 bp, Homo sapiens
gtggcagcagatttggtgt

SEQ ID NO: 8339039 - DNA, 22 bp, Homo sapiens
tctgcagcttgcacaggcaggc

SEQ ID NO: 8339040 - DNA, 18 bp, Homo sapiens
tctgcaggacctcagggc

SEQ ID NO: 8339041 - DNA, 22 bp, Homo sapiens
tctgcaggactgaggcctgttt

SEQ ID NO: 8339042 - DNA, 22 bp, Homo sapiens
tctgcaggaagctggcggctga

SEQ ID NO: 8339043 - DNA, 22 bp, Homo sapiens
tctgcaggatcagagccagagg

SEQ ID NO: 8339044 - DNA, 22 bp, Homo sapiens
tctgcaggaggctggctgcagg

SEQ ID NO: 8339045 - DNA, 22 bp, Homo sapiens
tctgcaggagagtgccctagag

SEQ ID NO: 8339046 - DNA, 22 bp, Homo sapiens
tctgcaggagcagggcgtggag

SEQ ID NO: 8339047 - DNA, 22 bp, Homo sapiens
tctgcaggtgggcccctagaat

SEQ ID NO: 8339048 - DNA, 22 bp, Homo sapiens
tctgcatattgttaatggaatg

SEQ ID NO: 8339049 - DNA, 22 bp, Homo sapiens
tctgcatttttacaagatcccc

SEQ ID NO: 8339050 - DNA, 22 bp, Homo sapiens
tctgcattacatgccatagaca

SEQ ID NO: 8339051 - DNA, 22 bp, Homo sapiens
tctgcaggcttataggatgggt

SEQ ID NO: 8339052 - DNA, 22 bp, Homo sapiens
tctgcagggatgtgaggggtga

SEQ ID NO: 8339053 - DNA, 22 bp, Homo sapiens
tctgcagggcccttggctcctg

SEQ ID NO: 8339054 - DNA, 17 bp, Homo sapiens
tctgcagggggccgtgt

SEQ ID NO: 8339055 - DNA, 22 bp, Homo sapiens
tctgccagtttatagacaagcc

SEQ ID NO: 8339056 - DNA, 22 bp, Homo sapiens
tctgcccaaggctgtcactaga

SEQ ID NO: 8339057 - DNA, 21 bp, Homo sapiens
tctgcccacactggccactgc

SEQ ID NO: 8339058 - DNA, 22 bp, Homo sapiens
tctgccatgcacccggacagct

SEQ ID NO: 8339059 - DNA, 22 bp, Homo sapiens
tctgcccagtttgtgctcaggt

SEQ ID NO: 8339060 - DNA, 22 bp, Homo sapiens
tctgccctcagggtaatgatca

SEQ ID NO: 8339061 - DNA, 22 bp, Homo sapiens
tctgccctcattgctgcctgga

SEQ ID NO: 8339062 - DNA, 22 bp, Homo sapiens
tctgccctcattgctgcctgga

SEQ ID NO: 8339063 - DNA, 18 bp, Homo sapiens
tctgcccaggacttggac

SEQ ID NO: 8339064 - DNA, 18 bp, Homo sapiens
tctgcccaggacttggac

SEQ ID NO: 8339065 - DNA, 22 bp, Homo sapiens
tctgcccaggacacctgccact

SEQ ID NO: 8339066 - DNA, 22 bp, Homo sapiens
tctgcccagggcagggcttgca

SEQ ID NO: 8339067 - DNA, 22 bp, Homo sapiens
tctgcccactgctctgctgccc

SEQ ID NO: 8339068 - DNA, 20 bp, Homo sapiens
tctgcccaccccggctccca

SEQ ID NO: 8339069 - DNA, 22 bp, Homo sapiens
tctgcctgccagtctggtcctc

SEQ ID NO: 8339070 - DNA, 22 bp, Homo sapiens
tctgcctgcagtgtggcagggc

SEQ ID NO: 8339071 - DNA, 22 bp, Homo sapiens
tctgcctgccagtctggtcctc

SEQ ID NO: 8339072 - DNA, 22 bp, Homo sapiens
tctgcctgagggagctgaggaa

SEQ ID NO: 8339073 - DNA, 18 bp, Homo sapiens
tctgccctgccattcact

SEQ ID NO: 8339074 - DNA, 22 bp, Homo sapiens
tctgcctggatgatggcagggc

SEQ ID NO: 8339075 - DNA, 22 bp, Homo sapiens
tctgcctgggtgtggagcagag

SEQ ID NO: 8339076 - DNA, 22 bp, Homo sapiens
tctgcctgcgctcacggggccg

SEQ ID NO: 8339077 - DNA, 22 bp, Homo sapiens
tctgcctgcggctgcaggtggc

SEQ ID NO: 8339078 - DNA, 22 bp, Homo sapiens
tctgctcagcatccctctgaga

SEQ ID NO: 8339079 - DNA, 20 bp, Homo sapiens
tctgctcagccctcagtggc

SEQ ID NO: 8339080 - DNA, 22 bp, Homo sapiens
tctgctcagccgatctgctccg

SEQ ID NO: 8339081 - DNA, 22 bp, Homo sapiens
tctgctcaggttacctagctag

SEQ ID NO: 8339082 - DNA, 22 bp, Homo sapiens
tctgctcactattacatggaca

SEQ ID NO: 8339083 - DNA, 22 bp, Homo sapiens
tctgctcacatggctccatgca

SEQ ID NO: 8339084 - DNA, 22 bp, Homo sapiens
tctgcaacattcctctccccac

SEQ ID NO: 8339085 - DNA, 22 bp, Homo sapiens
tctgcaacagtgccctgtaaat

SEQ ID NO: 8339086 - DNA, 21 bp, Homo sapiens
tctgatggtagatgagatgtg

SEQ ID NO: 8339087 - DNA, 22 bp, Homo sapiens
tctgatcctttgtcttcttggg

SEQ ID NO: 8339088 - DNA, 22 bp, Homo sapiens
tctgatatttgaagaccattag

SEQ ID NO: 8339089 - DNA, 22 bp, Homo sapiens
tctgagggttgtagagagggac

SEQ ID NO: 8339090 - DNA, 18 bp, Homo sapiens
tctgagggtgcgggagct

SEQ ID NO: 8339091 - DNA, 22 bp, Homo sapiens
tctgaggctgaatggactccgt

SEQ ID NO: 8339092 - DNA, 22 bp, Homo sapiens
tctgagggaatagctattgtag

SEQ ID NO: 8339093 - DNA, 22 bp, Homo sapiens
tctgaggcctgaagcagcagag

SEQ ID NO: 8339094 - DNA, 22 bp, Homo sapiens
tctgaggccctgcaggcagtgt

SEQ ID NO: 8339095 - DNA, 22 bp, Homo sapiens
tctgaggctaagagacagaggc

SEQ ID NO: 8339096 - DNA, 22 bp, Homo sapiens
tctgacattttgagaatgacat

SEQ ID NO: 8339097 - DNA, 22 bp, Homo sapiens
tctgaccagtgagctctgaaat

SEQ ID NO: 8339098 - DNA, 22 bp, Homo sapiens
tctgaccaggctggctcagggc

SEQ ID NO: 8339099 - DNA, 22 bp, Homo sapiens
tctgacttggcgctcttgtctt

SEQ ID NO: 8339100 - DNA, 22 bp, Homo sapiens
tctgacattagattaattggaa

SEQ ID NO: 8339101 - DNA, 22 bp, Homo sapiens
tctgagaataaaaattgcattt

SEQ ID NO: 8339102 - DNA, 23 bp, Homo sapiens
tctgagaaggtttcagccagact

SEQ ID NO: 8339103 - DNA, 22 bp, Homo sapiens
tctgagaagctagaggacaaag

SEQ ID NO: 8339104 - DNA, 17 bp, Homo sapiens
tctgagaaaggagaatc

SEQ ID NO: 8339105 - DNA, 22 bp, Homo sapiens
tctgagacccatacaggcccac

SEQ ID NO: 8339106 - DNA, 22 bp, Homo sapiens
tctgagacactcttgtgatggg

SEQ ID NO: 8339107 - DNA, 22 bp, Homo sapiens
tctgagctggagcccatcacct

SEQ ID NO: 8339108 - DNA, 22 bp, Homo sapiens
tctgagctgggggcctggcatg

SEQ ID NO: 8339109 - DNA, 22 bp, Homo sapiens
tctgagctgtggccattcttcc

SEQ ID NO: 8339110 - DNA, 22 bp, Homo sapiens
tctgagcttccctctgaggcag

SEQ ID NO: 8339111 - DNA, 22 bp, Homo sapiens
tctgagctacgatgcctgtcac

SEQ ID NO: 8339112 - DNA, 22 bp, Homo sapiens
tctggatgaaagggctatatat

SEQ ID NO: 8339113 - DNA, 22 bp, Homo sapiens
tctggatctccctcatcctggg

SEQ ID NO: 8339114 - DNA, 22 bp, Homo sapiens
tctggatggtcagctcttcctg

SEQ ID NO: 8339115 - DNA, 22 bp, Homo sapiens
tctggagttgagagtgtgcgag

SEQ ID NO: 8339116 - DNA, 23 bp, Homo sapiens
tctggaggggacactgcagatgc

SEQ ID NO: 8339117 - DNA, 22 bp, Homo sapiens
tctggagtctgagatctgagga

SEQ ID NO: 8339118 - DNA, 22 bp, Homo sapiens
tctggagtggagctgatcattt

SEQ ID NO: 8339119 - DNA, 22 bp, Homo sapiens
tctggagtccagatccatttgg

SEQ ID NO: 8339120 - DNA, 22 bp, Homo sapiens
tctggcagtgatttctgtgatc

SEQ ID NO: 8339121 - DNA, 22 bp, Homo sapiens
tctggagaggggcctagaattt

SEQ ID NO: 8339122 - DNA, 22 bp, Homo sapiens
tctggacttgaatcagagtaga

SEQ ID NO: 8339123 - DNA, 22 bp, Homo sapiens
tctggaagtcccttgatgccag

SEQ ID NO: 8339124 - DNA, 22 bp, Homo sapiens
tctggaaggggatctgtggtca

SEQ ID NO: 8339125 - DNA, 22 bp, Homo sapiens
tctgctctgtggcttcagctaa

SEQ ID NO: 8339126 - DNA, 22 bp, Homo sapiens
tctgctctgtactgcactggcc

SEQ ID NO: 8339127 - DNA, 22 bp, Homo sapiens
tctgctctagttgcttcctgcc

SEQ ID NO: 8339128 - DNA, 22 bp, Homo sapiens
tctgctgcctgcagggcagaga

SEQ ID NO: 8339129 - DNA, 22 bp, Homo sapiens
tctgctgacctttctctgacac

SEQ ID NO: 8339130 - DNA, 22 bp, Homo sapiens
tctgctgaacttgctgcccaga

SEQ ID NO: 8339131 - DNA, 22 bp, Homo sapiens
tctgctggccttagcaggtcta

SEQ ID NO: 8339132 - DNA, 22 bp, Homo sapiens
tctggaagaacggggcatgctg

SEQ ID NO: 8339133 - DNA, 22 bp, Homo sapiens
tctgctgtgtccctggtctcct

SEQ ID NO: 8339134 - DNA, 22 bp, Homo sapiens
tctgctgtgaggaggcaggatg

SEQ ID NO: 8339135 - DNA, 22 bp, Homo sapiens
tctgggcatgtctgtgaacacg

SEQ ID NO: 8339136 - DNA, 20 bp, Homo sapiens
tctgggcagggcacatggaa

SEQ ID NO: 8339137 - DNA, 23 bp, Homo sapiens
tctgggcatatctagtcacatcg

SEQ ID NO: 8339138 - DNA, 22 bp, Homo sapiens
tctgggcagttcggatcctctg

SEQ ID NO: 8339139 - DNA, 19 bp, Homo sapiens
tctgggcagggccagcacc

SEQ ID NO: 8339140 - DNA, 22 bp, Homo sapiens
tctgggcagagggtcttagtca

SEQ ID NO: 8339141 - DNA, 22 bp, Homo sapiens
tctgggcagaagcagtgcaaag

SEQ ID NO: 8339142 - DNA, 22 bp, Homo sapiens
tctgggcagccatgtgcctggc

SEQ ID NO: 8339143 - DNA, 22 bp, Homo sapiens
tctgggcagccgccccatagga

SEQ ID NO: 8339144 - DNA, 23 bp, Homo sapiens
tctgggcaccttgttgacatgat

SEQ ID NO: 8339145 - DNA, 22 bp, Homo sapiens
tctgggcacacaccatgcccac

SEQ ID NO: 8339146 - DNA, 22 bp, Homo sapiens
tctgggcaatggatgcactcac

SEQ ID NO: 8339147 - DNA, 22 bp, Homo sapiens
tctgggagtttctgtgggagct

SEQ ID NO: 8339148 - DNA, 22 bp, Homo sapiens
tctgggaggtggcagggtgcat

SEQ ID NO: 8339149 - DNA, 22 bp, Homo sapiens
tctgggaggggctgccattgct

SEQ ID NO: 8339150 - DNA, 22 bp, Homo sapiens
tctgggagtgtgtctggccatc

SEQ ID NO: 8339151 - DNA, 22 bp, Homo sapiens
tctgggaggtggcagggtgcat

SEQ ID NO: 8339152 - DNA, 22 bp, Homo sapiens
tctgggagagcacgtggctgac

SEQ ID NO: 8339153 - DNA, 22 bp, Homo sapiens
tctggctgtcattggaggcccc

SEQ ID NO: 8339154 - DNA, 22 bp, Homo sapiens
tctggctgtgtaaggtagcacc

SEQ ID NO: 8339155 - DNA, 22 bp, Homo sapiens
tctggctgattccctgggactg

SEQ ID NO: 8339156 - DNA, 22 bp, Homo sapiens
tctggctggctcggccgggagt

SEQ ID NO: 8339157 - DNA, 22 bp, Homo sapiens
tctggctggctcggccgggagt

SEQ ID NO: 8339158 - DNA, 22 bp, Homo sapiens
tctggctggcagtgatggtgtg

SEQ ID NO: 8339159 - DNA, 22 bp, Homo sapiens
tctggctcctggctccactgcc

SEQ ID NO: 8339160 - DNA, 19 bp, Homo sapiens
tctggctcctgccaggctg

SEQ ID NO: 8339161 - DNA, 19 bp, Homo sapiens
tctggctcctgccaggctg

SEQ ID NO: 8339162 - DNA, 22 bp, Homo sapiens
tctggctctaactaggcatcag

SEQ ID NO: 8339163 - DNA, 22 bp, Homo sapiens
tctggctcggatttgtctagca

SEQ ID NO: 8339164 - DNA, 22 bp, Homo sapiens
tctggctctcatactcgccagt

SEQ ID NO: 8339165 - DNA, 22 bp, Homo sapiens
tctggctctcaacaaatattta

SEQ ID NO: 8339166 - DNA, 22 bp, Homo sapiens
tctggctctccagtgctcttag

SEQ ID NO: 8339167 - DNA, 23 bp, Homo sapiens
tctggctctatgtgacagctctc

SEQ ID NO: 8339168 - DNA, 22 bp, Homo sapiens
tctggctctataactcctagct

SEQ ID NO: 8339169 - DNA, 22 bp, Homo sapiens
tctggctctttgggtgattgta

SEQ ID NO: 8339170 - DNA, 22 bp, Homo sapiens
tctggctctgacactactgtta

SEQ ID NO: 8339171 - DNA, 22 bp, Homo sapiens
tctggctctgaattcacttctg

SEQ ID NO: 8339172 - DNA, 22 bp, Homo sapiens
tctggctctctcatcacccaat

SEQ ID NO: 8339173 - DNA, 22 bp, Homo sapiens
tctggctctggagtccacctgc

SEQ ID NO: 8339174 - DNA, 22 bp, Homo sapiens
tctggctctgtgtccccaccca

SEQ ID NO: 8339175 - DNA, 22 bp, Homo sapiens
tctggctctgtgtcctcaccca

SEQ ID NO: 8339176 - DNA, 20 bp, Homo sapiens
tctggctctttgctcctccc

SEQ ID NO: 8339177 - DNA, 22 bp, Homo sapiens
tctggctccacacctcactgca

SEQ ID NO: 8339178 - DNA, 22 bp, Homo sapiens
tctggctccacctcctttacta

SEQ ID NO: 8339179 - DNA, 22 bp, Homo sapiens
tctggctccactctgtgcatgc

SEQ ID NO: 8339180 - DNA, 22 bp, Homo sapiens
tctggctccaggaccgggcaca

SEQ ID NO: 8339181 - DNA, 22 bp, Homo sapiens
tctggctccactttcttcattt

SEQ ID NO: 8339182 - DNA, 19 bp, Homo sapiens
tctggctccgcctcttagt

SEQ ID NO: 8339183 - DNA, 22 bp, Homo sapiens
tctggctccgtgtccgctccca

SEQ ID NO: 8339184 - DNA, 22 bp, Homo sapiens
tctggctcctgagtccatgctc

SEQ ID NO: 8339185 - DNA, 22 bp, Homo sapiens
tctggctcctgagtccatgctc

SEQ ID NO: 8339186 - DNA, 23 bp, Homo sapiens
tctggctccatccttggggatcc

SEQ ID NO: 8339187 - DNA, 22 bp, Homo sapiens
tctggctcccagcctgctctca

SEQ ID NO: 8339188 - DNA, 22 bp, Homo sapiens
tctggctccctggagctccaca

SEQ ID NO: 8339189 - DNA, 22 bp, Homo sapiens
tctgggtgaccctgggcaaggc

SEQ ID NO: 8339190 - DNA, 22 bp, Homo sapiens
tctgtaaaacaatattgtattc

SEQ ID NO: 8339191 - DNA, 22 bp, Homo sapiens
tctgggttcttgatgctacctt

SEQ ID NO: 8339192 - DNA, 22 bp, Homo sapiens
tctgggtgtagggcctggcaac

SEQ ID NO: 8339193 - DNA, 22 bp, Homo sapiens
tctgggggttaagtgaggacaa

SEQ ID NO: 8339194 - DNA, 22 bp, Homo sapiens
tctgggggttaagtgaggacaa

SEQ ID NO: 8339195 - DNA, 22 bp, Homo sapiens
tctgggggttaagtgaggacaa

SEQ ID NO: 8339196 - DNA, 22 bp, Homo sapiens
tctgggtcactgtgggagggca

SEQ ID NO: 8339197 - DNA, 22 bp, Homo sapiens
tctggggtttgtggttcttctg

SEQ ID NO: 8339198 - DNA, 22 bp, Homo sapiens
tctgggggaggaggcatggccc

SEQ ID NO: 8339199 - DNA, 22 bp, Homo sapiens
tctggggcagttactggggcct

SEQ ID NO: 8339200 - DNA, 22 bp, Homo sapiens
tctggggcagttactggggcct

SEQ ID NO: 8339201 - DNA, 22 bp, Homo sapiens
tctgggggcgaccagggactgc

SEQ ID NO: 8339202 - DNA, 21 bp, Homo sapiens
tctgggggtgagcctagaaat

SEQ ID NO: 8339203 - DNA, 22 bp, Homo sapiens
tctgggggaggaggcatggccc

SEQ ID NO: 8339204 - DNA, 22 bp, Homo sapiens
tctgtacatgagttgagaatca

SEQ ID NO: 8339205 - DNA, 22 bp, Homo sapiens
tctgtacagtaccagatagtaa

SEQ ID NO: 8339206 - DNA, 20 bp, Homo sapiens
tctgtaattatgccatcact

SEQ ID NO: 8339207 - DNA, 22 bp, Homo sapiens
tctgtaatcagagtagcagata

SEQ ID NO: 8339208 - DNA, 22 bp, Homo sapiens
tctgtagtttacagtatttcag

SEQ ID NO: 8339209 - DNA, 22 bp, Homo sapiens
tctgtatcgtaatcatgtctgg

SEQ ID NO: 8339210 - DNA, 22 bp, Homo sapiens
tctgtagtaggttgtagttctt

SEQ ID NO: 8339211 - DNA, 22 bp, Homo sapiens
tctgtctctttgttctgtgagt

SEQ ID NO: 8339212 - DNA, 20 bp, Homo sapiens
tctgtctctgagctagactt

SEQ ID NO: 8339213 - DNA, 18 bp, Homo sapiens
tctgtctctgtccttgct

SEQ ID NO: 8339214 - DNA, 21 bp, Homo sapiens
tctgtctctccactgccctgc

SEQ ID NO: 8339215 - DNA, 22 bp, Homo sapiens
tctgtctctcaagggccgtcct

SEQ ID NO: 8339216 - DNA, 22 bp, Homo sapiens
tctgtctcctgccagtgcctct

SEQ ID NO: 8339217 - DNA, 22 bp, Homo sapiens
tctgtctcctgccagtgcctct

SEQ ID NO: 8339218 - DNA, 18 bp, Homo sapiens
tctgtccttccattcttc

SEQ ID NO: 8339219 - DNA, 22 bp, Homo sapiens
tctgtcctctttgaagctgctc

SEQ ID NO: 8339220 - DNA, 22 bp, Homo sapiens
tctgtctcctcagatgactcca

SEQ ID NO: 8339221 - DNA, 22 bp, Homo sapiens
tctgtctcaagttcttgcactc

SEQ ID NO: 8339222 - DNA, 22 bp, Homo sapiens
tctgtctacagggagaatgata

SEQ ID NO: 8339223 - DNA, 22 bp, Homo sapiens
tctgtccaacactctctagaca

SEQ ID NO: 8339224 - DNA, 23 bp, Homo sapiens
tctgtccacgcgaggcccttgct

SEQ ID NO: 8339225 - DNA, 22 bp, Homo sapiens
tctgtccatttacagatatgca

SEQ ID NO: 8339226 - DNA, 22 bp, Homo sapiens
tctgtcctccacactgtaagtt

SEQ ID NO: 8339227 - DNA, 22 bp, Homo sapiens
tctgtccaggtcagcctacatt

SEQ ID NO: 8339228 - DNA, 22 bp, Homo sapiens
tcttataatctctattttaatg

SEQ ID NO: 8339229 - DNA, 22 bp, Homo sapiens
tcttatatgcacatacattggg

SEQ ID NO: 8339230 - DNA, 22 bp, Homo sapiens
tcttaagcagagaagaagttga

SEQ ID NO: 8339231 - DNA, 22 bp, Homo sapiens
tctgttttgtaccagatacagc

SEQ ID NO: 8339232 - DNA, 22 bp, Homo sapiens
tctgttttgtaccagatacagc

SEQ ID NO: 8339233 - DNA, 22 bp, Homo sapiens
tctgttttgcataatgttcttt

SEQ ID NO: 8339234 - DNA, 22 bp, Homo sapiens
tctgttttcatttgtcttgaga

SEQ ID NO: 8339235 - DNA, 22 bp, Homo sapiens
tctgtttctccaacattgtgag

SEQ ID NO: 8339236 - DNA, 22 bp, Homo sapiens
tctgttgactcctagcagccat

SEQ ID NO: 8339237 - DNA, 23 bp, Homo sapiens
tctgttcttttagctgatcattt

SEQ ID NO: 8339238 - DNA, 23 bp, Homo sapiens
tctgttcttttagctgatcattt

SEQ ID NO: 8339239 - DNA, 22 bp, Homo sapiens
tctgttctttagcctgcttgag

SEQ ID NO: 8339240 - DNA, 22 bp, Homo sapiens
tctgttctttccaacaagacag

SEQ ID NO: 8339241 - DNA, 22 bp, Homo sapiens
tctgttcttggtgcagctggga

SEQ ID NO: 8339242 - DNA, 22 bp, Homo sapiens
tctgttatctcaagtcacaaga

SEQ ID NO: 8339243 - DNA, 22 bp, Homo sapiens
tctgttattctgtctattgcca

SEQ ID NO: 8339244 - DNA, 20 bp, Homo sapiens
tctgttattattacattgcc

SEQ ID NO: 8339245 - DNA, 22 bp, Homo sapiens
tctgttattctgctcagtatag

SEQ ID NO: 8339246 - DNA, 22 bp, Homo sapiens
tctgttatgcataagcatcagt

SEQ ID NO: 8339247 - DNA, 22 bp, Homo sapiens
tctgtttagatgctttatctgt

SEQ ID NO: 8339248 - DNA, 22 bp, Homo sapiens
tctgtttaatgggaatgatact

SEQ ID NO: 8339249 - DNA, 22 bp, Homo sapiens
tctgttgcaatgtgcatggtga

SEQ ID NO: 8339250 - DNA, 22 bp, Homo sapiens
tctgttaaaagtggaataatag

SEQ ID NO: 8339251 - DNA, 22 bp, Homo sapiens
tctgttatacaacaagtaacag

SEQ ID NO: 8339252 - DNA, 22 bp, Homo sapiens
tctgttatacagtctgtggcac

SEQ ID NO: 8339253 - DNA, 22 bp, Homo sapiens
tctgttatatagataatgtgtg

SEQ ID NO: 8339254 - DNA, 22 bp, Homo sapiens
tctgttatctcaagtcacaaga

SEQ ID NO: 8339255 - DNA, 22 bp, Homo sapiens
tctgttataaatcacactgcat

SEQ ID NO: 8339256 - DNA, 22 bp, Homo sapiens
tctgtgtcactgaggcctgtgt

SEQ ID NO: 8339257 - DNA, 22 bp, Homo sapiens
tctgtgggtttcagggggctgt

SEQ ID NO: 8339258 - DNA, 22 bp, Homo sapiens
tctgtgggttttgcagagttgc

SEQ ID NO: 8339259 - DNA, 22 bp, Homo sapiens
tctgtggcttgggcctgcctgt

SEQ ID NO: 8339260 - DNA, 18 bp, Homo sapiens
tctgtgggatcagtgagg

SEQ ID NO: 8339261 - DNA, 18 bp, Homo sapiens
tctgtggagagggcagtt

SEQ ID NO: 8339262 - DNA, 22 bp, Homo sapiens
tctgtggaagattccaggcgtt

SEQ ID NO: 8339263 - DNA, 22 bp, Homo sapiens
tctgtgctcaagttctgcctct

SEQ ID NO: 8339264 - DNA, 22 bp, Homo sapiens
tctgtgcatttcaggacctgaa

SEQ ID NO: 8339265 - DNA, 22 bp, Homo sapiens
tctgtgctaatgcttcacaata

SEQ ID NO: 8339266 - DNA, 22 bp, Homo sapiens
tctgtgagaaccagtgccaggg

SEQ ID NO: 8339267 - DNA, 22 bp, Homo sapiens
tctgtgaatatagggcttgtta

SEQ ID NO: 8339268 - DNA, 22 bp, Homo sapiens
tctgtgcaccagaatgatattt

SEQ ID NO: 8339269 - DNA, 22 bp, Homo sapiens
tctgtgaaacagctctggcatg

SEQ ID NO: 8339270 - DNA, 22 bp, Homo sapiens
tctttacacaagacaagaataa

SEQ ID NO: 8339271 - DNA, 22 bp, Homo sapiens
tctttacaatctaagcatagtt

SEQ ID NO: 8339272 - DNA, 22 bp, Homo sapiens
tctttacagtcctctgtcaatc

SEQ ID NO: 8339273 - DNA, 22 bp, Homo sapiens
tctttacacaagacaagaataa

SEQ ID NO: 8339274 - DNA, 23 bp, Homo sapiens
tctttacatactgatgagttctc

SEQ ID NO: 8339275 - DNA, 22 bp, Homo sapiens
tctttacatcacaattgtatgg

SEQ ID NO: 8339276 - DNA, 22 bp, Homo sapiens
tctttagaaacttttcttcatg

SEQ ID NO: 8339277 - DNA, 22 bp, Homo sapiens
tcttgggcatgtgtttgatttc

SEQ ID NO: 8339278 - DNA, 22 bp, Homo sapiens
tcttgaaaggagattggaggca

SEQ ID NO: 8339279 - DNA, 22 bp, Homo sapiens
tcttgcttgatacatggaggaa

SEQ ID NO: 8339280 - DNA, 22 bp, Homo sapiens
tcttggagactcttgtatattt

SEQ ID NO: 8339281 - DNA, 22 bp, Homo sapiens
tcttggagatgaccaggcatgc

SEQ ID NO: 8339282 - DNA, 22 bp, Homo sapiens
tctttataaaagtcattatgtc

SEQ ID NO: 8339283 - DNA, 20 bp, Homo sapiens
tctttagatttatcttatgt

SEQ ID NO: 8339284 - DNA, 20 bp, Homo sapiens
tctttagatttatcttatgt

SEQ ID NO: 8339285 - DNA, 22 bp, Homo sapiens
tctttcaatgagcattctttcc

SEQ ID NO: 8339286 - DNA, 22 bp, Homo sapiens
tctttattgctactggtttgtc

SEQ ID NO: 8339287 - DNA, 22 bp, Homo sapiens
tctttcaatgtgaaaccatgta

SEQ ID NO: 8339288 - DNA, 22 bp, Homo sapiens
tctttcagctcttcaggaccca

SEQ ID NO: 8339289 - DNA, 22 bp, Homo sapiens
tctttgatcagcctttcactga

SEQ ID NO: 8339290 - DNA, 22 bp, Homo sapiens
tctttgaactctgtgtattaac

SEQ ID NO: 8339291 - DNA, 22 bp, Homo sapiens
tctttgaacttggctgatctct

SEQ ID NO: 8339292 - DNA, 22 bp, Homo sapiens
tctttgaacttggctgatctct

SEQ ID NO: 8339293 - DNA, 22 bp, Homo sapiens
tctttcctagaggctgatgagt

SEQ ID NO: 8339294 - DNA, 22 bp, Homo sapiens
tctttctacattttatatgctt

SEQ ID NO: 8339295 - DNA, 22 bp, Homo sapiens
tctttctacattttatatgctt

SEQ ID NO: 8339296 - DNA, 22 bp, Homo sapiens
tcttcctccctacagagctcag

SEQ ID NO: 8339297 - DNA, 22 bp, Homo sapiens
tcttcctctagatctgaggccc

SEQ ID NO: 8339298 - DNA, 21 bp, Homo sapiens
tcttcctgctccacactcccc

SEQ ID NO: 8339299 - DNA, 21 bp, Homo sapiens
tcttcctgacatatgcaaggc

SEQ ID NO: 8339300 - DNA, 22 bp, Homo sapiens
tcttcctgaaaccctgttccag

SEQ ID NO: 8339301 - DNA, 23 bp, Homo sapiens
tcttcctgaactatcaggcacat

SEQ ID NO: 8339302 - DNA, 22 bp, Homo sapiens
tcttcctgcttggtgtgtctgg

SEQ ID NO: 8339303 - DNA, 22 bp, Homo sapiens
tcttcctgctttggtgaggctt

SEQ ID NO: 8339304 - DNA, 22 bp, Homo sapiens
tcttcctggcattgatgctgca

SEQ ID NO: 8339305 - DNA, 22 bp, Homo sapiens
tcttcctggtttctgggccatc

SEQ ID NO: 8339306 - DNA, 17 bp, Homo sapiens
tcttcgggcgctaggta

SEQ ID NO: 8339307 - DNA, 22 bp, Homo sapiens
tcttctatgaatcattggaaca

SEQ ID NO: 8339308 - DNA, 22 bp, Homo sapiens
tcttctaatggttcagatatat

SEQ ID NO: 8339309 - DNA, 22 bp, Homo sapiens
tcttctttatgtcatatgccag

SEQ ID NO: 8339310 - DNA, 22 bp, Homo sapiens
tcttctttgaatcatagtgacc

SEQ ID NO: 8339311 - DNA, 22 bp, Homo sapiens
tcttctttgaatcatagtgacc

SEQ ID NO: 8339312 - DNA, 22 bp, Homo sapiens
tcttctttttgtcccacagaat

SEQ ID NO: 8339313 - DNA, 22 bp, Homo sapiens
tcttctttggatgaaagaatat

SEQ ID NO: 8339314 - DNA, 22 bp, Homo sapiens
tcttctttggatgaaagaatat

SEQ ID NO: 8339315 - DNA, 21 bp, Homo sapiens
tcttgaaaattgtagcagttt

SEQ ID NO: 8339316 - DNA, 22 bp, Homo sapiens
tcttctcagtttctctaggatg

SEQ ID NO: 8339317 - DNA, 20 bp, Homo sapiens
tcttctggatttcctttagg

SEQ ID NO: 8339318 - DNA, 22 bp, Homo sapiens
tcttatttagagaggactagag

SEQ ID NO: 8339319 - DNA, 22 bp, Homo sapiens
tcttattttgttagatgctgta

SEQ ID NO: 8339320 - DNA, 22 bp, Homo sapiens
tcttcaaaccctggctcttcct

SEQ ID NO: 8339321 - DNA, 22 bp, Homo sapiens
tcttcaaagaagccttggatta

SEQ ID NO: 8339322 - DNA, 22 bp, Homo sapiens
tcttcaaccttgttactatagc

SEQ ID NO: 8339323 - DNA, 22 bp, Homo sapiens
tcttcaaatcctacagtgtctg

SEQ ID NO: 8339324 - DNA, 22 bp, Homo sapiens
tcttcaaatgagtgtggattat

SEQ ID NO: 8339325 - DNA, 22 bp, Homo sapiens
tcttcagatggccagttgtccc

SEQ ID NO: 8339326 - DNA, 22 bp, Homo sapiens
tcttcataacctagagatagca

SEQ ID NO: 8339327 - DNA, 22 bp, Homo sapiens
tcttcagtcaatccagatgttt

SEQ ID NO: 8339328 - DNA, 22 bp, Homo sapiens
tcttccaattagaatatttggg

SEQ ID NO: 8339329 - DNA, 22 bp, Homo sapiens
tcttccaatggtttctagattt

SEQ ID NO: 8339330 - DNA, 22 bp, Homo sapiens
tcttccagcaatgtgaaatcac

SEQ ID NO: 8339331 - DNA, 22 bp, Homo sapiens
tcctttgcttctgtcattctcc

SEQ ID NO: 8339332 - DNA, 22 bp, Homo sapiens
tcctttgacttcttgcagtcca

SEQ ID NO: 8339333 - DNA, 22 bp, Homo sapiens
tcctttgttgtacaattatttt

SEQ ID NO: 8339334 - DNA, 22 bp, Homo sapiens
tcgaactcatagtcgtagctgt

SEQ ID NO: 8339335 - DNA, 22 bp, Homo sapiens
tcgaaataatttagaatataga

SEQ ID NO: 8339336 - DNA, 22 bp, Homo sapiens
tcgagtcatgttctcccattaa

SEQ ID NO: 8339337 - DNA, 22 bp, Homo sapiens
tcgcaccattgcactccagcca

SEQ ID NO: 8339338 - DNA, 19 bp, Homo sapiens
tcgagtcaagacactaggc

SEQ ID NO: 8339339 - DNA, 19 bp, Homo sapiens
tcctttgaatatcagttga

SEQ ID NO: 8339340 - DNA, 22 bp, Homo sapiens
tccttggctagtactggccagc

SEQ ID NO: 8339341 - DNA, 22 bp, Homo sapiens
tccttggctagtactggccagc

SEQ ID NO: 8339342 - DNA, 22 bp, Homo sapiens
tcgttagcctcgagatctttgt

SEQ ID NO: 8339343 - DNA, 22 bp, Homo sapiens
tcgtgtcagatcagaggttcct

SEQ ID NO: 8339344 - DNA, 19 bp, Homo sapiens
tcgtggggaggtgggcagc

SEQ ID NO: 8339345 - DNA, 21 bp, Homo sapiens
tcgtgcagcagctgaggcttg

SEQ ID NO: 8339346 - DNA, 22 bp, Homo sapiens
tctaaacattatgatagtagag

SEQ ID NO: 8339347 - DNA, 22 bp, Homo sapiens
tctaaacagtttcactcttaat

SEQ ID NO: 8339348 - DNA, 22 bp, Homo sapiens
tctaaaatgcagatctactggt

SEQ ID NO: 8339349 - DNA, 22 bp, Homo sapiens
tctaaaatgcagatctactggt

SEQ ID NO: 8339350 - DNA, 22 bp, Homo sapiens
tctaaagccttccatataacgc

SEQ ID NO: 8339351 - DNA, 22 bp, Homo sapiens
tccttcagggggccgcctgcac

SEQ ID NO: 8339352 - DNA, 22 bp, Homo sapiens
tccttcctggggtctctgctgc

SEQ ID NO: 8339353 - DNA, 22 bp, Homo sapiens
tccttctgaaaaatgcacacga

SEQ ID NO: 8339354 - DNA, 22 bp, Homo sapiens
tccttgaatggacattacactg

SEQ ID NO: 8339355 - DNA, 22 bp, Homo sapiens
tccttgaattgtgccacttacc

SEQ ID NO: 8339356 - DNA, 22 bp, Homo sapiens
tccttgaatataataacagtag

SEQ ID NO: 8339357 - DNA, 22 bp, Homo sapiens
tccttgaatcctagcatcctat

SEQ ID NO: 8339358 - DNA, 22 bp, Homo sapiens
tccttgaatgaagagaggtgac

SEQ ID NO: 8339359 - DNA, 22 bp, Homo sapiens
tccttgaatgaatgttctctcc

SEQ ID NO: 8339360 - DNA, 22 bp, Homo sapiens
tccttgactgtgaggaactagc

SEQ ID NO: 8339361 - DNA, 22 bp, Homo sapiens
tccttgaaaagaatgtctccat

SEQ ID NO: 8339362 - DNA, 22 bp, Homo sapiens
tccttgaaaatcttggtttaga

SEQ ID NO: 8339363 - DNA, 22 bp, Homo sapiens
tccttgaacagagggcctgggt

SEQ ID NO: 8339364 - DNA, 22 bp, Homo sapiens
tccttgaagaatgattcttgga

SEQ ID NO: 8339365 - DNA, 20 bp, Homo sapiens
tccttgaaagtggggtatat

SEQ ID NO: 8339366 - DNA, 22 bp, Homo sapiens
tccttgaaaggggctgcagggc

SEQ ID NO: 8339367 - DNA, 22 bp, Homo sapiens
tccttgaagagtgggcggtcga

SEQ ID NO: 8339368 - DNA, 22 bp, Homo sapiens
tccttgaagcaacgtgcagaca

SEQ ID NO: 8339369 - DNA, 22 bp, Homo sapiens
tccttgaagcaacgtgcagaca

SEQ ID NO: 8339370 - DNA, 22 bp, Homo sapiens
tccttgaagcttgtatctaata

SEQ ID NO: 8339371 - DNA, 22 bp, Homo sapiens
tccttaaatccttcagagatta

SEQ ID NO: 8339372 - DNA, 22 bp, Homo sapiens
tccttaaatgaactctgcatga

SEQ ID NO: 8339373 - DNA, 22 bp, Homo sapiens
tccttaggcaatttgggagagt

SEQ ID NO: 8339374 - DNA, 22 bp, Homo sapiens
tccttcaaagctcctagtgagc

SEQ ID NO: 8339375 - DNA, 22 bp, Homo sapiens
tctactatgtttcttaaataga

SEQ ID NO: 8339376 - DNA, 22 bp, Homo sapiens
tctactgtagtgatgctgcagt

SEQ ID NO: 8339377 - DNA, 22 bp, Homo sapiens
tctacattttctttatgtacat

SEQ ID NO: 8339378 - DNA, 22 bp, Homo sapiens
tctagaaacaggtttctagaaa

SEQ ID NO: 8339379 - DNA, 22 bp, Homo sapiens
tctacttttccctatacagttt

SEQ ID NO: 8339380 - DNA, 22 bp, Homo sapiens
tctagaaaaacaaagtatctga

SEQ ID NO: 8339381 - DNA, 22 bp, Homo sapiens
tctagagaaaaaactcaagtga

SEQ ID NO: 8339382 - DNA, 22 bp, Homo sapiens
tctagagactataatgtgtcct

SEQ ID NO: 8339383 - DNA, 22 bp, Homo sapiens
tctagagatacattggtcattt

SEQ ID NO: 8339384 - DNA, 22 bp, Homo sapiens
tctagagctttttcctcttgta

SEQ ID NO: 8339385 - DNA, 22 bp, Homo sapiens
tctagcaccacattaaatagca

SEQ ID NO: 8339386 - DNA, 22 bp, Homo sapiens
tctagatgaatgtgaggatatc

SEQ ID NO: 8339387 - DNA, 22 bp, Homo sapiens
tctagatgtactgctgaagagt

SEQ ID NO: 8339388 - DNA, 22 bp, Homo sapiens
tctaacttagggaatactttag

SEQ ID NO: 8339389 - DNA, 22 bp, Homo sapiens
tctaacttgtgagtatagatga

SEQ ID NO: 8339390 - DNA, 22 bp, Homo sapiens
tctacaaagaagaattaatgtc

SEQ ID NO: 8339391 - DNA, 22 bp, Homo sapiens
tctaattttaggcatttgttca

SEQ ID NO: 8339392 - DNA, 22 bp, Homo sapiens
tctaattttggcattttaacct

SEQ ID NO: 8339393 - DNA, 23 bp, Homo sapiens
tctacaaagctgtgtcaggaccc

SEQ ID NO: 8339394 - DNA, 22 bp, Homo sapiens
tctaaatggaaagaaaatacct

SEQ ID NO: 8339395 - DNA, 22 bp, Homo sapiens
tctaacctttgaaactgctttc

SEQ ID NO: 8339396 - DNA, 22 bp, Homo sapiens
tctacatatgtgatttctaagt

SEQ ID NO: 8339397 - DNA, 21 bp, Homo sapiens
tctacatatcaatatgtaatt

SEQ ID NO: 8339398 - DNA, 19 bp, Homo sapiens
tctacaaagtggcatcagg

SEQ ID NO: 8339399 - DNA, 22 bp, Homo sapiens
tctacaagtcaagtctatcaag

SEQ ID NO: 8339400 - DNA, 22 bp, Homo sapiens
tctacagaaactggctactctc

SEQ ID NO: 8339401 - DNA, 22 bp, Homo sapiens
tctcaatattatatgtcataaa

SEQ ID NO: 8339402 - DNA, 22 bp, Homo sapiens
tctcaatgactcctatttacat

SEQ ID NO: 8339403 - DNA, 22 bp, Homo sapiens
tctattcaggcagagtgcagca

SEQ ID NO: 8339404 - DNA, 22 bp, Homo sapiens
tctattttatactcaaatcttc

SEQ ID NO: 8339405 - DNA, 22 bp, Homo sapiens
tctattttatactcaaatcttc

SEQ ID NO: 8339406 - DNA, 22 bp, Homo sapiens
tctattttcttgccaaaactgc

SEQ ID NO: 8339407 - DNA, 22 bp, Homo sapiens
tctattttcttgccaaaactgc

SEQ ID NO: 8339408 - DNA, 22 bp, Homo sapiens
tctattttatactcaaatcttc

SEQ ID NO: 8339409 - DNA, 22 bp, Homo sapiens
tctatttgctggttgcttctgt

SEQ ID NO: 8339410 - DNA, 22 bp, Homo sapiens
tctatttttatagttgaagtgc

SEQ ID NO: 8339411 - DNA, 22 bp, Homo sapiens
tctcaaactgtgtattataatt

SEQ ID NO: 8339412 - DNA, 22 bp, Homo sapiens
tctataaagggccagatagtag

SEQ ID NO: 8339413 - DNA, 22 bp, Homo sapiens
tctatgaatgacacagataata

SEQ ID NO: 8339414 - DNA, 22 bp, Homo sapiens
tctattatggtacttatcatga

SEQ ID NO: 8339415 - DNA, 22 bp, Homo sapiens
tctagttagtggttgatactgt

SEQ ID NO: 8339416 - DNA, 22 bp, Homo sapiens
tctagtgttttggaacatggaa

SEQ ID NO: 8339417 - DNA, 22 bp, Homo sapiens
tctagtgttaaggcaaagtaaa

SEQ ID NO: 8339418 - DNA, 22 bp, Homo sapiens
tctataaagggccagatagtag

SEQ ID NO: 8339419 - DNA, 22 bp, Homo sapiens
tctataaaactcaagagcaatt

SEQ ID NO: 8339420 - DNA, 18 bp, Homo sapiens
tcctggccacactacctt

SEQ ID NO: 8339421 - DNA, 22 bp, Homo sapiens
tcctggccataggctatttcag

SEQ ID NO: 8339422 - DNA, 22 bp, Homo sapiens
tcctggccaagttactctctgc

SEQ ID NO: 8339423 - DNA, 20 bp, Homo sapiens
tcctggcctccctggggctc

SEQ ID NO: 8339424 - DNA, 22 bp, Homo sapiens
tcctggcctcgctgtccacctt

SEQ ID NO: 8339425 - DNA, 22 bp, Homo sapiens
tcctggctctgctgcctcctag

SEQ ID NO: 8339426 - DNA, 22 bp, Homo sapiens
tcctggcctagctcaccctgga

SEQ ID NO: 8339427 - DNA, 21 bp, Homo sapiens
tcctggcccactctatcccca

SEQ ID NO: 8339428 - DNA, 22 bp, Homo sapiens
tcctggcccactatgccagcat

SEQ ID NO: 8339429 - DNA, 22 bp, Homo sapiens
taagaattatctcatggataat

SEQ ID NO: 8339430 - DNA, 22 bp, Homo sapiens
taagaattgtgttgaatagagt

SEQ ID NO: 8339431 - DNA, 22 bp, Homo sapiens
taagaattgtgttgaatagagt

SEQ ID NO: 8339432 - DNA, 22 bp, Homo sapiens
taagaatagtccctagatgtgt

SEQ ID NO: 8339433 - DNA, 22 bp, Homo sapiens
taagaacattttcggaaagata

SEQ ID NO: 8339434 - DNA, 22 bp, Homo sapiens
taagaacagtgtttcatctcta

SEQ ID NO: 8339435 - DNA, 22 bp, Homo sapiens
taagaactcgtgatcatttgaa

SEQ ID NO: 8339436 - DNA, 22 bp, Homo sapiens
taagaacagtgtctgtctcaca

SEQ ID NO: 8339437 - DNA, 22 bp, Homo sapiens
taagaacataaattcatacggg

SEQ ID NO: 8339438 - DNA, 22 bp, Homo sapiens
taagaacagtgacagccaacat

SEQ ID NO: 8339439 - DNA, 22 bp, Homo sapiens
taagaacagtagaacagtaggt

SEQ ID NO: 8339440 - DNA, 23 bp, Homo sapiens
taagaacagacaagcatttacat

SEQ ID NO: 8339441 - DNA, 22 bp, Homo sapiens
tcctggaggcactcgctggggc

SEQ ID NO: 8339442 - DNA, 22 bp, Homo sapiens
tcctggaagatctctgtgagat

SEQ ID NO: 8339443 - DNA, 22 bp, Homo sapiens
tcctggggtcctgactgcttcc

SEQ ID NO: 8339444 - DNA, 22 bp, Homo sapiens
tcctggggtcctgactgcttcc

SEQ ID NO: 8339445 - DNA, 20 bp, Homo sapiens
tcctggggtaagccatggtc

SEQ ID NO: 8339446 - DNA, 22 bp, Homo sapiens
tcctggggtttagagggaagtg

SEQ ID NO: 8339447 - DNA, 22 bp, Homo sapiens
tcctggggtgtgttttgctgct

SEQ ID NO: 8339448 - DNA, 22 bp, Homo sapiens
tcctggggtgtgttttgctgct

SEQ ID NO: 8339449 - DNA, 22 bp, Homo sapiens
tcctggggttttggccgcagct

SEQ ID NO: 8339450 - DNA, 22 bp, Homo sapiens
tcctggggttttggccgcagct

SEQ ID NO: 8339451 - DNA, 22 bp, Homo sapiens
tcctggggtttagagggaagtg

SEQ ID NO: 8339452 - DNA, 22 bp, Homo sapiens
tcctgggtcccgcacatctgtc

SEQ ID NO: 8339453 - DNA, 22 bp, Homo sapiens
tcctgggtctgggtgtctgagg

SEQ ID NO: 8339454 - DNA, 22 bp, Homo sapiens
tcctgggtgaaagaacaggcag

SEQ ID NO: 8339455 - DNA, 22 bp, Homo sapiens
tcctggggccagcactggtgga

SEQ ID NO: 8339456 - DNA, 22 bp, Homo sapiens
tcctggggccagcactggtgga

SEQ ID NO: 8339457 - DNA, 22 bp, Homo sapiens
tcctggggccaggcacctctgg

SEQ ID NO: 8339458 - DNA, 22 bp, Homo sapiens
tcctggggctcatgggatttgt

SEQ ID NO: 8339459 - DNA, 22 bp, Homo sapiens
tcctggggctcatgggatttgt

SEQ ID NO: 8339460 - DNA, 22 bp, Homo sapiens
tcctggggccaggcacctctgg

SEQ ID NO: 8339461 - DNA, 22 bp, Homo sapiens
tcctggggccaggcacctctgg

SEQ ID NO: 8339462 - DNA, 16 bp, Homo sapiens
tcctggggatactgga

SEQ ID NO: 8339463 - DNA, 22 bp, Homo sapiens
tcctggggaggtcgaggctgag

SEQ ID NO: 8339464 - DNA, 16 bp, Homo sapiens
tcctggggatactgga

SEQ ID NO: 8339465 - DNA, 19 bp, Homo sapiens
tcctggggatgtggtcacc

SEQ ID NO: 8339466 - DNA, 19 bp, Homo sapiens
tcctggggatgtggtcacc

SEQ ID NO: 8339467 - DNA, 22 bp, Homo sapiens
tcctggggctctttgatgtgat

SEQ ID NO: 8339468 - DNA, 22 bp, Homo sapiens
tcctggggctctgagcgagaca

SEQ ID NO: 8339469 - DNA, 22 bp, Homo sapiens
tcctggggctctgagcgagaca

SEQ ID NO: 8339470 - DNA, 22 bp, Homo sapiens
tcctggggctctttgatgtgat

SEQ ID NO: 8339471 - DNA, 22 bp, Homo sapiens
tcctggggctgcaaggcctgtc

SEQ ID NO: 8339472 - DNA, 21 bp, Homo sapiens
tcctggggggtaggtgagttt

SEQ ID NO: 8339473 - DNA, 22 bp, Homo sapiens
tcctggggctgcaaggcctgtc

SEQ ID NO: 8339474 - DNA, 21 bp, Homo sapiens
tcctggggggtaggtgagttt

SEQ ID NO: 8339475 - DNA, 20 bp, Homo sapiens
tcctggggtaagccatggtc

SEQ ID NO: 8339476 - DNA, 22 bp, Homo sapiens
tcctgtctgctcacagagctgg

SEQ ID NO: 8339477 - DNA, 22 bp, Homo sapiens
tcctgtctaaagacctgcaggc

SEQ ID NO: 8339478 - DNA, 22 bp, Homo sapiens
tcctgtgcctccacctgctccg

SEQ ID NO: 8339479 - DNA, 18 bp, Homo sapiens
tcctgtggcccagagttt

SEQ ID NO: 8339480 - DNA, 22 bp, Homo sapiens
tcctgtcagtgaggcagatgaa

SEQ ID NO: 8339481 - DNA, 22 bp, Homo sapiens
tcctgtcctctgggtgccccat

SEQ ID NO: 8339482 - DNA, 20 bp, Homo sapiens
tcctgtccgcgccttgcgtc

SEQ ID NO: 8339483 - DNA, 20 bp, Homo sapiens
tcctgtccgcgccttgcgtc

SEQ ID NO: 8339484 - DNA, 22 bp, Homo sapiens
tcctggcttccactcctctgtt

SEQ ID NO: 8339485 - DNA, 22 bp, Homo sapiens
tcctggcttcctgctcttgtca

SEQ ID NO: 8339486 - DNA, 22 bp, Homo sapiens
tcctgggcacaagtgagtctcc

SEQ ID NO: 8339487 - DNA, 22 bp, Homo sapiens
tcctggggaggtcgaggctgag

SEQ ID NO: 8339488 - DNA, 22 bp, Homo sapiens
tcctggggagggttctggctcc

SEQ ID NO: 8339489 - DNA, 19 bp, Homo sapiens
tcctgggctgggccaggtc

SEQ ID NO: 8339490 - DNA, 19 bp, Homo sapiens
tcctgggcgttgactttgg

SEQ ID NO: 8339491 - DNA, 22 bp, Homo sapiens
tcctgggcggttatgtgatctg

SEQ ID NO: 8339492 - DNA, 22 bp, Homo sapiens
tcctgggccaagggctgtgagg

SEQ ID NO: 8339493 - DNA, 22 bp, Homo sapiens
tctctcagtcagatgctaaaga

SEQ ID NO: 8339494 - DNA, 22 bp, Homo sapiens
tctctccaacatggtggtgctg

SEQ ID NO: 8339495 - DNA, 22 bp, Homo sapiens
tctctcataagatgagtactta

SEQ ID NO: 8339496 - DNA, 22 bp, Homo sapiens
tctctcctccacaccgggtgct

SEQ ID NO: 8339497 - DNA, 22 bp, Homo sapiens
tctctcctctagtcagggtggt

SEQ ID NO: 8339498 - DNA, 22 bp, Homo sapiens
tctctgaagagctcagactagt

SEQ ID NO: 8339499 - DNA, 22 bp, Homo sapiens
tctctgaaagcagctgctcatc

SEQ ID NO: 8339500 - DNA, 22 bp, Homo sapiens
tctctgaattctgatgcaagtg

SEQ ID NO: 8339501 - DNA, 22 bp, Homo sapiens
tctctgagaaacatgttcaaag

SEQ ID NO: 8339502 - DNA, 22 bp, Homo sapiens
tctctgagcccaatgtagcaat

SEQ ID NO: 8339503 - DNA, 22 bp, Homo sapiens
tctctgagcccagtgtccccct

SEQ ID NO: 8339504 - DNA, 22 bp, Homo sapiens
tctctgagggagatggcctgcc

SEQ ID NO: 8339505 - DNA, 22 bp, Homo sapiens
tctctggcagaggccctatccc

SEQ ID NO: 8339506 - DNA, 22 bp, Homo sapiens
tctctggcagacacctccctga

SEQ ID NO: 8339507 - DNA, 22 bp, Homo sapiens
tctctggcactcccttatggct

SEQ ID NO: 8339508 - DNA, 22 bp, Homo sapiens
tctctggctgatattcctctgc

SEQ ID NO: 8339509 - DNA, 19 bp, Homo sapiens
tctctggcagttcagagca

SEQ ID NO: 8339510 - DNA, 19 bp, Homo sapiens
tctctgccgatcagggccc

SEQ ID NO: 8339511 - DNA, 19 bp, Homo sapiens
tctctgccgatcagggccc

SEQ ID NO: 8339512 - DNA, 22 bp, Homo sapiens
tctctgagttctcctccagccc

SEQ ID NO: 8339513 - DNA, 22 bp, Homo sapiens
tctctgcccatgagcaatctgc

SEQ ID NO: 8339514 - DNA, 19 bp, Homo sapiens
tctctgcttctcttggcat

SEQ ID NO: 8339515 - DNA, 19 bp, Homo sapiens
tctctggcttgtctgcctg

SEQ ID NO: 8339516 - DNA, 21 bp, Homo sapiens
tctctgggccctcctgtgggg

SEQ ID NO: 8339517 - DNA, 22 bp, Homo sapiens
tctctggggaaaaggctgatac

SEQ ID NO: 8339518 - DNA, 20 bp, Homo sapiens
tctctgggttctcactcagc

SEQ ID NO: 8339519 - DNA, 22 bp, Homo sapiens
tctctggggatggacctgggag

SEQ ID NO: 8339520 - DNA, 22 bp, Homo sapiens
tctgaaatggggctgaagcact

SEQ ID NO: 8339521 - DNA, 23 bp, Homo sapiens
tctgaagatgctgtttccagtga

SEQ ID NO: 8339522 - DNA, 21 bp, Homo sapiens
tctctttgggaacattaatca

SEQ ID NO: 8339523 - DNA, 22 bp, Homo sapiens
tctctttgcctgctgccatcca

SEQ ID NO: 8339524 - DNA, 22 bp, Homo sapiens
tctctttaagtataatcttata

SEQ ID NO: 8339525 - DNA, 22 bp, Homo sapiens
tctctttactttcaccaatttg

SEQ ID NO: 8339526 - DNA, 23 bp, Homo sapiens
tctctttcaagagcttaatgtgc

SEQ ID NO: 8339527 - DNA, 22 bp, Homo sapiens
tctcttgttgggtatatgaaat

SEQ ID NO: 8339528 - DNA, 22 bp, Homo sapiens
tctctttaaagactcagagatt

SEQ ID NO: 8339529 - DNA, 22 bp, Homo sapiens
tctgaaaatgttgactttgttt

SEQ ID NO: 8339530 - DNA, 22 bp, Homo sapiens
tctgaaagaagggcagtctttt

SEQ ID NO: 8339531 - DNA, 22 bp, Homo sapiens
tctgaaagggctaaataatttg

SEQ ID NO: 8339532 - DNA, 22 bp, Homo sapiens
tctctgtgggtttcaccagcgc

SEQ ID NO: 8339533 - DNA, 22 bp, Homo sapiens
tctctgtgtcctgaaatgaagg

SEQ ID NO: 8339534 - DNA, 21 bp, Homo sapiens
tctctgtggcctaccctctac

SEQ ID NO: 8339535 - DNA, 22 bp, Homo sapiens
tctctggtcccacctggccatt

SEQ ID NO: 8339536 - DNA, 22 bp, Homo sapiens
tctctgtctttgttgtcttcac

SEQ ID NO: 8339537 - DNA, 22 bp, Homo sapiens
tctctgtctgcacccaatcaat

SEQ ID NO: 8339538 - DNA, 22 bp, Homo sapiens
tctctgtctgagcctggcagac

SEQ ID NO: 8339539 - DNA, 22 bp, Homo sapiens
tctctgtctcccgtgtgtccgg

SEQ ID NO: 8339540 - DNA, 22 bp, Homo sapiens
tctcttctctagtgagcaactg

SEQ ID NO: 8339541 - DNA, 22 bp, Homo sapiens
tctcttctctagtgagcaactg

SEQ ID NO: 8339542 - DNA, 22 bp, Homo sapiens
tctcttctatttgagactattt

SEQ ID NO: 8339543 - DNA, 22 bp, Homo sapiens
tctcttctgaaacctgtcttta

SEQ ID NO: 8339544 - DNA, 22 bp, Homo sapiens
tctcttctgacctagccttgga

SEQ ID NO: 8339545 - DNA, 18 bp, Homo sapiens
tctcttcttggcagtcaa

SEQ ID NO: 8339546 - DNA, 22 bp, Homo sapiens
tctcttccagtaagagtcttta

SEQ ID NO: 8339547 - DNA, 21 bp, Homo sapiens
tctccagtatccttctctgag

SEQ ID NO: 8339548 - DNA, 22 bp, Homo sapiens
tctccagggcagagaatagcaa

SEQ ID NO: 8339549 - DNA, 22 bp, Homo sapiens
tctcccattacttatggcccac

SEQ ID NO: 8339550 - DNA, 19 bp, Homo sapiens
tctcccatgcctgtgtcta

SEQ ID NO: 8339551 - DNA, 22 bp, Homo sapiens
tctcccattcagcttgcagtca

SEQ ID NO: 8339552 - DNA, 22 bp, Homo sapiens
tctcccatgaggctgcggtcaa

SEQ ID NO: 8339553 - DNA, 22 bp, Homo sapiens
tctcccatgaggctgcggtcaa

SEQ ID NO: 8339554 - DNA, 19 bp, Homo sapiens
tctcccatgcctgtgtcta

SEQ ID NO: 8339555 - DNA, 22 bp, Homo sapiens
tctcccaggtcatacacagaga

SEQ ID NO: 8339556 - DNA, 22 bp, Homo sapiens
tctcccaggtgggtgcctggag

SEQ ID NO: 8339557 - DNA, 22 bp, Homo sapiens
tctcccagtcctctgtgcttac

SEQ ID NO: 8339558 - DNA, 22 bp, Homo sapiens
tctcccaggctgccctgtggac

SEQ ID NO: 8339559 - DNA, 22 bp, Homo sapiens
tctcgctctgtcgcccaggctg

SEQ ID NO: 8339560 - DNA, 22 bp, Homo sapiens
tctctaaacttatatgaactat

SEQ ID NO: 8339561 - DNA, 22 bp, Homo sapiens
tctctaaaattcccggccaact

SEQ ID NO: 8339562 - DNA, 21 bp, Homo sapiens
tctctaaaaagattctatttg

SEQ ID NO: 8339563 - DNA, 22 bp, Homo sapiens
tctctaaagatagctgcctcga

SEQ ID NO: 8339564 - DNA, 22 bp, Homo sapiens
tctctaaagaagcctccctaaa

SEQ ID NO: 8339565 - DNA, 22 bp, Homo sapiens
tctctaaagatatttatggcaa

SEQ ID NO: 8339566 - DNA, 22 bp, Homo sapiens
tctcctgggcttggttgaagtt

SEQ ID NO: 8339567 - DNA, 22 bp, Homo sapiens
tctcctgccactgcttcccatt

SEQ ID NO: 8339568 - DNA, 22 bp, Homo sapiens
tctcctcaccaccagcagcaga

SEQ ID NO: 8339569 - DNA, 21 bp, Homo sapiens
tctcctcccggggagaggccg

SEQ ID NO: 8339570 - DNA, 22 bp, Homo sapiens
tctcctctactgggtctgcaga

SEQ ID NO: 8339571 - DNA, 22 bp, Homo sapiens
tctcattttgagtcagacacta

SEQ ID NO: 8339572 - DNA, 22 bp, Homo sapiens
tctcatttggctttgttttaaa

SEQ ID NO: 8339573 - DNA, 22 bp, Homo sapiens
tctcatgttgcttaactctatg

SEQ ID NO: 8339574 - DNA, 23 bp, Homo sapiens
tctcatgtctttcctacaagcat

SEQ ID NO: 8339575 - DNA, 22 bp, Homo sapiens
tctcatgttttacctgtcctca

SEQ ID NO: 8339576 - DNA, 22 bp, Homo sapiens
tctcattaaaacattttaatta

SEQ ID NO: 8339577 - DNA, 22 bp, Homo sapiens
tctcatgctgaagtattttctc

SEQ ID NO: 8339578 - DNA, 22 bp, Homo sapiens
tctcaccatggtgcttgcttat

SEQ ID NO: 8339579 - DNA, 22 bp, Homo sapiens
tctcaccaaagccttgaccata

SEQ ID NO: 8339580 - DNA, 22 bp, Homo sapiens
tctcactcatttcctaggtctt

SEQ ID NO: 8339581 - DNA, 22 bp, Homo sapiens
tctcactgggtataaatgagta

SEQ ID NO: 8339582 - DNA, 22 bp, Homo sapiens
tctcagagagatgaaacttcca

SEQ ID NO: 8339583 - DNA, 22 bp, Homo sapiens
tctcagagagctgtgttttcct

SEQ ID NO: 8339584 - DNA, 22 bp, Homo sapiens
tctcagagaggggccgggcctt

SEQ ID NO: 8339585 - DNA, 22 bp, Homo sapiens
tctcagagatctttctgcatgt

SEQ ID NO: 8339586 - DNA, 22 bp, Homo sapiens
tctcagagaggggccgggcctt

SEQ ID NO: 8339587 - DNA, 22 bp, Homo sapiens
tctcagagatgtcaagagtcta

SEQ ID NO: 8339588 - DNA, 22 bp, Homo sapiens
tctcagagatgttagggaagag

SEQ ID NO: 8339589 - DNA, 18 bp, Homo sapiens
tctcagaggccatcctag

SEQ ID NO: 8339590 - DNA, 23 bp, Homo sapiens
tctcagaggattcctgggccttg

SEQ ID NO: 8339591 - DNA, 19 bp, Homo sapiens
tctcagaggaaaaattgct

SEQ ID NO: 8339592 - DNA, 22 bp, Homo sapiens
tctcagagctcacacctcctgg

SEQ ID NO: 8339593 - DNA, 22 bp, Homo sapiens
tctcagagcttcagaaagcacc

SEQ ID NO: 8339594 - DNA, 22 bp, Homo sapiens
tctcagagcctaactaacctaa

SEQ ID NO: 8339595 - DNA, 22 bp, Homo sapiens
tctcagagcttcagttattttc

SEQ ID NO: 8339596 - DNA, 22 bp, Homo sapiens
tctcagagattcagggagaagt

SEQ ID NO: 8339597 - DNA, 22 bp, Homo sapiens
tctcagagcatcattttcttag

SEQ ID NO: 8339598 - DNA, 22 bp, Homo sapiens
tctcagagattttgtttccctt

SEQ ID NO: 8339599 - DNA, 22 bp, Homo sapiens
tctcagagatttatggaaaact

SEQ ID NO: 8339600 - DNA, 19 bp, Homo sapiens
tctcagagccctagaggcc

SEQ ID NO: 8339601 - DNA, 18 bp, Homo sapiens
tctcagcccagctccggc

SEQ ID NO: 8339602 - DNA, 22 bp, Homo sapiens
tctcagagtgacaatgagaatt

SEQ ID NO: 8339603 - DNA, 22 bp, Homo sapiens
tctcagagtaattctttaaggt

SEQ ID NO: 8339604 - DNA, 22 bp, Homo sapiens
tctcagagttcctctggagtcc

SEQ ID NO: 8339605 - DNA, 22 bp, Homo sapiens
tctcagagtggtggtccctctg

SEQ ID NO: 8339606 - DNA, 22 bp, Homo sapiens
tctcagagggaggattactgcc

SEQ ID NO: 8339607 - DNA, 22 bp, Homo sapiens
tctcagagggaaaggccaattt

SEQ ID NO: 8339608 - DNA, 22 bp, Homo sapiens
tctcagaggtgccctggcatct

SEQ ID NO: 8339609 - DNA, 22 bp, Homo sapiens
tctcagaggtcttcagcctctg

SEQ ID NO: 8339610 - DNA, 22 bp, Homo sapiens
tctcagaggcccgacgttctcc

SEQ ID NO: 8339611 - DNA, 22 bp, Homo sapiens
tctcagagggaaacatgagtga

SEQ ID NO: 8339612 - DNA, 22 bp, Homo sapiens
tctcagagtttgaatctggagt

SEQ ID NO: 8339613 - DNA, 22 bp, Homo sapiens
tctcagagtttttttccaggac

SEQ ID NO: 8339614 - DNA, 22 bp, Homo sapiens
tctcagagtttacggggctgaa

SEQ ID NO: 8339615 - DNA, 22 bp, Homo sapiens
tctcagagtttagagctgagcc

SEQ ID NO: 8339616 - DNA, 19 bp, Homo sapiens
tgccctgcccgcagccttg

SEQ ID NO: 8339617 - DNA, 22 bp, Homo sapiens
tgccctgcccttgctatttcta

SEQ ID NO: 8339618 - DNA, 22 bp, Homo sapiens
tgccctgcctgagagacagtaa

SEQ ID NO: 8339619 - DNA, 22 bp, Homo sapiens
tgccctgctgtgcctggagcca

SEQ ID NO: 8339620 - DNA, 22 bp, Homo sapiens
tgccctgctaaccttggttcca

SEQ ID NO: 8339621 - DNA, 22 bp, Homo sapiens
tgccctgcggctatctagatga

SEQ ID NO: 8339622 - DNA, 22 bp, Homo sapiens
tgccctgctaaatataggtagc

SEQ ID NO: 8339623 - DNA, 22 bp, Homo sapiens
tgccctgccaagactgagtggt

SEQ ID NO: 8339624 - DNA, 22 bp, Homo sapiens
tgccctgcccatctaccctgtc

SEQ ID NO: 8339625 - DNA, 22 bp, Homo sapiens
tgccctgcatgcagggagctgt

SEQ ID NO: 8339626 - DNA, 22 bp, Homo sapiens
tgccctgccaagaccaagtggt

SEQ ID NO: 8339627 - DNA, 22 bp, Homo sapiens
tgccctgccaagactcagtggt

SEQ ID NO: 8339628 - DNA, 22 bp, Homo sapiens
tgccctgccaagactcagtggt

SEQ ID NO: 8339629 - DNA, 22 bp, Homo sapiens
tgccctgcagaccctgcagtgt

SEQ ID NO: 8339630 - DNA, 22 bp, Homo sapiens
tgccctgcagtgagtgcgtctg

SEQ ID NO: 8339631 - DNA, 22 bp, Homo sapiens
tgccctgcagaccctgcagtgt

SEQ ID NO: 8339632 - DNA, 22 bp, Homo sapiens
tgccctgcagtgagtgcgtctg

SEQ ID NO: 8339633 - DNA, 19 bp, Homo sapiens
tgccctgcacgctgtcctg

SEQ ID NO: 8339634 - DNA, 22 bp, Homo sapiens
tgccctgcttggtttattttca

SEQ ID NO: 8339635 - DNA, 22 bp, Homo sapiens
tgccctgcttctcttgggacag

SEQ ID NO: 8339636 - DNA, 22 bp, Homo sapiens
tgccctgctgtggctctgccca

SEQ ID NO: 8339637 - DNA, 22 bp, Homo sapiens
tgccctgctgtgcctggagcca

SEQ ID NO: 8339638 - DNA, 22 bp, Homo sapiens
tgccctgctgtggctctgccca

SEQ ID NO: 8339639 - DNA, 22 bp, Homo sapiens
tgccctggcattgggttggata

SEQ ID NO: 8339640 - DNA, 22 bp, Homo sapiens
tgccctggctcctcccacgctg

SEQ ID NO: 8339641 - DNA, 22 bp, Homo sapiens
tgcctaggctggagtgcaatgg

SEQ ID NO: 8339642 - DNA, 22 bp, Homo sapiens
tgcctcaagccctccactgcac

SEQ ID NO: 8339643 - DNA, 22 bp, Homo sapiens
tgccgcagtgcggggagggccc

SEQ ID NO: 8339644 - DNA, 22 bp, Homo sapiens
tgcctactagtactattttgtg

SEQ ID NO: 8339645 - DNA, 22 bp, Homo sapiens
tgccctgggacatgcagcggag

SEQ ID NO: 8339646 - DNA, 22 bp, Homo sapiens
tgcccttgaggacagctcccag

SEQ ID NO: 8339647 - DNA, 22 bp, Homo sapiens
tgcctctgttgagccttggctg

SEQ ID NO: 8339648 - DNA, 22 bp, Homo sapiens
tgcctgagggagtaagagtcct

SEQ ID NO: 8339649 - DNA, 22 bp, Homo sapiens
tgcctctgtgggccttcctggc

SEQ ID NO: 8339650 - DNA, 22 bp, Homo sapiens
tgcctctgtgggcagagctgcc

SEQ ID NO: 8339651 - DNA, 22 bp, Homo sapiens
tgcctcagctgaggccgctcca

SEQ ID NO: 8339652 - DNA, 22 bp, Homo sapiens
tgcctggatctgaggacccatt

SEQ ID NO: 8339653 - DNA, 22 bp, Homo sapiens
tgcctggagtgtgttcaggatt

SEQ ID NO: 8339654 - DNA, 22 bp, Homo sapiens
tgcctggagtccccaagtccat

SEQ ID NO: 8339655 - DNA, 21 bp, Homo sapiens
tgcctgcattctatcagacca

SEQ ID NO: 8339656 - DNA, 18 bp, Homo sapiens
tgcctggaaggaacagga

SEQ ID NO: 8339657 - DNA, 22 bp, Homo sapiens
tgcctggaaggcccatgggaag

SEQ ID NO: 8339658 - DNA, 22 bp, Homo sapiens
tgccagggccatagggagtcta

SEQ ID NO: 8339659 - DNA, 22 bp, Homo sapiens
tgccatccccatgtggtggaga

SEQ ID NO: 8339660 - DNA, 21 bp, Homo sapiens
tgccagggatttacagagcct

SEQ ID NO: 8339661 - DNA, 22 bp, Homo sapiens
tgccagggagccctgctgacca

SEQ ID NO: 8339662 - DNA, 22 bp, Homo sapiens
tgccaggcttagagcaggggct

SEQ ID NO: 8339663 - DNA, 20 bp, Homo sapiens
tgccaggcacggagtgcatg

SEQ ID NO: 8339664 - DNA, 22 bp, Homo sapiens
tgccaggcagtgtcagattgag

SEQ ID NO: 8339665 - DNA, 18 bp, Homo sapiens
tgccagccgactggcctg

SEQ ID NO: 8339666 - DNA, 22 bp, Homo sapiens
tgccagcctggcctgagtcttt

SEQ ID NO: 8339667 - DNA, 22 bp, Homo sapiens
tgccaggccaatgaaggcaggg

SEQ ID NO: 8339668 - DNA, 22 bp, Homo sapiens
tgccaggctaagtggaggactt

SEQ ID NO: 8339669 - DNA, 22 bp, Homo sapiens
tgcccaagtgtttggctgagtc

SEQ ID NO: 8339670 - DNA, 20 bp, Homo sapiens
tgcccagcaagagtgcagtt

SEQ ID NO: 8339671 - DNA, 22 bp, Homo sapiens
tgcccacttcaaaatcttcatt

SEQ ID NO: 8339672 - DNA, 21 bp, Homo sapiens
tgcccaccaagctccacactg

SEQ ID NO: 8339673 - DNA, 20 bp, Homo sapiens
tgcccagcaagagtgcagtt

SEQ ID NO: 8339674 - DNA, 22 bp, Homo sapiens
tgcccagcactgtgccagtcac

SEQ ID NO: 8339675 - DNA, 22 bp, Homo sapiens
tgcccagggtggagtgcagcgg

SEQ ID NO: 8339676 - DNA, 22 bp, Homo sapiens
tgcccaggattgtgaggtcagg

SEQ ID NO: 8339677 - DNA, 22 bp, Homo sapiens
tgcccaggattgtgaggtcagg

SEQ ID NO: 8339678 - DNA, 22 bp, Homo sapiens
tgcccccagacagaatccagtt

SEQ ID NO: 8339679 - DNA, 22 bp, Homo sapiens
tgcccagggtggagtgcagcgg

SEQ ID NO: 8339680 - DNA, 20 bp, Homo sapiens
tgcaggtgggcccttctggg

SEQ ID NO: 8339681 - DNA, 22 bp, Homo sapiens
tgcaggtgtggttcctcagcca

SEQ ID NO: 8339682 - DNA, 22 bp, Homo sapiens
tgcagtgggccggaggccaggg

SEQ ID NO: 8339683 - DNA, 23 bp, Homo sapiens
tgcagtgtttaacaatgacttga

SEQ ID NO: 8339684 - DNA, 22 bp, Homo sapiens
tgcaggtctctgcaaggcctat

SEQ ID NO: 8339685 - DNA, 20 bp, Homo sapiens
tgcagggctgcctcccagct

SEQ ID NO: 8339686 - DNA, 19 bp, Homo sapiens
tgcagggctgcgcctgggg

SEQ ID NO: 8339687 - DNA, 23 bp, Homo sapiens
tgcaggggaggcttaaagcaggt

SEQ ID NO: 8339688 - DNA, 22 bp, Homo sapiens
tgcagggaaaacccaggatgct

SEQ ID NO: 8339689 - DNA, 22 bp, Homo sapiens
tgcagggccgctggaggtcatg

SEQ ID NO: 8339690 - DNA, 22 bp, Homo sapiens
tgcagggcccttggggttgaac

SEQ ID NO: 8339691 - DNA, 22 bp, Homo sapiens
tgcagggcagtggaggttgagt

SEQ ID NO: 8339692 - DNA, 22 bp, Homo sapiens
tgcataattggtcctccacatt

SEQ ID NO: 8339693 - DNA, 22 bp, Homo sapiens
tgcatagaggatccagtgtggt

SEQ ID NO: 8339694 - DNA, 22 bp, Homo sapiens
tgcagttgaccatgctttatat

SEQ ID NO: 8339695 - DNA, 19 bp, Homo sapiens
tgcataaattatatacttt

SEQ ID NO: 8339696 - DNA, 22 bp, Homo sapiens
tgcatgcaaaaaaatctgcatt

SEQ ID NO: 8339697 - DNA, 22 bp, Homo sapiens
tgcatgatgttaaacatcaggt

SEQ ID NO: 8339698 - DNA, 22 bp, Homo sapiens
tgcatgcacgtatctgcgtgtg

SEQ ID NO: 8339699 - DNA, 22 bp, Homo sapiens
tgcatgcagctggtgataagaa

SEQ ID NO: 8339700 - DNA, 17 bp, Homo sapiens
tgcatgtcctttgttcc

SEQ ID NO: 8339701 - DNA, 23 bp, Homo sapiens
tgcatgtgattcatagagtccag

SEQ ID NO: 8339702 - DNA, 22 bp, Homo sapiens
tgcatgttccaactccatcact

SEQ ID NO: 8339703 - DNA, 22 bp, Homo sapiens
tgcatgttattgtggcaagaat

SEQ ID NO: 8339704 - DNA, 22 bp, Homo sapiens
tgcatgtttataacagatgagg

SEQ ID NO: 8339705 - DNA, 22 bp, Homo sapiens
tgcatgttaagaaaatattgag

SEQ ID NO: 8339706 - DNA, 22 bp, Homo sapiens
tgccagccaggttctgaggcta

SEQ ID NO: 8339707 - DNA, 22 bp, Homo sapiens
tgccagcccaccttggggcctc

SEQ ID NO: 8339708 - DNA, 22 bp, Homo sapiens
tgccagagagtggctgggtgtc

SEQ ID NO: 8339709 - DNA, 22 bp, Homo sapiens
tgccagagatttcacactgcta

SEQ ID NO: 8339710 - DNA, 22 bp, Homo sapiens
tgccaccctctctgctacccgc

SEQ ID NO: 8339711 - DNA, 23 bp, Homo sapiens
tgccacccttctcttcccagctt

SEQ ID NO: 8339712 - DNA, 22 bp, Homo sapiens
tgccagactctggggtgctaga

SEQ ID NO: 8339713 - DNA, 22 bp, Homo sapiens
tgccacagttgtttgtgctcta

SEQ ID NO: 8339714 - DNA, 22 bp, Homo sapiens
tgccacagggtcctcaggccag

SEQ ID NO: 8339715 - DNA, 22 bp, Homo sapiens
tgccaagagatgactgaaatgg

SEQ ID NO: 8339716 - DNA, 21 bp, Homo sapiens
tgcatttctaactagttgacc

SEQ ID NO: 8339717 - DNA, 22 bp, Homo sapiens
tgcatttggggcagactagcag

SEQ ID NO: 8339718 - DNA, 22 bp, Homo sapiens
tgcatttgtcttgtctcatgaa

SEQ ID NO: 8339719 - DNA, 22 bp, Homo sapiens
tgcattgttgaccagttgtgca

SEQ ID NO: 8339720 - DNA, 22 bp, Homo sapiens
tgcattgttgatgagttgaata

SEQ ID NO: 8339721 - DNA, 22 bp, Homo sapiens
tgcattgtaggatgtttagcag

SEQ ID NO: 8339722 - DNA, 17 bp, Homo sapiens
tgcattgtaggctagcc

SEQ ID NO: 8339723 - DNA, 22 bp, Homo sapiens
tgcattgttgaatatttcatag

SEQ ID NO: 8339724 - DNA, 17 bp, Homo sapiens
tgcattgttggaaattt

SEQ ID NO: 8339725 - DNA, 22 bp, Homo sapiens
tgcattgtttagaactctttgg

SEQ ID NO: 8339726 - DNA, 22 bp, Homo sapiens
tgcattgtttgataggtgaatt

SEQ ID NO: 8339727 - DNA, 22 bp, Homo sapiens
tgcatttacctggaggtcattt

SEQ ID NO: 8339728 - DNA, 21 bp, Homo sapiens
tgcattcttgtgtaaggtagt

SEQ ID NO: 8339729 - DNA, 22 bp, Homo sapiens
tgcattgcatttgtcatgaaga

SEQ ID NO: 8339730 - DNA, 22 bp, Homo sapiens
tgcattgcatttgtcatgaaga

SEQ ID NO: 8339731 - DNA, 22 bp, Homo sapiens
tgcattgcagttaactcagtat

SEQ ID NO: 8339732 - DNA, 22 bp, Homo sapiens
tgcagcctctctgcttcaggaa

SEQ ID NO: 8339733 - DNA, 21 bp, Homo sapiens
tgcagcctctgcccagcagtg

SEQ ID NO: 8339734 - DNA, 22 bp, Homo sapiens
tgcagccattttctgccaatgc

SEQ ID NO: 8339735 - DNA, 21 bp, Homo sapiens
tgcagccattcagccctatgc

SEQ ID NO: 8339736 - DNA, 22 bp, Homo sapiens
tgcagccaggaaatatttgctg

SEQ ID NO: 8339737 - DNA, 22 bp, Homo sapiens
tgcagcaggagccaggcctggt

SEQ ID NO: 8339738 - DNA, 22 bp, Homo sapiens
tgcagcagagtgggcctgggtg

SEQ ID NO: 8339739 - DNA, 22 bp, Homo sapiens
tgcagcagaatatggctgcagg

SEQ ID NO: 8339740 - DNA, 17 bp, Homo sapiens
tgcagctgatggggaaa

SEQ ID NO: 8339741 - DNA, 17 bp, Homo sapiens
tgcagctgctcccaggc

SEQ ID NO: 8339742 - DNA, 22 bp, Homo sapiens
tgcagctgctggcccaggtgct

SEQ ID NO: 8339743 - DNA, 22 bp, Homo sapiens
tgcagctgctggtggctgaaag

SEQ ID NO: 8339744 - DNA, 22 bp, Homo sapiens
tgcagctagcgtgcctagtgaa

SEQ ID NO: 8339745 - DNA, 22 bp, Homo sapiens
tgcagctgacccactccagtcc

SEQ ID NO: 8339746 - DNA, 21 bp, Homo sapiens
tgcagctgacactggtatgcc

SEQ ID NO: 8339747 - DNA, 18 bp, Homo sapiens
tgcaggagtgaccccggc

SEQ ID NO: 8339748 - DNA, 20 bp, Homo sapiens
tgcagctggtttcacaggga

SEQ ID NO: 8339749 - DNA, 22 bp, Homo sapiens
tgcagctgttacggaccctgtc

SEQ ID NO: 8339750 - DNA, 22 bp, Homo sapiens
tgcaggaacataggttccttgg

SEQ ID NO: 8339751 - DNA, 22 bp, Homo sapiens
tgcaggagcagagatggctgga

SEQ ID NO: 8339752 - DNA, 22 bp, Homo sapiens
tgcaggagagctggtctggccc

SEQ ID NO: 8339753 - DNA, 22 bp, Homo sapiens
tgcacaggccttgaagggagag

SEQ ID NO: 8339754 - DNA, 22 bp, Homo sapiens
tgcacagggagggggccagctc

SEQ ID NO: 8339755 - DNA, 22 bp, Homo sapiens
tgcacaggaggctgtggagaag

SEQ ID NO: 8339756 - DNA, 22 bp, Homo sapiens
tgcacaggtgagactcaggaag

SEQ ID NO: 8339757 - DNA, 20 bp, Homo sapiens
tgcacagggtgggaagcaac

SEQ ID NO: 8339758 - DNA, 21 bp, Homo sapiens
tgcacagggcccaggagagcc

SEQ ID NO: 8339759 - DNA, 22 bp, Homo sapiens
tgcacaggtatgcaaagcatgt

SEQ ID NO: 8339760 - DNA, 23 bp, Homo sapiens
tgcacaggacggccttataagta

SEQ ID NO: 8339761 - DNA, 22 bp, Homo sapiens
tgcacacagttctcaggaaaga

SEQ ID NO: 8339762 - DNA, 22 bp, Homo sapiens
tgcaccatacccattcccctct

SEQ ID NO: 8339763 - DNA, 22 bp, Homo sapiens
tgcaccattaatttatgtgaga

SEQ ID NO: 8339764 - DNA, 22 bp, Homo sapiens
tgcaccatgtaagtggccacgt

SEQ ID NO: 8339765 - DNA, 22 bp, Homo sapiens
tgcaccattttgtcaggctact

SEQ ID NO: 8339766 - DNA, 22 bp, Homo sapiens
tgcacaggtggtccatctgcac

SEQ ID NO: 8339767 - DNA, 22 bp, Homo sapiens
tgcacattgaatgagcaaactg

SEQ ID NO: 8339768 - DNA, 22 bp, Homo sapiens
tgcagaaaccaattcaagtaag

SEQ ID NO: 8339769 - DNA, 22 bp, Homo sapiens
tgcagaaagcattgactcttcc

SEQ ID NO: 8339770 - DNA, 22 bp, Homo sapiens
tgcagaaattcagaaagcataa

SEQ ID NO: 8339771 - DNA, 21 bp, Homo sapiens
tgcagaaatggtttttctaag

SEQ ID NO: 8339772 - DNA, 22 bp, Homo sapiens
tgcagaggagctggaaggctgg

SEQ ID NO: 8339773 - DNA, 22 bp, Homo sapiens
tgcagaggagctggaaggctgg

SEQ ID NO: 8339774 - DNA, 22 bp, Homo sapiens
tgcagaggagtcagcctgggca

SEQ ID NO: 8339775 - DNA, 21 bp, Homo sapiens
tgcagaggcacaaacaagccc

SEQ ID NO: 8339776 - DNA, 22 bp, Homo sapiens
tgcagaggcgccgtgggtgggg

SEQ ID NO: 8339777 - DNA, 22 bp, Homo sapiens
tgcagaggcatttattgatgta

SEQ ID NO: 8339778 - DNA, 22 bp, Homo sapiens
tgcagaatttagggaggcagca

SEQ ID NO: 8339779 - DNA, 22 bp, Homo sapiens
tgcagaatgttatcaaagttag

SEQ ID NO: 8339780 - DNA, 22 bp, Homo sapiens
tgcagatgagggatgaaaatga

SEQ ID NO: 8339781 - DNA, 22 bp, Homo sapiens
tgcagcactgttcacaatagcc

SEQ ID NO: 8339782 - DNA, 20 bp, Homo sapiens
tgcagcagaagcccatgctc

SEQ ID NO: 8339783 - DNA, 21 bp, Homo sapiens
tgcagcagaagtctctgtgtc

SEQ ID NO: 8339784 - DNA, 22 bp, Homo sapiens
tgcagagtcccaggacccagag

SEQ ID NO: 8339785 - DNA, 19 bp, Homo sapiens
tgcagagggtaggaaggcc

SEQ ID NO: 8339786 - DNA, 23 bp, Homo sapiens
tgcagagggactgaagccagctt

SEQ ID NO: 8339787 - DNA, 22 bp, Homo sapiens
tgcagagggagtgacggttcac

SEQ ID NO: 8339788 - DNA, 22 bp, Homo sapiens
tgcagagggaaaaggtgctcct

SEQ ID NO: 8339789 - DNA, 23 bp, Homo sapiens
tgatctctcttgggaggcaatat

SEQ ID NO: 8339790 - DNA, 21 bp, Homo sapiens
tgatcctttcccccatgttgc

SEQ ID NO: 8339791 - DNA, 22 bp, Homo sapiens
tgatccccttcccagtaagcct

SEQ ID NO: 8339792 - DNA, 22 bp, Homo sapiens
tgatattttatgagctttcata

SEQ ID NO: 8339793 - DNA, 22 bp, Homo sapiens
tgatattttatgagctttcata

SEQ ID NO: 8339794 - DNA, 22 bp, Homo sapiens
tgatcacaagtctgaagaatga

SEQ ID NO: 8339795 - DNA, 22 bp, Homo sapiens
tgatcacaagtctgaagaatga

SEQ ID NO: 8339796 - DNA, 22 bp, Homo sapiens
tgatcagtcccatgatcttcca

SEQ ID NO: 8339797 - DNA, 22 bp, Homo sapiens
tgatagcagcaaagacattttt

SEQ ID NO: 8339798 - DNA, 22 bp, Homo sapiens
tgatagaaaatgctgtcaagct

SEQ ID NO: 8339799 - DNA, 22 bp, Homo sapiens
tgatagaaaggaaattaattgg

SEQ ID NO: 8339800 - DNA, 22 bp, Homo sapiens
tgatagaaaggaaattaattgg

SEQ ID NO: 8339801 - DNA, 22 bp, Homo sapiens
tgatagaaaatgctgtcaagct

SEQ ID NO: 8339802 - DNA, 22 bp, Homo sapiens
tgatagaagcagaagcatacca

SEQ ID NO: 8339803 - DNA, 22 bp, Homo sapiens
tgagttctcatgaaatctagtt

SEQ ID NO: 8339804 - DNA, 22 bp, Homo sapiens
tgagttctgactgtgatgccag

SEQ ID NO: 8339805 - DNA, 22 bp, Homo sapiens
tgatactagcagtattttttac

SEQ ID NO: 8339806 - DNA, 20 bp, Homo sapiens
tgatatattactcaggggaa

SEQ ID NO: 8339807 - DNA, 22 bp, Homo sapiens
tgatatctaagaaattctacca

SEQ ID NO: 8339808 - DNA, 22 bp, Homo sapiens
tgatatctaagaaattctacca

SEQ ID NO: 8339809 - DNA, 22 bp, Homo sapiens
tgatatttgctgactgcattgt

SEQ ID NO: 8339810 - DNA, 22 bp, Homo sapiens
tgatatttaagcaaaaatatgg

SEQ ID NO: 8339811 - DNA, 23 bp, Homo sapiens
tgagtgtgttccctgtgagattt

SEQ ID NO: 8339812 - DNA, 19 bp, Homo sapiens
tgagtgggcccctgcagac

SEQ ID NO: 8339813 - DNA, 22 bp, Homo sapiens
tgagtgtgctaggtgtctcggt

SEQ ID NO: 8339814 - DNA, 22 bp, Homo sapiens
tgagtgtgcagggaagtggcgg

SEQ ID NO: 8339815 - DNA, 22 bp, Homo sapiens
tgagtgggacctgcgtgtgtca

SEQ ID NO: 8339816 - DNA, 19 bp, Homo sapiens
tgagtggagtgcaatgaag

SEQ ID NO: 8339817 - DNA, 22 bp, Homo sapiens
tgagtggagtagtgaatgcatt

SEQ ID NO: 8339818 - DNA, 22 bp, Homo sapiens
tgagtggacgtgaggctgagta

SEQ ID NO: 8339819 - DNA, 22 bp, Homo sapiens
tgagtggagaacagaggctctc

SEQ ID NO: 8339820 - DNA, 22 bp, Homo sapiens
tgagtggagactgtgtgtagag

SEQ ID NO: 8339821 - DNA, 18 bp, Homo sapiens
tgagtggaatgagggggc

SEQ ID NO: 8339822 - DNA, 19 bp, Homo sapiens
tgatgccctgacctgagcc

SEQ ID NO: 8339823 - DNA, 22 bp, Homo sapiens
tgatgatttcatttctagctgt

SEQ ID NO: 8339824 - DNA, 22 bp, Homo sapiens
tgatgatttgaaaccagtttct

SEQ ID NO: 8339825 - DNA, 22 bp, Homo sapiens
tgatgctgtcaaggaggtgaac

SEQ ID NO: 8339826 - DNA, 22 bp, Homo sapiens
tgatgctctcctaatatgaaaa

SEQ ID NO: 8339827 - DNA, 22 bp, Homo sapiens
tgatctttggtaatctggcaca

SEQ ID NO: 8339828 - DNA, 22 bp, Homo sapiens
tgatgaaactgaggttccaaga

SEQ ID NO: 8339829 - DNA, 22 bp, Homo sapiens
tgatgaaagttcagtagtgaat

SEQ ID NO: 8339830 - DNA, 22 bp, Homo sapiens
tgatgaaatgttgaggcagtga

SEQ ID NO: 8339831 - DNA, 22 bp, Homo sapiens
tgatgaaaatgttcagcaatta

SEQ ID NO: 8339832 - DNA, 22 bp, Homo sapiens
tgatgaataaccttgagcatat

SEQ ID NO: 8339833 - DNA, 22 bp, Homo sapiens
tgatgaatgtcatacataatga

SEQ ID NO: 8339834 - DNA, 22 bp, Homo sapiens
tgatggcctttttcaccaggct

SEQ ID NO: 8339835 - DNA, 22 bp, Homo sapiens
tgatggccagtcgcactggagg

SEQ ID NO: 8339836 - DNA, 22 bp, Homo sapiens
tgatggccctgtacaaggagtg

SEQ ID NO: 8339837 - DNA, 22 bp, Homo sapiens
tgattctaggtccattatttgc

SEQ ID NO: 8339838 - DNA, 22 bp, Homo sapiens
tgattcatcagaataggagttt

SEQ ID NO: 8339839 - DNA, 22 bp, Homo sapiens
tgattccaagacctattctatt

SEQ ID NO: 8339840 - DNA, 22 bp, Homo sapiens
tgatggttttattaataggacc

SEQ ID NO: 8339841 - DNA, 20 bp, Homo sapiens
tgatggttctttccgggttg

SEQ ID NO: 8339842 - DNA, 22 bp, Homo sapiens
tgatggttgattataaatcagt

SEQ ID NO: 8339843 - DNA, 22 bp, Homo sapiens
tgattaactgtctattaatcat

SEQ ID NO: 8339844 - DNA, 22 bp, Homo sapiens
tgattacaaaagattgtttgaa

SEQ ID NO: 8339845 - DNA, 22 bp, Homo sapiens
tgattacaacagagtcatccat

SEQ ID NO: 8339846 - DNA, 23 bp, Homo sapiens
tgattacaagggccaaagaaagg

SEQ ID NO: 8339847 - DNA, 22 bp, Homo sapiens
tgcaattttttagcacaaggag

SEQ ID NO: 8339848 - DNA, 22 bp, Homo sapiens
tgcacacaagttggagaatgaa

SEQ ID NO: 8339849 - DNA, 22 bp, Homo sapiens
tgcacacacacgtagagaaaag

SEQ ID NO: 8339850 - DNA, 22 bp, Homo sapiens
tgcaatctcggcactttgggag

SEQ ID NO: 8339851 - DNA, 22 bp, Homo sapiens
tgcaatttcaaatatcagaaag

SEQ ID NO: 8339852 - DNA, 22 bp, Homo sapiens
tgcaatttgacgtcagcacagt

SEQ ID NO: 8339853 - DNA, 22 bp, Homo sapiens
tgcaatttggggaagaaagaga

SEQ ID NO: 8339854 - DNA, 22 bp, Homo sapiens
tgcacacacgcggcacatctgt

SEQ ID NO: 8339855 - DNA, 22 bp, Homo sapiens
tgcaagaaacatattccacaag

SEQ ID NO: 8339856 - DNA, 22 bp, Homo sapiens
tgcaagaaatgtgaagctacaa

SEQ ID NO: 8339857 - DNA, 22 bp, Homo sapiens
tgcaacagtggggcatgctgaa

SEQ ID NO: 8339858 - DNA, 22 bp, Homo sapiens
tgcaaatttgacttcacacatc

SEQ ID NO: 8339859 - DNA, 22 bp, Homo sapiens
tgcaagaatgacccatctaccc

SEQ ID NO: 8339860 - DNA, 22 bp, Homo sapiens
tgcaagaatgacccatctaccc

SEQ ID NO: 8339861 - DNA, 22 bp, Homo sapiens
tgcaagggcttagggggctgtg

SEQ ID NO: 8339862 - DNA, 22 bp, Homo sapiens
tgcaaggctgcagagggtgcta

SEQ ID NO: 8339863 - DNA, 20 bp, Homo sapiens
tgcaaggccagggtcaggag

SEQ ID NO: 8339864 - DNA, 22 bp, Homo sapiens
tgcaaatgggcatctccaagtg

SEQ ID NO: 8339865 - DNA, 19 bp, Homo sapiens
tgcaaatgtaggaagaata

SEQ ID NO: 8339866 - DNA, 22 bp, Homo sapiens
tgcaaatgagttgcagatcagg

SEQ ID NO: 8339867 - DNA, 22 bp, Homo sapiens
tgcaaatatttccttatagcca

SEQ ID NO: 8339868 - DNA, 19 bp, Homo sapiens
tgcaaatgctgttgagaat

SEQ ID NO: 8339869 - DNA, 22 bp, Homo sapiens
tgcaaagaagcaacatccttgt

SEQ ID NO: 8339870 - DNA, 22 bp, Homo sapiens
tgcaaagatgaaatattaaagg

SEQ ID NO: 8339871 - DNA, 22 bp, Homo sapiens
tgcaaacaggagagtaagtata

SEQ ID NO: 8339872 - DNA, 22 bp, Homo sapiens
tgcaaaatgacttctgaaaaga

SEQ ID NO: 8339873 - DNA, 22 bp, Homo sapiens
tgatttcctagctgacatgaaa

SEQ ID NO: 8339874 - DNA, 22 bp, Homo sapiens
tgatttcctaggtctggagaag

SEQ ID NO: 8339875 - DNA, 22 bp, Homo sapiens
tgatttccctgtagcctctgaa

SEQ ID NO: 8339876 - DNA, 15 bp, Homo sapiens
tgatttcctactaac

SEQ ID NO: 8339877 - DNA, 22 bp, Homo sapiens
tgatttccccagtcttgctgct

SEQ ID NO: 8339878 - DNA, 22 bp, Homo sapiens
tgatttccctcatcataacaga

SEQ ID NO: 8339879 - DNA, 22 bp, Homo sapiens
tgatttccctcatcataacaga

SEQ ID NO: 8339880 - DNA, 22 bp, Homo sapiens
tgatttccctcatcataacaga

SEQ ID NO: 8339881 - DNA, 21 bp, Homo sapiens
tgatttccagaaaattggccc

SEQ ID NO: 8339882 - DNA, 23 bp, Homo sapiens
tgatttccagtgagtcagtggga

SEQ ID NO: 8339883 - DNA, 22 bp, Homo sapiens
tgatttccacgtgcacccaggt

SEQ ID NO: 8339884 - DNA, 21 bp, Homo sapiens
tgatttccagaaaattggccc

SEQ ID NO: 8339885 - DNA, 22 bp, Homo sapiens
tgatttccagttgctgggtgct

SEQ ID NO: 8339886 - DNA, 21 bp, Homo sapiens
tgatttccatcttaaaataaa

SEQ ID NO: 8339887 - DNA, 21 bp, Homo sapiens
tgatttccatcttaaaataaa

SEQ ID NO: 8339888 - DNA, 22 bp, Homo sapiens
tgatttccatgaagctgaaggc

SEQ ID NO: 8339889 - DNA, 22 bp, Homo sapiens
tgatttcatagtatatacatga

SEQ ID NO: 8339890 - DNA, 22 bp, Homo sapiens
tgatttccaaaaggcttctaag

SEQ ID NO: 8339891 - DNA, 22 bp, Homo sapiens
tgatttccaaaaggcttctaag

SEQ ID NO: 8339892 - DNA, 22 bp, Homo sapiens
tgatttccaataaggagaatgt

SEQ ID NO: 8339893 - DNA, 22 bp, Homo sapiens
tgatttccacagtcaggggtgc

SEQ ID NO: 8339894 - DNA, 22 bp, Homo sapiens
tgatttcaagtagtgacatgct

SEQ ID NO: 8339895 - DNA, 22 bp, Homo sapiens
tgatttcaagtagtgacatgct

SEQ ID NO: 8339896 - DNA, 22 bp, Homo sapiens
tgatttttaaaattctccttgc

SEQ ID NO: 8339897 - DNA, 22 bp, Homo sapiens
tgatttcctaggtctggagaag

SEQ ID NO: 8339898 - DNA, 22 bp, Homo sapiens
tgatttcctggctttggagttc

SEQ ID NO: 8339899 - DNA, 22 bp, Homo sapiens
tgatttcctctactagcaatta

SEQ ID NO: 8339900 - DNA, 22 bp, Homo sapiens
tgatttcctctactagcaatta

SEQ ID NO: 8339901 - DNA, 22 bp, Homo sapiens
tgattttgtcatgtttctgata

SEQ ID NO: 8339902 - DNA, 22 bp, Homo sapiens
tgaggaagggcacacggaccct

SEQ ID NO: 8339903 - DNA, 22 bp, Homo sapiens
tgaggaagggtgtgacggcacc

SEQ ID NO: 8339904 - DNA, 22 bp, Homo sapiens
tgaggaagtggttgtatggttt

SEQ ID NO: 8339905 - DNA, 22 bp, Homo sapiens
tgaggaagttgatctcatcagt

SEQ ID NO: 8339906 - DNA, 22 bp, Homo sapiens
tgaggaaggaattgaggtttta

SEQ ID NO: 8339907 - DNA, 22 bp, Homo sapiens
tgaggaagaacaagaatttaga

SEQ ID NO: 8339908 - DNA, 22 bp, Homo sapiens
tgaggaagcaaaggcttgtgtg

SEQ ID NO: 8339909 - DNA, 22 bp, Homo sapiens
tgaggaacaactcctgtgacta

SEQ ID NO: 8339910 - DNA, 22 bp, Homo sapiens
tgaggaactgccagactgtttt

SEQ ID NO: 8339911 - DNA, 22 bp, Homo sapiens
tgaggaggtcagagtctggctg

SEQ ID NO: 8339912 - DNA, 22 bp, Homo sapiens
tgaggaggtgggcacacagagt

SEQ ID NO: 8339913 - DNA, 22 bp, Homo sapiens
tgaggaggcccaggttggggct

SEQ ID NO: 8339914 - DNA, 22 bp, Homo sapiens
tgaggaggtcagagtctggctg

SEQ ID NO: 8339915 - DNA, 22 bp, Homo sapiens
tgaggaggcccaggttggggct

SEQ ID NO: 8339916 - DNA, 22 bp, Homo sapiens
tgaggaggtgggcacacagagt

SEQ ID NO: 8339917 - DNA, 22 bp, Homo sapiens
tgaggatggaatgctgtgcaag

SEQ ID NO: 8339918 - DNA, 22 bp, Homo sapiens
tgaggatggcagtgtgctcagc

SEQ ID NO: 8339919 - DNA, 22 bp, Homo sapiens
tgaggcaggagaatcaccggaa

SEQ ID NO: 8339920 - DNA, 21 bp, Homo sapiens
tgaggccaatagcccctggac

SEQ ID NO: 8339921 - DNA, 22 bp, Homo sapiens
tgaggcctcatttagggagagg

SEQ ID NO: 8339922 - DNA, 22 bp, Homo sapiens
tgaggcctcataatgagatttc

SEQ ID NO: 8339923 - DNA, 22 bp, Homo sapiens
tgaggccctctgggctggtcct

SEQ ID NO: 8339924 - DNA, 22 bp, Homo sapiens
tgaggccctctgggctggtcct

SEQ ID NO: 8339925 - DNA, 22 bp, Homo sapiens
tgaggccaagcctcctctgcca

SEQ ID NO: 8339926 - DNA, 22 bp, Homo sapiens
tgaggcagttgagcttcctgag

SEQ ID NO: 8339927 - DNA, 22 bp, Homo sapiens
tgaggcaggagaatggcgggaa

SEQ ID NO: 8339928 - DNA, 22 bp, Homo sapiens
tgagggtgtgcggcccagacag

SEQ ID NO: 8339929 - DNA, 22 bp, Homo sapiens
tgagggtgggcctgcaggaaga

SEQ ID NO: 8339930 - DNA, 22 bp, Homo sapiens
tgagggtggcacaggcacaaag

SEQ ID NO: 8339931 - DNA, 19 bp, Homo sapiens
tgaggggctcacagtctca

SEQ ID NO: 8339932 - DNA, 22 bp, Homo sapiens
tgaggggcggcctgcagaggcc

SEQ ID NO: 8339933 - DNA, 22 bp, Homo sapiens
tgaggggcgctggcaggttcct

SEQ ID NO: 8339934 - DNA, 22 bp, Homo sapiens
tgaggggccgcccaagcacttc

SEQ ID NO: 8339935 - DNA, 22 bp, Homo sapiens
tgaggggcatgtgtttacacat

SEQ ID NO: 8339936 - DNA, 22 bp, Homo sapiens
tgaggggcagagaggtgtccag

SEQ ID NO: 8339937 - DNA, 22 bp, Homo sapiens
tgaggggccagaccccacctag

SEQ ID NO: 8339938 - DNA, 22 bp, Homo sapiens
tgaggggccagaccccacctag

SEQ ID NO: 8339939 - DNA, 19 bp, Homo sapiens
tgaggggctcacagtctca

SEQ ID NO: 8339940 - DNA, 22 bp, Homo sapiens
tgaggggggtaatcactgggtt

SEQ ID NO: 8339941 - DNA, 22 bp, Homo sapiens
tgagggtctggaatctgggctt

SEQ ID NO: 8339942 - DNA, 22 bp, Homo sapiens
tgaggtgggtgtcaggtcagag

SEQ ID NO: 8339943 - DNA, 22 bp, Homo sapiens
tgaggtggttactgtggtgctc

SEQ ID NO: 8339944 - DNA, 22 bp, Homo sapiens
tgagtaaaagtgaatcttatgt

SEQ ID NO: 8339945 - DNA, 22 bp, Homo sapiens
tgagtaaaaattctacatttcc

SEQ ID NO: 8339946 - DNA, 22 bp, Homo sapiens
tgaggctgccttgggaagaggg

SEQ ID NO: 8339947 - DNA, 22 bp, Homo sapiens
tgaggctgccttgggaagaggg

SEQ ID NO: 8339948 - DNA, 21 bp, Homo sapiens
tgaggctgttgtaccagggag

SEQ ID NO: 8339949 - DNA, 22 bp, Homo sapiens
tgaggctgttctaccagggcca

SEQ ID NO: 8339950 - DNA, 22 bp, Homo sapiens
tgaggctggcaaggctggtatt

SEQ ID NO: 8339951 - DNA, 22 bp, Homo sapiens
tgaggctgttctaccagggcca

SEQ ID NO: 8339952 - DNA, 22 bp, Homo sapiens
tgagggacttgctagttctctg

SEQ ID NO: 8339953 - DNA, 22 bp, Homo sapiens
tgagggacaccagggctggagc

SEQ ID NO: 8339954 - DNA, 21 bp, Homo sapiens
tgagaatttactctggagagt

SEQ ID NO: 8339955 - DNA, 22 bp, Homo sapiens
tgagaaaagtgtggaggtcaat

SEQ ID NO: 8339956 - DNA, 22 bp, Homo sapiens
tgagaaaattactataattgtc

SEQ ID NO: 8339957 - DNA, 22 bp, Homo sapiens
tgagaaaatccagaggctagtt

SEQ ID NO: 8339958 - DNA, 22 bp, Homo sapiens
tgagaaagacagacattcctaa

SEQ ID NO: 8339959 - DNA, 22 bp, Homo sapiens
tgagaaattcgacatatattta

SEQ ID NO: 8339960 - DNA, 22 bp, Homo sapiens
tgagaaatattgcacagtgagg

SEQ ID NO: 8339961 - DNA, 20 bp, Homo sapiens
tgagaaagtagagactcagg

SEQ ID NO: 8339962 - DNA, 22 bp, Homo sapiens
tgagaagcagcttacaggtgtc

SEQ ID NO: 8339963 - DNA, 22 bp, Homo sapiens
tgagaacaaagttgaaagtttg

SEQ ID NO: 8339964 - DNA, 22 bp, Homo sapiens
tgagaacatacaaacagagaaa

SEQ ID NO: 8339965 - DNA, 22 bp, Homo sapiens
tgagaacttgtgctattgcaca

SEQ ID NO: 8339966 - DNA, 22 bp, Homo sapiens
tgagatttcgccgacagtattt

SEQ ID NO: 8339967 - DNA, 23 bp, Homo sapiens
tgagatctacagatctcagatct

SEQ ID NO: 8339968 - DNA, 22 bp, Homo sapiens
tgagatctctgcctatatggat

SEQ ID NO: 8339969 - DNA, 22 bp, Homo sapiens
tgagatctctgcctatatggat

SEQ ID NO: 8339970 - DNA, 23 bp, Homo sapiens
tgagatctttgtagtatcaatga

SEQ ID NO: 8339971 - DNA, 22 bp, Homo sapiens
tgagatgaagtgatgtaaaaca

SEQ ID NO: 8339972 - DNA, 22 bp, Homo sapiens
tgagatgaagtgatgtaaaaca

SEQ ID NO: 8339973 - DNA, 22 bp, Homo sapiens
tgagatctgtgcatgttagtta

SEQ ID NO: 8339974 - DNA, 22 bp, Homo sapiens
tgagatctgctaattgactgac

SEQ ID NO: 8339975 - DNA, 22 bp, Homo sapiens
tgagatcttcgctcttcacaga

SEQ ID NO: 8339976 - DNA, 22 bp, Homo sapiens
tgagatgaataactcctgctaa

SEQ ID NO: 8339977 - DNA, 22 bp, Homo sapiens
tgagatgagggctgcactcaaa

SEQ ID NO: 8339978 - DNA, 20 bp, Homo sapiens
tgagaggacatttttcatgt

SEQ ID NO: 8339979 - DNA, 22 bp, Homo sapiens
tgagaggatattttgggaggat

SEQ ID NO: 8339980 - DNA, 22 bp, Homo sapiens
tgagagcttgagtatcactggc

SEQ ID NO: 8339981 - DNA, 22 bp, Homo sapiens
tgagagcacagtgtggtctgga

SEQ ID NO: 8339982 - DNA, 22 bp, Homo sapiens
tgagcacagctttcactagaaa

SEQ ID NO: 8339983 - DNA, 22 bp, Homo sapiens
tgagcacatttcacatgacagg

SEQ ID NO: 8339984 - DNA, 22 bp, Homo sapiens
tgagcaggactgaccggcctta

SEQ ID NO: 8339985 - DNA, 22 bp, Homo sapiens
tgagcagctactgtgttcaggg

SEQ ID NO: 8339986 - DNA, 22 bp, Homo sapiens
tgagcaggctcccacttcagtg

SEQ ID NO: 8339987 - DNA, 22 bp, Homo sapiens
tgagcaggattcgcctcttgca

SEQ ID NO: 8339988 - DNA, 22 bp, Homo sapiens
tgagcaggattcgcctcttgca

SEQ ID NO: 8339989 - DNA, 21 bp, Homo sapiens
tgagcaggagtcatgggaatg

SEQ ID NO: 8339990 - DNA, 22 bp, Homo sapiens
tgagcaggattcgcctcttgca

SEQ ID NO: 8339991 - DNA, 22 bp, Homo sapiens
tgagcagtgatgcgttttgttt

SEQ ID NO: 8339992 - DNA, 22 bp, Homo sapiens
tgagcagggactttggagtctg

SEQ ID NO: 8339993 - DNA, 22 bp, Homo sapiens
tgagccaggctccatgccacct

SEQ ID NO: 8339994 - DNA, 19 bp, Homo sapiens
tgagccagggaggccatgc

SEQ ID NO: 8339995 - DNA, 22 bp, Homo sapiens
tgagcttgcagtgccagccttg

SEQ ID NO: 8339996 - DNA, 22 bp, Homo sapiens
tgagctggttcttgaggcatga

SEQ ID NO: 8339997 - DNA, 22 bp, Homo sapiens
tgagctctgttagggctggaac

SEQ ID NO: 8339998 - DNA, 22 bp, Homo sapiens
tgagctgacacccaatcatact

SEQ ID NO: 8339999 - DNA, 22 bp, Homo sapiens
tgagccaggttaagacaggagc

SEQ ID NO: 8340000 - DNA, 22 bp, Homo sapiens
tgagccagtctctcagaaccct

SEQ ID NO: 8340001 - DNA, 22 bp, Homo sapiens
tgagccctgacctagcctggcc

SEQ ID NO: 8340002 - DNA, 22 bp, Homo sapiens
tgagcctgcaataagcacagcc

SEQ ID NO: 8340003 - DNA, 22 bp, Homo sapiens
tgactgcccccaccgcacaggc

SEQ ID NO: 8340004 - DNA, 22 bp, Homo sapiens
tgactggagacctcagtagggt

SEQ ID NO: 8340005 - DNA, 21 bp, Homo sapiens
tgactgaggcttcttcacaca

SEQ ID NO: 8340006 - DNA, 22 bp, Homo sapiens
tgactgccatgagggtgagggc

SEQ ID NO: 8340007 - DNA, 22 bp, Homo sapiens
tgactagaattgtatttagtgt

SEQ ID NO: 8340008 - DNA, 22 bp, Homo sapiens
tgactagacctatatctttttg

SEQ ID NO: 8340009 - DNA, 22 bp, Homo sapiens
tgacctctgtcctgcagtctgg

SEQ ID NO: 8340010 - DNA, 22 bp, Homo sapiens
tgacctcttgtcggagctccag

SEQ ID NO: 8340011 - DNA, 22 bp, Homo sapiens
tgacatttatcttctacaatga

SEQ ID NO: 8340012 - DNA, 22 bp, Homo sapiens
tgacatttatcttctacaatga

SEQ ID NO: 8340013 - DNA, 22 bp, Homo sapiens
tgacattccgcagtaaggttaa

SEQ ID NO: 8340014 - DNA, 22 bp, Homo sapiens
tgacatttcggtgtatgtgatg

SEQ ID NO: 8340015 - DNA, 22 bp, Homo sapiens
tgaccctggcctggtggcggaa

SEQ ID NO: 8340016 - DNA, 22 bp, Homo sapiens
tgaccctggcctggtggcggaa

SEQ ID NO: 8340017 - DNA, 22 bp, Homo sapiens
tgaccctgcttcttggtgcagg

SEQ ID NO: 8340018 - DNA, 22 bp, Homo sapiens
tgaccctggcagcccactggcc

SEQ ID NO: 8340019 - DNA, 19 bp, Homo sapiens
tgacaggctgttgccttga

SEQ ID NO: 8340020 - DNA, 22 bp, Homo sapiens
tgacagcattactaatacatgt

SEQ ID NO: 8340021 - DNA, 23 bp, Homo sapiens
tgacagcaggaactgattatgta

SEQ ID NO: 8340022 - DNA, 22 bp, Homo sapiens
tgacagcataacactggtcttg

SEQ ID NO: 8340023 - DNA, 22 bp, Homo sapiens
tgacagtaccaccaaatctgat

SEQ ID NO: 8340024 - DNA, 22 bp, Homo sapiens
tgacagattttgatggctaata

SEQ ID NO: 8340025 - DNA, 22 bp, Homo sapiens
tgacagcaataattttatcttc

SEQ ID NO: 8340026 - DNA, 23 bp, Homo sapiens
tgacagaccttcccagacagtca

SEQ ID NO: 8340027 - DNA, 18 bp, Homo sapiens
tgacagaacctggagcct

SEQ ID NO: 8340028 - DNA, 22 bp, Homo sapiens
tgacagaaagaatatgtcaatc

SEQ ID NO: 8340029 - DNA, 22 bp, Homo sapiens
tgacaccacaactagccattga

SEQ ID NO: 8340030 - DNA, 22 bp, Homo sapiens
tgacaccttgctcttggacttc

SEQ ID NO: 8340031 - DNA, 22 bp, Homo sapiens
tgacaccttgatcttggactta

SEQ ID NO: 8340032 - DNA, 22 bp, Homo sapiens
tgacaccttgatcttggacttc

SEQ ID NO: 8340033 - DNA, 22 bp, Homo sapiens
tgacaccttgatcttggacttt

SEQ ID NO: 8340034 - DNA, 22 bp, Homo sapiens
tgacacccattatctgtgtgac

SEQ ID NO: 8340035 - DNA, 22 bp, Homo sapiens
tgacacctcgatcttggacttc

SEQ ID NO: 8340036 - DNA, 22 bp, Homo sapiens
tgacaccttcatcttggacttc

SEQ ID NO: 8340037 - DNA, 22 bp, Homo sapiens
tgacaccctctcctggagagag

SEQ ID NO: 8340038 - DNA, 22 bp, Homo sapiens
tgacacagtatcaaacatgatt

SEQ ID NO: 8340039 - DNA, 22 bp, Homo sapiens
tgacacaggcagctcccagcac

SEQ ID NO: 8340040 - DNA, 22 bp, Homo sapiens
tgacacagattagagacatacc

SEQ ID NO: 8340041 - DNA, 22 bp, Homo sapiens
tgacacagaaattaagctgtca

SEQ ID NO: 8340042 - DNA, 22 bp, Homo sapiens
tgacacactaggaaaagcattt

SEQ ID NO: 8340043 - DNA, 22 bp, Homo sapiens
tgaataagtgatgtcatatata

SEQ ID NO: 8340044 - DNA, 22 bp, Homo sapiens
tgaataagaattattataatga

SEQ ID NO: 8340045 - DNA, 20 bp, Homo sapiens
tgaaggtgactcctttcttg

SEQ ID NO: 8340046 - DNA, 22 bp, Homo sapiens
tgaaggcattgatgaaggaatc

SEQ ID NO: 8340047 - DNA, 22 bp, Homo sapiens
tgaaggctgttggatggggaag

SEQ ID NO: 8340048 - DNA, 22 bp, Homo sapiens
tgaagccatcaggaagccagca

SEQ ID NO: 8340049 - DNA, 22 bp, Homo sapiens
tgaagcagttctcagaagtggg

SEQ ID NO: 8340050 - DNA, 22 bp, Homo sapiens
tgaatctggatctatgatcaat

SEQ ID NO: 8340051 - DNA, 22 bp, Homo sapiens
tgaatgaatgaattaatagagt

SEQ ID NO: 8340052 - DNA, 22 bp, Homo sapiens
tgaatggtcactgagcatctgt

SEQ ID NO: 8340053 - DNA, 22 bp, Homo sapiens
tgaatgtaggcacatgcaaatg

SEQ ID NO: 8340054 - DNA, 22 bp, Homo sapiens
tgaatgtgatgctaaacatatg

SEQ ID NO: 8340055 - DNA, 22 bp, Homo sapiens
tgaatgttctctaaatactcct

SEQ ID NO: 8340056 - DNA, 22 bp, Homo sapiens
tgaatagatggtgacagtatga

SEQ ID NO: 8340057 - DNA, 22 bp, Homo sapiens
tgaatcctagttgaagataagg

SEQ ID NO: 8340058 - DNA, 22 bp, Homo sapiens
tgaatcagtataaattctcaaa

SEQ ID NO: 8340059 - DNA, 23 bp, Homo sapiens
tgacaaagtcatctctccttctt

SEQ ID NO: 8340060 - DNA, 22 bp, Homo sapiens
tgacaaagtgaggtcttcagta

SEQ ID NO: 8340061 - DNA, 22 bp, Homo sapiens
tgaatttaccttgcctatattt

SEQ ID NO: 8340062 - DNA, 22 bp, Homo sapiens
tgaatttaaaataaatgtagtt

SEQ ID NO: 8340063 - DNA, 22 bp, Homo sapiens
tgaatttaagcactgatgttaa

SEQ ID NO: 8340064 - DNA, 22 bp, Homo sapiens
tgaattgaattgaattgaattg

SEQ ID NO: 8340065 - DNA, 22 bp, Homo sapiens
tgaattgcctcttatatgacca

SEQ ID NO: 8340066 - DNA, 17 bp, Homo sapiens
tgaattcaatctgcact

SEQ ID NO: 8340067 - DNA, 22 bp, Homo sapiens
tgaattcaggtagcacctcccc

SEQ ID NO: 8340068 - DNA, 22 bp, Homo sapiens
tgaattctggctcttctgttta

SEQ ID NO: 8340069 - DNA, 22 bp, Homo sapiens
tgaaatcaatgtcttctgtctc

SEQ ID NO: 8340070 - DNA, 22 bp, Homo sapiens
tgaaatatttagagagtaagtt

SEQ ID NO: 8340071 - DNA, 22 bp, Homo sapiens
tgaaatatgctcccattcactt

SEQ ID NO: 8340072 - DNA, 22 bp, Homo sapiens
tgaaatagacttgcactatatg

SEQ ID NO: 8340073 - DNA, 22 bp, Homo sapiens
tgaaatatcattttcatctccc

SEQ ID NO: 8340074 - DNA, 22 bp, Homo sapiens
tgaaagattgtgattcaatatg

SEQ ID NO: 8340075 - DNA, 22 bp, Homo sapiens
tgaaaggtgtccaatatttctc

SEQ ID NO: 8340076 - DNA, 22 bp, Homo sapiens
tgaaaggtgtccaatatttctc

SEQ ID NO: 8340077 - DNA, 20 bp, Homo sapiens
tgaaaggtgggaattgtggg

SEQ ID NO: 8340078 - DNA, 22 bp, Homo sapiens
tgaaaggttaaaagtagtattg

SEQ ID NO: 8340079 - DNA, 22 bp, Homo sapiens
tgaaaggtagctggcctcatag

SEQ ID NO: 8340080 - DNA, 22 bp, Homo sapiens
tgaaaggtgacatttcttggat

SEQ ID NO: 8340081 - DNA, 22 bp, Homo sapiens
tgaaaggttatttaggtctgct

SEQ ID NO: 8340082 - DNA, 22 bp, Homo sapiens
tgaaagtaaccaagggaaggtc

SEQ ID NO: 8340083 - DNA, 22 bp, Homo sapiens
tgaaagtagcgcatttcactca

SEQ ID NO: 8340084 - DNA, 22 bp, Homo sapiens
tgaaagtatttgatttctatta

SEQ ID NO: 8340085 - DNA, 22 bp, Homo sapiens
tgaaatgtacaagtgctttttt

SEQ ID NO: 8340086 - DNA, 22 bp, Homo sapiens
tgaaatggtattctttttcaat

SEQ ID NO: 8340087 - DNA, 22 bp, Homo sapiens
tgaaatggcccaaacacccagt

SEQ ID NO: 8340088 - DNA, 22 bp, Homo sapiens
tgaaatggtattctttttcaat

SEQ ID NO: 8340089 - DNA, 22 bp, Homo sapiens
tgaaatggaattaatttgtatt

SEQ ID NO: 8340090 - DNA, 22 bp, Homo sapiens
tgaaatgtaaataggactagaa

SEQ ID NO: 8340091 - DNA, 22 bp, Homo sapiens
tgaaatggaattaatttgtatt

SEQ ID NO: 8340092 - DNA, 22 bp, Homo sapiens
tgaaatcttcactaagtctctt

SEQ ID NO: 8340093 - DNA, 22 bp, Homo sapiens
tgaaatcttatactttggtagt

SEQ ID NO: 8340094 - DNA, 22 bp, Homo sapiens
tgaaatctttagtttctgtccc

SEQ ID NO: 8340095 - DNA, 22 bp, Homo sapiens
tgaaatgcctatgaagtcagga

SEQ ID NO: 8340096 - DNA, 22 bp, Homo sapiens
tgaaatctgcatgcaaagtcct

SEQ ID NO: 8340097 - DNA, 22 bp, Homo sapiens
tgaaatctgtcccactttagct

SEQ ID NO: 8340098 - DNA, 22 bp, Homo sapiens
tgaaatcttagccattctgcct

SEQ ID NO: 8340099 - DNA, 21 bp, Homo sapiens
tgaaatctgatgggacaaatg

SEQ ID NO: 8340100 - DNA, 22 bp, Homo sapiens
tgaaatctaccctattcagggt

SEQ ID NO: 8340101 - DNA, 22 bp, Homo sapiens
tgaaatctcctctttatatatc

SEQ ID NO: 8340102 - DNA, 23 bp, Homo sapiens
tgaaatgtagaggaattccacct

SEQ ID NO: 8340103 - DNA, 22 bp, Homo sapiens
tgaaatgtagattaggcattct

SEQ ID NO: 8340104 - DNA, 22 bp, Homo sapiens
tgaaatgtagtgaagcatggaa

SEQ ID NO: 8340105 - DNA, 22 bp, Homo sapiens
tgaaatgtatattgccagtgta

SEQ ID NO: 8340106 - DNA, 22 bp, Homo sapiens
tgaaatgtcagtgttttataag

SEQ ID NO: 8340107 - DNA, 22 bp, Homo sapiens
tgaaatgtcagtgttttataag

SEQ ID NO: 8340108 - DNA, 22 bp, Homo sapiens
tgaaatgtagattaggcattct

SEQ ID NO: 8340109 - DNA, 22 bp, Homo sapiens
tgaaatgtctcacttagacttt

SEQ ID NO: 8340110 - DNA, 22 bp, Homo sapiens
tgaaatgtctcacttagacttt

SEQ ID NO: 8340111 - DNA, 22 bp, Homo sapiens
tgaaatgtcatcctttagccat

SEQ ID NO: 8340112 - DNA, 22 bp, Homo sapiens
tgaaatgtgtccatgttatttc

SEQ ID NO: 8340113 - DNA, 22 bp, Homo sapiens
tgaaatgtgatctgagcttggc

SEQ ID NO: 8340114 - DNA, 22 bp, Homo sapiens
tgaaatgtctgaaagccaatct

SEQ ID NO: 8340115 - DNA, 22 bp, Homo sapiens
tgaaatgtctttgcaattgaaa

SEQ ID NO: 8340116 - DNA, 22 bp, Homo sapiens
tgaaatgtgttatctgggcctg

SEQ ID NO: 8340117 - DNA, 22 bp, Homo sapiens
tgaaatgtgttctagtgttttg

SEQ ID NO: 8340118 - DNA, 22 bp, Homo sapiens
tgaaatgtgttctagtgttttg

SEQ ID NO: 8340119 - DNA, 22 bp, Homo sapiens
tgaaatgttaatcacacaaagg

SEQ ID NO: 8340120 - DNA, 22 bp, Homo sapiens
tgaaatgttctggagtttctgt

SEQ ID NO: 8340121 - DNA, 22 bp, Homo sapiens
tgaaatgttctggagtttctgt

SEQ ID NO: 8340122 - DNA, 22 bp, Homo sapiens
tgaaatgttggtaattttatat

SEQ ID NO: 8340123 - DNA, 22 bp, Homo sapiens
tgaaatgttggtaattttatat

SEQ ID NO: 8340124 - DNA, 22 bp, Homo sapiens
tgaaatgttggtaattttatat

SEQ ID NO: 8340125 - DNA, 22 bp, Homo sapiens
tgaaatgtttgaagaccactga

SEQ ID NO: 8340126 - DNA, 22 bp, Homo sapiens
tgaaatgtttgaagaccactga

SEQ ID NO: 8340127 - DNA, 22 bp, Homo sapiens
tgaaatgtttaggaccactaga

SEQ ID NO: 8340128 - DNA, 22 bp, Homo sapiens
tgaagacaaagtcaggcccaga

SEQ ID NO: 8340129 - DNA, 22 bp, Homo sapiens
tgaagcaggtgaatggatgtcg

SEQ ID NO: 8340130 - DNA, 22 bp, Homo sapiens
tgaagcaggtgaatggatgtcg

SEQ ID NO: 8340131 - DNA, 22 bp, Homo sapiens
tgaagcagggtggccagattgt

SEQ ID NO: 8340132 - DNA, 22 bp, Homo sapiens
tgaagcagttactgggtgttaa

SEQ ID NO: 8340133 - DNA, 22 bp, Homo sapiens
tgaagcagttctcagaagtggg

SEQ ID NO: 8340134 - DNA, 19 bp, Homo sapiens
tgaagcaggcagagaagat

SEQ ID NO: 8340135 - DNA, 22 bp, Homo sapiens
tgaagcaggatcgtttgcttca

SEQ ID NO: 8340136 - DNA, 22 bp, Homo sapiens
tgaagcaggcattgactgatga

SEQ ID NO: 8340137 - DNA, 22 bp, Homo sapiens
tgaagcaggaaccagcagcatt

SEQ ID NO: 8340138 - DNA, 22 bp, Homo sapiens
tgaagcaggaaacttcttgttt

SEQ ID NO: 8340139 - DNA, 22 bp, Homo sapiens
tgaagcagcttctttctgtcaa

SEQ ID NO: 8340140 - DNA, 22 bp, Homo sapiens
tgaagcagatggtctggtcatt

SEQ ID NO: 8340141 - DNA, 22 bp, Homo sapiens
tgaagcagatggtctggtcatt

SEQ ID NO: 8340142 - DNA, 22 bp, Homo sapiens
tgaagcagatggtctggtcatt

SEQ ID NO: 8340143 - DNA, 19 bp, Homo sapiens
tgaagcagcaaactctcag

SEQ ID NO: 8340144 - DNA, 20 bp, Homo sapiens
tgaagcagccttgattctgt

SEQ ID NO: 8340145 - DNA, 22 bp, Homo sapiens
tgaagcagcaaatgatgggaga

SEQ ID NO: 8340146 - DNA, 22 bp, Homo sapiens
tgaagcagcaaatgatgggaga

SEQ ID NO: 8340147 - DNA, 22 bp, Homo sapiens
tgaagcagcaccattttagagc

SEQ ID NO: 8340148 - DNA, 22 bp, Homo sapiens
tgaagcagaggggtcttgagct

SEQ ID NO: 8340149 - DNA, 22 bp, Homo sapiens
tgaagcagaggggtcttgagct

SEQ ID NO: 8340150 - DNA, 22 bp, Homo sapiens
tgaagcagagaatttgacagtc

SEQ ID NO: 8340151 - DNA, 22 bp, Homo sapiens
tgaagcacatttcttgagatga

SEQ ID NO: 8340152 - DNA, 22 bp, Homo sapiens
tgaagcagagtgaaggtgaatt

SEQ ID NO: 8340153 - DNA, 22 bp, Homo sapiens
tgaagcagagtgaaggtgaatt

SEQ ID NO: 8340154 - DNA, 22 bp, Homo sapiens
tgaagcaaacgcttctgttcct

SEQ ID NO: 8340155 - DNA, 22 bp, Homo sapiens
tgaagcaactggacaagttggc

SEQ ID NO: 8340156 - DNA, 19 bp, Homo sapiens
tgaagcaataccatttttg

SEQ ID NO: 8340157 - DNA, 22 bp, Homo sapiens
tgaaatttaggtgcagataaat

SEQ ID NO: 8340158 - DNA, 22 bp, Homo sapiens
tgaaatgtttgggtccagaagt

SEQ ID NO: 8340159 - DNA, 22 bp, Homo sapiens
tgaacagtgtatctagatcatg

SEQ ID NO: 8340160 - DNA, 22 bp, Homo sapiens
tgaacagtggttcatgtcacgg

SEQ ID NO: 8340161 - DNA, 22 bp, Homo sapiens
tgaacagtcatttagaatgtgc

SEQ ID NO: 8340162 - DNA, 22 bp, Homo sapiens
tgaacatacaattattaagaac

SEQ ID NO: 8340163 - DNA, 22 bp, Homo sapiens
tgaacatgctgttgatggcctg

SEQ ID NO: 8340164 - DNA, 22 bp, Homo sapiens
tgaaaaggagccttaggtaggt

SEQ ID NO: 8340165 - DNA, 22 bp, Homo sapiens
tgaaaaggagtccttgttttca

SEQ ID NO: 8340166 - DNA, 22 bp, Homo sapiens
tgaaaagtcttatattgtctga

SEQ ID NO: 8340167 - DNA, 20 bp, Homo sapiens
tgaaaaggtcaggagacatg

SEQ ID NO: 8340168 - DNA, 20 bp, Homo sapiens
tgaaaaggtcaggagacatg

SEQ ID NO: 8340169 - DNA, 22 bp, Homo sapiens
tgaaaagggtagatccctaagt

SEQ ID NO: 8340170 - DNA, 22 bp, Homo sapiens
tgaaaatatagttttccagact

SEQ ID NO: 8340171 - DNA, 22 bp, Homo sapiens
tgaaaatatagttttccagact

SEQ ID NO: 8340172 - DNA, 22 bp, Homo sapiens
tgaaaatgccctctatgtctca

SEQ ID NO: 8340173 - DNA, 22 bp, Homo sapiens
tgaaaatatagttttccagact

SEQ ID NO: 8340174 - DNA, 22 bp, Homo sapiens
tgaaaattaagcagatgaatga

SEQ ID NO: 8340175 - DNA, 22 bp, Homo sapiens
tgaaaattgttgtacttgataa

SEQ ID NO: 8340176 - DNA, 22 bp, Homo sapiens
tgaaaacactttagtttaggtc

SEQ ID NO: 8340177 - DNA, 22 bp, Homo sapiens
tgaaagaagtgtcacattgcca

SEQ ID NO: 8340178 - DNA, 17 bp, Homo sapiens
tgaaagaatcagggaga

SEQ ID NO: 8340179 - DNA, 22 bp, Homo sapiens
tgaaagaactagcatcttcaag

SEQ ID NO: 8340180 - DNA, 21 bp, Homo sapiens
tgaaagaaggtgcagtctgaa

SEQ ID NO: 8340181 - DNA, 22 bp, Homo sapiens
tgaaactaggccaatcaaatta

SEQ ID NO: 8340182 - DNA, 22 bp, Homo sapiens
tgaaagaactagcatcttcaag

SEQ ID NO: 8340183 - DNA, 22 bp, Homo sapiens
tgaaagaactagcatcttcaag

SEQ ID NO: 8340184 - DNA, 22 bp, Homo sapiens
tgaaacaaaccagtaattttgt

SEQ ID NO: 8340185 - DNA, 22 bp, Homo sapiens
tgaaacagtattctcaaccttt

SEQ ID NO: 8340186 - DNA, 22 bp, Homo sapiens
tgaaacagtgcttcactcagcc

SEQ ID NO: 8340187 - DNA, 22 bp, Homo sapiens
tgaaacaggcaaaactgcagat

SEQ ID NO: 8340188 - DNA, 21 bp, Homo sapiens
tgaaacatttgatcaaagcac

SEQ ID NO: 8340189 - DNA, 22 bp, Homo sapiens
tgaaacattgcactgtatgaat

SEQ ID NO: 8340190 - DNA, 22 bp, Homo sapiens
tgaaacattaggaaatcattat

SEQ ID NO: 8340191 - DNA, 22 bp, Homo sapiens
tcttttatcctacatttagctc

SEQ ID NO: 8340192 - DNA, 22 bp, Homo sapiens
tcttttatcctacatttagctc

SEQ ID NO: 8340193 - DNA, 22 bp, Homo sapiens
tcttttattaggctgaaatggg

SEQ ID NO: 8340194 - DNA, 22 bp, Homo sapiens
tcttttatctgttgtgtaacaa

SEQ ID NO: 8340195 - DNA, 20 bp, Homo sapiens
tcttttattggcagatcctg

SEQ ID NO: 8340196 - DNA, 23 bp, Homo sapiens
tcttttcaatggttctttatgtg

SEQ ID NO: 8340197 - DNA, 22 bp, Homo sapiens
tcttttcacagacaaatggaga

SEQ ID NO: 8340198 - DNA, 22 bp, Homo sapiens
tcttttcacaaaggagctggag

SEQ ID NO: 8340199 - DNA, 22 bp, Homo sapiens
tcttttcatcatttaataggta

SEQ ID NO: 8340200 - DNA, 22 bp, Homo sapiens
tcttttcattgagaacacactg

SEQ ID NO: 8340201 - DNA, 19 bp, Homo sapiens
tcttttcacgcattttgaa

SEQ ID NO: 8340202 - DNA, 22 bp, Homo sapiens
tcttttcaggaatggctctagt

SEQ ID NO: 8340203 - DNA, 22 bp, Homo sapiens
tcttttccttccctacagatct

SEQ ID NO: 8340204 - DNA, 22 bp, Homo sapiens
tcttttaacctaactagcttgg

SEQ ID NO: 8340205 - DNA, 22 bp, Homo sapiens
tcttttatagtgaattttcttg

SEQ ID NO: 8340206 - DNA, 22 bp, Homo sapiens
tcttttagtaataaatatttgt

SEQ ID NO: 8340207 - DNA, 22 bp, Homo sapiens
tcttttaaaagccctgctgtct

SEQ ID NO: 8340208 - DNA, 22 bp, Homo sapiens
tctttgtttgtactgttagaat

SEQ ID NO: 8340209 - DNA, 20 bp, Homo sapiens
tctttgttaattttatctcc

SEQ ID NO: 8340210 - DNA, 22 bp, Homo sapiens
tctttgttattgctttatctat

SEQ ID NO: 8340211 - DNA, 22 bp, Homo sapiens
tctttggattaaaatatttgta

SEQ ID NO: 8340212 - DNA, 22 bp, Homo sapiens
tctttgtaagacatgtaagtcc

SEQ ID NO: 8340213 - DNA, 22 bp, Homo sapiens
tctttgtaagttatatgtagta

SEQ ID NO: 8340214 - DNA, 22 bp, Homo sapiens
tctttgtatgtatgtttcaaag

SEQ ID NO: 8340215 - DNA, 22 bp, Homo sapiens
tctttgtagttataaacgactt

SEQ ID NO: 8340216 - DNA, 22 bp, Homo sapiens
tctttggatggaaaatgtattc

SEQ ID NO: 8340217 - DNA, 22 bp, Homo sapiens
tctttgatttgacaatatcttg

SEQ ID NO: 8340218 - DNA, 22 bp, Homo sapiens
tctttgctccacactctagaga

SEQ ID NO: 8340219 - DNA, 22 bp, Homo sapiens
tctttgcatcccttccatagtt

SEQ ID NO: 8340220 - DNA, 22 bp, Homo sapiens
tggccagcccttcagccatgcc

SEQ ID NO: 8340221 - DNA, 22 bp, Homo sapiens
tggccagcagagttcactctct

SEQ ID NO: 8340222 - DNA, 22 bp, Homo sapiens
tggccacactgcccccactggg

SEQ ID NO: 8340223 - DNA, 23 bp, Homo sapiens
tggccacagtccatgcatgccca

SEQ ID NO: 8340224 - DNA, 22 bp, Homo sapiens
tggccacagcctctgccagttc

SEQ ID NO: 8340225 - DNA, 22 bp, Homo sapiens
tggcatttagaaaacaacatgt

SEQ ID NO: 8340226 - DNA, 22 bp, Homo sapiens
tggcattgacaactttcagttc

SEQ ID NO: 8340227 - DNA, 22 bp, Homo sapiens
tggcatgtattagttggcagtt

SEQ ID NO: 8340228 - DNA, 22 bp, Homo sapiens
tggccactgctctcaagctcag

SEQ ID NO: 8340229 - DNA, 22 bp, Homo sapiens
tggccactggcttccactgagt

SEQ ID NO: 8340230 - DNA, 22 bp, Homo sapiens
tggccacagtgtccagcagcag

SEQ ID NO: 8340231 - DNA, 22 bp, Homo sapiens
tggccacatatgtgggacagct

SEQ ID NO: 8340232 - DNA, 22 bp, Homo sapiens
tggccacatcctttccttgtca

SEQ ID NO: 8340233 - DNA, 19 bp, Homo sapiens
tggcatctgggccctccag

SEQ ID NO: 8340234 - DNA, 22 bp, Homo sapiens
tggcatggactagtgctgaggt

SEQ ID NO: 8340235 - DNA, 18 bp, Homo sapiens
tggcataaaatcagagtc

SEQ ID NO: 8340236 - DNA, 22 bp, Homo sapiens
tggcagtcggacttctatctca

SEQ ID NO: 8340237 - DNA, 22 bp, Homo sapiens
tggcaggtccactcacagatct

SEQ ID NO: 8340238 - DNA, 18 bp, Homo sapiens
tggcaggtccagctgtgg

SEQ ID NO: 8340239 - DNA, 22 bp, Homo sapiens
tggcctcttaggacatcctcta

SEQ ID NO: 8340240 - DNA, 22 bp, Homo sapiens
tggcctcttaaggatgacacaa

SEQ ID NO: 8340241 - DNA, 22 bp, Homo sapiens
tggcctcttaaggatgacacaa

SEQ ID NO: 8340242 - DNA, 20 bp, Homo sapiens
tggcctctgagatgccacgg

SEQ ID NO: 8340243 - DNA, 22 bp, Homo sapiens
tggcctctgaggcacctttgcc

SEQ ID NO: 8340244 - DNA, 22 bp, Homo sapiens
tggccctgccactcactgctga

SEQ ID NO: 8340245 - DNA, 22 bp, Homo sapiens
tggccctgccactcactgctga

SEQ ID NO: 8340246 - DNA, 22 bp, Homo sapiens
tggccctgccctcttcatcttt

SEQ ID NO: 8340247 - DNA, 22 bp, Homo sapiens
tggccctgccgcactatcctca

SEQ ID NO: 8340248 - DNA, 21 bp, Homo sapiens
tggccctggccacggctgcca

SEQ ID NO: 8340249 - DNA, 22 bp, Homo sapiens
tggccctgggcagaggcaacat

SEQ ID NO: 8340250 - DNA, 22 bp, Homo sapiens
tggccctggctgagttagattt

SEQ ID NO: 8340251 - DNA, 22 bp, Homo sapiens
tggccctggctgagttagattt

SEQ ID NO: 8340252 - DNA, 22 bp, Homo sapiens
tggccctgggcatctttcgtga

SEQ ID NO: 8340253 - DNA, 22 bp, Homo sapiens
tggccctgggcagaggcaacat

SEQ ID NO: 8340254 - DNA, 22 bp, Homo sapiens
tggccctgtccctggagcctgg

SEQ ID NO: 8340255 - DNA, 22 bp, Homo sapiens
tggccctggtggcacagcctgc

SEQ ID NO: 8340256 - DNA, 22 bp, Homo sapiens
tggccctgggtggaatgtccca

SEQ ID NO: 8340257 - DNA, 22 bp, Homo sapiens
tggccctggtggcacagcctgc

SEQ ID NO: 8340258 - DNA, 22 bp, Homo sapiens
tggccctggtggcacagcctgc

SEQ ID NO: 8340259 - DNA, 22 bp, Homo sapiens
tggccctgtcctcatttcatct

SEQ ID NO: 8340260 - DNA, 22 bp, Homo sapiens
tggccctgtctgcacacaggat

SEQ ID NO: 8340261 - DNA, 22 bp, Homo sapiens
tggccctgtcctcatttcatct

SEQ ID NO: 8340262 - DNA, 22 bp, Homo sapiens
tggccctgtgactgagttctag

SEQ ID NO: 8340263 - DNA, 22 bp, Homo sapiens
tggccctgtgactgagttctag

SEQ ID NO: 8340264 - DNA, 22 bp, Homo sapiens
tggccctgtctgcacacaggat

SEQ ID NO: 8340265 - DNA, 22 bp, Homo sapiens
tggccctgtgtcctgctgccag

SEQ ID NO: 8340266 - DNA, 22 bp, Homo sapiens
tggccctgtgtcctgctgccag

SEQ ID NO: 8340267 - DNA, 22 bp, Homo sapiens
tggccctgtgtgcaggctgcac

SEQ ID NO: 8340268 - DNA, 22 bp, Homo sapiens
tggccctgtgtgcaggctgcac

SEQ ID NO: 8340269 - DNA, 22 bp, Homo sapiens
tggccctgttctgtacctcata

SEQ ID NO: 8340270 - DNA, 22 bp, Homo sapiens
tggccctgtggcttcagaacag

SEQ ID NO: 8340271 - DNA, 22 bp, Homo sapiens
tggccctgtggaggtcagtgag

SEQ ID NO: 8340272 - DNA, 22 bp, Homo sapiens
tggccctgtggaggtcagtgag

SEQ ID NO: 8340273 - DNA, 23 bp, Homo sapiens
tggccctgtgcatgctgcttccc

SEQ ID NO: 8340274 - DNA, 23 bp, Homo sapiens
tggccctgtgcatgctgcttccc

SEQ ID NO: 8340275 - DNA, 22 bp, Homo sapiens
tggccgggccgggcgcctccac

SEQ ID NO: 8340276 - DNA, 22 bp, Homo sapiens
tggccggggctgatggacagtg

SEQ ID NO: 8340277 - DNA, 22 bp, Homo sapiens
tggccgggaagggacagtgtgg

SEQ ID NO: 8340278 - DNA, 22 bp, Homo sapiens
tggccctgtgtgcaggctgcac

SEQ ID NO: 8340279 - DNA, 22 bp, Homo sapiens
tggccctgttctgtacctcata

SEQ ID NO: 8340280 - DNA, 22 bp, Homo sapiens
tggccctgttctgtacctcata

SEQ ID NO: 8340281 - DNA, 20 bp, Homo sapiens
tggccctgttttctccaggc

SEQ ID NO: 8340282 - DNA, 20 bp, Homo sapiens
tggccctgttttctccaggc

SEQ ID NO: 8340283 - DNA, 22 bp, Homo sapiens
tggcccagccctgctctagggc

SEQ ID NO: 8340284 - DNA, 22 bp, Homo sapiens
tggcccagctcagggtgggcgg

SEQ ID NO: 8340285 - DNA, 22 bp, Homo sapiens
tggcccagctcagggtgggcgg

SEQ ID NO: 8340286 - DNA, 22 bp, Homo sapiens
tggcccaggtctctctgagccc

SEQ ID NO: 8340287 - DNA, 22 bp, Homo sapiens
tggcccaggggctcttggtgtt

SEQ ID NO: 8340288 - DNA, 22 bp, Homo sapiens
tggcccaggtgcaagagacaga

SEQ ID NO: 8340289 - DNA, 22 bp, Homo sapiens
tggcccaggggctcttggtgtt

SEQ ID NO: 8340290 - DNA, 22 bp, Homo sapiens
tggcccagggcacagcagggag

SEQ ID NO: 8340291 - DNA, 22 bp, Homo sapiens
tggcccagggagttcatggtgt

SEQ ID NO: 8340292 - DNA, 22 bp, Homo sapiens
tggcccaggcgaggtgggcaga

SEQ ID NO: 8340293 - DNA, 22 bp, Homo sapiens
tggcccaggccaaagccctgga

SEQ ID NO: 8340294 - DNA, 22 bp, Homo sapiens
tggcccaggcgaggtgggcaga

SEQ ID NO: 8340295 - DNA, 22 bp, Homo sapiens
tggcccagctgcagatggtgga

SEQ ID NO: 8340296 - DNA, 22 bp, Homo sapiens
tggcccaggccaaagccctgga

SEQ ID NO: 8340297 - DNA, 22 bp, Homo sapiens
tggccctgacttggaggcctga

SEQ ID NO: 8340298 - DNA, 22 bp, Homo sapiens
tggccctgacttggaggcctga

SEQ ID NO: 8340299 - DNA, 22 bp, Homo sapiens
tggccctgactgatgtggaggg

SEQ ID NO: 8340300 - DNA, 22 bp, Homo sapiens
tggccctgaggacccagtgtgg

SEQ ID NO: 8340301 - DNA, 22 bp, Homo sapiens
tggccctgacttggaggcctga

SEQ ID NO: 8340302 - DNA, 22 bp, Homo sapiens
tggccctgaggacccagtgtgg

SEQ ID NO: 8340303 - DNA, 22 bp, Homo sapiens
tggccctgactgatgtggaggg

SEQ ID NO: 8340304 - DNA, 22 bp, Homo sapiens
tggccctgacaggtcctgggca

SEQ ID NO: 8340305 - DNA, 22 bp, Homo sapiens
tggccctgacacgtggtactgg

SEQ ID NO: 8340306 - DNA, 22 bp, Homo sapiens
tggccctgacacgtggtactgg

SEQ ID NO: 8340307 - DNA, 22 bp, Homo sapiens
tggccctgacaggtcctgggca

SEQ ID NO: 8340308 - DNA, 22 bp, Homo sapiens
tggccctgcacccagagcagtt

SEQ ID NO: 8340309 - DNA, 22 bp, Homo sapiens
tggccctgcacccagagcagtt

SEQ ID NO: 8340310 - DNA, 22 bp, Homo sapiens
tggccctgcagaactagcctgg

SEQ ID NO: 8340311 - DNA, 22 bp, Homo sapiens
tggccctgccactcactgctga

SEQ ID NO: 8340312 - DNA, 22 bp, Homo sapiens
tggccctgcagaactagcctgg

SEQ ID NO: 8340313 - DNA, 22 bp, Homo sapiens
tggccctgcacccagagcagtt

SEQ ID NO: 8340314 - DNA, 22 bp, Homo sapiens
tggccctgaggggctgtgcccc

SEQ ID NO: 8340315 - DNA, 22 bp, Homo sapiens
tggccctgagggctcggagcca

SEQ ID NO: 8340316 - DNA, 22 bp, Homo sapiens
tggccctgagggctcggagcca

SEQ ID NO: 8340317 - DNA, 22 bp, Homo sapiens
tggcccggctctgagctgtgct

SEQ ID NO: 8340318 - DNA, 22 bp, Homo sapiens
tggcccagtcagcaggagaggg

SEQ ID NO: 8340319 - DNA, 22 bp, Homo sapiens
tggccctcagcactgagacctt

SEQ ID NO: 8340320 - DNA, 17 bp, Homo sapiens
tggccctagactccagc

SEQ ID NO: 8340321 - DNA, 22 bp, Homo sapiens
tggccctctgcaagattctgga

SEQ ID NO: 8340322 - DNA, 22 bp, Homo sapiens
tggccctgaatcaaggccagca

SEQ ID NO: 8340323 - DNA, 22 bp, Homo sapiens
tggccctgaatcaaggccagca

SEQ ID NO: 8340324 - DNA, 22 bp, Homo sapiens
tggccctgaaggccttgagcat

SEQ ID NO: 8340325 - DNA, 22 bp, Homo sapiens
tggccctgaatcaaggccagca

SEQ ID NO: 8340326 - DNA, 23 bp, Homo sapiens
tggccctgaatctgtcctggagg

SEQ ID NO: 8340327 - DNA, 22 bp, Homo sapiens
tggattcacaccattctcctgc

SEQ ID NO: 8340328 - DNA, 22 bp, Homo sapiens
tggcaaattttggcaagctgaa

SEQ ID NO: 8340329 - DNA, 22 bp, Homo sapiens
tggcaactcctgactctactca

SEQ ID NO: 8340330 - DNA, 22 bp, Homo sapiens
tggcaactcaatttctacaaga

SEQ ID NO: 8340331 - DNA, 22 bp, Homo sapiens
tggcaaagaccgcaattacttt

SEQ ID NO: 8340332 - DNA, 22 bp, Homo sapiens
tggcaaaggggaccatgttgaa

SEQ ID NO: 8340333 - DNA, 23 bp, Homo sapiens
tggcaaagcattcttataacagt

SEQ ID NO: 8340334 - DNA, 22 bp, Homo sapiens
tggcacaagggctattccttag

SEQ ID NO: 8340335 - DNA, 22 bp, Homo sapiens
tggcacagacagcacagcaatg

SEQ ID NO: 8340336 - DNA, 22 bp, Homo sapiens
tggcacagacagatcaggagtc

SEQ ID NO: 8340337 - DNA, 22 bp, Homo sapiens
tggcacagcccattcagagaag

SEQ ID NO: 8340338 - DNA, 22 bp, Homo sapiens
tggcacagcctttaaagtacca

SEQ ID NO: 8340339 - DNA, 16 bp, Homo sapiens
tggcacagagcagata

SEQ ID NO: 8340340 - DNA, 17 bp, Homo sapiens
tggcacagaggtgctat

SEQ ID NO: 8340341 - DNA, 22 bp, Homo sapiens
tggcacagagggacccagcagc

SEQ ID NO: 8340342 - DNA, 22 bp, Homo sapiens
tggcactgggacagatgctctc

SEQ ID NO: 8340343 - DNA, 22 bp, Homo sapiens
tggcactggcgcaggatggcgg

SEQ ID NO: 8340344 - DNA, 22 bp, Homo sapiens
tggcactgccaacctgctaggt

SEQ ID NO: 8340345 - DNA, 22 bp, Homo sapiens
tggcacagttaaagttgtagaa

SEQ ID NO: 8340346 - DNA, 22 bp, Homo sapiens
tggcacatatttttagtgctca

SEQ ID NO: 8340347 - DNA, 22 bp, Homo sapiens
tggcacatggtaagtgcttaac

SEQ ID NO: 8340348 - DNA, 22 bp, Homo sapiens
tggcacatggttaatcataatt

SEQ ID NO: 8340349 - DNA, 22 bp, Homo sapiens
tggcagagagagtgcagtcgac

SEQ ID NO: 8340350 - DNA, 22 bp, Homo sapiens
tggcagagacaaggccgggcct

SEQ ID NO: 8340351 - DNA, 22 bp, Homo sapiens
tggcagagcccagaactgagca

SEQ ID NO: 8340352 - DNA, 21 bp, Homo sapiens
tggcaggcagctggaagcttg

SEQ ID NO: 8340353 - DNA, 20 bp, Homo sapiens
tggcaggagccactggaagc

SEQ ID NO: 8340354 - DNA, 22 bp, Homo sapiens
tggcagctgcgttgtgtttctg

SEQ ID NO: 8340355 - DNA, 22 bp, Homo sapiens
tggcaggaaaaagggccagagg

SEQ ID NO: 8340356 - DNA, 22 bp, Homo sapiens
tggcagagttcgctgtgccttt

SEQ ID NO: 8340357 - DNA, 22 bp, Homo sapiens
tggcagagtctgggcttgggca

SEQ ID NO: 8340358 - DNA, 22 bp, Homo sapiens
tggcagcagacatctgaggtct

SEQ ID NO: 8340359 - DNA, 22 bp, Homo sapiens
tggcagcagccatggaaggccc

SEQ ID NO: 8340360 - DNA, 22 bp, Homo sapiens
tggcagcctggaatctctcagc

SEQ ID NO: 8340361 - DNA, 19 bp, Homo sapiens
tggcagcctccacttttgc

SEQ ID NO: 8340362 - DNA, 22 bp, Homo sapiens
tggcttaagacgaaaagaaggg

SEQ ID NO: 8340363 - DNA, 22 bp, Homo sapiens
tggcttagttctagaaatttgg

SEQ ID NO: 8340364 - DNA, 22 bp, Homo sapiens
tggctgtgaacaaagagaataa

SEQ ID NO: 8340365 - DNA, 22 bp, Homo sapiens
tggctgtgggatatgtgactga

SEQ ID NO: 8340366 - DNA, 22 bp, Homo sapiens
tggctggcagtaggctagtggc

SEQ ID NO: 8340367 - DNA, 23 bp, Homo sapiens
tggctggcagaaactgaagcatg

SEQ ID NO: 8340368 - DNA, 22 bp, Homo sapiens
tggctggcatagccattgctcc

SEQ ID NO: 8340369 - DNA, 22 bp, Homo sapiens
tggctggcagttatctttggat

SEQ ID NO: 8340370 - DNA, 18 bp, Homo sapiens
tggctggcagtgggcagc

SEQ ID NO: 8340371 - DNA, 22 bp, Homo sapiens
tggctggccctgggagtgcaga

SEQ ID NO: 8340372 - DNA, 22 bp, Homo sapiens
tggctggcgccgggctagccac

SEQ ID NO: 8340373 - DNA, 23 bp, Homo sapiens
tggctggcgcctgcctcaccctg

SEQ ID NO: 8340374 - DNA, 22 bp, Homo sapiens
tggctggcgttggggccagtga

SEQ ID NO: 8340375 - DNA, 22 bp, Homo sapiens
tggctggctagaatggaaatgt

SEQ ID NO: 8340376 - DNA, 22 bp, Homo sapiens
tggctggagtgggagaagttta

SEQ ID NO: 8340377 - DNA, 22 bp, Homo sapiens
tggctggatgtgagatcaagag

SEQ ID NO: 8340378 - DNA, 22 bp, Homo sapiens
tggctggcaaggctggagtcag

SEQ ID NO: 8340379 - DNA, 22 bp, Homo sapiens
tgggaaatgtgtttctggacca

SEQ ID NO: 8340380 - DNA, 22 bp, Homo sapiens
tgggaaatcagtatagtatcag

SEQ ID NO: 8340381 - DNA, 22 bp, Homo sapiens
tgggaaattgtatttctatttc

SEQ ID NO: 8340382 - DNA, 22 bp, Homo sapiens
tgggaagaggcgggaggctgtt

SEQ ID NO: 8340383 - DNA, 22 bp, Homo sapiens
tgggaagaagcagagaactgga

SEQ ID NO: 8340384 - DNA, 22 bp, Homo sapiens
tgggaacattttgagctgagag

SEQ ID NO: 8340385 - DNA, 22 bp, Homo sapiens
tggcttctggctggtgagaaat

SEQ ID NO: 8340386 - DNA, 22 bp, Homo sapiens
tgggaggcagaagttgactgga

SEQ ID NO: 8340387 - DNA, 22 bp, Homo sapiens
tgggagctctgagcctgctgtg

SEQ ID NO: 8340388 - DNA, 22 bp, Homo sapiens
tgggagctggggttggacgtct

SEQ ID NO: 8340389 - DNA, 22 bp, Homo sapiens
tgggagaagcagtgggacagta

SEQ ID NO: 8340390 - DNA, 22 bp, Homo sapiens
tgggagaagcatggggtgcaga

SEQ ID NO: 8340391 - DNA, 22 bp, Homo sapiens
tgggagaacactgctctggatg

SEQ ID NO: 8340392 - DNA, 22 bp, Homo sapiens
tgggactgtggtcaaggacaaa

SEQ ID NO: 8340393 - DNA, 21 bp, Homo sapiens
tgggagagggctcagctaccc

SEQ ID NO: 8340394 - DNA, 22 bp, Homo sapiens
tgggacctctcttgagagagca

SEQ ID NO: 8340395 - DNA, 22 bp, Homo sapiens
tgggactgctcttgctggggtc

SEQ ID NO: 8340396 - DNA, 22 bp, Homo sapiens
tgggaagaggggtataaagaag

SEQ ID NO: 8340397 - DNA, 22 bp, Homo sapiens
tgggaagatatgagtgaccaac

SEQ ID NO: 8340398 - DNA, 22 bp, Homo sapiens
tgggaaggggagctggaaagga

SEQ ID NO: 8340399 - DNA, 22 bp, Homo sapiens
tgggaagggccgatggagcctc

SEQ ID NO: 8340400 - DNA, 22 bp, Homo sapiens
tgggaagggtcaacagctggaa

SEQ ID NO: 8340401 - DNA, 22 bp, Homo sapiens
tggctatgcaatttaggagttc

SEQ ID NO: 8340402 - DNA, 22 bp, Homo sapiens
tggctcaccttcagaatatacc

SEQ ID NO: 8340403 - DNA, 22 bp, Homo sapiens
tggctcagaagaaaaggtaaac

SEQ ID NO: 8340404 - DNA, 22 bp, Homo sapiens
tggctcagaactacttctagtt

SEQ ID NO: 8340405 - DNA, 22 bp, Homo sapiens
tggctcagaactacttctagtt

SEQ ID NO: 8340406 - DNA, 22 bp, Homo sapiens
tggcggtgacggcggcgcctgg

SEQ ID NO: 8340407 - DNA, 22 bp, Homo sapiens
tggcggagttccagctgggatc

SEQ ID NO: 8340408 - DNA, 21 bp, Homo sapiens
tggcggggacttgtggctgcc

SEQ ID NO: 8340409 - DNA, 20 bp, Homo sapiens
tggcggggatgagggagtta

SEQ ID NO: 8340410 - DNA, 21 bp, Homo sapiens
tggcggggacttgtggctgcc

SEQ ID NO: 8340411 - DNA, 22 bp, Homo sapiens
tggcgcgctcgctctcgctgag

SEQ ID NO: 8340412 - DNA, 17 bp, Homo sapiens
tggcgctcccagggtgc

SEQ ID NO: 8340413 - DNA, 22 bp, Homo sapiens
tggctcagaaggctgccttcac

SEQ ID NO: 8340414 - DNA, 22 bp, Homo sapiens
tggctcagagagggagtgtgga

SEQ ID NO: 8340415 - DNA, 22 bp, Homo sapiens
tggctcagagccttgagagctg

SEQ ID NO: 8340416 - DNA, 22 bp, Homo sapiens
tggctcagagcagggactctgg

SEQ ID NO: 8340417 - DNA, 22 bp, Homo sapiens
tggctcagagagggagtgtgga

SEQ ID NO: 8340418 - DNA, 22 bp, Homo sapiens
tggctcagagcagggactctgg

SEQ ID NO: 8340419 - DNA, 22 bp, Homo sapiens
tggctcagatgctcttccagtg

SEQ ID NO: 8340420 - DNA, 22 bp, Homo sapiens
tggctcagatgctcttccagtg

SEQ ID NO: 8340421 - DNA, 18 bp, Homo sapiens
tggctcagatggctttaa

SEQ ID NO: 8340422 - DNA, 22 bp, Homo sapiens
tggctcagatttttgtaggctt

SEQ ID NO: 8340423 - DNA, 22 bp, Homo sapiens
tggctcagaggggaagtggttt

SEQ ID NO: 8340424 - DNA, 22 bp, Homo sapiens
tggctcagataattcaaggggc

SEQ ID NO: 8340425 - DNA, 22 bp, Homo sapiens
tggctcagagttcatcttttag

SEQ ID NO: 8340426 - DNA, 22 bp, Homo sapiens
tggctcagataattcaaggggc

SEQ ID NO: 8340427 - DNA, 22 bp, Homo sapiens
tggcctgtcactgcccagggct

SEQ ID NO: 8340428 - DNA, 18 bp, Homo sapiens
tggctcctgcctcctgca

SEQ ID NO: 8340429 - DNA, 20 bp, Homo sapiens
tggctcctcttggctgtggc

SEQ ID NO: 8340430 - DNA, 22 bp, Homo sapiens
tggctcctgcagaccatctgga

SEQ ID NO: 8340431 - DNA, 22 bp, Homo sapiens
tggctcctcacgtcctcagagc

SEQ ID NO: 8340432 - DNA, 22 bp, Homo sapiens
tggctcccaaggagctcctgcc

SEQ ID NO: 8340433 - DNA, 22 bp, Homo sapiens
tggctcccacaaactcactact

SEQ ID NO: 8340434 - DNA, 22 bp, Homo sapiens
tggctccagatttcctgctgca

SEQ ID NO: 8340435 - DNA, 22 bp, Homo sapiens
tggctcagttaggtcagaaaca

SEQ ID NO: 8340436 - DNA, 22 bp, Homo sapiens
tggctcagttccatcatctgga

SEQ ID NO: 8340437 - DNA, 22 bp, Homo sapiens
tggctcagttaggtcagaaaca

SEQ ID NO: 8340438 - DNA, 22 bp, Homo sapiens
tggctcagtggcagccgcagct

SEQ ID NO: 8340439 - DNA, 21 bp, Homo sapiens
tggctcagttgctgggcacag

SEQ ID NO: 8340440 - DNA, 22 bp, Homo sapiens
tggctcagttccatcatctgga

SEQ ID NO: 8340441 - DNA, 22 bp, Homo sapiens
tggctccaaatcaactgctgtt

SEQ ID NO: 8340442 - DNA, 22 bp, Homo sapiens
tggctcaggcttgaaaatagat

SEQ ID NO: 8340443 - DNA, 22 bp, Homo sapiens
tggctcaggcctacgacgcctt

SEQ ID NO: 8340444 - DNA, 22 bp, Homo sapiens
tggctcaggcctacgacgcctt

SEQ ID NO: 8340445 - DNA, 22 bp, Homo sapiens
tggctcaggccacttcttttat

SEQ ID NO: 8340446 - DNA, 22 bp, Homo sapiens
tggctcaggataattttcccaa

SEQ ID NO: 8340447 - DNA, 22 bp, Homo sapiens
tggctcaggatctaagcagaat

SEQ ID NO: 8340448 - DNA, 22 bp, Homo sapiens
tggctcaggagggatctttgct

SEQ ID NO: 8340449 - DNA, 22 bp, Homo sapiens
tggctcagctttccccatctgg

SEQ ID NO: 8340450 - DNA, 22 bp, Homo sapiens
tggctcagccagccctaggaac

SEQ ID NO: 8340451 - DNA, 22 bp, Homo sapiens
tggctcagctttccccatctgg

SEQ ID NO: 8340452 - DNA, 22 bp, Homo sapiens
tggctcagcttacttttgaggg

SEQ ID NO: 8340453 - DNA, 22 bp, Homo sapiens
tggctcagcttacttttgaggg

SEQ ID NO: 8340454 - DNA, 22 bp, Homo sapiens
tggctcagcaagacattgacct

SEQ ID NO: 8340455 - DNA, 22 bp, Homo sapiens
tggctcagcaggttagaaacta

SEQ ID NO: 8340456 - DNA, 22 bp, Homo sapiens
tggctcagcattcactggtctt

SEQ ID NO: 8340457 - DNA, 22 bp, Homo sapiens
tggctcagtggcagccgcagct

SEQ ID NO: 8340458 - DNA, 22 bp, Homo sapiens
tggctcagtgcattcacagtaa

SEQ ID NO: 8340459 - DNA, 22 bp, Homo sapiens
tggctcagtgcattcacagtaa

SEQ ID NO: 8340460 - DNA, 22 bp, Homo sapiens
tggctcagtgacattcctccca

SEQ ID NO: 8340461 - DNA, 22 bp, Homo sapiens
tggctcagtgaagagataactt

SEQ ID NO: 8340462 - DNA, 22 bp, Homo sapiens
tggctcagtctgggttgactga

SEQ ID NO: 8340463 - DNA, 22 bp, Homo sapiens
tggctcagtcatggatgagtaa

SEQ ID NO: 8340464 - DNA, 22 bp, Homo sapiens
tggctcagtagcagtgtggtca

SEQ ID NO: 8340465 - DNA, 22 bp, Homo sapiens
tggctcagtagcagtgtggtca

SEQ ID NO: 8340466 - DNA, 22 bp, Homo sapiens
tggctcagtaatcgagtctcct

SEQ ID NO: 8340467 - DNA, 22 bp, Homo sapiens
tggctcagtaatcgagtctcct

SEQ ID NO: 8340468 - DNA, 22 bp, Homo sapiens
tggctcaggtgtgagctgaaga

SEQ ID NO: 8340469 - DNA, 22 bp, Homo sapiens
tggctcagggtccccaaatggt

SEQ ID NO: 8340470 - DNA, 23 bp, Homo sapiens
tggctcagggtctcttatgaagt

SEQ ID NO: 8340471 - DNA, 22 bp, Homo sapiens
tggctcaggggtctggctctgt

SEQ ID NO: 8340472 - DNA, 22 bp, Homo sapiens
tggctcaggggtctggctctgt

SEQ ID NO: 8340473 - DNA, 22 bp, Homo sapiens
tggctccttcattctcctgcca

SEQ ID NO: 8340474 - DNA, 23 bp, Homo sapiens
tggctctgagcttcctggtggcc

SEQ ID NO: 8340475 - DNA, 23 bp, Homo sapiens
tggctctgagcttcctggtggcc

SEQ ID NO: 8340476 - DNA, 22 bp, Homo sapiens
tggctctgagctgcaaagctgc

SEQ ID NO: 8340477 - DNA, 21 bp, Homo sapiens
tggctctgagcctcatggctg

SEQ ID NO: 8340478 - DNA, 22 bp, Homo sapiens
tggctctgcagcagtgtgcgtg

SEQ ID NO: 8340479 - DNA, 22 bp, Homo sapiens
tggctctgatcagatgtccagt

SEQ ID NO: 8340480 - DNA, 21 bp, Homo sapiens
tggctctgctcagagcagtcc

SEQ ID NO: 8340481 - DNA, 22 bp, Homo sapiens
tggctctgctgaacctagtgca

SEQ ID NO: 8340482 - DNA, 18 bp, Homo sapiens
tggctctgcagccagatg

SEQ ID NO: 8340483 - DNA, 22 bp, Homo sapiens
tggctctggagctcctgggccc

SEQ ID NO: 8340484 - DNA, 18 bp, Homo sapiens
tggctctggacttgctcc

SEQ ID NO: 8340485 - DNA, 22 bp, Homo sapiens
tggctctgttgtgctgagccag

SEQ ID NO: 8340486 - DNA, 19 bp, Homo sapiens
tggctctgtttctctggag

SEQ ID NO: 8340487 - DNA, 21 bp, Homo sapiens
tggctctgttcaatatatgga

SEQ ID NO: 8340488 - DNA, 22 bp, Homo sapiens
tggctctgttgtaaagaaattt

SEQ ID NO: 8340489 - DNA, 22 bp, Homo sapiens
tggctctggagctggcggctga

SEQ ID NO: 8340490 - DNA, 22 bp, Homo sapiens
tggctctggagctggcggctga

SEQ ID NO: 8340491 - DNA, 22 bp, Homo sapiens
tggctctggccaccgggagggc

SEQ ID NO: 8340492 - DNA, 22 bp, Homo sapiens
tggctctggccaccgggagggc

SEQ ID NO: 8340493 - DNA, 22 bp, Homo sapiens
tggctctggccaccgggagggc

SEQ ID NO: 8340494 - DNA, 22 bp, Homo sapiens
tggctctggcgtgaagcccaga

SEQ ID NO: 8340495 - DNA, 22 bp, Homo sapiens
tggctctgggaatgggaagatg

SEQ ID NO: 8340496 - DNA, 22 bp, Homo sapiens
tggctctgtgaacagacgactg

SEQ ID NO: 8340497 - DNA, 19 bp, Homo sapiens
tggctgagctggactgagg

SEQ ID NO: 8340498 - DNA, 22 bp, Homo sapiens
tggctgaggctggagtgcagtg

SEQ ID NO: 8340499 - DNA, 22 bp, Homo sapiens
tggctgaataatattctgttgt

SEQ ID NO: 8340500 - DNA, 22 bp, Homo sapiens
tggctgaatctgcagcaggaag

SEQ ID NO: 8340501 - DNA, 22 bp, Homo sapiens
tggctgaaggaagattcttcta

SEQ ID NO: 8340502 - DNA, 22 bp, Homo sapiens
tggctgaataaaatatggtgtt

SEQ ID NO: 8340503 - DNA, 22 bp, Homo sapiens
tggctgaactaatgtgctgttt

SEQ ID NO: 8340504 - DNA, 22 bp, Homo sapiens
tggctgctgcttggtcttcttc

SEQ ID NO: 8340505 - DNA, 22 bp, Homo sapiens
tggctgcagtgcttgagatgtc

SEQ ID NO: 8340506 - DNA, 22 bp, Homo sapiens
tggctgcagatcaagggcaggc

SEQ ID NO: 8340507 - DNA, 22 bp, Homo sapiens
tggctgagttctccaggagtag

SEQ ID NO: 8340508 - DNA, 22 bp, Homo sapiens
tgcttaaacatactatttatat

SEQ ID NO: 8340509 - DNA, 22 bp, Homo sapiens
tgcttaaaccctgatcatgtgt

SEQ ID NO: 8340510 - DNA, 22 bp, Homo sapiens
tgctgtctttttcccttcctaa

SEQ ID NO: 8340511 - DNA, 22 bp, Homo sapiens
tgctgtctttcattgtctgcct

SEQ ID NO: 8340512 - DNA, 22 bp, Homo sapiens
tgctgtccctaagtctcttcaa

SEQ ID NO: 8340513 - DNA, 22 bp, Homo sapiens
tgctgtgaggttgagaaggaag

SEQ ID NO: 8340514 - DNA, 22 bp, Homo sapiens
tgcttccactaatgagctgtgt

SEQ ID NO: 8340515 - DNA, 22 bp, Homo sapiens
tgcttctgcaggagctcctgat

SEQ ID NO: 8340516 - DNA, 22 bp, Homo sapiens
tgcttctgagttgcaggacttg

SEQ ID NO: 8340517 - DNA, 22 bp, Homo sapiens
tgcttctgaaatgcaggtcttc

SEQ ID NO: 8340518 - DNA, 22 bp, Homo sapiens
tgctgggcctcttccctggata

SEQ ID NO: 8340519 - DNA, 22 bp, Homo sapiens
tgctgggcactgtctctgggga

SEQ ID NO: 8340520 - DNA, 20 bp, Homo sapiens
tgctgggcatgcagtggaaa

SEQ ID NO: 8340521 - DNA, 22 bp, Homo sapiens
tgctggggtctctccggtgccc

SEQ ID NO: 8340522 - DNA, 23 bp, Homo sapiens
tgctggggtagtttgtggcacag

SEQ ID NO: 8340523 - DNA, 23 bp, Homo sapiens
tgctggggtagtttgtggcacag

SEQ ID NO: 8340524 - DNA, 22 bp, Homo sapiens
tgctggggtcatggggcgcccg

SEQ ID NO: 8340525 - DNA, 22 bp, Homo sapiens
tgctggggtcatggggcgcccg

SEQ ID NO: 8340526 - DNA, 20 bp, Homo sapiens
tgctggggacatacagggtg

SEQ ID NO: 8340527 - DNA, 22 bp, Homo sapiens
tgctggggagtgattgaccatc

SEQ ID NO: 8340528 - DNA, 22 bp, Homo sapiens
tgctggggatccgtaccaaccc

SEQ ID NO: 8340529 - DNA, 16 bp, Homo sapiens
tgctggggcgccgtcc

SEQ ID NO: 8340530 - DNA, 22 bp, Homo sapiens
tgctggggcagaagagccaaga

SEQ ID NO: 8340531 - DNA, 23 bp, Homo sapiens
tgctgtccaacagactggccatg

SEQ ID NO: 8340532 - DNA, 20 bp, Homo sapiens
tgctgtaagattagagagct

SEQ ID NO: 8340533 - DNA, 22 bp, Homo sapiens
tgctggaggattaaacaagtca

SEQ ID NO: 8340534 - DNA, 22 bp, Homo sapiens
tgctggagcccaggcggccttt

SEQ ID NO: 8340535 - DNA, 22 bp, Homo sapiens
tgctgctgtttcctacatctca

SEQ ID NO: 8340536 - DNA, 22 bp, Homo sapiens
tgctgctgttgacggctgtcca

SEQ ID NO: 8340537 - DNA, 19 bp, Homo sapiens
tgctgctgtccttgcaggg

SEQ ID NO: 8340538 - DNA, 22 bp, Homo sapiens
tgctgctgtatcatgccttcat

SEQ ID NO: 8340539 - DNA, 22 bp, Homo sapiens
tgctgctggatcttactcatct

SEQ ID NO: 8340540 - DNA, 22 bp, Homo sapiens
tgctgctgggtttgacagtcac

SEQ ID NO: 8340541 - DNA, 20 bp, Homo sapiens
tgctgcagtttcatgggact

SEQ ID NO: 8340542 - DNA, 22 bp, Homo sapiens
tgctgcatttatcttctcaaac

SEQ ID NO: 8340543 - DNA, 22 bp, Homo sapiens
tgctgccacaaattcagctgcc

SEQ ID NO: 8340544 - DNA, 22 bp, Homo sapiens
tgctgcctccttcctgccagga

SEQ ID NO: 8340545 - DNA, 22 bp, Homo sapiens
tgctgctgaaaaggtgtgctta

SEQ ID NO: 8340546 - DNA, 22 bp, Homo sapiens
tgctgctgacatttggggcttg

SEQ ID NO: 8340547 - DNA, 22 bp, Homo sapiens
tgctgctcctgcctggctccca

SEQ ID NO: 8340548 - DNA, 22 bp, Homo sapiens
tgctgagatgaatagagacctc

SEQ ID NO: 8340549 - DNA, 22 bp, Homo sapiens
tgctgagatgaatagggctgtc

SEQ ID NO: 8340550 - DNA, 22 bp, Homo sapiens
tgctgagcgcatccggcggccg

SEQ ID NO: 8340551 - DNA, 22 bp, Homo sapiens
tgctgaaattagaacattgagg

SEQ ID NO: 8340552 - DNA, 22 bp, Homo sapiens
tgctgaaaactcaaccattgtg

SEQ ID NO: 8340553 - DNA, 22 bp, Homo sapiens
tgctctgggttcttgctgttac

SEQ ID NO: 8340554 - DNA, 22 bp, Homo sapiens
tgctctggtaactcacttccat

SEQ ID NO: 8340555 - DNA, 23 bp, Homo sapiens
tgctcttctcagacctgtcagcc

SEQ ID NO: 8340556 - DNA, 20 bp, Homo sapiens
tgctctgtctaaaacttccc

SEQ ID NO: 8340557 - DNA, 22 bp, Homo sapiens
tgctctgtaaggtcagaaaagg

SEQ ID NO: 8340558 - DNA, 22 bp, Homo sapiens
tgctgcaggccttggctgggaa

SEQ ID NO: 8340559 - DNA, 22 bp, Homo sapiens
tgctgcagtgggattagcctga

SEQ ID NO: 8340560 - DNA, 22 bp, Homo sapiens
tgctgcagtgtttgctgaagtt

SEQ ID NO: 8340561 - DNA, 22 bp, Homo sapiens
tgctgagtcgtattatttttta

SEQ ID NO: 8340562 - DNA, 22 bp, Homo sapiens
tgctgagtactctcctgtgtag

SEQ ID NO: 8340563 - DNA, 22 bp, Homo sapiens
tgctgagtggcggcctcacttt

SEQ ID NO: 8340564 - DNA, 22 bp, Homo sapiens
tgctgagtatttgtttgaataa

SEQ ID NO: 8340565 - DNA, 22 bp, Homo sapiens
tgctgagtgggattcctgtgct

SEQ ID NO: 8340566 - DNA, 22 bp, Homo sapiens
tgctgattttgcctactgatcc

SEQ ID NO: 8340567 - DNA, 22 bp, Homo sapiens
tgctctcctgctcctcagccca

SEQ ID NO: 8340568 - DNA, 22 bp, Homo sapiens
tgctctccggcttccgtggcct

SEQ ID NO: 8340569 - DNA, 22 bp, Homo sapiens
tgctctgggaccgtcattaaaa

SEQ ID NO: 8340570 - DNA, 22 bp, Homo sapiens
tgctctgggattcagcagcctg

SEQ ID NO: 8340571 - DNA, 22 bp, Homo sapiens
tgctctggggctccccaccaga

SEQ ID NO: 8340572 - DNA, 22 bp, Homo sapiens
tgctctggggctccccaccaga

SEQ ID NO: 8340573 - DNA, 22 bp, Homo sapiens
tgctcctggcatctctgcgtcc

SEQ ID NO: 8340574 - DNA, 18 bp, Homo sapiens
tgctccaggcccatgggc

SEQ ID NO: 8340575 - DNA, 21 bp, Homo sapiens
tgctccaggagggggcagtcc

SEQ ID NO: 8340576 - DNA, 22 bp, Homo sapiens
tgctccaggccgcctggggctg

SEQ ID NO: 8340577 - DNA, 19 bp, Homo sapiens
tgctccaggccttgccgca

SEQ ID NO: 8340578 - DNA, 20 bp, Homo sapiens
tgctccaggaacactggccg

SEQ ID NO: 8340579 - DNA, 22 bp, Homo sapiens
tgctccagcgctgccaccagtt

SEQ ID NO: 8340580 - DNA, 22 bp, Homo sapiens
tgctccagcgctgccaccagtt

SEQ ID NO: 8340581 - DNA, 22 bp, Homo sapiens
tgctccagcgctgccaccagtt

SEQ ID NO: 8340582 - DNA, 22 bp, Homo sapiens
tgctccagcctatgctctccgg

SEQ ID NO: 8340583 - DNA, 22 bp, Homo sapiens
tgctccagcatgaccctcaatg

SEQ ID NO: 8340584 - DNA, 22 bp, Homo sapiens
tgctccagcccctggtgcacag

SEQ ID NO: 8340585 - DNA, 22 bp, Homo sapiens
tgctccagcaccaagagctcca

SEQ ID NO: 8340586 - DNA, 22 bp, Homo sapiens
tgctccagggcctccagtgggg

SEQ ID NO: 8340587 - DNA, 22 bp, Homo sapiens
tgctccgggaaagagcagccgc

SEQ ID NO: 8340588 - DNA, 22 bp, Homo sapiens
tgctcctgctgcatgcatctcc

SEQ ID NO: 8340589 - DNA, 22 bp, Homo sapiens
tgctattgtgaacagtgccaca

SEQ ID NO: 8340590 - DNA, 22 bp, Homo sapiens
tgctattttagacatactttgt

SEQ ID NO: 8340591 - DNA, 22 bp, Homo sapiens
tgctatttctatctcatttaaa

SEQ ID NO: 8340592 - DNA, 22 bp, Homo sapiens
tgctatttggaaaagcatttgg

SEQ ID NO: 8340593 - DNA, 22 bp, Homo sapiens
tgcgcctgtaagtccagagtcc

SEQ ID NO: 8340594 - DNA, 22 bp, Homo sapiens
tgcgcgggtgcctatctgtata

SEQ ID NO: 8340595 - DNA, 22 bp, Homo sapiens
tgcgcggctcagtcatctccag

SEQ ID NO: 8340596 - DNA, 22 bp, Homo sapiens
tgcgcggctcagtcatctccag

SEQ ID NO: 8340597 - DNA, 22 bp, Homo sapiens
tgcgggagggcaacgcggcatt

SEQ ID NO: 8340598 - DNA, 22 bp, Homo sapiens
tgcgggagtgcgccgagctctc

SEQ ID NO: 8340599 - DNA, 22 bp, Homo sapiens
tgcgggagtgcgccgagctctc

SEQ ID NO: 8340600 - DNA, 22 bp, Homo sapiens
tgcggcggcgggcagaggacta

SEQ ID NO: 8340601 - DNA, 22 bp, Homo sapiens
tgcggcagccaccgcgtggccc

SEQ ID NO: 8340602 - DNA, 22 bp, Homo sapiens
tgcggggccctcccgtgcactg

SEQ ID NO: 8340603 - DNA, 22 bp, Homo sapiens
tgcgggggaagctgtgggagaa

SEQ ID NO: 8340604 - DNA, 22 bp, Homo sapiens
tgctcagctggtgccagggtcc

SEQ ID NO: 8340605 - DNA, 18 bp, Homo sapiens
tgctcagctggtgctgaa

SEQ ID NO: 8340606 - DNA, 19 bp, Homo sapiens
tgctcatggggacttctcc

SEQ ID NO: 8340607 - DNA, 21 bp, Homo sapiens
tgctcatgagcccacagctgc

SEQ ID NO: 8340608 - DNA, 22 bp, Homo sapiens
tgctccagaacctgaccatgct

SEQ ID NO: 8340609 - DNA, 22 bp, Homo sapiens
tgctccagcaccaagagctcca

SEQ ID NO: 8340610 - DNA, 22 bp, Homo sapiens
tgctccagcaacaggcttagct

SEQ ID NO: 8340611 - DNA, 22 bp, Homo sapiens
tgctcacaattatcagaagtat

SEQ ID NO: 8340612 - DNA, 22 bp, Homo sapiens
tgctcactctattcacagtgcc

SEQ ID NO: 8340613 - DNA, 21 bp, Homo sapiens
tgctcacagatgtgctcagtg

SEQ ID NO: 8340614 - DNA, 22 bp, Homo sapiens
tgctcagagactctccctgagc

SEQ ID NO: 8340615 - DNA, 22 bp, Homo sapiens
tgctcagattacagccccacat

SEQ ID NO: 8340616 - DNA, 22 bp, Homo sapiens
tgctcagaagacttactggtta

SEQ ID NO: 8340617 - DNA, 22 bp, Homo sapiens
tgctcagactagctccagggaa

SEQ ID NO: 8340618 - DNA, 22 bp, Homo sapiens
tgctcagctaggctgaagaaga

SEQ ID NO: 8340619 - DNA, 22 bp, Homo sapiens
tgctcagcagtcaaggtcatag

SEQ ID NO: 8340620 - DNA, 22 bp, Homo sapiens
tgctcagcagatctcaggagat

SEQ ID NO: 8340621 - DNA, 22 bp, Homo sapiens
tgctcagcacagaccaggccag

SEQ ID NO: 8340622 - DNA, 19 bp, Homo sapiens
tgcctgtcagtagatctca

SEQ ID NO: 8340623 - DNA, 17 bp, Homo sapiens
tgcctgtgataagcaca

SEQ ID NO: 8340624 - DNA, 22 bp, Homo sapiens
tgcctgtaataatgctaagcac

SEQ ID NO: 8340625 - DNA, 22 bp, Homo sapiens
tgcctgggttgactcttagctg

SEQ ID NO: 8340626 - DNA, 22 bp, Homo sapiens
tgcctgggtgtaaagggccaac

SEQ ID NO: 8340627 - DNA, 22 bp, Homo sapiens
tgcctgggtgctggctggtcac

SEQ ID NO: 8340628 - DNA, 22 bp, Homo sapiens
tgcctgggtgctggctggtcac

SEQ ID NO: 8340629 - DNA, 22 bp, Homo sapiens
tgcctgggtccaggccaagcct

SEQ ID NO: 8340630 - DNA, 22 bp, Homo sapiens
tgcctgggtgccctctgctcct

SEQ ID NO: 8340631 - DNA, 22 bp, Homo sapiens
tgcctggggattgctctgggcc

SEQ ID NO: 8340632 - DNA, 22 bp, Homo sapiens
tgcctgggctcaccgcctcttt

SEQ ID NO: 8340633 - DNA, 22 bp, Homo sapiens
tgcctgggaaccaatcctggct

SEQ ID NO: 8340634 - DNA, 22 bp, Homo sapiens
tgcctgtgtcacagtgatgttt

SEQ ID NO: 8340635 - DNA, 22 bp, Homo sapiens
tgcctgtgtatttccggcctgc

SEQ ID NO: 8340636 - DNA, 22 bp, Homo sapiens
tgcctgtgtccccttcttggca

SEQ ID NO: 8340637 - DNA, 22 bp, Homo sapiens
tgcctgtggagccactagtttt

SEQ ID NO: 8340638 - DNA, 22 bp, Homo sapiens
tgcctgtgctgggattgcatgt

SEQ ID NO: 8340639 - DNA, 22 bp, Homo sapiens
tgcctgtgggcagagggccaga

SEQ ID NO: 8340640 - DNA, 22 bp, Homo sapiens
tgccttggttctctacttggag

SEQ ID NO: 8340641 - DNA, 22 bp, Homo sapiens
tgccttgggtcaacctttgagt

SEQ ID NO: 8340642 - DNA, 22 bp, Homo sapiens
tgccttggtgcttcttcatgtg

SEQ ID NO: 8340643 - DNA, 22 bp, Homo sapiens
tgcgaccctagccccctcactt

SEQ ID NO: 8340644 - DNA, 22 bp, Homo sapiens
tggaataatgaccacagaaaca

SEQ ID NO: 8340645 - DNA, 22 bp, Homo sapiens
tggaagtgatgctgaggtgacg

SEQ ID NO: 8340646 - DNA, 22 bp, Homo sapiens
tggaagccaggaagcaggggtc

SEQ ID NO: 8340647 - DNA, 22 bp, Homo sapiens
tggaagcatcacttcttgcctg

SEQ ID NO: 8340648 - DNA, 22 bp, Homo sapiens
tggaagcagtcacttcctagtt

SEQ ID NO: 8340649 - DNA, 22 bp, Homo sapiens
tggaagcacaggatcagtggaa

SEQ ID NO: 8340650 - DNA, 22 bp, Homo sapiens
tggaagcaacactcagctttac

SEQ ID NO: 8340651 - DNA, 22 bp, Homo sapiens
tggaagcacaggatcagtggaa

SEQ ID NO: 8340652 - DNA, 22 bp, Homo sapiens
tggaagcttttgagattgttgc

SEQ ID NO: 8340653 - DNA, 22 bp, Homo sapiens
tggaagcttctgaccatttttg

SEQ ID NO: 8340654 - DNA, 22 bp, Homo sapiens
tggaagcttcctgttcttgagg

SEQ ID NO: 8340655 - DNA, 17 bp, Homo sapiens
tggaagcttcatgttgg

SEQ ID NO: 8340656 - DNA, 22 bp, Homo sapiens
tggaagaggccagaaagtggga

SEQ ID NO: 8340657 - DNA, 22 bp, Homo sapiens
tggaagaggtggaagtggcttc

SEQ ID NO: 8340658 - DNA, 22 bp, Homo sapiens
tggaagagcaggcagacaatgc

SEQ ID NO: 8340659 - DNA, 22 bp, Homo sapiens
tggaagagaaaggagtggatct

SEQ ID NO: 8340660 - DNA, 22 bp, Homo sapiens
tggacaacatagtgagacctca

SEQ ID NO: 8340661 - DNA, 22 bp, Homo sapiens
tggacaacatagtgagacctca

SEQ ID NO: 8340662 - DNA, 22 bp, Homo sapiens
tggaatgaaaagtacttcagaa

SEQ ID NO: 8340663 - DNA, 22 bp, Homo sapiens
tggaatgacagagagtctgaat

SEQ ID NO: 8340664 - DNA, 23 bp, Homo sapiens
tggaatgagctgggaagctgagc

SEQ ID NO: 8340665 - DNA, 22 bp, Homo sapiens
tggacagcgaaagtgcctggga

SEQ ID NO: 8340666 - DNA, 22 bp, Homo sapiens
tggacactggagattcgtcagt

SEQ ID NO: 8340667 - DNA, 22 bp, Homo sapiens
tggaccctgaagcaacagggag

SEQ ID NO: 8340668 - DNA, 22 bp, Homo sapiens
tggaccggcagtggctatacag

SEQ ID NO: 8340669 - DNA, 23 bp, Homo sapiens
tggaccctgcacaccagctctac

SEQ ID NO: 8340670 - DNA, 22 bp, Homo sapiens
tggactctgaactggcactgac

SEQ ID NO: 8340671 - DNA, 21 bp, Homo sapiens
tggacttatggagtgtttctt

SEQ ID NO: 8340672 - DNA, 22 bp, Homo sapiens
tggactcagtgctgccattccc

SEQ ID NO: 8340673 - DNA, 22 bp, Homo sapiens
tggactcagaagtgttctttta

SEQ ID NO: 8340674 - DNA, 22 bp, Homo sapiens
tggactcagagttggtggcagt

SEQ ID NO: 8340675 - DNA, 22 bp, Homo sapiens
tggactcagagttggtggcagt

SEQ ID NO: 8340676 - DNA, 22 bp, Homo sapiens
tggactcaagtccaagttcacg

SEQ ID NO: 8340677 - DNA, 22 bp, Homo sapiens
tgcttgagacacatatgaattt

SEQ ID NO: 8340678 - DNA, 22 bp, Homo sapiens
tgcttgatgattgctgtctccc

SEQ ID NO: 8340679 - DNA, 22 bp, Homo sapiens
tgcttgatttggcagtgtattc

SEQ ID NO: 8340680 - DNA, 22 bp, Homo sapiens
tgcttgattagggaagtcacat

SEQ ID NO: 8340681 - DNA, 22 bp, Homo sapiens
tgcttgcatccaacattaaggg

SEQ ID NO: 8340682 - DNA, 22 bp, Homo sapiens
tgcttctgtttgtttctgtcat

SEQ ID NO: 8340683 - DNA, 22 bp, Homo sapiens
tgctttgcctgctttgactcat

SEQ ID NO: 8340684 - DNA, 21 bp, Homo sapiens
tgctttgctcgttcccagagt

SEQ ID NO: 8340685 - DNA, 21 bp, Homo sapiens
tgctttatgggaaaaatgtca

SEQ ID NO: 8340686 - DNA, 22 bp, Homo sapiens
tgctttataacttagtttatgg

SEQ ID NO: 8340687 - DNA, 22 bp, Homo sapiens
tggaaatacaagaagtatgtca

SEQ ID NO: 8340688 - DNA, 22 bp, Homo sapiens
tggaaatacttgccataaaact

SEQ ID NO: 8340689 - DNA, 22 bp, Homo sapiens
tggaaaggaggcttgtggaata

SEQ ID NO: 8340690 - DNA, 22 bp, Homo sapiens
tggaaagatgaagatgtttaag

SEQ ID NO: 8340691 - DNA, 22 bp, Homo sapiens
tggaaatagtaatgcataagtg

SEQ ID NO: 8340692 - DNA, 22 bp, Homo sapiens
tggaaatagtaatgcataagtg

SEQ ID NO: 8340693 - DNA, 22 bp, Homo sapiens
tggaaatagttgtgagtcaggc

SEQ ID NO: 8340694 - DNA, 22 bp, Homo sapiens
tggaaatagctccagtttcatt

SEQ ID NO: 8340695 - DNA, 22 bp, Homo sapiens
tggaaatatgctccattctttt

SEQ ID NO: 8340696 - DNA, 22 bp, Homo sapiens
tggaaatagctccagttaagca

SEQ ID NO: 8340697 - DNA, 22 bp, Homo sapiens
tggaaatagctccagtttcatt

SEQ ID NO: 8340698 - DNA, 22 bp, Homo sapiens
tggaaatagatagtatcattca

SEQ ID NO: 8340699 - DNA, 22 bp, Homo sapiens
tggaaatattgggtaatagttg

SEQ ID NO: 8340700 - DNA, 23 bp, Homo sapiens
tggaaatctgggtgaggacagaa

SEQ ID NO: 8340701 - DNA, 22 bp, Homo sapiens
tggaacactttcagtagctatt

SEQ ID NO: 8340702 - DNA, 22 bp, Homo sapiens
tggaacacatctaaggaagcag

SEQ ID NO: 8340703 - DNA, 22 bp, Homo sapiens
tggaaaatgtgactattctaaa

SEQ ID NO: 8340704 - DNA, 22 bp, Homo sapiens
tggaaaatgtgactattctaaa

SEQ ID NO: 8340705 - DNA, 22 bp, Homo sapiens
tggaaaattagtagtgaaaggc

SEQ ID NO: 8340706 - DNA, 22 bp, Homo sapiens
tggaaacacccacgcatgcata

SEQ ID NO: 8340707 - DNA, 22 bp, Homo sapiens
tggaaacaaagtcataagctca

SEQ ID NO: 8340708 - DNA, 22 bp, Homo sapiens
tggaaacaaagtcataagctca

SEQ ID NO: 8340709 - DNA, 21 bp, Homo sapiens
tggaaaacatttaaatagcaa

SEQ ID NO: 8340710 - DNA, 22 bp, Homo sapiens
tggaaaatatttaggtgaatga

SEQ ID NO: 8340711 - DNA, 22 bp, Homo sapiens
tggaaacactgcatgttcaccc

SEQ ID NO: 8340712 - DNA, 22 bp, Homo sapiens
tggaaacaggagaatatcttct

SEQ ID NO: 8340713 - DNA, 22 bp, Homo sapiens
tgcttttaagaacaatgctgct

SEQ ID NO: 8340714 - DNA, 22 bp, Homo sapiens
tgctttggccactagaattcag

SEQ ID NO: 8340715 - DNA, 22 bp, Homo sapiens
tgctttttagtactgtcttatt

SEQ ID NO: 8340716 - DNA, 20 bp, Homo sapiens
tgcttttatacctataatga

SEQ ID NO: 8340717 - DNA, 22 bp, Homo sapiens
tgcttttaggagattaaaatta

SEQ ID NO: 8340718 - DNA, 22 bp, Homo sapiens
tgctttttgcaccctttgccgt

SEQ ID NO: 8340719 - DNA, 22 bp, Homo sapiens
tggagcagagatggtggccttc

SEQ ID NO: 8340720 - DNA, 22 bp, Homo sapiens
tggagcagaggaagaaggcttt

SEQ ID NO: 8340721 - DNA, 22 bp, Homo sapiens
tggagcagaggctgaggttggg

SEQ ID NO: 8340722 - DNA, 22 bp, Homo sapiens
tggagcagagttcagcggggag

SEQ ID NO: 8340723 - DNA, 22 bp, Homo sapiens
tggagcagcattcatccagcag

SEQ ID NO: 8340724 - DNA, 22 bp, Homo sapiens
tggagcagcatcactttgagct

SEQ ID NO: 8340725 - DNA, 22 bp, Homo sapiens
tggagcagcacaagaaagggga

SEQ ID NO: 8340726 - DNA, 22 bp, Homo sapiens
tggagcagccatgatgacagag

SEQ ID NO: 8340727 - DNA, 22 bp, Homo sapiens
tggagcagccttttctaagcaa

SEQ ID NO: 8340728 - DNA, 22 bp, Homo sapiens
tggagcagagatgggagcccaa

SEQ ID NO: 8340729 - DNA, 22 bp, Homo sapiens
tggagagctgttgaaatgcaga

SEQ ID NO: 8340730 - DNA, 22 bp, Homo sapiens
tggagagcaagtcgcagacatg

SEQ ID NO: 8340731 - DNA, 22 bp, Homo sapiens
tggagagcaatgaggggcaggc

SEQ ID NO: 8340732 - DNA, 22 bp, Homo sapiens
tggagagcaatgaggggcaggc

SEQ ID NO: 8340733 - DNA, 18 bp, Homo sapiens
tggagagcagcagtgggg

SEQ ID NO: 8340734 - DNA, 22 bp, Homo sapiens
tggagaaagctgcatatggaaa

SEQ ID NO: 8340735 - DNA, 22 bp, Homo sapiens
tggagaagctgtaggtggactc

SEQ ID NO: 8340736 - DNA, 22 bp, Homo sapiens
tggagcagctgaacagagttga

SEQ ID NO: 8340737 - DNA, 22 bp, Homo sapiens
tggagcagctctagcgggcgcc

SEQ ID NO: 8340738 - DNA, 22 bp, Homo sapiens
tggagcagctctagcgggcgcc

SEQ ID NO: 8340739 - DNA, 22 bp, Homo sapiens
tggagcagctaagcctctgaga

SEQ ID NO: 8340740 - DNA, 18 bp, Homo sapiens
tggagcaggaagcctggc

SEQ ID NO: 8340741 - DNA, 22 bp, Homo sapiens
tggagcaggacggggagtggta

SEQ ID NO: 8340742 - DNA, 22 bp, Homo sapiens
tggagcaggtgccaggtgtgtg

SEQ ID NO: 8340743 - DNA, 22 bp, Homo sapiens
tggagcaggtgggatgtcgtga

SEQ ID NO: 8340744 - DNA, 22 bp, Homo sapiens
tggagcaggtgctcagggtaat

SEQ ID NO: 8340745 - DNA, 22 bp, Homo sapiens
tggagccaggagcctgggagtc

SEQ ID NO: 8340746 - DNA, 22 bp, Homo sapiens
tggagccagcccaggcccctct

SEQ ID NO: 8340747 - DNA, 22 bp, Homo sapiens
tggagccagcggcctgctgagg

SEQ ID NO: 8340748 - DNA, 23 bp, Homo sapiens
tggagctgacagtcagagggagg

SEQ ID NO: 8340749 - DNA, 23 bp, Homo sapiens
tggagctgacagtcagagggagg

SEQ ID NO: 8340750 - DNA, 22 bp, Homo sapiens
tggagctgaactttgaggccag

SEQ ID NO: 8340751 - DNA, 20 bp, Homo sapiens
tggagctccagcgtccatgt

SEQ ID NO: 8340752 - DNA, 22 bp, Homo sapiens
tggagcccatgagccataccag

SEQ ID NO: 8340753 - DNA, 22 bp, Homo sapiens
tggagcccctcacccacacctg

SEQ ID NO: 8340754 - DNA, 22 bp, Homo sapiens
tggagcccctcacccacacctg

SEQ ID NO: 8340755 - DNA, 18 bp, Homo sapiens
tggagccattgccaccat

SEQ ID NO: 8340756 - DNA, 22 bp, Homo sapiens
tggagccaggctggccctgcca

SEQ ID NO: 8340757 - DNA, 21 bp, Homo sapiens
tggagctgccacttgagctgc

SEQ ID NO: 8340758 - DNA, 22 bp, Homo sapiens
tggagctggaagaatgtagacg

SEQ ID NO: 8340759 - DNA, 18 bp, Homo sapiens
tggagctgagtgctgtgc

SEQ ID NO: 8340760 - DNA, 18 bp, Homo sapiens
tggagctgagtgctgtgc

SEQ ID NO: 8340761 - DNA, 22 bp, Homo sapiens
tggagctggcttgtggaagttg

SEQ ID NO: 8340762 - DNA, 22 bp, Homo sapiens
tggagctggcttgtggaagttg

SEQ ID NO: 8340763 - DNA, 22 bp, Homo sapiens
tggagctggcagcggaaaaggg

SEQ ID NO: 8340764 - DNA, 22 bp, Homo sapiens
tggagctggaatttgagctgga

SEQ ID NO: 8340765 - DNA, 22 bp, Homo sapiens
tggagctggaatttgagctgga

SEQ ID NO: 8340766 - DNA, 22 bp, Homo sapiens
tggagctggaagacagtgatat

SEQ ID NO: 8340767 - DNA, 22 bp, Homo sapiens
tggagctggaagacagtgatat

SEQ ID NO: 8340768 - DNA, 22 bp, Homo sapiens
tggaggcccacactgggtagat

SEQ ID NO: 8340769 - DNA, 22 bp, Homo sapiens
tggaggccatgccagagcccta

SEQ ID NO: 8340770 - DNA, 22 bp, Homo sapiens
tggaggccatgccagagcccta

SEQ ID NO: 8340771 - DNA, 22 bp, Homo sapiens
tggaggcagtcacctgaagtca

SEQ ID NO: 8340772 - DNA, 22 bp, Homo sapiens
tggaggccatacctcctgacat

SEQ ID NO: 8340773 - DNA, 22 bp, Homo sapiens
tggaggcaggttagccagacga

SEQ ID NO: 8340774 - DNA, 22 bp, Homo sapiens
tggaggccgcgtagtctgagca

SEQ ID NO: 8340775 - DNA, 22 bp, Homo sapiens
tggaggccgcgtagtctgagca

SEQ ID NO: 8340776 - DNA, 22 bp, Homo sapiens
tggaggccggactgagaggcat

SEQ ID NO: 8340777 - DNA, 22 bp, Homo sapiens
tggaggctggagtgcagtggcg

SEQ ID NO: 8340778 - DNA, 22 bp, Homo sapiens
tggaggcaggtggaggagtgaa

SEQ ID NO: 8340779 - DNA, 22 bp, Homo sapiens
tggaggcaggagacagggcaaa

SEQ ID NO: 8340780 - DNA, 18 bp, Homo sapiens
tggaggcagagttctggc

SEQ ID NO: 8340781 - DNA, 20 bp, Homo sapiens
tggaggcacctgtggagatc

SEQ ID NO: 8340782 - DNA, 22 bp, Homo sapiens
tggaggagggctggtgtctgta

SEQ ID NO: 8340783 - DNA, 22 bp, Homo sapiens
tggaggagggctggtgtctgta

SEQ ID NO: 8340784 - DNA, 22 bp, Homo sapiens
tggaggagaccattccactcag

SEQ ID NO: 8340785 - DNA, 22 bp, Homo sapiens
tggagctgtcactcagaaccaa

SEQ ID NO: 8340786 - DNA, 20 bp, Homo sapiens
tggagctgtggtaaggagca

SEQ ID NO: 8340787 - DNA, 22 bp, Homo sapiens
tggagctggttctggggaagct

SEQ ID NO: 8340788 - DNA, 22 bp, Homo sapiens
tggagctggtaaacagtgacat

SEQ ID NO: 8340789 - DNA, 23 bp, Homo sapiens
tggagctgggatttgatttgatt

SEQ ID NO: 8340790 - DNA, 23 bp, Homo sapiens
tggagctgggctcagaccctggg

SEQ ID NO: 8340791 - DNA, 22 bp, Homo sapiens
tggagctggggtttgaatctgg

SEQ ID NO: 8340792 - DNA, 22 bp, Homo sapiens
tggaggtgtccaactcgtgggt

SEQ ID NO: 8340793 - DNA, 22 bp, Homo sapiens
tggagtcccactgggaactggg

SEQ ID NO: 8340794 - DNA, 22 bp, Homo sapiens
tggagttcttgttctatgcaag

SEQ ID NO: 8340795 - DNA, 22 bp, Homo sapiens
tggagttctttttcaagataga

SEQ ID NO: 8340796 - DNA, 22 bp, Homo sapiens
tggatgctgtaggacacgctct

SEQ ID NO: 8340797 - DNA, 22 bp, Homo sapiens
tggatgctgagaacactgcctg

SEQ ID NO: 8340798 - DNA, 20 bp, Homo sapiens
tggatgctgcacgtagatgg

SEQ ID NO: 8340799 - DNA, 22 bp, Homo sapiens
tggatgctatggagtatttaga

SEQ ID NO: 8340800 - DNA, 22 bp, Homo sapiens
tggatacagctgatagcaggat

SEQ ID NO: 8340801 - DNA, 22 bp, Homo sapiens
tggatacaaaaacaatctctac

SEQ ID NO: 8340802 - DNA, 22 bp, Homo sapiens
tggaggctgtgtgcatgagacc

SEQ ID NO: 8340803 - DNA, 22 bp, Homo sapiens
tggaggctggtttctgctgagg

SEQ ID NO: 8340804 - DNA, 22 bp, Homo sapiens
tggaggctggtttctgctgagg

SEQ ID NO: 8340805 - DNA, 22 bp, Homo sapiens
tggaggctggtttctgctgagg

SEQ ID NO: 8340806 - DNA, 22 bp, Homo sapiens
tggagggaacaaaggagtccca

SEQ ID NO: 8340807 - DNA, 22 bp, Homo sapiens
tggagggcatgctgtccatggg

SEQ ID NO: 8340808 - DNA, 22 bp, Homo sapiens
tggaggtggcatctgacagctg

SEQ ID NO: 8340809 - DNA, 22 bp, Homo sapiens
tggagggctaagctgagggata

SEQ ID NO: 8340810 - DNA, 18 bp, Homo sapiens
tggagggcttgctgcagc

SEQ ID NO: 8340811 - DNA, 19 bp, Homo sapiens
tggtctctgtctctttgca

SEQ ID NO: 8340812 - DNA, 22 bp, Homo sapiens
tggtctctgctgcagcttctca

SEQ ID NO: 8340813 - DNA, 22 bp, Homo sapiens
tggtctctgcaggccaggctca

SEQ ID NO: 8340814 - DNA, 22 bp, Homo sapiens
tggtccttcgtggtgcagttct

SEQ ID NO: 8340815 - DNA, 22 bp, Homo sapiens
tggtcctgtctcaaggagcctt

SEQ ID NO: 8340816 - DNA, 22 bp, Homo sapiens
tggtcctggggtgcaggctgac

SEQ ID NO: 8340817 - DNA, 22 bp, Homo sapiens
tggtcctggtagcggtgtgctt

SEQ ID NO: 8340818 - DNA, 22 bp, Homo sapiens
tggtcctggtcatctgggctgg

SEQ ID NO: 8340819 - DNA, 22 bp, Homo sapiens
tggtcagttgcatcagagaagt

SEQ ID NO: 8340820 - DNA, 22 bp, Homo sapiens
tggtcagttgtgactagaacac

SEQ ID NO: 8340821 - DNA, 22 bp, Homo sapiens
tggtcctgatcaccgctgggca

SEQ ID NO: 8340822 - DNA, 22 bp, Homo sapiens
tggtcctgaggcttgtttccac

SEQ ID NO: 8340823 - DNA, 22 bp, Homo sapiens
tggtcctgccccgtgcacagag

SEQ ID NO: 8340824 - DNA, 22 bp, Homo sapiens
tggtgcagttcccagggccggg

SEQ ID NO: 8340825 - DNA, 22 bp, Homo sapiens
tggtgcagtccaaagggagcag

SEQ ID NO: 8340826 - DNA, 22 bp, Homo sapiens
tggtgccatcatagctcactgc

SEQ ID NO: 8340827 - DNA, 22 bp, Homo sapiens
tggtgccattagccctgctgtt

SEQ ID NO: 8340828 - DNA, 22 bp, Homo sapiens
tggtgcagtagagctgtctggg

SEQ ID NO: 8340829 - DNA, 22 bp, Homo sapiens
tggtgcagtagaaggccgactt

SEQ ID NO: 8340830 - DNA, 22 bp, Homo sapiens
tggtgcaggagttggcagggac

SEQ ID NO: 8340831 - DNA, 22 bp, Homo sapiens
tggtggagacctcgctaacccc

SEQ ID NO: 8340832 - DNA, 22 bp, Homo sapiens
tggtgctgtggaggggcagaag

SEQ ID NO: 8340833 - DNA, 23 bp, Homo sapiens
tggtgcctcagaagcagtgggct

SEQ ID NO: 8340834 - DNA, 22 bp, Homo sapiens
tggtggcaacattgctggagtg

SEQ ID NO: 8340835 - DNA, 19 bp, Homo sapiens
tggtggaggtgcacctgac

SEQ ID NO: 8340836 - DNA, 22 bp, Homo sapiens
tggtgggagtgagggcatgcca

SEQ ID NO: 8340837 - DNA, 22 bp, Homo sapiens
tggtgggcacagtgcccaggct

SEQ ID NO: 8340838 - DNA, 22 bp, Homo sapiens
tggtgggctgagtctcatcgga

SEQ ID NO: 8340839 - DNA, 23 bp, Homo sapiens
tggtgggccctgcttgctcactg

SEQ ID NO: 8340840 - DNA, 22 bp, Homo sapiens
tggtggccaattcacagggctc

SEQ ID NO: 8340841 - DNA, 23 bp, Homo sapiens
tgtaacaatttcatatacatgca

SEQ ID NO: 8340842 - DNA, 23 bp, Homo sapiens
tgtaacaatttcatatacatgca

SEQ ID NO: 8340843 - DNA, 22 bp, Homo sapiens
tgtaacaatttcttactattgt

SEQ ID NO: 8340844 - DNA, 22 bp, Homo sapiens
tgtaacatcacagtgatgtttg

SEQ ID NO: 8340845 - DNA, 22 bp, Homo sapiens
tgtaacatcactaccatgtggt

SEQ ID NO: 8340846 - DNA, 21 bp, Homo sapiens
tgtaacaaaatactgcagatt

SEQ ID NO: 8340847 - DNA, 22 bp, Homo sapiens
tgtaaattggaaatcaatcaag

SEQ ID NO: 8340848 - DNA, 22 bp, Homo sapiens
tgtaacaatgaatatagtgact

SEQ ID NO: 8340849 - DNA, 22 bp, Homo sapiens
tgtaacaaatacccttgaagtt

SEQ ID NO: 8340850 - DNA, 22 bp, Homo sapiens
tgtaagaacaactgtcaaatgt

SEQ ID NO: 8340851 - DNA, 22 bp, Homo sapiens
tgtaagagaaaagtgatcgtgg

SEQ ID NO: 8340852 - DNA, 22 bp, Homo sapiens
tgtaagaaaacctgtacaaaga

SEQ ID NO: 8340853 - DNA, 22 bp, Homo sapiens
tgtaactcagaaagtcttcatt

SEQ ID NO: 8340854 - DNA, 22 bp, Homo sapiens
tgtacaaagagtatagctttga

SEQ ID NO: 8340855 - DNA, 22 bp, Homo sapiens
tgtacacaacctacagtctgct

SEQ ID NO: 8340856 - DNA, 22 bp, Homo sapiens
tgtacacaacctacagtctgct

SEQ ID NO: 8340857 - DNA, 22 bp, Homo sapiens
tgtacaatgccgagactaactc

SEQ ID NO: 8340858 - DNA, 22 bp, Homo sapiens
tgtacacaattcttaacataca

SEQ ID NO: 8340859 - DNA, 23 bp, Homo sapiens
tgtacaagtacgacctctccctc

SEQ ID NO: 8340860 - DNA, 22 bp, Homo sapiens
tgtacaaggccatctacatgct

SEQ ID NO: 8340861 - DNA, 22 bp, Homo sapiens
tgtacaatgccagggaacacca

SEQ ID NO: 8340862 - DNA, 19 bp, Homo sapiens
tgtacaaggattatgcagg

SEQ ID NO: 8340863 - DNA, 22 bp, Homo sapiens
tgtacacattaagctctttaga

SEQ ID NO: 8340864 - DNA, 22 bp, Homo sapiens
tgtacacatgcccacttgaagc

SEQ ID NO: 8340865 - DNA, 22 bp, Homo sapiens
tgtacacatggtgtacactccc

SEQ ID NO: 8340866 - DNA, 22 bp, Homo sapiens
tgtacacattaagctctttaga

SEQ ID NO: 8340867 - DNA, 22 bp, Homo sapiens
tgtacacatttattctctctca

SEQ ID NO: 8340868 - DNA, 22 bp, Homo sapiens
tgtaccataatgtgtattttaa

SEQ ID NO: 8340869 - DNA, 22 bp, Homo sapiens
tgtacagtcatgctttctgttc

SEQ ID NO: 8340870 - DNA, 22 bp, Homo sapiens
tgtacagtgccatgcagtttgc

SEQ ID NO: 8340871 - DNA, 21 bp, Homo sapiens
tggtttgcggccaaagttaaa

SEQ ID NO: 8340872 - DNA, 22 bp, Homo sapiens
tggtttgcccactcgagtgatt

SEQ ID NO: 8340873 - DNA, 22 bp, Homo sapiens
tgtaaataatgcatgtaaatca

SEQ ID NO: 8340874 - DNA, 22 bp, Homo sapiens
tgtaaagatccttagcaacatc

SEQ ID NO: 8340875 - DNA, 22 bp, Homo sapiens
tgtaaagattagattacatgaa

SEQ ID NO: 8340876 - DNA, 22 bp, Homo sapiens
tgtaaagcaactgatctgctcc

SEQ ID NO: 8340877 - DNA, 22 bp, Homo sapiens
tgtaaagcatttcctaaatcca

SEQ ID NO: 8340878 - DNA, 22 bp, Homo sapiens
tgtaaagagaaggcttataaag

SEQ ID NO: 8340879 - DNA, 18 bp, Homo sapiens
tgtaaacactttcattct

SEQ ID NO: 8340880 - DNA, 22 bp, Homo sapiens
tggtttatatcttgattctagt

SEQ ID NO: 8340881 - DNA, 22 bp, Homo sapiens
tggtttataacatgtctcatga

SEQ ID NO: 8340882 - DNA, 23 bp, Homo sapiens
tggtttatgatatgtatgggaat

SEQ ID NO: 8340883 - DNA, 22 bp, Homo sapiens
tggtttatgctgttgcagctct

SEQ ID NO: 8340884 - DNA, 22 bp, Homo sapiens
tggtttcccattatctgcagga

SEQ ID NO: 8340885 - DNA, 22 bp, Homo sapiens
tgtatatacatacacacatgaa

SEQ ID NO: 8340886 - DNA, 22 bp, Homo sapiens
tgtatataagcatttacttgtt

SEQ ID NO: 8340887 - DNA, 22 bp, Homo sapiens
tgtatacaggattactcatagc

SEQ ID NO: 8340888 - DNA, 22 bp, Homo sapiens
tgtatacatttaactagataga

SEQ ID NO: 8340889 - DNA, 21 bp, Homo sapiens
tgtatacacacatatatgtac

SEQ ID NO: 8340890 - DNA, 21 bp, Homo sapiens
tgtatacacgtgttgaaaaca

SEQ ID NO: 8340891 - DNA, 23 bp, Homo sapiens
tgtatctgtactattcctgcctc

SEQ ID NO: 8340892 - DNA, 22 bp, Homo sapiens
tgtatgcaataataactatgtg

SEQ ID NO: 8340893 - DNA, 22 bp, Homo sapiens
tgtatgcaaatttattagcaca

SEQ ID NO: 8340894 - DNA, 22 bp, Homo sapiens
tgtatgaatatgtattttcata

SEQ ID NO: 8340895 - DNA, 22 bp, Homo sapiens
tgtatattgcctgagtctttcc

SEQ ID NO: 8340896 - DNA, 22 bp, Homo sapiens
tgtatattgcctgagtctttcc

SEQ ID NO: 8340897 - DNA, 22 bp, Homo sapiens
tgtatatgagtctgagtgtaca

SEQ ID NO: 8340898 - DNA, 22 bp, Homo sapiens
tgtatatatttctttcattcta

SEQ ID NO: 8340899 - DNA, 22 bp, Homo sapiens
tgtatatgtgatgtacatgtac

SEQ ID NO: 8340900 - DNA, 22 bp, Homo sapiens
tgtagctttatattgtgttggg

SEQ ID NO: 8340901 - DNA, 22 bp, Homo sapiens
tgtagcttcagtctgatctcat

SEQ ID NO: 8340902 - DNA, 21 bp, Homo sapiens
tgtagataaggttgtggagta

SEQ ID NO: 8340903 - DNA, 18 bp, Homo sapiens
tgtagagccaggtttgcc

SEQ ID NO: 8340904 - DNA, 18 bp, Homo sapiens
tgtagaaaagataggaat

SEQ ID NO: 8340905 - DNA, 22 bp, Homo sapiens
tgtacttccccaatgacagcac

SEQ ID NO: 8340906 - DNA, 22 bp, Homo sapiens
tgtacttcaaaccctttggttt

SEQ ID NO: 8340907 - DNA, 22 bp, Homo sapiens
tgtacttctggtgactttatag

SEQ ID NO: 8340908 - DNA, 22 bp, Homo sapiens
tgtactgtatcattgcaacttt

SEQ ID NO: 8340909 - DNA, 22 bp, Homo sapiens
tgtagaaattagtaagatcaac

SEQ ID NO: 8340910 - DNA, 22 bp, Homo sapiens
tgtagaactgacattttggact

SEQ ID NO: 8340911 - DNA, 22 bp, Homo sapiens
tgtagacatgcttttctgatga

SEQ ID NO: 8340912 - DNA, 18 bp, Homo sapiens
tgtagacagggcatggaa

SEQ ID NO: 8340913 - DNA, 22 bp, Homo sapiens
tgtagacagtgggatctctggg

SEQ ID NO: 8340914 - DNA, 22 bp, Homo sapiens
tgtcacattgaatatgatttat

SEQ ID NO: 8340915 - DNA, 21 bp, Homo sapiens
tgtcacatgtggatggtattt

SEQ ID NO: 8340916 - DNA, 22 bp, Homo sapiens
tgtcacataggcaaaatgtttt

SEQ ID NO: 8340917 - DNA, 22 bp, Homo sapiens
tgtatttttagacctttagacc

SEQ ID NO: 8340918 - DNA, 22 bp, Homo sapiens
tgtcaaaaccttggaggcaagg

SEQ ID NO: 8340919 - DNA, 22 bp, Homo sapiens
tgtattttcagagtggcatttc

SEQ ID NO: 8340920 - DNA, 22 bp, Homo sapiens
tgtattttctgaggagcattag

SEQ ID NO: 8340921 - DNA, 22 bp, Homo sapiens
tgtatttggtgtatttaatgag

SEQ ID NO: 8340922 - DNA, 22 bp, Homo sapiens
tgtatttattcttctggtgttt

SEQ ID NO: 8340923 - DNA, 22 bp, Homo sapiens
tgtatttagtccagtctctcat

SEQ ID NO: 8340924 - DNA, 22 bp, Homo sapiens
tgtatttaattgtatcatcaca

SEQ ID NO: 8340925 - DNA, 22 bp, Homo sapiens
tgtatttaagctttacctaaaa

SEQ ID NO: 8340926 - DNA, 22 bp, Homo sapiens
tgtatgcacatggataagtatg

SEQ ID NO: 8340927 - DNA, 22 bp, Homo sapiens
tgtatgcatctttgataaatag

SEQ ID NO: 8340928 - DNA, 22 bp, Homo sapiens
tgtatgcataaaattatttaca

SEQ ID NO: 8340929 - DNA, 17 bp, Homo sapiens
tgtatgcataaaattta

SEQ ID NO: 8340930 - DNA, 22 bp, Homo sapiens
tgtcctggtgcttcttgggatt

SEQ ID NO: 8340931 - DNA, 22 bp, Homo sapiens
tgtcctgggtggatgcttcatt

SEQ ID NO: 8340932 - DNA, 22 bp, Homo sapiens
tgtcctgggtggatgcttcatt

SEQ ID NO: 8340933 - DNA, 22 bp, Homo sapiens
tgtcctgggtggatgcttcatt

SEQ ID NO: 8340934 - DNA, 21 bp, Homo sapiens
tgtcctggtcactgctctccc

SEQ ID NO: 8340935 - DNA, 22 bp, Homo sapiens
tgtcctggtgctccaggtggct

SEQ ID NO: 8340936 - DNA, 22 bp, Homo sapiens
tgtcctgggaactcacagtcca

SEQ ID NO: 8340937 - DNA, 22 bp, Homo sapiens
tgtcctcaggacctggcacagt

SEQ ID NO: 8340938 - DNA, 22 bp, Homo sapiens
tgtcctcaggacctggcacagt

SEQ ID NO: 8340939 - DNA, 19 bp, Homo sapiens
tgtcctcacagagcataac

SEQ ID NO: 8340940 - DNA, 22 bp, Homo sapiens
tgtcctcacacgtagggagtaa

SEQ ID NO: 8340941 - DNA, 22 bp, Homo sapiens
tgtcccagtttatctgggactg

SEQ ID NO: 8340942 - DNA, 22 bp, Homo sapiens
tgtcccagggaaggcccagcac

SEQ ID NO: 8340943 - DNA, 20 bp, Homo sapiens
tgtcccctagatcccagctc

SEQ ID NO: 8340944 - DNA, 22 bp, Homo sapiens
tgtccccattctaagaggtggc

SEQ ID NO: 8340945 - DNA, 22 bp, Homo sapiens
tgtccccattctaagaggtggc

SEQ ID NO: 8340946 - DNA, 22 bp, Homo sapiens
tgtccccaggtcctctgccgtc

SEQ ID NO: 8340947 - DNA, 22 bp, Homo sapiens
tgtccccaaggttcagcccaca

SEQ ID NO: 8340948 - DNA, 22 bp, Homo sapiens
tgtccccaaggttcagcccaca

SEQ ID NO: 8340949 - DNA, 22 bp, Homo sapiens
tgtcagtggtaaggttgggagt

SEQ ID NO: 8340950 - DNA, 22 bp, Homo sapiens
tgtcagtggacctggagaggcc

SEQ ID NO: 8340951 - DNA, 22 bp, Homo sapiens
tgtcagtgatttgtagggaatt

SEQ ID NO: 8340952 - DNA, 22 bp, Homo sapiens
tgtcactttggggagagttttg

SEQ ID NO: 8340953 - DNA, 22 bp, Homo sapiens
tgtccacatcactcacttgtca

SEQ ID NO: 8340954 - DNA, 22 bp, Homo sapiens
tgtccagcggcctggctgctga

SEQ ID NO: 8340955 - DNA, 22 bp, Homo sapiens
tgtccagccggagtcggttaga

SEQ ID NO: 8340956 - DNA, 22 bp, Homo sapiens
tgtccagcacagccaggcttac

SEQ ID NO: 8340957 - DNA, 22 bp, Homo sapiens
tgtccagctgacattcccttcc

SEQ ID NO: 8340958 - DNA, 22 bp, Homo sapiens
tgtccagctgaaggcagcctca

SEQ ID NO: 8340959 - DNA, 22 bp, Homo sapiens
tgtccagctcgagacactatct

SEQ ID NO: 8340960 - DNA, 20 bp, Homo sapiens
tgtcatttatttatcaaatg

SEQ ID NO: 8340961 - DNA, 18 bp, Homo sapiens
tgtcattgccagggaagc

SEQ ID NO: 8340962 - DNA, 22 bp, Homo sapiens
tgtcattgaggaaaactaggtg

SEQ ID NO: 8340963 - DNA, 22 bp, Homo sapiens
tgtcattcatttaagtatgttt

SEQ ID NO: 8340964 - DNA, 23 bp, Homo sapiens
tgtcattgtgactacagaaccag

SEQ ID NO: 8340965 - DNA, 20 bp, Homo sapiens
tgtcattgtttctaggacct

SEQ ID NO: 8340966 - DNA, 22 bp, Homo sapiens
tgtcatatgttgatgaaagaga

SEQ ID NO: 8340967 - DNA, 21 bp, Homo sapiens
tgtcatatttcaatacagttt

SEQ ID NO: 8340968 - DNA, 22 bp, Homo sapiens
tgtcatgcaggtttgttataga

SEQ ID NO: 8340969 - DNA, 22 bp, Homo sapiens
tgtcatcttaaatcattcccac

SEQ ID NO: 8340970 - DNA, 22 bp, Homo sapiens
tgggccagggcacccagtccag

SEQ ID NO: 8340971 - DNA, 23 bp, Homo sapiens
tgggccagggagtccggtttctt

SEQ ID NO: 8340972 - DNA, 22 bp, Homo sapiens
tgggccaggcatgtgatcagca

SEQ ID NO: 8340973 - DNA, 22 bp, Homo sapiens
tgggccaggggcctcttctgat

SEQ ID NO: 8340974 - DNA, 22 bp, Homo sapiens
tgggccagtccagccccaggga

SEQ ID NO: 8340975 - DNA, 22 bp, Homo sapiens
tgggccaggtctgtgtcagctg

SEQ ID NO: 8340976 - DNA, 22 bp, Homo sapiens
tgggccagtcctgcctaaggtg

SEQ ID NO: 8340977 - DNA, 22 bp, Homo sapiens
tgggccagtccagccccaggga

SEQ ID NO: 8340978 - DNA, 22 bp, Homo sapiens
tgggccagtcctgcctaaggtg

SEQ ID NO: 8340979 - DNA, 22 bp, Homo sapiens
tgggccagttatttcacctctg

SEQ ID NO: 8340980 - DNA, 22 bp, Homo sapiens
tgggccagttctttactcgtcc

SEQ ID NO: 8340981 - DNA, 22 bp, Homo sapiens
tgggcctcatgcccagccaccc

SEQ ID NO: 8340982 - DNA, 22 bp, Homo sapiens
tgggcctcatgcccagccaccc

SEQ ID NO: 8340983 - DNA, 22 bp, Homo sapiens
tgggcctcagtttccttaggat

SEQ ID NO: 8340984 - DNA, 22 bp, Homo sapiens
tgggcctcagtttccttaggat

SEQ ID NO: 8340985 - DNA, 22 bp, Homo sapiens
tgggcctccaattccagcggga

SEQ ID NO: 8340986 - DNA, 22 bp, Homo sapiens
tgggcctcctgccctggcctag

SEQ ID NO: 8340987 - DNA, 22 bp, Homo sapiens
tgggcctccgcatggcccagcg

SEQ ID NO: 8340988 - DNA, 22 bp, Homo sapiens
tgggcctcccatgtcttaggga

SEQ ID NO: 8340989 - DNA, 23 bp, Homo sapiens
tgggcctggaaagccttagagag

SEQ ID NO: 8340990 - DNA, 22 bp, Homo sapiens
tgggcctgggctggacagcctg

SEQ ID NO: 8340991 - DNA, 22 bp, Homo sapiens
tgggcctggacaaggccactag

SEQ ID NO: 8340992 - DNA, 19 bp, Homo sapiens
tgggcctgcatctgggtct

SEQ ID NO: 8340993 - DNA, 18 bp, Homo sapiens
tgggcctgcatcctagtc

SEQ ID NO: 8340994 - DNA, 22 bp, Homo sapiens
tgggcctgagctcaccaggggc

SEQ ID NO: 8340995 - DNA, 21 bp, Homo sapiens
tgggcctgattcccagggtca

SEQ ID NO: 8340996 - DNA, 22 bp, Homo sapiens
tgggcctctgtttcctcatctg

SEQ ID NO: 8340997 - DNA, 20 bp, Homo sapiens
tgggcctctggtgcctctgg

SEQ ID NO: 8340998 - DNA, 22 bp, Homo sapiens
tgggcctcggggaagcccgtgt

SEQ ID NO: 8340999 - DNA, 22 bp, Homo sapiens
tgggcctcctttccattcagag

SEQ ID NO: 8341000 - DNA, 22 bp, Homo sapiens
tgggcctctgccacgctccccc

SEQ ID NO: 8341001 - DNA, 22 bp, Homo sapiens
tgggcctctgggttagtcccta

SEQ ID NO: 8341002 - DNA, 23 bp, Homo sapiens
tgggcgaggcaggagtggagcac

SEQ ID NO: 8341003 - DNA, 22 bp, Homo sapiens
tgggcgaggcccagggctgcgt

SEQ ID NO: 8341004 - DNA, 22 bp, Homo sapiens
tgggcggtgtgcaggctctgct

SEQ ID NO: 8341005 - DNA, 23 bp, Homo sapiens
tgggcggggcttttcactctgcc

SEQ ID NO: 8341006 - DNA, 22 bp, Homo sapiens
tgggcggactcgggcatggaat

SEQ ID NO: 8341007 - DNA, 22 bp, Homo sapiens
tgggcgggcaggagcgcacctg

SEQ ID NO: 8341008 - DNA, 22 bp, Homo sapiens
tgggctagatatttttgggctg

SEQ ID NO: 8341009 - DNA, 22 bp, Homo sapiens
tgggctcagggaagcttggcct

SEQ ID NO: 8341010 - DNA, 22 bp, Homo sapiens
tgggcgacagagcaagactccg

SEQ ID NO: 8341011 - DNA, 22 bp, Homo sapiens
tgggcgaggagaatgctgtgaa

SEQ ID NO: 8341012 - DNA, 20 bp, Homo sapiens
tgggcctgtggcagaagtct

SEQ ID NO: 8341013 - DNA, 22 bp, Homo sapiens
tgggcctgtgatgctgggctat

SEQ ID NO: 8341014 - DNA, 22 bp, Homo sapiens
tgggctctctcacctggaggct

SEQ ID NO: 8341015 - DNA, 22 bp, Homo sapiens
tgggctctcgtccctgcagaag

SEQ ID NO: 8341016 - DNA, 22 bp, Homo sapiens
tgggctctctttacctcataac

SEQ ID NO: 8341017 - DNA, 22 bp, Homo sapiens
tgggctctgggtggcctgagca

SEQ ID NO: 8341018 - DNA, 22 bp, Homo sapiens
tgggctctggagggcctaggat

SEQ ID NO: 8341019 - DNA, 22 bp, Homo sapiens
tgggctctgcatcagtgcccat

SEQ ID NO: 8341020 - DNA, 22 bp, Homo sapiens
tgggctgcccaaggtggccatg

SEQ ID NO: 8341021 - DNA, 22 bp, Homo sapiens
tgggctgccagctctccagatg

SEQ ID NO: 8341022 - DNA, 22 bp, Homo sapiens
tgggctgccctgatggtcctca

SEQ ID NO: 8341023 - DNA, 22 bp, Homo sapiens
tgggctgccggcaggctctgcc

SEQ ID NO: 8341024 - DNA, 22 bp, Homo sapiens
tgggctgcaggggttgagagct

SEQ ID NO: 8341025 - DNA, 22 bp, Homo sapiens
tgggctgcagagcccggccttc

SEQ ID NO: 8341026 - DNA, 22 bp, Homo sapiens
tgggctgcactgctctttatcg

SEQ ID NO: 8341027 - DNA, 22 bp, Homo sapiens
tgggctgcactccattttctgc

SEQ ID NO: 8341028 - DNA, 22 bp, Homo sapiens
tgggctgcacctttgtaaatct

SEQ ID NO: 8341029 - DNA, 22 bp, Homo sapiens
tgggctgcaccctcagcctctg

SEQ ID NO: 8341030 - DNA, 21 bp, Homo sapiens
tgggctctttaacccaggcac

SEQ ID NO: 8341031 - DNA, 22 bp, Homo sapiens
tgggaggcccaggcctggcagg

SEQ ID NO: 8341032 - DNA, 22 bp, Homo sapiens
tgggaggccaaggcaggcggat

SEQ ID NO: 8341033 - DNA, 22 bp, Homo sapiens
tgggaggcaggtaggtgatgat

SEQ ID NO: 8341034 - DNA, 22 bp, Homo sapiens
tgggaggcttccagaccttgct

SEQ ID NO: 8341035 - DNA, 22 bp, Homo sapiens
tgggaggtctcttgcggcctag

SEQ ID NO: 8341036 - DNA, 22 bp, Homo sapiens
tgggaggccgaggcaggtggat

SEQ ID NO: 8341037 - DNA, 22 bp, Homo sapiens
tgggagtgatacagtatggaat

SEQ ID NO: 8341038 - DNA, 22 bp, Homo sapiens
tgggatgaatacaatgggatca

SEQ ID NO: 8341039 - DNA, 19 bp, Homo sapiens
tgggatgatgcagaaggta

SEQ ID NO: 8341040 - DNA, 22 bp, Homo sapiens
tgggatgagttgttaggactga

SEQ ID NO: 8341041 - DNA, 22 bp, Homo sapiens
tgggatgagggtgagccacatg

SEQ ID NO: 8341042 - DNA, 22 bp, Homo sapiens
tgggcaagtatcggactctgag

SEQ ID NO: 8341043 - DNA, 21 bp, Homo sapiens
tgggcaagtttgggggtcctc

SEQ ID NO: 8341044 - DNA, 22 bp, Homo sapiens
tgggcagaggcagcagaaacct

SEQ ID NO: 8341045 - DNA, 22 bp, Homo sapiens
tgggcagaggacagggaagatc

SEQ ID NO: 8341046 - DNA, 22 bp, Homo sapiens
tgggcagagagtagaggcaacg

SEQ ID NO: 8341047 - DNA, 22 bp, Homo sapiens
tgggcagagatctggatcaaac

SEQ ID NO: 8341048 - DNA, 22 bp, Homo sapiens
tgggcagagtcatacaggagac

SEQ ID NO: 8341049 - DNA, 22 bp, Homo sapiens
tgggcagagtcatacaggagac

SEQ ID NO: 8341050 - DNA, 22 bp, Homo sapiens
tgggcagaggctctgaagtcca

SEQ ID NO: 8341051 - DNA, 22 bp, Homo sapiens
tgggcagagtagctcagaagaa

SEQ ID NO: 8341052 - DNA, 22 bp, Homo sapiens
tgggcacaggggaatggatgaa

SEQ ID NO: 8341053 - DNA, 20 bp, Homo sapiens
tgggcacagctttggagggc

SEQ ID NO: 8341054 - DNA, 22 bp, Homo sapiens
tgggcacaggggtaggaatgag

SEQ ID NO: 8341055 - DNA, 22 bp, Homo sapiens
tgggcagactaaggtcaaagct

SEQ ID NO: 8341056 - DNA, 22 bp, Homo sapiens
tgggcagactgagccctgtccc

SEQ ID NO: 8341057 - DNA, 19 bp, Homo sapiens
tgggcagctccctctgtcc

SEQ ID NO: 8341058 - DNA, 22 bp, Homo sapiens
tgggcagggagctggaaccaca

SEQ ID NO: 8341059 - DNA, 22 bp, Homo sapiens
tgggcagggagctggaaccaca

SEQ ID NO: 8341060 - DNA, 22 bp, Homo sapiens
tgggcagggatctcttttgcaa

SEQ ID NO: 8341061 - DNA, 20 bp, Homo sapiens
tgggcagcactgctggctgg

SEQ ID NO: 8341062 - DNA, 20 bp, Homo sapiens
tgggcagcactgctggctgg

SEQ ID NO: 8341063 - DNA, 22 bp, Homo sapiens
tgggcagattaatgcagtggct

SEQ ID NO: 8341064 - DNA, 22 bp, Homo sapiens
tgggcagagtcgtggggaatag

SEQ ID NO: 8341065 - DNA, 22 bp, Homo sapiens
tgggcagagttgtgatgaactg

SEQ ID NO: 8341066 - DNA, 15 bp, Homo sapiens
tgggcagatcacttg

SEQ ID NO: 8341067 - DNA, 22 bp, Homo sapiens
tgggcagatctttggtggctag

SEQ ID NO: 8341068 - DNA, 16 bp, Homo sapiens
tgggcagatgagaaga

SEQ ID NO: 8341069 - DNA, 22 bp, Homo sapiens
tgggcagatgtcctctgaagtg

SEQ ID NO: 8341070 - DNA, 21 bp, Homo sapiens
tgggcagatggcagtgtggct

SEQ ID NO: 8341071 - DNA, 22 bp, Homo sapiens
tgggcagatgtggctctccttg

SEQ ID NO: 8341072 - DNA, 22 bp, Homo sapiens
tgggccagcactgggtgctcat

SEQ ID NO: 8341073 - DNA, 22 bp, Homo sapiens
tgggccagctccctgcccctgg

SEQ ID NO: 8341074 - DNA, 22 bp, Homo sapiens
tgggccagctgaagtgccgccc

SEQ ID NO: 8341075 - DNA, 22 bp, Homo sapiens
tgggccagcaattgctgctcag

SEQ ID NO: 8341076 - DNA, 22 bp, Homo sapiens
tgggccacgtcatctcccacaa

SEQ ID NO: 8341077 - DNA, 22 bp, Homo sapiens
tgggccacaagccatgggacca

SEQ ID NO: 8341078 - DNA, 22 bp, Homo sapiens
tgggcatggactgtggagccgc

SEQ ID NO: 8341079 - DNA, 22 bp, Homo sapiens
tgggcatcccgcgtctggctgc

SEQ ID NO: 8341080 - DNA, 22 bp, Homo sapiens
tgggcagtggctgggcctctct

SEQ ID NO: 8341081 - DNA, 22 bp, Homo sapiens
tgggcagtcatcagcacaccgg

SEQ ID NO: 8341082 - DNA, 22 bp, Homo sapiens
tgggcagtccagctggaaacgg

SEQ ID NO: 8341083 - DNA, 22 bp, Homo sapiens
tgggcaggttgttatttgacat

SEQ ID NO: 8341084 - DNA, 22 bp, Homo sapiens
tgggcaggggccctgcttccgt

SEQ ID NO: 8341085 - DNA, 19 bp, Homo sapiens
tgggcaggttcagtaatgg

SEQ ID NO: 8341086 - DNA, 22 bp, Homo sapiens
tgggcagggtctctgttatcag

SEQ ID NO: 8341087 - DNA, 22 bp, Homo sapiens
tgggcaggtgctattttccatg

SEQ ID NO: 8341088 - DNA, 22 bp, Homo sapiens
tggtatatgcatggaggtatca

SEQ ID NO: 8341089 - DNA, 22 bp, Homo sapiens
tggtaacacaggcattaaagtt

SEQ ID NO: 8341090 - DNA, 22 bp, Homo sapiens
tggtaactgtttagtgttaatg

SEQ ID NO: 8341091 - DNA, 19 bp, Homo sapiens
tggtaactgcatctccaga

SEQ ID NO: 8341092 - DNA, 22 bp, Homo sapiens
tggtaactttcagcatggtgac

SEQ ID NO: 8341093 - DNA, 22 bp, Homo sapiens
tggtaagaacccatcagagaag

SEQ ID NO: 8341094 - DNA, 23 bp, Homo sapiens
tgggtgctaatctgctctgtgga

SEQ ID NO: 8341095 - DNA, 22 bp, Homo sapiens
tgggtgctctgcttccctgcac

SEQ ID NO: 8341096 - DNA, 21 bp, Homo sapiens
tgggtggaagcgggaggccgc

SEQ ID NO: 8341097 - DNA, 22 bp, Homo sapiens
tgggtgggagcgccctgtctgg

SEQ ID NO: 8341098 - DNA, 16 bp, Homo sapiens
tgggtgggaggagcgg

SEQ ID NO: 8341099 - DNA, 21 bp, Homo sapiens
tgggtgggcagagtctcttca

SEQ ID NO: 8341100 - DNA, 22 bp, Homo sapiens
tgggtgtcaatgtcacacgatt

SEQ ID NO: 8341101 - DNA, 20 bp, Homo sapiens
tgggtctgcttggcttcagt

SEQ ID NO: 8341102 - DNA, 22 bp, Homo sapiens
tgggtctgtagggctgtccaat

SEQ ID NO: 8341103 - DNA, 22 bp, Homo sapiens
tggggttgcctcccgccctgga

SEQ ID NO: 8341104 - DNA, 22 bp, Homo sapiens
tgggtaaactgggtctggagag

SEQ ID NO: 8341105 - DNA, 22 bp, Homo sapiens
tgggtagagtggagggataaga

SEQ ID NO: 8341106 - DNA, 22 bp, Homo sapiens
tgggggtgaaagtctggacagt

SEQ ID NO: 8341107 - DNA, 22 bp, Homo sapiens
tgggggtgctgagaagacagga

SEQ ID NO: 8341108 - DNA, 22 bp, Homo sapiens
tggggtctggagttgcccatga

SEQ ID NO: 8341109 - DNA, 22 bp, Homo sapiens
tggggtggaacccttctgctgg

SEQ ID NO: 8341110 - DNA, 22 bp, Homo sapiens
tggggtgacagtgcagtggtca

SEQ ID NO: 8341111 - DNA, 22 bp, Homo sapiens
tggggtgccgacagggagggca

SEQ ID NO: 8341112 - DNA, 22 bp, Homo sapiens
tggggtgggcatgcgctgtcct

SEQ ID NO: 8341113 - DNA, 22 bp, Homo sapiens
tggggatgaaacccaggcatct

SEQ ID NO: 8341114 - DNA, 19 bp, Homo sapiens
tggggatgctgatgaccaa

SEQ ID NO: 8341115 - DNA, 16 bp, Homo sapiens
tggggatggggaagag

SEQ ID NO: 8341116 - DNA, 22 bp, Homo sapiens
tggggatgtaaatgaggtgata

SEQ ID NO: 8341117 - DNA, 22 bp, Homo sapiens
tggggatgtagaaatgaacaac

SEQ ID NO: 8341118 - DNA, 22 bp, Homo sapiens
tggggatgtagaaatgaacaac

SEQ ID NO: 8341119 - DNA, 22 bp, Homo sapiens
tggggatgtcatataagaggaa

SEQ ID NO: 8341120 - DNA, 22 bp, Homo sapiens
tggggaggtaacaatttcaggc

SEQ ID NO: 8341121 - DNA, 21 bp, Homo sapiens
tggggaggggacctgattatg

SEQ ID NO: 8341122 - DNA, 21 bp, Homo sapiens
tggggaggggacctgattatg

SEQ ID NO: 8341123 - DNA, 22 bp, Homo sapiens
tggggaggtaacaatttcaggc

SEQ ID NO: 8341124 - DNA, 22 bp, Homo sapiens
tggggaggttcgggaatcttgt

SEQ ID NO: 8341125 - DNA, 22 bp, Homo sapiens
tggggactgacagccaggcctc

SEQ ID NO: 8341126 - DNA, 22 bp, Homo sapiens
tggggaggaagtcagatttcag

SEQ ID NO: 8341127 - DNA, 22 bp, Homo sapiens
tggggaggaagtcagatttcag

SEQ ID NO: 8341128 - DNA, 23 bp, Homo sapiens
tggggagggaagtcatttctgta

SEQ ID NO: 8341129 - DNA, 23 bp, Homo sapiens
tggggagggaagtcatttctgta

SEQ ID NO: 8341130 - DNA, 22 bp, Homo sapiens
tggggaggatatgtgagttatt

SEQ ID NO: 8341131 - DNA, 22 bp, Homo sapiens
tggggaggacgggcgccttcct

SEQ ID NO: 8341132 - DNA, 22 bp, Homo sapiens
tggggaggacgggcgccttcct

SEQ ID NO: 8341133 - DNA, 22 bp, Homo sapiens
tggggaggatatgtgagttatt

SEQ ID NO: 8341134 - DNA, 22 bp, Homo sapiens
tggggaaggatcaccacaatct

SEQ ID NO: 8341135 - DNA, 16 bp, Homo sapiens
tggggaagctcgtgag

SEQ ID NO: 8341136 - DNA, 22 bp, Homo sapiens
tggggaagggcaccctggagac

SEQ ID NO: 8341137 - DNA, 22 bp, Homo sapiens
tggggacaggagacttacagct

SEQ ID NO: 8341138 - DNA, 22 bp, Homo sapiens
tgggctggctgaggcattcact

SEQ ID NO: 8341139 - DNA, 22 bp, Homo sapiens
tgggggcacttcgaggtcgcct

SEQ ID NO: 8341140 - DNA, 22 bp, Homo sapiens
tgggggctgtgcacaggctcac

SEQ ID NO: 8341141 - DNA, 22 bp, Homo sapiens
tgggggctgagtaagatgagat

SEQ ID NO: 8341142 - DNA, 22 bp, Homo sapiens
tgggggcatggaccagcctggc

SEQ ID NO: 8341143 - DNA, 22 bp, Homo sapiens
tgggggagctcagtccagccca

SEQ ID NO: 8341144 - DNA, 22 bp, Homo sapiens
tgggggagctcagtccagccca

SEQ ID NO: 8341145 - DNA, 22 bp, Homo sapiens
tgggggagtatagtctggcctc

SEQ ID NO: 8341146 - DNA, 22 bp, Homo sapiens
tgggggagtatagtctggcctc

SEQ ID NO: 8341147 - DNA, 22 bp, Homo sapiens
tgggggagccttcacagtagct

SEQ ID NO: 8341148 - DNA, 22 bp, Homo sapiens
tgggggagccttcacagtagct

SEQ ID NO: 8341149 - DNA, 22 bp, Homo sapiens
tgggggagcgacagacataatt

SEQ ID NO: 8341150 - DNA, 22 bp, Homo sapiens
tgggggagattgtgcatctcta

SEQ ID NO: 8341151 - DNA, 22 bp, Homo sapiens
tgggggagagtgcaagcatgaa

SEQ ID NO: 8341152 - DNA, 22 bp, Homo sapiens
tgggggagagtttagatgattt

SEQ ID NO: 8341153 - DNA, 22 bp, Homo sapiens
tgggggagagtttagatgattt

SEQ ID NO: 8341154 - DNA, 22 bp, Homo sapiens
tgggggagagtttagatgattt

SEQ ID NO: 8341155 - DNA, 22 bp, Homo sapiens
tgggggagagaggcattctttc

SEQ ID NO: 8341156 - DNA, 22 bp, Homo sapiens
tgggggagatagagtctgatgg

SEQ ID NO: 8341157 - DNA, 22 bp, Homo sapiens
tgggggagatagagtctgatgg

SEQ ID NO: 8341158 - DNA, 22 bp, Homo sapiens
tgggggagattagagcttctta

SEQ ID NO: 8341159 - DNA, 22 bp, Homo sapiens
tgggggagattgtgcatctcta

SEQ ID NO: 8341160 - DNA, 22 bp, Homo sapiens
tgggggagattagagcttctta

SEQ ID NO: 8341161 - DNA, 22 bp, Homo sapiens
tggggctggggatcttgagcct

SEQ ID NO: 8341162 - DNA, 22 bp, Homo sapiens
tggggctgtcccggtttggcga

SEQ ID NO: 8341163 - DNA, 22 bp, Homo sapiens
tggggctggcacagtctctatt

SEQ ID NO: 8341164 - DNA, 22 bp, Homo sapiens
tggggctggctattgtctccct

SEQ ID NO: 8341165 - DNA, 22 bp, Homo sapiens
tggggctggctattgtctccct

SEQ ID NO: 8341166 - DNA, 22 bp, Homo sapiens
tggggccagagatggggcgcag

SEQ ID NO: 8341167 - DNA, 22 bp, Homo sapiens
tggggccagagctgcagggagc

SEQ ID NO: 8341168 - DNA, 22 bp, Homo sapiens
tggggccagagctgcagggagc

SEQ ID NO: 8341169 - DNA, 22 bp, Homo sapiens
tggggccacagcctcctagctt

SEQ ID NO: 8341170 - DNA, 22 bp, Homo sapiens
tggggccacactgatctcccag

SEQ ID NO: 8341171 - DNA, 22 bp, Homo sapiens
tggggcagagtaggattttggc

SEQ ID NO: 8341172 - DNA, 22 bp, Homo sapiens
tggggccagcggggaggactca

SEQ ID NO: 8341173 - DNA, 22 bp, Homo sapiens
tggggccagggaggaccagaca

SEQ ID NO: 8341174 - DNA, 22 bp, Homo sapiens
tggggccagagctgcagggagc

SEQ ID NO: 8341175 - DNA, 22 bp, Homo sapiens
tggggccagggaggaccagaca

SEQ ID NO: 8341176 - DNA, 22 bp, Homo sapiens
tggggccagggaggaccagaca

SEQ ID NO: 8341177 - DNA, 22 bp, Homo sapiens
tggggccaggtggctgcaggtc

SEQ ID NO: 8341178 - DNA, 22 bp, Homo sapiens
tggggccaggtggctgcaggtc

SEQ ID NO: 8341179 - DNA, 22 bp, Homo sapiens
tggggccatctcacccactgtt

SEQ ID NO: 8341180 - DNA, 22 bp, Homo sapiens
tggggctcatgcctgctggaac

SEQ ID NO: 8341181 - DNA, 22 bp, Homo sapiens
tggggctcacctaggctggaag

SEQ ID NO: 8341182 - DNA, 22 bp, Homo sapiens
tggggctctccacagtgtctca

SEQ ID NO: 8341183 - DNA, 22 bp, Homo sapiens
tggggctcctcctggcaggagg

SEQ ID NO: 8341184 - DNA, 23 bp, Homo sapiens
tggggctctggcaggcctgaggt

SEQ ID NO: 8341185 - DNA, 22 bp, Homo sapiens
tggggctgaggagcctcactct

SEQ ID NO: 8341186 - DNA, 22 bp, Homo sapiens
tggggctgaggagcctcactct

SEQ ID NO: 8341187 - DNA, 23 bp, Homo sapiens
tggggctgatggagacggaccag

SEQ ID NO: 8341188 - DNA, 22 bp, Homo sapiens
tggggcctgaggtggagctgca

SEQ ID NO: 8341189 - DNA, 22 bp, Homo sapiens
tggggcgcccccactccacaga

SEQ ID NO: 8341190 - DNA, 22 bp, Homo sapiens
tggggcgcccccactccacaga

SEQ ID NO: 8341191 - DNA, 22 bp, Homo sapiens
tggggcgcgaggtcctggctcc

SEQ ID NO: 8341192 - DNA, 22 bp, Homo sapiens
ttaaaatgcagattctgattca

SEQ ID NO: 8341193 - DNA, 22 bp, Homo sapiens
tgtttttttatatacctgaagt

SEQ ID NO: 8341194 - DNA, 22 bp, Homo sapiens
ttaaaactgcaaatcctactga

SEQ ID NO: 8341195 - DNA, 22 bp, Homo sapiens
tgtttgtatctctctctgtggc

SEQ ID NO: 8341196 - DNA, 22 bp, Homo sapiens
tgtttgttccctctctttcctg

SEQ ID NO: 8341197 - DNA, 22 bp, Homo sapiens
tgtttgtggttataataagtat

SEQ ID NO: 8341198 - DNA, 22 bp, Homo sapiens
tgttttatgagccatataacct

SEQ ID NO: 8341199 - DNA, 22 bp, Homo sapiens
tgttttagttctgtcttgcatg

SEQ ID NO: 8341200 - DNA, 22 bp, Homo sapiens
tgttttaatctcccattgctct

SEQ ID NO: 8341201 - DNA, 22 bp, Homo sapiens
tgttttaagagcgcactttata

SEQ ID NO: 8341202 - DNA, 22 bp, Homo sapiens
tgttttaaagccattgcctttc

SEQ ID NO: 8341203 - DNA, 18 bp, Homo sapiens
tgtttattctcctgacag

SEQ ID NO: 8341204 - DNA, 22 bp, Homo sapiens
tgtttattgagtgcctactata

SEQ ID NO: 8341205 - DNA, 22 bp, Homo sapiens
tgtttattgagtgcctactata

SEQ ID NO: 8341206 - DNA, 22 bp, Homo sapiens
tgtttattgcagtgctgggctg

SEQ ID NO: 8341207 - DNA, 22 bp, Homo sapiens
tgtttatagggtctgtcacttg

SEQ ID NO: 8341208 - DNA, 21 bp, Homo sapiens
tgtttatggaaaagagacaaa

SEQ ID NO: 8341209 - DNA, 22 bp, Homo sapiens
tgtttattcatggctaatgaaa

SEQ ID NO: 8341210 - DNA, 22 bp, Homo sapiens
tgtttattcatggctaatgaaa

SEQ ID NO: 8341211 - DNA, 22 bp, Homo sapiens
tgtttattcatggctaatgaaa

SEQ ID NO: 8341212 - DNA, 23 bp, Homo sapiens
tgttgtgactggatgctttgtcc

SEQ ID NO: 8341213 - DNA, 22 bp, Homo sapiens
tgttgttacattcctgtgtccc

SEQ ID NO: 8341214 - DNA, 22 bp, Homo sapiens
tgtttaaccaccattctattct

SEQ ID NO: 8341215 - DNA, 21 bp, Homo sapiens
tgtttactccctgcaagcacg

SEQ ID NO: 8341216 - DNA, 22 bp, Homo sapiens
tgttgggatcgaatggtggaac

SEQ ID NO: 8341217 - DNA, 22 bp, Homo sapiens
tgttggggtcaggagctagcct

SEQ ID NO: 8341218 - DNA, 22 bp, Homo sapiens
tgttgattagtgtttagactta

SEQ ID NO: 8341219 - DNA, 22 bp, Homo sapiens
tgttgactggtaactttaaaca

SEQ ID NO: 8341220 - DNA, 18 bp, Homo sapiens
tgttgaaacttcaggtaa

SEQ ID NO: 8341221 - DNA, 20 bp, Homo sapiens
tgttgaattcatggtgactt

SEQ ID NO: 8341222 - DNA, 22 bp, Homo sapiens
tgttaacatgtgtattgtatga

SEQ ID NO: 8341223 - DNA, 22 bp, Homo sapiens
tgttagaaaggctattggacca

SEQ ID NO: 8341224 - DNA, 22 bp, Homo sapiens
tgttaccataggtcagaacgtt

SEQ ID NO: 8341225 - DNA, 22 bp, Homo sapiens
tgttacatttctctttcttgga

SEQ ID NO: 8341226 - DNA, 16 bp, Homo sapiens
tgttagctgtgcatta

SEQ ID NO: 8341227 - DNA, 22 bp, Homo sapiens
tgttagcaaggataattatgat

SEQ ID NO: 8341228 - DNA, 22 bp, Homo sapiens
tgttcttagcaggagcatctat

SEQ ID NO: 8341229 - DNA, 22 bp, Homo sapiens
tgttcttaacttttgtgtatat

SEQ ID NO: 8341230 - DNA, 22 bp, Homo sapiens
tgttcttacggaacttatcttt

SEQ ID NO: 8341231 - DNA, 22 bp, Homo sapiens
tgttcttatggctatttctccc

SEQ ID NO: 8341232 - DNA, 22 bp, Homo sapiens
tgttctttcagttagacacagt

SEQ ID NO: 8341233 - DNA, 20 bp, Homo sapiens
tgtgggccttcggcgtgctc

SEQ ID NO: 8341234 - DNA, 23 bp, Homo sapiens
tgtgggcgcattgtaagggtagc

SEQ ID NO: 8341235 - DNA, 20 bp, Homo sapiens
tgtgggcccttggctggcaa

SEQ ID NO: 8341236 - DNA, 22 bp, Homo sapiens
tgtgggcctcagcaggactcca

SEQ ID NO: 8341237 - DNA, 22 bp, Homo sapiens
tgtgggccaggaggcctcagtg

SEQ ID NO: 8341238 - DNA, 22 bp, Homo sapiens
tgtgggccaggaggcctcagtg

SEQ ID NO: 8341239 - DNA, 22 bp, Homo sapiens
tgtgggaggattcagaattggg

SEQ ID NO: 8341240 - DNA, 22 bp, Homo sapiens
tgtgggagaaggaagcaagctg

SEQ ID NO: 8341241 - DNA, 22 bp, Homo sapiens
tgtgggacagggacagtgatat

SEQ ID NO: 8341242 - DNA, 23 bp, Homo sapiens
tgtgggaatgttggagaggaaac

SEQ ID NO: 8341243 - DNA, 22 bp, Homo sapiens
tgtgggaatgacgaggaagagg

SEQ ID NO: 8341244 - DNA, 22 bp, Homo sapiens
tgtgggaagatgttgcaggaga

SEQ ID NO: 8341245 - DNA, 22 bp, Homo sapiens
tgtgggaagatgttgcaggaga

SEQ ID NO: 8341246 - DNA, 22 bp, Homo sapiens
tgtgggaagtttggagggaaag

SEQ ID NO: 8341247 - DNA, 22 bp, Homo sapiens
tgtggctgcaggcgatggagga

SEQ ID NO: 8341248 - DNA, 22 bp, Homo sapiens
tgtggctctgccccctggtaag

SEQ ID NO: 8341249 - DNA, 22 bp, Homo sapiens
tgtggctgactcctggtcccca

SEQ ID NO: 8341250 - DNA, 22 bp, Homo sapiens
tgtggacaccactgggactgga

SEQ ID NO: 8341251 - DNA, 22 bp, Homo sapiens
tgtgtcagaagtacttttggaa

SEQ ID NO: 8341252 - DNA, 22 bp, Homo sapiens
tgtgtcagaatttttgtggcaa

SEQ ID NO: 8341253 - DNA, 19 bp, Homo sapiens
tgtgtgccctcaccacata

SEQ ID NO: 8341254 - DNA, 22 bp, Homo sapiens
tgtgtgggagcacgggctgttg

SEQ ID NO: 8341255 - DNA, 22 bp, Homo sapiens
tgtgtggattcatctcaaagag

SEQ ID NO: 8341256 - DNA, 18 bp, Homo sapiens
tgtgaacacatttttctg

SEQ ID NO: 8341257 - DNA, 22 bp, Homo sapiens
tgtgaatgtatagtttgtatat

SEQ ID NO: 8341258 - DNA, 22 bp, Homo sapiens
tgtgaatgttaatattggatta

SEQ ID NO: 8341259 - DNA, 23 bp, Homo sapiens
tgtgaattgaggacatcaaaagc

SEQ ID NO: 8341260 - DNA, 22 bp, Homo sapiens
tgtgaatggcagttggatagca

SEQ ID NO: 8341261 - DNA, 22 bp, Homo sapiens
tgtgaatggacaattaaatcta

SEQ ID NO: 8341262 - DNA, 22 bp, Homo sapiens
tgtgacagaaagtggatgggac

SEQ ID NO: 8341263 - DNA, 21 bp, Homo sapiens
tgtgacagaggcggtgcctac

SEQ ID NO: 8341264 - DNA, 23 bp, Homo sapiens
tgtgacagtgacaatactgactt

SEQ ID NO: 8341265 - DNA, 22 bp, Homo sapiens
tgtgacatcgctgtgtctgttt

SEQ ID NO: 8341266 - DNA, 20 bp, Homo sapiens
tgtgaaagcagtagaatgac

SEQ ID NO: 8341267 - DNA, 22 bp, Homo sapiens
tgtgaaagcagccatgggcatt

SEQ ID NO: 8341268 - DNA, 22 bp, Homo sapiens
tgtgaaagatactaggcagagg

SEQ ID NO: 8341269 - DNA, 22 bp, Homo sapiens
tgtgaaaggagccatagacagt

SEQ ID NO: 8341270 - DNA, 22 bp, Homo sapiens
tgtgaaaggaaggcatgaaaag

SEQ ID NO: 8341271 - DNA, 21 bp, Homo sapiens
tgtgaaatagctatgctacat

SEQ ID NO: 8341272 - DNA, 22 bp, Homo sapiens
tgtgaaatattggcaatttcat

SEQ ID NO: 8341273 - DNA, 22 bp, Homo sapiens
tgtgaaatcacaggctatttag

SEQ ID NO: 8341274 - DNA, 22 bp, Homo sapiens
tgtgaaatgtggatgttaatag

SEQ ID NO: 8341275 - DNA, 22 bp, Homo sapiens
tgtgaaatgctatttccatgag

SEQ ID NO: 8341276 - DNA, 22 bp, Homo sapiens
tgtgaaatgagtatatttgaat

SEQ ID NO: 8341277 - DNA, 22 bp, Homo sapiens
tgtgaaattgagaaactttcac

SEQ ID NO: 8341278 - DNA, 22 bp, Homo sapiens
tgtgaaattcttgaaatgcaca

SEQ ID NO: 8341279 - DNA, 22 bp, Homo sapiens
tgtgaaattcttgaaatgcaca

SEQ ID NO: 8341280 - DNA, 22 bp, Homo sapiens
tgtgagatacctgttcaaatta

SEQ ID NO: 8341281 - DNA, 22 bp, Homo sapiens
tgtgagatacctgttcaaatta

SEQ ID NO: 8341282 - DNA, 22 bp, Homo sapiens
tgtgagaagggcatgcagggag

SEQ ID NO: 8341283 - DNA, 22 bp, Homo sapiens
tgtgagaattcctgatcacagg

SEQ ID NO: 8341284 - DNA, 22 bp, Homo sapiens
tgtgagaagggtgaggctttta

SEQ ID NO: 8341285 - DNA, 21 bp, Homo sapiens
tgtgagaagagtactgaggtc

SEQ ID NO: 8341286 - DNA, 22 bp, Homo sapiens
tgtgacttgatgtttgcaccag

SEQ ID NO: 8341287 - DNA, 22 bp, Homo sapiens
tgtgaccatttgccacaatggt

SEQ ID NO: 8341288 - DNA, 22 bp, Homo sapiens
tgtgcaacatgagacagaacag

SEQ ID NO: 8341289 - DNA, 22 bp, Homo sapiens
tgtgcaatcatattttaaaatg

SEQ ID NO: 8341290 - DNA, 22 bp, Homo sapiens
tgtgcacaggaagctattctct

SEQ ID NO: 8341291 - DNA, 22 bp, Homo sapiens
tgtgcagctatctctctacagt

SEQ ID NO: 8341292 - DNA, 22 bp, Homo sapiens
tgtgcagctagtcctggacttg

SEQ ID NO: 8341293 - DNA, 22 bp, Homo sapiens
tgtgcagatagtgatttcagaa

SEQ ID NO: 8341294 - DNA, 20 bp, Homo sapiens
tgtgcatgaactgagggatt

SEQ ID NO: 8341295 - DNA, 22 bp, Homo sapiens
tgtgcatgttgcttgaactcct

SEQ ID NO: 8341296 - DNA, 23 bp, Homo sapiens
tgtgccaagcttagaaagaacct

SEQ ID NO: 8341297 - DNA, 22 bp, Homo sapiens
tgtgcccttttgacagtgagag

SEQ ID NO: 8341298 - DNA, 22 bp, Homo sapiens
tgtgccctcagaagagtacatc

SEQ ID NO: 8341299 - DNA, 22 bp, Homo sapiens
tgtggaaaagaataagggagat

SEQ ID NO: 8341300 - DNA, 19 bp, Homo sapiens
tgtggaaaaaggagacatt

SEQ ID NO: 8341301 - DNA, 22 bp, Homo sapiens
tgtgctgctctcagtgacagcc

SEQ ID NO: 8341302 - DNA, 22 bp, Homo sapiens
tgtggaaagtggtctaagcaca

SEQ ID NO: 8341303 - DNA, 22 bp, Homo sapiens
tgtgctctggagttgccttcac

SEQ ID NO: 8341304 - DNA, 22 bp, Homo sapiens
tgtgctccatcatccataatct

SEQ ID NO: 8341305 - DNA, 23 bp, Homo sapiens
tgtgctcccaaatgtaggtctat

SEQ ID NO: 8341306 - DNA, 17 bp, Homo sapiens
tgtgctctctcactcag

SEQ ID NO: 8341307 - DNA, 22 bp, Homo sapiens
tgtgctctgactttctcctggt

SEQ ID NO: 8341308 - DNA, 22 bp, Homo sapiens
tgtgctctgcccctgactgttt

SEQ ID NO: 8341309 - DNA, 22 bp, Homo sapiens
tgtgcgtggttcccggggccat

SEQ ID NO: 8341310 - DNA, 22 bp, Homo sapiens
tgtgctccacactcccagtcct

SEQ ID NO: 8341311 - DNA, 22 bp, Homo sapiens
tgtgctccaacaatttatattc

SEQ ID NO: 8341312 - DNA, 22 bp, Homo sapiens
tgtgcctggagtccctgaggag

SEQ ID NO: 8341313 - DNA, 22 bp, Homo sapiens
tgtgcctgtcaccctcagagag

SEQ ID NO: 8341314 - DNA, 22 bp, Homo sapiens
tgtgcgtgatggaccgggcctg

SEQ ID NO: 8341315 - DNA, 22 bp, Homo sapiens
tgtgcgggtgcgcatgcagagg

SEQ ID NO: 8341316 - DNA, 22 bp, Homo sapiens
tgtcttattttaaaagggaagt

SEQ ID NO: 8341317 - DNA, 22 bp, Homo sapiens
tgtcttcagaattaagagtatg

SEQ ID NO: 8341318 - DNA, 22 bp, Homo sapiens
tgtcttcaggagtaaatatcat

SEQ ID NO: 8341319 - DNA, 19 bp, Homo sapiens
tgtcttaattaactcagag

SEQ ID NO: 8341320 - DNA, 22 bp, Homo sapiens
tgtctgggatgttggcagccac

SEQ ID NO: 8341321 - DNA, 21 bp, Homo sapiens
tgtcttcatatgagatggtgt

SEQ ID NO: 8341322 - DNA, 22 bp, Homo sapiens
tgtcttcctcttggcttgagct

SEQ ID NO: 8341323 - DNA, 22 bp, Homo sapiens
tgtgaaaagggctttgtacaaa

SEQ ID NO: 8341324 - DNA, 22 bp, Homo sapiens
tgtcttttggagcatctttctt

SEQ ID NO: 8341325 - DNA, 22 bp, Homo sapiens
tgtcttttctactgtaagcata

SEQ ID NO: 8341326 - DNA, 22 bp, Homo sapiens
tgtcttttataactgacatata

SEQ ID NO: 8341327 - DNA, 22 bp, Homo sapiens
tgtctctgaagccccctccttt

SEQ ID NO: 8341328 - DNA, 22 bp, Homo sapiens
tgtctctgaaatatgtggctcc

SEQ ID NO: 8341329 - DNA, 22 bp, Homo sapiens
tgtctctgagatgactcccacc

SEQ ID NO: 8341330 - DNA, 22 bp, Homo sapiens
tgtctctgctgcaccttctggg

SEQ ID NO: 8341331 - DNA, 22 bp, Homo sapiens
tgtctctttggcctcccatatg

SEQ ID NO: 8341332 - DNA, 22 bp, Homo sapiens
tgtctcttgttaatgattacta

SEQ ID NO: 8341333 - DNA, 22 bp, Homo sapiens
tgtctgagctggggcagacaga

SEQ ID NO: 8341334 - DNA, 22 bp, Homo sapiens
tgtctccatgtgatagtggcct

SEQ ID NO: 8341335 - DNA, 23 bp, Homo sapiens
tgtctccatctcattacttgggg

SEQ ID NO: 8341336 - DNA, 22 bp, Homo sapiens
tgtctcctgagagctggacaga

SEQ ID NO: 8341337 - DNA, 22 bp, Homo sapiens
tgtctcctgcaggggtgtgggc

SEQ ID NO: 8341338 - DNA, 22 bp, Homo sapiens
tgtctctagggcaatgtgaact

SEQ ID NO: 8341339 - DNA, 22 bp, Homo sapiens
tgtctagacaagaagtattgcc

SEQ ID NO: 8341340 - DNA, 22 bp, Homo sapiens
tgtctacaaacgtgtacacatt

SEQ ID NO: 8341341 - DNA, 22 bp, Homo sapiens
tgtctccaggggcaggccagcc

SEQ ID NO: 8341342 - DNA, 22 bp, Homo sapiens
tgtctccacaggtgtcagctca

SEQ ID NO: 8341343 - DNA, 22 bp, Homo sapiens
ttcaccaggtgtacagttagtt

SEQ ID NO: 8341344 - DNA, 22 bp, Homo sapiens
ttcaccatcattaacttcatgt

SEQ ID NO: 8341345 - DNA, 22 bp, Homo sapiens
ttcacattggtgatatgtttct

SEQ ID NO: 8341346 - DNA, 22 bp, Homo sapiens
ttcacatttcataccacagctt

SEQ ID NO: 8341347 - DNA, 22 bp, Homo sapiens
ttatttgccagaatttctcttg

SEQ ID NO: 8341348 - DNA, 20 bp, Homo sapiens
ttatttgctctttatctgca

SEQ ID NO: 8341349 - DNA, 22 bp, Homo sapiens
ttatttgcccatgtttagcaga

SEQ ID NO: 8341350 - DNA, 22 bp, Homo sapiens
ttatttggttattgtaattggg

SEQ ID NO: 8341351 - DNA, 22 bp, Homo sapiens
ttatttgacttcttgctatgct

SEQ ID NO: 8341352 - DNA, 22 bp, Homo sapiens
ttatttcttgtctatgtagcca

SEQ ID NO: 8341353 - DNA, 22 bp, Homo sapiens
ttatttcttgtctatgtagcca

SEQ ID NO: 8341354 - DNA, 22 bp, Homo sapiens
ttcacccaatataactagagga

SEQ ID NO: 8341355 - DNA, 22 bp, Homo sapiens
ttcagcagcttttagtacattg

SEQ ID NO: 8341356 - DNA, 22 bp, Homo sapiens
ttcagccagtcatcagtcttgt

SEQ ID NO: 8341357 - DNA, 22 bp, Homo sapiens
ttcattaattcattcagtgact

SEQ ID NO: 8341358 - DNA, 21 bp, Homo sapiens
ttcattcatggcataatatag

SEQ ID NO: 8341359 - DNA, 22 bp, Homo sapiens
ttcattcattacgtgccaggca

SEQ ID NO: 8341360 - DNA, 22 bp, Homo sapiens
ttccagccactttatactgcta

SEQ ID NO: 8341361 - DNA, 22 bp, Homo sapiens
ttaatggaacagcatgcataga

SEQ ID NO: 8341362 - DNA, 22 bp, Homo sapiens
ttaaagcagtttgtatacatgg

SEQ ID NO: 8341363 - DNA, 22 bp, Homo sapiens
ttaaagaatagtgcccctattg

SEQ ID NO: 8341364 - DNA, 22 bp, Homo sapiens
ttacaaagttctgagttcaaac

SEQ ID NO: 8341365 - DNA, 22 bp, Homo sapiens
ttacaacatatgataggagtct

SEQ ID NO: 8341366 - DNA, 22 bp, Homo sapiens
ttacaagacacagtgctgaagg

SEQ ID NO: 8341367 - DNA, 22 bp, Homo sapiens
ttacagatggatctagcaaaat

SEQ ID NO: 8341368 - DNA, 22 bp, Homo sapiens
ttacagatgtaggaactgaagt

SEQ ID NO: 8341369 - DNA, 22 bp, Homo sapiens
ttacagatggggttgcaataaa

SEQ ID NO: 8341370 - DNA, 22 bp, Homo sapiens
ttacatgactgcccttgtcagg

SEQ ID NO: 8341371 - DNA, 22 bp, Homo sapiens
ttacagctagccaattatttag

SEQ ID NO: 8341372 - DNA, 22 bp, Homo sapiens
ttacatgatgatttcataaaca

SEQ ID NO: 8341373 - DNA, 22 bp, Homo sapiens
ttacatgatgatttcataaaca

SEQ ID NO: 8341374 - DNA, 22 bp, Homo sapiens
ttacatgtaatctaaaataatt

SEQ ID NO: 8341375 - DNA, 22 bp, Homo sapiens
ttacattagacccactttcatg

SEQ ID NO: 8341376 - DNA, 22 bp, Homo sapiens
ttacattaagccaatggattct

SEQ ID NO: 8341377 - DNA, 22 bp, Homo sapiens
ttacattagacccactttcatg

SEQ ID NO: 8341378 - DNA, 22 bp, Homo sapiens
ttacattaagccaatggattct

SEQ ID NO: 8341379 - DNA, 22 bp, Homo sapiens
ttacatttggctatgtcctcta

SEQ ID NO: 8341380 - DNA, 22 bp, Homo sapiens
ttacatttcccccttggaggct

SEQ ID NO: 8341381 - DNA, 22 bp, Homo sapiens
ttacattgtccagaaattattg

SEQ ID NO: 8341382 - DNA, 22 bp, Homo sapiens
ttacattttagttaacctgtga

SEQ ID NO: 8341383 - DNA, 22 bp, Homo sapiens
ttacacaaaaataagatatggc

SEQ ID NO: 8341384 - DNA, 22 bp, Homo sapiens
ttacagagataaactgtaagtg

SEQ ID NO: 8341385 - DNA, 17 bp, Homo sapiens
ttacagaggtaattaag

SEQ ID NO: 8341386 - DNA, 22 bp, Homo sapiens
ttacagatactttgtaggcaag

SEQ ID NO: 8341387 - DNA, 22 bp, Homo sapiens
ttacagagttcgcacctggtgg

SEQ ID NO: 8341388 - DNA, 22 bp, Homo sapiens
ttacagagtggtctggctatgt

SEQ ID NO: 8341389 - DNA, 22 bp, Homo sapiens
ttacaattgagtctattgtatg

SEQ ID NO: 8341390 - DNA, 22 bp, Homo sapiens
ttacaagataacctgatgctgt

SEQ ID NO: 8341391 - DNA, 22 bp, Homo sapiens
ttacaagataacctgatgctgt

SEQ ID NO: 8341392 - DNA, 22 bp, Homo sapiens
ttacaagacagtgtggtaaata

SEQ ID NO: 8341393 - DNA, 22 bp, Homo sapiens
ttacaagacactgctgacacag

SEQ ID NO: 8341394 - DNA, 22 bp, Homo sapiens
ttacaagacagtgtggtaaata

SEQ ID NO: 8341395 - DNA, 22 bp, Homo sapiens
ttacaagatatgtgagaactag

SEQ ID NO: 8341396 - DNA, 22 bp, Homo sapiens
ttacaagatatgtgagaactag

SEQ ID NO: 8341397 - DNA, 22 bp, Homo sapiens
ttacaagataacggagaaagca

SEQ ID NO: 8341398 - DNA, 22 bp, Homo sapiens
ttacaagatgggaaagggaagt

SEQ ID NO: 8341399 - DNA, 22 bp, Homo sapiens
ttacaagattaattattggagt

SEQ ID NO: 8341400 - DNA, 22 bp, Homo sapiens
ttacaagattaattattggagt

SEQ ID NO: 8341401 - DNA, 22 bp, Homo sapiens
ttacaagcagctacatatcaca

SEQ ID NO: 8341402 - DNA, 22 bp, Homo sapiens
ttacaagatgggaaagggaagt

SEQ ID NO: 8341403 - DNA, 22 bp, Homo sapiens
ttacaagatctttgaaggcaag

SEQ ID NO: 8341404 - DNA, 22 bp, Homo sapiens
ttacaagatctttgaaggcaag

SEQ ID NO: 8341405 - DNA, 22 bp, Homo sapiens
ttatgatttgccacagattggt

SEQ ID NO: 8341406 - DNA, 22 bp, Homo sapiens
ttatgatttgccacagattggt

SEQ ID NO: 8341407 - DNA, 22 bp, Homo sapiens
ttatgacatatgagtacaagta

SEQ ID NO: 8341408 - DNA, 22 bp, Homo sapiens
ttatgacaggaaaatcacagaa

SEQ ID NO: 8341409 - DNA, 22 bp, Homo sapiens
ttatgaagttcctgttacagtg

SEQ ID NO: 8341410 - DNA, 22 bp, Homo sapiens
ttatatgattgagcatcttggt

SEQ ID NO: 8341411 - DNA, 20 bp, Homo sapiens
ttatctgtcaatctgtctca

SEQ ID NO: 8341412 - DNA, 22 bp, Homo sapiens
ttagtgaaagtaatacaaagta

SEQ ID NO: 8341413 - DNA, 22 bp, Homo sapiens
ttattctgcacttttaaaatat

SEQ ID NO: 8341414 - DNA, 22 bp, Homo sapiens
ttattcatcagtgcattaattt

SEQ ID NO: 8341415 - DNA, 22 bp, Homo sapiens
ttattattggtgagttaaggaa

SEQ ID NO: 8341416 - DNA, 22 bp, Homo sapiens
ttattattccccaagtcattat

SEQ ID NO: 8341417 - DNA, 22 bp, Homo sapiens
ttattattgattcgctctcaaa

SEQ ID NO: 8341418 - DNA, 22 bp, Homo sapiens
ttatttatgttaacagtcgaga

SEQ ID NO: 8341419 - DNA, 22 bp, Homo sapiens
ttatttatgttaacagtcgaga

SEQ ID NO: 8341420 - DNA, 22 bp, Homo sapiens
ttatttatggccctcacctgat

SEQ ID NO: 8341421 - DNA, 22 bp, Homo sapiens
ttattcttggatctgagtctct

SEQ ID NO: 8341422 - DNA, 22 bp, Homo sapiens
ttatttccctgagggttgcagg

SEQ ID NO: 8341423 - DNA, 22 bp, Homo sapiens
ttattcttggatctgagtctct

SEQ ID NO: 8341424 - DNA, 18 bp, Homo sapiens
ttattcttccaggccacc

SEQ ID NO: 8341425 - DNA, 22 bp, Homo sapiens
ttattcttcttctcttgccagg

SEQ ID NO: 8341426 - DNA, 19 bp, Homo sapiens
ttattcttaaagtagctta

SEQ ID NO: 8341427 - DNA, 19 bp, Homo sapiens
ttattcttaaagtagctta

SEQ ID NO: 8341428 - DNA, 22 bp, Homo sapiens
ttattctggaggaagcaaatgg

SEQ ID NO: 8341429 - DNA, 22 bp, Homo sapiens
ttagtacattcactgtggtagg

SEQ ID NO: 8341430 - DNA, 22 bp, Homo sapiens
ttagtacatagatgatggttga

SEQ ID NO: 8341431 - DNA, 22 bp, Homo sapiens
ttagtacagaatcaaaagcaat

SEQ ID NO: 8341432 - DNA, 22 bp, Homo sapiens
ttaggaagcaggcctaaaattt

SEQ ID NO: 8341433 - DNA, 17 bp, Homo sapiens
ttagcaaaatagcactt

SEQ ID NO: 8341434 - DNA, 22 bp, Homo sapiens
ttagatttgtagtgagttcaga

SEQ ID NO: 8341435 - DNA, 22 bp, Homo sapiens
ttagatttacaagcactgttta

SEQ ID NO: 8341436 - DNA, 22 bp, Homo sapiens
ttagatttatatgtgagaatgg

SEQ ID NO: 8341437 - DNA, 22 bp, Homo sapiens
ttagatgtgtatatacatgtca

SEQ ID NO: 8341438 - DNA, 22 bp, Homo sapiens
ttagatgtttatatacagattt

SEQ ID NO: 8341439 - DNA, 22 bp, Homo sapiens
ttagcacttgggagtatttatt

SEQ ID NO: 8341440 - DNA, 22 bp, Homo sapiens
ttagcagctaaactgacagacc

SEQ ID NO: 8341441 - DNA, 22 bp, Homo sapiens
ttagcattctgcctcctatatc

SEQ ID NO: 8341442 - DNA, 22 bp, Homo sapiens
ttagcagtcacagtgctaacat

SEQ ID NO: 8341443 - DNA, 22 bp, Homo sapiens
ttagcatagccattgaaatatg

SEQ ID NO: 8341444 - DNA, 21 bp, Homo sapiens
ttagcagttgttgatttccag

SEQ ID NO: 8341445 - DNA, 22 bp, Homo sapiens
ttagcagttcattgattatcgt

SEQ ID NO: 8341446 - DNA, 20 bp, Homo sapiens
ttagcagtagagtgtgcttc

SEQ ID NO: 8341447 - DNA, 22 bp, Homo sapiens
ttagaaaggggtgaatcaatgg

SEQ ID NO: 8341448 - DNA, 22 bp, Homo sapiens
ttagaaagggtgtctgaatctg

SEQ ID NO: 8341449 - DNA, 22 bp, Homo sapiens
ttagaaaggttttgctctgaaa

SEQ ID NO: 8341450 - DNA, 22 bp, Homo sapiens
ttagaaaggaatcttcatttca

SEQ ID NO: 8341451 - DNA, 22 bp, Homo sapiens
ttagaaaggagcttatttcttt

SEQ ID NO: 8341452 - DNA, 22 bp, Homo sapiens
ttagaaaggaatcttcatttca

SEQ ID NO: 8341453 - DNA, 22 bp, Homo sapiens
ttagaaaggaatcttcatttca

SEQ ID NO: 8341454 - DNA, 22 bp, Homo sapiens
ttacattttgcacagatgtccc

SEQ ID NO: 8341455 - DNA, 22 bp, Homo sapiens
ttacattttgcacagatgtccc

SEQ ID NO: 8341456 - DNA, 22 bp, Homo sapiens
ttagatatgtttttgctaatgc

SEQ ID NO: 8341457 - DNA, 22 bp, Homo sapiens
ttagaacactgagaaagtgatg

SEQ ID NO: 8341458 - DNA, 22 bp, Homo sapiens
aagtggccctaggccaagggga

SEQ ID NO: 8341459 - DNA, 22 bp, Homo sapiens
aagtggccccttgagaatacca

SEQ ID NO: 8341460 - DNA, 22 bp, Homo sapiens
aagtttgtggtcatttattata

SEQ ID NO: 8341461 - DNA, 22 bp, Homo sapiens
aagtttgttgtacatgttagta

SEQ ID NO: 8341462 - DNA, 22 bp, Homo sapiens
aagtgcagtggcgtgatcttgg

SEQ ID NO: 8341463 - DNA, 22 bp, Homo sapiens
actgacatttttccctaagcat

SEQ ID NO: 8341464 - DNA, 22 bp, Homo sapiens
actgagaagctcgcagtgatgc

SEQ ID NO: 8341465 - DNA, 22 bp, Homo sapiens
actgagacagctccgctgcccg

SEQ ID NO: 8341466 - DNA, 22 bp, Homo sapiens
aataaagcctgtctctttagag

SEQ ID NO: 8341467 - DNA, 22 bp, Homo sapiens
aataaagcctgtctctttagag

SEQ ID NO: 8341468 - DNA, 22 bp, Homo sapiens
aataaagccttattgattttac

SEQ ID NO: 8341469 - DNA, 22 bp, Homo sapiens
aataaagccttattgattttac

SEQ ID NO: 8341470 - DNA, 22 bp, Homo sapiens
aataacagaaacttgagcatca

SEQ ID NO: 8341471 - DNA, 22 bp, Homo sapiens
aataacagaaacttgagcatca

SEQ ID NO: 8341472 - DNA, 22 bp, Homo sapiens
aataaatgttaagattgtctca

SEQ ID NO: 8341473 - DNA, 22 bp, Homo sapiens
aagtaaatatctgtagtcttta

SEQ ID NO: 8341474 - DNA, 22 bp, Homo sapiens
aagtaacaatgctgttgaattg

SEQ ID NO: 8341475 - DNA, 21 bp, Homo sapiens
aagtaacaccactcctggagt

SEQ ID NO: 8341476 - DNA, 22 bp, Homo sapiens
acctgggaggcagaggttgcag

SEQ ID NO: 8341477 - DNA, 22 bp, Homo sapiens
acctgggaggcggaggttgcag

SEQ ID NO: 8341478 - DNA, 20 bp, Homo sapiens
accttgaacccgccagccat

SEQ ID NO: 8341479 - DNA, 22 bp, Homo sapiens
accttctggtctgcctgacagc

SEQ ID NO: 8341480 - DNA, 22 bp, Homo sapiens
accttctggtctgcctgacagc

SEQ ID NO: 8341481 - DNA, 20 bp, Homo sapiens
acctggggttgcctgtgctc

SEQ ID NO: 8341482 - DNA, 20 bp, Homo sapiens
acctggggttgcctgtgctc

SEQ ID NO: 8341483 - DNA, 22 bp, Homo sapiens
aagtgcacttatagtaatatgt

SEQ ID NO: 8341484 - DNA, 22 bp, Homo sapiens
aagtgatttagtcttataaagg

SEQ ID NO: 8341485 - DNA, 22 bp, Homo sapiens
aagtgaaattgccattcttata

SEQ ID NO: 8341486 - DNA, 22 bp, Homo sapiens
aagtgacaaaagggtatccaaa

SEQ ID NO: 8341487 - DNA, 22 bp, Homo sapiens
aagtgacacctcttccctttcc

SEQ ID NO: 8341488 - DNA, 22 bp, Homo sapiens
aagtgacacatggcacttctat

SEQ ID NO: 8341489 - DNA, 22 bp, Homo sapiens
acttatatttgctttatgcttc

SEQ ID NO: 8341490 - DNA, 22 bp, Homo sapiens
acttcctgcagcttctcagccc

SEQ ID NO: 8341491 - DNA, 22 bp, Homo sapiens
acttcctgcagcttctcagccc

SEQ ID NO: 8341492 - DNA, 19 bp, Homo sapiens
acttcctgcccgctccttt

SEQ ID NO: 8341493 - DNA, 22 bp, Homo sapiens
aatatcttctaaggatagaact

SEQ ID NO: 8341494 - DNA, 22 bp, Homo sapiens
acttcctgcaatcgtccactcc

SEQ ID NO: 8341495 - DNA, 22 bp, Homo sapiens
acttcctgcaatcgtccactcc

SEQ ID NO: 8341496 - DNA, 22 bp, Homo sapiens
aataacagattttcaagctgtg

SEQ ID NO: 8341497 - DNA, 22 bp, Homo sapiens
actgtgctggagccctctggag

SEQ ID NO: 8341498 - DNA, 22 bp, Homo sapiens
actgtggctcatcaggctggtg

SEQ ID NO: 8341499 - DNA, 22 bp, Homo sapiens
actgtgggggagccagtcccat

SEQ ID NO: 8341500 - DNA, 22 bp, Homo sapiens
aatacttgtcagatgaataaga

SEQ ID NO: 8341501 - DNA, 22 bp, Homo sapiens
aatagaaaggaggggctcttgt

SEQ ID NO: 8341502 - DNA, 22 bp, Homo sapiens
aatagaaaggaggggctcttgt

SEQ ID NO: 8341503 - DNA, 22 bp, Homo sapiens
aatattatcaaaagctttttca

SEQ ID NO: 8341504 - DNA, 22 bp, Homo sapiens
aatattagtttctcaagagaga

SEQ ID NO: 8341505 - DNA, 22 bp, Homo sapiens
aatatgttcaaaatagatcact

SEQ ID NO: 8341506 - DNA, 22 bp, Homo sapiens
aatatgttgagtctatctttat

SEQ ID NO: 8341507 - DNA, 22 bp, Homo sapiens
aatatgtttataagatatcttc

SEQ ID NO: 8341508 - DNA, 22 bp, Homo sapiens
aatatgttccacttaaagctgg

SEQ ID NO: 8341509 - DNA, 22 bp, Homo sapiens
aatatgcaaataggtgtaatga

SEQ ID NO: 8341510 - DNA, 22 bp, Homo sapiens
aatatgcagcatgatgaagtaa

SEQ ID NO: 8341511 - DNA, 20 bp, Homo sapiens
agaaaatgttttcagctgga

SEQ ID NO: 8341512 - DNA, 22 bp, Homo sapiens
agaaaattactccagagacaag

SEQ ID NO: 8341513 - DNA, 21 bp, Homo sapiens
agaaaatggcgttttagattt

SEQ ID NO: 8341514 - DNA, 22 bp, Homo sapiens
agaaaattactccagagacaag

SEQ ID NO: 8341515 - DNA, 22 bp, Homo sapiens
agaaacctcacagcaattctga

SEQ ID NO: 8341516 - DNA, 22 bp, Homo sapiens
agaaaccatctttatatatctg

SEQ ID NO: 8341517 - DNA, 22 bp, Homo sapiens
agaaaataatttcttggctggt

SEQ ID NO: 8341518 - DNA, 22 bp, Homo sapiens
agaaaataatttcttggctggt

SEQ ID NO: 8341519 - DNA, 22 bp, Homo sapiens
agaaaactgggaggagagcttc

SEQ ID NO: 8341520 - DNA, 22 bp, Homo sapiens
agaaaactggagcctggggttg

SEQ ID NO: 8341521 - DNA, 22 bp, Homo sapiens
agaaaatattcattgagaggct

SEQ ID NO: 8341522 - DNA, 22 bp, Homo sapiens
agaaaatattcattgagaggct

SEQ ID NO: 8341523 - DNA, 22 bp, Homo sapiens
agaaaatattcattgagaggct

SEQ ID NO: 8341524 - DNA, 21 bp, Homo sapiens
agaaaatggcgttttagattt

SEQ ID NO: 8341525 - DNA, 21 bp, Homo sapiens
agaaaatggcgttttagattt

SEQ ID NO: 8341526 - DNA, 22 bp, Homo sapiens
agaaactattatggtaaacaaa

SEQ ID NO: 8341527 - DNA, 22 bp, Homo sapiens
agaaactaagtcataactcttt

SEQ ID NO: 8341528 - DNA, 22 bp, Homo sapiens
aatctgtattgttaacaagtaa

SEQ ID NO: 8341529 - DNA, 22 bp, Homo sapiens
aatctgtcccttaactagtcat

SEQ ID NO: 8341530 - DNA, 22 bp, Homo sapiens
aatctgtttaacagatttctgt

SEQ ID NO: 8341531 - DNA, 22 bp, Homo sapiens
aatctgttctactctattcaga

SEQ ID NO: 8341532 - DNA, 22 bp, Homo sapiens
aatctgtttttgaaactttgta

SEQ ID NO: 8341533 - DNA, 22 bp, Homo sapiens
aatctgtttttgaaactttgta

SEQ ID NO: 8341534 - DNA, 22 bp, Homo sapiens
aatctgtttccaatacttgcta

SEQ ID NO: 8341535 - DNA, 22 bp, Homo sapiens
aatctgtttgatgcttgtgata

SEQ ID NO: 8341536 - DNA, 22 bp, Homo sapiens
aatcttacaccgaatttaaact

SEQ ID NO: 8341537 - DNA, 22 bp, Homo sapiens
aatcttacaccgaatttaaact

SEQ ID NO: 8341538 - DNA, 22 bp, Homo sapiens
aatcttcacagaaaaatgtctg

SEQ ID NO: 8341539 - DNA, 22 bp, Homo sapiens
aatcttcatgtcctctctaatt

SEQ ID NO: 8341540 - DNA, 22 bp, Homo sapiens
aatcttcataaaaatctagtag

SEQ ID NO: 8341541 - DNA, 22 bp, Homo sapiens
aatcttcagtgtctaaaaagca

SEQ ID NO: 8341542 - DNA, 22 bp, Homo sapiens
aatcttcactaaaatggacaag

SEQ ID NO: 8341543 - DNA, 22 bp, Homo sapiens
aatcttcattttgacaagattc

SEQ ID NO: 8341544 - DNA, 22 bp, Homo sapiens
aatcttttgattctagggctgt

SEQ ID NO: 8341545 - DNA, 22 bp, Homo sapiens
aatcttttaggggatcctgagg

SEQ ID NO: 8341546 - DNA, 22 bp, Homo sapiens
aatctttttcacaagaaagcac

SEQ ID NO: 8341547 - DNA, 22 bp, Homo sapiens
aatctttcaaatttctttgggt

SEQ ID NO: 8341548 - DNA, 22 bp, Homo sapiens
acataataggtgcctgaatatt

SEQ ID NO: 8341549 - DNA, 22 bp, Homo sapiens
acataatgaaatgcagaaatca

SEQ ID NO: 8341550 - DNA, 22 bp, Homo sapiens
acataatgagctctttataaat

SEQ ID NO: 8341551 - DNA, 22 bp, Homo sapiens
acataataggtacctgaataat

SEQ ID NO: 8341552 - DNA, 22 bp, Homo sapiens
acataagttatggataaaatgt

SEQ ID NO: 8341553 - DNA, 22 bp, Homo sapiens
acataataaaaataacagctca

SEQ ID NO: 8341554 - DNA, 22 bp, Homo sapiens
acataatacctaggacagtttg

SEQ ID NO: 8341555 - DNA, 22 bp, Homo sapiens
acataagtgcacaataaatatt

SEQ ID NO: 8341556 - DNA, 23 bp, Homo sapiens
acatgggaaatgcaaagagaagt

SEQ ID NO: 8341557 - DNA, 22 bp, Homo sapiens
acatggggcccaaagagaggtc

SEQ ID NO: 8341558 - DNA, 23 bp, Homo sapiens
acatagaacagaatatatttgtg

SEQ ID NO: 8341559 - DNA, 23 bp, Homo sapiens
acatagaacagaatatatttgtg

SEQ ID NO: 8341560 - DNA, 22 bp, Homo sapiens
acatactttttaaaagattgct

SEQ ID NO: 8341561 - DNA, 22 bp, Homo sapiens
acatagaaatttatttcttaca

SEQ ID NO: 8341562 - DNA, 22 bp, Homo sapiens
acattatagttgctacagagta

SEQ ID NO: 8341563 - DNA, 22 bp, Homo sapiens
acattcaaccaatgtttgctat

SEQ ID NO: 8341564 - DNA, 22 bp, Homo sapiens
acattacataagattgtaacct

SEQ ID NO: 8341565 - DNA, 22 bp, Homo sapiens
aaggccagcttgtagggctggt

SEQ ID NO: 8341566 - DNA, 22 bp, Homo sapiens
acatggtatttctattataatt

SEQ ID NO: 8341567 - DNA, 22 bp, Homo sapiens
accagctgtgtcctggctgcag

SEQ ID NO: 8341568 - DNA, 22 bp, Homo sapiens
accaggccaacagctaagttaa

SEQ ID NO: 8341569 - DNA, 21 bp, Homo sapiens
accaggccaggaggctggcac

SEQ ID NO: 8341570 - DNA, 22 bp, Homo sapiens
accaggccaaaatcatatttac

SEQ ID NO: 8341571 - DNA, 22 bp, Homo sapiens
aagtaaaatgtttcctttatta

SEQ ID NO: 8341572 - DNA, 22 bp, Homo sapiens
aagtaaaatgtttcctttatta

SEQ ID NO: 8341573 - DNA, 22 bp, Homo sapiens
aagtaaaagctttaccatgcgc

SEQ ID NO: 8341574 - DNA, 22 bp, Homo sapiens
acattttgcccttatttgctga

SEQ ID NO: 8341575 - DNA, 22 bp, Homo sapiens
acagcttgcaatggctttcaac

SEQ ID NO: 8341576 - DNA, 22 bp, Homo sapiens
acagattttattattcaggtat

SEQ ID NO: 8341577 - DNA, 22 bp, Homo sapiens
acagatgaggaagagtcagcca

SEQ ID NO: 8341578 - DNA, 22 bp, Homo sapiens
acagatgaggaatttatttggt

SEQ ID NO: 8341579 - DNA, 22 bp, Homo sapiens
acagatgagattcattgaccac

SEQ ID NO: 8341580 - DNA, 22 bp, Homo sapiens
acagatgagagacaatgtgcta

SEQ ID NO: 8341581 - DNA, 22 bp, Homo sapiens
acagcttttcaattctgctgag

SEQ ID NO: 8341582 - DNA, 22 bp, Homo sapiens
acaggaaagagctaggcatagg

SEQ ID NO: 8341583 - DNA, 21 bp, Homo sapiens
acaggagaccgcctggcagtc

SEQ ID NO: 8341584 - DNA, 22 bp, Homo sapiens
acaggagaccctgctggttctg

SEQ ID NO: 8341585 - DNA, 22 bp, Homo sapiens
acaggaaatgaaatggtatcta

SEQ ID NO: 8341586 - DNA, 22 bp, Homo sapiens
acaggagccaaacacatgccag

SEQ ID NO: 8341587 - DNA, 22 bp, Homo sapiens
acaggaggagcagctgtgtgcc

SEQ ID NO: 8341588 - DNA, 22 bp, Homo sapiens
acaggagctctagggacagcac

SEQ ID NO: 8341589 - DNA, 22 bp, Homo sapiens
acaggcactttgacatgccatc

SEQ ID NO: 8341590 - DNA, 22 bp, Homo sapiens
acaggcagagtcaggttgggtt

SEQ ID NO: 8341591 - DNA, 22 bp, Homo sapiens
acaggtaccggtcagattacgg

SEQ ID NO: 8341592 - DNA, 22 bp, Homo sapiens
acagtgctaaacacttcttgaa

SEQ ID NO: 8341593 - DNA, 22 bp, Homo sapiens
acagtttacagggatttgagct

SEQ ID NO: 8341594 - DNA, 22 bp, Homo sapiens
acagtgtagcatggtagcaatg

SEQ ID NO: 8341595 - DNA, 22 bp, Homo sapiens
acagtgtatattgtttatctgg

SEQ ID NO: 8341596 - DNA, 22 bp, Homo sapiens
acagtgtactaaatagtaagag

SEQ ID NO: 8341597 - DNA, 22 bp, Homo sapiens
acagtgctcatgtgacatggtg

SEQ ID NO: 8341598 - DNA, 22 bp, Homo sapiens
acagtgctcatgtgacatggtg

SEQ ID NO: 8341599 - DNA, 22 bp, Homo sapiens
acagtgctatcaatagctagaa

SEQ ID NO: 8341600 - DNA, 22 bp, Homo sapiens
acagtgctaatgatgccaagat

SEQ ID NO: 8341601 - DNA, 22 bp, Homo sapiens
acagtgctgtcaaatatgtttt

SEQ ID NO: 8341602 - DNA, 22 bp, Homo sapiens
acagtgctggctacaaccctgg

SEQ ID NO: 8341603 - DNA, 22 bp, Homo sapiens
acagtgctgatctagactgacc

SEQ ID NO: 8341604 - DNA, 22 bp, Homo sapiens
acagtgctgaacgacatggaag

SEQ ID NO: 8341605 - DNA, 20 bp, Homo sapiens
acagtgggtggggagcactg

SEQ ID NO: 8341606 - DNA, 18 bp, Homo sapiens
acagtgctgtcactgctt

SEQ ID NO: 8341607 - DNA, 22 bp, Homo sapiens
agcaggagggttttgtagagtc

SEQ ID NO: 8341608 - DNA, 22 bp, Homo sapiens
agcaggagtgtcccctggctgt

SEQ ID NO: 8341609 - DNA, 22 bp, Homo sapiens
agcaggaggagagcctggcggt

SEQ ID NO: 8341610 - DNA, 22 bp, Homo sapiens
agcaggagctgtgggaagatgg

SEQ ID NO: 8341611 - DNA, 22 bp, Homo sapiens
agcagctgagatggtaagattc

SEQ ID NO: 8341612 - DNA, 21 bp, Homo sapiens
agcagccatggatggtatgta

SEQ ID NO: 8341613 - DNA, 22 bp, Homo sapiens
agcagccatttaaaatgaattg

SEQ ID NO: 8341614 - DNA, 19 bp, Homo sapiens
agcagccatcgaccatgga

SEQ ID NO: 8341615 - DNA, 21 bp, Homo sapiens
agcagccatttcacagagact

SEQ ID NO: 8341616 - DNA, 22 bp, Homo sapiens
agcagccagttctctgtggtag

SEQ ID NO: 8341617 - DNA, 19 bp, Homo sapiens
agcagccatagacaatatg

SEQ ID NO: 8341618 - DNA, 22 bp, Homo sapiens
agcagccatagatagcatgcaa

SEQ ID NO: 8341619 - DNA, 23 bp, Homo sapiens
agcagccatagggaagcaataca

SEQ ID NO: 8341620 - DNA, 22 bp, Homo sapiens
agcagccatagatagcatgcaa

SEQ ID NO: 8341621 - DNA, 22 bp, Homo sapiens
agcagccatccttagagaaaga

SEQ ID NO: 8341622 - DNA, 22 bp, Homo sapiens
agcagctctgtttacctggagg

SEQ ID NO: 8341623 - DNA, 22 bp, Homo sapiens
agcagggctgtgctccttccga

SEQ ID NO: 8341624 - DNA, 22 bp, Homo sapiens
agcatcccatgactctggagga

SEQ ID NO: 8341625 - DNA, 22 bp, Homo sapiens
agcaggtgagcacagccaggct

SEQ ID NO: 8341626 - DNA, 22 bp, Homo sapiens
agatttcctgcactgcctttga

SEQ ID NO: 8341627 - DNA, 22 bp, Homo sapiens
agatttcccaaatacttgttat

SEQ ID NO: 8341628 - DNA, 22 bp, Homo sapiens
agatttccctcttgtatttgca

SEQ ID NO: 8341629 - DNA, 22 bp, Homo sapiens
agatttcccactccatgtattg

SEQ ID NO: 8341630 - DNA, 22 bp, Homo sapiens
agatttctgtcaccttctatgc

SEQ ID NO: 8341631 - DNA, 22 bp, Homo sapiens
agatttctgtggtcatgtaatg

SEQ ID NO: 8341632 - DNA, 22 bp, Homo sapiens
acacacagaaggaagccccact

SEQ ID NO: 8341633 - DNA, 22 bp, Homo sapiens
agcagaaacagccagtctggac

SEQ ID NO: 8341634 - DNA, 22 bp, Homo sapiens
agcagaaatagaagtcaatgat

SEQ ID NO: 8341635 - DNA, 22 bp, Homo sapiens
agcagaaaattggaaatgacaa

SEQ ID NO: 8341636 - DNA, 22 bp, Homo sapiens
agcactttgggagataaagctg

SEQ ID NO: 8341637 - DNA, 19 bp, Homo sapiens
agcacttgtggtcctccct

SEQ ID NO: 8341638 - DNA, 22 bp, Homo sapiens
acacactgttgctcatccaggc

SEQ ID NO: 8341639 - DNA, 22 bp, Homo sapiens
agcagccaggaatctgcagagc

SEQ ID NO: 8341640 - DNA, 22 bp, Homo sapiens
agcagccagtgggagtgataca

SEQ ID NO: 8341641 - DNA, 23 bp, Homo sapiens
agcagccagagatcctcggccct

SEQ ID NO: 8341642 - DNA, 22 bp, Homo sapiens
agcagccagagtctgaacatta

SEQ ID NO: 8341643 - DNA, 16 bp, Homo sapiens
agcagccagcactgga

SEQ ID NO: 8341644 - DNA, 22 bp, Homo sapiens
agcagcaacttatttttcttat

SEQ ID NO: 8341645 - DNA, 22 bp, Homo sapiens
agcagcaactgctagagtggca

SEQ ID NO: 8341646 - DNA, 19 bp, Homo sapiens
agcagcagcaccagggatt

SEQ ID NO: 8341647 - DNA, 22 bp, Homo sapiens
agcattcattgctagaatgtaa

SEQ ID NO: 8341648 - DNA, 22 bp, Homo sapiens
agcattcatgatgacaacagga

SEQ ID NO: 8341649 - DNA, 20 bp, Homo sapiens
agcattcattcagcaagcct

SEQ ID NO: 8341650 - DNA, 20 bp, Homo sapiens
agcattcattcagcaagcct

SEQ ID NO: 8341651 - DNA, 22 bp, Homo sapiens
agcattcaatgattggacttgc

SEQ ID NO: 8341652 - DNA, 22 bp, Homo sapiens
agcattcaagtaattcacttgg

SEQ ID NO: 8341653 - DNA, 22 bp, Homo sapiens
agcatctttaggaagagaaaga

SEQ ID NO: 8341654 - DNA, 22 bp, Homo sapiens
agccaggctaaatgagccatga

SEQ ID NO: 8341655 - DNA, 22 bp, Homo sapiens
agcattgcctgcctattgctaa

SEQ ID NO: 8341656 - DNA, 22 bp, Homo sapiens
agcatttaagcttctgcaaagc

SEQ ID NO: 8341657 - DNA, 22 bp, Homo sapiens
agcatttaagggtggatacagg

SEQ ID NO: 8341658 - DNA, 22 bp, Homo sapiens
agcatttaatcctacatagatc

SEQ ID NO: 8341659 - DNA, 22 bp, Homo sapiens
agcatttaattacagtttaatt

SEQ ID NO: 8341660 - DNA, 22 bp, Homo sapiens
agccaggacagggcagctcgct

SEQ ID NO: 8341661 - DNA, 22 bp, Homo sapiens
acagaactgggggcacagatag

SEQ ID NO: 8341662 - DNA, 22 bp, Homo sapiens
acagaactgtgatctcataaat

SEQ ID NO: 8341663 - DNA, 22 bp, Homo sapiens
acagaactgagaattctctatc

SEQ ID NO: 8341664 - DNA, 22 bp, Homo sapiens
acagaacaggctgagaaaaaca

SEQ ID NO: 8341665 - DNA, 22 bp, Homo sapiens
agccaggctaaatgagccatga

SEQ ID NO: 8341666 - DNA, 22 bp, Homo sapiens
acagacagtaaatagtgtggct

SEQ ID NO: 8341667 - DNA, 21 bp, Homo sapiens
acagacagtccagagaaaaga

SEQ ID NO: 8341668 - DNA, 22 bp, Homo sapiens
agcctggctgtaacctcatggt

SEQ ID NO: 8341669 - DNA, 22 bp, Homo sapiens
agcctgtgaaatctctgccact

SEQ ID NO: 8341670 - DNA, 22 bp, Homo sapiens
agcctgtgagggatgctgcagt

SEQ ID NO: 8341671 - DNA, 22 bp, Homo sapiens
agcctgtgacattgactatgaa

SEQ ID NO: 8341672 - DNA, 22 bp, Homo sapiens
agcctgtgactctgtgaaacca

SEQ ID NO: 8341673 - DNA, 22 bp, Homo sapiens
agcctgtggaaactgggtgcag

SEQ ID NO: 8341674 - DNA, 22 bp, Homo sapiens
agcctgtggatccctgcactgg

SEQ ID NO: 8341675 - DNA, 22 bp, Homo sapiens
agcctgtgggagccgctcccgt

SEQ ID NO: 8341676 - DNA, 22 bp, Homo sapiens
agcctgtgtgctttggacaggg

SEQ ID NO: 8341677 - DNA, 22 bp, Homo sapiens
agcctgtgtgaagccctcagag

SEQ ID NO: 8341678 - DNA, 22 bp, Homo sapiens
agcctgtgtcctcatctgcagc

SEQ ID NO: 8341679 - DNA, 20 bp, Homo sapiens
agcctgtgtacttgcctgtg

SEQ ID NO: 8341680 - DNA, 22 bp, Homo sapiens
agcctgtgttgctctggcgata

SEQ ID NO: 8341681 - DNA, 22 bp, Homo sapiens
agctcaggtctcaggaggtgtc

SEQ ID NO: 8341682 - DNA, 22 bp, Homo sapiens
agctcaggtagactcagcatct

SEQ ID NO: 8341683 - DNA, 22 bp, Homo sapiens
agctcaggccggagctacaggc

SEQ ID NO: 8341684 - DNA, 22 bp, Homo sapiens
agctcaagctacacacagagtc

SEQ ID NO: 8341685 - DNA, 22 bp, Homo sapiens
agccctggggctggtcttggaa

SEQ ID NO: 8341686 - DNA, 22 bp, Homo sapiens
agccctggggctggtcttggaa

SEQ ID NO: 8341687 - DNA, 22 bp, Homo sapiens
agccctgcgatcgtgatttctt

SEQ ID NO: 8341688 - DNA, 22 bp, Homo sapiens
agccctgcgctcacgttctgca

SEQ ID NO: 8341689 - DNA, 22 bp, Homo sapiens
agccctgccattctctggagct

SEQ ID NO: 8341690 - DNA, 22 bp, Homo sapiens
agccctgcatagaagggaacac

SEQ ID NO: 8341691 - DNA, 16 bp, Homo sapiens
agccctgccgtgtact

SEQ ID NO: 8341692 - DNA, 22 bp, Homo sapiens
agccctgcctctccaatgccca

SEQ ID NO: 8341693 - DNA, 22 bp, Homo sapiens
agccctgccctgccatgtggca

SEQ ID NO: 8341694 - DNA, 22 bp, Homo sapiens
acagacatggaccaagcactgt

SEQ ID NO: 8341695 - DNA, 22 bp, Homo sapiens
agcccctgtaccctgagtgctt

SEQ ID NO: 8341696 - DNA, 22 bp, Homo sapiens
agccctgcaggatgagggaggt

SEQ ID NO: 8341697 - DNA, 22 bp, Homo sapiens
agccctgcataaatcagttggt

SEQ ID NO: 8341698 - DNA, 22 bp, Homo sapiens
agccctgcaggaggtgggagag

SEQ ID NO: 8341699 - DNA, 22 bp, Homo sapiens
agccctgcacaggtctgtggct

SEQ ID NO: 8341700 - DNA, 22 bp, Homo sapiens
agccctgcacagttcgggagga

SEQ ID NO: 8341701 - DNA, 21 bp, Homo sapiens
agcctggcccagggggaggct

SEQ ID NO: 8341702 - DNA, 22 bp, Homo sapiens
agccctgggtcccagtcctggc

SEQ ID NO: 8341703 - DNA, 22 bp, Homo sapiens
agccctgggttagggtgggagc

SEQ ID NO: 8341704 - DNA, 23 bp, Homo sapiens
agaatttcaaagtccagcacatt

SEQ ID NO: 8341705 - DNA, 22 bp, Homo sapiens
agaatttaggatgcatgtgaat

SEQ ID NO: 8341706 - DNA, 22 bp, Homo sapiens
agaatcttgggcaaattcatct

SEQ ID NO: 8341707 - DNA, 22 bp, Homo sapiens
agaattgttctgtagcttggct

SEQ ID NO: 8341708 - DNA, 22 bp, Homo sapiens
agaatcctggagaagctgtacc

SEQ ID NO: 8341709 - DNA, 22 bp, Homo sapiens
agaatttctggaagattgcaag

SEQ ID NO: 8341710 - DNA, 22 bp, Homo sapiens
aatgtacactgaaagcctatca

SEQ ID NO: 8341711 - DNA, 21 bp, Homo sapiens
aatgtataacagagcccatca

SEQ ID NO: 8341712 - DNA, 22 bp, Homo sapiens
aatgtagatgagatattttttg

SEQ ID NO: 8341713 - DNA, 20 bp, Homo sapiens
aatgtactgtttgtgggggc

SEQ ID NO: 8341714 - DNA, 22 bp, Homo sapiens
aatgtacagctgctgctgaagg

SEQ ID NO: 8341715 - DNA, 22 bp, Homo sapiens
aatgtacagctgctgctgaagg

SEQ ID NO: 8341716 - DNA, 22 bp, Homo sapiens
aatgaaaattggaccctagaac

SEQ ID NO: 8341717 - DNA, 22 bp, Homo sapiens
aatgaaacatatttaggaataa

SEQ ID NO: 8341718 - DNA, 22 bp, Homo sapiens
aatgaaactagtagaatctttg

SEQ ID NO: 8341719 - DNA, 22 bp, Homo sapiens
aatgctttggggttggtactgt

SEQ ID NO: 8341720 - DNA, 22 bp, Homo sapiens
aatgctttgattgattaaaaca

SEQ ID NO: 8341721 - DNA, 22 bp, Homo sapiens
aatggacaggagagcatagtca

SEQ ID NO: 8341722 - DNA, 22 bp, Homo sapiens
agaataatcactgaagttcaaa

SEQ ID NO: 8341723 - DNA, 22 bp, Homo sapiens
agaatcagtgctggctattagc

SEQ ID NO: 8341724 - DNA, 21 bp, Homo sapiens
agaataatggtatcatttgct

SEQ ID NO: 8341725 - DNA, 19 bp, Homo sapiens
agaatcatcttgaagtgat

SEQ ID NO: 8341726 - DNA, 22 bp, Homo sapiens
aatggagaccctaaggaagagg

SEQ ID NO: 8341727 - DNA, 22 bp, Homo sapiens
agaataaatgctacctatcaca

SEQ ID NO: 8341728 - DNA, 22 bp, Homo sapiens
agaataaatgctacctatcaca

SEQ ID NO: 8341729 - DNA, 22 bp, Homo sapiens
agagaaacccttcagtgttttg

SEQ ID NO: 8341730 - DNA, 19 bp, Homo sapiens
agagaaagaattgagtcta

SEQ ID NO: 8341731 - DNA, 19 bp, Homo sapiens
agactctgtgtgagacttt

SEQ ID NO: 8341732 - DNA, 22 bp, Homo sapiens
agactctggagtcagctaggat

SEQ ID NO: 8341733 - DNA, 22 bp, Homo sapiens
agacctctggatagatgtgagg

SEQ ID NO: 8341734 - DNA, 22 bp, Homo sapiens
agacactggtgaagaaatcagg

SEQ ID NO: 8341735 - DNA, 22 bp, Homo sapiens
agacctcaataccaggcaccac

SEQ ID NO: 8341736 - DNA, 17 bp, Homo sapiens
agacactgagccaagta

SEQ ID NO: 8341737 - DNA, 22 bp, Homo sapiens
agagatcaaagcttgccaagta

SEQ ID NO: 8341738 - DNA, 22 bp, Homo sapiens
agagatctccatgcccttataa

SEQ ID NO: 8341739 - DNA, 22 bp, Homo sapiens
agagatctctgaagctgctgct

SEQ ID NO: 8341740 - DNA, 22 bp, Homo sapiens
agagatctgaaacaaattagga

SEQ ID NO: 8341741 - DNA, 22 bp, Homo sapiens
agagatctatttaatagtgtta

SEQ ID NO: 8341742 - DNA, 22 bp, Homo sapiens
agagatctagcacctgctggtc

SEQ ID NO: 8341743 - DNA, 21 bp, Homo sapiens
agagatctgaagaaccattag

SEQ ID NO: 8341744 - DNA, 22 bp, Homo sapiens
agagatctgtctactatttaag

SEQ ID NO: 8341745 - DNA, 22 bp, Homo sapiens
agagatctgtgcttactacaag

SEQ ID NO: 8341746 - DNA, 22 bp, Homo sapiens
aattatgtagccatatgaaaca

SEQ ID NO: 8341747 - DNA, 22 bp, Homo sapiens
agagatataagtataaataggg

SEQ ID NO: 8341748 - DNA, 22 bp, Homo sapiens
agagataaagctatgatttatg

SEQ ID NO: 8341749 - DNA, 20 bp, Homo sapiens
agagagaggtaaattgagca

SEQ ID NO: 8341750 - DNA, 22 bp, Homo sapiens
agagagaggcagcagtgctcac

SEQ ID NO: 8341751 - DNA, 22 bp, Homo sapiens
agagaaagtaaagattctacct

SEQ ID NO: 8341752 - DNA, 22 bp, Homo sapiens
agagaaagtcctgatctctcta

SEQ ID NO: 8341753 - DNA, 22 bp, Homo sapiens
agatatagttgttgagaagaac

SEQ ID NO: 8341754 - DNA, 22 bp, Homo sapiens
agatatgagaatatagaggccc

SEQ ID NO: 8341755 - DNA, 22 bp, Homo sapiens
agatatgactagaagctcattt

SEQ ID NO: 8341756 - DNA, 22 bp, Homo sapiens
agatatctgatgaaaatactct

SEQ ID NO: 8341757 - DNA, 22 bp, Homo sapiens
agatatctgcaatataatttaa

SEQ ID NO: 8341758 - DNA, 22 bp, Homo sapiens
agatctcacctctgtgtattat

SEQ ID NO: 8341759 - DNA, 22 bp, Homo sapiens
agattacaaatcctctgtgttt

SEQ ID NO: 8341760 - DNA, 22 bp, Homo sapiens
agattacagaagaataagtaga

SEQ ID NO: 8341761 - DNA, 21 bp, Homo sapiens
agattacaggtgtgatccacc

SEQ ID NO: 8341762 - DNA, 19 bp, Homo sapiens
agattattgcacattcatg

SEQ ID NO: 8341763 - DNA, 22 bp, Homo sapiens
agattatttccagactaatgaa

SEQ ID NO: 8341764 - DNA, 22 bp, Homo sapiens
agagtgaaggccaggttacagt

SEQ ID NO: 8341765 - DNA, 22 bp, Homo sapiens
agagtgaaggttgacacttcac

SEQ ID NO: 8341766 - DNA, 22 bp, Homo sapiens
agagtgaaaagctagagcagta

SEQ ID NO: 8341767 - DNA, 22 bp, Homo sapiens
agagtctgtgctttcatcagga

SEQ ID NO: 8341768 - DNA, 21 bp, Homo sapiens
agagtctgcatttctgacaag

SEQ ID NO: 8341769 - DNA, 22 bp, Homo sapiens
agagtctgtgaagtcagttact

SEQ ID NO: 8341770 - DNA, 22 bp, Homo sapiens
acaaaaagctccattactgtcc

SEQ ID NO: 8341771 - DNA, 20 bp, Homo sapiens
agagtaactggcacataggg

SEQ ID NO: 8341772 - DNA, 22 bp, Homo sapiens
agaggtggccatgggcgctgga

SEQ ID NO: 8341773 - DNA, 22 bp, Homo sapiens
aatttcaatgcactcatggttg

SEQ ID NO: 8341774 - DNA, 22 bp, Homo sapiens
agaggccaatagtaggtggcat

SEQ ID NO: 8341775 - DNA, 22 bp, Homo sapiens
aattttgtgtgggatcaaagga

SEQ ID NO: 8341776 - DNA, 21 bp, Homo sapiens
aattttgaaggaagattaagg

SEQ ID NO: 8341777 - DNA, 21 bp, Homo sapiens
aattttgaaggaagattaagg

SEQ ID NO: 8341778 - DNA, 22 bp, Homo sapiens
agagggcatgcttggtggcctg

SEQ ID NO: 8341779 - DNA, 22 bp, Homo sapiens
agaggccaagccagactgtgca

SEQ ID NO: 8341780 - DNA, 19 bp, Homo sapiens
agaggcagtctccaacagg

SEQ ID NO: 8341781 - DNA, 23 bp, Homo sapiens
agaggcaggagtggcttgcccgg

SEQ ID NO: 8341782 - DNA, 22 bp, Homo sapiens
agagcagctgtgacatggacag

SEQ ID NO: 8341783 - DNA, 22 bp, Homo sapiens
agagcagctcgctacctctcta

SEQ ID NO: 8341784 - DNA, 22 bp, Homo sapiens
agagcagctgcattcagcacct

SEQ ID NO: 8341785 - DNA, 22 bp, Homo sapiens
aattcagtgtctggcactgctg

SEQ ID NO: 8341786 - DNA, 22 bp, Homo sapiens
aattcagttatatgtccacttc

SEQ ID NO: 8341787 - DNA, 22 bp, Homo sapiens
aatgttacgatcaacaacacat

SEQ ID NO: 8341788 - DNA, 22 bp, Homo sapiens
aatgttttgtatgcctctgagc

SEQ ID NO: 8341789 - DNA, 22 bp, Homo sapiens
aatgttttttggtctgatgaat

SEQ ID NO: 8341790 - DNA, 22 bp, Homo sapiens
aactttcagcaagtaattctgg

SEQ ID NO: 8341791 - DNA, 22 bp, Homo sapiens
aactttcaggcaatgaatattt

SEQ ID NO: 8341792 - DNA, 22 bp, Homo sapiens
aatgtattttgggagtttcttt

SEQ ID NO: 8341793 - DNA, 22 bp, Homo sapiens
aatgtattttgggagtttcttt

SEQ ID NO: 8341794 - DNA, 22 bp, Homo sapiens
aatgtatttgatgtattagcct

SEQ ID NO: 8341795 - DNA, 22 bp, Homo sapiens
aatgtatttgatgtattagcct

SEQ ID NO: 8341796 - DNA, 20 bp, Homo sapiens
aatgtattgttttgtttcag

SEQ ID NO: 8341797 - DNA, 22 bp, Homo sapiens
aatgtattttgggagtttcttt

SEQ ID NO: 8341798 - DNA, 22 bp, Homo sapiens
aatgtacaccgtgggtttttta

SEQ ID NO: 8341799 - DNA, 22 bp, Homo sapiens
aatgtattctgggaaaatgtta

SEQ ID NO: 8341800 - DNA, 22 bp, Homo sapiens
aactccttaatgcatttcagag

SEQ ID NO: 8341801 - DNA, 20 bp, Homo sapiens
aactcctagcctcaagtgat

SEQ ID NO: 8341802 - DNA, 23 bp, Homo sapiens
aactctggctagcatagaataga

SEQ ID NO: 8341803 - DNA, 22 bp, Homo sapiens
aactctctctggctcccagcaa

SEQ ID NO: 8341804 - DNA, 22 bp, Homo sapiens
aagaattgatgtgaattgcagc

SEQ ID NO: 8341805 - DNA, 22 bp, Homo sapiens
aagaatttaaactaaccatatg

SEQ ID NO: 8341806 - DNA, 22 bp, Homo sapiens
aagaattattgcaatactagat

SEQ ID NO: 8341807 - DNA, 22 bp, Homo sapiens
aagacaagcatcaaatcaggca

SEQ ID NO: 8341808 - DNA, 22 bp, Homo sapiens
aattcaatctaagaaatgatca

SEQ ID NO: 8341809 - DNA, 22 bp, Homo sapiens
aattcaatctaagaaatgatca

SEQ ID NO: 8341810 - DNA, 20 bp, Homo sapiens
aattagatgtttaatcaata

SEQ ID NO: 8341811 - DNA, 22 bp, Homo sapiens
aattatttaactcctttggaga

SEQ ID NO: 8341812 - DNA, 22 bp, Homo sapiens
aattatttaactcctttggaga

SEQ ID NO: 8341813 - DNA, 22 bp, Homo sapiens
acaactttctgggttatctgat

SEQ ID NO: 8341814 - DNA, 23 bp, Homo sapiens
acaactttacagatacattttgt

SEQ ID NO: 8341815 - DNA, 22 bp, Homo sapiens
acaagaaaggtaggattcaggt

SEQ ID NO: 8341816 - DNA, 22 bp, Homo sapiens
acaagaaaggtaggattcaggt

SEQ ID NO: 8341817 - DNA, 22 bp, Homo sapiens
aagacattgctgcttttaattg

SEQ ID NO: 8341818 - DNA, 22 bp, Homo sapiens
aagacattcacaaatgttcact

SEQ ID NO: 8341819 - DNA, 22 bp, Homo sapiens
aagacaattttgagtatgcaca

SEQ ID NO: 8341820 - DNA, 19 bp, Homo sapiens
acagaaatgtaagtgagac

SEQ ID NO: 8341821 - DNA, 22 bp, Homo sapiens
acagaagacagagtgttcatct

SEQ ID NO: 8341822 - DNA, 20 bp, Homo sapiens
aagatagaatcctaactttg

SEQ ID NO: 8341823 - DNA, 22 bp, Homo sapiens
aagatagatgtcatcagcatat

SEQ ID NO: 8341824 - DNA, 22 bp, Homo sapiens
aagatactgatgatgtaggcta

SEQ ID NO: 8341825 - DNA, 20 bp, Homo sapiens
aagatactccagaaattaaa

SEQ ID NO: 8341826 - DNA, 22 bp, Homo sapiens
acactagatgccaatagcaccc

SEQ ID NO: 8341827 - DNA, 22 bp, Homo sapiens
aagatacattatgtctctctga

SEQ ID NO: 8341828 - DNA, 22 bp, Homo sapiens
aagcaaaaggttacacttctgg

SEQ ID NO: 8341829 - DNA, 22 bp, Homo sapiens
aagcaaaacgtgctctaggagg

SEQ ID NO: 8341830 - DNA, 22 bp, Homo sapiens
aagcaaaaggttacacttctgg

SEQ ID NO: 8341831 - DNA, 22 bp, Homo sapiens
aagcaaaaggttacacttctgg

SEQ ID NO: 8341832 - DNA, 22 bp, Homo sapiens
acagaagcaaagactcaggcaa

SEQ ID NO: 8341833 - DNA, 22 bp, Homo sapiens
acagaagagcacatttagtatg

SEQ ID NO: 8341834 - DNA, 22 bp, Homo sapiens
acagaagagcacatttagtatg

SEQ ID NO: 8341835 - DNA, 22 bp, Homo sapiens
acagatgacttgtctgctgtaa

SEQ ID NO: 8341836 - DNA, 22 bp, Homo sapiens
acagatgaaacccagctagttg

SEQ ID NO: 8341837 - DNA, 22 bp, Homo sapiens
acagatgaatctgtgattgctg

SEQ ID NO: 8341838 - DNA, 23 bp, Homo sapiens
acagatcatctcgaaacaactat

SEQ ID NO: 8341839 - DNA, 18 bp, Homo sapiens
acagaggcagacatgtat

SEQ ID NO: 8341840 - DNA, 22 bp, Homo sapiens
acagaggacaactaggcgctca

SEQ ID NO: 8341841 - DNA, 22 bp, Homo sapiens
acagaggaaggctgagctgccc

SEQ ID NO: 8341842 - DNA, 22 bp, Homo sapiens
acagaggaagcatatagcacaa

SEQ ID NO: 8341843 - DNA, 22 bp, Homo sapiens
aagcaaacaggagaagagctgt

SEQ ID NO: 8341844 - DNA, 22 bp, Homo sapiens
acacacaggtaaaggagcctgg

SEQ ID NO: 8341845 - DNA, 22 bp, Homo sapiens
aagacatttatttgaatcaatt

SEQ ID NO: 8341846 - DNA, 22 bp, Homo sapiens
aagacatttatttgaatcaatt

SEQ ID NO: 8341847 - DNA, 22 bp, Homo sapiens
aagaggaggattgatgtgggag

SEQ ID NO: 8341848 - DNA, 23 bp, Homo sapiens
aagaggaggccctgctcccgtcc

SEQ ID NO: 8341849 - DNA, 22 bp, Homo sapiens
aagaggagggcagattcaaggc

SEQ ID NO: 8341850 - DNA, 22 bp, Homo sapiens
aagaggagtagatgtggttggt

SEQ ID NO: 8341851 - DNA, 22 bp, Homo sapiens
acactacaatctcagaactata

SEQ ID NO: 8341852 - DNA, 22 bp, Homo sapiens
acactaaggttggagtcacagt

SEQ ID NO: 8341853 - DNA, 22 bp, Homo sapiens
acacctttcaggtccagacagt

SEQ ID NO: 8341854 - DNA, 22 bp, Homo sapiens
acacctggtctttgcatgagca

SEQ ID NO: 8341855 - DNA, 22 bp, Homo sapiens
acaccttctgagaactgagcag

SEQ ID NO: 8341856 - DNA, 22 bp, Homo sapiens
aagagtaaagcaaagcacttgt

SEQ ID NO: 8341857 - DNA, 22 bp, Homo sapiens
aagagtcatagagacattgatt

SEQ ID NO: 8341858 - DNA, 22 bp, Homo sapiens
aaatttcaagcaaagtagctat

SEQ ID NO: 8341859 - DNA, 22 bp, Homo sapiens
aacaaatgtgttttgtaattaa

SEQ ID NO: 8341860 - DNA, 22 bp, Homo sapiens
aacaaatgtgtggcagtgtggg

SEQ ID NO: 8341861 - DNA, 22 bp, Homo sapiens
aacaagcagatgcaatgcactt

SEQ ID NO: 8341862 - DNA, 22 bp, Homo sapiens
aacaagatagatatcacttagg

SEQ ID NO: 8341863 - DNA, 22 bp, Homo sapiens
aacaagcagatgcaatgcactt

SEQ ID NO: 8341864 - DNA, 22 bp, Homo sapiens
aacaataattgcggttctctat

SEQ ID NO: 8341865 - DNA, 20 bp, Homo sapiens
aacaatctagaagctattct

SEQ ID NO: 8341866 - DNA, 22 bp, Homo sapiens
aaggggctcttgtcaggcgcag

SEQ ID NO: 8341867 - DNA, 23 bp, Homo sapiens
aacaataggttttggcagaatag

SEQ ID NO: 8341868 - DNA, 22 bp, Homo sapiens
aaggggcatgcttttgccagga

SEQ ID NO: 8341869 - DNA, 22 bp, Homo sapiens
aaggggagatgtcatgggccct

SEQ ID NO: 8341870 - DNA, 22 bp, Homo sapiens
aaattattatgcccctctataa

SEQ ID NO: 8341871 - DNA, 22 bp, Homo sapiens
aaattattataggcagagctga

SEQ ID NO: 8341872 - DNA, 22 bp, Homo sapiens
aaggaaacactgaactttgtag

SEQ ID NO: 8341873 - DNA, 22 bp, Homo sapiens
aaggaaacactgaactttgtag

SEQ ID NO: 8341874 - DNA, 22 bp, Homo sapiens
aaggactccaattctttcatct

SEQ ID NO: 8341875 - DNA, 22 bp, Homo sapiens
aaggacctgattttgagcatct

SEQ ID NO: 8341876 - DNA, 22 bp, Homo sapiens
aaggacatttctgactaatgca

SEQ ID NO: 8341877 - DNA, 22 bp, Homo sapiens
aaggactggcattatcttatgt

SEQ ID NO: 8341878 - DNA, 22 bp, Homo sapiens
aaggactgctaggaagccgtgt

SEQ ID NO: 8341879 - DNA, 22 bp, Homo sapiens
aaggactgacaaatgtcttcct

SEQ ID NO: 8341880 - DNA, 22 bp, Homo sapiens
aaatttaaaaagcagcattgca

SEQ ID NO: 8341881 - DNA, 18 bp, Homo sapiens
aagctgggaaggagacag

SEQ ID NO: 8341882 - DNA, 22 bp, Homo sapiens
aagctgattctaaaatttatta

SEQ ID NO: 8341883 - DNA, 22 bp, Homo sapiens
aagctgtcaatgtatctagtct

SEQ ID NO: 8341884 - DNA, 22 bp, Homo sapiens
aagctggggactcagaccccat

SEQ ID NO: 8341885 - DNA, 22 bp, Homo sapiens
aagctttgggcagaagaggatt

SEQ ID NO: 8341886 - DNA, 21 bp, Homo sapiens
aaggaaaagcttggtctctga

SEQ ID NO: 8341887 - DNA, 21 bp, Homo sapiens
aaggaaaagcttggtctctga

SEQ ID NO: 8341888 - DNA, 22 bp, Homo sapiens
aagctttttggatttgcttcag

SEQ ID NO: 8341889 - DNA, 22 bp, Homo sapiens
aagctttgttcttcacagagtg

SEQ ID NO: 8341890 - DNA, 22 bp, Homo sapiens
aagcttttattaaaatcttgcc

SEQ ID NO: 8341891 - DNA, 22 bp, Homo sapiens
aataaacaaatctttcctgtgg

SEQ ID NO: 8341892 - DNA, 22 bp, Homo sapiens
aacagtttgcctgaaatgtatt

SEQ ID NO: 8341893 - DNA, 22 bp, Homo sapiens
aacagtttgagctttgaatttc

SEQ ID NO: 8341894 - DNA, 22 bp, Homo sapiens
aataaaatggtcagttttctca

SEQ ID NO: 8341895 - DNA, 22 bp, Homo sapiens
aagtttgagaagcttatagata

SEQ ID NO: 8341896 - DNA, 22 bp, Homo sapiens
aagtttctgttcgctttaataa

SEQ ID NO: 8341897 - DNA, 22 bp, Homo sapiens
aagtttctgttcatatctctga

SEQ ID NO: 8341898 - DNA, 20 bp, Homo sapiens
aagtttctggtttatatctt

SEQ ID NO: 8341899 - DNA, 22 bp, Homo sapiens
aagttgctaaaggagttctttg

SEQ ID NO: 8341900 - DNA, 22 bp, Homo sapiens
aagttgctagtgcttttctgag

SEQ ID NO: 8341901 - DNA, 20 bp, Homo sapiens
aagttacattgtattgtacc

SEQ ID NO: 8341902 - DNA, 22 bp, Homo sapiens
aacactggtttggcattagatg

SEQ ID NO: 8341903 - DNA, 22 bp, Homo sapiens
aagttgagagaaagcccgtgtt

SEQ ID NO: 8341904 - DNA, 22 bp, Homo sapiens
aagttgattaatctttcgagaa

SEQ ID NO: 8341905 - DNA, 22 bp, Homo sapiens
aagttgatggcgtctttgagat

SEQ ID NO: 8341906 - DNA, 22 bp, Homo sapiens
aagttgatagcatgttaagctc

SEQ ID NO: 8341907 - DNA, 19 bp, Homo sapiens
aagttgatcattttgacag

SEQ ID NO: 8341908 - DNA, 22 bp, Homo sapiens
aagttcttgagccctattctag

SEQ ID NO: 8341909 - DNA, 22 bp, Homo sapiens
aagtatttcgttctgaaaaagt

SEQ ID NO: 8341910 - DNA, 22 bp, Homo sapiens
aagtcaagtgttattattgtag

SEQ ID NO: 8341911 - DNA, 21 bp, Homo sapiens
aagtcaatacagataagtctt

SEQ ID NO: 8341912 - DNA, 22 bp, Homo sapiens
aatcacatttacattgctaatt

SEQ ID NO: 8341913 - DNA, 22 bp, Homo sapiens
aatcacattgaatctgctacct

SEQ ID NO: 8341914 - DNA, 22 bp, Homo sapiens
aatcacattagtgaaacactga

SEQ ID NO: 8341915 - DNA, 22 bp, Homo sapiens
aatcacattacagcatatctgt

SEQ ID NO: 8341916 - DNA, 22 bp, Homo sapiens
aactatacatatttacatagac

SEQ ID NO: 8341917 - DNA, 22 bp, Homo sapiens
aacatttacaaatccttctgca

SEQ ID NO: 8341918 - DNA, 22 bp, Homo sapiens
aacattgattgcatctgttcac

SEQ ID NO: 8341919 - DNA, 20 bp, Homo sapiens
aacattgaaagtctagaaga

SEQ ID NO: 8341920 - DNA, 22 bp, Homo sapiens
aacattgaacttggcacaccca

SEQ ID NO: 8341921 - DNA, 22 bp, Homo sapiens
aacattgagttagggagcgtat

SEQ ID NO: 8341922 - DNA, 22 bp, Homo sapiens
aacattgagttctacttccatt

SEQ ID NO: 8341923 - DNA, 21 bp, Homo sapiens
aacattgattcatttggctat

SEQ ID NO: 8341924 - DNA, 22 bp, Homo sapiens
aacagtttgtggatagcttgta

SEQ ID NO: 8341925 - DNA, 22 bp, Homo sapiens
aacattctgtcaattgatgacc

SEQ ID NO: 8341926 - DNA, 22 bp, Homo sapiens
aacattaagatggcggaacagt

SEQ ID NO: 8341927 - DNA, 22 bp, Homo sapiens
aatcacattaagccctgttcag

SEQ ID NO: 8341928 - DNA, 22 bp, Homo sapiens
aacatttcagcacctgattcct

SEQ ID NO: 8341929 - DNA, 22 bp, Homo sapiens
aacatttatggtagtcattgca

SEQ ID NO: 8341930 - DNA, 22 bp, Homo sapiens
aacatttatatgggttcatgaa

SEQ ID NO: 8341931 - DNA, 22 bp, Homo sapiens
aacatttaggaaggacctcctc

SEQ ID NO: 8341932 - DNA, 22 bp, Homo sapiens
aacatttatgattgaggtaaat

SEQ ID NO: 8341933 - DNA, 22 bp, Homo sapiens
aaatacagattctgactcagag

SEQ ID NO: 8341934 - DNA, 22 bp, Homo sapiens
aaatactgttgaatgaagtaag

SEQ ID NO: 8341935 - DNA, 22 bp, Homo sapiens
aaatagaaaccaacaaggtcag

SEQ ID NO: 8341936 - DNA, 22 bp, Homo sapiens
aaatagaattaactagctactg

SEQ ID NO: 8341937 - DNA, 22 bp, Homo sapiens
aaatagaaaccaacaaggtcag

SEQ ID NO: 8341938 - DNA, 22 bp, Homo sapiens
aaatagaattaactagctactg

SEQ ID NO: 8341939 - DNA, 22 bp, Homo sapiens
aaatagaattggaagcagagtt

SEQ ID NO: 8341940 - DNA, 22 bp, Homo sapiens
aaatatgtgatcagtgaataaa

SEQ ID NO: 8341941 - DNA, 23 bp, Homo sapiens
aaatatgtctgagggcaaagaat

SEQ ID NO: 8341942 - DNA, 22 bp, Homo sapiens
aaactagaaatcagcaagatag

SEQ ID NO: 8341943 - DNA, 22 bp, Homo sapiens
aaactacatctcatggatgagg

SEQ ID NO: 8341944 - DNA, 19 bp, Homo sapiens
aaactaaggggaaatgttt

SEQ ID NO: 8341945 - DNA, 22 bp, Homo sapiens
aaatcagtccctcttggaattt

SEQ ID NO: 8341946 - DNA, 22 bp, Homo sapiens
aaatcagtgctcatttgaaagg

SEQ ID NO: 8341947 - DNA, 22 bp, Homo sapiens
aaatcagttcacgttctgaggt

SEQ ID NO: 8341948 - DNA, 22 bp, Homo sapiens
aaatcagttaagatgaggccat

SEQ ID NO: 8341949 - DNA, 22 bp, Homo sapiens
aaatcagttagtggtaggattg

SEQ ID NO: 8341950 - DNA, 22 bp, Homo sapiens
aaatcagttctccctttcttca

SEQ ID NO: 8341951 - DNA, 22 bp, Homo sapiens
aaatcagttggaacacaagcag

SEQ ID NO: 8341952 - DNA, 22 bp, Homo sapiens
aaatcagttgttatattaaaga

SEQ ID NO: 8341953 - DNA, 22 bp, Homo sapiens
aaatcattatttacagttctga

SEQ ID NO: 8341954 - DNA, 22 bp, Homo sapiens
aaatcatctctgcatccttagc

SEQ ID NO: 8341955 - DNA, 22 bp, Homo sapiens
aaatcatgaggacattatgcca

SEQ ID NO: 8341956 - DNA, 22 bp, Homo sapiens
aaatgctagggagaaactctcc

SEQ ID NO: 8341957 - DNA, 18 bp, Homo sapiens
aaatgctaggctacatga

SEQ ID NO: 8341958 - DNA, 22 bp, Homo sapiens
aaatggcagtagaaaagaatcc

SEQ ID NO: 8341959 - DNA, 22 bp, Homo sapiens
aaatgctaacaaggaatgctgc

SEQ ID NO: 8341960 - DNA, 22 bp, Homo sapiens
aaatgctacatacacatcaggg

SEQ ID NO: 8341961 - DNA, 22 bp, Homo sapiens
aaatgctacacaggaattctca

SEQ ID NO: 8341962 - DNA, 18 bp, Homo sapiens
aaatgctaggctacatga

SEQ ID NO: 8341963 - DNA, 22 bp, Homo sapiens
aaacagttttttaagtctctag

SEQ ID NO: 8341964 - DNA, 22 bp, Homo sapiens
aaacatagataatagatagatg

SEQ ID NO: 8341965 - DNA, 22 bp, Homo sapiens
aaacatctatcagcatttttta

SEQ ID NO: 8341966 - DNA, 22 bp, Homo sapiens
aaacatctactgtaggctggag

SEQ ID NO: 8341967 - DNA, 22 bp, Homo sapiens
aaacatctattatgtgctgagc

SEQ ID NO: 8341968 - DNA, 22 bp, Homo sapiens
aaacagttttctcatttagtgt

SEQ ID NO: 8341969 - DNA, 22 bp, Homo sapiens
aaacagttttctcatttagtgt

SEQ ID NO: 8341970 - DNA, 22 bp, Homo sapiens
aaacagttttgccaaaaggaca

SEQ ID NO: 8341971 - DNA, 22 bp, Homo sapiens
aaagtcattttccagaccagta

SEQ ID NO: 8341972 - DNA, 22 bp, Homo sapiens
aaagtgcagtccatgaaattaa

SEQ ID NO: 8341973 - DNA, 22 bp, Homo sapiens
aaacactgtctctggtattgaa

SEQ ID NO: 8341974 - DNA, 22 bp, Homo sapiens
aaacactggcaatttcatgcac

SEQ ID NO: 8341975 - DNA, 22 bp, Homo sapiens
aaacactgtacaatctgcaggg

SEQ ID NO: 8341976 - DNA, 22 bp, Homo sapiens
aaacactggtatgatgtatagt

SEQ ID NO: 8341977 - DNA, 22 bp, Homo sapiens
aaagcaatggatgagaatctgt

SEQ ID NO: 8341978 - DNA, 22 bp, Homo sapiens
aaagcaatgcccgttcattatc

SEQ ID NO: 8341979 - DNA, 22 bp, Homo sapiens
aaagcaatcagattcagatgtc

SEQ ID NO: 8341980 - DNA, 22 bp, Homo sapiens
aaagatgtcatacacattaaga

SEQ ID NO: 8341981 - DNA, 22 bp, Homo sapiens
aaacaaacataggtttgaaagt

SEQ ID NO: 8341982 - DNA, 22 bp, Homo sapiens
aaacaacaatccaatgggagct

SEQ ID NO: 8341983 - DNA, 22 bp, Homo sapiens
aaacaagagcttacatggctgc

SEQ ID NO: 8341984 - DNA, 22 bp, Homo sapiens
aaacaacttctgcactatgggt

SEQ ID NO: 8341985 - DNA, 22 bp, Homo sapiens
aaacaacgatgtacacatttat

SEQ ID NO: 8341986 - DNA, 22 bp, Homo sapiens
aaaattcattcctcagactgcc

SEQ ID NO: 8341987 - DNA, 22 bp, Homo sapiens
aaaatagattctaggatgtctt

SEQ ID NO: 8341988 - DNA, 22 bp, Homo sapiens
aaaaatgaattcttcagtggca

SEQ ID NO: 8341989 - DNA, 22 bp, Homo sapiens
aaaaagatagcattgtgctcct

SEQ ID NO: 8341990 - DNA, 19 bp, Homo sapiens
aaaaagaggctataatatt

SEQ ID NO: 8341991 - DNA, 22 bp, Homo sapiens
aaaaagatgtcctgaagtttag

SEQ ID NO: 8341992 - DNA, 20 bp, Homo sapiens
aaaaagacaaaacgagttgg

SEQ ID NO: 8341993 - DNA, 20 bp, Homo sapiens
aaaaagacaaaacgagttgg

SEQ ID NO: 8341994 - DNA, 22 bp, Homo sapiens
aaaagtcagtctctcctagctc

SEQ ID NO: 8341995 - DNA, 22 bp, Homo sapiens
aaagaagacagacatttctttc

SEQ ID NO: 8341996 - DNA, 22 bp, Homo sapiens
aaagaagagcaaatttgttgta

SEQ ID NO: 8341997 - DNA, 21 bp, Homo sapiens
aaagatgagaactggatggct

SEQ ID NO: 8341998 - DNA, 22 bp, Homo sapiens
aaacttgagccaagggcttggg

SEQ ID NO: 8341999 - DNA, 22 bp, Homo sapiens
aaactttaggaaggaatttaca

SEQ ID NO: 8342000 - DNA, 22 bp, Homo sapiens
aaacttgtgtatgtatatgcaa

SEQ ID NO: 8342001 - DNA, 22 bp, Homo sapiens
aaacatctggaggccccgtttg

SEQ ID NO: 8342002 - DNA, 22 bp, Homo sapiens
aaacatctggttacctagggtc

SEQ ID NO: 8342003 - DNA, 22 bp, Homo sapiens
aaacatcttctcttgattcttt

SEQ ID NO: 8342004 - DNA, 22 bp, Homo sapiens
aaacatcttgctctgattggta

SEQ ID NO: 8342005 - DNA, 22 bp, Homo sapiens
aaacatctttctattgcaagtt

SEQ ID NO: 8342006 - DNA, 22 bp, Homo sapiens
aaacagtcgtcttaatagtatt

SEQ ID NO: 8342007 - DNA, 22 bp, Homo sapiens
aaacatctgacttgctttttca

SEQ ID NO: 8342008 - DNA, 22 bp, Homo sapiens
aaaccattaggttttatctact

SEQ ID NO: 8342009 - DNA, 22 bp, Homo sapiens
aaaccatttgaattattactga

SEQ ID NO: 8342010 - DNA, 22 bp, Homo sapiens
aaaccatgagcagctgggctga

SEQ ID NO: 8342011 - DNA, 22 bp, Homo sapiens
aaaccatgcagtctgtgtacat

SEQ ID NO: 8342012 - DNA, 22 bp, Homo sapiens
aaaccatggctcattggagatg

SEQ ID NO: 8342013 - DNA, 22 bp, Homo sapiens
aaaccatgctttgatgatttta

SEQ ID NO: 8342014 - DNA, 22 bp, Homo sapiens
aaaccatggagtaagttcacat

SEQ ID NO: 8342015 - DNA, 22 bp, Homo sapiens
aaaccacagttcagtgcttttg

SEQ ID NO: 8342016 - DNA, 22 bp, Homo sapiens
aaacatttgcaactcggtttgg

SEQ ID NO: 8342017 - DNA, 23 bp, Homo sapiens
aaacatttctcttttcctgcctc

SEQ ID NO: 8342018 - DNA, 22 bp, Homo sapiens
aaacatttttcttcatcatcct

SEQ ID NO: 8342019 - DNA, 22 bp, Homo sapiens
aaatatcttaggagtatatgag

SEQ ID NO: 8342020 - DNA, 22 bp, Homo sapiens
aaatatcattctggtgcacaga

SEQ ID NO: 8342021 - DNA, 22 bp, Homo sapiens
aagattctcagagtgaaagaat

SEQ ID NO: 8342022 - DNA, 22 bp, Homo sapiens
aagaggaggacggttcccagaa

SEQ ID NO: 8342023 - DNA, 18 bp, Homo sapiens
aagaggaggaaacccagg

SEQ ID NO: 8342024 - DNA, 22 bp, Homo sapiens
aagaggagacttcagcaacttg

SEQ ID NO: 8342025 - DNA, 22 bp, Homo sapiens
aagcaacagaaacattctaata

SEQ ID NO: 8342026 - DNA, 22 bp, Homo sapiens
aagcaaagtgctttgcctccag

SEQ ID NO: 8342027 - DNA, 22 bp, Homo sapiens
aagccagatagaagaactcatt

SEQ ID NO: 8342028 - DNA, 22 bp, Homo sapiens
aagcagcaagtttatttctatc

SEQ ID NO: 8342029 - DNA, 22 bp, Homo sapiens
aagcagattggggatttccatg

SEQ ID NO: 8342030 - DNA, 22 bp, Homo sapiens
aagcagatgccaagatttacca

SEQ ID NO: 8342031 - DNA, 20 bp, Homo sapiens
aagcactgtggtggcatgga

SEQ ID NO: 8342032 - DNA, 22 bp, Homo sapiens
aagcacttgcttagatgtggtt

SEQ ID NO: 8342033 - DNA, 22 bp, Homo sapiens
aagcactgtacaaatgtcactt

SEQ ID NO: 8342034 - DNA, 22 bp, Homo sapiens
aagcactgggtatagcaatgat

SEQ ID NO: 8342035 - DNA, 22 bp, Homo sapiens
aagcactgggtatagcaatgat

SEQ ID NO: 8342036 - DNA, 22 bp, Homo sapiens
aagcactgaggaaaaatttgat

SEQ ID NO: 8342037 - DNA, 22 bp, Homo sapiens
aagcactgggaggaggctgaga

SEQ ID NO: 8342038 - DNA, 22 bp, Homo sapiens
aactttctttgcatctaagttt

SEQ ID NO: 8342039 - DNA, 22 bp, Homo sapiens
aactttgggcctaagtactgtt

SEQ ID NO: 8342040 - DNA, 22 bp, Homo sapiens
aagaaagctgaatattctgtgt

SEQ ID NO: 8342041 - DNA, 22 bp, Homo sapiens
aagaaagccaaagttcatacct

SEQ ID NO: 8342042 - DNA, 22 bp, Homo sapiens
aagaatgattacaaagcaacga

SEQ ID NO: 8342043 - DNA, 22 bp, Homo sapiens
aagaatgaaggatttagctgtt

SEQ ID NO: 8342044 - DNA, 22 bp, Homo sapiens
aagaatgagctcaaagatctta

SEQ ID NO: 8342045 - DNA, 22 bp, Homo sapiens
aagaaagtgctttgtaaattat

SEQ ID NO: 8342046 - DNA, 22 bp, Homo sapiens
aagaaagtgggtaatatgattt

SEQ ID NO: 8342047 - DNA, 21 bp, Homo sapiens
aagacagaaaagcctattttc

SEQ ID NO: 8342048 - DNA, 20 bp, Homo sapiens
aagagcatagtacaggaaga

SEQ ID NO: 8342049 - DNA, 22 bp, Homo sapiens
aagagcatatatgtatgtttgt

SEQ ID NO: 8342050 - DNA, 22 bp, Homo sapiens
aagagcccttgttcataattat

SEQ ID NO: 8342051 - DNA, 22 bp, Homo sapiens
aagaggagaaaggctggctttg

SEQ ID NO: 8342052 - DNA, 22 bp, Homo sapiens
aagagcatatggttctcaaagc

SEQ ID NO: 8342053 - DNA, 22 bp, Homo sapiens
aagagcatcaatgactcgcagt

SEQ ID NO: 8342054 - DNA, 22 bp, Homo sapiens
aagagcatattaatagtggaga

SEQ ID NO: 8342055 - DNA, 22 bp, Homo sapiens
aagagcatcggtggagccccca

SEQ ID NO: 8342056 - DNA, 22 bp, Homo sapiens
aagagcattccgttctgattct

SEQ ID NO: 8342057 - DNA, 22 bp, Homo sapiens
aagagcatgtaattggatttct

SEQ ID NO: 8342058 - DNA, 22 bp, Homo sapiens
aagagcatgttaattctaggac

SEQ ID NO: 8342059 - DNA, 22 bp, Homo sapiens
aagagcatggaatggagatcca

SEQ ID NO: 8342060 - DNA, 22 bp, Homo sapiens
aagagcatctatttcacagtgg

SEQ ID NO: 8342061 - DNA, 22 bp, Homo sapiens
aagagcatggagttcccctaaa

SEQ ID NO: 8342062 - DNA, 22 bp, Homo sapiens
aagagcatggcaagaaaagggt

SEQ ID NO: 8342063 - DNA, 22 bp, Homo sapiens
aagagcattttgtaaaatcctt

SEQ ID NO: 8342064 - DNA, 22 bp, Homo sapiens
aagagcatttggtgagatttga

SEQ ID NO: 8342065 - DNA, 22 bp, Homo sapiens
aagagcattttagtctcccttt

SEQ ID NO: 8342066 - DNA, 22 bp, Homo sapiens
aagagcatttaattaggagagt

SEQ ID NO: 8342067 - DNA, 22 bp, Homo sapiens
aagagcattcctaaaggaccat

SEQ ID NO: 8342068 - DNA, 22 bp, Homo sapiens
aagagcatttccactggcactg

SEQ ID NO: 8342069 - DNA, 22 bp, Homo sapiens
aactcactttgtggcttctgaa

SEQ ID NO: 8342070 - DNA, 22 bp, Homo sapiens
aacatttgtactaaagaagttc

SEQ ID NO: 8342071 - DNA, 22 bp, Homo sapiens
aacatttgcatgctttattaga

SEQ ID NO: 8342072 - DNA, 22 bp, Homo sapiens
aacatttgcagaggaaagctat

SEQ ID NO: 8342073 - DNA, 22 bp, Homo sapiens
aacatttgagaaaaatactctt

SEQ ID NO: 8342074 - DNA, 22 bp, Homo sapiens
aacatttcttctgaaactgagt

SEQ ID NO: 8342075 - DNA, 22 bp, Homo sapiens
aacatttgaaaatcaagaatct

SEQ ID NO: 8342076 - DNA, 22 bp, Homo sapiens
aactgaaatcaatcagtgattc

SEQ ID NO: 8342077 - DNA, 22 bp, Homo sapiens
aactcactttgtggcttctgaa

SEQ ID NO: 8342078 - DNA, 22 bp, Homo sapiens
aactcagcatcctgcacagaga

SEQ ID NO: 8342079 - DNA, 22 bp, Homo sapiens
aactcagcatcagtgtccagaa

SEQ ID NO: 8342080 - DNA, 21 bp, Homo sapiens
aacatttctgggagaactcac

SEQ ID NO: 8342081 - DNA, 22 bp, Homo sapiens
aacatttcattggaagctatgt

SEQ ID NO: 8342082 - DNA, 22 bp, Homo sapiens
aacatttcattggaagctatgt

SEQ ID NO: 8342083 - DNA, 22 bp, Homo sapiens
aacattctattttgctaaaaca

SEQ ID NO: 8342084 - DNA, 22 bp, Homo sapiens
aacattctatgtgcattcagaa

SEQ ID NO: 8342085 - DNA, 22 bp, Homo sapiens
aacattaattacagtcaaacat

SEQ ID NO: 8342086 - DNA, 22 bp, Homo sapiens
aacagtatggaagccattagga

SEQ ID NO: 8342087 - DNA, 22 bp, Homo sapiens
aacagtatggaagccattagga

SEQ ID NO: 8342088 - DNA, 22 bp, Homo sapiens
aacagtatcttttatcagaaat

SEQ ID NO: 8342089 - DNA, 22 bp, Homo sapiens
aacagtatcttttatcagaaat

SEQ ID NO: 8342090 - DNA, 19 bp, Homo sapiens
aacagtctgggaagcacag

SEQ ID NO: 8342091 - DNA, 22 bp, Homo sapiens
aacagtcttacagaagtagcca

SEQ ID NO: 8342092 - DNA, 22 bp, Homo sapiens
aacagtatatgaaatgttagga

SEQ ID NO: 8342093 - DNA, 22 bp, Homo sapiens
aacagctttgcttctggagaca

SEQ ID NO: 8342094 - DNA, 22 bp, Homo sapiens
aacagctttgcttctggagaca

SEQ ID NO: 8342095 - DNA, 22 bp, Homo sapiens
aacagcttttttggtcagcatt

SEQ ID NO: 8342096 - DNA, 22 bp, Homo sapiens
aacagcttttttggtcagcatt

SEQ ID NO: 8342097 - DNA, 22 bp, Homo sapiens
aacagcttgctgcaccttaata

SEQ ID NO: 8342098 - DNA, 22 bp, Homo sapiens
aacagctttagaggataatagt

SEQ ID NO: 8342099 - DNA, 22 bp, Homo sapiens
aacaagaacacctacagttcta

SEQ ID NO: 8342100 - DNA, 22 bp, Homo sapiens
aacaagaagagagggacgtaat

SEQ ID NO: 8342101 - DNA, 22 bp, Homo sapiens
aacaagagactctgttccagaa

SEQ ID NO: 8342102 - DNA, 22 bp, Homo sapiens
aacaattgacacttcattgtga

SEQ ID NO: 8342103 - DNA, 22 bp, Homo sapiens
aaagcacattacaagctcagtc

SEQ ID NO: 8342104 - DNA, 22 bp, Homo sapiens
aaagcacatgagtagtgtagta

SEQ ID NO: 8342105 - DNA, 22 bp, Homo sapiens
aaagcacatgagtagtgtagta

SEQ ID NO: 8342106 - DNA, 22 bp, Homo sapiens
aaagcacatagtagaaggattt

SEQ ID NO: 8342107 - DNA, 22 bp, Homo sapiens
aaagcacaggagagttcagtaa

SEQ ID NO: 8342108 - DNA, 22 bp, Homo sapiens
aaagcacagggtgctagagagt

SEQ ID NO: 8342109 - DNA, 22 bp, Homo sapiens
aaagcaatttaatggaccatga

SEQ ID NO: 8342110 - DNA, 22 bp, Homo sapiens
aacaaatttagctctgagtgct

SEQ ID NO: 8342111 - DNA, 22 bp, Homo sapiens
aacaacagctgctaaagagttg

SEQ ID NO: 8342112 - DNA, 22 bp, Homo sapiens
aaatggtagtagcattccatat

SEQ ID NO: 8342113 - DNA, 22 bp, Homo sapiens
aaatggtataatgtcatgtatt

SEQ ID NO: 8342114 - DNA, 22 bp, Homo sapiens
aaatggtaagacaacacattat

SEQ ID NO: 8342115 - DNA, 22 bp, Homo sapiens
aaatggtaagacaacacattat

SEQ ID NO: 8342116 - DNA, 22 bp, Homo sapiens
aaatggtaccctaatggccaga

SEQ ID NO: 8342117 - DNA, 22 bp, Homo sapiens
aaatggtagtagcattccatat

SEQ ID NO: 8342118 - DNA, 22 bp, Homo sapiens
aaatggctacaagatgtgctct

SEQ ID NO: 8342119 - DNA, 22 bp, Homo sapiens
aaagcaagtctctacaaagtac

SEQ ID NO: 8342120 - DNA, 22 bp, Homo sapiens
aaagcaattgtggtttttgtca

SEQ ID NO: 8342121 - DNA, 22 bp, Homo sapiens
agcagctcaacagtgtctctat

SEQ ID NO: 8342122 - DNA, 22 bp, Homo sapiens
agcagcctttgatcatctggga

SEQ ID NO: 8342123 - DNA, 22 bp, Homo sapiens
agcagctcccctcatgctccac

SEQ ID NO: 8342124 - DNA, 22 bp, Homo sapiens
cacagagcaggtgctgggaaga

SEQ ID NO: 8342125 - DNA, 21 bp, Homo sapiens
agcagctgggcaacatggagg

SEQ ID NO: 8342126 - DNA, 22 bp, Homo sapiens
agcagcctcccagggagcagcc

SEQ ID NO: 8342127 - DNA, 22 bp, Homo sapiens
agcagccagagaatgatgcagt

SEQ ID NO: 8342128 - DNA, 22 bp, Homo sapiens
caatacagcacacctgtatcag

SEQ ID NO: 8342129 - DNA, 19 bp, Homo sapiens
agcagcagaagtgtgcctt

SEQ ID NO: 8342130 - DNA, 22 bp, Homo sapiens
caatacaattaccagttaatca

SEQ ID NO: 8342131 - DNA, 22 bp, Homo sapiens
caataatatcctgtgctgtttg

SEQ ID NO: 8342132 - DNA, 22 bp, Homo sapiens
caataatatcctgtgctgtttg

SEQ ID NO: 8342133 - DNA, 16 bp, Homo sapiens
agcagaggtgagtgaa

SEQ ID NO: 8342134 - DNA, 22 bp, Homo sapiens
agcagaggtttgttggaaacct

SEQ ID NO: 8342135 - DNA, 22 bp, Homo sapiens
agcagaggtttgttggaaacct

SEQ ID NO: 8342136 - DNA, 22 bp, Homo sapiens
agcagagctgggatcctgggtc

SEQ ID NO: 8342137 - DNA, 22 bp, Homo sapiens
agcagagcggggcctccggaag

SEQ ID NO: 8342138 - DNA, 22 bp, Homo sapiens
agcagagacctggttttgttga

SEQ ID NO: 8342139 - DNA, 22 bp, Homo sapiens
agcagagcgcctgctcagaggg

SEQ ID NO: 8342140 - DNA, 22 bp, Homo sapiens
caaaggcagttactgaatgaag

SEQ ID NO: 8342141 - DNA, 22 bp, Homo sapiens
agcactggagtttagtgggatt

SEQ ID NO: 8342142 - DNA, 22 bp, Homo sapiens
agcactggaaagttaagagttt

SEQ ID NO: 8342143 - DNA, 22 bp, Homo sapiens
agcatattcatgccagactact

SEQ ID NO: 8342144 - DNA, 22 bp, Homo sapiens
agcatgcacatgactggcttaa

SEQ ID NO: 8342145 - DNA, 22 bp, Homo sapiens
agcagggctgcagtgtgtcttt

SEQ ID NO: 8342146 - DNA, 22 bp, Homo sapiens
agcagtcaggacctgtgatttt

SEQ ID NO: 8342147 - DNA, 22 bp, Homo sapiens
agcatgcagtaaagcccatgtc

SEQ ID NO: 8342148 - DNA, 22 bp, Homo sapiens
agcatgcttattttatctcatt

SEQ ID NO: 8342149 - DNA, 22 bp, Homo sapiens
agcatggggcaatgcatgtgct

SEQ ID NO: 8342150 - DNA, 22 bp, Homo sapiens
agcatggcactcaaggctcctg

SEQ ID NO: 8342151 - DNA, 22 bp, Homo sapiens
cactgtgggtcccagactggag

SEQ ID NO: 8342152 - DNA, 22 bp, Homo sapiens
cactgtgggtcccagactggag

SEQ ID NO: 8342153 - DNA, 20 bp, Homo sapiens
caccagcagcagctgccacc

SEQ ID NO: 8342154 - DNA, 20 bp, Homo sapiens
caccagcagcagctgccacc

SEQ ID NO: 8342155 - DNA, 22 bp, Homo sapiens
caccagcagcggtgtgagggtg

SEQ ID NO: 8342156 - DNA, 22 bp, Homo sapiens
agcagggctctgccatgggccc

SEQ ID NO: 8342157 - DNA, 22 bp, Homo sapiens
agcagggctctgtggagggtgg

SEQ ID NO: 8342158 - DNA, 22 bp, Homo sapiens
caccactgtatccctagcactt

SEQ ID NO: 8342159 - DNA, 22 bp, Homo sapiens
cacatttaatcctttataagta

SEQ ID NO: 8342160 - DNA, 22 bp, Homo sapiens
agcagggcaggtaaggatcaga

SEQ ID NO: 8342161 - DNA, 22 bp, Homo sapiens
agcagggcactggaaggcactg

SEQ ID NO: 8342162 - DNA, 22 bp, Homo sapiens
cacagcagaacttaatttcaaa

SEQ ID NO: 8342163 - DNA, 22 bp, Homo sapiens
cacagcagaaatatgaaggcag

SEQ ID NO: 8342164 - DNA, 22 bp, Homo sapiens
cagagacatccattttatatgc

SEQ ID NO: 8342165 - DNA, 22 bp, Homo sapiens
cagagaccctaggcaggtgaca

SEQ ID NO: 8342166 - DNA, 22 bp, Homo sapiens
cagagaccccgctgcccttctg

SEQ ID NO: 8342167 - DNA, 20 bp, Homo sapiens
cagagacccaggcttcagct

SEQ ID NO: 8342168 - DNA, 20 bp, Homo sapiens
cagagacccaggcttcagct

SEQ ID NO: 8342169 - DNA, 20 bp, Homo sapiens
cagagaccaggccaggtgtc

SEQ ID NO: 8342170 - DNA, 22 bp, Homo sapiens
cagagaccccgctgcccttctg

SEQ ID NO: 8342171 - DNA, 22 bp, Homo sapiens
cagagaccccgctgcccttctg

SEQ ID NO: 8342172 - DNA, 22 bp, Homo sapiens
cagagacccttctcagtggcca

SEQ ID NO: 8342173 - DNA, 22 bp, Homo sapiens
cagagacccttctcagtggcca

SEQ ID NO: 8342174 - DNA, 22 bp, Homo sapiens
agccaggccttagggagaggca

SEQ ID NO: 8342175 - DNA, 18 bp, Homo sapiens
cagagctcctggatgcag

SEQ ID NO: 8342176 - DNA, 22 bp, Homo sapiens
agccagctaccggggctcctgg

SEQ ID NO: 8342177 - DNA, 22 bp, Homo sapiens
agccagccgggggaccacagtg

SEQ ID NO: 8342178 - DNA, 19 bp, Homo sapiens
agccagcagcgtagcatct

SEQ ID NO: 8342179 - DNA, 22 bp, Homo sapiens
cactttataaaattggtgtgag

SEQ ID NO: 8342180 - DNA, 22 bp, Homo sapiens
cactttctgtgtatcttccatt

SEQ ID NO: 8342181 - DNA, 22 bp, Homo sapiens
agccctgctcatctggatcccg

SEQ ID NO: 8342182 - DNA, 23 bp, Homo sapiens
agccctgctgagacccagctccc

SEQ ID NO: 8342183 - DNA, 22 bp, Homo sapiens
agccctgctcatctggatcccg

SEQ ID NO: 8342184 - DNA, 23 bp, Homo sapiens
agccctgctgagacccagctccc

SEQ ID NO: 8342185 - DNA, 22 bp, Homo sapiens
agccctgcgtgccaggggactg

SEQ ID NO: 8342186 - DNA, 22 bp, Homo sapiens
agccctgctgcctgaattagct

SEQ ID NO: 8342187 - DNA, 22 bp, Homo sapiens
agccctgctgcttcttgtattt

SEQ ID NO: 8342188 - DNA, 22 bp, Homo sapiens
agccctgcttcaccatttactt

SEQ ID NO: 8342189 - DNA, 22 bp, Homo sapiens
agccctggagcaaaggtgtctt

SEQ ID NO: 8342190 - DNA, 22 bp, Homo sapiens
agccctggattctgaggtccaa

SEQ ID NO: 8342191 - DNA, 22 bp, Homo sapiens
agccctggagcaaaggtgtctt

SEQ ID NO: 8342192 - DNA, 22 bp, Homo sapiens
agccctggcagagccaggtagt

SEQ ID NO: 8342193 - DNA, 22 bp, Homo sapiens
agccctggctcccagcagcgct

SEQ ID NO: 8342194 - DNA, 22 bp, Homo sapiens
agccctgggcacctgtgagggg

SEQ ID NO: 8342195 - DNA, 22 bp, Homo sapiens
agccctgggcacctgtgagggg

SEQ ID NO: 8342196 - DNA, 22 bp, Homo sapiens
agccctgggcgttactgggatg

SEQ ID NO: 8342197 - DNA, 22 bp, Homo sapiens
agccctgggcagccaaggaagc

SEQ ID NO: 8342198 - DNA, 22 bp, Homo sapiens
agccctgggcgttactgggatg

SEQ ID NO: 8342199 - DNA, 18 bp, Homo sapiens
cagagctcctggatgcag

SEQ ID NO: 8342200 - DNA, 22 bp, Homo sapiens
agccagtgtcgtgtgacatgag

SEQ ID NO: 8342201 - DNA, 22 bp, Homo sapiens
agccagtgggattagagcctct

SEQ ID NO: 8342202 - DNA, 22 bp, Homo sapiens
agccccagtaagggagggcctg

SEQ ID NO: 8342203 - DNA, 22 bp, Homo sapiens
agccccaggatgggccgcagga

SEQ ID NO: 8342204 - DNA, 22 bp, Homo sapiens
cagcaactgtgcctgacacaca

SEQ ID NO: 8342205 - DNA, 22 bp, Homo sapiens
cagatgtgattcttccctcagc

SEQ ID NO: 8342206 - DNA, 22 bp, Homo sapiens
cagatgtatatgcataaaaagt

SEQ ID NO: 8342207 - DNA, 22 bp, Homo sapiens
cagatgtggaatgcagcaggct

SEQ ID NO: 8342208 - DNA, 20 bp, Homo sapiens
cagatgggacgtggaggagt

SEQ ID NO: 8342209 - DNA, 20 bp, Homo sapiens
cagatgggacgtggaggagt

SEQ ID NO: 8342210 - DNA, 22 bp, Homo sapiens
cagatgtaatctgacagctgga

SEQ ID NO: 8342211 - DNA, 22 bp, Homo sapiens
cagatgtaatctgacagctgga

SEQ ID NO: 8342212 - DNA, 22 bp, Homo sapiens
agcctgggcaacaacacagcga

SEQ ID NO: 8342213 - DNA, 22 bp, Homo sapiens
agcctgggaatttagagttcgg

SEQ ID NO: 8342214 - DNA, 22 bp, Homo sapiens
agcctgggaatttagagttcgg

SEQ ID NO: 8342215 - DNA, 22 bp, Homo sapiens
cagcaacttaggcagaacatct

SEQ ID NO: 8342216 - DNA, 22 bp, Homo sapiens
cagcaagaaaattcacatgctc

SEQ ID NO: 8342217 - DNA, 22 bp, Homo sapiens
agcctggtttaagcattttata

SEQ ID NO: 8342218 - DNA, 22 bp, Homo sapiens
agcctgggtgggggttcggaga

SEQ ID NO: 8342219 - DNA, 22 bp, Homo sapiens
agcctgggtttttattaaggag

SEQ ID NO: 8342220 - DNA, 22 bp, Homo sapiens
agcctggtttaagcattttata

SEQ ID NO: 8342221 - DNA, 20 bp, Homo sapiens
agcctggggaattccacccc

SEQ ID NO: 8342222 - DNA, 22 bp, Homo sapiens
agcctggggcacttctccaaac

SEQ ID NO: 8342223 - DNA, 22 bp, Homo sapiens
agcctgggcctggcttcccgcc

SEQ ID NO: 8342224 - DNA, 18 bp, Homo sapiens
agcctgggctctgcctgg

SEQ ID NO: 8342225 - DNA, 22 bp, Homo sapiens
agctagaatattgatctgaaat

SEQ ID NO: 8342226 - DNA, 22 bp, Homo sapiens
agctagaatgttccttttcatt

SEQ ID NO: 8342227 - DNA, 22 bp, Homo sapiens
agctagaagtcctagataaagg

SEQ ID NO: 8342228 - DNA, 22 bp, Homo sapiens
agctctgtgaagccagcagttc

SEQ ID NO: 8342229 - DNA, 22 bp, Homo sapiens
agctctgtgcaggcagaggcat

SEQ ID NO: 8342230 - DNA, 22 bp, Homo sapiens
agctctgtaacccattccctgt

SEQ ID NO: 8342231 - DNA, 22 bp, Homo sapiens
agctcctggtgcctcagccgaa

SEQ ID NO: 8342232 - DNA, 22 bp, Homo sapiens
agctcctggctttcctctcacc

SEQ ID NO: 8342233 - DNA, 19 bp, Homo sapiens
agctccaggcctggatgct

SEQ ID NO: 8342234 - DNA, 22 bp, Homo sapiens
agctccagggaaagagtggatc

SEQ ID NO: 8342235 - DNA, 21 bp, Homo sapiens
agctccaggctcctggggttc

SEQ ID NO: 8342236 - DNA, 22 bp, Homo sapiens
agctcaggccggagctacaggc

SEQ ID NO: 8342237 - DNA, 22 bp, Homo sapiens
agctcaggcaactctgggcccc

SEQ ID NO: 8342238 - DNA, 22 bp, Homo sapiens
agctaggacaggtagagatggg

SEQ ID NO: 8342239 - DNA, 22 bp, Homo sapiens
agatataataatttacaagtgt

SEQ ID NO: 8342240 - DNA, 22 bp, Homo sapiens
agatataataatttacaagtgt

SEQ ID NO: 8342241 - DNA, 22 bp, Homo sapiens
attggtagttttgtatttctct

SEQ ID NO: 8342242 - DNA, 22 bp, Homo sapiens
agatatttaaatcagacaaaga

SEQ ID NO: 8342243 - DNA, 22 bp, Homo sapiens
agatatttgtatcttgctattg

SEQ ID NO: 8342244 - DNA, 22 bp, Homo sapiens
agatattaatcgtacataaggt

SEQ ID NO: 8342245 - DNA, 22 bp, Homo sapiens
agatcaagggagtgctcactct

SEQ ID NO: 8342246 - DNA, 22 bp, Homo sapiens
agatcacagtcaattgcaagtt

SEQ ID NO: 8342247 - DNA, 23 bp, Homo sapiens
agatcagcatggatcagtcttct

SEQ ID NO: 8342248 - DNA, 22 bp, Homo sapiens
agatcagaaagccaatatcata

SEQ ID NO: 8342249 - DNA, 22 bp, Homo sapiens
agatcatatgaaaaatttcaag

SEQ ID NO: 8342250 - DNA, 22 bp, Homo sapiens
agatgcttcagtgtttaattta

SEQ ID NO: 8342251 - DNA, 22 bp, Homo sapiens
agatgctgtcacacacactgtt

SEQ ID NO: 8342252 - DNA, 22 bp, Homo sapiens
agatggagttgtagcagtgact

SEQ ID NO: 8342253 - DNA, 22 bp, Homo sapiens
agatggagttgtagcagtgact

SEQ ID NO: 8342254 - DNA, 22 bp, Homo sapiens
caaagcagacgcagtaagggta

SEQ ID NO: 8342255 - DNA, 22 bp, Homo sapiens
caaagcaagggctgaagactcc

SEQ ID NO: 8342256 - DNA, 22 bp, Homo sapiens
caaagcaaggctcagtttgaac

SEQ ID NO: 8342257 - DNA, 22 bp, Homo sapiens
caaagcaagggctgaagactcc

SEQ ID NO: 8342258 - DNA, 22 bp, Homo sapiens
caaaccatgacatgaagcgtga

SEQ ID NO: 8342259 - DNA, 22 bp, Homo sapiens
caaaccagtaggaagtctatta

SEQ ID NO: 8342260 - DNA, 22 bp, Homo sapiens
agcaacagtgtatatcataggc

SEQ ID NO: 8342261 - DNA, 22 bp, Homo sapiens
agcaacgagaagcacaaaataa

SEQ ID NO: 8342262 - DNA, 22 bp, Homo sapiens
agcaagaaatcttcagtgttct

SEQ ID NO: 8342263 - DNA, 22 bp, Homo sapiens
agcaagaagctttgctgtgata

SEQ ID NO: 8342264 - DNA, 22 bp, Homo sapiens
agcaagaagggcaaggaagttt

SEQ ID NO: 8342265 - DNA, 21 bp, Homo sapiens
agcaagaatcaggaaggctct

SEQ ID NO: 8342266 - DNA, 18 bp, Homo sapiens
agcaagacagtggtgtga

SEQ ID NO: 8342267 - DNA, 22 bp, Homo sapiens
agcaagactcagcaggatacca

SEQ ID NO: 8342268 - DNA, 22 bp, Homo sapiens
attttatctgcttactttcagg

SEQ ID NO: 8342269 - DNA, 22 bp, Homo sapiens
attttatgacacgattcttcca

SEQ ID NO: 8342270 - DNA, 22 bp, Homo sapiens
attttcaccctgaatatattga

SEQ ID NO: 8342271 - DNA, 22 bp, Homo sapiens
agatgtggatgagtcgccgacc

SEQ ID NO: 8342272 - DNA, 22 bp, Homo sapiens
agatgtgggagatgcttctgca

SEQ ID NO: 8342273 - DNA, 22 bp, Homo sapiens
agatgtggcctttgggagatta

SEQ ID NO: 8342274 - DNA, 22 bp, Homo sapiens
agatgttccagccaatgggaat

SEQ ID NO: 8342275 - DNA, 22 bp, Homo sapiens
agatgtttaaaaagatgactct

SEQ ID NO: 8342276 - DNA, 22 bp, Homo sapiens
agcaaagctgattaagagcaca

SEQ ID NO: 8342277 - DNA, 22 bp, Homo sapiens
agatgtggttattctcttcctt

SEQ ID NO: 8342278 - DNA, 20 bp, Homo sapiens
agcaacaataaaatgtcctg

SEQ ID NO: 8342279 - DNA, 18 bp, Homo sapiens
agcaacagaaacatatgg

SEQ ID NO: 8342280 - DNA, 22 bp, Homo sapiens
agcaacagccctgaggttcatg

SEQ ID NO: 8342281 - DNA, 22 bp, Homo sapiens
agcaacagccctgtttcattag

SEQ ID NO: 8342282 - DNA, 22 bp, Homo sapiens
agcaacagcaacgacatttctc

SEQ ID NO: 8342283 - DNA, 22 bp, Homo sapiens
agcaacagcaacgacatttctc

SEQ ID NO: 8342284 - DNA, 22 bp, Homo sapiens
attacagatagactttgaagct

SEQ ID NO: 8342285 - DNA, 22 bp, Homo sapiens
attacagaagatatgctcaaca

SEQ ID NO: 8342286 - DNA, 22 bp, Homo sapiens
attacagaaagcaatattgagt

SEQ ID NO: 8342287 - DNA, 22 bp, Homo sapiens
attacacatagacattcgttca

SEQ ID NO: 8342288 - DNA, 22 bp, Homo sapiens
attacacaggctggctctttga

SEQ ID NO: 8342289 - DNA, 22 bp, Homo sapiens
attacacagcggttactactag

SEQ ID NO: 8342290 - DNA, 22 bp, Homo sapiens
attacacaggatttgccttact

SEQ ID NO: 8342291 - DNA, 22 bp, Homo sapiens
agagctggctgtgggtgacttt

SEQ ID NO: 8342292 - DNA, 20 bp, Homo sapiens
agagctgggaagctccctat

SEQ ID NO: 8342293 - DNA, 22 bp, Homo sapiens
agaggaggctgggtccagataa

SEQ ID NO: 8342294 - DNA, 22 bp, Homo sapiens
agaggctgcacttgctcatgat

SEQ ID NO: 8342295 - DNA, 22 bp, Homo sapiens
agaggctgatggagtagtgtct

SEQ ID NO: 8342296 - DNA, 22 bp, Homo sapiens
agaggccaggctgcagagggat

SEQ ID NO: 8342297 - DNA, 18 bp, Homo sapiens
agaggctggacaggggat

SEQ ID NO: 8342298 - DNA, 23 bp, Homo sapiens
agaggctgcagggtattgagaat

SEQ ID NO: 8342299 - DNA, 22 bp, Homo sapiens
agaggctgcaggctggaaatca

SEQ ID NO: 8342300 - DNA, 22 bp, Homo sapiens
agaggctgcaggctggaaatca

SEQ ID NO: 8342301 - DNA, 22 bp, Homo sapiens
agaggctgcacttgctcatgat

SEQ ID NO: 8342302 - DNA, 22 bp, Homo sapiens
agaggctggattgagcatagac

SEQ ID NO: 8342303 - DNA, 22 bp, Homo sapiens
agaggctggattgagcatagac

SEQ ID NO: 8342304 - DNA, 22 bp, Homo sapiens
agaggctggattgagcatagac

SEQ ID NO: 8342305 - DNA, 22 bp, Homo sapiens
agaggccaccactgtcagggac

SEQ ID NO: 8342306 - DNA, 22 bp, Homo sapiens
agaggccaccttctcttgagaa

SEQ ID NO: 8342307 - DNA, 22 bp, Homo sapiens
agaggccagaaagtatgccacc

SEQ ID NO: 8342308 - DNA, 22 bp, Homo sapiens
agaggccagatcatcatagatg

SEQ ID NO: 8342309 - DNA, 22 bp, Homo sapiens
agaggccagcactgcagggaag

SEQ ID NO: 8342310 - DNA, 23 bp, Homo sapiens
agaggccagcctttggagacacc

SEQ ID NO: 8342311 - DNA, 23 bp, Homo sapiens
agaggccagcctttggagacacc

SEQ ID NO: 8342312 - DNA, 23 bp, Homo sapiens
agagtccacaagattttccagtg

SEQ ID NO: 8342313 - DNA, 22 bp, Homo sapiens
agagtcagcttatgacacagtc

SEQ ID NO: 8342314 - DNA, 19 bp, Homo sapiens
agagtattgaatttgccct

SEQ ID NO: 8342315 - DNA, 18 bp, Homo sapiens
agagtatacagacaacaa

SEQ ID NO: 8342316 - DNA, 22 bp, Homo sapiens
agagtccatgaagacagctgag

SEQ ID NO: 8342317 - DNA, 22 bp, Homo sapiens
agagtccctcttcccaggaggc

SEQ ID NO: 8342318 - DNA, 22 bp, Homo sapiens
agagtccaggtgggctggaggc

SEQ ID NO: 8342319 - DNA, 22 bp, Homo sapiens
agagtccatatgtgggaggagt

SEQ ID NO: 8342320 - DNA, 22 bp, Homo sapiens
agagtctgaggaggaccaacag

SEQ ID NO: 8342321 - DNA, 22 bp, Homo sapiens
agagtgattctagttagggaat

SEQ ID NO: 8342322 - DNA, 22 bp, Homo sapiens
agagtgatgggttgtgctgacc

SEQ ID NO: 8342323 - DNA, 22 bp, Homo sapiens
agagtgatcagatatcaggtgt

SEQ ID NO: 8342324 - DNA, 22 bp, Homo sapiens
agagtgcttaaagctggctttg

SEQ ID NO: 8342325 - DNA, 22 bp, Homo sapiens
agaggggcagggtctccggatt

SEQ ID NO: 8342326 - DNA, 22 bp, Homo sapiens
agaggggcccggttctccgtct

SEQ ID NO: 8342327 - DNA, 22 bp, Homo sapiens
agaggggcgggaactcaacctc

SEQ ID NO: 8342328 - DNA, 22 bp, Homo sapiens
agaggggcaagtaaagagtctt

SEQ ID NO: 8342329 - DNA, 22 bp, Homo sapiens
agaggggaggcgaaccagagtc

SEQ ID NO: 8342330 - DNA, 19 bp, Homo sapiens
agaggctgtcacctgtagc

SEQ ID NO: 8342331 - DNA, 22 bp, Homo sapiens
agaggctgtcccttgctattcc

SEQ ID NO: 8342332 - DNA, 22 bp, Homo sapiens
agaggctgggtacgggccacct

SEQ ID NO: 8342333 - DNA, 22 bp, Homo sapiens
agaggctgggtacgggccacct

SEQ ID NO: 8342334 - DNA, 22 bp, Homo sapiens
agaggctgggcaggacccacag

SEQ ID NO: 8342335 - DNA, 22 bp, Homo sapiens
agaggctgggaagggtccccgg

SEQ ID NO: 8342336 - DNA, 22 bp, Homo sapiens
atgcaggttgggcaagtgtggg

SEQ ID NO: 8342337 - DNA, 22 bp, Homo sapiens
atgatatagagagtagattaaa

SEQ ID NO: 8342338 - DNA, 22 bp, Homo sapiens
atgatacattgcaaaattttaa

SEQ ID NO: 8342339 - DNA, 22 bp, Homo sapiens
atgatacatttacctatggtct

SEQ ID NO: 8342340 - DNA, 22 bp, Homo sapiens
atgatagctaccgtttatgctg

SEQ ID NO: 8342341 - DNA, 22 bp, Homo sapiens
atgatatacttcctagaacagt

SEQ ID NO: 8342342 - DNA, 22 bp, Homo sapiens
atgatacatcttgtttatttca

SEQ ID NO: 8342343 - DNA, 22 bp, Homo sapiens
atgccaaagcccaagttcatca

SEQ ID NO: 8342344 - DNA, 22 bp, Homo sapiens
atgccaaagatgtttgatagaa

SEQ ID NO: 8342345 - DNA, 22 bp, Homo sapiens
atgccaaaatgttacatttctt

SEQ ID NO: 8342346 - DNA, 22 bp, Homo sapiens
atgcatttttgagtatgaatga

SEQ ID NO: 8342347 - DNA, 22 bp, Homo sapiens
atgcatttgtaaaatataatcg

SEQ ID NO: 8342348 - DNA, 22 bp, Homo sapiens
atgccaaattctactttcagca

SEQ ID NO: 8342349 - DNA, 22 bp, Homo sapiens
atgccaaatttctttctgttct

SEQ ID NO: 8342350 - DNA, 22 bp, Homo sapiens
agacctggagtgaagagttccc

SEQ ID NO: 8342351 - DNA, 22 bp, Homo sapiens
agaccccatacctcagcaggta

SEQ ID NO: 8342352 - DNA, 22 bp, Homo sapiens
agacccaggattggggctgccg

SEQ ID NO: 8342353 - DNA, 22 bp, Homo sapiens
agacctggtttatcaccagcat

SEQ ID NO: 8342354 - DNA, 22 bp, Homo sapiens
agactggtttttaacttcacct

SEQ ID NO: 8342355 - DNA, 22 bp, Homo sapiens
atgcctggtcccacctctaggt

SEQ ID NO: 8342356 - DNA, 22 bp, Homo sapiens
atgcctgtgctatattctcaca

SEQ ID NO: 8342357 - DNA, 22 bp, Homo sapiens
agacaagactaggcagttgttg

SEQ ID NO: 8342358 - DNA, 22 bp, Homo sapiens
agaatattgaaagttcttgaca

SEQ ID NO: 8342359 - DNA, 22 bp, Homo sapiens
atgaggctctcaacaccttgag

SEQ ID NO: 8342360 - DNA, 22 bp, Homo sapiens
agaatatgatcggaatacagat

SEQ ID NO: 8342361 - DNA, 22 bp, Homo sapiens
agaatattcatctgtattctta

SEQ ID NO: 8342362 - DNA, 22 bp, Homo sapiens
agaatattgaaagttcttgaca

SEQ ID NO: 8342363 - DNA, 22 bp, Homo sapiens
agaatatgatggttggagaatt

SEQ ID NO: 8342364 - DNA, 22 bp, Homo sapiens
agaatatagttaccaaattctg

SEQ ID NO: 8342365 - DNA, 22 bp, Homo sapiens
agaatatatgactgcaagacta

SEQ ID NO: 8342366 - DNA, 22 bp, Homo sapiens
atgaaggctgtgtagatggatg

SEQ ID NO: 8342367 - DNA, 22 bp, Homo sapiens
atctgctggcatctctagccca

SEQ ID NO: 8342368 - DNA, 22 bp, Homo sapiens
atctgctgcccagccacttgct

SEQ ID NO: 8342369 - DNA, 22 bp, Homo sapiens
atgaacacatgtacacatttct

SEQ ID NO: 8342370 - DNA, 22 bp, Homo sapiens
atgaagcagttaaggtgcatga

SEQ ID NO: 8342371 - DNA, 22 bp, Homo sapiens
atgaagcattacaggatgacag

SEQ ID NO: 8342372 - DNA, 22 bp, Homo sapiens
agagagcatggcacagaggggt

SEQ ID NO: 8342373 - DNA, 22 bp, Homo sapiens
agagaggttaaggagctcttgt

SEQ ID NO: 8342374 - DNA, 22 bp, Homo sapiens
agagaggctgggcgtagggctt

SEQ ID NO: 8342375 - DNA, 22 bp, Homo sapiens
agagaatccccagacagagtta

SEQ ID NO: 8342376 - DNA, 22 bp, Homo sapiens
agagaatacaaagaagatatgt

SEQ ID NO: 8342377 - DNA, 22 bp, Homo sapiens
agacttctctccttgacttgca

SEQ ID NO: 8342378 - DNA, 22 bp, Homo sapiens
agacttctcttggctatattat

SEQ ID NO: 8342379 - DNA, 22 bp, Homo sapiens
agacttatgcttcaaatagtaa

SEQ ID NO: 8342380 - DNA, 22 bp, Homo sapiens
agagccaggccaggccggggca

SEQ ID NO: 8342381 - DNA, 22 bp, Homo sapiens
agagcccaggtcctggagaggg

SEQ ID NO: 8342382 - DNA, 20 bp, Homo sapiens
agagcccagatgtctgtatt

SEQ ID NO: 8342383 - DNA, 22 bp, Homo sapiens
agagcccagaaagtatgtcata

SEQ ID NO: 8342384 - DNA, 22 bp, Homo sapiens
agagcccagtctttgtgtgaag

SEQ ID NO: 8342385 - DNA, 22 bp, Homo sapiens
agagcccctgggtcacacagcc

SEQ ID NO: 8342386 - DNA, 22 bp, Homo sapiens
agagcagcacgttgtccccaca

SEQ ID NO: 8342387 - DNA, 20 bp, Homo sapiens
agagcagcagttggtgaggt

SEQ ID NO: 8342388 - DNA, 21 bp, Homo sapiens
agagcctgagatcttccagca

SEQ ID NO: 8342389 - DNA, 22 bp, Homo sapiens
agagcctgagcctgatcttgaa

SEQ ID NO: 8342390 - DNA, 22 bp, Homo sapiens
agagcctgaggccctgagaggg

SEQ ID NO: 8342391 - DNA, 17 bp, Homo sapiens
agagctcttcactgtga

SEQ ID NO: 8342392 - DNA, 22 bp, Homo sapiens
agagctctttgatttgcttctc

SEQ ID NO: 8342393 - DNA, 22 bp, Homo sapiens
agagccctctgcaatgcctcag

SEQ ID NO: 8342394 - DNA, 22 bp, Homo sapiens
agagccctcttcactgcccctt

SEQ ID NO: 8342395 - DNA, 22 bp, Homo sapiens
agagctggatggtcaagatggc

SEQ ID NO: 8342396 - DNA, 22 bp, Homo sapiens
agagctggaatcagacctcagg

SEQ ID NO: 8342397 - DNA, 22 bp, Homo sapiens
agagctggctgctgcggtgctt

SEQ ID NO: 8342398 - DNA, 22 bp, Homo sapiens
aggaggggttctcgggtgctga

SEQ ID NO: 8342399 - DNA, 21 bp, Homo sapiens
aggaggggtctttcccactga

SEQ ID NO: 8342400 - DNA, 21 bp, Homo sapiens
aggaggggtctttcccactga

SEQ ID NO: 8342401 - DNA, 22 bp, Homo sapiens
aggaggggttctcgggtgctga

SEQ ID NO: 8342402 - DNA, 22 bp, Homo sapiens
aggagggtcatgttgaagtgta

SEQ ID NO: 8342403 - DNA, 22 bp, Homo sapiens
aggagggtacaatgggtggaaa

SEQ ID NO: 8342404 - DNA, 22 bp, Homo sapiens
aggcaaaattacaaagttatta

SEQ ID NO: 8342405 - DNA, 22 bp, Homo sapiens
aggcaaagcgataccagagcta

SEQ ID NO: 8342406 - DNA, 22 bp, Homo sapiens
aggaggggcatagaaatgtaat

SEQ ID NO: 8342407 - DNA, 22 bp, Homo sapiens
aggaggctgtggagcactccat

SEQ ID NO: 8342408 - DNA, 22 bp, Homo sapiens
aggaggctgtggagcactccat

SEQ ID NO: 8342409 - DNA, 22 bp, Homo sapiens
aggcacagatttggggaaagca

SEQ ID NO: 8342410 - DNA, 18 bp, Homo sapiens
aggcacagagcatacata

SEQ ID NO: 8342411 - DNA, 22 bp, Homo sapiens
acataaatttcactgttccgtg

SEQ ID NO: 8342412 - DNA, 22 bp, Homo sapiens
acatacacaagcgtacatgaac

SEQ ID NO: 8342413 - DNA, 22 bp, Homo sapiens
acatacacatgaatatattttt

SEQ ID NO: 8342414 - DNA, 23 bp, Homo sapiens
acatacataagcaccacattttg

SEQ ID NO: 8342415 - DNA, 23 bp, Homo sapiens
aggaaggaggtcctaacagtatc

SEQ ID NO: 8342416 - DNA, 22 bp, Homo sapiens
aggaaggcacattgttggctaa

SEQ ID NO: 8342417 - DNA, 22 bp, Homo sapiens
aggacttctccgataagtcaga

SEQ ID NO: 8342418 - DNA, 22 bp, Homo sapiens
aggagccctccgttgcttcatc

SEQ ID NO: 8342419 - DNA, 22 bp, Homo sapiens
aggagctgcagattctgccttg

SEQ ID NO: 8342420 - DNA, 20 bp, Homo sapiens
aggagccattgactgcagca

SEQ ID NO: 8342421 - DNA, 22 bp, Homo sapiens
aggagccatggaggtgaggcgg

SEQ ID NO: 8342422 - DNA, 22 bp, Homo sapiens
aggagccattttccaagggcga

SEQ ID NO: 8342423 - DNA, 22 bp, Homo sapiens
acagggtggggatggtgagctt

SEQ ID NO: 8342424 - DNA, 22 bp, Homo sapiens
acagggtgactttgtgacagat

SEQ ID NO: 8342425 - DNA, 22 bp, Homo sapiens
acagggtcattttatgatctgt

SEQ ID NO: 8342426 - DNA, 22 bp, Homo sapiens
acagggtcttagagatcacctg

SEQ ID NO: 8342427 - DNA, 22 bp, Homo sapiens
acagggtcaagggtgctacaag

SEQ ID NO: 8342428 - DNA, 22 bp, Homo sapiens
acagccagaggtggtcctgggt

SEQ ID NO: 8342429 - DNA, 22 bp, Homo sapiens
agctcccagaagccagagtcgg

SEQ ID NO: 8342430 - DNA, 22 bp, Homo sapiens
acagccaggtaaaggcatggca

SEQ ID NO: 8342431 - DNA, 22 bp, Homo sapiens
acagccagtaaggaaagaccca

SEQ ID NO: 8342432 - DNA, 22 bp, Homo sapiens
acagccagggtctcaggaggcg

SEQ ID NO: 8342433 - DNA, 22 bp, Homo sapiens
acagccagtgactgcagaccct

SEQ ID NO: 8342434 - DNA, 22 bp, Homo sapiens
acagccagtcctcccacagggt

SEQ ID NO: 8342435 - DNA, 22 bp, Homo sapiens
acagccagtaatctacccctgt

SEQ ID NO: 8342436 - DNA, 22 bp, Homo sapiens
acagccagtcatctcagcaggg

SEQ ID NO: 8342437 - DNA, 22 bp, Homo sapiens
agctgcaggattatggaatgga

SEQ ID NO: 8342438 - DNA, 22 bp, Homo sapiens
agctgcagctacagtgttggtt

SEQ ID NO: 8342439 - DNA, 22 bp, Homo sapiens
agctgcaggagtcgcctaggat

SEQ ID NO: 8342440 - DNA, 22 bp, Homo sapiens
acagccatagatgcttatgtaa

SEQ ID NO: 8342441 - DNA, 22 bp, Homo sapiens
acagccagtgctccgtgaggac

SEQ ID NO: 8342442 - DNA, 22 bp, Homo sapiens
acagccagtgactggacaagct

SEQ ID NO: 8342443 - DNA, 22 bp, Homo sapiens
agctgcagccgcagctgtggcc

SEQ ID NO: 8342444 - DNA, 22 bp, Homo sapiens
agctgctgtgtgctcaggcagg

SEQ ID NO: 8342445 - DNA, 22 bp, Homo sapiens
agctgctgtttggtgagtcttg

SEQ ID NO: 8342446 - DNA, 22 bp, Homo sapiens
agctggctatacttgaaaagtc

SEQ ID NO: 8342447 - DNA, 21 bp, Homo sapiens
agctggctctctctggagaga

SEQ ID NO: 8342448 - DNA, 22 bp, Homo sapiens
agctgggcaaaatgtgaggttg

SEQ ID NO: 8342449 - DNA, 22 bp, Homo sapiens
agctgtgggcctgggagagctg

SEQ ID NO: 8342450 - DNA, 22 bp, Homo sapiens
agctgggactcaactgtctggg

SEQ ID NO: 8342451 - DNA, 22 bp, Homo sapiens
agcttagtggttgtatgagtta

SEQ ID NO: 8342452 - DNA, 22 bp, Homo sapiens
agctgtggggaggaggctagca

SEQ ID NO: 8342453 - DNA, 22 bp, Homo sapiens
agctgtggtacttgattcacaa

SEQ ID NO: 8342454 - DNA, 22 bp, Homo sapiens
aggaagagcattcacatggtag

SEQ ID NO: 8342455 - DNA, 22 bp, Homo sapiens
aggaaactttcttttgcttcat

SEQ ID NO: 8342456 - DNA, 22 bp, Homo sapiens
aggaaactaacttatctttata

SEQ ID NO: 8342457 - DNA, 22 bp, Homo sapiens
aggaaactaattagtagaataa

SEQ ID NO: 8342458 - DNA, 22 bp, Homo sapiens
aggaaaaacctgttaatggtag

SEQ ID NO: 8342459 - DNA, 22 bp, Homo sapiens
aggaaaaagagttgctgccttc

SEQ ID NO: 8342460 - DNA, 22 bp, Homo sapiens
aggaaaaaagtctgtgattata

SEQ ID NO: 8342461 - DNA, 22 bp, Homo sapiens
agcttttagtacgttaaaattg

SEQ ID NO: 8342462 - DNA, 19 bp, Homo sapiens
agcttttactaacagcaga

SEQ ID NO: 8342463 - DNA, 22 bp, Homo sapiens
accagggcagccgaggtgtgtc

SEQ ID NO: 8342464 - DNA, 22 bp, Homo sapiens
accagggcacattccggccaga

SEQ ID NO: 8342465 - DNA, 22 bp, Homo sapiens
accagggcacattccggccaga

SEQ ID NO: 8342466 - DNA, 22 bp, Homo sapiens
accagggttgagtcagctgcgt

SEQ ID NO: 8342467 - DNA, 22 bp, Homo sapiens
accagggcttacagcagtagct

SEQ ID NO: 8342468 - DNA, 22 bp, Homo sapiens
accagggctgacaatctgatgg

SEQ ID NO: 8342469 - DNA, 22 bp, Homo sapiens
accagggctgggataggtcagg

SEQ ID NO: 8342470 - DNA, 22 bp, Homo sapiens
accagggcggcttgaggaggca

SEQ ID NO: 8342471 - DNA, 22 bp, Homo sapiens
accagggccgcgggcgactagc

SEQ ID NO: 8342472 - DNA, 22 bp, Homo sapiens
accagggcccgggagagctctc

SEQ ID NO: 8342473 - DNA, 22 bp, Homo sapiens
accagttttttatacatcttct

SEQ ID NO: 8342474 - DNA, 22 bp, Homo sapiens
agggcctcgggctcagtgggtc

SEQ ID NO: 8342475 - DNA, 22 bp, Homo sapiens
agggcctctaccatccaaggtt

SEQ ID NO: 8342476 - DNA, 22 bp, Homo sapiens
agggccagttctacctctgaat

SEQ ID NO: 8342477 - DNA, 22 bp, Homo sapiens
agggcctcctaatttcctcata

SEQ ID NO: 8342478 - DNA, 22 bp, Homo sapiens
agggcctcctaatttcctcata

SEQ ID NO: 8342479 - DNA, 22 bp, Homo sapiens
accagtgtcaccccaaccagga

SEQ ID NO: 8342480 - DNA, 20 bp, Homo sapiens
accaggagatggaggcaggg

SEQ ID NO: 8342481 - DNA, 22 bp, Homo sapiens
accaggacttcattaggttctt

SEQ ID NO: 8342482 - DNA, 22 bp, Homo sapiens
accaaggagccacatacaacct

SEQ ID NO: 8342483 - DNA, 22 bp, Homo sapiens
accaaggagtttggtattttag

SEQ ID NO: 8342484 - DNA, 22 bp, Homo sapiens
accaatgtcccgcccacgctgc

SEQ ID NO: 8342485 - DNA, 22 bp, Homo sapiens
accacaggaattgctctgtggt

SEQ ID NO: 8342486 - DNA, 22 bp, Homo sapiens
accaaggagaaggtgcaagctt

SEQ ID NO: 8342487 - DNA, 22 bp, Homo sapiens
accaaggaagagattctcagtt

SEQ ID NO: 8342488 - DNA, 22 bp, Homo sapiens
accaaggagacaaaggtgtatt

SEQ ID NO: 8342489 - DNA, 22 bp, Homo sapiens
accaaggaagaatctatttgag

SEQ ID NO: 8342490 - DNA, 22 bp, Homo sapiens
accaaatgtttttccagaaatg

SEQ ID NO: 8342491 - DNA, 22 bp, Homo sapiens
acccaccacagtggctggcaca

SEQ ID NO: 8342492 - DNA, 22 bp, Homo sapiens
agggcctgagctctcctccagt

SEQ ID NO: 8342493 - DNA, 22 bp, Homo sapiens
acccactgtcatctctgaccac

SEQ ID NO: 8342494 - DNA, 22 bp, Homo sapiens
acccagagaactgtgccttgag

SEQ ID NO: 8342495 - DNA, 22 bp, Homo sapiens
acccactgtagccactctgggt

SEQ ID NO: 8342496 - DNA, 22 bp, Homo sapiens
agggcctgacacccttgccagc

SEQ ID NO: 8342497 - DNA, 21 bp, Homo sapiens
agggcctctgtgtactggggg

SEQ ID NO: 8342498 - DNA, 22 bp, Homo sapiens
agggcctgagaccgtggcttga

SEQ ID NO: 8342499 - DNA, 22 bp, Homo sapiens
agggcctctgagccagttctgg

SEQ ID NO: 8342500 - DNA, 19 bp, Homo sapiens
agggcctgagcagatgttg

SEQ ID NO: 8342501 - DNA, 22 bp, Homo sapiens
agggcctgagaccgtggcttga

SEQ ID NO: 8342502 - DNA, 22 bp, Homo sapiens
agggcctctgacgcccccagcc

SEQ ID NO: 8342503 - DNA, 22 bp, Homo sapiens
agggcctctctgggcctttcct

SEQ ID NO: 8342504 - DNA, 22 bp, Homo sapiens
agggcctctgagccagttctgg

SEQ ID NO: 8342505 - DNA, 22 bp, Homo sapiens
agggcctctggaacactgaggg

SEQ ID NO: 8342506 - DNA, 23 bp, Homo sapiens
agggcctctgtcccccagcactc

SEQ ID NO: 8342507 - DNA, 22 bp, Homo sapiens
acccagggtttgagctctgcag

SEQ ID NO: 8342508 - DNA, 22 bp, Homo sapiens
acccagggtagagtgcagtggc

SEQ ID NO: 8342509 - DNA, 22 bp, Homo sapiens
acccagagcagagcttggcttc

SEQ ID NO: 8342510 - DNA, 22 bp, Homo sapiens
acccagagactagcacggtaca

SEQ ID NO: 8342511 - DNA, 22 bp, Homo sapiens
acccagagatgtcaatggcttt

SEQ ID NO: 8342512 - DNA, 22 bp, Homo sapiens
acccagggtagagtgcagtggc

SEQ ID NO: 8342513 - DNA, 22 bp, Homo sapiens
acccagggtagaacctcagagc

SEQ ID NO: 8342514 - DNA, 22 bp, Homo sapiens
acccagggaccccgctgacgcc

SEQ ID NO: 8342515 - DNA, 22 bp, Homo sapiens
acccatcacttttaggctttgc

SEQ ID NO: 8342516 - DNA, 22 bp, Homo sapiens
acccatcagcggctggagctgg

SEQ ID NO: 8342517 - DNA, 22 bp, Homo sapiens
accccaaaagagtaatagaatt

SEQ ID NO: 8342518 - DNA, 17 bp, Homo sapiens
acccattttgcacaggc

SEQ ID NO: 8342519 - DNA, 22 bp, Homo sapiens
accccactaccccggcagatgg

SEQ ID NO: 8342520 - DNA, 22 bp, Homo sapiens
accccactcctctgttttaact

SEQ ID NO: 8342521 - DNA, 22 bp, Homo sapiens
accccactcacacatggacctg

SEQ ID NO: 8342522 - DNA, 22 bp, Homo sapiens
accctgcctctgcttcctgtag

SEQ ID NO: 8342523 - DNA, 22 bp, Homo sapiens
accctgcctgacaacagaggat

SEQ ID NO: 8342524 - DNA, 22 bp, Homo sapiens
accctgcctgacaacagaggat

SEQ ID NO: 8342525 - DNA, 22 bp, Homo sapiens
accctggacatcttgtcatagc

SEQ ID NO: 8342526 - DNA, 22 bp, Homo sapiens
accctggagcaataatccctgg

SEQ ID NO: 8342527 - DNA, 22 bp, Homo sapiens
accctggactggggctgaggct

SEQ ID NO: 8342528 - DNA, 22 bp, Homo sapiens
accctgggtcatatacagtgtg

SEQ ID NO: 8342529 - DNA, 22 bp, Homo sapiens
accctgggtatttcccaaactt

SEQ ID NO: 8342530 - DNA, 22 bp, Homo sapiens
accctggggtcacccttctctg

SEQ ID NO: 8342531 - DNA, 16 bp, Homo sapiens
accctgggtagtcctg

SEQ ID NO: 8342532 - DNA, 22 bp, Homo sapiens
accctgggggtggccagtgcca

SEQ ID NO: 8342533 - DNA, 22 bp, Homo sapiens
accctgggggtggccagtgcca

SEQ ID NO: 8342534 - DNA, 22 bp, Homo sapiens
accctgggcttggcctgctcag

SEQ ID NO: 8342535 - DNA, 22 bp, Homo sapiens
accctgggtgagaggcaaacag

SEQ ID NO: 8342536 - DNA, 22 bp, Homo sapiens
accctgggtctcaatcatccta

SEQ ID NO: 8342537 - DNA, 22 bp, Homo sapiens
accctgggttcccgcagcacca

SEQ ID NO: 8342538 - DNA, 21 bp, Homo sapiens
accctgggttctccataccct

SEQ ID NO: 8342539 - DNA, 22 bp, Homo sapiens
accctgggcacaccatttcccc

SEQ ID NO: 8342540 - DNA, 18 bp, Homo sapiens
accctgggcaattcactc

SEQ ID NO: 8342541 - DNA, 23 bp, Homo sapiens
accctgggcaagtcacctaacct

SEQ ID NO: 8342542 - DNA, 22 bp, Homo sapiens
accctgggagggagaaatcaga

SEQ ID NO: 8342543 - DNA, 22 bp, Homo sapiens
accctgggaactggaaactgga

SEQ ID NO: 8342544 - DNA, 22 bp, Homo sapiens
accctgggacttccgagttgag

SEQ ID NO: 8342545 - DNA, 22 bp, Homo sapiens
accctgggacctggaggtggat

SEQ ID NO: 8342546 - DNA, 22 bp, Homo sapiens
accctggaggtctacagtgcag

SEQ ID NO: 8342547 - DNA, 22 bp, Homo sapiens
accctggagcttttctggccct

SEQ ID NO: 8342548 - DNA, 22 bp, Homo sapiens
accctggattgggaaccagaag

SEQ ID NO: 8342549 - DNA, 22 bp, Homo sapiens
accctggaggtggaggtgcagt

SEQ ID NO: 8342550 - DNA, 22 bp, Homo sapiens
acatgaaaaatgtttgcagttt

SEQ ID NO: 8342551 - DNA, 22 bp, Homo sapiens
acatgaaaaatgtttgcagttt

SEQ ID NO: 8342552 - DNA, 22 bp, Homo sapiens
acatgaaaagactatctgatta

SEQ ID NO: 8342553 - DNA, 22 bp, Homo sapiens
aggccagccctgggctgagaga

SEQ ID NO: 8342554 - DNA, 22 bp, Homo sapiens
aggccagcagacgtgggactga

SEQ ID NO: 8342555 - DNA, 22 bp, Homo sapiens
aggccagcagcatgacggcatc

SEQ ID NO: 8342556 - DNA, 22 bp, Homo sapiens
aggccagcattctctctccagg

SEQ ID NO: 8342557 - DNA, 22 bp, Homo sapiens
aggccagccctcacctgtgttc

SEQ ID NO: 8342558 - DNA, 18 bp, Homo sapiens
aggccagccctgctactg

SEQ ID NO: 8342559 - DNA, 21 bp, Homo sapiens
aggcccagctttcctcttgct

SEQ ID NO: 8342560 - DNA, 22 bp, Homo sapiens
aggcccagggctgctctctgaa

SEQ ID NO: 8342561 - DNA, 22 bp, Homo sapiens
aggcccagggctgctctctgaa

SEQ ID NO: 8342562 - DNA, 22 bp, Homo sapiens
aggccctgagcatccgagggca

SEQ ID NO: 8342563 - DNA, 22 bp, Homo sapiens
aggccctgatccgaatccagat

SEQ ID NO: 8342564 - DNA, 22 bp, Homo sapiens
aggccctgagcatccgagggca

SEQ ID NO: 8342565 - DNA, 22 bp, Homo sapiens
aggccctgagaaaatccctgca

SEQ ID NO: 8342566 - DNA, 22 bp, Homo sapiens
aggcccagtagtcgacggcgct

SEQ ID NO: 8342567 - DNA, 19 bp, Homo sapiens
aggcatgggaagagaagtc

SEQ ID NO: 8342568 - DNA, 22 bp, Homo sapiens
aggcatggctttaggcaggcgt

SEQ ID NO: 8342569 - DNA, 22 bp, Homo sapiens
aggccacaggtggaagccagag

SEQ ID NO: 8342570 - DNA, 22 bp, Homo sapiens
aggccagcaccagagtcaagaa

SEQ ID NO: 8342571 - DNA, 18 bp, Homo sapiens
aggcatggtggtgcgcac

SEQ ID NO: 8342572 - DNA, 22 bp, Homo sapiens
aggcatgggtagaagagaagcc

SEQ ID NO: 8342573 - DNA, 18 bp, Homo sapiens
aggccacactccagaaca

SEQ ID NO: 8342574 - DNA, 22 bp, Homo sapiens
aggccacagatactgtgaagta

SEQ ID NO: 8342575 - DNA, 22 bp, Homo sapiens
acattctaaagcatgctcagga

SEQ ID NO: 8342576 - DNA, 22 bp, Homo sapiens
acattctaacattgtacagata

SEQ ID NO: 8342577 - DNA, 22 bp, Homo sapiens
acattctaaagcatgctcagga

SEQ ID NO: 8342578 - DNA, 22 bp, Homo sapiens
acattctagaagtctttgcaat

SEQ ID NO: 8342579 - DNA, 22 bp, Homo sapiens
acattctagaagagcttcactt

SEQ ID NO: 8342580 - DNA, 22 bp, Homo sapiens
acattctatggttgatgagttg

SEQ ID NO: 8342581 - DNA, 22 bp, Homo sapiens
acattctatagcaagctgatct

SEQ ID NO: 8342582 - DNA, 22 bp, Homo sapiens
acattgaaagcatattatctcc

SEQ ID NO: 8342583 - DNA, 22 bp, Homo sapiens
acattctttgagttttgttaaa

SEQ ID NO: 8342584 - DNA, 22 bp, Homo sapiens
aggccctgcaggaagcaggatg

SEQ ID NO: 8342585 - DNA, 22 bp, Homo sapiens
aggccctgatccgaatccagat

SEQ ID NO: 8342586 - DNA, 22 bp, Homo sapiens
aggccctgcaggagtggggaca

SEQ ID NO: 8342587 - DNA, 22 bp, Homo sapiens
acattaagatgtgctgtaggat

SEQ ID NO: 8342588 - DNA, 22 bp, Homo sapiens
acattaagaaacgagagagcaa

SEQ ID NO: 8342589 - DNA, 22 bp, Homo sapiens
aggccctgcattgtactgaggg

SEQ ID NO: 8342590 - DNA, 22 bp, Homo sapiens
aggccctgcattgtactgaggg

SEQ ID NO: 8342591 - DNA, 22 bp, Homo sapiens
acattaagttttagatgtcaat

SEQ ID NO: 8342592 - DNA, 22 bp, Homo sapiens
acattcaagatgcattcactta

SEQ ID NO: 8342593 - DNA, 19 bp, Homo sapiens
acattgaattttcttcttt

SEQ ID NO: 8342594 - DNA, 22 bp, Homo sapiens
acattgacaaagattgagctgt

SEQ ID NO: 8342595 - DNA, 22 bp, Homo sapiens
acattgaagggctatccaatag

SEQ ID NO: 8342596 - DNA, 22 bp, Homo sapiens
acattgaagggctatccaatag

SEQ ID NO: 8342597 - DNA, 22 bp, Homo sapiens
acattgaatttcacttttgtac

SEQ ID NO: 8342598 - DNA, 22 bp, Homo sapiens
acattgaattcaaaattactga

SEQ ID NO: 8342599 - DNA, 22 bp, Homo sapiens
acattgaacagtacaaatgatc

SEQ ID NO: 8342600 - DNA, 22 bp, Homo sapiens
acattgaagctgtgaaatcaaa

SEQ ID NO: 8342601 - DNA, 22 bp, Homo sapiens
acattgaactacttgtaatgag

SEQ ID NO: 8342602 - DNA, 22 bp, Homo sapiens
acattgaaccagtagacacaaa

SEQ ID NO: 8342603 - DNA, 22 bp, Homo sapiens
aggcttccgagtagctgggact

SEQ ID NO: 8342604 - DNA, 22 bp, Homo sapiens
aggcttcagttgtaccttcttg

SEQ ID NO: 8342605 - DNA, 22 bp, Homo sapiens
actgccaggccagtagaacata

SEQ ID NO: 8342606 - DNA, 22 bp, Homo sapiens
actgccaggatggcactagagg

SEQ ID NO: 8342607 - DNA, 22 bp, Homo sapiens
actgcatttgtctgtctcaatt

SEQ ID NO: 8342608 - DNA, 22 bp, Homo sapiens
actgcccttgtcctggcacacc

SEQ ID NO: 8342609 - DNA, 22 bp, Homo sapiens
actgccctggcaccacacatgc

SEQ ID NO: 8342610 - DNA, 22 bp, Homo sapiens
actgcccaggaatctcaaagaa

SEQ ID NO: 8342611 - DNA, 22 bp, Homo sapiens
actgcctgtagccctgagatgt

SEQ ID NO: 8342612 - DNA, 22 bp, Homo sapiens
actgggcagcagctcgagccgc

SEQ ID NO: 8342613 - DNA, 22 bp, Homo sapiens
actgggcatcccatggcagagc

SEQ ID NO: 8342614 - DNA, 22 bp, Homo sapiens
actgggcagggaaggagaccga

SEQ ID NO: 8342615 - DNA, 22 bp, Homo sapiens
actgggcatgatgagtcaccta

SEQ ID NO: 8342616 - DNA, 22 bp, Homo sapiens
agtgctctgggtccactccaga

SEQ ID NO: 8342617 - DNA, 22 bp, Homo sapiens
agtgctctgatctccttgggtt

SEQ ID NO: 8342618 - DNA, 22 bp, Homo sapiens
agtgctctctccccagtgctac

SEQ ID NO: 8342619 - DNA, 22 bp, Homo sapiens
agtgctcctttcattgctgccc

SEQ ID NO: 8342620 - DNA, 22 bp, Homo sapiens
agtgctcctttcattgctgccc

SEQ ID NO: 8342621 - DNA, 22 bp, Homo sapiens
agtgctctaacagtcaaaaaag

SEQ ID NO: 8342622 - DNA, 22 bp, Homo sapiens
agtgctcctcagaagagttgga

SEQ ID NO: 8342623 - DNA, 22 bp, Homo sapiens
agtgctcctgaagcttgaggca

SEQ ID NO: 8342624 - DNA, 22 bp, Homo sapiens
agtgctcctgccagctttctgg

SEQ ID NO: 8342625 - DNA, 22 bp, Homo sapiens
actgcattctttatcccacaac

SEQ ID NO: 8342626 - DNA, 22 bp, Homo sapiens
agtgctccacattgcactattc

SEQ ID NO: 8342627 - DNA, 22 bp, Homo sapiens
agtgctccctagagttgtgcaa

SEQ ID NO: 8342628 - DNA, 22 bp, Homo sapiens
agtgctccaaaggttggtcatt

SEQ ID NO: 8342629 - DNA, 22 bp, Homo sapiens
agtgaatatttttagacaccca

SEQ ID NO: 8342630 - DNA, 22 bp, Homo sapiens
agtgaatatttttagacaccca

SEQ ID NO: 8342631 - DNA, 21 bp, Homo sapiens
agtgaagagtgaaacacatgg

SEQ ID NO: 8342632 - DNA, 22 bp, Homo sapiens
actctgccttggtgtcacaaga

SEQ ID NO: 8342633 - DNA, 22 bp, Homo sapiens
actctgccttagtcctggggct

SEQ ID NO: 8342634 - DNA, 22 bp, Homo sapiens
actctgcctggaggtaacagga

SEQ ID NO: 8342635 - DNA, 22 bp, Homo sapiens
actctgcctgcggtgggcggga

SEQ ID NO: 8342636 - DNA, 22 bp, Homo sapiens
actctgcctttcagcagatgaa

SEQ ID NO: 8342637 - DNA, 22 bp, Homo sapiens
actctgccctaggcctctgggg

SEQ ID NO: 8342638 - DNA, 22 bp, Homo sapiens
actctgcctgaacctcctgcaa

SEQ ID NO: 8342639 - DNA, 22 bp, Homo sapiens
actctgccccgagttctgggaa

SEQ ID NO: 8342640 - DNA, 22 bp, Homo sapiens
actctgccatcccaggtgctgt

SEQ ID NO: 8342641 - DNA, 21 bp, Homo sapiens
actctgccagtctcctgcact

SEQ ID NO: 8342642 - DNA, 22 bp, Homo sapiens
actctgccacataaaggtagat

SEQ ID NO: 8342643 - DNA, 22 bp, Homo sapiens
actctgaaacttgcaacacatt

SEQ ID NO: 8342644 - DNA, 22 bp, Homo sapiens
agtgaaatttgtttagataggt

SEQ ID NO: 8342645 - DNA, 22 bp, Homo sapiens
agtgaacctagcatggattatc

SEQ ID NO: 8342646 - DNA, 22 bp, Homo sapiens
agtgaacagtttggaacacatg

SEQ ID NO: 8342647 - DNA, 22 bp, Homo sapiens
agtgaacaagttaagaacacta

SEQ ID NO: 8342648 - DNA, 22 bp, Homo sapiens
agtgaaatttgtttagataggt

SEQ ID NO: 8342649 - DNA, 22 bp, Homo sapiens
actcctgccacacagatgctgt

SEQ ID NO: 8342650 - DNA, 22 bp, Homo sapiens
actcctcagccagcatcaggga

SEQ ID NO: 8342651 - DNA, 22 bp, Homo sapiens
actcctcagtcaaatagttggt

SEQ ID NO: 8342652 - DNA, 22 bp, Homo sapiens
actcctgccacacagatgctgt

SEQ ID NO: 8342653 - DNA, 22 bp, Homo sapiens
actccgggagccaggagaggct

SEQ ID NO: 8342654 - DNA, 22 bp, Homo sapiens
actctctgagctaccaggtgag

SEQ ID NO: 8342655 - DNA, 22 bp, Homo sapiens
actctaaaatgctatgagatct

SEQ ID NO: 8342656 - DNA, 22 bp, Homo sapiens
actctaaatagcctcttaaaca

SEQ ID NO: 8342657 - DNA, 22 bp, Homo sapiens
actctaaatagcctcttaaaca

SEQ ID NO: 8342658 - DNA, 22 bp, Homo sapiens
actctaaaccccactctgctgg

SEQ ID NO: 8342659 - DNA, 22 bp, Homo sapiens
actctaaatagataaccatgca

SEQ ID NO: 8342660 - DNA, 22 bp, Homo sapiens
agtataaagtggttttcagcac

SEQ ID NO: 8342661 - DNA, 22 bp, Homo sapiens
agtataaagtggttttcagcac

SEQ ID NO: 8342662 - DNA, 22 bp, Homo sapiens
agtatacatagagatggctgtt

SEQ ID NO: 8342663 - DNA, 22 bp, Homo sapiens
agtatacaaataaatgtgtaat

SEQ ID NO: 8342664 - DNA, 22 bp, Homo sapiens
agtatacagtaatgacatatct

SEQ ID NO: 8342665 - DNA, 22 bp, Homo sapiens
agtacttcagaggctgcccagg

SEQ ID NO: 8342666 - DNA, 23 bp, Homo sapiens
agtacatttgacccaaataagct

SEQ ID NO: 8342667 - DNA, 22 bp, Homo sapiens
agtacccttttcactgtcacaa

SEQ ID NO: 8342668 - DNA, 22 bp, Homo sapiens
aggtggggaaaccagcgatccc

SEQ ID NO: 8342669 - DNA, 22 bp, Homo sapiens
agtaataatagctgtaaagtgc

SEQ ID NO: 8342670 - DNA, 22 bp, Homo sapiens
aggtgggcggattcatgaggtc

SEQ ID NO: 8342671 - DNA, 22 bp, Homo sapiens
aggtgggcggattcatgaggtc

SEQ ID NO: 8342672 - DNA, 22 bp, Homo sapiens
aggtgggcttggtgccaacatg

SEQ ID NO: 8342673 - DNA, 22 bp, Homo sapiens
aggtgggcggatcacaaggtca

SEQ ID NO: 8342674 - DNA, 22 bp, Homo sapiens
aggtgggcccagtgggctccag

SEQ ID NO: 8342675 - DNA, 22 bp, Homo sapiens
aggtgggcgctgctcccgctgg

SEQ ID NO: 8342676 - DNA, 21 bp, Homo sapiens
aggtgggcaggtggagtggcc

SEQ ID NO: 8342677 - DNA, 22 bp, Homo sapiens
aggtgggcatagctagaatatt

SEQ ID NO: 8342678 - DNA, 21 bp, Homo sapiens
aggtgggcaggtggagtggcc

SEQ ID NO: 8342679 - DNA, 22 bp, Homo sapiens
actagaaactaatggattatta

SEQ ID NO: 8342680 - DNA, 22 bp, Homo sapiens
actagaaagtttccagagttat

SEQ ID NO: 8342681 - DNA, 20 bp, Homo sapiens
actagaaagtcactgggggg

SEQ ID NO: 8342682 - DNA, 22 bp, Homo sapiens
actagaaagcactaagctaggc

SEQ ID NO: 8342683 - DNA, 22 bp, Homo sapiens
actagaaagaagttttttgaga

SEQ ID NO: 8342684 - DNA, 22 bp, Homo sapiens
actagaaattactcagaataaa

SEQ ID NO: 8342685 - DNA, 22 bp, Homo sapiens
aggtgggcacagatggagaagt

SEQ ID NO: 8342686 - DNA, 22 bp, Homo sapiens
actagaaattactcagaataaa

SEQ ID NO: 8342687 - DNA, 22 bp, Homo sapiens
aggtgggcaccaggcttgtggt

SEQ ID NO: 8342688 - DNA, 22 bp, Homo sapiens
aggtgggcactccgctcgaggt

SEQ ID NO: 8342689 - DNA, 22 bp, Homo sapiens
aggtgggcactccgctcgaggt

SEQ ID NO: 8342690 - DNA, 22 bp, Homo sapiens
aggtgaagttgaggaggcagaa

SEQ ID NO: 8342691 - DNA, 19 bp, Homo sapiens
aggtgacatgtgacagcct

SEQ ID NO: 8342692 - DNA, 22 bp, Homo sapiens
aggtgacattcagagaacattt

SEQ ID NO: 8342693 - DNA, 22 bp, Homo sapiens
aggtgacatcccggcagcagag

SEQ ID NO: 8342694 - DNA, 22 bp, Homo sapiens
aggtgacaggacaggagctggt

SEQ ID NO: 8342695 - DNA, 19 bp, Homo sapiens
aggtgacaggtgcacttgc

SEQ ID NO: 8342696 - DNA, 22 bp, Homo sapiens
acgaaatactttgcacagtttt

SEQ ID NO: 8342697 - DNA, 22 bp, Homo sapiens
acgaggagcctgtggcctggta

SEQ ID NO: 8342698 - DNA, 22 bp, Homo sapiens
acgaggttggagagttgtttgg

SEQ ID NO: 8342699 - DNA, 22 bp, Homo sapiens
aggtctgtttaacaaagtcagg

SEQ ID NO: 8342700 - DNA, 22 bp, Homo sapiens
aggtccagcctgccctctctcc

SEQ ID NO: 8342701 - DNA, 22 bp, Homo sapiens
aggtccagactgtgtaccctag

SEQ ID NO: 8342702 - DNA, 22 bp, Homo sapiens
aggtccagaacgtgcctactct

SEQ ID NO: 8342703 - DNA, 22 bp, Homo sapiens
aggtccaggcatttgggttggg

SEQ ID NO: 8342704 - DNA, 22 bp, Homo sapiens
aggtccaggatttgtggggtct

SEQ ID NO: 8342705 - DNA, 22 bp, Homo sapiens
acctttctgcaagttctgggac

SEQ ID NO: 8342706 - DNA, 22 bp, Homo sapiens
acccttctgtgacctgcctgtc

SEQ ID NO: 8342707 - DNA, 21 bp, Homo sapiens
aggtcaaaggcatccatgagg

SEQ ID NO: 8342708 - DNA, 22 bp, Homo sapiens
aggtcaagattctacatttgta

SEQ ID NO: 8342709 - DNA, 22 bp, Homo sapiens
aggtcaagaattgatgtggttt

SEQ ID NO: 8342710 - DNA, 22 bp, Homo sapiens
aggtcatttttgccttctattt

SEQ ID NO: 8342711 - DNA, 22 bp, Homo sapiens
aggtcatttccttagaggcaga

SEQ ID NO: 8342712 - DNA, 22 bp, Homo sapiens
aggtcattgttaagtcaccata

SEQ ID NO: 8342713 - DNA, 22 bp, Homo sapiens
aggtcaaggctgcagtgagctg

SEQ ID NO: 8342714 - DNA, 22 bp, Homo sapiens
aggtcaagggcaagagtgaggt

SEQ ID NO: 8342715 - DNA, 22 bp, Homo sapiens
agaaatcattgaattatttgct

SEQ ID NO: 8342716 - DNA, 22 bp, Homo sapiens
agaaatctaagatgctcaagga

SEQ ID NO: 8342717 - DNA, 22 bp, Homo sapiens
agaaatctcagtatctcaggga

SEQ ID NO: 8342718 - DNA, 22 bp, Homo sapiens
atccaggagggctgactcctta

SEQ ID NO: 8342719 - DNA, 19 bp, Homo sapiens
atcccatctggtttttccc

SEQ ID NO: 8342720 - DNA, 22 bp, Homo sapiens
atcccacctcaatctgaagctc

SEQ ID NO: 8342721 - DNA, 22 bp, Homo sapiens
atccattttttcagaatgctct

SEQ ID NO: 8342722 - DNA, 23 bp, Homo sapiens
agaacagtgactaatatagagag

SEQ ID NO: 8342723 - DNA, 23 bp, Homo sapiens
agaacagtgactaatatagagag

SEQ ID NO: 8342724 - DNA, 22 bp, Homo sapiens
agaacataattatcataaactg

SEQ ID NO: 8342725 - DNA, 22 bp, Homo sapiens
agaacatatctgttttctaact

SEQ ID NO: 8342726 - DNA, 22 bp, Homo sapiens
agaacatagatacctaagacag

SEQ ID NO: 8342727 - DNA, 22 bp, Homo sapiens
agaacagtcgtggtgagagaaa

SEQ ID NO: 8342728 - DNA, 22 bp, Homo sapiens
agaaccagtttaagatttgggt

SEQ ID NO: 8342729 - DNA, 22 bp, Homo sapiens
atctctggcaatgcagcatcgt

SEQ ID NO: 8342730 - DNA, 22 bp, Homo sapiens
atctcttctgagcaattcctgt

SEQ ID NO: 8342731 - DNA, 22 bp, Homo sapiens
atctctgtaattacatgatatt

SEQ ID NO: 8342732 - DNA, 22 bp, Homo sapiens
atctctgtgccatcattgcccc

SEQ ID NO: 8342733 - DNA, 22 bp, Homo sapiens
atctctgttagatctgcttaaa

SEQ ID NO: 8342734 - DNA, 22 bp, Homo sapiens
atctctgggtccatagaagaga

SEQ ID NO: 8342735 - DNA, 22 bp, Homo sapiens
atctctggccttccttttccaa

SEQ ID NO: 8342736 - DNA, 22 bp, Homo sapiens
agaaatcatgtcttatttctat

SEQ ID NO: 8342737 - DNA, 22 bp, Homo sapiens
agaaatcatgactaagagcagt

SEQ ID NO: 8342738 - DNA, 22 bp, Homo sapiens
agaaatcatgtcttatttctat

SEQ ID NO: 8342739 - DNA, 22 bp, Homo sapiens
atcagtgtttcaaatgtaatct

SEQ ID NO: 8342740 - DNA, 22 bp, Homo sapiens
atcagtttaaatgggctgttgg

SEQ ID NO: 8342741 - DNA, 22 bp, Homo sapiens
atcagtttaactgtcaagagcc

SEQ ID NO: 8342742 - DNA, 22 bp, Homo sapiens
atcagtgccccatggctaatgc

SEQ ID NO: 8342743 - DNA, 19 bp, Homo sapiens
atcagtgcatgagtgctgt

SEQ ID NO: 8342744 - DNA, 22 bp, Homo sapiens
agaaagcatctccattgtaggt

SEQ ID NO: 8342745 - DNA, 22 bp, Homo sapiens
agaaagcatctccattgtaggt

SEQ ID NO: 8342746 - DNA, 22 bp, Homo sapiens
agaaagcagcatttatgatctc

SEQ ID NO: 8342747 - DNA, 22 bp, Homo sapiens
atcagcaatctcgtgtattagg

SEQ ID NO: 8342748 - DNA, 22 bp, Homo sapiens
atcagcaatcaaattgcagagt

SEQ ID NO: 8342749 - DNA, 21 bp, Homo sapiens
atatttttgtttggactgtca

SEQ ID NO: 8342750 - DNA, 22 bp, Homo sapiens
agaaagcacgggccccaggctc

SEQ ID NO: 8342751 - DNA, 22 bp, Homo sapiens
agaaagcacagcgggtccattt

SEQ ID NO: 8342752 - DNA, 23 bp, Homo sapiens
acttttcaattagctatgcttaa

SEQ ID NO: 8342753 - DNA, 22 bp, Homo sapiens
acttttctccctcctgccttca

SEQ ID NO: 8342754 - DNA, 22 bp, Homo sapiens
atatttttccatgtgggactct

SEQ ID NO: 8342755 - DNA, 22 bp, Homo sapiens
agaaaaagaaagtggatttgtc

SEQ ID NO: 8342756 - DNA, 22 bp, Homo sapiens
atatttctccaaatgttttcaa

SEQ ID NO: 8342757 - DNA, 22 bp, Homo sapiens
atattttggtagctctcaatga

SEQ ID NO: 8342758 - DNA, 22 bp, Homo sapiens
agaaaaagtcaaggaattggac

SEQ ID NO: 8342759 - DNA, 22 bp, Homo sapiens
actgttttgtgccttagtttcc

SEQ ID NO: 8342760 - DNA, 22 bp, Homo sapiens
actgttttgtgccttagtttcc

SEQ ID NO: 8342761 - DNA, 22 bp, Homo sapiens
actgtttatagttttgagctga

SEQ ID NO: 8342762 - DNA, 22 bp, Homo sapiens
actgttttctaaagaacagatg

SEQ ID NO: 8342763 - DNA, 19 bp, Homo sapiens
ataaataaaaagtgggaga

SEQ ID NO: 8342764 - DNA, 22 bp, Homo sapiens
acttcctggctgggtgacctgg

SEQ ID NO: 8342765 - DNA, 22 bp, Homo sapiens
acttcctggctgggtgacctgg

SEQ ID NO: 8342766 - DNA, 22 bp, Homo sapiens
acttcctggctgggtgacctgg

SEQ ID NO: 8342767 - DNA, 22 bp, Homo sapiens
acttcctgtgttggtcttgctg

SEQ ID NO: 8342768 - DNA, 22 bp, Homo sapiens
acttcctgtgttggtcttgctg

SEQ ID NO: 8342769 - DNA, 22 bp, Homo sapiens
acttcctgttatgtgtgcctct

SEQ ID NO: 8342770 - DNA, 22 bp, Homo sapiens
acttcctgttatgtgtgcctct

SEQ ID NO: 8342771 - DNA, 22 bp, Homo sapiens
acttcctgttatgtgtgcctct

SEQ ID NO: 8342772 - DNA, 22 bp, Homo sapiens
acttcctgggcatgcagagtcc

SEQ ID NO: 8342773 - DNA, 22 bp, Homo sapiens
agttttatatcttccattggtt

SEQ ID NO: 8342774 - DNA, 22 bp, Homo sapiens
agttttagagtaagaattactg

SEQ ID NO: 8342775 - DNA, 22 bp, Homo sapiens
agttttatctgtaagctgttca

SEQ ID NO: 8342776 - DNA, 22 bp, Homo sapiens
agttttatgcagtgttctgata

SEQ ID NO: 8342777 - DNA, 21 bp, Homo sapiens
actgttattcccattttcacc

SEQ ID NO: 8342778 - DNA, 22 bp, Homo sapiens
actgttatttgtaatccattat

SEQ ID NO: 8342779 - DNA, 22 bp, Homo sapiens
actgttatttcaccactactga

SEQ ID NO: 8342780 - DNA, 22 bp, Homo sapiens
actgttattgtgaacgggcaat

SEQ ID NO: 8342781 - DNA, 23 bp, Homo sapiens
agtttttctgcatggttctgtat

SEQ ID NO: 8342782 - DNA, 22 bp, Homo sapiens
agtttttctgctggtctcacta

SEQ ID NO: 8342783 - DNA, 22 bp, Homo sapiens
agtttttctgggaggcactgct

SEQ ID NO: 8342784 - DNA, 22 bp, Homo sapiens
agtttttgacaaactgtagttg

SEQ ID NO: 8342785 - DNA, 22 bp, Homo sapiens
agtttttctcccctggcttcat

SEQ ID NO: 8342786 - DNA, 22 bp, Homo sapiens
agtttttgctgatagcatgctt

SEQ ID NO: 8342787 - DNA, 22 bp, Homo sapiens
agttttatgtagacaattcatt

SEQ ID NO: 8342788 - DNA, 21 bp, Homo sapiens
agtttttactcttaactgtgg

SEQ ID NO: 8342789 - DNA, 22 bp, Homo sapiens
agtttttcctgattttacagaa

SEQ ID NO: 8342790 - DNA, 22 bp, Homo sapiens
agtttttccgtggctacgataa

SEQ ID NO: 8342791 - DNA, 21 bp, Homo sapiens
actttacaatttacatagtga

SEQ ID NO: 8342792 - DNA, 22 bp, Homo sapiens
actttacaatatcctgtgactt

SEQ ID NO: 8342793 - DNA, 22 bp, Homo sapiens
actttaaagcagaatggctatg

SEQ ID NO: 8342794 - DNA, 21 bp, Homo sapiens
actttacaatttacatagtga

SEQ ID NO: 8342795 - DNA, 22 bp, Homo sapiens
atacatatccacaggagataaa

SEQ ID NO: 8342796 - DNA, 22 bp, Homo sapiens
atacatatgaatgatttggctc

SEQ ID NO: 8342797 - DNA, 22 bp, Homo sapiens
atacaaaatatatactggagac

SEQ ID NO: 8342798 - DNA, 22 bp, Homo sapiens
atacaaaatatatactggagac

SEQ ID NO: 8342799 - DNA, 22 bp, Homo sapiens
atacaaaaattagccgggagta

SEQ ID NO: 8342800 - DNA, 22 bp, Homo sapiens
atagatattagcaaaattttat

SEQ ID NO: 8342801 - DNA, 23 bp, Homo sapiens
acttttcaattagctatgcttaa

SEQ ID NO: 8342802 - DNA, 22 bp, Homo sapiens
atagatacattgttatatttgt

SEQ ID NO: 8342803 - DNA, 22 bp, Homo sapiens
atagagttttattttccaataa

SEQ ID NO: 8342804 - DNA, 22 bp, Homo sapiens
atagagtgatgtaaggtatgtg

SEQ ID NO: 8342805 - DNA, 22 bp, Homo sapiens
actttggaataagctatataac

SEQ ID NO: 8342806 - DNA, 22 bp, Homo sapiens
actttggaaattgtctataaga

SEQ ID NO: 8342807 - DNA, 22 bp, Homo sapiens
atacatctagagtcataaaaac

SEQ ID NO: 8342808 - DNA, 22 bp, Homo sapiens
ctcaccacaccgtcggcctcct

SEQ ID NO: 8342809 - DNA, 22 bp, Homo sapiens
ctcaccacagagcctgtccagc

SEQ ID NO: 8342810 - DNA, 22 bp, Homo sapiens
ctcaccacagagcctgtccagc

SEQ ID NO: 8342811 - DNA, 23 bp, Homo sapiens
ctcaccaagcgccgccgctgtgt

SEQ ID NO: 8342812 - DNA, 23 bp, Homo sapiens
ctcaccaagcgccgccgctgtgt

SEQ ID NO: 8342813 - DNA, 22 bp, Homo sapiens
ctcacatacctgttttcccttt

SEQ ID NO: 8342814 - DNA, 22 bp, Homo sapiens
agtctatattgtgaaagtaaaa

SEQ ID NO: 8342815 - DNA, 22 bp, Homo sapiens
agtctacaatcttaaatgaact

SEQ ID NO: 8342816 - DNA, 22 bp, Homo sapiens
agtctagatgatcctaggaata

SEQ ID NO: 8342817 - DNA, 22 bp, Homo sapiens
agtctagatgtgtactaggtta

SEQ ID NO: 8342818 - DNA, 22 bp, Homo sapiens
agtctcagaaaagaagcatgga

SEQ ID NO: 8342819 - DNA, 22 bp, Homo sapiens
agtctcagaaaatatgcttttt

SEQ ID NO: 8342820 - DNA, 22 bp, Homo sapiens
agtgaaattcctggtctttgtt

SEQ ID NO: 8342821 - DNA, 21 bp, Homo sapiens
agtgaaattgcatcagaggga

SEQ ID NO: 8342822 - DNA, 22 bp, Homo sapiens
agtgaaattgctgtaagaggaa

SEQ ID NO: 8342823 - DNA, 22 bp, Homo sapiens
agtgaaatgatagtgtaaatac

SEQ ID NO: 8342824 - DNA, 22 bp, Homo sapiens
agtgaaatgactgaatcagata

SEQ ID NO: 8342825 - DNA, 19 bp, Homo sapiens
agtgaaatggagtattcaa

SEQ ID NO: 8342826 - DNA, 22 bp, Homo sapiens
agtgaaatggatgctgctactg

SEQ ID NO: 8342827 - DNA, 22 bp, Homo sapiens
agtgaaatgattctgagcaaga

SEQ ID NO: 8342828 - DNA, 19 bp, Homo sapiens
agtgaaatggagtattcaa

SEQ ID NO: 8342829 - DNA, 22 bp, Homo sapiens
agtgaaatgattctgagcaaga

SEQ ID NO: 8342830 - DNA, 21 bp, Homo sapiens
agtgaaatgaagtgtatgctc

SEQ ID NO: 8342831 - DNA, 21 bp, Homo sapiens
agtgaaatgaagtgtatgctc

SEQ ID NO: 8342832 - DNA, 22 bp, Homo sapiens
agtgaaatgactgaatcagata

SEQ ID NO: 8342833 - DNA, 22 bp, Homo sapiens
agtgaaatcctggtcaacaggt

SEQ ID NO: 8342834 - DNA, 22 bp, Homo sapiens
agtgaaataaagctgcctatgg

SEQ ID NO: 8342835 - DNA, 22 bp, Homo sapiens
agtgaaatactgtcgtttttag

SEQ ID NO: 8342836 - DNA, 22 bp, Homo sapiens
agtgaaatagcatttatgaagc

SEQ ID NO: 8342837 - DNA, 22 bp, Homo sapiens
agtgaaatagcatttatgaagc

SEQ ID NO: 8342838 - DNA, 22 bp, Homo sapiens
agtgaaatatgcccattgctgt

SEQ ID NO: 8342839 - DNA, 22 bp, Homo sapiens
agtgaaatcaggttttgactgc

SEQ ID NO: 8342840 - DNA, 22 bp, Homo sapiens
agtgagggactagtgctgggga

SEQ ID NO: 8342841 - DNA, 22 bp, Homo sapiens
agtgaggtcatactggagaggg

SEQ ID NO: 8342842 - DNA, 22 bp, Homo sapiens
agtgaggtggggtcacagggac

SEQ ID NO: 8342843 - DNA, 22 bp, Homo sapiens
agtgaggtcaggatctcaggga

SEQ ID NO: 8342844 - DNA, 22 bp, Homo sapiens
agtgattgagtgttagcagtct

SEQ ID NO: 8342845 - DNA, 21 bp, Homo sapiens
agtgatttatgagagaatgac

SEQ ID NO: 8342846 - DNA, 19 bp, Homo sapiens
agtgcattttatgtttcaa

SEQ ID NO: 8342847 - DNA, 22 bp, Homo sapiens
agtgcattctccatcatctagg

SEQ ID NO: 8342848 - DNA, 22 bp, Homo sapiens
agtgcattcagtattcataggc

SEQ ID NO: 8342849 - DNA, 20 bp, Homo sapiens
agtgccctccgacattgttt

SEQ ID NO: 8342850 - DNA, 22 bp, Homo sapiens
agtgccctcgtgcccagggcct

SEQ ID NO: 8342851 - DNA, 22 bp, Homo sapiens
agtgccctgctggggcaggaga

SEQ ID NO: 8342852 - DNA, 22 bp, Homo sapiens
agtgccctgtggcttcagcaat

SEQ ID NO: 8342853 - DNA, 22 bp, Homo sapiens
agtgccttctctgggctaggtc

SEQ ID NO: 8342854 - DNA, 22 bp, Homo sapiens
agtgccttaaacagcatcggag

SEQ ID NO: 8342855 - DNA, 22 bp, Homo sapiens
agtggatggtattgggaccagg

SEQ ID NO: 8342856 - DNA, 22 bp, Homo sapiens
agtggatggtattgggaccagg

SEQ ID NO: 8342857 - DNA, 22 bp, Homo sapiens
agtggaggttattgagttaagg

SEQ ID NO: 8342858 - DNA, 22 bp, Homo sapiens
agtggagtgagtggcagaagga

SEQ ID NO: 8342859 - DNA, 22 bp, Homo sapiens
agtggatggtcactgatccagt

SEQ ID NO: 8342860 - DNA, 22 bp, Homo sapiens
agtggatggtcactgatccagt

SEQ ID NO: 8342861 - DNA, 22 bp, Homo sapiens
agtggagttgagttgatggatt

SEQ ID NO: 8342862 - DNA, 22 bp, Homo sapiens
ctgagctctaatgtcagccttg

SEQ ID NO: 8342863 - DNA, 22 bp, Homo sapiens
ctgagctcagtcccagctctac

SEQ ID NO: 8342864 - DNA, 22 bp, Homo sapiens
ctgagctcagtcccagctctac

SEQ ID NO: 8342865 - DNA, 22 bp, Homo sapiens
ctgagctcacgccattctcctt

SEQ ID NO: 8342866 - DNA, 22 bp, Homo sapiens
ctgagctcaagcgatcctccca

SEQ ID NO: 8342867 - DNA, 22 bp, Homo sapiens
ctgagctgctcccgctgcagcg

SEQ ID NO: 8342868 - DNA, 22 bp, Homo sapiens
agttccagctgtgaccagaaaa

SEQ ID NO: 8342869 - DNA, 19 bp, Homo sapiens
agttccacactttatctgg

SEQ ID NO: 8342870 - DNA, 19 bp, Homo sapiens
agttatttctaaatttacc

SEQ ID NO: 8342871 - DNA, 22 bp, Homo sapiens
agtgtttgtaaactacagatct

SEQ ID NO: 8342872 - DNA, 22 bp, Homo sapiens
agtgttttattagaacacagcc

SEQ ID NO: 8342873 - DNA, 22 bp, Homo sapiens
agtgttttatttcagcactttg

SEQ ID NO: 8342874 - DNA, 22 bp, Homo sapiens
agtgttttgctaatcctattaa

SEQ ID NO: 8342875 - DNA, 17 bp, Homo sapiens
agtgtttccttatcatt

SEQ ID NO: 8342876 - DNA, 22 bp, Homo sapiens
agtgtttcccagtaggatgaaa

SEQ ID NO: 8342877 - DNA, 22 bp, Homo sapiens
agtgtttctggcaaatgaaagt

SEQ ID NO: 8342878 - DNA, 22 bp, Homo sapiens
agtgtttctcagaagggcctat

SEQ ID NO: 8342879 - DNA, 22 bp, Homo sapiens
agtgtttgcatctcattgattt

SEQ ID NO: 8342880 - DNA, 20 bp, Homo sapiens
agtgtttgctcacagtctcc

SEQ ID NO: 8342881 - DNA, 22 bp, Homo sapiens
agtgtgctgcttaaacagttgt

SEQ ID NO: 8342882 - DNA, 22 bp, Homo sapiens
agtgtgcttaagtttatcagga

SEQ ID NO: 8342883 - DNA, 22 bp, Homo sapiens
agtgtggagccactgagtggct

SEQ ID NO: 8342884 - DNA, 22 bp, Homo sapiens
agtgtggacttttcctaggagg

SEQ ID NO: 8342885 - DNA, 22 bp, Homo sapiens
agtgtggaccttcacacagaga

SEQ ID NO: 8342886 - DNA, 22 bp, Homo sapiens
agtgtggagcatcgagggcaga

SEQ ID NO: 8342887 - DNA, 22 bp, Homo sapiens
agtgtgatttattggaagaggt

SEQ ID NO: 8342888 - DNA, 22 bp, Homo sapiens
agtggcccctgtgccaccacac

SEQ ID NO: 8342889 - DNA, 22 bp, Homo sapiens
ctctggagttcttcaagctact

SEQ ID NO: 8342890 - DNA, 22 bp, Homo sapiens
agtgggtggcgcagaggaggaa

SEQ ID NO: 8342891 - DNA, 22 bp, Homo sapiens
agtgggtgggtgtctgacagtt

SEQ ID NO: 8342892 - DNA, 22 bp, Homo sapiens
agtgtcatatgccactgcatcc

SEQ ID NO: 8342893 - DNA, 19 bp, Homo sapiens
agtgtcatcagctactcag

SEQ ID NO: 8342894 - DNA, 22 bp, Homo sapiens
agtgtcattccagggaccctcg

SEQ ID NO: 8342895 - DNA, 18 bp, Homo sapiens
agtgtcagctgcagctca

SEQ ID NO: 8342896 - DNA, 22 bp, Homo sapiens
agtgtattgctttcatcatttt

SEQ ID NO: 8342897 - DNA, 22 bp, Homo sapiens
agtgtatttgcctataaaaatg

SEQ ID NO: 8342898 - DNA, 22 bp, Homo sapiens
agtgtctttgacacattcaaag

SEQ ID NO: 8342899 - DNA, 22 bp, Homo sapiens
agtgtctttggctaagtgctgt

SEQ ID NO: 8342900 - DNA, 22 bp, Homo sapiens
agtgtcattttgtccatcttct

SEQ ID NO: 8342901 - DNA, 22 bp, Homo sapiens
agtgtcctagcaagccggtcct

SEQ ID NO: 8342902 - DNA, 17 bp, Homo sapiens
aggtgcagaggcagagc

SEQ ID NO: 8342903 - DNA, 17 bp, Homo sapiens
aggtgcagaggcagagc

SEQ ID NO: 8342904 - DNA, 18 bp, Homo sapiens
aggtgcagcctctgaggc

SEQ ID NO: 8342905 - DNA, 22 bp, Homo sapiens
cctgtgccagctgggccctgcc

SEQ ID NO: 8342906 - DNA, 22 bp, Homo sapiens
aggtgcagctggtggagtctgg

SEQ ID NO: 8342907 - DNA, 22 bp, Homo sapiens
cctgtgccagccccttctgctg

SEQ ID NO: 8342908 - DNA, 22 bp, Homo sapiens
cctggggctctgcacagagcag

SEQ ID NO: 8342909 - DNA, 22 bp, Homo sapiens
cctggggctccagagcagcgga

SEQ ID NO: 8342910 - DNA, 22 bp, Homo sapiens
cctgggctttgagggcaggatg

SEQ ID NO: 8342911 - DNA, 20 bp, Homo sapiens
cctggggtacactggcatgt

SEQ ID NO: 8342912 - DNA, 22 bp, Homo sapiens
cctgggggccaggaaggtgtga

SEQ ID NO: 8342913 - DNA, 22 bp, Homo sapiens
cctggggctctgcacagagcag

SEQ ID NO: 8342914 - DNA, 22 bp, Homo sapiens
cctggggctttctttgtatcat

SEQ ID NO: 8342915 - DNA, 22 bp, Homo sapiens
cctggggctctgcacagagcag

SEQ ID NO: 8342916 - DNA, 22 bp, Homo sapiens
aggtggcagagctggcccagcg

SEQ ID NO: 8342917 - DNA, 22 bp, Homo sapiens
cctgtgggtacaacagggtcac

SEQ ID NO: 8342918 - DNA, 22 bp, Homo sapiens
cctgtggggccatctcagtcac

SEQ ID NO: 8342919 - DNA, 22 bp, Homo sapiens
cctgtggggagagatctcttag

SEQ ID NO: 8342920 - DNA, 22 bp, Homo sapiens
cctgtgggagcccaggcagata

SEQ ID NO: 8342921 - DNA, 22 bp, Homo sapiens
cctgtgggcctgcacgtgggga

SEQ ID NO: 8342922 - DNA, 22 bp, Homo sapiens
aggtggcagcagaatcagggag

SEQ ID NO: 8342923 - DNA, 22 bp, Homo sapiens
aggtggcagcagaatcagggag

SEQ ID NO: 8342924 - DNA, 22 bp, Homo sapiens
ccttccagaaagcacttagtta

SEQ ID NO: 8342925 - DNA, 21 bp, Homo sapiens
ccttccaccttctgccatgtg

SEQ ID NO: 8342926 - DNA, 19 bp, Homo sapiens
ccttccagaactaaattaa

SEQ ID NO: 8342927 - DNA, 23 bp, Homo sapiens
aggtacacattatagaaatagac

SEQ ID NO: 8342928 - DNA, 22 bp, Homo sapiens
aggtaagaatagaggattgggg

SEQ ID NO: 8342929 - DNA, 22 bp, Homo sapiens
aggtaacattgcctccatctga

SEQ ID NO: 8342930 - DNA, 22 bp, Homo sapiens
aggtaaagacagtgaaagaggg

SEQ ID NO: 8342931 - DNA, 22 bp, Homo sapiens
aggtaaagactgcaaggagaat

SEQ ID NO: 8342932 - DNA, 22 bp, Homo sapiens
aggtcagcaggccaggggcgaa

SEQ ID NO: 8342933 - DNA, 22 bp, Homo sapiens
aggtcagcatgctcctctctgt

SEQ ID NO: 8342934 - DNA, 22 bp, Homo sapiens
cctgggagaactgctgggttgg

SEQ ID NO: 8342935 - DNA, 22 bp, Homo sapiens
cctgggaggctgtgggtctgct

SEQ ID NO: 8342936 - DNA, 22 bp, Homo sapiens
cctgggaggctgaggctgcagt

SEQ ID NO: 8342937 - DNA, 22 bp, Homo sapiens
cctgggaggctgtgggtctgct

SEQ ID NO: 8342938 - DNA, 22 bp, Homo sapiens
cctgggagggcaagtgctgatg

SEQ ID NO: 8342939 - DNA, 22 bp, Homo sapiens
cctgggaggtggaggttgcagc

SEQ ID NO: 8342940 - DNA, 22 bp, Homo sapiens
cctgggagggcaagtgctgatg

SEQ ID NO: 8342941 - DNA, 22 bp, Homo sapiens
ctatgacacaggccattatata

SEQ ID NO: 8342942 - DNA, 22 bp, Homo sapiens
ctattgaaagtgtacaattcaa

SEQ ID NO: 8342943 - DNA, 22 bp, Homo sapiens
ctattctagattacagtataaa

SEQ ID NO: 8342944 - DNA, 22 bp, Homo sapiens
ctatcttttgttcattttgagt

SEQ ID NO: 8342945 - DNA, 22 bp, Homo sapiens
ctatcttggtccagtctacacc

SEQ ID NO: 8342946 - DNA, 22 bp, Homo sapiens
ctattgaatagcccaaatcatt

SEQ ID NO: 8342947 - DNA, 22 bp, Homo sapiens
ctattgaattaactattaaagt

SEQ ID NO: 8342948 - DNA, 22 bp, Homo sapiens
ctattgaggacataaggactct

SEQ ID NO: 8342949 - DNA, 22 bp, Homo sapiens
ctattgaaagtgtacaattcaa

SEQ ID NO: 8342950 - DNA, 22 bp, Homo sapiens
agtcctgggtccagcaggtcct

SEQ ID NO: 8342951 - DNA, 22 bp, Homo sapiens
ctatccaaggagtttttgaaat

SEQ ID NO: 8342952 - DNA, 22 bp, Homo sapiens
ctatatttcttggctttaaaca

SEQ ID NO: 8342953 - DNA, 22 bp, Homo sapiens
ctatatttcttggctttaaaca

SEQ ID NO: 8342954 - DNA, 22 bp, Homo sapiens
ctatatttggtgagggatgtct

SEQ ID NO: 8342955 - DNA, 22 bp, Homo sapiens
ctagtctgcagcggggaggggt

SEQ ID NO: 8342956 - DNA, 22 bp, Homo sapiens
agtcacacactgtcagttctgc

SEQ ID NO: 8342957 - DNA, 22 bp, Homo sapiens
agtcaatatttcaataacccat

SEQ ID NO: 8342958 - DNA, 22 bp, Homo sapiens
agtcacagggtacacaaggatt

SEQ ID NO: 8342959 - DNA, 22 bp, Homo sapiens
agtcacatagctctggtttctt

SEQ ID NO: 8342960 - DNA, 22 bp, Homo sapiens
agtcacatgcattttcttcaat

SEQ ID NO: 8342961 - DNA, 20 bp, Homo sapiens
agtcacattgagcttttgga

SEQ ID NO: 8342962 - DNA, 22 bp, Homo sapiens
ctagctttttatgacaatcttg

SEQ ID NO: 8342963 - DNA, 22 bp, Homo sapiens
agtaaacagtttcttagaagaa

SEQ ID NO: 8342964 - DNA, 22 bp, Homo sapiens
agtaaacatatttgtggtggga

SEQ ID NO: 8342965 - DNA, 22 bp, Homo sapiens
agtaaacatgtaattgttcatt

SEQ ID NO: 8342966 - DNA, 22 bp, Homo sapiens
agtaaataacagagaaaatggg

SEQ ID NO: 8342967 - DNA, 18 bp, Homo sapiens
agtaaatgttaaatattg

SEQ ID NO: 8342968 - DNA, 22 bp, Homo sapiens
agtaaatgaaagcaattttaga

SEQ ID NO: 8342969 - DNA, 18 bp, Homo sapiens
agtaaatggtttattttc

SEQ ID NO: 8342970 - DNA, 22 bp, Homo sapiens
agtaaaaattgaggtgcaaaat

SEQ ID NO: 8342971 - DNA, 22 bp, Homo sapiens
ccttccaggtgcaggcaagcct

SEQ ID NO: 8342972 - DNA, 22 bp, Homo sapiens
agtagaataattggattacagt

SEQ ID NO: 8342973 - DNA, 22 bp, Homo sapiens
agtagaaatgtagtgtagagaa

SEQ ID NO: 8342974 - DNA, 22 bp, Homo sapiens
agtagatttttgaatgtaagtt

SEQ ID NO: 8342975 - DNA, 22 bp, Homo sapiens
agtagaaatgtagtgtagagaa

SEQ ID NO: 8342976 - DNA, 22 bp, Homo sapiens
agtagaaatgtaagaaggatta

SEQ ID NO: 8342977 - DNA, 22 bp, Homo sapiens
agtacagtggtcataatataaa

SEQ ID NO: 8342978 - DNA, 22 bp, Homo sapiens
agtaacaaatgcatctgggcat

SEQ ID NO: 8342979 - DNA, 22 bp, Homo sapiens
agtatttctagttggttctact

SEQ ID NO: 8342980 - DNA, 22 bp, Homo sapiens
agtatttctgctcatgaaagag

SEQ ID NO: 8342981 - DNA, 22 bp, Homo sapiens
atccatgaaggtacttctcagg

SEQ ID NO: 8342982 - DNA, 22 bp, Homo sapiens
cttaatctcacctgcaaagtcc

SEQ ID NO: 8342983 - DNA, 16 bp, Homo sapiens
cttaagtgctgaaagg

SEQ ID NO: 8342984 - DNA, 22 bp, Homo sapiens
atcatagaggaaaatccacgtt

SEQ ID NO: 8342985 - DNA, 19 bp, Homo sapiens
atcatacatgttacactct

SEQ ID NO: 8342986 - DNA, 22 bp, Homo sapiens
cttattcataagtcagacacac

SEQ ID NO: 8342987 - DNA, 22 bp, Homo sapiens
cttattcatatattctcggtag

SEQ ID NO: 8342988 - DNA, 22 bp, Homo sapiens
cttcaagaagacagcagagcat

SEQ ID NO: 8342989 - DNA, 21 bp, Homo sapiens
cttattcactgttatttatca

SEQ ID NO: 8342990 - DNA, 22 bp, Homo sapiens
cttattcaatgctggaaatgtt

SEQ ID NO: 8342991 - DNA, 22 bp, Homo sapiens
cttattcagaaggagaaatgga

SEQ ID NO: 8342992 - DNA, 22 bp, Homo sapiens
cttattcagaccttggattctt

SEQ ID NO: 8342993 - DNA, 22 bp, Homo sapiens
cttattcagatacagactcttg

SEQ ID NO: 8342994 - DNA, 22 bp, Homo sapiens
cttattcagcaagtttgggtac

SEQ ID NO: 8342995 - DNA, 22 bp, Homo sapiens
cttattcagcacttgctctgta

SEQ ID NO: 8342996 - DNA, 22 bp, Homo sapiens
cttcaagatatttctagaatca

SEQ ID NO: 8342997 - DNA, 22 bp, Homo sapiens
cttcaagagaatgcagggatgt

SEQ ID NO: 8342998 - DNA, 22 bp, Homo sapiens
cttcaagatccatagatattgc

SEQ ID NO: 8342999 - DNA, 22 bp, Homo sapiens
atctgtccctggtccaagattt

SEQ ID NO: 8343000 - DNA, 22 bp, Homo sapiens
atctgtcctggagctaggcttc

SEQ ID NO: 8343001 - DNA, 18 bp, Homo sapiens
atctgtcctttctctgcc

SEQ ID NO: 8343002 - DNA, 22 bp, Homo sapiens
atctgtcttccaccacacatcc

SEQ ID NO: 8343003 - DNA, 22 bp, Homo sapiens
atctgtcttgccttgcatattt

SEQ ID NO: 8343004 - DNA, 22 bp, Homo sapiens
atctgtggcgcaaacaaaggct

SEQ ID NO: 8343005 - DNA, 23 bp, Homo sapiens
atctgttcatctgacacagattc

SEQ ID NO: 8343006 - DNA, 22 bp, Homo sapiens
atctgttcttcaaaatattaca

SEQ ID NO: 8343007 - DNA, 22 bp, Homo sapiens
atctgtaattttgaatgcaaat

SEQ ID NO: 8343008 - DNA, 22 bp, Homo sapiens
atctgtaaatgcaaatgtagct

SEQ ID NO: 8343009 - DNA, 22 bp, Homo sapiens
atctggtttggggatccttgtg

SEQ ID NO: 8343010 - DNA, 22 bp, Homo sapiens
atctggctcttcctggagttcc

SEQ ID NO: 8343011 - DNA, 22 bp, Homo sapiens
atctggctctctcatttacaaa

SEQ ID NO: 8343012 - DNA, 22 bp, Homo sapiens
atctggctcccttggaatccgt

SEQ ID NO: 8343013 - DNA, 22 bp, Homo sapiens
atctggctcctacacttgaaga

SEQ ID NO: 8343014 - DNA, 22 bp, Homo sapiens
atctggctcattcagggaacgg

SEQ ID NO: 8343015 - DNA, 22 bp, Homo sapiens
atctggctcgctaggctctggg

SEQ ID NO: 8343016 - DNA, 20 bp, Homo sapiens
atctggctcagatcctgcag

SEQ ID NO: 8343017 - DNA, 22 bp, Homo sapiens
cttcttaaattggattgctatt

SEQ ID NO: 8343018 - DNA, 22 bp, Homo sapiens
atctctatctttattgaaatct

SEQ ID NO: 8343019 - DNA, 22 bp, Homo sapiens
atctctaatttaaaaagtaaca

SEQ ID NO: 8343020 - DNA, 22 bp, Homo sapiens
atctctaatttaaaaagtaaca

SEQ ID NO: 8343021 - DNA, 22 bp, Homo sapiens
atctccgccatcgcgaacgcct

SEQ ID NO: 8343022 - DNA, 22 bp, Homo sapiens
cttctgcactgaccttttgtcc

SEQ ID NO: 8343023 - DNA, 22 bp, Homo sapiens
cttctgcaagagcatcagttgt

SEQ ID NO: 8343024 - DNA, 22 bp, Homo sapiens
cttctgcaggccttattttagt

SEQ ID NO: 8343025 - DNA, 22 bp, Homo sapiens
cttctgtggatgttggatgcat

SEQ ID NO: 8343026 - DNA, 22 bp, Homo sapiens
cttctgtgcaattgtggaggag

SEQ ID NO: 8343027 - DNA, 22 bp, Homo sapiens
atattattttccctggagttgt

SEQ ID NO: 8343028 - DNA, 18 bp, Homo sapiens
atattcaagaagacagag

SEQ ID NO: 8343029 - DNA, 22 bp, Homo sapiens
atattcaagtgaggatggctaa

SEQ ID NO: 8343030 - DNA, 18 bp, Homo sapiens
atattcaagaagacagag

SEQ ID NO: 8343031 - DNA, 20 bp, Homo sapiens
ctgggtggcaagcaaggggg

SEQ ID NO: 8343032 - DNA, 22 bp, Homo sapiens
ctgggtggagcctggtcatctg

SEQ ID NO: 8343033 - DNA, 22 bp, Homo sapiens
ctggtccagtggatgctgaggg

SEQ ID NO: 8343034 - DNA, 22 bp, Homo sapiens
ctggtcattcaggtgttttaaa

SEQ ID NO: 8343035 - DNA, 22 bp, Homo sapiens
ctggtcatcactctaacagact

SEQ ID NO: 8343036 - DNA, 22 bp, Homo sapiens
ctgggtggcgtctggggccagt

SEQ ID NO: 8343037 - DNA, 22 bp, Homo sapiens
ctgggtggcagagcctgcagtg

SEQ ID NO: 8343038 - DNA, 22 bp, Homo sapiens
ctgggtggctgtccagccagcc

SEQ ID NO: 8343039 - DNA, 22 bp, Homo sapiens
ctggggcttcaatgcttcggtg

SEQ ID NO: 8343040 - DNA, 22 bp, Homo sapiens
ctggggcttcaatgcttcggtg

SEQ ID NO: 8343041 - DNA, 23 bp, Homo sapiens
ctggggctttcaaatctgggcag

SEQ ID NO: 8343042 - DNA, 22 bp, Homo sapiens
atattattctagtaacagtgat

SEQ ID NO: 8343043 - DNA, 22 bp, Homo sapiens
atattattctagctcttgtgtg

SEQ ID NO: 8343044 - DNA, 22 bp, Homo sapiens
ctgggggcaatggtcagagtgt

SEQ ID NO: 8343045 - DNA, 23 bp, Homo sapiens
ctggggctttcaaatctgggcag

SEQ ID NO: 8343046 - DNA, 22 bp, Homo sapiens
ctgggagcttggagcctttggt

SEQ ID NO: 8343047 - DNA, 22 bp, Homo sapiens
ctgggagcttttagaaatgcag

SEQ ID NO: 8343048 - DNA, 22 bp, Homo sapiens
ctgggaggacaacttggagctc

SEQ ID NO: 8343049 - DNA, 22 bp, Homo sapiens
ctgggaggacaacttggagctc

SEQ ID NO: 8343050 - DNA, 22 bp, Homo sapiens
ctgggaggcggaggttgcagtg

SEQ ID NO: 8343051 - DNA, 22 bp, Homo sapiens
ctgggaggcggaggttgtagtg

SEQ ID NO: 8343052 - DNA, 22 bp, Homo sapiens
ctgggaggtggaggttgcattg

SEQ ID NO: 8343053 - DNA, 22 bp, Homo sapiens
ctgtctccgccctcttggtagg

SEQ ID NO: 8343054 - DNA, 22 bp, Homo sapiens
ctgtctcctccactgcatggga

SEQ ID NO: 8343055 - DNA, 22 bp, Homo sapiens
ctgtctcctccactgcatggga

SEQ ID NO: 8343056 - DNA, 22 bp, Homo sapiens
ctgtctcctcctttgttcttaa

SEQ ID NO: 8343057 - DNA, 22 bp, Homo sapiens
atcataaaccactttgtaatct

SEQ ID NO: 8343058 - DNA, 22 bp, Homo sapiens
atcataaaattgcaccatttct

SEQ ID NO: 8343059 - DNA, 22 bp, Homo sapiens
atcagttttgttcactactata

SEQ ID NO: 8343060 - DNA, 22 bp, Homo sapiens
atcagtttttattaatgtagct

SEQ ID NO: 8343061 - DNA, 22 bp, Homo sapiens
atcagttttgggggacatactg

SEQ ID NO: 8343062 - DNA, 22 bp, Homo sapiens
atcagtttgtatatgaaacact

SEQ ID NO: 8343063 - DNA, 22 bp, Homo sapiens
atcagtttctaccatgtggaat

SEQ ID NO: 8343064 - DNA, 22 bp, Homo sapiens
atcagtttctgtgaagaacaca

SEQ ID NO: 8343065 - DNA, 22 bp, Homo sapiens
atcagtttcacttgcttgcaaa

SEQ ID NO: 8343066 - DNA, 22 bp, Homo sapiens
atcagtttatacttataaatct

SEQ ID NO: 8343067 - DNA, 22 bp, Homo sapiens
atcagtttggtgctttcagtga

SEQ ID NO: 8343068 - DNA, 22 bp, Homo sapiens
atcagtttggaacattcaggcc

SEQ ID NO: 8343069 - DNA, 22 bp, Homo sapiens
atcagtttgataataaggcttg

SEQ ID NO: 8343070 - DNA, 22 bp, Homo sapiens
atcagtttgagtgctgtgtcaa

SEQ ID NO: 8343071 - DNA, 22 bp, Homo sapiens
atcagtttctgtgaagaacaca

SEQ ID NO: 8343072 - DNA, 22 bp, Homo sapiens
atcagcatcgggtggtggtggg

SEQ ID NO: 8343073 - DNA, 22 bp, Homo sapiens
atcagctaattagaattaggat

SEQ ID NO: 8343074 - DNA, 22 bp, Homo sapiens
ctgtaagatgggataagacttt

SEQ ID NO: 8343075 - DNA, 22 bp, Homo sapiens
atcacacagcaaggtggaggca

SEQ ID NO: 8343076 - DNA, 22 bp, Homo sapiens
atcaagaattgggagctattga

SEQ ID NO: 8343077 - DNA, 22 bp, Homo sapiens
atcacagatttgatacttttgt

SEQ ID NO: 8343078 - DNA, 22 bp, Homo sapiens
atcacagattgtgaataactat

SEQ ID NO: 8343079 - DNA, 22 bp, Homo sapiens
ctgcagggaactgaggcccaga

SEQ ID NO: 8343080 - DNA, 22 bp, Homo sapiens
ctgcagggaccacaagcaggtt

SEQ ID NO: 8343081 - DNA, 22 bp, Homo sapiens
ctgcagggagaggggacagcct

SEQ ID NO: 8343082 - DNA, 22 bp, Homo sapiens
ctgcagggacccaagtctttgg

SEQ ID NO: 8343083 - DNA, 22 bp, Homo sapiens
ctgcagggaccacaagcaggtt

SEQ ID NO: 8343084 - DNA, 21 bp, Homo sapiens
ataaagacaaacactatttgg

SEQ ID NO: 8343085 - DNA, 22 bp, Homo sapiens
ataaagcatctagtctgtcact

SEQ ID NO: 8343086 - DNA, 22 bp, Homo sapiens
ataaaacttgggtatgatccct

SEQ ID NO: 8343087 - DNA, 22 bp, Homo sapiens
ataaaacttattagaattgtgt

SEQ ID NO: 8343088 - DNA, 22 bp, Homo sapiens
ataaaacttattagaattgtgt

SEQ ID NO: 8343089 - DNA, 20 bp, Homo sapiens
ataaaactctaatctggcct

SEQ ID NO: 8343090 - DNA, 22 bp, Homo sapiens
ataaaagaagttttggtacttg

SEQ ID NO: 8343091 - DNA, 22 bp, Homo sapiens
agttctgtggctgtgccctgta

SEQ ID NO: 8343092 - DNA, 22 bp, Homo sapiens
agttcttattgaatagaaatca

SEQ ID NO: 8343093 - DNA, 22 bp, Homo sapiens
agttctataattaaaatgaagg

SEQ ID NO: 8343094 - DNA, 22 bp, Homo sapiens
agttctgagcatctaggcagct

SEQ ID NO: 8343095 - DNA, 22 bp, Homo sapiens
agttctgactctgaatctggga

SEQ ID NO: 8343096 - DNA, 22 bp, Homo sapiens
agttctgaatgaggaatctggg

SEQ ID NO: 8343097 - DNA, 22 bp, Homo sapiens
agttctgtgacaatatcattac

SEQ ID NO: 8343098 - DNA, 22 bp, Homo sapiens
ctgcctgggttcaagtcctgtt

SEQ ID NO: 8343099 - DNA, 22 bp, Homo sapiens
ctgctacacgattctgattcca

SEQ ID NO: 8343100 - DNA, 22 bp, Homo sapiens
ctgctacaccggaatagtgaca

SEQ ID NO: 8343101 - DNA, 22 bp, Homo sapiens
ctgcctgtgccaccgcctcatt

SEQ ID NO: 8343102 - DNA, 20 bp, Homo sapiens
ctgctcagaccaactcttct

SEQ ID NO: 8343103 - DNA, 19 bp, Homo sapiens
ctgctcagagcagctccag

SEQ ID NO: 8343104 - DNA, 19 bp, Homo sapiens
ctgctcagagcagctccag

SEQ ID NO: 8343105 - DNA, 22 bp, Homo sapiens
ctgctacttaccagctgtgtaa

SEQ ID NO: 8343106 - DNA, 22 bp, Homo sapiens
ctgctgggcagaggctgcatga

SEQ ID NO: 8343107 - DNA, 22 bp, Homo sapiens
ctgctgggctcctcatgtgact

SEQ ID NO: 8343108 - DNA, 22 bp, Homo sapiens
ctgctggggaggcgcctcgacg

SEQ ID NO: 8343109 - DNA, 22 bp, Homo sapiens
atacacaggcatgcttctgatt

SEQ ID NO: 8343110 - DNA, 22 bp, Homo sapiens
atacacaggtgctaggtcaata

SEQ ID NO: 8343111 - DNA, 22 bp, Homo sapiens
atacacaggtgctaggtcaata

SEQ ID NO: 8343112 - DNA, 21 bp, Homo sapiens
atacacatacacataaatgtg

SEQ ID NO: 8343113 - DNA, 22 bp, Homo sapiens
atacacatatcaggtgtataca

SEQ ID NO: 8343114 - DNA, 22 bp, Homo sapiens
atacacatatgtgtgtatatgt

SEQ ID NO: 8343115 - DNA, 22 bp, Homo sapiens
ctgctgggggacacaggtccgg

SEQ ID NO: 8343116 - DNA, 22 bp, Homo sapiens
ctgctgggggacacaggtccgg

SEQ ID NO: 8343117 - DNA, 19 bp, Homo sapiens
atatacatactgtgtgcat

SEQ ID NO: 8343118 - DNA, 22 bp, Homo sapiens
atatacagttttacagggtttc

SEQ ID NO: 8343119 - DNA, 22 bp, Homo sapiens
atatacatgggaatatgtggag

SEQ ID NO: 8343120 - DNA, 22 bp, Homo sapiens
atatacttggagactatcattg

SEQ ID NO: 8343121 - DNA, 22 bp, Homo sapiens
ctgggagctggatgccctgccc

SEQ ID NO: 8343122 - DNA, 22 bp, Homo sapiens
ctgggagctggatgccctgccc

SEQ ID NO: 8343123 - DNA, 22 bp, Homo sapiens
ctgggagctggatgccctgccc

SEQ ID NO: 8343124 - DNA, 22 bp, Homo sapiens
ctgggagcttgttaggaatgca

SEQ ID NO: 8343125 - DNA, 22 bp, Homo sapiens
ctgggagctggaatgggagaag

SEQ ID NO: 8343126 - DNA, 22 bp, Homo sapiens
ctggctgaggcagagcctgggg

SEQ ID NO: 8343127 - DNA, 22 bp, Homo sapiens
atatacagtatgtactgtggtt

SEQ ID NO: 8343128 - DNA, 22 bp, Homo sapiens
atatacaggtggtatgtgtaaa

SEQ ID NO: 8343129 - DNA, 22 bp, Homo sapiens
atatacactccactgatacagg

SEQ ID NO: 8343130 - DNA, 22 bp, Homo sapiens
ctggctcaataaatattagctg

SEQ ID NO: 8343131 - DNA, 22 bp, Homo sapiens
ctggctcaatttgtactgctgt

SEQ ID NO: 8343132 - DNA, 22 bp, Homo sapiens
ctggctaattgtcagttgttac

SEQ ID NO: 8343133 - DNA, 22 bp, Homo sapiens
ctggctcacaggtgagatgcat

SEQ ID NO: 8343134 - DNA, 22 bp, Homo sapiens
atagtgcattttattatcagca

SEQ ID NO: 8343135 - DNA, 22 bp, Homo sapiens
ctggctcacaggtgagatgcat

SEQ ID NO: 8343136 - DNA, 22 bp, Homo sapiens
atagtgcagccccttttctatt

SEQ ID NO: 8343137 - DNA, 22 bp, Homo sapiens
atagtggtgagctgcatttatg

SEQ ID NO: 8343138 - DNA, 22 bp, Homo sapiens
atagtttgaaggctgttctact

SEQ ID NO: 8343139 - DNA, 22 bp, Homo sapiens
atataaagagcttagtatagtg

SEQ ID NO: 8343140 - DNA, 22 bp, Homo sapiens
atataaagtgtttagaaagctg

SEQ ID NO: 8343141 - DNA, 22 bp, Homo sapiens
atacatgtcatcatatgtttgt

SEQ ID NO: 8343142 - DNA, 22 bp, Homo sapiens
atacatgtgccatgttggtgta

SEQ ID NO: 8343143 - DNA, 22 bp, Homo sapiens
atacatgtgccgcgttggtgtg

SEQ ID NO: 8343144 - DNA, 22 bp, Homo sapiens
atacatgtgctatgttggtgta

SEQ ID NO: 8343145 - DNA, 22 bp, Homo sapiens
atacatgcgccatgttggtgtg

SEQ ID NO: 8343146 - DNA, 22 bp, Homo sapiens
atacatgattttttgagggtgg

SEQ ID NO: 8343147 - DNA, 22 bp, Homo sapiens
ctggagtggccggtgctgtggc

SEQ ID NO: 8343148 - DNA, 22 bp, Homo sapiens
ctggagtgcagtggcatgatca

SEQ ID NO: 8343149 - DNA, 22 bp, Homo sapiens
ctggcaggtggatggggactcc

SEQ ID NO: 8343150 - DNA, 22 bp, Homo sapiens
ctggcaggttatagagctgccc

SEQ ID NO: 8343151 - DNA, 22 bp, Homo sapiens
ctggcaggtctcgctgacgtgt

SEQ ID NO: 8343152 - DNA, 22 bp, Homo sapiens
ctggcaggtttggtgtctggtg

SEQ ID NO: 8343153 - DNA, 22 bp, Homo sapiens
ctggcagtattaagagaagtga

SEQ ID NO: 8343154 - DNA, 22 bp, Homo sapiens
ctggcaggttatagagctgccc

SEQ ID NO: 8343155 - DNA, 22 bp, Homo sapiens
ctggcctcagagggtcatggtg

SEQ ID NO: 8343156 - DNA, 22 bp, Homo sapiens
ctggccctatgagcctcctgat

SEQ ID NO: 8343157 - DNA, 22 bp, Homo sapiens
ctggccctatgagcctcctgat

SEQ ID NO: 8343158 - DNA, 20 bp, Homo sapiens
ctggccagaacgcctacaca

SEQ ID NO: 8343159 - DNA, 20 bp, Homo sapiens
ctggccagaacgcctacaca

SEQ ID NO: 8343160 - DNA, 22 bp, Homo sapiens
aggaagagggtggcagataatc

SEQ ID NO: 8343161 - DNA, 22 bp, Homo sapiens
aggaagaggtagctgtcaaggg

SEQ ID NO: 8343162 - DNA, 22 bp, Homo sapiens
cagggtttcaccatgttagcag

SEQ ID NO: 8343163 - DNA, 22 bp, Homo sapiens
aggaagaggtgtgcaatggtgt

SEQ ID NO: 8343164 - DNA, 22 bp, Homo sapiens
aggaagcactggaaggggttgg

SEQ ID NO: 8343165 - DNA, 22 bp, Homo sapiens
aggaagcaccggaatgatgact

SEQ ID NO: 8343166 - DNA, 22 bp, Homo sapiens
aggaagagtgttacctatgggt

SEQ ID NO: 8343167 - DNA, 22 bp, Homo sapiens
cagggtgctgcaccatccctca

SEQ ID NO: 8343168 - DNA, 22 bp, Homo sapiens
cagggtggtaccagcatctagt

SEQ ID NO: 8343169 - DNA, 22 bp, Homo sapiens
cagggtggggctggctatcaaa

SEQ ID NO: 8343170 - DNA, 22 bp, Homo sapiens
cagggtggtgaatagctatagt

SEQ ID NO: 8343171 - DNA, 22 bp, Homo sapiens
cagggtggtgaatagctatagt

SEQ ID NO: 8343172 - DNA, 22 bp, Homo sapiens
cagggtggtaccagcatctagt

SEQ ID NO: 8343173 - DNA, 22 bp, Homo sapiens
aggaaacatccttatctattct

SEQ ID NO: 8343174 - DNA, 22 bp, Homo sapiens
aggaaacagtgaacttggcagg

SEQ ID NO: 8343175 - DNA, 22 bp, Homo sapiens
aggaaacatgaatctgccttga

SEQ ID NO: 8343176 - DNA, 22 bp, Homo sapiens
aggaagtgaaagggaaggagtt

SEQ ID NO: 8343177 - DNA, 22 bp, Homo sapiens
caggtcctggcagctgactcag

SEQ ID NO: 8343178 - DNA, 22 bp, Homo sapiens
caggtcccgttccccagagatt

SEQ ID NO: 8343179 - DNA, 22 bp, Homo sapiens
caggtcctcgggggaggccggc

SEQ ID NO: 8343180 - DNA, 22 bp, Homo sapiens
aggaaaaataaggcagcagggc

SEQ ID NO: 8343181 - DNA, 20 bp, Homo sapiens
aggaaaaatggaaactggag

SEQ ID NO: 8343182 - DNA, 20 bp, Homo sapiens
aggaaaagggtggtggtaga

SEQ ID NO: 8343183 - DNA, 22 bp, Homo sapiens
aggaaaacagaccaaggagctc

SEQ ID NO: 8343184 - DNA, 22 bp, Homo sapiens
aggaaaagtgtgaagtatggag

SEQ ID NO: 8343185 - DNA, 22 bp, Homo sapiens
aggaaaatgatattctgctgtt

SEQ ID NO: 8343186 - DNA, 22 bp, Homo sapiens
aggaaaatgaaacagcaactgt

SEQ ID NO: 8343187 - DNA, 22 bp, Homo sapiens
aggaaaatcgagtctggaggca

SEQ ID NO: 8343188 - DNA, 22 bp, Homo sapiens
aggaaaatggaccagagttgtt

SEQ ID NO: 8343189 - DNA, 22 bp, Homo sapiens
aggaaaattatcatgagagcca

SEQ ID NO: 8343190 - DNA, 22 bp, Homo sapiens
aggaaaattatcatgagagcca

SEQ ID NO: 8343191 - DNA, 22 bp, Homo sapiens
cagggacattggtggccaggtt

SEQ ID NO: 8343192 - DNA, 22 bp, Homo sapiens
cagggactgagatccagactgt

SEQ ID NO: 8343193 - DNA, 22 bp, Homo sapiens
cagggaccctactagctcacac

SEQ ID NO: 8343194 - DNA, 22 bp, Homo sapiens
agctttcactgatatgctttga

SEQ ID NO: 8343195 - DNA, 22 bp, Homo sapiens
caggctggagttacctttaggg

SEQ ID NO: 8343196 - DNA, 22 bp, Homo sapiens
agctggtgctcggggagctggc

SEQ ID NO: 8343197 - DNA, 22 bp, Homo sapiens
caggctgtgaaactgagatgcg

SEQ ID NO: 8343198 - DNA, 22 bp, Homo sapiens
agctggaggagtttctcctagc

SEQ ID NO: 8343199 - DNA, 22 bp, Homo sapiens
agctgggcagactgcagtggtt

SEQ ID NO: 8343200 - DNA, 22 bp, Homo sapiens
caggcagaggaagtctgggtct

SEQ ID NO: 8343201 - DNA, 22 bp, Homo sapiens
agctggagaatgtggatgatcc

SEQ ID NO: 8343202 - DNA, 22 bp, Homo sapiens
agctggagagtttccaggaagg

SEQ ID NO: 8343203 - DNA, 22 bp, Homo sapiens
agctggagatgagtgacgtgcc

SEQ ID NO: 8343204 - DNA, 22 bp, Homo sapiens
agctggagaaacctgggagggt

SEQ ID NO: 8343205 - DNA, 22 bp, Homo sapiens
agctggagaataggaattagtg

SEQ ID NO: 8343206 - DNA, 19 bp, Homo sapiens
agctggagattggagggca

SEQ ID NO: 8343207 - DNA, 22 bp, Homo sapiens
agctggagattctggggacagt

SEQ ID NO: 8343208 - DNA, 22 bp, Homo sapiens
agctggagcttcaagcaggtaa

SEQ ID NO: 8343209 - DNA, 22 bp, Homo sapiens
agctggagcttcaagcaggtaa

SEQ ID NO: 8343210 - DNA, 22 bp, Homo sapiens
agctggagccagtgtgaggctt

SEQ ID NO: 8343211 - DNA, 22 bp, Homo sapiens
agctggagccagtgtgaggctt

SEQ ID NO: 8343212 - DNA, 22 bp, Homo sapiens
caggcagagtgaggtggtctaa

SEQ ID NO: 8343213 - DNA, 22 bp, Homo sapiens
caggcagagtgagaagcccttg

SEQ ID NO: 8343214 - DNA, 22 bp, Homo sapiens
caggcagaggaggccttctcct

SEQ ID NO: 8343215 - DNA, 20 bp, Homo sapiens
caggcagaggatgctgacca

SEQ ID NO: 8343216 - DNA, 22 bp, Homo sapiens
agctggtccttccctgccctgt

SEQ ID NO: 8343217 - DNA, 22 bp, Homo sapiens
agctcttttgctctccaagttt

SEQ ID NO: 8343218 - DNA, 17 bp, Homo sapiens
caggaaaatatgagtga

SEQ ID NO: 8343219 - DNA, 22 bp, Homo sapiens
caggaacccccactctcagctc

SEQ ID NO: 8343220 - DNA, 22 bp, Homo sapiens
caggaacctaaagagacattac

SEQ ID NO: 8343221 - DNA, 22 bp, Homo sapiens
caggaacctacatctgtttggg

SEQ ID NO: 8343222 - DNA, 18 bp, Homo sapiens
caggaacctctccttttt

SEQ ID NO: 8343223 - DNA, 22 bp, Homo sapiens
caggaacctaatgaaggctcac

SEQ ID NO: 8343224 - DNA, 22 bp, Homo sapiens
caggaaccaggagagtccctga

SEQ ID NO: 8343225 - DNA, 22 bp, Homo sapiens
caggaacccaatgggccaggcc

SEQ ID NO: 8343226 - DNA, 20 bp, Homo sapiens
caggaaccaaagaggactcc

SEQ ID NO: 8343227 - DNA, 22 bp, Homo sapiens
caggaaccagaaccttcccccg

SEQ ID NO: 8343228 - DNA, 22 bp, Homo sapiens
caggaaccattttctctttata

SEQ ID NO: 8343229 - DNA, 22 bp, Homo sapiens
caggaaccatgaagacatatac

SEQ ID NO: 8343230 - DNA, 23 bp, Homo sapiens
caggaaatgaatccaggaggatg

SEQ ID NO: 8343231 - DNA, 22 bp, Homo sapiens
caggaaatgctatcatagctga

SEQ ID NO: 8343232 - DNA, 22 bp, Homo sapiens
caggaaatgaacaggaatgaac

SEQ ID NO: 8343233 - DNA, 22 bp, Homo sapiens
caggaaccttgtctgtgttgtt

SEQ ID NO: 8343234 - DNA, 22 bp, Homo sapiens
caggaacctgtgcgtagggatg

SEQ ID NO: 8343235 - DNA, 22 bp, Homo sapiens
caggaacctgctccaagaggca

SEQ ID NO: 8343236 - DNA, 16 bp, Homo sapiens
caggaacctgtctggc

SEQ ID NO: 8343237 - DNA, 22 bp, Homo sapiens
caggaagaccagggctgtggct

SEQ ID NO: 8343238 - DNA, 22 bp, Homo sapiens
agctgcctccctgtgcttgtcc

SEQ ID NO: 8343239 - DNA, 22 bp, Homo sapiens
agctgctgggagaagtgagcca

SEQ ID NO: 8343240 - DNA, 22 bp, Homo sapiens
agctgccctcgctggggccaga

SEQ ID NO: 8343241 - DNA, 20 bp, Homo sapiens
agctgcccctgggcactgcc

SEQ ID NO: 8343242 - DNA, 22 bp, Homo sapiens
agctgccctggcggagctgctc

SEQ ID NO: 8343243 - DNA, 22 bp, Homo sapiens
agctgccagatgacagtgctat

SEQ ID NO: 8343244 - DNA, 22 bp, Homo sapiens
agctgcccccagggctgtgctt

SEQ ID NO: 8343245 - DNA, 22 bp, Homo sapiens
agctgcccttctcttgcccttg

SEQ ID NO: 8343246 - DNA, 22 bp, Homo sapiens
agctgccgatgcccagctgcat

SEQ ID NO: 8343247 - DNA, 18 bp, Homo sapiens
cagtgaggatgaagggtt

SEQ ID NO: 8343248 - DNA, 22 bp, Homo sapiens
cagtctcttttcagctccatcc

SEQ ID NO: 8343249 - DNA, 22 bp, Homo sapiens
cagtgagggcccccttccaggt

SEQ ID NO: 8343250 - DNA, 22 bp, Homo sapiens
cagtgagggaagatctcagcac

SEQ ID NO: 8343251 - DNA, 22 bp, Homo sapiens
cagtgcaggcttgtggccgcag

SEQ ID NO: 8343252 - DNA, 22 bp, Homo sapiens
cagtgcagccaaggacaggcac

SEQ ID NO: 8343253 - DNA, 22 bp, Homo sapiens
aggagcagcccactcctgtcct

SEQ ID NO: 8343254 - DNA, 22 bp, Homo sapiens
aggagctgatagtctatggaga

SEQ ID NO: 8343255 - DNA, 22 bp, Homo sapiens
aggagctgatagtctatggaga

SEQ ID NO: 8343256 - DNA, 22 bp, Homo sapiens
aggagctggccactaggatgca

SEQ ID NO: 8343257 - DNA, 22 bp, Homo sapiens
aggagctgggagaaggactaaa

SEQ ID NO: 8343258 - DNA, 22 bp, Homo sapiens
aggagctgggctgctgctggga

SEQ ID NO: 8343259 - DNA, 22 bp, Homo sapiens
aggagctgggctgctgctggga

SEQ ID NO: 8343260 - DNA, 22 bp, Homo sapiens
cagttcagctgtcagcctccca

SEQ ID NO: 8343261 - DNA, 22 bp, Homo sapiens
cagttataggagccattgtata

SEQ ID NO: 8343262 - DNA, 22 bp, Homo sapiens
cagttccttgagaatggttgct

SEQ ID NO: 8343263 - DNA, 19 bp, Homo sapiens
catatttttgggctggcat

SEQ ID NO: 8343264 - DNA, 22 bp, Homo sapiens
catattttagttgctgaacagc

SEQ ID NO: 8343265 - DNA, 22 bp, Homo sapiens
catcagaaaccttgaggaaact

SEQ ID NO: 8343266 - DNA, 22 bp, Homo sapiens
catcactgtcctcagcattcca

SEQ ID NO: 8343267 - DNA, 22 bp, Homo sapiens
catcactgtccaaagttcagtt

SEQ ID NO: 8343268 - DNA, 22 bp, Homo sapiens
catcactgtccaaagttcagtt

SEQ ID NO: 8343269 - DNA, 22 bp, Homo sapiens
catcactgacgctgagattcca

SEQ ID NO: 8343270 - DNA, 22 bp, Homo sapiens
aggaggctgggcacagtggcct

SEQ ID NO: 8343271 - DNA, 22 bp, Homo sapiens
aggaggctgggcacagtggcct

SEQ ID NO: 8343272 - DNA, 22 bp, Homo sapiens
aggaggctgcaaccctgaggcc

SEQ ID NO: 8343273 - DNA, 22 bp, Homo sapiens
aggaggctgcaaccctgaggcc

SEQ ID NO: 8343274 - DNA, 22 bp, Homo sapiens
aggagggtggcctcatgtgagt

SEQ ID NO: 8343275 - DNA, 22 bp, Homo sapiens
aggaggctggttcaggccatat

SEQ ID NO: 8343276 - DNA, 22 bp, Homo sapiens
aggaggctggttcaggccatat

SEQ ID NO: 8343277 - DNA, 22 bp, Homo sapiens
aggaggggcaatgatagtctgg

SEQ ID NO: 8343278 - DNA, 22 bp, Homo sapiens
aggagggtttcaatgggatgag

SEQ ID NO: 8343279 - DNA, 22 bp, Homo sapiens
aggagggttctctggacagagg

SEQ ID NO: 8343280 - DNA, 22 bp, Homo sapiens
catcattaccatcattagtagt

SEQ ID NO: 8343281 - DNA, 22 bp, Homo sapiens
aggagtgtggccagggctctgg

SEQ ID NO: 8343282 - DNA, 22 bp, Homo sapiens
aggagtggtgcaggacctgcca

SEQ ID NO: 8343283 - DNA, 22 bp, Homo sapiens
aggatctgtgcctcaacccaga

SEQ ID NO: 8343284 - DNA, 22 bp, Homo sapiens
aggatctgttgaataaatttga

SEQ ID NO: 8343285 - DNA, 22 bp, Homo sapiens
aggatcctgtatggagaagctg

SEQ ID NO: 8343286 - DNA, 22 bp, Homo sapiens
aggatcctttggccacttctta

SEQ ID NO: 8343287 - DNA, 22 bp, Homo sapiens
aggatcctttttctgctgtttg

SEQ ID NO: 8343288 - DNA, 23 bp, Homo sapiens
aggatcctggtacaggagcagag

SEQ ID NO: 8343289 - DNA, 22 bp, Homo sapiens
aggatcctgcgctttgggggag

SEQ ID NO: 8343290 - DNA, 22 bp, Homo sapiens
aggatcctccttagaaaagacc

SEQ ID NO: 8343291 - DNA, 22 bp, Homo sapiens
aggatacaagtctcagaatgct

SEQ ID NO: 8343292 - DNA, 22 bp, Homo sapiens
aggcacaggtggacttcacagt

SEQ ID NO: 8343293 - DNA, 22 bp, Homo sapiens
aggatgaatatttagtgggata

SEQ ID NO: 8343294 - DNA, 22 bp, Homo sapiens
aggatgaataactgaaatggtg

SEQ ID NO: 8343295 - DNA, 22 bp, Homo sapiens
aggcacagtggctcacacctgt

SEQ ID NO: 8343296 - DNA, 22 bp, Homo sapiens
aggcacagtgcctggaatcaaa

SEQ ID NO: 8343297 - DNA, 22 bp, Homo sapiens
aggcacagtttcatccccgggc

SEQ ID NO: 8343298 - DNA, 22 bp, Homo sapiens
aggcactgaagaactctttttg

SEQ ID NO: 8343299 - DNA, 22 bp, Homo sapiens
aggcactgaatatccagtaaaa

SEQ ID NO: 8343300 - DNA, 23 bp, Homo sapiens
aggcactgaatgtgtcagtgagt

SEQ ID NO: 8343301 - DNA, 22 bp, Homo sapiens
aggcactgaagtggtaaatgta

SEQ ID NO: 8343302 - DNA, 22 bp, Homo sapiens
aggcactgaaggaagcttgcgc

SEQ ID NO: 8343303 - DNA, 22 bp, Homo sapiens
aggcactgacagattctgtgtc

SEQ ID NO: 8343304 - DNA, 22 bp, Homo sapiens
aggcactgacaattctggactg

SEQ ID NO: 8343305 - DNA, 22 bp, Homo sapiens
aggcactgactcaagggagcca

SEQ ID NO: 8343306 - DNA, 22 bp, Homo sapiens
aggcactgacctgcttccttga

SEQ ID NO: 8343307 - DNA, 22 bp, Homo sapiens
aggcactgagaggctgtgttgc

SEQ ID NO: 8343308 - DNA, 22 bp, Homo sapiens
aggcactgattctcagagttac

SEQ ID NO: 8343309 - DNA, 22 bp, Homo sapiens
aggcagagagcagtggccgtct

SEQ ID NO: 8343310 - DNA, 22 bp, Homo sapiens
aggcactgattctgttttccat

SEQ ID NO: 8343311 - DNA, 22 bp, Homo sapiens
ccaaactgggccagtcagctgt

SEQ ID NO: 8343312 - DNA, 22 bp, Homo sapiens
ccaaactgtgtcgtctgcatag

SEQ ID NO: 8343313 - DNA, 22 bp, Homo sapiens
ccaaactgtttcgtatttatgc

SEQ ID NO: 8343314 - DNA, 21 bp, Homo sapiens
aggcaggattcaaacacagag

SEQ ID NO: 8343315 - DNA, 22 bp, Homo sapiens
aggcaggcccctgagaatagac

SEQ ID NO: 8343316 - DNA, 22 bp, Homo sapiens
aggcaggctagtcgcttgagcc

SEQ ID NO: 8343317 - DNA, 22 bp, Homo sapiens
aggcaggctcaatgcccagtct

SEQ ID NO: 8343318 - DNA, 22 bp, Homo sapiens
aggcaggccctctggaaaggta

SEQ ID NO: 8343319 - DNA, 23 bp, Homo sapiens
aggcagagccaaggtcaaaaccc

SEQ ID NO: 8343320 - DNA, 22 bp, Homo sapiens
aggcagcgtagcaaggctagta

SEQ ID NO: 8343321 - DNA, 23 bp, Homo sapiens
aggcagctgggtagcatctttct

SEQ ID NO: 8343322 - DNA, 22 bp, Homo sapiens
agggcgcatctctggggtgaat

SEQ ID NO: 8343323 - DNA, 22 bp, Homo sapiens
agggcgaggagacggaggcaca

SEQ ID NO: 8343324 - DNA, 19 bp, Homo sapiens
agggcggggcccaggcaca

SEQ ID NO: 8343325 - DNA, 22 bp, Homo sapiens
agggcgctgtctggccagcggt

SEQ ID NO: 8343326 - DNA, 19 bp, Homo sapiens
agggcggggcccaggcaca

SEQ ID NO: 8343327 - DNA, 22 bp, Homo sapiens
agggcgggctcatcacatgctc

SEQ ID NO: 8343328 - DNA, 22 bp, Homo sapiens
cctcaggcaggaaactgtcccg

SEQ ID NO: 8343329 - DNA, 22 bp, Homo sapiens
cctcaggccctgtccctgcgcc

SEQ ID NO: 8343330 - DNA, 22 bp, Homo sapiens
cctcaggcaggaaactgtcccg

SEQ ID NO: 8343331 - DNA, 22 bp, Homo sapiens
agggctggagccacagctggga

SEQ ID NO: 8343332 - DNA, 22 bp, Homo sapiens
agggctggagccacagctggga

SEQ ID NO: 8343333 - DNA, 22 bp, Homo sapiens
agggctggagccacagctggga

SEQ ID NO: 8343334 - DNA, 22 bp, Homo sapiens
agggctgcttacctggaatggc

SEQ ID NO: 8343335 - DNA, 22 bp, Homo sapiens
agggctgctttgctaaatatgg

SEQ ID NO: 8343336 - DNA, 22 bp, Homo sapiens
agggctgcatctgcctggtgaa

SEQ ID NO: 8343337 - DNA, 22 bp, Homo sapiens
agggctgctgaggaagccttgc

SEQ ID NO: 8343338 - DNA, 22 bp, Homo sapiens
agggctgctgctccgggcccag

SEQ ID NO: 8343339 - DNA, 22 bp, Homo sapiens
agggcgtggtggtgctggagca

SEQ ID NO: 8343340 - DNA, 22 bp, Homo sapiens
agggctgcagtcctaaggtgct

SEQ ID NO: 8343341 - DNA, 18 bp, Homo sapiens
agggcctccatcccctcc

SEQ ID NO: 8343342 - DNA, 18 bp, Homo sapiens
agggcctccatcccctcc

SEQ ID NO: 8343343 - DNA, 23 bp, Homo sapiens
ccctggaacttcactcatgcaca

SEQ ID NO: 8343344 - DNA, 22 bp, Homo sapiens
ccctggaactcctaggcaagca

SEQ ID NO: 8343345 - DNA, 22 bp, Homo sapiens
ccctggaacccatggccagtgt

SEQ ID NO: 8343346 - DNA, 22 bp, Homo sapiens
ccctggaaatgaggcatgtgcg

SEQ ID NO: 8343347 - DNA, 22 bp, Homo sapiens
agggcctgaggctgacggggag

SEQ ID NO: 8343348 - DNA, 23 bp, Homo sapiens
agggcctgatggctcccgctggc

SEQ ID NO: 8343349 - DNA, 23 bp, Homo sapiens
agggcctgatggctcccgctggc

SEQ ID NO: 8343350 - DNA, 22 bp, Homo sapiens
agggcctggcgcgtggccgccg

SEQ ID NO: 8343351 - DNA, 22 bp, Homo sapiens
agggcctggcgcgtggccgccg

SEQ ID NO: 8343352 - DNA, 22 bp, Homo sapiens
agggtagggccgtagggccatg

SEQ ID NO: 8343353 - DNA, 22 bp, Homo sapiens
cctgagaggccctctcactgtc

SEQ ID NO: 8343354 - DNA, 22 bp, Homo sapiens
cctgagagccctagccaggcgc

SEQ ID NO: 8343355 - DNA, 22 bp, Homo sapiens
aggggatggagctggaaggcag

SEQ ID NO: 8343356 - DNA, 22 bp, Homo sapiens
aggggatggagctggaaggcag

SEQ ID NO: 8343357 - DNA, 20 bp, Homo sapiens
aggggcacctgcgacggggc

SEQ ID NO: 8343358 - DNA, 23 bp, Homo sapiens
aggggcagcaagttttggtgtta

SEQ ID NO: 8343359 - DNA, 22 bp, Homo sapiens
aggggcagcctcacaatcctct

SEQ ID NO: 8343360 - DNA, 22 bp, Homo sapiens
aggggagagttaatgtgaatgt

SEQ ID NO: 8343361 - DNA, 22 bp, Homo sapiens
agggctggctccgttaccttga

SEQ ID NO: 8343362 - DNA, 22 bp, Homo sapiens
agggctggccacatgatttggt

SEQ ID NO: 8343363 - DNA, 22 bp, Homo sapiens
aggggaggagcttttcttgcct

SEQ ID NO: 8343364 - DNA, 22 bp, Homo sapiens
aggggaggcagcgataaacctg

SEQ ID NO: 8343365 - DNA, 22 bp, Homo sapiens
aggggaggcagcgataaacctg

SEQ ID NO: 8343366 - DNA, 22 bp, Homo sapiens
aggggaggtgtccccaaatctc

SEQ ID NO: 8343367 - DNA, 22 bp, Homo sapiens
aggggaggtgtccccaaatctc

SEQ ID NO: 8343368 - DNA, 22 bp, Homo sapiens
aggggatgatcctcccgcagcg

SEQ ID NO: 8343369 - DNA, 22 bp, Homo sapiens
aggggatgcctagtggagtctc

SEQ ID NO: 8343370 - DNA, 22 bp, Homo sapiens
ccccagagagcaccatgaagcc

SEQ ID NO: 8343371 - DNA, 22 bp, Homo sapiens
ccccagaaagcctggcactagg

SEQ ID NO: 8343372 - DNA, 22 bp, Homo sapiens
ccccagaaggggacagagggta

SEQ ID NO: 8343373 - DNA, 22 bp, Homo sapiens
ccccagaagtttgcacaagaga

SEQ ID NO: 8343374 - DNA, 22 bp, Homo sapiens
cccatgccttctgactcacagg

SEQ ID NO: 8343375 - DNA, 22 bp, Homo sapiens
cccatgccttctgactcacagg

SEQ ID NO: 8343376 - DNA, 22 bp, Homo sapiens
cccatgcatccctctcctgggc

SEQ ID NO: 8343377 - DNA, 22 bp, Homo sapiens
cccatgcaccctctaagaagga

SEQ ID NO: 8343378 - DNA, 22 bp, Homo sapiens
cccatgagtgctgctcagaggc

SEQ ID NO: 8343379 - DNA, 22 bp, Homo sapiens
cccatgactctcattcacagtc

SEQ ID NO: 8343380 - DNA, 17 bp, Homo sapiens
ccctcactcctgccggg

SEQ ID NO: 8343381 - DNA, 22 bp, Homo sapiens
ccctcactgtccttgggccctt

SEQ ID NO: 8343382 - DNA, 22 bp, Homo sapiens
ccctcacttcacgctctgcaga

SEQ ID NO: 8343383 - DNA, 21 bp, Homo sapiens
ccccagcaccttgccagcctg

SEQ ID NO: 8343384 - DNA, 22 bp, Homo sapiens
ccccttccacagtgcttcctaa

SEQ ID NO: 8343385 - DNA, 22 bp, Homo sapiens
ccccagcacttggagtggggag

SEQ ID NO: 8343386 - DNA, 22 bp, Homo sapiens
ccctgccctgggcagaagtggg

SEQ ID NO: 8343387 - DNA, 22 bp, Homo sapiens
ccctgcccaccacatgctggga

SEQ ID NO: 8343388 - DNA, 22 bp, Homo sapiens
ccctgcccatcggggcggcctg

SEQ ID NO: 8343389 - DNA, 22 bp, Homo sapiens
ccctgcccatcggggcggcctg

SEQ ID NO: 8343390 - DNA, 22 bp, Homo sapiens
ccctgcccaccacatgctggga

SEQ ID NO: 8343391 - DNA, 22 bp, Homo sapiens
ccctgccagggtcctgacagac

SEQ ID NO: 8343392 - DNA, 18 bp, Homo sapiens
ccctgccagctcccagca

SEQ ID NO: 8343393 - DNA, 22 bp, Homo sapiens
ccctgccagggtcctgacagac

SEQ ID NO: 8343394 - DNA, 21 bp, Homo sapiens
ccctgccctcaaggacagtgc

SEQ ID NO: 8343395 - DNA, 22 bp, Homo sapiens
ccctgccctggagacacttaaa

SEQ ID NO: 8343396 - DNA, 23 bp, Homo sapiens
ccctgcccattgagcaggacgtc

SEQ ID NO: 8343397 - DNA, 22 bp, Homo sapiens
ccctgccccaggcggcttcact

SEQ ID NO: 8343398 - DNA, 23 bp, Homo sapiens
ccctgcccattgagcaggacgtc

SEQ ID NO: 8343399 - DNA, 20 bp, Homo sapiens
ccctcccagatgcttcccaa

SEQ ID NO: 8343400 - DNA, 20 bp, Homo sapiens
ccctcccagatgcttcccaa

SEQ ID NO: 8343401 - DNA, 18 bp, Homo sapiens
ccctgccagctcccagca

SEQ ID NO: 8343402 - DNA, 22 bp, Homo sapiens
ccctgccaatcccgtctctctg

SEQ ID NO: 8343403 - DNA, 22 bp, Homo sapiens
ccctcccaggagtggccagaga

SEQ ID NO: 8343404 - DNA, 22 bp, Homo sapiens
cccaggaggtggagcttgcagt

SEQ ID NO: 8343405 - DNA, 22 bp, Homo sapiens
cccaggaggtcaaggctgcagt

SEQ ID NO: 8343406 - DNA, 22 bp, Homo sapiens
cccaggctgtgcaaacttcaaa

SEQ ID NO: 8343407 - DNA, 22 bp, Homo sapiens
cccagtttcaactttccagtgg

SEQ ID NO: 8343408 - DNA, 22 bp, Homo sapiens
cccatcaggaacccaggagccc

SEQ ID NO: 8343409 - DNA, 22 bp, Homo sapiens
aggctggtgtgtcctgaagcct

SEQ ID NO: 8343410 - DNA, 22 bp, Homo sapiens
aggctggtgtctctgtcctgtc

SEQ ID NO: 8343411 - DNA, 22 bp, Homo sapiens
aggctggtctatacggagacga

SEQ ID NO: 8343412 - DNA, 22 bp, Homo sapiens
aggctggtgattagaagcagcc

SEQ ID NO: 8343413 - DNA, 22 bp, Homo sapiens
aggctggtcccagggagggaat

SEQ ID NO: 8343414 - DNA, 22 bp, Homo sapiens
aggctgggtacctgtcatatgc

SEQ ID NO: 8343415 - DNA, 22 bp, Homo sapiens
cccaggagcttctctctgcctc

SEQ ID NO: 8343416 - DNA, 22 bp, Homo sapiens
cccaggagcttctctctgcctc

SEQ ID NO: 8343417 - DNA, 22 bp, Homo sapiens
cccaggaggtagaggttgcagt

SEQ ID NO: 8343418 - DNA, 22 bp, Homo sapiens
cccaggagatggaggttgcagt

SEQ ID NO: 8343419 - DNA, 23 bp, Homo sapiens
cccaggagcctgagtcctctctg

SEQ ID NO: 8343420 - DNA, 22 bp, Homo sapiens
ccagggcctgagggcgacgccc

SEQ ID NO: 8343421 - DNA, 22 bp, Homo sapiens
ccagggcctgccacttagcaag

SEQ ID NO: 8343422 - DNA, 20 bp, Homo sapiens
ccagggctggctcctgggat

SEQ ID NO: 8343423 - DNA, 22 bp, Homo sapiens
ccagggctggtggctgcagagg

SEQ ID NO: 8343424 - DNA, 22 bp, Homo sapiens
ccagggctggtgggagatgctg

SEQ ID NO: 8343425 - DNA, 22 bp, Homo sapiens
aggctagaggcttctggcttca

SEQ ID NO: 8343426 - DNA, 22 bp, Homo sapiens
ccaggctgctgttggtgtccgc

SEQ ID NO: 8343427 - DNA, 22 bp, Homo sapiens
aggcgtggttgaggcgagcata

SEQ ID NO: 8343428 - DNA, 22 bp, Homo sapiens
aggcgtggttgaggcgagcata

SEQ ID NO: 8343429 - DNA, 22 bp, Homo sapiens
aggcgtgggaggatctgaggcc

SEQ ID NO: 8343430 - DNA, 22 bp, Homo sapiens
aggctggcggtgactgctctga

SEQ ID NO: 8343431 - DNA, 22 bp, Homo sapiens
aggctggcgtcaggggctgtac

SEQ ID NO: 8343432 - DNA, 22 bp, Homo sapiens
aggctggcgacatctggcgggc

SEQ ID NO: 8343433 - DNA, 17 bp, Homo sapiens
aggctggccttcacagt

SEQ ID NO: 8343434 - DNA, 22 bp, Homo sapiens
aggctggccctactggctgcct

SEQ ID NO: 8343435 - DNA, 22 bp, Homo sapiens
aggctggcctatttctttatcg

SEQ ID NO: 8343436 - DNA, 22 bp, Homo sapiens
aggctggccctactggctgcct

SEQ ID NO: 8343437 - DNA, 22 bp, Homo sapiens
aggctggctggggatgcgtctt

SEQ ID NO: 8343438 - DNA, 22 bp, Homo sapiens
ccatttgttcgcccagctccaa

SEQ ID NO: 8343439 - DNA, 22 bp, Homo sapiens
ccatttgtcacctctgcactcc

SEQ ID NO: 8343440 - DNA, 22 bp, Homo sapiens
aggctgggctccgcccaactcc

SEQ ID NO: 8343441 - DNA, 22 bp, Homo sapiens
aggctgggtacctgtcatatgc

SEQ ID NO: 8343442 - DNA, 22 bp, Homo sapiens
ccaggtcttgtttgacatcaat

SEQ ID NO: 8343443 - DNA, 22 bp, Homo sapiens
ccaggtgactgtcagaggtttt

SEQ ID NO: 8343444 - DNA, 22 bp, Homo sapiens
ccaggtcttggcccccggacct

SEQ ID NO: 8343445 - DNA, 22 bp, Homo sapiens
ccaggtctgtcttcttagctca

SEQ ID NO: 8343446 - DNA, 22 bp, Homo sapiens
aggctggacccgacacctgccc

SEQ ID NO: 8343447 - DNA, 22 bp, Homo sapiens
aggctggaaagggaccagagtg

SEQ ID NO: 8343448 - DNA, 22 bp, Homo sapiens
aggctggagtacagtggctatt

SEQ ID NO: 8343449 - DNA, 22 bp, Homo sapiens
aggctggagtacagtggctatt

SEQ ID NO: 8343450 - DNA, 22 bp, Homo sapiens
aggctggaggtttgttgcggct

SEQ ID NO: 8343451 - DNA, 22 bp, Homo sapiens
aggctggaggtttgttgcggct

SEQ ID NO: 8343452 - DNA, 22 bp, Homo sapiens
aggctggagagtgcagtggcgt

SEQ ID NO: 8343453 - DNA, 22 bp, Homo sapiens
aggctggagagtgcagtggcgt

SEQ ID NO: 8343454 - DNA, 22 bp, Homo sapiens
aggctggagtgtagcagtgcag

SEQ ID NO: 8343455 - DNA, 22 bp, Homo sapiens
aggctggagtgtagcagtgcag

SEQ ID NO: 8343456 - DNA, 22 bp, Homo sapiens
aggctggagtgctggagtgctg

SEQ ID NO: 8343457 - DNA, 22 bp, Homo sapiens
aggctggagtgtagcagtgcag

SEQ ID NO: 8343458 - DNA, 22 bp, Homo sapiens
aggctggcccacctcttgtctt

SEQ ID NO: 8343459 - DNA, 22 bp, Homo sapiens
aggctggagtgctggagtgctg

SEQ ID NO: 8343460 - DNA, 22 bp, Homo sapiens
aggctggagtgcagtggtgtga

SEQ ID NO: 8343461 - DNA, 22 bp, Homo sapiens
aggctggagtgcagtggcgtga

SEQ ID NO: 8343462 - DNA, 22 bp, Homo sapiens
aggctggagtgcagtggcgtga

SEQ ID NO: 8343463 - DNA, 22 bp, Homo sapiens
aggctggagtgcaatggcgtga

SEQ ID NO: 8343464 - DNA, 22 bp, Homo sapiens
aggccacaagaactaccccatc

SEQ ID NO: 8343465 - DNA, 22 bp, Homo sapiens
ccagagaaaaatgtgtccctgt

SEQ ID NO: 8343466 - DNA, 22 bp, Homo sapiens
ccagaccctgctctggggctct

SEQ ID NO: 8343467 - DNA, 22 bp, Homo sapiens
aggcccagactcagcggggcgg

SEQ ID NO: 8343468 - DNA, 22 bp, Homo sapiens
aggccagttgttcagtgggccg

SEQ ID NO: 8343469 - DNA, 23 bp, Homo sapiens
aggccagtttttcctgcttgctg

SEQ ID NO: 8343470 - DNA, 22 bp, Homo sapiens
aggccacagttgaggccagcaa

SEQ ID NO: 8343471 - DNA, 22 bp, Homo sapiens
aggccagaaaaagacagctcca

SEQ ID NO: 8343472 - DNA, 22 bp, Homo sapiens
ccagagcctggcatctgcataa

SEQ ID NO: 8343473 - DNA, 22 bp, Homo sapiens
ccagagcctggcatctgcataa

SEQ ID NO: 8343474 - DNA, 17 bp, Homo sapiens
ccagagctactgagact

SEQ ID NO: 8343475 - DNA, 22 bp, Homo sapiens
ccagctggcaggagagtcaggg

SEQ ID NO: 8343476 - DNA, 22 bp, Homo sapiens
ccagctggagccaaggtggact

SEQ ID NO: 8343477 - DNA, 22 bp, Homo sapiens
ccagctggaagagtgcagaact

SEQ ID NO: 8343478 - DNA, 22 bp, Homo sapiens
ccagctggaaacaaatagagtg

SEQ ID NO: 8343479 - DNA, 22 bp, Homo sapiens
ccagctcttggtgcacttacat

SEQ ID NO: 8343480 - DNA, 23 bp, Homo sapiens
ccagctccgtgagcctcgggctc

SEQ ID NO: 8343481 - DNA, 21 bp, Homo sapiens
ccagctctgcctccagttggt

SEQ ID NO: 8343482 - DNA, 22 bp, Homo sapiens
ccagcaggagatgcctgtgtct

SEQ ID NO: 8343483 - DNA, 22 bp, Homo sapiens
ccagcaggagactagcaacata

SEQ ID NO: 8343484 - DNA, 22 bp, Homo sapiens
aggcgctgtctggggtcgcggc

SEQ ID NO: 8343485 - DNA, 22 bp, Homo sapiens
aggcgctgcatgtgaaggagtt

SEQ ID NO: 8343486 - DNA, 22 bp, Homo sapiens
aggcggagctcagtgtgtccaa

SEQ ID NO: 8343487 - DNA, 19 bp, Homo sapiens
aggcggctcgcgcgcctcc

SEQ ID NO: 8343488 - DNA, 22 bp, Homo sapiens
aggcggctggtgtcctgcaggt

SEQ ID NO: 8343489 - DNA, 22 bp, Homo sapiens
aggcgctgtgcttggggctgga

SEQ ID NO: 8343490 - DNA, 22 bp, Homo sapiens
aggcggctggtgtcctgcaggt

SEQ ID NO: 8343491 - DNA, 22 bp, Homo sapiens
aggcggtgctgtggacagtgac

SEQ ID NO: 8343492 - DNA, 22 bp, Homo sapiens
aggcgggtaccctggctcgaaa

SEQ ID NO: 8343493 - DNA, 22 bp, Homo sapiens
aggcggtgtgctttgcagagca

SEQ ID NO: 8343494 - DNA, 22 bp, Homo sapiens
aggcggtggccaaggagcggga

SEQ ID NO: 8343495 - DNA, 22 bp, Homo sapiens
ccaggaaggtgtttaactagag

SEQ ID NO: 8343496 - DNA, 22 bp, Homo sapiens
ccaggacaagccagagggacag

SEQ ID NO: 8343497 - DNA, 22 bp, Homo sapiens
aggcctgtaatcccagcacttt

SEQ ID NO: 8343498 - DNA, 22 bp, Homo sapiens
aggcctgtctggggctcagcca

SEQ ID NO: 8343499 - DNA, 22 bp, Homo sapiens
aggcctgtctgaggtccccact

SEQ ID NO: 8343500 - DNA, 22 bp, Homo sapiens
aggcctgtcccagctgaggacg

SEQ ID NO: 8343501 - DNA, 22 bp, Homo sapiens
aggcctgtagttcctctttcca

SEQ ID NO: 8343502 - DNA, 22 bp, Homo sapiens
aggcctgggacgggagccgtga

SEQ ID NO: 8343503 - DNA, 22 bp, Homo sapiens
gctcggagaactgggggctccg

SEQ ID NO: 8343504 - DNA, 22 bp, Homo sapiens
gctcgcgccgcaccggtccacc

SEQ ID NO: 8343505 - DNA, 17 bp, Homo sapiens
gctccaggcgtgagtga

SEQ ID NO: 8343506 - DNA, 22 bp, Homo sapiens
gctctaaagggttggacaggtg

SEQ ID NO: 8343507 - DNA, 22 bp, Homo sapiens
gctctaaagtccagtcaactag

SEQ ID NO: 8343508 - DNA, 19 bp, Homo sapiens
gctctaaaagattttgaag

SEQ ID NO: 8343509 - DNA, 20 bp, Homo sapiens
gctctaaaccacaaagccca

SEQ ID NO: 8343510 - DNA, 22 bp, Homo sapiens
gctctaaagaacccagaggagt

SEQ ID NO: 8343511 - DNA, 20 bp, Homo sapiens
gctctaaagccacagattga

SEQ ID NO: 8343512 - DNA, 22 bp, Homo sapiens
gctctaaagagaatctatgcgg

SEQ ID NO: 8343513 - DNA, 22 bp, Homo sapiens
gctctagcccatttcctgcttg

SEQ ID NO: 8343514 - DNA, 22 bp, Homo sapiens
gctccaggcgagctggaccaga

SEQ ID NO: 8343515 - DNA, 22 bp, Homo sapiens
gctccaggcgagctggaccaga

SEQ ID NO: 8343516 - DNA, 22 bp, Homo sapiens
gctcagggctaaggctgagggg

SEQ ID NO: 8343517 - DNA, 22 bp, Homo sapiens
gctcaggggaatgggctgccgt

SEQ ID NO: 8343518 - DNA, 22 bp, Homo sapiens
gctcagggtcccttggtgctgg

SEQ ID NO: 8343519 - DNA, 22 bp, Homo sapiens
gctcaggcaggagtgcagtggc

SEQ ID NO: 8343520 - DNA, 22 bp, Homo sapiens
gctatttttgagccatttataa

SEQ ID NO: 8343521 - DNA, 22 bp, Homo sapiens
gctacaaactgtcatggtgctt

SEQ ID NO: 8343522 - DNA, 22 bp, Homo sapiens
gctaagtggttttcttctcctc

SEQ ID NO: 8343523 - DNA, 22 bp, Homo sapiens
gctaatcaatgttaaggctgtg

SEQ ID NO: 8343524 - DNA, 22 bp, Homo sapiens
gctaatcaatgttaaggctgtg

SEQ ID NO: 8343525 - DNA, 22 bp, Homo sapiens
gcgtggggtaggtagacatgga

SEQ ID NO: 8343526 - DNA, 22 bp, Homo sapiens
gcgtggggtaggtagacatgga

SEQ ID NO: 8343527 - DNA, 22 bp, Homo sapiens
gctaagaaaaattcatgtatat

SEQ ID NO: 8343528 - DNA, 22 bp, Homo sapiens
caaatgtgttttttcttctaca

SEQ ID NO: 8343529 - DNA, 22 bp, Homo sapiens
gctgaggaagtcaggtggccca

SEQ ID NO: 8343530 - DNA, 22 bp, Homo sapiens
caaatctaggatgcatgtagtg

SEQ ID NO: 8343531 - DNA, 22 bp, Homo sapiens
caaatctatatgttgatattct

SEQ ID NO: 8343532 - DNA, 22 bp, Homo sapiens
caaatcatggaataactagaga

SEQ ID NO: 8343533 - DNA, 22 bp, Homo sapiens
caaatcatggctctagcttaca

SEQ ID NO: 8343534 - DNA, 22 bp, Homo sapiens
gctctgggtgaacttggagcaa

SEQ ID NO: 8343535 - DNA, 22 bp, Homo sapiens
gctctgggtgaatggcagattg

SEQ ID NO: 8343536 - DNA, 22 bp, Homo sapiens
gctctgagaggtgcagcagtaa

SEQ ID NO: 8343537 - DNA, 22 bp, Homo sapiens
caaatattccaggtacatccct

SEQ ID NO: 8343538 - DNA, 22 bp, Homo sapiens
caaatagacttaagcatctgta

SEQ ID NO: 8343539 - DNA, 22 bp, Homo sapiens
attttgaagggaattgaagttc

SEQ ID NO: 8343540 - DNA, 22 bp, Homo sapiens
attttgaaaccaagttatttcc

SEQ ID NO: 8343541 - DNA, 22 bp, Homo sapiens
attttgaaaccaagttatttcc

SEQ ID NO: 8343542 - DNA, 22 bp, Homo sapiens
attttgaaaagcatttgagtaa

SEQ ID NO: 8343543 - DNA, 22 bp, Homo sapiens
attttgaaaagcatttgagtaa

SEQ ID NO: 8343544 - DNA, 23 bp, Homo sapiens
attttacaggtcagttccttgaa

SEQ ID NO: 8343545 - DNA, 22 bp, Homo sapiens
gcctgcccacggggctggcata

SEQ ID NO: 8343546 - DNA, 22 bp, Homo sapiens
gcctgcccacggggctggcata

SEQ ID NO: 8343547 - DNA, 22 bp, Homo sapiens
gcctgccctgaaagaggtgaag

SEQ ID NO: 8343548 - DNA, 21 bp, Homo sapiens
gcctgccccatgtttctgttg

SEQ ID NO: 8343549 - DNA, 22 bp, Homo sapiens
gcctgccccttcctgggcaggg

SEQ ID NO: 8343550 - DNA, 22 bp, Homo sapiens
gcctgccccttcctgggcaggg

SEQ ID NO: 8343551 - DNA, 22 bp, Homo sapiens
attttctagatagatgatgcat

SEQ ID NO: 8343552 - DNA, 21 bp, Homo sapiens
gcctgccctctgtgatggcca

SEQ ID NO: 8343553 - DNA, 22 bp, Homo sapiens
attttaataagatccatttggt

SEQ ID NO: 8343554 - DNA, 22 bp, Homo sapiens
atttgtctttggacctgtgaga

SEQ ID NO: 8343555 - DNA, 22 bp, Homo sapiens
atttgtctgcttgctgccttcc

SEQ ID NO: 8343556 - DNA, 22 bp, Homo sapiens
atttgtctgcttgctgccttcc

SEQ ID NO: 8343557 - DNA, 22 bp, Homo sapiens
atttgtctttggacctgtgaga

SEQ ID NO: 8343558 - DNA, 22 bp, Homo sapiens
atttgtctttgagtgccctgct

SEQ ID NO: 8343559 - DNA, 22 bp, Homo sapiens
atttgtcttcagtaggttcttc

SEQ ID NO: 8343560 - DNA, 22 bp, Homo sapiens
atttgtctttgagtgccctgct

SEQ ID NO: 8343561 - DNA, 22 bp, Homo sapiens
atttgtctttggacctgtgaga

SEQ ID NO: 8343562 - DNA, 18 bp, Homo sapiens
atttgcaggcatgcaggc

SEQ ID NO: 8343563 - DNA, 22 bp, Homo sapiens
atttgcaaagtcgtatctgtga

SEQ ID NO: 8343564 - DNA, 22 bp, Homo sapiens
atttgcaagagtaagaatttct

SEQ ID NO: 8343565 - DNA, 22 bp, Homo sapiens
atttgatttgtagatagtgtag

SEQ ID NO: 8343566 - DNA, 22 bp, Homo sapiens
atttgcaattactcatgtcatt

SEQ ID NO: 8343567 - DNA, 22 bp, Homo sapiens
atttgcaagcatgcacaaaagc

SEQ ID NO: 8343568 - DNA, 22 bp, Homo sapiens
atttgattagctgtgtaatttt

SEQ ID NO: 8343569 - DNA, 21 bp, Homo sapiens
gccccctggactcctcatcca

SEQ ID NO: 8343570 - DNA, 22 bp, Homo sapiens
gccccgtcgtggggccagggat

SEQ ID NO: 8343571 - DNA, 22 bp, Homo sapiens
gccctgccctgagccgtagacc

SEQ ID NO: 8343572 - DNA, 22 bp, Homo sapiens
gccctgccctgttgaaactaga

SEQ ID NO: 8343573 - DNA, 22 bp, Homo sapiens
gccctgccctgttgaaactaga

SEQ ID NO: 8343574 - DNA, 22 bp, Homo sapiens
gccctgccctgagccgtagacc

SEQ ID NO: 8343575 - DNA, 22 bp, Homo sapiens
gccctgccgggtattttgtgct

SEQ ID NO: 8343576 - DNA, 22 bp, Homo sapiens
gccctgccgggtattttgtgct

SEQ ID NO: 8343577 - DNA, 23 bp, Homo sapiens
gccctgcccttagcacactcaca

SEQ ID NO: 8343578 - DNA, 23 bp, Homo sapiens
gccctgcccttagcacactcaca

SEQ ID NO: 8343579 - DNA, 22 bp, Homo sapiens
gccctgccctctcggcactcgc

SEQ ID NO: 8343580 - DNA, 22 bp, Homo sapiens
gccctgccctctcggcactcgc

SEQ ID NO: 8343581 - DNA, 19 bp, Homo sapiens
gccctcctcactgagctct

SEQ ID NO: 8343582 - DNA, 22 bp, Homo sapiens
gccctccctacagcctatttct

SEQ ID NO: 8343583 - DNA, 23 bp, Homo sapiens
gccctccctcccaggtgggtgtt

SEQ ID NO: 8343584 - DNA, 22 bp, Homo sapiens
gccctcccctctgggtggtgag

SEQ ID NO: 8343585 - DNA, 22 bp, Homo sapiens
gccctcccctctgggtggtgag

SEQ ID NO: 8343586 - DNA, 18 bp, Homo sapiens
gccagagggaagcaggtg

SEQ ID NO: 8343587 - DNA, 22 bp, Homo sapiens
atttacagacgtggattagtgc

SEQ ID NO: 8343588 - DNA, 22 bp, Homo sapiens
atttacagacgtggattagtgc

SEQ ID NO: 8343589 - DNA, 22 bp, Homo sapiens
atttacagtttagcatttcaag

SEQ ID NO: 8343590 - DNA, 22 bp, Homo sapiens
atttacataatagactttaggt

SEQ ID NO: 8343591 - DNA, 22 bp, Homo sapiens
gcccagcccagaaaggttcgga

SEQ ID NO: 8343592 - DNA, 22 bp, Homo sapiens
gcccagcccagaaaggttcgga

SEQ ID NO: 8343593 - DNA, 22 bp, Homo sapiens
gcccagccacagtcactttcat

SEQ ID NO: 8343594 - DNA, 22 bp, Homo sapiens
gcccagcaggacagagtggttt

SEQ ID NO: 8343595 - DNA, 22 bp, Homo sapiens
gcccactccagcttctcccaca

SEQ ID NO: 8343596 - DNA, 18 bp, Homo sapiens
gccagagggcccaaggtc

SEQ ID NO: 8343597 - DNA, 22 bp, Homo sapiens
gccagaggggctcgaaggcgcg

SEQ ID NO: 8343598 - DNA, 22 bp, Homo sapiens
gccactgcactccagcccaggc

SEQ ID NO: 8343599 - DNA, 21 bp, Homo sapiens
gccactgcactccagcctggg

SEQ ID NO: 8343600 - DNA, 22 bp, Homo sapiens
gccacgttgccacccgggtgac

SEQ ID NO: 8343601 - DNA, 21 bp, Homo sapiens
gccacgtttcagtcttctcag

SEQ ID NO: 8343602 - DNA, 22 bp, Homo sapiens
gcattcactgggtgttcatggg

SEQ ID NO: 8343603 - DNA, 22 bp, Homo sapiens
gcattcatcttcctccatgcag

SEQ ID NO: 8343604 - DNA, 22 bp, Homo sapiens
atttaaatgcttaagagggttt

SEQ ID NO: 8343605 - DNA, 22 bp, Homo sapiens
atttaaagtggtagattggcag

SEQ ID NO: 8343606 - DNA, 16 bp, Homo sapiens
attgttttcaattaga

SEQ ID NO: 8343607 - DNA, 22 bp, Homo sapiens
attgttttaattccattgtgaa

SEQ ID NO: 8343608 - DNA, 22 bp, Homo sapiens
gcagtgattggatcagagatgg

SEQ ID NO: 8343609 - DNA, 22 bp, Homo sapiens
gcagtgattttgctcagataaa

SEQ ID NO: 8343610 - DNA, 22 bp, Homo sapiens
gcagtgattggctttcacaaaa

SEQ ID NO: 8343611 - DNA, 22 bp, Homo sapiens
attgtaacaggatccctgtggc

SEQ ID NO: 8343612 - DNA, 22 bp, Homo sapiens
attgtaacagacacatcagatt

SEQ ID NO: 8343613 - DNA, 22 bp, Homo sapiens
attgtaattttagagaaagtgg

SEQ ID NO: 8343614 - DNA, 22 bp, Homo sapiens
gcagtgctaagtagctggccca

SEQ ID NO: 8343615 - DNA, 22 bp, Homo sapiens
gcagtgctaaggattctgcctt

SEQ ID NO: 8343616 - DNA, 22 bp, Homo sapiens
gcagtgctgatcccatggcaga

SEQ ID NO: 8343617 - DNA, 22 bp, Homo sapiens
attgttgaggcagttcatcttg

SEQ ID NO: 8343618 - DNA, 22 bp, Homo sapiens
attgttgaggagactcttcaat

SEQ ID NO: 8343619 - DNA, 18 bp, Homo sapiens
attgttctgtgacatgtc

SEQ ID NO: 8343620 - DNA, 22 bp, Homo sapiens
gcaggcggatcactggaagtca

SEQ ID NO: 8343621 - DNA, 22 bp, Homo sapiens
gcaggcggaggttgcagtgagc

SEQ ID NO: 8343622 - DNA, 22 bp, Homo sapiens
gcaggagcaaactgcagtgtgg

SEQ ID NO: 8343623 - DNA, 19 bp, Homo sapiens
gcaggataggctgagacta

SEQ ID NO: 8343624 - DNA, 22 bp, Homo sapiens
gcagggacgccagggacagcaa

SEQ ID NO: 8343625 - DNA, 22 bp, Homo sapiens
gcagggactttggcaacaggtg

SEQ ID NO: 8343626 - DNA, 22 bp, Homo sapiens
gcaggctggtctgaccatccct

SEQ ID NO: 8343627 - DNA, 22 bp, Homo sapiens
attggttttgttatctccattc

SEQ ID NO: 8343628 - DNA, 22 bp, Homo sapiens
attggcagttggctgtggttca

SEQ ID NO: 8343629 - DNA, 22 bp, Homo sapiens
gcaggtggatcacctgaggtca

SEQ ID NO: 8343630 - DNA, 22 bp, Homo sapiens
gcaggtggatcacctgaggtca

SEQ ID NO: 8343631 - DNA, 22 bp, Homo sapiens
gcaggtggatcaccacgtcagg

SEQ ID NO: 8343632 - DNA, 22 bp, Homo sapiens
gcagggtctgaggccacagagg

SEQ ID NO: 8343633 - DNA, 22 bp, Homo sapiens
gcagggtctgaggccacagagg

SEQ ID NO: 8343634 - DNA, 22 bp, Homo sapiens
gcagggtcttgagaggcagcca

SEQ ID NO: 8343635 - DNA, 22 bp, Homo sapiens
gcagggtcttgagaggcagcca

SEQ ID NO: 8343636 - DNA, 22 bp, Homo sapiens
gcagggtcttgagaggcagcca

SEQ ID NO: 8343637 - DNA, 22 bp, Homo sapiens
gcagggtaggtgacaggtagtc

SEQ ID NO: 8343638 - DNA, 22 bp, Homo sapiens
gcagggtccatggaggcagccc

SEQ ID NO: 8343639 - DNA, 22 bp, Homo sapiens
gcagggtccatggaggcagccc

SEQ ID NO: 8343640 - DNA, 22 bp, Homo sapiens
gcagggtccatggaggcagccc

SEQ ID NO: 8343641 - DNA, 22 bp, Homo sapiens
gcagggattgtgcagggggcta

SEQ ID NO: 8343642 - DNA, 16 bp, Homo sapiens
gcaggggtgggtggag

SEQ ID NO: 8343643 - DNA, 16 bp, Homo sapiens
gcaggggtgggtggag

SEQ ID NO: 8343644 - DNA, 23 bp, Homo sapiens
gcactgggctctcagcaaggtgt

SEQ ID NO: 8343645 - DNA, 22 bp, Homo sapiens
gcacagggccctgtgcgtaggt

SEQ ID NO: 8343646 - DNA, 22 bp, Homo sapiens
gcacagggagcaggtctctggt

SEQ ID NO: 8343647 - DNA, 22 bp, Homo sapiens
gcacagggcaacaggtctgtta

SEQ ID NO: 8343648 - DNA, 22 bp, Homo sapiens
gcactgggggcagcagtgaggg

SEQ ID NO: 8343649 - DNA, 18 bp, Homo sapiens
gcacagagcaagtttcat

SEQ ID NO: 8343650 - DNA, 18 bp, Homo sapiens
gcacagagcaagtttcat

SEQ ID NO: 8343651 - DNA, 22 bp, Homo sapiens
gcaactgaacatgtgtgtggcc

SEQ ID NO: 8343652 - DNA, 22 bp, Homo sapiens
gcacagagcttgtttacatttg

SEQ ID NO: 8343653 - DNA, 17 bp, Homo sapiens
gcacagaggccaaagga

SEQ ID NO: 8343654 - DNA, 22 bp, Homo sapiens
gcacagggagcaggtctctggt

SEQ ID NO: 8343655 - DNA, 22 bp, Homo sapiens
gcacagggagcaggtctctggt

SEQ ID NO: 8343656 - DNA, 22 bp, Homo sapiens
gcaaattgggaaatttctctag

SEQ ID NO: 8343657 - DNA, 22 bp, Homo sapiens
gcaaattgggctgactcaaggt

SEQ ID NO: 8343658 - DNA, 22 bp, Homo sapiens
gcaaattgctagctttctctgc

SEQ ID NO: 8343659 - DNA, 22 bp, Homo sapiens
gcaaattgaatccagtaataaa

SEQ ID NO: 8343660 - DNA, 22 bp, Homo sapiens
gcaactgaacatgtgtgtggcc

SEQ ID NO: 8343661 - DNA, 22 bp, Homo sapiens
gcacacaggggagttctcagaa

SEQ ID NO: 8343662 - DNA, 22 bp, Homo sapiens
gcaacattgcttctgaacatag

SEQ ID NO: 8343663 - DNA, 22 bp, Homo sapiens
gcaaaacagtcgatgcctccca

SEQ ID NO: 8343664 - DNA, 22 bp, Homo sapiens
gcaaacaagctgcctgaagatt

SEQ ID NO: 8343665 - DNA, 22 bp, Homo sapiens
gatttctgtggcttgtacatat

SEQ ID NO: 8343666 - DNA, 22 bp, Homo sapiens
atgtttctaaaacttgcatggc

SEQ ID NO: 8343667 - DNA, 22 bp, Homo sapiens
gcagccagggagagaaccaggg

SEQ ID NO: 8343668 - DNA, 19 bp, Homo sapiens
gcagccaggtgctctacct

SEQ ID NO: 8343669 - DNA, 22 bp, Homo sapiens
gcagccaggggctgtgacctgt

SEQ ID NO: 8343670 - DNA, 22 bp, Homo sapiens
gcagccagggttaattatattt

SEQ ID NO: 8343671 - DNA, 22 bp, Homo sapiens
gcagccaggaagcctttccctc

SEQ ID NO: 8343672 - DNA, 22 bp, Homo sapiens
gcagctttaatctgaataagta

SEQ ID NO: 8343673 - DNA, 22 bp, Homo sapiens
gcagccaggtttgaggaccact

SEQ ID NO: 8343674 - DNA, 16 bp, Homo sapiens
gcagaggaaaggggag

SEQ ID NO: 8343675 - DNA, 22 bp, Homo sapiens
gcagaggcctaggtggaaggcc

SEQ ID NO: 8343676 - DNA, 22 bp, Homo sapiens
gcagaatagggcataactttgc

SEQ ID NO: 8343677 - DNA, 22 bp, Homo sapiens
gcagaatattatggaaaaagta

SEQ ID NO: 8343678 - DNA, 22 bp, Homo sapiens
gcagaagggaataaggagcttt

SEQ ID NO: 8343679 - DNA, 22 bp, Homo sapiens
gcagaggctgtagggaaggttg

SEQ ID NO: 8343680 - DNA, 22 bp, Homo sapiens
gcagaggcctgaaggtggcggg

SEQ ID NO: 8343681 - DNA, 22 bp, Homo sapiens
gcagaggggaagctgaggaatt

SEQ ID NO: 8343682 - DNA, 22 bp, Homo sapiens
gcagaggggaagctgaggaatt

SEQ ID NO: 8343683 - DNA, 22 bp, Homo sapiens
gcagagggcaggggtgtttgtt

SEQ ID NO: 8343684 - DNA, 22 bp, Homo sapiens
gcagatgagtgagatagacttc

SEQ ID NO: 8343685 - DNA, 22 bp, Homo sapiens
gagcagctccagccgcatgact

SEQ ID NO: 8343686 - DNA, 22 bp, Homo sapiens
gagcacagtaaagcagtgtcac

SEQ ID NO: 8343687 - DNA, 22 bp, Homo sapiens
gagaggtgaatgtggatgccac

SEQ ID NO: 8343688 - DNA, 22 bp, Homo sapiens
gagaggtggaggttgcagtgag

SEQ ID NO: 8343689 - DNA, 21 bp, Homo sapiens
atggaaaaacaggtagagcat

SEQ ID NO: 8343690 - DNA, 22 bp, Homo sapiens
gagaggtcatctcccatcagca

SEQ ID NO: 8343691 - DNA, 22 bp, Homo sapiens
gagcagctctgggtgacccagt

SEQ ID NO: 8343692 - DNA, 22 bp, Homo sapiens
gagcagctctgtgcctggagac

SEQ ID NO: 8343693 - DNA, 22 bp, Homo sapiens
gagcagctctgtgcctggagac

SEQ ID NO: 8343694 - DNA, 19 bp, Homo sapiens
gagcagctgcacccattga

SEQ ID NO: 8343695 - DNA, 17 bp, Homo sapiens
gagcagggatgcggttc

SEQ ID NO: 8343696 - DNA, 22 bp, Homo sapiens
gagcaggtctttcatggtgcat

SEQ ID NO: 8343697 - DNA, 22 bp, Homo sapiens
gagccctgaacaacagcaggaa

SEQ ID NO: 8343698 - DNA, 22 bp, Homo sapiens
gagcctggggaccctcctgagt

SEQ ID NO: 8343699 - DNA, 22 bp, Homo sapiens
gagcggaggcttggaggccagc

SEQ ID NO: 8343700 - DNA, 22 bp, Homo sapiens
gagcgatgtgggtatgtagaag

SEQ ID NO: 8343701 - DNA, 23 bp, Homo sapiens
gagctctgcactaggccctggga

SEQ ID NO: 8343702 - DNA, 22 bp, Homo sapiens
gagctctgcagattgttttagg

SEQ ID NO: 8343703 - DNA, 22 bp, Homo sapiens
atggtttaagggagaatattga

SEQ ID NO: 8343704 - DNA, 22 bp, Homo sapiens
gaggaagcagggcttggctgag

SEQ ID NO: 8343705 - DNA, 22 bp, Homo sapiens
gaggaagccccattgaagccag

SEQ ID NO: 8343706 - DNA, 22 bp, Homo sapiens
gagctctggcagggcaggtctg

SEQ ID NO: 8343707 - DNA, 22 bp, Homo sapiens
gagctctgggaaacaaagtgta

SEQ ID NO: 8343708 - DNA, 22 bp, Homo sapiens
gagctctggacgaggggagtgg

SEQ ID NO: 8343709 - DNA, 22 bp, Homo sapiens
gagctctgcggaaaacgtgccg

SEQ ID NO: 8343710 - DNA, 22 bp, Homo sapiens
gagctctgctactcaaagtatg

SEQ ID NO: 8343711 - DNA, 22 bp, Homo sapiens
gagctctgcttgggttcttagg

SEQ ID NO: 8343712 - DNA, 22 bp, Homo sapiens
gagctctggttcatgatctatt

SEQ ID NO: 8343713 - DNA, 22 bp, Homo sapiens
gagctctgtgaatgtggggagg

SEQ ID NO: 8343714 - DNA, 22 bp, Homo sapiens
gagctctgtacacagagggtgt

SEQ ID NO: 8343715 - DNA, 22 bp, Homo sapiens
gagctctgtccacacttggaga

SEQ ID NO: 8343716 - DNA, 22 bp, Homo sapiens
gagctggggcggatactcagct

SEQ ID NO: 8343717 - DNA, 22 bp, Homo sapiens
gagctggggcggatactcagct

SEQ ID NO: 8343718 - DNA, 22 bp, Homo sapiens
atgtaaagtatctgaaatgctg

SEQ ID NO: 8343719 - DNA, 22 bp, Homo sapiens
atgtaaagttcagtacagtttt

SEQ ID NO: 8343720 - DNA, 22 bp, Homo sapiens
atgtaaagttacttgagttttg

SEQ ID NO: 8343721 - DNA, 22 bp, Homo sapiens
atgtaaagttacttgagttttg

SEQ ID NO: 8343722 - DNA, 22 bp, Homo sapiens
atgtaacattgaattatatagt

SEQ ID NO: 8343723 - DNA, 22 bp, Homo sapiens
atgtaacaggtgaagctctgag

SEQ ID NO: 8343724 - DNA, 22 bp, Homo sapiens
atgtaacaaatggtatacatgt

SEQ ID NO: 8343725 - DNA, 22 bp, Homo sapiens
atgtaatttagaaatgaacaca

SEQ ID NO: 8343726 - DNA, 22 bp, Homo sapiens
atgtaatttatgttatccataa

SEQ ID NO: 8343727 - DNA, 22 bp, Homo sapiens
atgtaaggctgcctatgacact

SEQ ID NO: 8343728 - DNA, 22 bp, Homo sapiens
atgtaaggttcagagtatgtga

SEQ ID NO: 8343729 - DNA, 22 bp, Homo sapiens
atgtaactgttatattttgttg

SEQ ID NO: 8343730 - DNA, 22 bp, Homo sapiens
atgtacaaaatgttttgaaatg

SEQ ID NO: 8343731 - DNA, 22 bp, Homo sapiens
atgtacaacctgcatgacagtc

SEQ ID NO: 8343732 - DNA, 22 bp, Homo sapiens
atgtatttgaaatttgagacat

SEQ ID NO: 8343733 - DNA, 22 bp, Homo sapiens
atgtacaatctatcacaagaag

SEQ ID NO: 8343734 - DNA, 22 bp, Homo sapiens
atgtcacagcaggagtattctt

SEQ ID NO: 8343735 - DNA, 22 bp, Homo sapiens
atgtcacagtctgactcagtga

SEQ ID NO: 8343736 - DNA, 18 bp, Homo sapiens
gatctctgcagtgcctac

SEQ ID NO: 8343737 - DNA, 22 bp, Homo sapiens
gatctctgaatctgaagccttc

SEQ ID NO: 8343738 - DNA, 22 bp, Homo sapiens
gatctctgaatctgaagccttc

SEQ ID NO: 8343739 - DNA, 22 bp, Homo sapiens
gatctctgctggaagggacacc

SEQ ID NO: 8343740 - DNA, 21 bp, Homo sapiens
gatctctggaaggagaaagct

SEQ ID NO: 8343741 - DNA, 18 bp, Homo sapiens
gatctctgcagtgcctac

SEQ ID NO: 8343742 - DNA, 21 bp, Homo sapiens
gatctctggaatgactctggc

SEQ ID NO: 8343743 - DNA, 22 bp, Homo sapiens
gatctctgtggactcttagcac

SEQ ID NO: 8343744 - DNA, 22 bp, Homo sapiens
gatctctgtggactcttagcac

SEQ ID NO: 8343745 - DNA, 22 bp, Homo sapiens
gatccttgcacttgacttggca

SEQ ID NO: 8343746 - DNA, 22 bp, Homo sapiens
gatccttgcaactctgtgaggt

SEQ ID NO: 8343747 - DNA, 22 bp, Homo sapiens
gatatttacaaatttgccaata

SEQ ID NO: 8343748 - DNA, 22 bp, Homo sapiens
gagttattgagtatagaatgta

SEQ ID NO: 8343749 - DNA, 22 bp, Homo sapiens
gagttacatttggtgacacttc

SEQ ID NO: 8343750 - DNA, 22 bp, Homo sapiens
gagttacattcattgttacgct

SEQ ID NO: 8343751 - DNA, 22 bp, Homo sapiens
gagttacacagaagtcagtttg

SEQ ID NO: 8343752 - DNA, 22 bp, Homo sapiens
gagtgcaggcctgagcaccatc

SEQ ID NO: 8343753 - DNA, 22 bp, Homo sapiens
gagtgcagatgccagccccagt

SEQ ID NO: 8343754 - DNA, 23 bp, Homo sapiens
gagtgcagaatagacatgcagtg

SEQ ID NO: 8343755 - DNA, 17 bp, Homo sapiens
gagtgcagacacaagca

SEQ ID NO: 8343756 - DNA, 22 bp, Homo sapiens
gagtgcagatgaacagaagatt

SEQ ID NO: 8343757 - DNA, 20 bp, Homo sapiens
gagtccaggggcctgtagca

SEQ ID NO: 8343758 - DNA, 22 bp, Homo sapiens
gagtccagttagtgaggctggg

SEQ ID NO: 8343759 - DNA, 22 bp, Homo sapiens
atgtttcaaatatatagagttg

SEQ ID NO: 8343760 - DNA, 22 bp, Homo sapiens
atgtttattgttttaagctgct

SEQ ID NO: 8343761 - DNA, 21 bp, Homo sapiens
gagtgcaggtctgatgccatc

SEQ ID NO: 8343762 - DNA, 22 bp, Homo sapiens
atgtttcaggaaatcagctaga

SEQ ID NO: 8343763 - DNA, 22 bp, Homo sapiens
atgtttcagatacagatcaaat

SEQ ID NO: 8343764 - DNA, 22 bp, Homo sapiens
atgtttcaggcgaactaacatg

SEQ ID NO: 8343765 - DNA, 22 bp, Homo sapiens
atgtttcaggcgaactaacatg

SEQ ID NO: 8343766 - DNA, 22 bp, Homo sapiens
gagggggctagcgcagtgccca

SEQ ID NO: 8343767 - DNA, 22 bp, Homo sapiens
gagggggctagcgcagtgccca

SEQ ID NO: 8343768 - DNA, 22 bp, Homo sapiens
gagggggctagcgcagtgccca

SEQ ID NO: 8343769 - DNA, 22 bp, Homo sapiens
gaggggggcgccctgcagtgca

SEQ ID NO: 8343770 - DNA, 19 bp, Homo sapiens
gaggggaggaattgacaag

SEQ ID NO: 8343771 - DNA, 22 bp, Homo sapiens
gaggggagcccccatcctccag

SEQ ID NO: 8343772 - DNA, 22 bp, Homo sapiens
gaggttggggctgcagtgagct

SEQ ID NO: 8343773 - DNA, 22 bp, Homo sapiens
gaggttggtgaggggacacggt

SEQ ID NO: 8343774 - DNA, 22 bp, Homo sapiens
gagtccaggatttgagctctgt

SEQ ID NO: 8343775 - DNA, 22 bp, Homo sapiens
gagtccaggcatccctcccata

SEQ ID NO: 8343776 - DNA, 22 bp, Homo sapiens
gagtccaggcatccctcccata

SEQ ID NO: 8343777 - DNA, 22 bp, Homo sapiens
gaggctgttaggagggactctg

SEQ ID NO: 8343778 - DNA, 22 bp, Homo sapiens
gaggctgtgtcttggggtggaa

SEQ ID NO: 8343779 - DNA, 22 bp, Homo sapiens
gaggctgtgtttcagtgaggcc

SEQ ID NO: 8343780 - DNA, 22 bp, Homo sapiens
gaggccaagttggagaccaggt

SEQ ID NO: 8343781 - DNA, 23 bp, Homo sapiens
gaggcttgatcagcttcctccac

SEQ ID NO: 8343782 - DNA, 22 bp, Homo sapiens
gaggctgttggctgatctgagt

SEQ ID NO: 8343783 - DNA, 22 bp, Homo sapiens
gaggctgtttgtggcagtgatg

SEQ ID NO: 8343784 - DNA, 22 bp, Homo sapiens
gaggctgttagggcctgaggta

SEQ ID NO: 8343785 - DNA, 16 bp, Homo sapiens
gaagcagagggtgttg

SEQ ID NO: 8343786 - DNA, 22 bp, Homo sapiens
gaagcactgtgctgctaagttg

SEQ ID NO: 8343787 - DNA, 22 bp, Homo sapiens
gaagcacattagatgtgtcttc

SEQ ID NO: 8343788 - DNA, 22 bp, Homo sapiens
gaagcacatggctgtgagcaac

SEQ ID NO: 8343789 - DNA, 22 bp, Homo sapiens
gaagcagaaggtttggacgtgc

SEQ ID NO: 8343790 - DNA, 22 bp, Homo sapiens
gaagcacaaagtgtagttccga

SEQ ID NO: 8343791 - DNA, 22 bp, Homo sapiens
gaatgtgggctgtgaagaggag

SEQ ID NO: 8343792 - DNA, 22 bp, Homo sapiens
gaatgtgtgactctattgagca

SEQ ID NO: 8343793 - DNA, 22 bp, Homo sapiens
atgccctgtggttcatgtgaga

SEQ ID NO: 8343794 - DNA, 21 bp, Homo sapiens
atgcccttcactcaaggccag

SEQ ID NO: 8343795 - DNA, 22 bp, Homo sapiens
atgccctgtgactctcctggac

SEQ ID NO: 8343796 - DNA, 23 bp, Homo sapiens
atgccctgtagaggctgctgacc

SEQ ID NO: 8343797 - DNA, 22 bp, Homo sapiens
atgccctggggctacctctgag

SEQ ID NO: 8343798 - DNA, 20 bp, Homo sapiens
atgcctctaattttgcaaac

SEQ ID NO: 8343799 - DNA, 22 bp, Homo sapiens
gacagggacgaggcttcaggca

SEQ ID NO: 8343800 - DNA, 22 bp, Homo sapiens
atgcccaccctcagcccaggct

SEQ ID NO: 8343801 - DNA, 22 bp, Homo sapiens
atgccacttcattccagcctcg

SEQ ID NO: 8343802 - DNA, 22 bp, Homo sapiens
atgccattttatactcattcaa

SEQ ID NO: 8343803 - DNA, 22 bp, Homo sapiens
atgcccgatacctagttaactc

SEQ ID NO: 8343804 - DNA, 22 bp, Homo sapiens
atgccctgctgccatctggccg

SEQ ID NO: 8343805 - DNA, 22 bp, Homo sapiens
atgctttagttcaaaggactta

SEQ ID NO: 8343806 - DNA, 22 bp, Homo sapiens
gacagtttttaatcctttcatg

SEQ ID NO: 8343807 - DNA, 22 bp, Homo sapiens
gacagtttctgaatgcgtactt

SEQ ID NO: 8343808 - DNA, 22 bp, Homo sapiens
gacagttaggacaactgacttc

SEQ ID NO: 8343809 - DNA, 22 bp, Homo sapiens
gacagttaggggctggatgcca

SEQ ID NO: 8343810 - DNA, 22 bp, Homo sapiens
gacagtttaggttcaaatctca

SEQ ID NO: 8343811 - DNA, 22 bp, Homo sapiens
gacagttacccccaaaagaatt

SEQ ID NO: 8343812 - DNA, 22 bp, Homo sapiens
gacagggcgagactcagtctca

SEQ ID NO: 8343813 - DNA, 22 bp, Homo sapiens
gacagggcgcccagcctgtttc

SEQ ID NO: 8343814 - DNA, 22 bp, Homo sapiens
gacagggcaagactctgtctaa

SEQ ID NO: 8343815 - DNA, 22 bp, Homo sapiens
gaccccagaggaaggggcgccg

SEQ ID NO: 8343816 - DNA, 22 bp, Homo sapiens
gaccccagaggaaggggcgccg

SEQ ID NO: 8343817 - DNA, 22 bp, Homo sapiens
gaccccaaccctagagtctgac

SEQ ID NO: 8343818 - DNA, 22 bp, Homo sapiens
gaccccaggcagatcagggggt

SEQ ID NO: 8343819 - DNA, 22 bp, Homo sapiens
gaccccaggcagatcagggggt

SEQ ID NO: 8343820 - DNA, 22 bp, Homo sapiens
gactggggtaaggtgaggaggt

SEQ ID NO: 8343821 - DNA, 22 bp, Homo sapiens
gaccctggaactttcagcagag

SEQ ID NO: 8343822 - DNA, 22 bp, Homo sapiens
atgctttgatagtttattacat

SEQ ID NO: 8343823 - DNA, 22 bp, Homo sapiens
atgctttgaagtttttcctcat

SEQ ID NO: 8343824 - DNA, 22 bp, Homo sapiens
atgcttttccaggagaaatata

SEQ ID NO: 8343825 - DNA, 22 bp, Homo sapiens
gaaatctgaactctgtatcctt

SEQ ID NO: 8343826 - DNA, 22 bp, Homo sapiens
gaaatatacatgaagtcggctg

SEQ ID NO: 8343827 - DNA, 22 bp, Homo sapiens
gaaatctgaacaacagctgtca

SEQ ID NO: 8343828 - DNA, 22 bp, Homo sapiens
gaaaatgcctctggcattaaac

SEQ ID NO: 8343829 - DNA, 22 bp, Homo sapiens
gaaatgaaatagcaccaaggtt

SEQ ID NO: 8343830 - DNA, 22 bp, Homo sapiens
gaaatctgcccagtgcactggt

SEQ ID NO: 8343831 - DNA, 22 bp, Homo sapiens
gaaatctgaatcttctgttggt

SEQ ID NO: 8343832 - DNA, 22 bp, Homo sapiens
gaaatctgcggtgaggcctgag

SEQ ID NO: 8343833 - DNA, 22 bp, Homo sapiens
gaaatctgtctttgtttgaata

SEQ ID NO: 8343834 - DNA, 22 bp, Homo sapiens
gaaatctgtctttgtttgaata

SEQ ID NO: 8343835 - DNA, 22 bp, Homo sapiens
gaaatctgcttcttgcatagta

SEQ ID NO: 8343836 - DNA, 22 bp, Homo sapiens
gaaatgattttagtttatcatg

SEQ ID NO: 8343837 - DNA, 22 bp, Homo sapiens
gaacataactattgtgaatagt

SEQ ID NO: 8343838 - DNA, 22 bp, Homo sapiens
gaacatcttatccatttcctct

SEQ ID NO: 8343839 - DNA, 22 bp, Homo sapiens
gaacatctgtgatctctttggg

SEQ ID NO: 8343840 - DNA, 22 bp, Homo sapiens
gaacattattgtacaaatgtct

SEQ ID NO: 8343841 - DNA, 22 bp, Homo sapiens
gaacattcacagactcaccatt

SEQ ID NO: 8343842 - DNA, 22 bp, Homo sapiens
gaacattcttgggcaagttact

SEQ ID NO: 8343843 - DNA, 22 bp, Homo sapiens
gaacatttatattagatagcta

SEQ ID NO: 8343844 - DNA, 22 bp, Homo sapiens
gaacattcttggaggaaataac

SEQ ID NO: 8343845 - DNA, 22 bp, Homo sapiens
gaacatttatgatgcaatacct

SEQ ID NO: 8343846 - DNA, 22 bp, Homo sapiens
gaacatttccagaaaggaacta

SEQ ID NO: 8343847 - DNA, 22 bp, Homo sapiens
atgcacaacagtggctgccttg

SEQ ID NO: 8343848 - DNA, 22 bp, Homo sapiens
gaagaaagattggcatgcttca

SEQ ID NO: 8343849 - DNA, 22 bp, Homo sapiens
atgcaagacccagaaatcatta

SEQ ID NO: 8343850 - DNA, 22 bp, Homo sapiens
gaaaatagcagatagaccaatg

SEQ ID NO: 8343851 - DNA, 22 bp, Homo sapiens
gaaaatagcagatagaccaatg

SEQ ID NO: 8343852 - DNA, 22 bp, Homo sapiens
gaaaataggcagatgcattgta

SEQ ID NO: 8343853 - DNA, 22 bp, Homo sapiens
gaaaataggcagatgcattgta

SEQ ID NO: 8343854 - DNA, 20 bp, Homo sapiens
gaaaataggccagccaggta

SEQ ID NO: 8343855 - DNA, 20 bp, Homo sapiens
gaaaataggccagccaggta

SEQ ID NO: 8343856 - DNA, 22 bp, Homo sapiens
gaaaatctgcttatattatttt

SEQ ID NO: 8343857 - DNA, 22 bp, Homo sapiens
gaaaatgagcctcagctacatt

SEQ ID NO: 8343858 - DNA, 22 bp, Homo sapiens
gaaaataggctgcatctccttc

SEQ ID NO: 8343859 - DNA, 22 bp, Homo sapiens
gaaaataggctgcatctccttc

SEQ ID NO: 8343860 - DNA, 22 bp, Homo sapiens
gaaaatagttcatcacaatgat

SEQ ID NO: 8343861 - DNA, 22 bp, Homo sapiens
gaaaatagttcatcacaatgat

SEQ ID NO: 8343862 - DNA, 22 bp, Homo sapiens
gaaaagaactgcatgggattaa

SEQ ID NO: 8343863 - DNA, 22 bp, Homo sapiens
gaaaagaactgcatgggattaa

SEQ ID NO: 8343864 - DNA, 22 bp, Homo sapiens
gaaaagaactgcatgggattaa

SEQ ID NO: 8343865 - DNA, 22 bp, Homo sapiens
gaaaacttggatctctagaatg

SEQ ID NO: 8343866 - DNA, 22 bp, Homo sapiens
gaaaactattggcctagaacaa

SEQ ID NO: 8343867 - DNA, 22 bp, Homo sapiens
gaaaactaacggaaaagttagg

SEQ ID NO: 8343868 - DNA, 19 bp, Homo sapiens
gaaaacatgggtgagggtc

SEQ ID NO: 8343869 - DNA, 21 bp, Homo sapiens
gaaaaccatttgcatcatgag

SEQ ID NO: 8343870 - DNA, 22 bp, Homo sapiens
gaaaaccacctcccatcaagca

SEQ ID NO: 8343871 - DNA, 19 bp, Homo sapiens
atgaattgagcacttacta

SEQ ID NO: 8343872 - DNA, 22 bp, Homo sapiens
atgaattaaggataactggtct

SEQ ID NO: 8343873 - DNA, 22 bp, Homo sapiens
atgaatgtgatgattctgttac

SEQ ID NO: 8343874 - DNA, 22 bp, Homo sapiens
atgaatgtaagtggatttcttt

SEQ ID NO: 8343875 - DNA, 22 bp, Homo sapiens
cttgagggactctatgacttag

SEQ ID NO: 8343876 - DNA, 22 bp, Homo sapiens
atcttcaacttgatcatttgaa

SEQ ID NO: 8343877 - DNA, 22 bp, Homo sapiens
atcttcatcaagttcacagtgg

SEQ ID NO: 8343878 - DNA, 22 bp, Homo sapiens
atcttcccaggctggggagagg

SEQ ID NO: 8343879 - DNA, 22 bp, Homo sapiens
atcttcccaggctggggagagg

SEQ ID NO: 8343880 - DNA, 22 bp, Homo sapiens
atcttcccaggctggggagagg

SEQ ID NO: 8343881 - DNA, 22 bp, Homo sapiens
cttgagaagcattaagaggtag

SEQ ID NO: 8343882 - DNA, 22 bp, Homo sapiens
cttgagaatgtgagccacagat

SEQ ID NO: 8343883 - DNA, 21 bp, Homo sapiens
cttgagaattaactgttcatt

SEQ ID NO: 8343884 - DNA, 21 bp, Homo sapiens
cttgagaattaactgttcatt

SEQ ID NO: 8343885 - DNA, 18 bp, Homo sapiens
ggctgctcgctctccccg

SEQ ID NO: 8343886 - DNA, 22 bp, Homo sapiens
ggctgctcctttaccctggcag

SEQ ID NO: 8343887 - DNA, 18 bp, Homo sapiens
ggctgctcctctccctac

SEQ ID NO: 8343888 - DNA, 22 bp, Homo sapiens
ggctgctcacgcagccctccct

SEQ ID NO: 8343889 - DNA, 22 bp, Homo sapiens
ggctgcggatctaaggctggga

SEQ ID NO: 8343890 - DNA, 22 bp, Homo sapiens
ggctgcctcaaagctcaagctc

SEQ ID NO: 8343891 - DNA, 22 bp, Homo sapiens
cactgtccctgtttcctggaaa

SEQ ID NO: 8343892 - DNA, 22 bp, Homo sapiens
ggctgcagccctcgcctagcca

SEQ ID NO: 8343893 - DNA, 22 bp, Homo sapiens
ggctgcagcagagggactcacg

SEQ ID NO: 8343894 - DNA, 20 bp, Homo sapiens
cactgccctccagcctgagc

SEQ ID NO: 8343895 - DNA, 22 bp, Homo sapiens
cactgcccaggcacccatcttg

SEQ ID NO: 8343896 - DNA, 22 bp, Homo sapiens
cactgcccaggacctgccaccc

SEQ ID NO: 8343897 - DNA, 22 bp, Homo sapiens
ggctcctgtggcaagacagctt

SEQ ID NO: 8343898 - DNA, 22 bp, Homo sapiens
ggctcctgtcctcctggagctc

SEQ ID NO: 8343899 - DNA, 22 bp, Homo sapiens
ggctcctgtcctcctggagctc

SEQ ID NO: 8343900 - DNA, 22 bp, Homo sapiens
ggctcctgtcccctcagctgct

SEQ ID NO: 8343901 - DNA, 22 bp, Homo sapiens
ggctcctgtcccctcagctgct

SEQ ID NO: 8343902 - DNA, 22 bp, Homo sapiens
ggctcctgggggtgctcctgcc

SEQ ID NO: 8343903 - DNA, 22 bp, Homo sapiens
ggctcctgggggtgctcctgcc

SEQ ID NO: 8343904 - DNA, 22 bp, Homo sapiens
ggcgccgcactcggtgcagccg

SEQ ID NO: 8343905 - DNA, 22 bp, Homo sapiens
ggcgccgcactcggtgcagccg

SEQ ID NO: 8343906 - DNA, 20 bp, Homo sapiens
ggcgcctggcctcatggctg

SEQ ID NO: 8343907 - DNA, 19 bp, Homo sapiens
ggctcctggggctcagccc

SEQ ID NO: 8343908 - DNA, 22 bp, Homo sapiens
ggctgggagctggacaggccgg

SEQ ID NO: 8343909 - DNA, 22 bp, Homo sapiens
ggctgggagctggacaggccgg

SEQ ID NO: 8343910 - DNA, 22 bp, Homo sapiens
ggcttggcagaggtgggtgctt

SEQ ID NO: 8343911 - DNA, 22 bp, Homo sapiens
cagaacagagcctgaatctctc

SEQ ID NO: 8343912 - DNA, 23 bp, Homo sapiens
ggctgggagctccgggtgcacgt

SEQ ID NO: 8343913 - DNA, 22 bp, Homo sapiens
cagaaatgtttgttaatattgt

SEQ ID NO: 8343914 - DNA, 22 bp, Homo sapiens
ggctgctgtgacctcaggtgat

SEQ ID NO: 8343915 - DNA, 22 bp, Homo sapiens
ggctgctgtgacctcaggtgat

SEQ ID NO: 8343916 - DNA, 21 bp, Homo sapiens
ggctgctgtcaccgctgtcac

SEQ ID NO: 8343917 - DNA, 19 bp, Homo sapiens
cagaaatagcgaagtgtaa

SEQ ID NO: 8343918 - DNA, 22 bp, Homo sapiens
ggctgctgtactgatgtcagtt

SEQ ID NO: 8343919 - DNA, 22 bp, Homo sapiens
ggctgctgtactgatgtcagtt

SEQ ID NO: 8343920 - DNA, 20 bp, Homo sapiens
ggctgctggtttggctctgt

SEQ ID NO: 8343921 - DNA, 20 bp, Homo sapiens
ggctgctggtttggctctgt

SEQ ID NO: 8343922 - DNA, 22 bp, Homo sapiens
ggctgctggtggaatggtaggc

SEQ ID NO: 8343923 - DNA, 19 bp, Homo sapiens
ggctgctggttacagaggc

SEQ ID NO: 8343924 - DNA, 22 bp, Homo sapiens
ggaggtggaggttgcagtgagc

SEQ ID NO: 8343925 - DNA, 22 bp, Homo sapiens
ggagtctgcggcagacactgta

SEQ ID NO: 8343926 - DNA, 22 bp, Homo sapiens
ggagtctgctcccagacatgat

SEQ ID NO: 8343927 - DNA, 22 bp, Homo sapiens
ggagtctggagtggggcccaag

SEQ ID NO: 8343928 - DNA, 22 bp, Homo sapiens
ggagtctgggaattggagagaa

SEQ ID NO: 8343929 - DNA, 22 bp, Homo sapiens
ggagtctgtcacctgtttctct

SEQ ID NO: 8343930 - DNA, 21 bp, Homo sapiens
ggagtctgtggatgctgtttc

SEQ ID NO: 8343931 - DNA, 22 bp, Homo sapiens
ggagtctgtgtcttgaagcagt

SEQ ID NO: 8343932 - DNA, 22 bp, Homo sapiens
ggagtctgttttacatgcagga

SEQ ID NO: 8343933 - DNA, 22 bp, Homo sapiens
ggagtgaaaggtaagttgagct

SEQ ID NO: 8343934 - DNA, 22 bp, Homo sapiens
ggagtttcttgagcccttaagg

SEQ ID NO: 8343935 - DNA, 21 bp, Homo sapiens
ggagtttttctggaagggact

SEQ ID NO: 8343936 - DNA, 22 bp, Homo sapiens
ggagtgactcacagctgggaca

SEQ ID NO: 8343937 - DNA, 22 bp, Homo sapiens
ggcagctgcaaatctgctctgt

SEQ ID NO: 8343938 - DNA, 22 bp, Homo sapiens
ggcaggaagaggagggtgaact

SEQ ID NO: 8343939 - DNA, 22 bp, Homo sapiens
ggatatatgcatgttatcattt

SEQ ID NO: 8343940 - DNA, 22 bp, Homo sapiens
ggatattctttatagatacagt

SEQ ID NO: 8343941 - DNA, 22 bp, Homo sapiens
ggatcattaacacatccatcac

SEQ ID NO: 8343942 - DNA, 22 bp, Homo sapiens
ggcaggtgtggtgaccagagat

SEQ ID NO: 8343943 - DNA, 22 bp, Homo sapiens
ggcaggtgtggtgaccagagat

SEQ ID NO: 8343944 - DNA, 22 bp, Homo sapiens
cacatgcccagaacttctcatt

SEQ ID NO: 8343945 - DNA, 22 bp, Homo sapiens
cacatgcctattaaccaaacga

SEQ ID NO: 8343946 - DNA, 22 bp, Homo sapiens
cacatgccttcctcaggcctct

SEQ ID NO: 8343947 - DNA, 22 bp, Homo sapiens
ggcaggtgtgagatcgaggcca

SEQ ID NO: 8343948 - DNA, 19 bp, Homo sapiens
ggcaggtgtgcttatgctt

SEQ ID NO: 8343949 - DNA, 22 bp, Homo sapiens
ggcaggagaaaggtctcttctt

SEQ ID NO: 8343950 - DNA, 22 bp, Homo sapiens
ggcaggactgatcagtgggatg

SEQ ID NO: 8343951 - DNA, 22 bp, Homo sapiens
ggcaggactcttctgtgggccg

SEQ ID NO: 8343952 - DNA, 22 bp, Homo sapiens
ggcaggactctcaggaccaagc

SEQ ID NO: 8343953 - DNA, 22 bp, Homo sapiens
ggcgcacgccattggccgtgcg

SEQ ID NO: 8343954 - DNA, 22 bp, Homo sapiens
ggcgcacgccattggccgtgcg

SEQ ID NO: 8343955 - DNA, 23 bp, Homo sapiens
ggcctgtgttttgtctgaagtac

SEQ ID NO: 8343956 - DNA, 22 bp, Homo sapiens
ggcgaggccgggacaggctgga

SEQ ID NO: 8343957 - DNA, 22 bp, Homo sapiens
ggcgagggagcagtgcggtggg

SEQ ID NO: 8343958 - DNA, 22 bp, Homo sapiens
ggcgcaggccttggatcctggt

SEQ ID NO: 8343959 - DNA, 22 bp, Homo sapiens
ggcgccagcactgcagcgcctc

SEQ ID NO: 8343960 - DNA, 22 bp, Homo sapiens
ggcgccctggtgccgcaccgcg

SEQ ID NO: 8343961 - DNA, 22 bp, Homo sapiens
ggcgccagcccaggccgtcgtg

SEQ ID NO: 8343962 - DNA, 22 bp, Homo sapiens
ggccccagcttcaaccccgtgg

SEQ ID NO: 8343963 - DNA, 22 bp, Homo sapiens
ggcccagcacagtgcttggggg

SEQ ID NO: 8343964 - DNA, 22 bp, Homo sapiens
ggcccagcatcttgtgaagttt

SEQ ID NO: 8343965 - DNA, 22 bp, Homo sapiens
ggccagcggcacagcctggccc

SEQ ID NO: 8343966 - DNA, 22 bp, Homo sapiens
ggccagcctggggctcccagac

SEQ ID NO: 8343967 - DNA, 22 bp, Homo sapiens
ggccagccctcctccctgggtt

SEQ ID NO: 8343968 - DNA, 22 bp, Homo sapiens
ggccagcccagtggtcctctct

SEQ ID NO: 8343969 - DNA, 18 bp, Homo sapiens
ggccagccccaggccagc

SEQ ID NO: 8343970 - DNA, 22 bp, Homo sapiens
cacatttgaaggaattagcatt

SEQ ID NO: 8343971 - DNA, 22 bp, Homo sapiens
ggccagctccttggcagtgcct

SEQ ID NO: 8343972 - DNA, 22 bp, Homo sapiens
cacccagcattggctaagagag

SEQ ID NO: 8343973 - DNA, 21 bp, Homo sapiens
ggccagctcggaaggtcccat

SEQ ID NO: 8343974 - DNA, 22 bp, Homo sapiens
ggccagctacccatctgcgtca

SEQ ID NO: 8343975 - DNA, 22 bp, Homo sapiens
ggccagctcagactccacttgc

SEQ ID NO: 8343976 - DNA, 22 bp, Homo sapiens
ggccagctcagtctccatcagg

SEQ ID NO: 8343977 - DNA, 18 bp, Homo sapiens
ggccagctcctgaggcag

SEQ ID NO: 8343978 - DNA, 18 bp, Homo sapiens
ggagagtgacagagtcgt

SEQ ID NO: 8343979 - DNA, 18 bp, Homo sapiens
ggagagtgacagagtcgt

SEQ ID NO: 8343980 - DNA, 18 bp, Homo sapiens
ggagagtgagatcaaaca

SEQ ID NO: 8343981 - DNA, 17 bp, Homo sapiens
ggagagtgggaatggcc

SEQ ID NO: 8343982 - DNA, 22 bp, Homo sapiens
ggagagtggattccagctgtat

SEQ ID NO: 8343983 - DNA, 22 bp, Homo sapiens
ggagagtggattccagctgtat

SEQ ID NO: 8343984 - DNA, 16 bp, Homo sapiens
ggagagtgtctgcaaa

SEQ ID NO: 8343985 - DNA, 22 bp, Homo sapiens
ggagagtgggagcaactgttgc

SEQ ID NO: 8343986 - DNA, 22 bp, Homo sapiens
ggagagtgggagcaactgttgc

SEQ ID NO: 8343987 - DNA, 22 bp, Homo sapiens
ggacagcccatacacatgtctg

SEQ ID NO: 8343988 - DNA, 22 bp, Homo sapiens
ggacagccgagtggccttctcc

SEQ ID NO: 8343989 - DNA, 22 bp, Homo sapiens
cacagagaattcccatatgtga

SEQ ID NO: 8343990 - DNA, 22 bp, Homo sapiens
cacagagacagatctattttgc

SEQ ID NO: 8343991 - DNA, 23 bp, Homo sapiens
ggagatctaggttggcatttcct

SEQ ID NO: 8343992 - DNA, 22 bp, Homo sapiens
ggagatctgagagctggaagtg

SEQ ID NO: 8343993 - DNA, 22 bp, Homo sapiens
ggagatctcagttttataatca

SEQ ID NO: 8343994 - DNA, 22 bp, Homo sapiens
ggaagagaggttcagccctaag

SEQ ID NO: 8343995 - DNA, 22 bp, Homo sapiens
ggaaggggtcacctcctgatga

SEQ ID NO: 8343996 - DNA, 22 bp, Homo sapiens
ggacaaaggggtacgatctagc

SEQ ID NO: 8343997 - DNA, 22 bp, Homo sapiens
ggacacagataatcacacagat

SEQ ID NO: 8343998 - DNA, 23 bp, Homo sapiens
ggacacagagataagtgagacaa

SEQ ID NO: 8343999 - DNA, 22 bp, Homo sapiens
cacagcagggcatggctgttgt

SEQ ID NO: 8344000 - DNA, 22 bp, Homo sapiens
cacagcaggcagaacgtgggca

SEQ ID NO: 8344001 - DNA, 22 bp, Homo sapiens
cacagcagggatgaatggagtg

SEQ ID NO: 8344002 - DNA, 22 bp, Homo sapiens
cacagccctgcgccccagtttg

SEQ ID NO: 8344003 - DNA, 22 bp, Homo sapiens
ggagctggccgcctatgtgcag

SEQ ID NO: 8344004 - DNA, 22 bp, Homo sapiens
ggaggagagaggttgcaaacac

SEQ ID NO: 8344005 - DNA, 22 bp, Homo sapiens
ggaggggccggctgcctgccac

SEQ ID NO: 8344006 - DNA, 22 bp, Homo sapiens
ggaggggccggctgcctgccac

SEQ ID NO: 8344007 - DNA, 22 bp, Homo sapiens
ggaggggcatagttcaccatca

SEQ ID NO: 8344008 - DNA, 22 bp, Homo sapiens
ggaggggccggctgcctgccac

SEQ ID NO: 8344009 - DNA, 22 bp, Homo sapiens
ggaggggcagccatggaactcc

SEQ ID NO: 8344010 - DNA, 22 bp, Homo sapiens
ggaggggcaggtcccaagttgt

SEQ ID NO: 8344011 - DNA, 22 bp, Homo sapiens
ggaggggcatagttcaccatca

SEQ ID NO: 8344012 - DNA, 22 bp, Homo sapiens
ggaggggcagccatggaactcc

SEQ ID NO: 8344013 - DNA, 19 bp, Homo sapiens
cacagctctgctcagggaa

SEQ ID NO: 8344014 - DNA, 22 bp, Homo sapiens
ggaggggatttagtagatgcta

SEQ ID NO: 8344015 - DNA, 22 bp, Homo sapiens
cacagcgtgtccctgcggatgc

SEQ ID NO: 8344016 - DNA, 22 bp, Homo sapiens
caaatttaagttagaaagcaat

SEQ ID NO: 8344017 - DNA, 22 bp, Homo sapiens
caaatttaagttagaaagcaat

SEQ ID NO: 8344018 - DNA, 22 bp, Homo sapiens
gctggcagagagctggtgagga

SEQ ID NO: 8344019 - DNA, 16 bp, Homo sapiens
gctggagggaggggtt

SEQ ID NO: 8344020 - DNA, 16 bp, Homo sapiens
gctggagggaggggtt

SEQ ID NO: 8344021 - DNA, 22 bp, Homo sapiens
gctgggccgacctgggctgcag

SEQ ID NO: 8344022 - DNA, 22 bp, Homo sapiens
gctgggccagccagacatgtga

SEQ ID NO: 8344023 - DNA, 22 bp, Homo sapiens
gctgggagccctggtctgctcc

SEQ ID NO: 8344024 - DNA, 19 bp, Homo sapiens
gctgggagcagaccctccc

SEQ ID NO: 8344025 - DNA, 22 bp, Homo sapiens
gctgggagcaaagccatgcata

SEQ ID NO: 8344026 - DNA, 22 bp, Homo sapiens
gctggtgctctgggccctgagg

SEQ ID NO: 8344027 - DNA, 22 bp, Homo sapiens
gctggtggcagagctccgcggc

SEQ ID NO: 8344028 - DNA, 22 bp, Homo sapiens
gctggtcctcaagggcacagcc

SEQ ID NO: 8344029 - DNA, 20 bp, Homo sapiens
caagtgttattgtgcattta

SEQ ID NO: 8344030 - DNA, 22 bp, Homo sapiens
caagttaattggtattttgatc

SEQ ID NO: 8344031 - DNA, 20 bp, Homo sapiens
gctgggctaccactggccct

SEQ ID NO: 8344032 - DNA, 22 bp, Homo sapiens
caagtcaatgattataagagtc

SEQ ID NO: 8344033 - DNA, 22 bp, Homo sapiens
ggaaatgtcatagaaatataag

SEQ ID NO: 8344034 - DNA, 17 bp, Homo sapiens
ggaaatgtacctctttt

SEQ ID NO: 8344035 - DNA, 22 bp, Homo sapiens
ggaacacagaagggctgaaaaa

SEQ ID NO: 8344036 - DNA, 22 bp, Homo sapiens
caatggaggtttactctgcagc

SEQ ID NO: 8344037 - DNA, 21 bp, Homo sapiens
cagagcagcgttctgctgtgg

SEQ ID NO: 8344038 - DNA, 17 bp, Homo sapiens
gggcgcgggtagagccc

SEQ ID NO: 8344039 - DNA, 17 bp, Homo sapiens
gggcgcgggtagagccc

SEQ ID NO: 8344040 - DNA, 18 bp, Homo sapiens
gggccctggcgtccgccc

SEQ ID NO: 8344041 - DNA, 22 bp, Homo sapiens
gggccctggccgaatccctctg

SEQ ID NO: 8344042 - DNA, 22 bp, Homo sapiens
gggccctggctttcctgttctt

SEQ ID NO: 8344043 - DNA, 20 bp, Homo sapiens
gggccctgggattcagagca

SEQ ID NO: 8344044 - DNA, 22 bp, Homo sapiens
gggccctgggattcagagcaag

SEQ ID NO: 8344045 - DNA, 22 bp, Homo sapiens
gggccctggctttcctgttctt

SEQ ID NO: 8344046 - DNA, 22 bp, Homo sapiens
cagagcagagtgattgttctgg

SEQ ID NO: 8344047 - DNA, 18 bp, Homo sapiens
cagagcagaggtggagcg

SEQ ID NO: 8344048 - DNA, 22 bp, Homo sapiens
gggccctggacgtggcggcaga

SEQ ID NO: 8344049 - DNA, 22 bp, Homo sapiens
gggccctggatttaagcatgga

SEQ ID NO: 8344050 - DNA, 22 bp, Homo sapiens
gggccctggccgaatccctctg

SEQ ID NO: 8344051 - DNA, 22 bp, Homo sapiens
gggccctgcgactcgcggcgga

SEQ ID NO: 8344052 - DNA, 22 bp, Homo sapiens
gggccctgcgtccggaagtctg

SEQ ID NO: 8344053 - DNA, 22 bp, Homo sapiens
cagagagagtggggtgtggatt

SEQ ID NO: 8344054 - DNA, 22 bp, Homo sapiens
cagagagaatatgtagtatgga

SEQ ID NO: 8344055 - DNA, 20 bp, Homo sapiens
cagagacctgtcttcacaga

SEQ ID NO: 8344056 - DNA, 22 bp, Homo sapiens
cagaagcagattctaaagcaag

SEQ ID NO: 8344057 - DNA, 23 bp, Homo sapiens
cagaagcacctgttgactgctgc

SEQ ID NO: 8344058 - DNA, 22 bp, Homo sapiens
ggggcggggctctgagaagcat

SEQ ID NO: 8344059 - DNA, 22 bp, Homo sapiens
cagaggacttcccactcatctg

SEQ ID NO: 8344060 - DNA, 22 bp, Homo sapiens
ggggcgctcggagggatcccct

SEQ ID NO: 8344061 - DNA, 22 bp, Homo sapiens
ggggcgctcggagggatcccct

SEQ ID NO: 8344062 - DNA, 22 bp, Homo sapiens
cagaggaccagaaaggggccca

SEQ ID NO: 8344063 - DNA, 22 bp, Homo sapiens
gggggcagaatgtactcttgtc

SEQ ID NO: 8344064 - DNA, 22 bp, Homo sapiens
gggggaggtgaatgcaataagg

SEQ ID NO: 8344065 - DNA, 22 bp, Homo sapiens
gggggatgctcaggaggctgct

SEQ ID NO: 8344066 - DNA, 22 bp, Homo sapiens
gggggcagtaacctcaaagtgt

SEQ ID NO: 8344067 - DNA, 22 bp, Homo sapiens
gggggcaggtctggaactttga

SEQ ID NO: 8344068 - DNA, 22 bp, Homo sapiens
gggggcagtaacctcaaagtgt

SEQ ID NO: 8344069 - DNA, 22 bp, Homo sapiens
cagaggcagaggtcatctctgg

SEQ ID NO: 8344070 - DNA, 22 bp, Homo sapiens
cagaggcagaccctccagggcg

SEQ ID NO: 8344071 - DNA, 22 bp, Homo sapiens
cagaggcaggaagatgggcagt

SEQ ID NO: 8344072 - DNA, 22 bp, Homo sapiens
gggctctgcgctcagctccagc

SEQ ID NO: 8344073 - DNA, 22 bp, Homo sapiens
gggctctgcgctcagctccagc

SEQ ID NO: 8344074 - DNA, 22 bp, Homo sapiens
gggctctgcctggctgggagta

SEQ ID NO: 8344075 - DNA, 22 bp, Homo sapiens
gggctctgcagtgacttgaggg

SEQ ID NO: 8344076 - DNA, 20 bp, Homo sapiens
gggctctgcatccatcagcc

SEQ ID NO: 8344077 - DNA, 22 bp, Homo sapiens
gggctctgcctggctgggagta

SEQ ID NO: 8344078 - DNA, 21 bp, Homo sapiens
gggctctgccctcctggagct

SEQ ID NO: 8344079 - DNA, 21 bp, Homo sapiens
gggctctgccctcctggagct

SEQ ID NO: 8344080 - DNA, 22 bp, Homo sapiens
cagaggaagagatacaagccct

SEQ ID NO: 8344081 - DNA, 22 bp, Homo sapiens
cagaggaaatgggaaggagata

SEQ ID NO: 8344082 - DNA, 18 bp, Homo sapiens
gggctctgatccttcacc

SEQ ID NO: 8344083 - DNA, 18 bp, Homo sapiens
gggctctgatccttcacc

SEQ ID NO: 8344084 - DNA, 22 bp, Homo sapiens
gggctctgcagtgacttgaggg

SEQ ID NO: 8344085 - DNA, 22 bp, Homo sapiens
gggctctgatagagattattgc

SEQ ID NO: 8344086 - DNA, 22 bp, Homo sapiens
gggctctgcacgttctggcgtc

SEQ ID NO: 8344087 - DNA, 22 bp, Homo sapiens
gggctctgcagagaactggctc

SEQ ID NO: 8344088 - DNA, 22 bp, Homo sapiens
gggctctgcagagaactggctc

SEQ ID NO: 8344089 - DNA, 22 bp, Homo sapiens
gggctctgcacgttctggcgtc

SEQ ID NO: 8344090 - DNA, 22 bp, Homo sapiens
gggctcagtctgcggcgcgcgg

SEQ ID NO: 8344091 - DNA, 22 bp, Homo sapiens
gggctcagtcggcaagcccctt

SEQ ID NO: 8344092 - DNA, 22 bp, Homo sapiens
gggctcagtcctggttctaccc

SEQ ID NO: 8344093 - DNA, 22 bp, Homo sapiens
gggctcagtctgcggcgcgcgg

SEQ ID NO: 8344094 - DNA, 22 bp, Homo sapiens
gggctcagtctggcgtggaatg

SEQ ID NO: 8344095 - DNA, 22 bp, Homo sapiens
gggctcaggagtttgaggctgc

SEQ ID NO: 8344096 - DNA, 22 bp, Homo sapiens
gggctcaggcctggcctctcac

SEQ ID NO: 8344097 - DNA, 22 bp, Homo sapiens
gggctcagggacacatgtgtgt

SEQ ID NO: 8344098 - DNA, 22 bp, Homo sapiens
gggctcaggtcagggcatcagc

SEQ ID NO: 8344099 - DNA, 22 bp, Homo sapiens
gtaacattttgagcagtaggct

SEQ ID NO: 8344100 - DNA, 22 bp, Homo sapiens
gtaagaggagtgggaagcctca

SEQ ID NO: 8344101 - DNA, 22 bp, Homo sapiens
cagcagactggagtaggcagtg

SEQ ID NO: 8344102 - DNA, 20 bp, Homo sapiens
cagcagagacccatggggag

SEQ ID NO: 8344103 - DNA, 22 bp, Homo sapiens
ggtgtcctttgggggctccgag

SEQ ID NO: 8344104 - DNA, 22 bp, Homo sapiens
ggtgtctcagctgctggcaggg

SEQ ID NO: 8344105 - DNA, 22 bp, Homo sapiens
ggtggcagtgcttgcgggtcta

SEQ ID NO: 8344106 - DNA, 22 bp, Homo sapiens
ggtggcagtagcactgggcctg

SEQ ID NO: 8344107 - DNA, 22 bp, Homo sapiens
ggtggcagggagtgtccctggg

SEQ ID NO: 8344108 - DNA, 22 bp, Homo sapiens
cagatggagtcccgtggagttc

SEQ ID NO: 8344109 - DNA, 22 bp, Homo sapiens
cagatggaaggcatagaggttt

SEQ ID NO: 8344110 - DNA, 22 bp, Homo sapiens
cagatggaacacagaaaggaga

SEQ ID NO: 8344111 - DNA, 22 bp, Homo sapiens
cagataaaggcttactagtagt

SEQ ID NO: 8344112 - DNA, 22 bp, Homo sapiens
cagataaaggcttactagtagt

SEQ ID NO: 8344113 - DNA, 22 bp, Homo sapiens
cagataaaggcttactagtagt

SEQ ID NO: 8344114 - DNA, 20 bp, Homo sapiens
cagataaacgggaaagaagc

SEQ ID NO: 8344115 - DNA, 22 bp, Homo sapiens
cagataaatagatagataaact

SEQ ID NO: 8344116 - DNA, 22 bp, Homo sapiens
cagataaatagatagataaact

SEQ ID NO: 8344117 - DNA, 22 bp, Homo sapiens
cagatacaggtttttgttagat

SEQ ID NO: 8344118 - DNA, 22 bp, Homo sapiens
cagatacattaaaatgatgatt

SEQ ID NO: 8344119 - DNA, 22 bp, Homo sapiens
cagatatattttccttattagg

SEQ ID NO: 8344120 - DNA, 22 bp, Homo sapiens
cagatatatattcatcaggctg

SEQ ID NO: 8344121 - DNA, 22 bp, Homo sapiens
cagatataaatggatgtggtag

SEQ ID NO: 8344122 - DNA, 22 bp, Homo sapiens
cagatataagaaagctattgtc

SEQ ID NO: 8344123 - DNA, 22 bp, Homo sapiens
cagatataagaaagctattgtc

SEQ ID NO: 8344124 - DNA, 22 bp, Homo sapiens
ggtgcagaagaaagcagtcatt

SEQ ID NO: 8344125 - DNA, 22 bp, Homo sapiens
ggtgcagagcagtgtcagagca

SEQ ID NO: 8344126 - DNA, 22 bp, Homo sapiens
ggtgcagaaggaagggagctgg

SEQ ID NO: 8344127 - DNA, 22 bp, Homo sapiens
ggtgcagaggagccagctgggg

SEQ ID NO: 8344128 - DNA, 22 bp, Homo sapiens
ggtgcagctggacagagaagcc

SEQ ID NO: 8344129 - DNA, 22 bp, Homo sapiens
cagagtgaaaactgagctcaaa

SEQ ID NO: 8344130 - DNA, 22 bp, Homo sapiens
cagagtgaaaactgagctcaaa

SEQ ID NO: 8344131 - DNA, 22 bp, Homo sapiens
ggggtgagctgggcctgtgcct

SEQ ID NO: 8344132 - DNA, 22 bp, Homo sapiens
ggggtgagatcaaggaagccct

SEQ ID NO: 8344133 - DNA, 22 bp, Homo sapiens
ggggtgagatcaaggaagccct

SEQ ID NO: 8344134 - DNA, 22 bp, Homo sapiens
ggggtctgggcttagctggaat

SEQ ID NO: 8344135 - DNA, 22 bp, Homo sapiens
ggggtctgctgcggagcagaga

SEQ ID NO: 8344136 - DNA, 22 bp, Homo sapiens
ggggtctgggttgctcggcctt

SEQ ID NO: 8344137 - DNA, 22 bp, Homo sapiens
ggggtcctggaggccagctgga

SEQ ID NO: 8344138 - DNA, 22 bp, Homo sapiens
ggggtctgcgccactgtctgcg

SEQ ID NO: 8344139 - DNA, 22 bp, Homo sapiens
ggggtcctcggagcctgggtct

SEQ ID NO: 8344140 - DNA, 22 bp, Homo sapiens
cagagtttcggtaagcatagaa

SEQ ID NO: 8344141 - DNA, 22 bp, Homo sapiens
cagagtgttagcgctggttggg

SEQ ID NO: 8344142 - DNA, 22 bp, Homo sapiens
cagagtgtttctttgggtgggt

SEQ ID NO: 8344143 - DNA, 16 bp, Homo sapiens
cagagtgtaaacagga

SEQ ID NO: 8344144 - DNA, 22 bp, Homo sapiens
cagagtggtgcaagggcagtgt

SEQ ID NO: 8344145 - DNA, 22 bp, Homo sapiens
cagagtgtattctgcagttgca

SEQ ID NO: 8344146 - DNA, 22 bp, Homo sapiens
cagagtgtggcatcttccaact

SEQ ID NO: 8344147 - DNA, 22 bp, Homo sapiens
cagagtgtatctgtgtaagcat

SEQ ID NO: 8344148 - DNA, 22 bp, Homo sapiens
cagagtgttgaccataagccca

SEQ ID NO: 8344149 - DNA, 22 bp, Homo sapiens
cagagtgggctgtcagccacca

SEQ ID NO: 8344150 - DNA, 22 bp, Homo sapiens
cagagtgggctgtcagccacca

SEQ ID NO: 8344151 - DNA, 22 bp, Homo sapiens
cagaggcaggataagaactgcg

SEQ ID NO: 8344152 - DNA, 22 bp, Homo sapiens
cagaggcctttctacagtgata

SEQ ID NO: 8344153 - DNA, 22 bp, Homo sapiens
cagaggctgagcagtcagtttg

SEQ ID NO: 8344154 - DNA, 22 bp, Homo sapiens
cagaggctgatgtgggatgggc

SEQ ID NO: 8344155 - DNA, 22 bp, Homo sapiens
ggggtagggtgattgtgaagta

SEQ ID NO: 8344156 - DNA, 22 bp, Homo sapiens
cagaggctgctctgggtggcat

SEQ ID NO: 8344157 - DNA, 22 bp, Homo sapiens
ggggtaggtcatagcccctcta

SEQ ID NO: 8344158 - DNA, 21 bp, Homo sapiens
ggggtatacctatgagatagt

SEQ ID NO: 8344159 - DNA, 22 bp, Homo sapiens
gtgaataagacctaaggatgaa

SEQ ID NO: 8344160 - DNA, 22 bp, Homo sapiens
gtgaataaagggagttttcaaa

SEQ ID NO: 8344161 - DNA, 22 bp, Homo sapiens
gtgaataacctactccaggcct

SEQ ID NO: 8344162 - DNA, 22 bp, Homo sapiens
gtgaaggtagactgggcttcct

SEQ ID NO: 8344163 - DNA, 22 bp, Homo sapiens
gtgaatcagctcacgaaaatgg

SEQ ID NO: 8344164 - DNA, 22 bp, Homo sapiens
gtgcaaaagtaattgcagtact

SEQ ID NO: 8344165 - DNA, 22 bp, Homo sapiens
gtgcagcttcctggtctcagcc

SEQ ID NO: 8344166 - DNA, 22 bp, Homo sapiens
gtgcagctgggcgctgaccttc

SEQ ID NO: 8344167 - DNA, 22 bp, Homo sapiens
gtgcagctgcaggagtcaggtc

SEQ ID NO: 8344168 - DNA, 22 bp, Homo sapiens
gtgaagtaagtactattaagat

SEQ ID NO: 8344169 - DNA, 22 bp, Homo sapiens
gtctctgtggctggctccttcc

SEQ ID NO: 8344170 - DNA, 22 bp, Homo sapiens
gtctctgtcatttcaccttccc

SEQ ID NO: 8344171 - DNA, 20 bp, Homo sapiens
gtctccactgggggttaacc

SEQ ID NO: 8344172 - DNA, 22 bp, Homo sapiens
gtctcagataacatgtattcta

SEQ ID NO: 8344173 - DNA, 22 bp, Homo sapiens
gtctcagattcagacatctaca

SEQ ID NO: 8344174 - DNA, 20 bp, Homo sapiens
gtctcagaatggatttgcat

SEQ ID NO: 8344175 - DNA, 22 bp, Homo sapiens
gtctcagagagctactctctta

SEQ ID NO: 8344176 - DNA, 22 bp, Homo sapiens
gtctcagaccaccctctttggc

SEQ ID NO: 8344177 - DNA, 22 bp, Homo sapiens
gtctcagagagctactctctta

SEQ ID NO: 8344178 - DNA, 22 bp, Homo sapiens
gtctcagagtcctacttattcc

SEQ ID NO: 8344179 - DNA, 22 bp, Homo sapiens
gtcctctgtgtaggctgcagac

SEQ ID NO: 8344180 - DNA, 22 bp, Homo sapiens
cagcagtctgtttcaacaggtc

SEQ ID NO: 8344181 - DNA, 22 bp, Homo sapiens
cagcagtggccatctgtgtggt

SEQ ID NO: 8344182 - DNA, 22 bp, Homo sapiens
cagcagagctgtgtgggaaggg

SEQ ID NO: 8344183 - DNA, 22 bp, Homo sapiens
cagcagggaagctgtgctgttt

SEQ ID NO: 8344184 - DNA, 22 bp, Homo sapiens
cagcaggtctcagcagctcctt

SEQ ID NO: 8344185 - DNA, 22 bp, Homo sapiens
cagctcccgccatcgggaggca

SEQ ID NO: 8344186 - DNA, 22 bp, Homo sapiens
cagctcctctggccagccctgc

SEQ ID NO: 8344187 - DNA, 22 bp, Homo sapiens
cagctctgatgaaatgtaccag

SEQ ID NO: 8344188 - DNA, 22 bp, Homo sapiens
cagctctgaggaacactccttt

SEQ ID NO: 8344189 - DNA, 22 bp, Homo sapiens
cagctctgaggaacactccttt

SEQ ID NO: 8344190 - DNA, 22 bp, Homo sapiens
cagctctgagactgaggctatg

SEQ ID NO: 8344191 - DNA, 21 bp, Homo sapiens
cagctctgagatttctactag

SEQ ID NO: 8344192 - DNA, 22 bp, Homo sapiens
cagccgtcagatgtgccgcagc

SEQ ID NO: 8344193 - DNA, 20 bp, Homo sapiens
cagccctttatcctcctatg

SEQ ID NO: 8344194 - DNA, 22 bp, Homo sapiens
cagcccttggctggctccttgc

SEQ ID NO: 8344195 - DNA, 22 bp, Homo sapiens
gtgccctgacacacctggtgtg

SEQ ID NO: 8344196 - DNA, 22 bp, Homo sapiens
gtgcattcaggggttgacagga

SEQ ID NO: 8344197 - DNA, 22 bp, Homo sapiens
cagctcccagtggcagctcctt

SEQ ID NO: 8344198 - DNA, 22 bp, Homo sapiens
cagctccccatggttcctgaag

SEQ ID NO: 8344199 - DNA, 22 bp, Homo sapiens
tccagggcatgctcagactcag

SEQ ID NO: 8344200 - DNA, 22 bp, Homo sapiens
tccagggcatgctcagactcag

SEQ ID NO: 8344201 - DNA, 23 bp, Homo sapiens
tccagggcagtggctgggtctgc

SEQ ID NO: 8344202 - DNA, 22 bp, Homo sapiens
tccagggccaagtcatggaacc

SEQ ID NO: 8344203 - DNA, 22 bp, Homo sapiens
tccagggcatggggagagagtg

SEQ ID NO: 8344204 - DNA, 21 bp, Homo sapiens
tccaggggccagcacccaagc

SEQ ID NO: 8344205 - DNA, 22 bp, Homo sapiens
tccaggggagtgctacgcacag

SEQ ID NO: 8344206 - DNA, 19 bp, Homo sapiens
tccaggggctccacctcct

SEQ ID NO: 8344207 - DNA, 22 bp, Homo sapiens
tccagggtcagaagtcacatac

SEQ ID NO: 8344208 - DNA, 22 bp, Homo sapiens
tccagggcagtgactacagcgg

SEQ ID NO: 8344209 - DNA, 23 bp, Homo sapiens
tccagggcagtggctgggtctgc

SEQ ID NO: 8344210 - DNA, 22 bp, Homo sapiens
tccagggcaggtgctgggctct

SEQ ID NO: 8344211 - DNA, 22 bp, Homo sapiens
cattacaaccccaaattacaaa

SEQ ID NO: 8344212 - DNA, 22 bp, Homo sapiens
cattaagtctgttaactggaga

SEQ ID NO: 8344213 - DNA, 22 bp, Homo sapiens
cattaagtctgttaactggaga

SEQ ID NO: 8344214 - DNA, 22 bp, Homo sapiens
cattacaaccccaaattacaaa

SEQ ID NO: 8344215 - DNA, 22 bp, Homo sapiens
cattacaaagttataaacagtt

SEQ ID NO: 8344216 - DNA, 22 bp, Homo sapiens
cattacaaagttataaacagtt

SEQ ID NO: 8344217 - DNA, 22 bp, Homo sapiens
catgtacagtttttctgtcctg

SEQ ID NO: 8344218 - DNA, 22 bp, Homo sapiens
catgtacatgcctactatcaat

SEQ ID NO: 8344219 - DNA, 23 bp, Homo sapiens
catgtacagagtttgataaagtg

SEQ ID NO: 8344220 - DNA, 23 bp, Homo sapiens
catgtacagagtttgataaagtg

SEQ ID NO: 8344221 - DNA, 22 bp, Homo sapiens
catgtacactcatgtaactata

SEQ ID NO: 8344222 - DNA, 23 bp, Homo sapiens
catgtacacacagctgtacagtg

SEQ ID NO: 8344223 - DNA, 23 bp, Homo sapiens
catgtacacacagctgtacagtg

SEQ ID NO: 8344224 - DNA, 22 bp, Homo sapiens
catgtacacacaaagggacaat

SEQ ID NO: 8344225 - DNA, 22 bp, Homo sapiens
catgtgggaagaggccagctgg

SEQ ID NO: 8344226 - DNA, 22 bp, Homo sapiens
tccaggctttttcatgctgtct

SEQ ID NO: 8344227 - DNA, 23 bp, Homo sapiens
catgtgcctgctgtgtggaagcc

SEQ ID NO: 8344228 - DNA, 22 bp, Homo sapiens
tccaggcttgagaccaggctct

SEQ ID NO: 8344229 - DNA, 22 bp, Homo sapiens
cattaagtatttcagttactgt

SEQ ID NO: 8344230 - DNA, 22 bp, Homo sapiens
catgtgggacaatctcaggtat

SEQ ID NO: 8344231 - DNA, 22 bp, Homo sapiens
catggtgggtgtagtttccgcc

SEQ ID NO: 8344232 - DNA, 22 bp, Homo sapiens
catggtgaggggtgaagggcag

SEQ ID NO: 8344233 - DNA, 22 bp, Homo sapiens
catgtaaagaatttcacacaag

SEQ ID NO: 8344234 - DNA, 22 bp, Homo sapiens
catgcttatatggaaaggaaga

SEQ ID NO: 8344235 - DNA, 22 bp, Homo sapiens
tccagcagaaaagaggtaggga

SEQ ID NO: 8344236 - DNA, 22 bp, Homo sapiens
tccagcagaaccagagacctgg

SEQ ID NO: 8344237 - DNA, 22 bp, Homo sapiens
tccaagaggagacactgggatg

SEQ ID NO: 8344238 - DNA, 22 bp, Homo sapiens
tccaagaagtcatctaaactgt

SEQ ID NO: 8344239 - DNA, 20 bp, Homo sapiens
tccaagagtgatgtttcata

SEQ ID NO: 8344240 - DNA, 22 bp, Homo sapiens
tccaagagtatagtttattggc

SEQ ID NO: 8344241 - DNA, 22 bp, Homo sapiens
catgctgagcacattctgtatt

SEQ ID NO: 8344242 - DNA, 22 bp, Homo sapiens
tcatcagggatattggcctgaa

SEQ ID NO: 8344243 - DNA, 20 bp, Homo sapiens
catgccagaatgtgaggtag

SEQ ID NO: 8344244 - DNA, 22 bp, Homo sapiens
catgccacgctgctgcaaggac

SEQ ID NO: 8344245 - DNA, 22 bp, Homo sapiens
catgccacgccgctgcaaggac

SEQ ID NO: 8344246 - DNA, 22 bp, Homo sapiens
catgctccaaaaacaagagaat

SEQ ID NO: 8344247 - DNA, 22 bp, Homo sapiens
tcatacaactaagagtttcaga

SEQ ID NO: 8344248 - DNA, 22 bp, Homo sapiens
tcataagtaatttaaacattcc

SEQ ID NO: 8344249 - DNA, 22 bp, Homo sapiens
tcatcactcattggacaacaga

SEQ ID NO: 8344250 - DNA, 22 bp, Homo sapiens
tcatcactgtatcattgataga

SEQ ID NO: 8344251 - DNA, 22 bp, Homo sapiens
tcatacataaataagagtttag

SEQ ID NO: 8344252 - DNA, 22 bp, Homo sapiens
tcatcacatatgtcatgatttg

SEQ ID NO: 8344253 - DNA, 22 bp, Homo sapiens
tcatcaaagtcaaagaatgact

SEQ ID NO: 8344254 - DNA, 19 bp, Homo sapiens
tcataaggagagaggaaat

SEQ ID NO: 8344255 - DNA, 22 bp, Homo sapiens
tcataacagctaagtccctttc

SEQ ID NO: 8344256 - DNA, 22 bp, Homo sapiens
catctaatacctcatttaatct

SEQ ID NO: 8344257 - DNA, 22 bp, Homo sapiens
tcagtgtgattaggctatctga

SEQ ID NO: 8344258 - DNA, 20 bp, Homo sapiens
tcagtgtggcggggacctca

SEQ ID NO: 8344259 - DNA, 22 bp, Homo sapiens
catcagtgaaagtgaatgttct

SEQ ID NO: 8344260 - DNA, 22 bp, Homo sapiens
catcagtgaaagtgaatgttct

SEQ ID NO: 8344261 - DNA, 22 bp, Homo sapiens
catcagtgcccttggggatgcc

SEQ ID NO: 8344262 - DNA, 20 bp, Homo sapiens
catcagtgcctgacaggtcc

SEQ ID NO: 8344263 - DNA, 22 bp, Homo sapiens
catcagtgagccccttgatgag

SEQ ID NO: 8344264 - DNA, 22 bp, Homo sapiens
catcagtgttcactattccttc

SEQ ID NO: 8344265 - DNA, 22 bp, Homo sapiens
catcagtgtgttgccttgctca

SEQ ID NO: 8344266 - DNA, 22 bp, Homo sapiens
catcagtgtctctctggtactt

SEQ ID NO: 8344267 - DNA, 22 bp, Homo sapiens
catcagtgtggcagttcactgt

SEQ ID NO: 8344268 - DNA, 22 bp, Homo sapiens
catcagtggtaactgaatggtt

SEQ ID NO: 8344269 - DNA, 22 bp, Homo sapiens
catcagcactatgattaaagta

SEQ ID NO: 8344270 - DNA, 22 bp, Homo sapiens
catcagcaggcaacactcttgg

SEQ ID NO: 8344271 - DNA, 22 bp, Homo sapiens
catcagcagtcacatgatgctg

SEQ ID NO: 8344272 - DNA, 22 bp, Homo sapiens
catcaaatgccatatatggttg

SEQ ID NO: 8344273 - DNA, 22 bp, Homo sapiens
catcaaataaagaaattccttg

SEQ ID NO: 8344274 - DNA, 22 bp, Homo sapiens
catcaaatactacatgggttgg

SEQ ID NO: 8344275 - DNA, 22 bp, Homo sapiens
catcaaaattagacattgttga

SEQ ID NO: 8344276 - DNA, 22 bp, Homo sapiens
tcaggcagaggatggggagcgt

SEQ ID NO: 8344277 - DNA, 22 bp, Homo sapiens
tcaggcagaccaccgtgggcag

SEQ ID NO: 8344278 - DNA, 22 bp, Homo sapiens
tcaggcagagctgtggagctct

SEQ ID NO: 8344279 - DNA, 22 bp, Homo sapiens
catcaagatggaagagcaaata

SEQ ID NO: 8344280 - DNA, 22 bp, Homo sapiens
cagtgtctacagtggctggagg

SEQ ID NO: 8344281 - DNA, 22 bp, Homo sapiens
tcacttattgctcatctcatgc

SEQ ID NO: 8344282 - DNA, 22 bp, Homo sapiens
tcacttagatggggatcatcac

SEQ ID NO: 8344283 - DNA, 22 bp, Homo sapiens
tctcagagaagtgatgagcaat

SEQ ID NO: 8344284 - DNA, 22 bp, Homo sapiens
tctcagagacctgaactccctg

SEQ ID NO: 8344285 - DNA, 22 bp, Homo sapiens
tctcaggaatagagtggcagca

SEQ ID NO: 8344286 - DNA, 22 bp, Homo sapiens
tctcaggaagattagggctaag

SEQ ID NO: 8344287 - DNA, 22 bp, Homo sapiens
tctatacaagtttcactttgac

SEQ ID NO: 8344288 - DNA, 21 bp, Homo sapiens
tctataatatgcaggtcatca

SEQ ID NO: 8344289 - DNA, 22 bp, Homo sapiens
tctataatggaaagtggatgtg

SEQ ID NO: 8344290 - DNA, 22 bp, Homo sapiens
tctataaattatgcagtctcag

SEQ ID NO: 8344291 - DNA, 21 bp, Homo sapiens
tctataactatagtgacagat

SEQ ID NO: 8344292 - DNA, 22 bp, Homo sapiens
tctagaatttgcgtaggttaga

SEQ ID NO: 8344293 - DNA, 22 bp, Homo sapiens
tctagaattcccttttgacaat

SEQ ID NO: 8344294 - DNA, 22 bp, Homo sapiens
tctataaatgcagatatgtgtg

SEQ ID NO: 8344295 - DNA, 22 bp, Homo sapiens
tctataaatgcagatatgtgtg

SEQ ID NO: 8344296 - DNA, 22 bp, Homo sapiens
tctagaatttgcgtaggttaga

SEQ ID NO: 8344297 - DNA, 21 bp, Homo sapiens
tctagaatcctgtataagact

SEQ ID NO: 8344298 - DNA, 22 bp, Homo sapiens
tctagaatggctgggcacagct

SEQ ID NO: 8344299 - DNA, 22 bp, Homo sapiens
tctcaggagtagtgggatccat

SEQ ID NO: 8344300 - DNA, 22 bp, Homo sapiens
tctcaggatctaatacatggta

SEQ ID NO: 8344301 - DNA, 17 bp, Homo sapiens
tctcaggcacgtgtggc

SEQ ID NO: 8344302 - DNA, 23 bp, Homo sapiens
tctcaggacacacatgtctatca

SEQ ID NO: 8344303 - DNA, 22 bp, Homo sapiens
ccaccctgagccgcaagagcag

SEQ ID NO: 8344304 - DNA, 18 bp, Homo sapiens
ccacccagggggagagga

SEQ ID NO: 8344305 - DNA, 22 bp, Homo sapiens
ccaccctgagccgcaagagcag

SEQ ID NO: 8344306 - DNA, 19 bp, Homo sapiens
tcctgttatggagcttagg

SEQ ID NO: 8344307 - DNA, 22 bp, Homo sapiens
tctaatgaggactttatagaga

SEQ ID NO: 8344308 - DNA, 22 bp, Homo sapiens
tctaatgcagttctgggtattt

SEQ ID NO: 8344309 - DNA, 22 bp, Homo sapiens
tctagaatcactgtttccatct

SEQ ID NO: 8344310 - DNA, 22 bp, Homo sapiens
tctagaatagattctgctgatc

SEQ ID NO: 8344311 - DNA, 22 bp, Homo sapiens
tctagaatactgtgacatgcca

SEQ ID NO: 8344312 - DNA, 22 bp, Homo sapiens
tctagaaagccaaattaggaat

SEQ ID NO: 8344313 - DNA, 22 bp, Homo sapiens
ccagagggccctggtctcagct

SEQ ID NO: 8344314 - DNA, 22 bp, Homo sapiens
tctctgggataaactgggccag

SEQ ID NO: 8344315 - DNA, 22 bp, Homo sapiens
ccagagcagggcagcagggctc

SEQ ID NO: 8344316 - DNA, 22 bp, Homo sapiens
ccagagccagagaggtgcctgc

SEQ ID NO: 8344317 - DNA, 22 bp, Homo sapiens
ccagagcccctgagcttccctg

SEQ ID NO: 8344318 - DNA, 22 bp, Homo sapiens
ccagagcccgggacctggactt

SEQ ID NO: 8344319 - DNA, 22 bp, Homo sapiens
ccagagcccgggacctggactt

SEQ ID NO: 8344320 - DNA, 22 bp, Homo sapiens
ccagagccggctccctcagctt

SEQ ID NO: 8344321 - DNA, 22 bp, Homo sapiens
ccagaggctgggttcacctcag

SEQ ID NO: 8344322 - DNA, 22 bp, Homo sapiens
ccagaggctgggttcacctcag

SEQ ID NO: 8344323 - DNA, 22 bp, Homo sapiens
ccagagcctaagatctgatcct

SEQ ID NO: 8344324 - DNA, 22 bp, Homo sapiens
ccagagcctcaacacaggtcct

SEQ ID NO: 8344325 - DNA, 22 bp, Homo sapiens
tccataagcaggttcttcctga

SEQ ID NO: 8344326 - DNA, 19 bp, Homo sapiens
tccataagcttgtgttcat

SEQ ID NO: 8344327 - DNA, 21 bp, Homo sapiens
tccataagagaccatctccta

SEQ ID NO: 8344328 - DNA, 22 bp, Homo sapiens
tccataaattttatgaacatat

SEQ ID NO: 8344329 - DNA, 22 bp, Homo sapiens
tccataaaccagaaaatcaaga

SEQ ID NO: 8344330 - DNA, 22 bp, Homo sapiens
tccatacccagctttctcacac

SEQ ID NO: 8344331 - DNA, 22 bp, Homo sapiens
tccatatacaacttaatcttta

SEQ ID NO: 8344332 - DNA, 22 bp, Homo sapiens
catttccccctcatgttgcagc

SEQ ID NO: 8344333 - DNA, 22 bp, Homo sapiens
catttcagtgttattctaattt

SEQ ID NO: 8344334 - DNA, 22 bp, Homo sapiens
catttcattcctttgaaagtgg

SEQ ID NO: 8344335 - DNA, 22 bp, Homo sapiens
cattttatgtttatggagtgct

SEQ ID NO: 8344336 - DNA, 22 bp, Homo sapiens
cattttcagcacccatctgaaa

SEQ ID NO: 8344337 - DNA, 22 bp, Homo sapiens
catttgtctctaggaagtgagg

SEQ ID NO: 8344338 - DNA, 22 bp, Homo sapiens
catttgtcatcactgagctgcc

SEQ ID NO: 8344339 - DNA, 22 bp, Homo sapiens
catttctagggatcataaagta

SEQ ID NO: 8344340 - DNA, 22 bp, Homo sapiens
tcctgagggctcggggctcatg

SEQ ID NO: 8344341 - DNA, 22 bp, Homo sapiens
ccaaaaattagatacacatata

SEQ ID NO: 8344342 - DNA, 22 bp, Homo sapiens
tcctgagaaggcacagcttgca

SEQ ID NO: 8344343 - DNA, 19 bp, Homo sapiens
cattttctcattgtgcccc

SEQ ID NO: 8344344 - DNA, 22 bp, Homo sapiens
cattttgtagcaatgactgttg

SEQ ID NO: 8344345 - DNA, 22 bp, Homo sapiens
ccaacaacatagggctagttgg

SEQ ID NO: 8344346 - DNA, 23 bp, Homo sapiens
ccaagactgttaggagtggggag

SEQ ID NO: 8344347 - DNA, 22 bp, Homo sapiens
tcctgcccagagctctccactc

SEQ ID NO: 8344348 - DNA, 22 bp, Homo sapiens
tcctgcccagagctctccactc

SEQ ID NO: 8344349 - DNA, 21 bp, Homo sapiens
ccacaggggctcccctgtcag

SEQ ID NO: 8344350 - DNA, 22 bp, Homo sapiens
ccacagggctctaggcgcttcc

SEQ ID NO: 8344351 - DNA, 16 bp, Homo sapiens
ccacagggcaaggggc

SEQ ID NO: 8344352 - DNA, 22 bp, Homo sapiens
ccacagggcctttcctgctggc

SEQ ID NO: 8344353 - DNA, 22 bp, Homo sapiens
tcctggaggacagaggcatctc

SEQ ID NO: 8344354 - DNA, 22 bp, Homo sapiens
tagcatctgttctttcattaaa

SEQ ID NO: 8344355 - DNA, 22 bp, Homo sapiens
tagcatctttttctgtcttcta

SEQ ID NO: 8344356 - DNA, 21 bp, Homo sapiens
tagcatctctactgtcataga

SEQ ID NO: 8344357 - DNA, 22 bp, Homo sapiens
tagcatgtcagtcgccacacgt

SEQ ID NO: 8344358 - DNA, 22 bp, Homo sapiens
tagcagtgttgccgttggctgc

SEQ ID NO: 8344359 - DNA, 22 bp, Homo sapiens
tagcataacaggtaagagtgag

SEQ ID NO: 8344360 - DNA, 22 bp, Homo sapiens
tagcatagtttggaaatgcagg

SEQ ID NO: 8344361 - DNA, 22 bp, Homo sapiens
cagggcatccgtgctccatgct

SEQ ID NO: 8344362 - DNA, 22 bp, Homo sapiens
cagggccaagctgcagcatctg

SEQ ID NO: 8344363 - DNA, 22 bp, Homo sapiens
cagggatggcctggcgggccac

SEQ ID NO: 8344364 - DNA, 22 bp, Homo sapiens
cagggatgagcagatggagcaa

SEQ ID NO: 8344365 - DNA, 22 bp, Homo sapiens
cagggagcggagtcccatgcct

SEQ ID NO: 8344366 - DNA, 22 bp, Homo sapiens
cagggatgaccagagggatgtg

SEQ ID NO: 8344367 - DNA, 22 bp, Homo sapiens
tagaacagtataggctaaacat

SEQ ID NO: 8344368 - DNA, 22 bp, Homo sapiens
tagaacagcatttggctattaa

SEQ ID NO: 8344369 - DNA, 22 bp, Homo sapiens
tagaaatgtcgtctccacattt

SEQ ID NO: 8344370 - DNA, 22 bp, Homo sapiens
tagaaagcagtatctccatttt

SEQ ID NO: 8344371 - DNA, 22 bp, Homo sapiens
tagaaagcatgcaagtttgatg

SEQ ID NO: 8344372 - DNA, 22 bp, Homo sapiens
tagaaagcagttgtgggggctc

SEQ ID NO: 8344373 - DNA, 22 bp, Homo sapiens
tagaacaatgaatttctggagg

SEQ ID NO: 8344374 - DNA, 22 bp, Homo sapiens
tagaaatgttggtattaacatt

SEQ ID NO: 8344375 - DNA, 22 bp, Homo sapiens
tagaaatgttggtattaacatt

SEQ ID NO: 8344376 - DNA, 22 bp, Homo sapiens
tagacatttggagttttatgac

SEQ ID NO: 8344377 - DNA, 22 bp, Homo sapiens
tagacatttctggttattgaca

SEQ ID NO: 8344378 - DNA, 22 bp, Homo sapiens
tagacagttaaactactggtgg

SEQ ID NO: 8344379 - DNA, 22 bp, Homo sapiens
tagacagtgagctatgagtggt

SEQ ID NO: 8344380 - DNA, 22 bp, Homo sapiens
tagacatagtttttatgactta

SEQ ID NO: 8344381 - DNA, 22 bp, Homo sapiens
tagaaagcaaaatcctaccaag

SEQ ID NO: 8344382 - DNA, 22 bp, Homo sapiens
tagaaagcagaaaccatcagag

SEQ ID NO: 8344383 - DNA, 22 bp, Homo sapiens
tagaaagagcatagtattataa

SEQ ID NO: 8344384 - DNA, 22 bp, Homo sapiens
tagaaacaagggagaggattct

SEQ ID NO: 8344385 - DNA, 22 bp, Homo sapiens
tagaaacaagggagaggattct

SEQ ID NO: 8344386 - DNA, 22 bp, Homo sapiens
tagaaagacaatgggaagtgct

SEQ ID NO: 8344387 - DNA, 22 bp, Homo sapiens
tagaaacaagtttctctttggg

SEQ ID NO: 8344388 - DNA, 22 bp, Homo sapiens
caggctgcaagaaaggcattca

SEQ ID NO: 8344389 - DNA, 22 bp, Homo sapiens
caggctgcagcagcagtggccc

SEQ ID NO: 8344390 - DNA, 22 bp, Homo sapiens
taccccaagagtgtctgccatg

SEQ ID NO: 8344391 - DNA, 22 bp, Homo sapiens
tacagagaactcatagaaagaa

SEQ ID NO: 8344392 - DNA, 22 bp, Homo sapiens
tacagagaataataggacaggt

SEQ ID NO: 8344393 - DNA, 22 bp, Homo sapiens
tacagagaactcatagaaagaa

SEQ ID NO: 8344394 - DNA, 22 bp, Homo sapiens
tacactggccaaatgcctttgg

SEQ ID NO: 8344395 - DNA, 22 bp, Homo sapiens
caggccaatatcacatgctatg

SEQ ID NO: 8344396 - DNA, 22 bp, Homo sapiens
caggccaatttcttgtcattta

SEQ ID NO: 8344397 - DNA, 22 bp, Homo sapiens
caggccccattcctcttgggac

SEQ ID NO: 8344398 - DNA, 22 bp, Homo sapiens
caggcccaggggtctggcccac

SEQ ID NO: 8344399 - DNA, 22 bp, Homo sapiens
caggccctgcactaggccctgg

SEQ ID NO: 8344400 - DNA, 22 bp, Homo sapiens
caggccctgcactaggccctgg

SEQ ID NO: 8344401 - DNA, 22 bp, Homo sapiens
caggccctcgtggtgagctggg

SEQ ID NO: 8344402 - DNA, 22 bp, Homo sapiens
caggccctctgcaccctcgtct

SEQ ID NO: 8344403 - DNA, 22 bp, Homo sapiens
caggccctgcacagtggtcctg

SEQ ID NO: 8344404 - DNA, 22 bp, Homo sapiens
caggccctgaggattcggcggg

SEQ ID NO: 8344405 - DNA, 22 bp, Homo sapiens
caggccctcgcccgcagcgacc

SEQ ID NO: 8344406 - DNA, 22 bp, Homo sapiens
caggccctcctgtgatctgcct

SEQ ID NO: 8344407 - DNA, 22 bp, Homo sapiens
tacacagatttcagtatcatca

SEQ ID NO: 8344408 - DNA, 22 bp, Homo sapiens
tacacaggggagcatggttgac

SEQ ID NO: 8344409 - DNA, 22 bp, Homo sapiens
tacacagggaaaggtctcagag

SEQ ID NO: 8344410 - DNA, 22 bp, Homo sapiens
caggccaaaattcaggcattct

SEQ ID NO: 8344411 - DNA, 22 bp, Homo sapiens
tacacagggtatggcttgagga

SEQ ID NO: 8344412 - DNA, 22 bp, Homo sapiens
caggccaataaatgtgatggcc

SEQ ID NO: 8344413 - DNA, 22 bp, Homo sapiens
tacacagatatgtgatcaatca

SEQ ID NO: 8344414 - DNA, 20 bp, Homo sapiens
gtggagaggctggcgggact

SEQ ID NO: 8344415 - DNA, 22 bp, Homo sapiens
cagctctgcctctggggctgag

SEQ ID NO: 8344416 - DNA, 22 bp, Homo sapiens
cagctctgctgggaggatgcag

SEQ ID NO: 8344417 - DNA, 22 bp, Homo sapiens
cagctctgccacttcctagcta

SEQ ID NO: 8344418 - DNA, 17 bp, Homo sapiens
cagctctgcatcttcct

SEQ ID NO: 8344419 - DNA, 17 bp, Homo sapiens
cagctctgcatcttcct

SEQ ID NO: 8344420 - DNA, 22 bp, Homo sapiens
cagctctgccacttcctagcta

SEQ ID NO: 8344421 - DNA, 22 bp, Homo sapiens
cagctctgccacttcctagcta

SEQ ID NO: 8344422 - DNA, 22 bp, Homo sapiens
cagctctgccatcatctgcctt

SEQ ID NO: 8344423 - DNA, 22 bp, Homo sapiens
tacagcgaaaatttagcttgat

SEQ ID NO: 8344424 - DNA, 22 bp, Homo sapiens
tacagcgatcagtgtcattagc

SEQ ID NO: 8344425 - DNA, 22 bp, Homo sapiens
tacagcattgtgtcttcactca

SEQ ID NO: 8344426 - DNA, 22 bp, Homo sapiens
tacagagagctccggacattca

SEQ ID NO: 8344427 - DNA, 20 bp, Homo sapiens
tacagagagctagctctctg

SEQ ID NO: 8344428 - DNA, 22 bp, Homo sapiens
tacagcagggcgctgtgatgaa

SEQ ID NO: 8344429 - DNA, 22 bp, Homo sapiens
tacagcatgtccttagcaaggc

SEQ ID NO: 8344430 - DNA, 22 bp, Homo sapiens
tacagagagataagtgtaaaag

SEQ ID NO: 8344431 - DNA, 20 bp, Homo sapiens
tacagagagctagctctctg

SEQ ID NO: 8344432 - DNA, 22 bp, Homo sapiens
tacagagagaggggttaccagg

SEQ ID NO: 8344433 - DNA, 22 bp, Homo sapiens
tacagttactttgaaaattgat

SEQ ID NO: 8344434 - DNA, 17 bp, Homo sapiens
tacagttagaatctgga

SEQ ID NO: 8344435 - DNA, 22 bp, Homo sapiens
tacagttagcctgtctactccc

SEQ ID NO: 8344436 - DNA, 22 bp, Homo sapiens
tacagttatatgtgataagtaa

SEQ ID NO: 8344437 - DNA, 22 bp, Homo sapiens
caggctcggaagtgctggcttt

SEQ ID NO: 8344438 - DNA, 22 bp, Homo sapiens
caggctcctcactcatgctccc

SEQ ID NO: 8344439 - DNA, 22 bp, Homo sapiens
caggctccctgccagggccggc

SEQ ID NO: 8344440 - DNA, 22 bp, Homo sapiens
tacagttagtgcctggctactt

SEQ ID NO: 8344441 - DNA, 23 bp, Homo sapiens
tacagttatgttcctgggtcact

SEQ ID NO: 8344442 - DNA, 22 bp, Homo sapiens
tacagtttagaaccatagatgg

SEQ ID NO: 8344443 - DNA, 22 bp, Homo sapiens
tacagtttcccagcagatgcaa

SEQ ID NO: 8344444 - DNA, 22 bp, Homo sapiens
tacagtttctcattatgctctc

SEQ ID NO: 8344445 - DNA, 22 bp, Homo sapiens
tcacacatttctcaagtgtagg

SEQ ID NO: 8344446 - DNA, 22 bp, Homo sapiens
cagtgcagttggtggcaggggt

SEQ ID NO: 8344447 - DNA, 22 bp, Homo sapiens
cagtgcaggtttagggctgggg

SEQ ID NO: 8344448 - DNA, 22 bp, Homo sapiens
cagtgcaggtggcagaggacag

SEQ ID NO: 8344449 - DNA, 22 bp, Homo sapiens
tcacacgtgaggttctatcctg

SEQ ID NO: 8344450 - DNA, 22 bp, Homo sapiens
tcacacgtccttgctactcctc

SEQ ID NO: 8344451 - DNA, 19 bp, Homo sapiens
cagtggagattggaggagg

SEQ ID NO: 8344452 - DNA, 22 bp, Homo sapiens
cagtggaggccttgggaccttt

SEQ ID NO: 8344453 - DNA, 22 bp, Homo sapiens
tcactgcaaggaggcttctcaa

SEQ ID NO: 8344454 - DNA, 22 bp, Homo sapiens
tcactgcaatctctgccttcca

SEQ ID NO: 8344455 - DNA, 21 bp, Homo sapiens
tcactgcaatgctaggagaaa

SEQ ID NO: 8344456 - DNA, 22 bp, Homo sapiens
tcactgcactaggtaatgccac

SEQ ID NO: 8344457 - DNA, 22 bp, Homo sapiens
tcactgcagcctctgcctcccg

SEQ ID NO: 8344458 - DNA, 22 bp, Homo sapiens
tcactgcatcccatctccagcc

SEQ ID NO: 8344459 - DNA, 22 bp, Homo sapiens
tcactgcaggtttttcaggagg

SEQ ID NO: 8344460 - DNA, 22 bp, Homo sapiens
cagtgggtgatgagtcctgggg

SEQ ID NO: 8344461 - DNA, 22 bp, Homo sapiens
cagtgggtcctgcgtctgccag

SEQ ID NO: 8344462 - DNA, 22 bp, Homo sapiens
tcactgcaagctcctcctcctg

SEQ ID NO: 8344463 - DNA, 22 bp, Homo sapiens
tcactgcaagctctgccttccg

SEQ ID NO: 8344464 - DNA, 22 bp, Homo sapiens
tcactgcaacctctgccttccg

SEQ ID NO: 8344465 - DNA, 22 bp, Homo sapiens
tcactgcaagctccacctcccg

SEQ ID NO: 8344466 - DNA, 22 bp, Homo sapiens
tcactgcaacctctgcctcccg

SEQ ID NO: 8344467 - DNA, 22 bp, Homo sapiens
tcactcctcattgctgcccatt

SEQ ID NO: 8344468 - DNA, 22 bp, Homo sapiens
cagtacttttcaaccagtatga

SEQ ID NO: 8344469 - DNA, 22 bp, Homo sapiens
cagtacttttctggctttctac

SEQ ID NO: 8344470 - DNA, 22 bp, Homo sapiens
cagtactttgcatcattccact

SEQ ID NO: 8344471 - DNA, 22 bp, Homo sapiens
cagtacttgtcctcaggtgtta

SEQ ID NO: 8344472 - DNA, 22 bp, Homo sapiens
cagtactttgaagatattttag

SEQ ID NO: 8344473 - DNA, 22 bp, Homo sapiens
cagtacttggtcaaggaagcag

SEQ ID NO: 8344474 - DNA, 22 bp, Homo sapiens
tcaaaagaaacaccatgttcct

SEQ ID NO: 8344475 - DNA, 22 bp, Homo sapiens
cagtgaacttgagtacttcatt

SEQ ID NO: 8344476 - DNA, 22 bp, Homo sapiens
tcaaattagtggaataataatg

SEQ ID NO: 8344477 - DNA, 22 bp, Homo sapiens
cagtcccagctgctcagaaggc

SEQ ID NO: 8344478 - DNA, 22 bp, Homo sapiens
cagtccctagtggagctcacag

SEQ ID NO: 8344479 - DNA, 22 bp, Homo sapiens
cagtccctgggggagtcaccag

SEQ ID NO: 8344480 - DNA, 22 bp, Homo sapiens
cagtcctcagtgagtgatcctg

SEQ ID NO: 8344481 - DNA, 22 bp, Homo sapiens
tatatatatgcacacacaccta

SEQ ID NO: 8344482 - DNA, 22 bp, Homo sapiens
tatatagaaaagcagatgttgg

SEQ ID NO: 8344483 - DNA, 18 bp, Homo sapiens
tatatagagaaacccatt

SEQ ID NO: 8344484 - DNA, 22 bp, Homo sapiens
tatataattttctgccatatcc

SEQ ID NO: 8344485 - DNA, 22 bp, Homo sapiens
tagttttagtcccattttacag

SEQ ID NO: 8344486 - DNA, 22 bp, Homo sapiens
tagtgtcttcaggagatatgag

SEQ ID NO: 8344487 - DNA, 21 bp, Homo sapiens
tagtgtcttaagagccttgca

SEQ ID NO: 8344488 - DNA, 22 bp, Homo sapiens
tagtttctagacagtaagaatt

SEQ ID NO: 8344489 - DNA, 22 bp, Homo sapiens
tagtgttcagctttatttccag

SEQ ID NO: 8344490 - DNA, 22 bp, Homo sapiens
tagtttctttcacgtagtaata

SEQ ID NO: 8344491 - DNA, 22 bp, Homo sapiens
tagtttcttcacctgtaaaatg

SEQ ID NO: 8344492 - DNA, 22 bp, Homo sapiens
tagtaaattaaaatattgactt

SEQ ID NO: 8344493 - DNA, 22 bp, Homo sapiens
tagtaaattaaaatattgactt

SEQ ID NO: 8344494 - DNA, 21 bp, Homo sapiens
cagggccaatcctgacctcta

SEQ ID NO: 8344495 - DNA, 20 bp, Homo sapiens
cagggccacgctccaaggca

SEQ ID NO: 8344496 - DNA, 22 bp, Homo sapiens
cagggccaccctctgctgggtg

SEQ ID NO: 8344497 - DNA, 22 bp, Homo sapiens
tagtacagtggagagcaaagaa

SEQ ID NO: 8344498 - DNA, 22 bp, Homo sapiens
tagtacagtgctctgtaagttt

SEQ ID NO: 8344499 - DNA, 22 bp, Homo sapiens
cagggctgaggacacaagtaaa

SEQ ID NO: 8344500 - DNA, 22 bp, Homo sapiens
tagtgattctgtgagcctttac

SEQ ID NO: 8344501 - DNA, 22 bp, Homo sapiens
caggtgggctgcctctccagct

SEQ ID NO: 8344502 - DNA, 22 bp, Homo sapiens
caggtgggcttgggagaacact

SEQ ID NO: 8344503 - DNA, 22 bp, Homo sapiens
caggtggggcgccctcaggcag

SEQ ID NO: 8344504 - DNA, 22 bp, Homo sapiens
tatgtacatcgttgaattcaaa

SEQ ID NO: 8344505 - DNA, 22 bp, Homo sapiens
caggtggggagagtgtggagca

SEQ ID NO: 8344506 - DNA, 22 bp, Homo sapiens
caggtggggcagctgtgggagc

SEQ ID NO: 8344507 - DNA, 22 bp, Homo sapiens
tatgtacatggagagcaattga

SEQ ID NO: 8344508 - DNA, 22 bp, Homo sapiens
tatgtacatgatttcatttgct

SEQ ID NO: 8344509 - DNA, 22 bp, Homo sapiens
tatgtacatcttgagcaatgaa

SEQ ID NO: 8344510 - DNA, 22 bp, Homo sapiens
cagtacttagttctcatggttt

SEQ ID NO: 8344511 - DNA, 22 bp, Homo sapiens
cagtacttaacttataggagag

SEQ ID NO: 8344512 - DNA, 23 bp, Homo sapiens
cagtacttagtgtagcgttaatt

SEQ ID NO: 8344513 - DNA, 22 bp, Homo sapiens
cagtacttgggaatgctgggga

SEQ ID NO: 8344514 - DNA, 22 bp, Homo sapiens
cagtacttggggggttctaagt

SEQ ID NO: 8344515 - DNA, 22 bp, Homo sapiens
cagtacttcttggaaactggat

SEQ ID NO: 8344516 - DNA, 22 bp, Homo sapiens
cagtacttatttctatttaggg

SEQ ID NO: 8344517 - DNA, 22 bp, Homo sapiens
cagtaaaagatggaaatagaat

SEQ ID NO: 8344518 - DNA, 22 bp, Homo sapiens
tatgatttgtagacatttgatt

SEQ ID NO: 8344519 - DNA, 22 bp, Homo sapiens
tatgatattctaaattgacacc

SEQ ID NO: 8344520 - DNA, 21 bp, Homo sapiens
tatgaacatgaccaatagtcc

SEQ ID NO: 8344521 - DNA, 21 bp, Homo sapiens
tatgaacatgaccaatagtcc

SEQ ID NO: 8344522 - DNA, 22 bp, Homo sapiens
tatattctttcaccttcttcct

SEQ ID NO: 8344523 - DNA, 22 bp, Homo sapiens
tatattgaccagtacaattggt

SEQ ID NO: 8344524 - DNA, 22 bp, Homo sapiens
tatattcttaccagtgtatgta

SEQ ID NO: 8344525 - DNA, 18 bp, Homo sapiens
tatattctgtgccctggt

SEQ ID NO: 8344526 - DNA, 22 bp, Homo sapiens
tatattctgattccatctgtgt

SEQ ID NO: 8344527 - DNA, 22 bp, Homo sapiens
tatattctgattccatctgtgt

SEQ ID NO: 8344528 - DNA, 22 bp, Homo sapiens
tatattctattgtacctctcct

SEQ ID NO: 8344529 - DNA, 22 bp, Homo sapiens
ccaggagcaccaggcctgtgcc

SEQ ID NO: 8344530 - DNA, 22 bp, Homo sapiens
ccaggagccactcaggcccaca

SEQ ID NO: 8344531 - DNA, 22 bp, Homo sapiens
ccaggagcattaagagaacata

SEQ ID NO: 8344532 - DNA, 20 bp, Homo sapiens
tctgttattgcatgtacata

SEQ ID NO: 8344533 - DNA, 22 bp, Homo sapiens
tctgttcatagtagtgtatatg

SEQ ID NO: 8344534 - DNA, 22 bp, Homo sapiens
tctgttcatcatctggacacat

SEQ ID NO: 8344535 - DNA, 22 bp, Homo sapiens
tctgttcagttgattagacaga

SEQ ID NO: 8344536 - DNA, 22 bp, Homo sapiens
tctgttcttctccactgtatgt

SEQ ID NO: 8344537 - DNA, 22 bp, Homo sapiens
tctgttcttgcttttctccaac

SEQ ID NO: 8344538 - DNA, 22 bp, Homo sapiens
tctgttcttctccactgtatgt

SEQ ID NO: 8344539 - DNA, 22 bp, Homo sapiens
tctgttctaagcattctatgtg

SEQ ID NO: 8344540 - DNA, 22 bp, Homo sapiens
tctggggagcagccctggtgag

SEQ ID NO: 8344541 - DNA, 22 bp, Homo sapiens
tctggggagtgcctaagtggaa

SEQ ID NO: 8344542 - DNA, 22 bp, Homo sapiens
ccaggagcaacttgaaggcaag

SEQ ID NO: 8344543 - DNA, 22 bp, Homo sapiens
ccagcactcctgtctcaagtct

SEQ ID NO: 8344544 - DNA, 22 bp, Homo sapiens
tctgggaggctgggtcccgtcc

SEQ ID NO: 8344545 - DNA, 22 bp, Homo sapiens
ccaggcagagggatccccatcc

SEQ ID NO: 8344546 - DNA, 20 bp, Homo sapiens
tcttacaatcgttacatcca

SEQ ID NO: 8344547 - DNA, 22 bp, Homo sapiens
tcttacatatacgtcatttagt

SEQ ID NO: 8344548 - DNA, 22 bp, Homo sapiens
tcttacatatagcatgagtaca

SEQ ID NO: 8344549 - DNA, 22 bp, Homo sapiens
ccaggaggctctgactggaccc

SEQ ID NO: 8344550 - DNA, 22 bp, Homo sapiens
ccaggaggcggaggttgcagtg

SEQ ID NO: 8344551 - DNA, 22 bp, Homo sapiens
ccaggaggcttcgtccgtggag

SEQ ID NO: 8344552 - DNA, 22 bp, Homo sapiens
ccaggcagaatgaaacccctgt

SEQ ID NO: 8344553 - DNA, 22 bp, Homo sapiens
ccaggcagcctgctccattctg

SEQ ID NO: 8344554 - DNA, 22 bp, Homo sapiens
ccaggcagccaagtgtgtgtgt

SEQ ID NO: 8344555 - DNA, 22 bp, Homo sapiens
ccaggcaggcgatggtgcagtg

SEQ ID NO: 8344556 - DNA, 22 bp, Homo sapiens
ccaggcaggcgatggtgcagtg

SEQ ID NO: 8344557 - DNA, 22 bp, Homo sapiens
ccaggcccgttcccttctccag

SEQ ID NO: 8344558 - DNA, 22 bp, Homo sapiens
tcttagaagtttatggcacgga

SEQ ID NO: 8344559 - DNA, 22 bp, Homo sapiens
tcttctctcctgcttggcagaa

SEQ ID NO: 8344560 - DNA, 17 bp, Homo sapiens
tcttctcttccagtctt

SEQ ID NO: 8344561 - DNA, 22 bp, Homo sapiens
tcttctggatcgatcacattgt

SEQ ID NO: 8344562 - DNA, 22 bp, Homo sapiens
ccagggctctgcttctgccatg

SEQ ID NO: 8344563 - DNA, 22 bp, Homo sapiens
ccagggctctgcttctgccatg

SEQ ID NO: 8344564 - DNA, 22 bp, Homo sapiens
ccagggctgccgcatccctggt

SEQ ID NO: 8344565 - DNA, 23 bp, Homo sapiens
ccagggcccctacaccactgtcc

SEQ ID NO: 8344566 - DNA, 22 bp, Homo sapiens
tgaagtatacaggctctgctaa

SEQ ID NO: 8344567 - DNA, 22 bp, Homo sapiens
ccagggcatcctcacatcgcag

SEQ ID NO: 8344568 - DNA, 22 bp, Homo sapiens
ccagggcatcacatccagtgtt

SEQ ID NO: 8344569 - DNA, 22 bp, Homo sapiens
tgaaatgatcagtttggttact

SEQ ID NO: 8344570 - DNA, 22 bp, Homo sapiens
tgaaatgatatctgataacaaa

SEQ ID NO: 8344571 - DNA, 22 bp, Homo sapiens
tgaaatgagcatttattcttta

SEQ ID NO: 8344572 - DNA, 22 bp, Homo sapiens
tgaaatgatatctgataacaaa

SEQ ID NO: 8344573 - DNA, 22 bp, Homo sapiens
tgaaatgagatagataatcagg

SEQ ID NO: 8344574 - DNA, 22 bp, Homo sapiens
tgaaatgagatagataatcagg

SEQ ID NO: 8344575 - DNA, 22 bp, Homo sapiens
tgaaatgagataatttaagtgc

SEQ ID NO: 8344576 - DNA, 22 bp, Homo sapiens
ccagggagtttccaatctgaga

SEQ ID NO: 8344577 - DNA, 22 bp, Homo sapiens
ccagggcaataggaacactttt

SEQ ID NO: 8344578 - DNA, 22 bp, Homo sapiens
ccagggcaaatgagatcatagc

SEQ ID NO: 8344579 - DNA, 22 bp, Homo sapiens
ccagggcaacgctgtctcagag

SEQ ID NO: 8344580 - DNA, 22 bp, Homo sapiens
ccagggcacgttgggacagtac

SEQ ID NO: 8344581 - DNA, 22 bp, Homo sapiens
ccagggcaggagaaagactcac

SEQ ID NO: 8344582 - DNA, 22 bp, Homo sapiens
ccagggcagggaccacgtgtct

SEQ ID NO: 8344583 - DNA, 22 bp, Homo sapiens
tcttgcacttcatgaatatgtt

SEQ ID NO: 8344584 - DNA, 22 bp, Homo sapiens
ccaggcctgattgggaatcttg

SEQ ID NO: 8344585 - DNA, 22 bp, Homo sapiens
tcttttcttgcattattgcact

SEQ ID NO: 8344586 - DNA, 22 bp, Homo sapiens
tcttttgtcatagagcatggta

SEQ ID NO: 8344587 - DNA, 22 bp, Homo sapiens
tcttttgtcggtgtatcatgga

SEQ ID NO: 8344588 - DNA, 22 bp, Homo sapiens
tcttttgtactcagtattgaca

SEQ ID NO: 8344589 - DNA, 22 bp, Homo sapiens
tcttgcatacactatatgtaca

SEQ ID NO: 8344590 - DNA, 22 bp, Homo sapiens
tcttttctggactctgcatgga

SEQ ID NO: 8344591 - DNA, 22 bp, Homo sapiens
tcttttcttcttaatggttaat

SEQ ID NO: 8344592 - DNA, 22 bp, Homo sapiens
tcttttctgtaactcagtgtct

SEQ ID NO: 8344593 - DNA, 22 bp, Homo sapiens
tcttttgtgattctttagttac

SEQ ID NO: 8344594 - DNA, 22 bp, Homo sapiens
tcttttgtgccaagtaatgaat

SEQ ID NO: 8344595 - DNA, 22 bp, Homo sapiens
tgaaacaattagaatgtaatga

SEQ ID NO: 8344596 - DNA, 22 bp, Homo sapiens
tgaaacactgcgataaaatcct

SEQ ID NO: 8344597 - DNA, 22 bp, Homo sapiens
tgaaacagaagatgttcatgtg

SEQ ID NO: 8344598 - DNA, 22 bp, Homo sapiens
tgaaacagagtggatacagtga

SEQ ID NO: 8344599 - DNA, 23 bp, Homo sapiens
tgaaacagatgccaatgatcaag

SEQ ID NO: 8344600 - DNA, 22 bp, Homo sapiens
tgaaatgacaaaggtttttctt

SEQ ID NO: 8344601 - DNA, 21 bp, Homo sapiens
tgaaatgagaatgctgagcac

SEQ ID NO: 8344602 - DNA, 22 bp, Homo sapiens
tgaaatgacagtcttaagctct

SEQ ID NO: 8344603 - DNA, 22 bp, Homo sapiens
ccaggctgtaagagtgatgttg

SEQ ID NO: 8344604 - DNA, 23 bp, Homo sapiens
tgcaggactcaagaaagaaaggc

SEQ ID NO: 8344605 - DNA, 22 bp, Homo sapiens
tgcaggacagtttggaagagag

SEQ ID NO: 8344606 - DNA, 22 bp, Homo sapiens
tgcagctgcaggagggtgggag

SEQ ID NO: 8344607 - DNA, 22 bp, Homo sapiens
tgcagctgcctagggctggctt

SEQ ID NO: 8344608 - DNA, 22 bp, Homo sapiens
tgcagctgctcattctctcagt

SEQ ID NO: 8344609 - DNA, 22 bp, Homo sapiens
tgcagctgcaagtccaggtcag

SEQ ID NO: 8344610 - DNA, 20 bp, Homo sapiens
tgcagctgcaggagggtggg

SEQ ID NO: 8344611 - DNA, 22 bp, Homo sapiens
tgcagccaattcattcattctt

SEQ ID NO: 8344612 - DNA, 22 bp, Homo sapiens
tgcagccaccacctctgctgaa

SEQ ID NO: 8344613 - DNA, 22 bp, Homo sapiens
cccagcaggaggaggttgcagt

SEQ ID NO: 8344614 - DNA, 22 bp, Homo sapiens
cccagcagggtctctgtgtcta

SEQ ID NO: 8344615 - DNA, 22 bp, Homo sapiens
cccagcaggcatgttgggagga

SEQ ID NO: 8344616 - DNA, 22 bp, Homo sapiens
cccagcaggtcggtgctgcctg

SEQ ID NO: 8344617 - DNA, 22 bp, Homo sapiens
cccagcagcttgcacagtgctg

SEQ ID NO: 8344618 - DNA, 22 bp, Homo sapiens
cccagcagccttgtcccttctc

SEQ ID NO: 8344619 - DNA, 22 bp, Homo sapiens
tgataagatgctgagtgcattg

SEQ ID NO: 8344620 - DNA, 22 bp, Homo sapiens
tgcaataatgtatgtcactccc

SEQ ID NO: 8344621 - DNA, 22 bp, Homo sapiens
tgcaataacccatgagatagaa

SEQ ID NO: 8344622 - DNA, 22 bp, Homo sapiens
tgcacagatgggcttgttcata

SEQ ID NO: 8344623 - DNA, 22 bp, Homo sapiens
cccagagctccggtcctgccca

SEQ ID NO: 8344624 - DNA, 22 bp, Homo sapiens
ccatccctcctactcacagtca

SEQ ID NO: 8344625 - DNA, 22 bp, Homo sapiens
tgagtccaaattctaccacctc

SEQ ID NO: 8344626 - DNA, 22 bp, Homo sapiens
ccatcctgcattgctattcaga

SEQ ID NO: 8344627 - DNA, 22 bp, Homo sapiens
ccatcctgcattgctattcaga

SEQ ID NO: 8344628 - DNA, 22 bp, Homo sapiens
tgagtctaggacaagttcagga

SEQ ID NO: 8344629 - DNA, 17 bp, Homo sapiens
tgaggccatggcaccat

SEQ ID NO: 8344630 - DNA, 22 bp, Homo sapiens
tgaggccaggatcccaggctct

SEQ ID NO: 8344631 - DNA, 22 bp, Homo sapiens
tgaggctgacaaaagatgaggt

SEQ ID NO: 8344632 - DNA, 18 bp, Homo sapiens
tgaggctgaatatggggc

SEQ ID NO: 8344633 - DNA, 22 bp, Homo sapiens
tgaggctgaaactggcgataga

SEQ ID NO: 8344634 - DNA, 22 bp, Homo sapiens
tgaggcccagccgccctgagag

SEQ ID NO: 8344635 - DNA, 20 bp, Homo sapiens
tgaggcccagcagagtcggg

SEQ ID NO: 8344636 - DNA, 22 bp, Homo sapiens
ccatcagcatgggagcatgggc

SEQ ID NO: 8344637 - DNA, 23 bp, Homo sapiens
ccatcaggcctccgtgtccagcc

SEQ ID NO: 8344638 - DNA, 22 bp, Homo sapiens
ccatcagctccagtatcttctg

SEQ ID NO: 8344639 - DNA, 22 bp, Homo sapiens
ccatagaactctgaggccagag

SEQ ID NO: 8344640 - DNA, 22 bp, Homo sapiens
ccatagaactctgaggccagag

SEQ ID NO: 8344641 - DNA, 18 bp, Homo sapiens
tgaggctgagggtagagg

SEQ ID NO: 8344642 - DNA, 22 bp, Homo sapiens
tgaggctgagatatcagggagg

SEQ ID NO: 8344643 - DNA, 22 bp, Homo sapiens
tgaggctgacaaaagatgaggt

SEQ ID NO: 8344644 - DNA, 22 bp, Homo sapiens
tgaggctgagatatcagggagg

SEQ ID NO: 8344645 - DNA, 20 bp, Homo sapiens
ccagtccacctgagacatgt

SEQ ID NO: 8344646 - DNA, 22 bp, Homo sapiens
ccaggtgtgtcaccattgccca

SEQ ID NO: 8344647 - DNA, 22 bp, Homo sapiens
ccaggtggaggtgtgaggtcct

SEQ ID NO: 8344648 - DNA, 22 bp, Homo sapiens
ccaggtggataaggtttctgga

SEQ ID NO: 8344649 - DNA, 22 bp, Homo sapiens
tgagcagagacttcaagggcag

SEQ ID NO: 8344650 - DNA, 22 bp, Homo sapiens
ccagggctgctgggggagttga

SEQ ID NO: 8344651 - DNA, 22 bp, Homo sapiens
ccagggctgcctggccgtgtgt

SEQ ID NO: 8344652 - DNA, 22 bp, Homo sapiens
tgagcaggtgagtctagggcag

SEQ ID NO: 8344653 - DNA, 22 bp, Homo sapiens
tgagcaggtcaggaagtacatt

SEQ ID NO: 8344654 - DNA, 18 bp, Homo sapiens
tgagcaggggctgacctt

SEQ ID NO: 8344655 - DNA, 22 bp, Homo sapiens
tgagcaggtcaagactccagct

SEQ ID NO: 8344656 - DNA, 22 bp, Homo sapiens
tgagcaggtcaagactccagct

SEQ ID NO: 8344657 - DNA, 19 bp, Homo sapiens
ccagtgccggcgctgggga

SEQ ID NO: 8344658 - DNA, 17 bp, Homo sapiens
ccagtgcctgtggcaac

SEQ ID NO: 8344659 - DNA, 22 bp, Homo sapiens
ccagtgcctgtgggcatggtgc

SEQ ID NO: 8344660 - DNA, 22 bp, Homo sapiens
ccagtgcccagctgcccaggca

SEQ ID NO: 8344661 - DNA, 22 bp, Homo sapiens
ccagtgcttctttgctagctgg

SEQ ID NO: 8344662 - DNA, 21 bp, Homo sapiens
ccagtgctacagctgcctgac

SEQ ID NO: 8344663 - DNA, 22 bp, Homo sapiens
tgagccagttcttcagatccat

SEQ ID NO: 8344664 - DNA, 19 bp, Homo sapiens
ccagtcccatacaggagat

SEQ ID NO: 8344665 - DNA, 22 bp, Homo sapiens
cctgcagggaatcgaggcagaa

SEQ ID NO: 8344666 - DNA, 23 bp, Homo sapiens
cctgcagctgctggggctccacc

SEQ ID NO: 8344667 - DNA, 23 bp, Homo sapiens
tggggagagttaccctggaagcg

SEQ ID NO: 8344668 - DNA, 22 bp, Homo sapiens
tggggagagttacaaggaatct

SEQ ID NO: 8344669 - DNA, 22 bp, Homo sapiens
tggggagaggtatcattgagat

SEQ ID NO: 8344670 - DNA, 22 bp, Homo sapiens
cctgataatattgacctacaga

SEQ ID NO: 8344671 - DNA, 22 bp, Homo sapiens
cctgataatgtaattgttaaat

SEQ ID NO: 8344672 - DNA, 22 bp, Homo sapiens
cctgataacacagatacaagat

SEQ ID NO: 8344673 - DNA, 22 bp, Homo sapiens
cctgataaaccctggaatttgt

SEQ ID NO: 8344674 - DNA, 22 bp, Homo sapiens
tggggagagaccggaatgtttc

SEQ ID NO: 8344675 - DNA, 22 bp, Homo sapiens
tggggagactggccgagatcct

SEQ ID NO: 8344676 - DNA, 22 bp, Homo sapiens
tgggctccggcggcctcaggct

SEQ ID NO: 8344677 - DNA, 22 bp, Homo sapiens
tgggctccgttgcctggggcag

SEQ ID NO: 8344678 - DNA, 22 bp, Homo sapiens
tgggctcctcgtcactcgctgt

SEQ ID NO: 8344679 - DNA, 22 bp, Homo sapiens
tgggctccggcggcctcaggct

SEQ ID NO: 8344680 - DNA, 23 bp, Homo sapiens
tgggcctggcctcccagtccagc

SEQ ID NO: 8344681 - DNA, 22 bp, Homo sapiens
tgggcaggagagaagctaaaga

SEQ ID NO: 8344682 - DNA, 22 bp, Homo sapiens
tgggcaggataatatctcatgt

SEQ ID NO: 8344683 - DNA, 22 bp, Homo sapiens
tgggcaggatgcgttgattctt

SEQ ID NO: 8344684 - DNA, 22 bp, Homo sapiens
tgggcaggcaagtgaatacctt

SEQ ID NO: 8344685 - DNA, 22 bp, Homo sapiens
tgggccgggcactgtactgggc

SEQ ID NO: 8344686 - DNA, 22 bp, Homo sapiens
tggtaatatatgccagataaaa

SEQ ID NO: 8344687 - DNA, 22 bp, Homo sapiens
tgggtgggagcaccctgtctgg

SEQ ID NO: 8344688 - DNA, 22 bp, Homo sapiens
tgggtggagaagtggacctgct

SEQ ID NO: 8344689 - DNA, 22 bp, Homo sapiens
cctgcaggtttcccccggacgg

SEQ ID NO: 8344690 - DNA, 22 bp, Homo sapiens
cctgccacttcttgctatggag

SEQ ID NO: 8344691 - DNA, 22 bp, Homo sapiens
tgggtcagtttgggggccagcc

SEQ ID NO: 8344692 - DNA, 22 bp, Homo sapiens
cctgcattaaatcctgttctgc

SEQ ID NO: 8344693 - DNA, 22 bp, Homo sapiens
cctgccactgtaggtgacagtt

SEQ ID NO: 8344694 - DNA, 22 bp, Homo sapiens
cctgcattgctcttctgttcct

SEQ ID NO: 8344695 - DNA, 19 bp, Homo sapiens
cctgcagggatgagaggtt

SEQ ID NO: 8344696 - DNA, 22 bp, Homo sapiens
cctgcagggaatcgaggcagaa

SEQ ID NO: 8344697 - DNA, 22 bp, Homo sapiens
cctgcagggtgctgccacagat

SEQ ID NO: 8344698 - DNA, 22 bp, Homo sapiens
cctgcagggtgctgccacagat

SEQ ID NO: 8344699 - DNA, 22 bp, Homo sapiens
cctgcaggtccccggatgcgca

SEQ ID NO: 8344700 - DNA, 22 bp, Homo sapiens
tggtagcaacatctcagtggct

SEQ ID NO: 8344701 - DNA, 22 bp, Homo sapiens
tggtacatgggtaggtatctct

SEQ ID NO: 8344702 - DNA, 22 bp, Homo sapiens
cctgcccagcttcacctcaggc

SEQ ID NO: 8344703 - DNA, 22 bp, Homo sapiens
cctgccctgtcactggctaggg

SEQ ID NO: 8344704 - DNA, 22 bp, Homo sapiens
cctgcccagagcccctttcact

SEQ ID NO: 8344705 - DNA, 22 bp, Homo sapiens
cctgcccttctttccccagcat

SEQ ID NO: 8344706 - DNA, 22 bp, Homo sapiens
cctgcccttctttccccagcat

SEQ ID NO: 8344707 - DNA, 22 bp, Homo sapiens
cctgcctcaggactctgcatat

SEQ ID NO: 8344708 - DNA, 22 bp, Homo sapiens
cctgcctcaggactctgcatat

SEQ ID NO: 8344709 - DNA, 23 bp, Homo sapiens
cctgccggacctggtggggagac

SEQ ID NO: 8344710 - DNA, 22 bp, Homo sapiens
tggttagacacatgcatgtcat

SEQ ID NO: 8344711 - DNA, 22 bp, Homo sapiens
tggttacataagaatagcactg

SEQ ID NO: 8344712 - DNA, 22 bp, Homo sapiens
cctctcccacgtggcagaggct

SEQ ID NO: 8344713 - DNA, 22 bp, Homo sapiens
cctctcccacgtggcagaggct

SEQ ID NO: 8344714 - DNA, 22 bp, Homo sapiens
cctctcccaggcgcggcggcag

SEQ ID NO: 8344715 - DNA, 22 bp, Homo sapiens
cctctcccagggagagcctgag

SEQ ID NO: 8344716 - DNA, 22 bp, Homo sapiens
cctctcccagggagagcctgag

SEQ ID NO: 8344717 - DNA, 19 bp, Homo sapiens
cctctcccatgcttacctc

SEQ ID NO: 8344718 - DNA, 22 bp, Homo sapiens
cctctcccgggtgccgctgggc

SEQ ID NO: 8344719 - DNA, 20 bp, Homo sapiens
cctcctggtcaggtgtgcag

SEQ ID NO: 8344720 - DNA, 20 bp, Homo sapiens
cctcctggtcaggtgtgcag

SEQ ID NO: 8344721 - DNA, 22 bp, Homo sapiens
tgggagagcagagaaccctctt

SEQ ID NO: 8344722 - DNA, 22 bp, Homo sapiens
tgggagagcactgcagccccgg

SEQ ID NO: 8344723 - DNA, 22 bp, Homo sapiens
tgggcagacgctgttggaaggc

SEQ ID NO: 8344724 - DNA, 22 bp, Homo sapiens
tgggcagacgggagcttgcctt

SEQ ID NO: 8344725 - DNA, 22 bp, Homo sapiens
tgggcagacattgagtttgttc

SEQ ID NO: 8344726 - DNA, 22 bp, Homo sapiens
tgggcagaattgtggtagttaa

SEQ ID NO: 8344727 - DNA, 22 bp, Homo sapiens
tgggcagaatgtgggatccaga

SEQ ID NO: 8344728 - DNA, 22 bp, Homo sapiens
tgggcagaaggaagagccacct

SEQ ID NO: 8344729 - DNA, 22 bp, Homo sapiens
tgggcagaaatcagtatcagat

SEQ ID NO: 8344730 - DNA, 22 bp, Homo sapiens
tgggcagaaatcagtatcagat

SEQ ID NO: 8344731 - DNA, 22 bp, Homo sapiens
tgggagagaattctggtgactg

SEQ ID NO: 8344732 - DNA, 22 bp, Homo sapiens
tgggacaggaggcctctggaga

SEQ ID NO: 8344733 - DNA, 22 bp, Homo sapiens
tgggacagagtgagctttggcc

SEQ ID NO: 8344734 - DNA, 19 bp, Homo sapiens
tggcaggtagtgagcagtc

SEQ ID NO: 8344735 - DNA, 22 bp, Homo sapiens
tggcagtggctttgctggtgga

SEQ ID NO: 8344736 - DNA, 21 bp, Homo sapiens
cctccaggtgattccgtgctc

SEQ ID NO: 8344737 - DNA, 23 bp, Homo sapiens
cctcctgggcacaggcctgatgg

SEQ ID NO: 8344738 - DNA, 23 bp, Homo sapiens
cctcctgggcacaggcctgatgg

SEQ ID NO: 8344739 - DNA, 22 bp, Homo sapiens
cctcctggcctgtgcagagccc

SEQ ID NO: 8344740 - DNA, 22 bp, Homo sapiens
cctcccacttcttgctgaggtc

SEQ ID NO: 8344741 - DNA, 23 bp, Homo sapiens
cctcccacctatttcactttctt

SEQ ID NO: 8344742 - DNA, 22 bp, Homo sapiens
cctcccaccgtatctcagtggc

SEQ ID NO: 8344743 - DNA, 22 bp, Homo sapiens
cctcccaccgtatctcagtggc

SEQ ID NO: 8344744 - DNA, 22 bp, Homo sapiens
cctcccacattgaggacatgct

SEQ ID NO: 8344745 - DNA, 17 bp, Homo sapiens
cctcccacaccgccctg

SEQ ID NO: 8344746 - DNA, 18 bp, Homo sapiens
tggagacatagacaatgt

SEQ ID NO: 8344747 - DNA, 22 bp, Homo sapiens
tggagaattctatgttgagggg

SEQ ID NO: 8344748 - DNA, 23 bp, Homo sapiens
tggagaattcagtctttgttttg

SEQ ID NO: 8344749 - DNA, 22 bp, Homo sapiens
tggagatccttcattttggtgt

SEQ ID NO: 8344750 - DNA, 23 bp, Homo sapiens
tggaaacattctgaatgtccatc

SEQ ID NO: 8344751 - DNA, 22 bp, Homo sapiens
ccctcctcaactctggcttcca

SEQ ID NO: 8344752 - DNA, 22 bp, Homo sapiens
ccctccctttgcagcagtgcat

SEQ ID NO: 8344753 - DNA, 22 bp, Homo sapiens
ccctccctttgcagcagtgcat

SEQ ID NO: 8344754 - DNA, 22 bp, Homo sapiens
tggaggcattgtgactgctgaa

SEQ ID NO: 8344755 - DNA, 22 bp, Homo sapiens
tggaggcatgacagtgtctgga

SEQ ID NO: 8344756 - DNA, 22 bp, Homo sapiens
tggaggcattttaggttgtcac

SEQ ID NO: 8344757 - DNA, 22 bp, Homo sapiens
tggaggccacatgaacgctgcg

SEQ ID NO: 8344758 - DNA, 22 bp, Homo sapiens
tggaggcataggcctgggccct

SEQ ID NO: 8344759 - DNA, 22 bp, Homo sapiens
tggaggcatcagagtgcttggc

SEQ ID NO: 8344760 - DNA, 22 bp, Homo sapiens
tggagatgggttaatggagaga

SEQ ID NO: 8344761 - DNA, 22 bp, Homo sapiens
tggagatgaggacatggacgtc

SEQ ID NO: 8344762 - DNA, 22 bp, Homo sapiens
tggagatgggaaaaaggaggta

SEQ ID NO: 8344763 - DNA, 22 bp, Homo sapiens
ccctggaggttgaggctgcagt

SEQ ID NO: 8344764 - DNA, 22 bp, Homo sapiens
ccctggaggttgaggctgcagt

SEQ ID NO: 8344765 - DNA, 22 bp, Homo sapiens
ccctggagggcagacagatgcc

SEQ ID NO: 8344766 - DNA, 22 bp, Homo sapiens
ccctggagtagcactgggtcgc

SEQ ID NO: 8344767 - DNA, 22 bp, Homo sapiens
ccctggagtagcactgggtcgc

SEQ ID NO: 8344768 - DNA, 22 bp, Homo sapiens
ccctgggaagtattccagctat

SEQ ID NO: 8344769 - DNA, 22 bp, Homo sapiens
ccctgggacccgctgcagaggc

SEQ ID NO: 8344770 - DNA, 22 bp, Homo sapiens
ccctttcaacattctgccttgt

SEQ ID NO: 8344771 - DNA, 22 bp, Homo sapiens
ccctttagcccctgcagagact

SEQ ID NO: 8344772 - DNA, 22 bp, Homo sapiens
cccttgcttgcccagtcacagg

SEQ ID NO: 8344773 - DNA, 22 bp, Homo sapiens
cccttggaggaagctctaggct

SEQ ID NO: 8344774 - DNA, 21 bp, Homo sapiens
cccttgcctgcactcctcggc

SEQ ID NO: 8344775 - DNA, 21 bp, Homo sapiens
cccttgcctgcactcctcggc

SEQ ID NO: 8344776 - DNA, 22 bp, Homo sapiens
cccttgctgccacagctgccca

SEQ ID NO: 8344777 - DNA, 21 bp, Homo sapiens
cccttgcaaagtgctttccca

SEQ ID NO: 8344778 - DNA, 22 bp, Homo sapiens
cccagtgtctcttgtgcctttc

SEQ ID NO: 8344779 - DNA, 22 bp, Homo sapiens
tgctgggggttcagatgagtaa

SEQ ID NO: 8344780 - DNA, 22 bp, Homo sapiens
tgctgggggttcagatgagtaa

SEQ ID NO: 8344781 - DNA, 18 bp, Homo sapiens
tgctggggtagaatccac

SEQ ID NO: 8344782 - DNA, 22 bp, Homo sapiens
tgctgggggtagctctgcgtag

SEQ ID NO: 8344783 - DNA, 22 bp, Homo sapiens
tgctgggggtgtctcaccaggc

SEQ ID NO: 8344784 - DNA, 22 bp, Homo sapiens
tgctgggggtgtctcaccaggc

SEQ ID NO: 8344785 - DNA, 22 bp, Homo sapiens
tgctgggggctttctggatacc

SEQ ID NO: 8344786 - DNA, 22 bp, Homo sapiens
tgctggggctctgaccactcca

SEQ ID NO: 8344787 - DNA, 22 bp, Homo sapiens
tgctggggctctgaccactcca

SEQ ID NO: 8344788 - DNA, 22 bp, Homo sapiens
ccctccagtgtcccagtgggga

SEQ ID NO: 8344789 - DNA, 22 bp, Homo sapiens
ccctccccacaaagcttcacac

SEQ ID NO: 8344790 - DNA, 22 bp, Homo sapiens
tgcttgtattcatatcacagct

SEQ ID NO: 8344791 - DNA, 22 bp, Homo sapiens
ccctccccagggtcatattgaa

SEQ ID NO: 8344792 - DNA, 22 bp, Homo sapiens
tgcttggagaatcagtcccagc

SEQ ID NO: 8344793 - DNA, 23 bp, Homo sapiens
tgcttggagatgcagacctctga

SEQ ID NO: 8344794 - DNA, 23 bp, Homo sapiens
tgcttggacaagactctattaag

SEQ ID NO: 8344795 - DNA, 22 bp, Homo sapiens
tgcttgggaatgtggagtcaga

SEQ ID NO: 8344796 - DNA, 22 bp, Homo sapiens
ccccaggcagggcctaacagag

SEQ ID NO: 8344797 - DNA, 22 bp, Homo sapiens
tgctgtttgagcttattttcag

SEQ ID NO: 8344798 - DNA, 22 bp, Homo sapiens
tgctgtttcattttcctcatcc

SEQ ID NO: 8344799 - DNA, 22 bp, Homo sapiens
tgctacaattcacatctggata

SEQ ID NO: 8344800 - DNA, 22 bp, Homo sapiens
tgctacatgcactgtgatctag

SEQ ID NO: 8344801 - DNA, 19 bp, Homo sapiens
tgctaagtcctttagaggc

SEQ ID NO: 8344802 - DNA, 22 bp, Homo sapiens
tgctaagtcactcaagacctct

SEQ ID NO: 8344803 - DNA, 22 bp, Homo sapiens
tgcaggtgccatcgctgctcat

SEQ ID NO: 8344804 - DNA, 22 bp, Homo sapiens
tgctagtgtgtgagatgttcaa

SEQ ID NO: 8344805 - DNA, 22 bp, Homo sapiens
tgctcaggaggaggctgtgagg

SEQ ID NO: 8344806 - DNA, 22 bp, Homo sapiens
tgctcagcttcagaggatcccc

SEQ ID NO: 8344807 - DNA, 19 bp, Homo sapiens
tgctcaggccaaggagccc

SEQ ID NO: 8344808 - DNA, 22 bp, Homo sapiens
tgctcaggccctgggccatcct

SEQ ID NO: 8344809 - DNA, 22 bp, Homo sapiens
tgctcaggccctgggccatcct

SEQ ID NO: 8344810 - DNA, 19 bp, Homo sapiens
cccagtccttgtcctgggc

SEQ ID NO: 8344811 - DNA, 22 bp, Homo sapiens
tgctcagggagcttcctggtgg

SEQ ID NO: 8344812 - DNA, 22 bp, Homo sapiens
tgctcaggtgccttggctgctg

SEQ ID NO: 8344813 - DNA, 22 bp, Homo sapiens
tgctctgcaagcaggagcaaga

SEQ ID NO: 8344814 - DNA, 22 bp, Homo sapiens
tgctctgcacatccctcacaaa

SEQ ID NO: 8344815 - DNA, 22 bp, Homo sapiens
tgctctggaatagtcctaggca

SEQ ID NO: 8344816 - DNA, 19 bp, Homo sapiens
tgctgcaggatgctgctgg

SEQ ID NO: 8344817 - DNA, 22 bp, Homo sapiens
ctgggcactttggggagcctac

SEQ ID NO: 8344818 - DNA, 22 bp, Homo sapiens
ctgggcagaattttaggatggc

SEQ ID NO: 8344819 - DNA, 22 bp, Homo sapiens
ctgggcagagctaacacctgag

SEQ ID NO: 8344820 - DNA, 22 bp, Homo sapiens
ctgggcagcacatcatcgtatc

SEQ ID NO: 8344821 - DNA, 22 bp, Homo sapiens
ctgggcagagtccggaagatgg

SEQ ID NO: 8344822 - DNA, 22 bp, Homo sapiens
ctgggcagctgtatcagggagt

SEQ ID NO: 8344823 - DNA, 22 bp, Homo sapiens
ctgggcagcctcacacaatgtt

SEQ ID NO: 8344824 - DNA, 22 bp, Homo sapiens
ctgggcagctccataccaccca

SEQ ID NO: 8344825 - DNA, 22 bp, Homo sapiens
ctgggcagctaccaccactgct

SEQ ID NO: 8344826 - DNA, 22 bp, Homo sapiens
ctgggcagctaccaccactgct

SEQ ID NO: 8344827 - DNA, 22 bp, Homo sapiens
ctgggcacctttgcagcaggct

SEQ ID NO: 8344828 - DNA, 22 bp, Homo sapiens
ctgggcaatatgctgggcctgg

SEQ ID NO: 8344829 - DNA, 22 bp, Homo sapiens
ctgggagcggctgtcactggtt

SEQ ID NO: 8344830 - DNA, 17 bp, Homo sapiens
ctgggatgtggactctt

SEQ ID NO: 8344831 - DNA, 22 bp, Homo sapiens
ctgggagcccgcgtcctggtgg

SEQ ID NO: 8344832 - DNA, 22 bp, Homo sapiens
ctgggagcaagaggctgcaaat

SEQ ID NO: 8344833 - DNA, 22 bp, Homo sapiens
ctgggagccctgactagcctgg

SEQ ID NO: 8344834 - DNA, 22 bp, Homo sapiens
ctgggcgcgtcccctgaggcgg

SEQ ID NO: 8344835 - DNA, 22 bp, Homo sapiens
ctgggagaggtggtgggaagta

SEQ ID NO: 8344836 - DNA, 22 bp, Homo sapiens
ctgggagatatgaggatctgga

SEQ ID NO: 8344837 - DNA, 22 bp, Homo sapiens
ctgggagattgaggccatggtg

SEQ ID NO: 8344838 - DNA, 22 bp, Homo sapiens
ctgggagatgactcagagcagg

SEQ ID NO: 8344839 - DNA, 22 bp, Homo sapiens
ctgggagatctgttgggactgg

SEQ ID NO: 8344840 - DNA, 22 bp, Homo sapiens
ctgggagatctcctgagggcag

SEQ ID NO: 8344841 - DNA, 22 bp, Homo sapiens
ctgggagatctcctgagggcag

SEQ ID NO: 8344842 - DNA, 22 bp, Homo sapiens
ctgggacctcctgaggtggagc

SEQ ID NO: 8344843 - DNA, 23 bp, Homo sapiens
ctgggacatggtaggggcacaac

SEQ ID NO: 8344844 - DNA, 22 bp, Homo sapiens
ctgcttatggaattgtatactg

SEQ ID NO: 8344845 - DNA, 22 bp, Homo sapiens
ctgcttatggagatgagtaaga

SEQ ID NO: 8344846 - DNA, 22 bp, Homo sapiens
ctgggaagaagtgggctacatt

SEQ ID NO: 8344847 - DNA, 22 bp, Homo sapiens
ctgggaagaaattgtgggaggc

SEQ ID NO: 8344848 - DNA, 22 bp, Homo sapiens
ctgcttcctgctgggatactga

SEQ ID NO: 8344849 - DNA, 22 bp, Homo sapiens
ctgcttccatggtctggagact

SEQ ID NO: 8344850 - DNA, 22 bp, Homo sapiens
ctggtgagacggttgacaggag

SEQ ID NO: 8344851 - DNA, 19 bp, Homo sapiens
ctgtacaggttgcttctgg

SEQ ID NO: 8344852 - DNA, 22 bp, Homo sapiens
ctgtacagaagctagagcaaat

SEQ ID NO: 8344853 - DNA, 22 bp, Homo sapiens
ctgtacatcccgagagccagta

SEQ ID NO: 8344854 - DNA, 22 bp, Homo sapiens
ctgtacatcccgagagccagta

SEQ ID NO: 8344855 - DNA, 22 bp, Homo sapiens
ctgtacatcccaagatatttct

SEQ ID NO: 8344856 - DNA, 22 bp, Homo sapiens
ctgtacatatgtctccagagtg

SEQ ID NO: 8344857 - DNA, 22 bp, Homo sapiens
ctgtacatctctgaggacagta

SEQ ID NO: 8344858 - DNA, 22 bp, Homo sapiens
ctgtacatcttaaatggaaaaa

SEQ ID NO: 8344859 - DNA, 22 bp, Homo sapiens
ctgtacatcccaagatatttct

SEQ ID NO: 8344860 - DNA, 22 bp, Homo sapiens
ctgtacatctctgaggacagta

SEQ ID NO: 8344861 - DNA, 22 bp, Homo sapiens
ctgtactaattgctttacatgt

SEQ ID NO: 8344862 - DNA, 20 bp, Homo sapiens
ctggggagcctcgcggtggc

SEQ ID NO: 8344863 - DNA, 20 bp, Homo sapiens
ctggggagctgctcccacga

SEQ ID NO: 8344864 - DNA, 22 bp, Homo sapiens
ctggtctgcgggaaggcgtggg

SEQ ID NO: 8344865 - DNA, 22 bp, Homo sapiens
ctggtctgaaaaggaggcatgc

SEQ ID NO: 8344866 - DNA, 22 bp, Homo sapiens
ctggtctgggatgagggatgta

SEQ ID NO: 8344867 - DNA, 22 bp, Homo sapiens
ctggggactcattcagagcata

SEQ ID NO: 8344868 - DNA, 22 bp, Homo sapiens
ctggggaaggcggtgactgcgc

SEQ ID NO: 8344869 - DNA, 22 bp, Homo sapiens
ctggggagaagcgactcggctg

SEQ ID NO: 8344870 - DNA, 22 bp, Homo sapiens
ctggggagaagcgactcggctg

SEQ ID NO: 8344871 - DNA, 22 bp, Homo sapiens
ctgtctgtcaagttcatctcca

SEQ ID NO: 8344872 - DNA, 22 bp, Homo sapiens
ctgtctgtacaaatgtggggcc

SEQ ID NO: 8344873 - DNA, 22 bp, Homo sapiens
ctgtgctggattctgaggctac

SEQ ID NO: 8344874 - DNA, 22 bp, Homo sapiens
ctgtgctggagatgggccagag

SEQ ID NO: 8344875 - DNA, 22 bp, Homo sapiens
ctgtgctggtccagggagctgg

SEQ ID NO: 8344876 - DNA, 22 bp, Homo sapiens
ctgtgctctggcatcgctgcaa

SEQ ID NO: 8344877 - DNA, 22 bp, Homo sapiens
ctgtgctctggcatcgctgcaa

SEQ ID NO: 8344878 - DNA, 22 bp, Homo sapiens
ctgtgccctgtggctggcacct

SEQ ID NO: 8344879 - DNA, 22 bp, Homo sapiens
ctgtgccctttcgctgcactgt

SEQ ID NO: 8344880 - DNA, 22 bp, Homo sapiens
ctgtcaggtttcccatctgcaa

SEQ ID NO: 8344881 - DNA, 22 bp, Homo sapiens
ctgtcacctctgtggacccact

SEQ ID NO: 8344882 - DNA, 22 bp, Homo sapiens
ctgtcagaggctctctgttgcc

SEQ ID NO: 8344883 - DNA, 19 bp, Homo sapiens
ctgtcaggggctggatgtt

SEQ ID NO: 8344884 - DNA, 22 bp, Homo sapiens
ctgtcaggggcgggtggagcgg

SEQ ID NO: 8344885 - DNA, 22 bp, Homo sapiens
ctgtcagcttctcctggccaga

SEQ ID NO: 8344886 - DNA, 22 bp, Homo sapiens
ctgtcaaatggaaacttatcct

SEQ ID NO: 8344887 - DNA, 22 bp, Homo sapiens
cttacagagaagaaaatgtagt

SEQ ID NO: 8344888 - DNA, 22 bp, Homo sapiens
cttacacactagatggtaggtg

SEQ ID NO: 8344889 - DNA, 22 bp, Homo sapiens
cttacacagtctggcacttctt

SEQ ID NO: 8344890 - DNA, 22 bp, Homo sapiens
cttacatactgagaaaatatcc

SEQ ID NO: 8344891 - DNA, 22 bp, Homo sapiens
cttacattgtgtgcatgagggg

SEQ ID NO: 8344892 - DNA, 22 bp, Homo sapiens
cttaccatgtgagaaacaaaca

SEQ ID NO: 8344893 - DNA, 22 bp, Homo sapiens
cttagaaatgcagattctcagg

SEQ ID NO: 8344894 - DNA, 22 bp, Homo sapiens
cttagaaatgcagattctcagg

SEQ ID NO: 8344895 - DNA, 22 bp, Homo sapiens
cttacaaatacacttaggagag

SEQ ID NO: 8344896 - DNA, 22 bp, Homo sapiens
cttacaaaggagaggagatagg

SEQ ID NO: 8344897 - DNA, 22 bp, Homo sapiens
cttacaaatacacttaggagag

SEQ ID NO: 8344898 - DNA, 22 bp, Homo sapiens
cttacaaaggagaggagatagg

SEQ ID NO: 8344899 - DNA, 22 bp, Homo sapiens
ctgttttatctcaagagttcaa

SEQ ID NO: 8344900 - DNA, 21 bp, Homo sapiens
ctgtttcttgtgaagtgacac

SEQ ID NO: 8344901 - DNA, 21 bp, Homo sapiens
ctgtggaagggaactagaggg

SEQ ID NO: 8344902 - DNA, 22 bp, Homo sapiens
cttccaaagcactttatggacc

SEQ ID NO: 8344903 - DNA, 22 bp, Homo sapiens
cttcatttggagaactgtgctt

SEQ ID NO: 8344904 - DNA, 22 bp, Homo sapiens
cttccaaaatttatatgttgaa

SEQ ID NO: 8344905 - DNA, 22 bp, Homo sapiens
cttcatttccatccaactggga

SEQ ID NO: 8344906 - DNA, 18 bp, Homo sapiens
cttcatttgtagagttcc

SEQ ID NO: 8344907 - DNA, 22 bp, Homo sapiens
cttaggcagactgctgatgcag

SEQ ID NO: 8344908 - DNA, 22 bp, Homo sapiens
cttagccctgagagttctgagc

SEQ ID NO: 8344909 - DNA, 22 bp, Homo sapiens
cttctagagctggagcaaatgt

SEQ ID NO: 8344910 - DNA, 22 bp, Homo sapiens
cttcctgttgtcacagtctgcg

SEQ ID NO: 8344911 - DNA, 22 bp, Homo sapiens
cttccagctgattggcatccag

SEQ ID NO: 8344912 - DNA, 22 bp, Homo sapiens
cttccacattatttaggaatcc

SEQ ID NO: 8344913 - DNA, 20 bp, Homo sapiens
cttccaccagggccgctgat

SEQ ID NO: 8344914 - DNA, 22 bp, Homo sapiens
ctttgaattccagtacaataac

SEQ ID NO: 8344915 - DNA, 22 bp, Homo sapiens
ctttgaaaacacacgaatagac

SEQ ID NO: 8344916 - DNA, 22 bp, Homo sapiens
ctttaacagttccattcaattt

SEQ ID NO: 8344917 - DNA, 22 bp, Homo sapiens
cttgtgaaatgccagataatct

SEQ ID NO: 8344918 - DNA, 22 bp, Homo sapiens
cttctcttggtagttcttgttg

SEQ ID NO: 8344919 - DNA, 22 bp, Homo sapiens
gaaagccatagcccagctttac

SEQ ID NO: 8344920 - DNA, 22 bp, Homo sapiens
gaaacagattaacagcatattt

SEQ ID NO: 8344921 - DNA, 22 bp, Homo sapiens
gaaaatttctgccacatgtgtg

SEQ ID NO: 8344922 - DNA, 22 bp, Homo sapiens
gaaacaatacttgtcctcacta

SEQ ID NO: 8344923 - DNA, 22 bp, Homo sapiens
gaaaatttaattctcttctgtg

SEQ ID NO: 8344924 - DNA, 22 bp, Homo sapiens
gaaaatgtttcctgttatttgc

SEQ ID NO: 8344925 - DNA, 22 bp, Homo sapiens
cttttctctgtaccgtatatct

SEQ ID NO: 8344926 - DNA, 22 bp, Homo sapiens
cttttctagagccgcagcccta

SEQ ID NO: 8344927 - DNA, 21 bp, Homo sapiens
cttttctagtcccagccccgc

SEQ ID NO: 8344928 - DNA, 22 bp, Homo sapiens
cttttctactaatgagtagcta

SEQ ID NO: 8344929 - DNA, 21 bp, Homo sapiens
cttttctctccgcaggacatt

SEQ ID NO: 8344930 - DNA, 22 bp, Homo sapiens
cttttctctgcgggtctttcat

SEQ ID NO: 8344931 - DNA, 22 bp, Homo sapiens
cttttgatggagttcaagaagc

SEQ ID NO: 8344932 - DNA, 21 bp, Homo sapiens
ctttgcaagatgtctatgaaa

SEQ ID NO: 8344933 - DNA, 22 bp, Homo sapiens
ctttgattcagagagaattagc

SEQ ID NO: 8344934 - DNA, 22 bp, Homo sapiens
gagcagttgggctctaggaagt

SEQ ID NO: 8344935 - DNA, 22 bp, Homo sapiens
gagcagttttatttcatgagac

SEQ ID NO: 8344936 - DNA, 22 bp, Homo sapiens
gagcatggctgcctccctgtgc

SEQ ID NO: 8344937 - DNA, 22 bp, Homo sapiens
gagaggggcccaagccacatag

SEQ ID NO: 8344938 - DNA, 22 bp, Homo sapiens
gagaggggtttgccatcctatg

SEQ ID NO: 8344939 - DNA, 22 bp, Homo sapiens
gagcaggctctgcctgtgtgtc

SEQ ID NO: 8344940 - DNA, 22 bp, Homo sapiens
gagcaggcttgcagagaagggg

SEQ ID NO: 8344941 - DNA, 22 bp, Homo sapiens
gagcccaggaagtggaggctga

SEQ ID NO: 8344942 - DNA, 22 bp, Homo sapiens
gagcccagcttgcacatggagc

SEQ ID NO: 8344943 - DNA, 22 bp, Homo sapiens
gagcccagtctgctcctgcgcc

SEQ ID NO: 8344944 - DNA, 22 bp, Homo sapiens
gagccctgaacaacagcaggaa

SEQ ID NO: 8344945 - DNA, 22 bp, Homo sapiens
gaggaagaatcagggtggtgag

SEQ ID NO: 8344946 - DNA, 22 bp, Homo sapiens
gaggaagaattggttattggag

SEQ ID NO: 8344947 - DNA, 22 bp, Homo sapiens
gaggaagaagcaaaccagctaa

SEQ ID NO: 8344948 - DNA, 22 bp, Homo sapiens
gaggaagaagggattagaactc

SEQ ID NO: 8344949 - DNA, 22 bp, Homo sapiens
gaggaagaaagcataggtgggg

SEQ ID NO: 8344950 - DNA, 22 bp, Homo sapiens
gaggaacagagacgggatcgct

SEQ ID NO: 8344951 - DNA, 22 bp, Homo sapiens
gaggaacagcagccacatgtcc

SEQ ID NO: 8344952 - DNA, 22 bp, Homo sapiens
gaggaaccaaatcagcttgcac

SEQ ID NO: 8344953 - DNA, 22 bp, Homo sapiens
gaggaacctgggcttccatcct

SEQ ID NO: 8344954 - DNA, 22 bp, Homo sapiens
gaggaacccagctggggttgcc

SEQ ID NO: 8344955 - DNA, 22 bp, Homo sapiens
gaggaacctatgatttagagca

SEQ ID NO: 8344956 - DNA, 22 bp, Homo sapiens
gaggaacctcctgaaaagtata

SEQ ID NO: 8344957 - DNA, 22 bp, Homo sapiens
gaggaaccaccttgggtaggct

SEQ ID NO: 8344958 - DNA, 22 bp, Homo sapiens
gaggaaccaatctgtgatattc

SEQ ID NO: 8344959 - DNA, 22 bp, Homo sapiens
gaggaaccactctgagaagcca

SEQ ID NO: 8344960 - DNA, 22 bp, Homo sapiens
gaggaacccaagctcaccgtca

SEQ ID NO: 8344961 - DNA, 20 bp, Homo sapiens
gaggaaccactgggaggaga

SEQ ID NO: 8344962 - DNA, 22 bp, Homo sapiens
gagctgcctgtgtgccatgatg

SEQ ID NO: 8344963 - DNA, 22 bp, Homo sapiens
gagctgcctgtgtgccatgatg

SEQ ID NO: 8344964 - DNA, 22 bp, Homo sapiens
gagctgctgaagggaaaatgaa

SEQ ID NO: 8344965 - DNA, 22 bp, Homo sapiens
gaggaaaatggagtgtaattaa

SEQ ID NO: 8344966 - DNA, 22 bp, Homo sapiens
gaggaaagagtcaaatctgaag

SEQ ID NO: 8344967 - DNA, 22 bp, Homo sapiens
gagctgcctacattgccaagag

SEQ ID NO: 8344968 - DNA, 18 bp, Homo sapiens
gagccctgagtctgcaca

SEQ ID NO: 8344969 - DNA, 22 bp, Homo sapiens
gagccctgatttgcagcatttg

SEQ ID NO: 8344970 - DNA, 22 bp, Homo sapiens
gagccctgctgggccttgtctc

SEQ ID NO: 8344971 - DNA, 22 bp, Homo sapiens
gagccctgcggagccccgaggc

SEQ ID NO: 8344972 - DNA, 22 bp, Homo sapiens
gagccctgtagcaagtcatgtc

SEQ ID NO: 8344973 - DNA, 22 bp, Homo sapiens
gagccctgtaggaatctctcaa

SEQ ID NO: 8344974 - DNA, 22 bp, Homo sapiens
gaggctcagagggagcatggtc

SEQ ID NO: 8344975 - DNA, 22 bp, Homo sapiens
gaggctgaagtgtacatgggtg

SEQ ID NO: 8344976 - DNA, 22 bp, Homo sapiens
gaggcagttcctgagtgacaag

SEQ ID NO: 8344977 - DNA, 22 bp, Homo sapiens
gaggctcacctagggagcactg

SEQ ID NO: 8344978 - DNA, 22 bp, Homo sapiens
gaggctcactaggcatcctggg

SEQ ID NO: 8344979 - DNA, 22 bp, Homo sapiens
gaggagcacatgaggctgaggg

SEQ ID NO: 8344980 - DNA, 22 bp, Homo sapiens
gaggagagggctgcgggcccac

SEQ ID NO: 8344981 - DNA, 22 bp, Homo sapiens
gaggagagggctgcgggcccac

SEQ ID NO: 8344982 - DNA, 22 bp, Homo sapiens
gaggagagatggtagattgggt

SEQ ID NO: 8344983 - DNA, 22 bp, Homo sapiens
gaggcagcttggggctgtgggt

SEQ ID NO: 8344984 - DNA, 22 bp, Homo sapiens
gaggcagcttagggtactgact

SEQ ID NO: 8344985 - DNA, 22 bp, Homo sapiens
gaggctgcattcttcccactgc

SEQ ID NO: 8344986 - DNA, 22 bp, Homo sapiens
gaggctgccaatgtgtgcatgt

SEQ ID NO: 8344987 - DNA, 22 bp, Homo sapiens
gaggctgcaggcaatgctgccc

SEQ ID NO: 8344988 - DNA, 22 bp, Homo sapiens
gaggctgcaggcaatgctgccc

SEQ ID NO: 8344989 - DNA, 22 bp, Homo sapiens
gaggctgattcggggaacagca

SEQ ID NO: 8344990 - DNA, 22 bp, Homo sapiens
gaggctgagggttagagagtca

SEQ ID NO: 8344991 - DNA, 22 bp, Homo sapiens
gaggctgaggcggatggatcac

SEQ ID NO: 8344992 - DNA, 22 bp, Homo sapiens
gaggctgaggttgcagtgagct

SEQ ID NO: 8344993 - DNA, 22 bp, Homo sapiens
gaggctgaggttgcagtgagcc

SEQ ID NO: 8344994 - DNA, 22 bp, Homo sapiens
gagggagggactagcattctct

SEQ ID NO: 8344995 - DNA, 22 bp, Homo sapiens
gagggaggggagctccaccctc

SEQ ID NO: 8344996 - DNA, 22 bp, Homo sapiens
gagggctgtgaaggagcgggtt

SEQ ID NO: 8344997 - DNA, 22 bp, Homo sapiens
gaggggctggctgtggtcccat

SEQ ID NO: 8344998 - DNA, 22 bp, Homo sapiens
gaggggctgggcagtccctgga

SEQ ID NO: 8344999 - DNA, 22 bp, Homo sapiens
gaggggctgggcagtccctgga

SEQ ID NO: 8345000 - DNA, 22 bp, Homo sapiens
gaggggctggcacgatggctgc

SEQ ID NO: 8345001 - DNA, 22 bp, Homo sapiens
gaggggctggctgtggtcccat

SEQ ID NO: 8345002 - DNA, 22 bp, Homo sapiens
gaggggctggcacgatggctgc

SEQ ID NO: 8345003 - DNA, 22 bp, Homo sapiens
gaggggctgccctggtgtcagg

SEQ ID NO: 8345004 - DNA, 22 bp, Homo sapiens
gagggctgatgttgccacctca

SEQ ID NO: 8345005 - DNA, 22 bp, Homo sapiens
gagggctgccacgttgggcgag

SEQ ID NO: 8345006 - DNA, 22 bp, Homo sapiens
gagggctgctgccagatatgcc

SEQ ID NO: 8345007 - DNA, 22 bp, Homo sapiens
gagggctgatgttgccacctca

SEQ ID NO: 8345008 - DNA, 22 bp, Homo sapiens
gagggctgatgttgccacctca

SEQ ID NO: 8345009 - DNA, 22 bp, Homo sapiens
gactgaggtgcccagaggtgac

SEQ ID NO: 8345010 - DNA, 22 bp, Homo sapiens
gagaaacactgttagtttatta

SEQ ID NO: 8345011 - DNA, 22 bp, Homo sapiens
gagaaagatggaatcttacagg

SEQ ID NO: 8345012 - DNA, 22 bp, Homo sapiens
gagaaactgttggaattttaat

SEQ ID NO: 8345013 - DNA, 22 bp, Homo sapiens
gagacagatgctgctggagcat

SEQ ID NO: 8345014 - DNA, 22 bp, Homo sapiens
gagaaagcttctttcccacagg

SEQ ID NO: 8345015 - DNA, 22 bp, Homo sapiens
gagaaaggcattcctatgcaaa

SEQ ID NO: 8345016 - DNA, 23 bp, Homo sapiens
gagaccagggccagctgtgtcat

SEQ ID NO: 8345017 - DNA, 22 bp, Homo sapiens
gagaccaggaagtacagcagcc

SEQ ID NO: 8345018 - DNA, 22 bp, Homo sapiens
gagaaagcttcagaaatggcct

SEQ ID NO: 8345019 - DNA, 22 bp, Homo sapiens
gagaaagctaaataagttgatt

SEQ ID NO: 8345020 - DNA, 22 bp, Homo sapiens
gagaaagctaataggaatccta

SEQ ID NO: 8345021 - DNA, 18 bp, Homo sapiens
gagaaagcagggaatgtt

SEQ ID NO: 8345022 - DNA, 23 bp, Homo sapiens
gagaaagccggctatgatcctgg

SEQ ID NO: 8345023 - DNA, 19 bp, Homo sapiens
gagaaagcaggcacagcac

SEQ ID NO: 8345024 - DNA, 22 bp, Homo sapiens
gagagaaaagggggaattgatt

SEQ ID NO: 8345025 - DNA, 22 bp, Homo sapiens
gagactgcattgtccaagggtt

SEQ ID NO: 8345026 - DNA, 22 bp, Homo sapiens
gagacggggccctggccaggcg

SEQ ID NO: 8345027 - DNA, 22 bp, Homo sapiens
gagacctgagtcaccctgtctg

SEQ ID NO: 8345028 - DNA, 22 bp, Homo sapiens
gagacctgcagctgtagtctgc

SEQ ID NO: 8345029 - DNA, 22 bp, Homo sapiens
gagaccccagctcagcctccag

SEQ ID NO: 8345030 - DNA, 22 bp, Homo sapiens
gagaccctcttcctccctacag

SEQ ID NO: 8345031 - DNA, 22 bp, Homo sapiens
gaccagagaaaggcactggaag

SEQ ID NO: 8345032 - DNA, 21 bp, Homo sapiens
gaccacagggaaggtcttgca

SEQ ID NO: 8345033 - DNA, 22 bp, Homo sapiens
gacatttagctgttttgcattt

SEQ ID NO: 8345034 - DNA, 22 bp, Homo sapiens
gactgaggtattaagatggctt

SEQ ID NO: 8345035 - DNA, 21 bp, Homo sapiens
gactctctagtgctgtccagt

SEQ ID NO: 8345036 - DNA, 22 bp, Homo sapiens
gactcggcacttgtcttggagt

SEQ ID NO: 8345037 - DNA, 22 bp, Homo sapiens
gactctggtgtcagaagtgccc

SEQ ID NO: 8345038 - DNA, 22 bp, Homo sapiens
gacagagaggctgagcagtaca

SEQ ID NO: 8345039 - DNA, 22 bp, Homo sapiens
gacagacatttcctgatccaat

SEQ ID NO: 8345040 - DNA, 22 bp, Homo sapiens
gacagcagatgaagcctgcaga

SEQ ID NO: 8345041 - DNA, 20 bp, Homo sapiens
gacattcatagttattacca

SEQ ID NO: 8345042 - DNA, 20 bp, Homo sapiens
gacattcatagttattacca

SEQ ID NO: 8345043 - DNA, 22 bp, Homo sapiens
gacattcattaagcctttctgt

SEQ ID NO: 8345044 - DNA, 22 bp, Homo sapiens
gacattcacagtttccgatggt

SEQ ID NO: 8345045 - DNA, 22 bp, Homo sapiens
gacattcacaggtaaacattcc

SEQ ID NO: 8345046 - DNA, 22 bp, Homo sapiens
gacattgacagtcctccttata

SEQ ID NO: 8345047 - DNA, 22 bp, Homo sapiens
gacattgagtatttcttttctc

SEQ ID NO: 8345048 - DNA, 22 bp, Homo sapiens
gacatttaaggcagtcacttaa

SEQ ID NO: 8345049 - DNA, 22 bp, Homo sapiens
gacatttaaattgcaggcagcc

SEQ ID NO: 8345050 - DNA, 22 bp, Homo sapiens
gacatttaatagtattgtggga

SEQ ID NO: 8345051 - DNA, 22 bp, Homo sapiens
gaatgaataggtgtccagatgg

SEQ ID NO: 8345052 - DNA, 22 bp, Homo sapiens
gaatgattaactagttgataca

SEQ ID NO: 8345053 - DNA, 22 bp, Homo sapiens
gacacagtaatgtgtttcatct

SEQ ID NO: 8345054 - DNA, 22 bp, Homo sapiens
gacacagtaatgtgtttcatct

SEQ ID NO: 8345055 - DNA, 22 bp, Homo sapiens
gaatgatttggttgtttagatt

SEQ ID NO: 8345056 - DNA, 22 bp, Homo sapiens
gaatgatttagtgttcaaggaa

SEQ ID NO: 8345057 - DNA, 22 bp, Homo sapiens
gacacagttacttattttgcct

SEQ ID NO: 8345058 - DNA, 22 bp, Homo sapiens
gacacagtggttctgtgagtaa

SEQ ID NO: 8345059 - DNA, 22 bp, Homo sapiens
gacacagtagccagtgcagtga

SEQ ID NO: 8345060 - DNA, 19 bp, Homo sapiens
gacacagttggttcctttg

SEQ ID NO: 8345061 - DNA, 22 bp, Homo sapiens
gacacagttccctatgaggtaa

SEQ ID NO: 8345062 - DNA, 22 bp, Homo sapiens
gacagaattttccatcatgtgg

SEQ ID NO: 8345063 - DNA, 22 bp, Homo sapiens
gacagacacctggggggttgct

SEQ ID NO: 8345064 - DNA, 22 bp, Homo sapiens
gacagaattttccatcatgtgg

SEQ ID NO: 8345065 - DNA, 22 bp, Homo sapiens
gacagacaggagctcacaggca

SEQ ID NO: 8345066 - DNA, 22 bp, Homo sapiens
gaagggtgtgtgtgagggacac

SEQ ID NO: 8345067 - DNA, 22 bp, Homo sapiens
gaatctcaaattaagaatttta

SEQ ID NO: 8345068 - DNA, 22 bp, Homo sapiens
gaatcatttcttctgaaaggta

SEQ ID NO: 8345069 - DNA, 22 bp, Homo sapiens
gaatcatttagctctgcatgga

SEQ ID NO: 8345070 - DNA, 22 bp, Homo sapiens
gaatcatttatttttgacagca

SEQ ID NO: 8345071 - DNA, 22 bp, Homo sapiens
gaatcattcattgctcaattaa

SEQ ID NO: 8345072 - DNA, 22 bp, Homo sapiens
gaatcattggaaccacatccaa

SEQ ID NO: 8345073 - DNA, 22 bp, Homo sapiens
gaatatttgtaattactgttga

SEQ ID NO: 8345074 - DNA, 22 bp, Homo sapiens
gaaggcagggaatgtggtgcta

SEQ ID NO: 8345075 - DNA, 22 bp, Homo sapiens
gaagccacagagattgtggggg

SEQ ID NO: 8345076 - DNA, 22 bp, Homo sapiens
gaaaggaagaaaggtcatttta

SEQ ID NO: 8345077 - DNA, 22 bp, Homo sapiens
gaaaggagtcagtcttactgaa

SEQ ID NO: 8345078 - DNA, 22 bp, Homo sapiens
gaaaggagagggttaaggagct

SEQ ID NO: 8345079 - DNA, 22 bp, Homo sapiens
gaagcagctcagattgactgaa

SEQ ID NO: 8345080 - DNA, 22 bp, Homo sapiens
gaagcagctgccagagatgtct

SEQ ID NO: 8345081 - DNA, 22 bp, Homo sapiens
gaagcagctggtgagatggagc

SEQ ID NO: 8345082 - DNA, 22 bp, Homo sapiens
gaagcagctagcccactagtca

SEQ ID NO: 8345083 - DNA, 22 bp, Homo sapiens
gaagcagctaggatcttcattt

SEQ ID NO: 8345084 - DNA, 22 bp, Homo sapiens
gaagcagcgaagtggaagggac

SEQ ID NO: 8345085 - DNA, 22 bp, Homo sapiens
gaagcagccacggggagacaga

SEQ ID NO: 8345086 - DNA, 20 bp, Homo sapiens
gaagcagcttcatgtagaca

SEQ ID NO: 8345087 - DNA, 22 bp, Homo sapiens
gaagcagctttctggtgaggag

SEQ ID NO: 8345088 - DNA, 22 bp, Homo sapiens
gaagcagggagcagtctttgca

SEQ ID NO: 8345089 - DNA, 22 bp, Homo sapiens
gaagcagtttctgtaatgaaat

SEQ ID NO: 8345090 - DNA, 22 bp, Homo sapiens
ctccccacgcctggactaagag

SEQ ID NO: 8345091 - DNA, 22 bp, Homo sapiens
ctccccagcattctgacttcct

SEQ ID NO: 8345092 - DNA, 22 bp, Homo sapiens
ctccccacacactaggcctgat

SEQ ID NO: 8345093 - DNA, 22 bp, Homo sapiens
ctccccaaagataacggcttct

SEQ ID NO: 8345094 - DNA, 22 bp, Homo sapiens
ttgtttacactgcagaattggg

SEQ ID NO: 8345095 - DNA, 22 bp, Homo sapiens
ctccccagcattctgacttcct

SEQ ID NO: 8345096 - DNA, 22 bp, Homo sapiens
ctcccttccaatgactatgctt

SEQ ID NO: 8345097 - DNA, 22 bp, Homo sapiens
ctccggagagcagacgagggca

SEQ ID NO: 8345098 - DNA, 19 bp, Homo sapiens
ctcctcagtcccagaggtc

SEQ ID NO: 8345099 - DNA, 22 bp, Homo sapiens
ctcctcagtcaggtctagggtc

SEQ ID NO: 8345100 - DNA, 19 bp, Homo sapiens
ctcctcagtcccagaggtc

SEQ ID NO: 8345101 - DNA, 21 bp, Homo sapiens
ctcctcaggaccagccacagg

SEQ ID NO: 8345102 - DNA, 22 bp, Homo sapiens
ctcctcaggaagtagcatgtgt

SEQ ID NO: 8345103 - DNA, 22 bp, Homo sapiens
ctcctcagctgggaggagtccc

SEQ ID NO: 8345104 - DNA, 22 bp, Homo sapiens
ctctaatactgaccaagtcacc

SEQ ID NO: 8345105 - DNA, 22 bp, Homo sapiens
ctcggtggacatttcagaggtg

SEQ ID NO: 8345106 - DNA, 22 bp, Homo sapiens
tttcaaataccataaacctaat

SEQ ID NO: 8345107 - DNA, 22 bp, Homo sapiens
tttcaaataccataaacctaat

SEQ ID NO: 8345108 - DNA, 22 bp, Homo sapiens
tttcaaatgcatgtctttcctc

SEQ ID NO: 8345109 - DNA, 22 bp, Homo sapiens
tttcaaatagaatctttccaaa

SEQ ID NO: 8345110 - DNA, 22 bp, Homo sapiens
tttcaaatagaatctttccaaa

SEQ ID NO: 8345111 - DNA, 22 bp, Homo sapiens
ctcctgtgcacctccagcggca

SEQ ID NO: 8345112 - DNA, 22 bp, Homo sapiens
ctcctgtgggtcaccaataggc

SEQ ID NO: 8345113 - DNA, 22 bp, Homo sapiens
ctcctgtcagaagcatcctgag

SEQ ID NO: 8345114 - DNA, 22 bp, Homo sapiens
ctcctgggctgtcggcgctctg

SEQ ID NO: 8345115 - DNA, 22 bp, Homo sapiens
tttacaatagggtctgaatgaa

SEQ ID NO: 8345116 - DNA, 20 bp, Homo sapiens
ctcctcagttccatgggagg

SEQ ID NO: 8345117 - DNA, 22 bp, Homo sapiens
ctcctcagttgtcccatggaga

SEQ ID NO: 8345118 - DNA, 22 bp, Homo sapiens
tttacacaaaagatagcacacc

SEQ ID NO: 8345119 - DNA, 22 bp, Homo sapiens
ctcctgcctgtgggactgagga

SEQ ID NO: 8345120 - DNA, 22 bp, Homo sapiens
ctcctgcctgtgggactgagga

SEQ ID NO: 8345121 - DNA, 22 bp, Homo sapiens
tttacacatacctctttaaagt

SEQ ID NO: 8345122 - DNA, 22 bp, Homo sapiens
tttatatgtttgtacaattaag

SEQ ID NO: 8345123 - DNA, 22 bp, Homo sapiens
tttatatgtttgtacaattaag

SEQ ID NO: 8345124 - DNA, 22 bp, Homo sapiens
tttatatcttatgtcatttcaa

SEQ ID NO: 8345125 - DNA, 22 bp, Homo sapiens
tttatatctggagttgctagga

SEQ ID NO: 8345126 - DNA, 22 bp, Homo sapiens
tttatatctggagttgctagga

SEQ ID NO: 8345127 - DNA, 22 bp, Homo sapiens
tttatatccatctttgaagtaa

SEQ ID NO: 8345128 - DNA, 22 bp, Homo sapiens
ctctagcagcagcccttcctta

SEQ ID NO: 8345129 - DNA, 22 bp, Homo sapiens
ctctattagtctttgctaaata

SEQ ID NO: 8345130 - DNA, 22 bp, Homo sapiens
ctctattctaatggattctggg

SEQ ID NO: 8345131 - DNA, 22 bp, Homo sapiens
ctctatttatggcatctttatg

SEQ ID NO: 8345132 - DNA, 22 bp, Homo sapiens
tttctgatttgacttgaagtat

SEQ ID NO: 8345133 - DNA, 22 bp, Homo sapiens
tttctgatattcatttagaaga

SEQ ID NO: 8345134 - DNA, 22 bp, Homo sapiens
tttctgattctcactttggcat

SEQ ID NO: 8345135 - DNA, 22 bp, Homo sapiens
tttctgatatactgtagaatcc

SEQ ID NO: 8345136 - DNA, 22 bp, Homo sapiens
tttctgatatactgtagaatcc

SEQ ID NO: 8345137 - DNA, 22 bp, Homo sapiens
tttctgttgttggtgtctggct

SEQ ID NO: 8345138 - DNA, 22 bp, Homo sapiens
ctctgagggtctaaggagtcac

SEQ ID NO: 8345139 - DNA, 22 bp, Homo sapiens
ctctggagcgctgcttcccgcg

SEQ ID NO: 8345140 - DNA, 22 bp, Homo sapiens
ctctggaggcagcaccagccag

SEQ ID NO: 8345141 - DNA, 22 bp, Homo sapiens
ctctggaggttgagcccagcaa

SEQ ID NO: 8345142 - DNA, 22 bp, Homo sapiens
ctctggagtcaggcagccctgg

SEQ ID NO: 8345143 - DNA, 22 bp, Homo sapiens
ctctgctgtgccgccagggcct

SEQ ID NO: 8345144 - DNA, 22 bp, Homo sapiens
ctctgctgctttgccagtggaa

SEQ ID NO: 8345145 - DNA, 20 bp, Homo sapiens
ctctgctgcccgccggctgc

SEQ ID NO: 8345146 - DNA, 22 bp, Homo sapiens
ctctgctgcccaggcctgctag

SEQ ID NO: 8345147 - DNA, 22 bp, Homo sapiens
tttcttctgtttgtagttacac

SEQ ID NO: 8345148 - DNA, 22 bp, Homo sapiens
tttcttatattctgtcattgtt

SEQ ID NO: 8345149 - DNA, 19 bp, Homo sapiens
tttctgtttgcttctggtt

SEQ ID NO: 8345150 - DNA, 22 bp, Homo sapiens
tttcttcttgagtaaccagatt

SEQ ID NO: 8345151 - DNA, 22 bp, Homo sapiens
tttcttcttaatactggctgct

SEQ ID NO: 8345152 - DNA, 22 bp, Homo sapiens
tttcttctttcccagtgatggg

SEQ ID NO: 8345153 - DNA, 22 bp, Homo sapiens
ctgcagtgaaatcaggaagcaa

SEQ ID NO: 8345154 - DNA, 22 bp, Homo sapiens
ctgcaggttgagcagccaggtt

SEQ ID NO: 8345155 - DNA, 22 bp, Homo sapiens
ctgcagtatcttaaaatttgta

SEQ ID NO: 8345156 - DNA, 23 bp, Homo sapiens
ctgcagtcgccggcctgggtgcc

SEQ ID NO: 8345157 - DNA, 22 bp, Homo sapiens
ctgcatatcaaattactcctgg

SEQ ID NO: 8345158 - DNA, 22 bp, Homo sapiens
ctgcagtgttctggaatgcatt

SEQ ID NO: 8345159 - DNA, 22 bp, Homo sapiens
ctgcagggtttttcaaggacaa

SEQ ID NO: 8345160 - DNA, 22 bp, Homo sapiens
ctgcaggggcctcgagcacagg

SEQ ID NO: 8345161 - DNA, 22 bp, Homo sapiens
ctgcaggggctggagttggctt

SEQ ID NO: 8345162 - DNA, 22 bp, Homo sapiens
ctgagggctggagctgaggcct

SEQ ID NO: 8345163 - DNA, 21 bp, Homo sapiens
ctgagggccgcagctgggctc

SEQ ID NO: 8345164 - DNA, 22 bp, Homo sapiens
ctgccctgagtcatgccagatg

SEQ ID NO: 8345165 - DNA, 22 bp, Homo sapiens
ctgccctgcagctccacggact

SEQ ID NO: 8345166 - DNA, 22 bp, Homo sapiens
ctgccctgctctccgggatctt

SEQ ID NO: 8345167 - DNA, 22 bp, Homo sapiens
ctgccctgctggagatcacagt

SEQ ID NO: 8345168 - DNA, 22 bp, Homo sapiens
ctgccctgcttgatgacagcga

SEQ ID NO: 8345169 - DNA, 22 bp, Homo sapiens
ctgccctgcttgatgacagcga

SEQ ID NO: 8345170 - DNA, 22 bp, Homo sapiens
ctgcctctattcactgaggcag

SEQ ID NO: 8345171 - DNA, 22 bp, Homo sapiens
ctgccctgggccaggaagcggc

SEQ ID NO: 8345172 - DNA, 20 bp, Homo sapiens
ctgctccacccggctctcag

SEQ ID NO: 8345173 - DNA, 19 bp, Homo sapiens
ctgctccaggagctgggga

SEQ ID NO: 8345174 - DNA, 22 bp, Homo sapiens
ctgctccaggaacagagctgct

SEQ ID NO: 8345175 - DNA, 23 bp, Homo sapiens
ctgctccaggacagcatggaggt

SEQ ID NO: 8345176 - DNA, 22 bp, Homo sapiens
ctgctccacctccgggtcaggc

SEQ ID NO: 8345177 - DNA, 22 bp, Homo sapiens
ctgctccagacacctgcagggg

SEQ ID NO: 8345178 - DNA, 19 bp, Homo sapiens
ctgctccctccttctggca

SEQ ID NO: 8345179 - DNA, 22 bp, Homo sapiens
ctgctccccagcctgcgccttt

SEQ ID NO: 8345180 - DNA, 22 bp, Homo sapiens
ctgctccccagcctgcgccttt

SEQ ID NO: 8345181 - DNA, 22 bp, Homo sapiens
ctgctccaggatttcaggccag

SEQ ID NO: 8345182 - DNA, 22 bp, Homo sapiens
ctgcctgaagaattgtgttgca

SEQ ID NO: 8345183 - DNA, 22 bp, Homo sapiens
ctgcctgactgataatctctga

SEQ ID NO: 8345184 - DNA, 22 bp, Homo sapiens
ctgcctgagtacaagtcccaga

SEQ ID NO: 8345185 - DNA, 22 bp, Homo sapiens
ctgcgggctgtcaggcgtgcca

SEQ ID NO: 8345186 - DNA, 22 bp, Homo sapiens
ctgcggtgggctgggctgtccc

SEQ ID NO: 8345187 - DNA, 22 bp, Homo sapiens
ctgcctgcctggagacagatgg

SEQ ID NO: 8345188 - DNA, 22 bp, Homo sapiens
ctgctctaggggcagggccctt

SEQ ID NO: 8345189 - DNA, 22 bp, Homo sapiens
ctgctgccggcgagcctccctt

SEQ ID NO: 8345190 - DNA, 22 bp, Homo sapiens
ctgctgccggcgagcctccctt

SEQ ID NO: 8345191 - DNA, 22 bp, Homo sapiens
ctgctgcctagtccaagacgtg

SEQ ID NO: 8345192 - DNA, 22 bp, Homo sapiens
ctgctgcctgattgcagacctc

SEQ ID NO: 8345193 - DNA, 22 bp, Homo sapiens
ctgaatatcatttacatttgga

SEQ ID NO: 8345194 - DNA, 19 bp, Homo sapiens
ctgagagatgcttcacaca

SEQ ID NO: 8345195 - DNA, 22 bp, Homo sapiens
ctgagatggagttttgctcttg

SEQ ID NO: 8345196 - DNA, 22 bp, Homo sapiens
ctgagatggtagatggatgtta

SEQ ID NO: 8345197 - DNA, 22 bp, Homo sapiens
ctgagctgggagtagagactct

SEQ ID NO: 8345198 - DNA, 22 bp, Homo sapiens
ctgaggctgggcatggggtcca

SEQ ID NO: 8345199 - DNA, 18 bp, Homo sapiens
ctgagggcagcccctggg

SEQ ID NO: 8345200 - DNA, 21 bp, Homo sapiens
ctgagcttattgaaaggaaga

SEQ ID NO: 8345201 - DNA, 22 bp, Homo sapiens
ctgagctgtttaatcccagata

SEQ ID NO: 8345202 - DNA, 22 bp, Homo sapiens
ctgagctggtggaagcatgcag

SEQ ID NO: 8345203 - DNA, 19 bp, Homo sapiens
ctgaaacacagagagggct

SEQ ID NO: 8345204 - DNA, 22 bp, Homo sapiens
ctgaaagaataagatgtttaca

SEQ ID NO: 8345205 - DNA, 22 bp, Homo sapiens
ctgaaactatggggaggggagc

SEQ ID NO: 8345206 - DNA, 22 bp, Homo sapiens
ctgaaactacagtaaggagaac

SEQ ID NO: 8345207 - DNA, 20 bp, Homo sapiens
tttttctgggcttccatagc

SEQ ID NO: 8345208 - DNA, 20 bp, Homo sapiens
tttttctgggcttccatagc

SEQ ID NO: 8345209 - DNA, 22 bp, Homo sapiens
tttttctgtctcttacattgca

SEQ ID NO: 8345210 - DNA, 22 bp, Homo sapiens
ctgaaggatttagttctttgct

SEQ ID NO: 8345211 - DNA, 22 bp, Homo sapiens
ctgaagcaaaggatcgagctaa

SEQ ID NO: 8345212 - DNA, 22 bp, Homo sapiens
ctgaaggacacgtgaggagcca

SEQ ID NO: 8345213 - DNA, 20 bp, Homo sapiens
ctgaaagacgtaacagtgca

SEQ ID NO: 8345214 - DNA, 22 bp, Homo sapiens
ctgaaggacttggtgatagttg

SEQ ID NO: 8345215 - DNA, 22 bp, Homo sapiens
ctgaaggagaaggccactgttc

SEQ ID NO: 8345216 - DNA, 22 bp, Homo sapiens
ctgaaggagcatagtcagtttt

SEQ ID NO: 8345217 - DNA, 22 bp, Homo sapiens
ctgaaggaggtagagtgacata

SEQ ID NO: 8345218 - DNA, 22 bp, Homo sapiens
ctgaaggattagagagcactta

SEQ ID NO: 8345219 - DNA, 22 bp, Homo sapiens
ctgaaggattcaaaatggcagg

SEQ ID NO: 8345220 - DNA, 18 bp, Homo sapiens
ctgaaggatccaggtgta

SEQ ID NO: 8345221 - DNA, 22 bp, Homo sapiens
ctgaaggatgtgtggtgggagt

SEQ ID NO: 8345222 - DNA, 22 bp, Homo sapiens
ttttcctggggcttctggactc

SEQ ID NO: 8345223 - DNA, 22 bp, Homo sapiens
ttttcctctgtatttgaaatgc

SEQ ID NO: 8345224 - DNA, 22 bp, Homo sapiens
ttttcctctgttattagtgtga

SEQ ID NO: 8345225 - DNA, 22 bp, Homo sapiens
ttttcctgcctgtctctagagg

SEQ ID NO: 8345226 - DNA, 22 bp, Homo sapiens
ctctggagtgcagcctggtggc

SEQ ID NO: 8345227 - DNA, 22 bp, Homo sapiens
ctctggagtcctgtatcactcc

SEQ ID NO: 8345228 - DNA, 22 bp, Homo sapiens
ctctggagtcctgtatcactcc

SEQ ID NO: 8345229 - DNA, 22 bp, Homo sapiens
ttttcagttgtgctctctagtt

SEQ ID NO: 8345230 - DNA, 22 bp, Homo sapiens
tttttctgagcggtaatcatca

SEQ ID NO: 8345231 - DNA, 22 bp, Homo sapiens
tttttctagaccttaaaggcca

SEQ ID NO: 8345232 - DNA, 22 bp, Homo sapiens
tttttctagctcaaagattcta

SEQ ID NO: 8345233 - DNA, 22 bp, Homo sapiens
cggctgggttcggctgcaggcc

SEQ ID NO: 8345234 - DNA, 22 bp, Homo sapiens
cggctgggtagaggtgccgggt

SEQ ID NO: 8345235 - DNA, 22 bp, Homo sapiens
cggctggtgtcgggcacagcaa

SEQ ID NO: 8345236 - DNA, 22 bp, Homo sapiens
cggctgggttcggctgcaggcc

SEQ ID NO: 8345237 - DNA, 22 bp, Homo sapiens
ttcagtttcagtcttgcaaaaa

SEQ ID NO: 8345238 - DNA, 22 bp, Homo sapiens
ttcagtttctaaatgctcctct

SEQ ID NO: 8345239 - DNA, 22 bp, Homo sapiens
ttcagtttcgttatctatgaga

SEQ ID NO: 8345240 - DNA, 22 bp, Homo sapiens
ttcctctcaacatgcctgccgg

SEQ ID NO: 8345241 - DNA, 22 bp, Homo sapiens
ttcctctcctcccaccaggtga

SEQ ID NO: 8345242 - DNA, 17 bp, Homo sapiens
ttcctctcacatttttt

SEQ ID NO: 8345243 - DNA, 22 bp, Homo sapiens
ttcctctcctcacatgagtcac

SEQ ID NO: 8345244 - DNA, 22 bp, Homo sapiens
ttcctctctcttgccagaatgt

SEQ ID NO: 8345245 - DNA, 22 bp, Homo sapiens
ttcctctcgctctccggggccc

SEQ ID NO: 8345246 - DNA, 22 bp, Homo sapiens
ttcctaaaagctgagtagagaa

SEQ ID NO: 8345247 - DNA, 22 bp, Homo sapiens
cgtcctgctcggcgcgcctcgg

SEQ ID NO: 8345248 - DNA, 22 bp, Homo sapiens
cgtcctcagaggccatccgaaa

SEQ ID NO: 8345249 - DNA, 22 bp, Homo sapiens
cgtctctggcccggcccctggg

SEQ ID NO: 8345250 - DNA, 22 bp, Homo sapiens
cgtctaggccgtgccctgaggt

SEQ ID NO: 8345251 - DNA, 20 bp, Homo sapiens
cgtccccttgagcaggtccc

SEQ ID NO: 8345252 - DNA, 22 bp, Homo sapiens
ttccactttgggtctgtgcagg

SEQ ID NO: 8345253 - DNA, 22 bp, Homo sapiens
ttccactctatgatagaagggt

SEQ ID NO: 8345254 - DNA, 22 bp, Homo sapiens
ttccactcttctctggacttat

SEQ ID NO: 8345255 - DNA, 22 bp, Homo sapiens
ttccagaaaaaaatgtatatct

SEQ ID NO: 8345256 - DNA, 22 bp, Homo sapiens
ttctacatatatttttctcact

SEQ ID NO: 8345257 - DNA, 22 bp, Homo sapiens
ctaaatgtcatggagttgtaga

SEQ ID NO: 8345258 - DNA, 22 bp, Homo sapiens
ctaaatgtcatggagttgtaga

SEQ ID NO: 8345259 - DNA, 22 bp, Homo sapiens
ctaaatgtctcagagggagaca

SEQ ID NO: 8345260 - DNA, 22 bp, Homo sapiens
ctaaatgtgactcaccatctca

SEQ ID NO: 8345261 - DNA, 22 bp, Homo sapiens
ctaaatgtgactcaccatctca

SEQ ID NO: 8345262 - DNA, 22 bp, Homo sapiens
ctaaatgtcagagtagcttgca

SEQ ID NO: 8345263 - DNA, 22 bp, Homo sapiens
ctaaatgttttatcttcctggc

SEQ ID NO: 8345264 - DNA, 22 bp, Homo sapiens
ctaaatgttttatcttcctggc

SEQ ID NO: 8345265 - DNA, 22 bp, Homo sapiens
ctaaatgttggtgttccccaca

SEQ ID NO: 8345266 - DNA, 22 bp, Homo sapiens
ctaaatgttggtgttccccaca

SEQ ID NO: 8345267 - DNA, 20 bp, Homo sapiens
ctaaatgttggaggggcttc

SEQ ID NO: 8345268 - DNA, 22 bp, Homo sapiens
ctaaatgttcacatgcaatttt

SEQ ID NO: 8345269 - DNA, 22 bp, Homo sapiens
ctaaatgtgctaatagcatgaa

SEQ ID NO: 8345270 - DNA, 22 bp, Homo sapiens
ctacattatgtttattgggact

SEQ ID NO: 8345271 - DNA, 22 bp, Homo sapiens
ctacattaaattggcttactta

SEQ ID NO: 8345272 - DNA, 22 bp, Homo sapiens
ctacatgtaggtttccttaatt

SEQ ID NO: 8345273 - DNA, 22 bp, Homo sapiens
ctacagtgtcgtgtggtttctg

SEQ ID NO: 8345274 - DNA, 22 bp, Homo sapiens
ttctacatttaaaaggaaaatc

SEQ ID NO: 8345275 - DNA, 22 bp, Homo sapiens
ttctacatgtcaagtctccaag

SEQ ID NO: 8345276 - DNA, 22 bp, Homo sapiens
ttctacattgtgaagttcttta

SEQ ID NO: 8345277 - DNA, 22 bp, Homo sapiens
ttctacattgtgaagttcttta

SEQ ID NO: 8345278 - DNA, 22 bp, Homo sapiens
ttctccttgttcccttcaattg

SEQ ID NO: 8345279 - DNA, 22 bp, Homo sapiens
ctagtgtttattaatcatgagg

SEQ ID NO: 8345280 - DNA, 22 bp, Homo sapiens
ctagtgtagctcttgtaagcag

SEQ ID NO: 8345281 - DNA, 22 bp, Homo sapiens
ctagttctagatccctgaggaa

SEQ ID NO: 8345282 - DNA, 22 bp, Homo sapiens
ctagtgctctaggggctgaagg

SEQ ID NO: 8345283 - DNA, 22 bp, Homo sapiens
ctagttgaagaggctgtcatca

SEQ ID NO: 8345284 - DNA, 22 bp, Homo sapiens
ctataaatctacccagcattgg

SEQ ID NO: 8345285 - DNA, 22 bp, Homo sapiens
ttctcatagagacatgattata

SEQ ID NO: 8345286 - DNA, 22 bp, Homo sapiens
ttctcattctgactcagtgtag

SEQ ID NO: 8345287 - DNA, 22 bp, Homo sapiens
ttctcctgcccttggacttcca

SEQ ID NO: 8345288 - DNA, 22 bp, Homo sapiens
ttctcctggagtgcttgttggg

SEQ ID NO: 8345289 - DNA, 22 bp, Homo sapiens
ttctcatgaaactcgcttcctc

SEQ ID NO: 8345290 - DNA, 22 bp, Homo sapiens
ttctcatgatgcaattcatccc

SEQ ID NO: 8345291 - DNA, 22 bp, Homo sapiens
ttctcatgtaaatgccatcatc

SEQ ID NO: 8345292 - DNA, 22 bp, Homo sapiens
ttctcatggtgtctttatacat

SEQ ID NO: 8345293 - DNA, 22 bp, Homo sapiens
ttctcatagatgctatagacag

SEQ ID NO: 8345294 - DNA, 22 bp, Homo sapiens
ttgaatctctctgagattcagt

SEQ ID NO: 8345295 - DNA, 22 bp, Homo sapiens
ctcactgcaatctccgtctccc

SEQ ID NO: 8345296 - DNA, 22 bp, Homo sapiens
ctcactgcaagctctgcctccc

SEQ ID NO: 8345297 - DNA, 22 bp, Homo sapiens
ctcactgcaagctctgcctccc

SEQ ID NO: 8345298 - DNA, 22 bp, Homo sapiens
ctcactgcaagctctgcctcca

SEQ ID NO: 8345299 - DNA, 22 bp, Homo sapiens
ctcactgcaagctctgcctcca

SEQ ID NO: 8345300 - DNA, 22 bp, Homo sapiens
ttcttcattcccttacttccga

SEQ ID NO: 8345301 - DNA, 22 bp, Homo sapiens
ttcttcatctgtaagataagca

SEQ ID NO: 8345302 - DNA, 22 bp, Homo sapiens
ttgaaggacatcttgtttctag

SEQ ID NO: 8345303 - DNA, 22 bp, Homo sapiens
ttgaaggaggctcctttttaaa

SEQ ID NO: 8345304 - DNA, 21 bp, Homo sapiens
ttgaaggatcacttctgtacc

SEQ ID NO: 8345305 - DNA, 23 bp, Homo sapiens
ttgaaggagaaagctttcttggt

SEQ ID NO: 8345306 - DNA, 22 bp, Homo sapiens
ttctgaaataggagatagctgt

SEQ ID NO: 8345307 - DNA, 22 bp, Homo sapiens
ttctgaaagtctttttaagtta

SEQ ID NO: 8345308 - DNA, 22 bp, Homo sapiens
ttctgaaattcgactatccaat

SEQ ID NO: 8345309 - DNA, 22 bp, Homo sapiens
ttctgaaatgagatataaggta

SEQ ID NO: 8345310 - DNA, 22 bp, Homo sapiens
ttctgaaagccaattcattgaa

SEQ ID NO: 8345311 - DNA, 22 bp, Homo sapiens
ttctgaaagtctttttaagtta

SEQ ID NO: 8345312 - DNA, 22 bp, Homo sapiens
ttctgaaaggcatgtcaggtag

SEQ ID NO: 8345313 - DNA, 22 bp, Homo sapiens
ttctgaaaggcaggttgtttgc

SEQ ID NO: 8345314 - DNA, 22 bp, Homo sapiens
ttctgaaatttcaactttacta

SEQ ID NO: 8345315 - DNA, 22 bp, Homo sapiens
ttctgaaatttctgtagatctt

SEQ ID NO: 8345316 - DNA, 22 bp, Homo sapiens
ttctgtctccctgatgtagagc

SEQ ID NO: 8345317 - DNA, 22 bp, Homo sapiens
ctataaatctacccagcattgg

SEQ ID NO: 8345318 - DNA, 22 bp, Homo sapiens
ttctgaaaacacactttgcagc

SEQ ID NO: 8345319 - DNA, 22 bp, Homo sapiens
ttctgaaaattgggtcatactt

SEQ ID NO: 8345320 - DNA, 23 bp, Homo sapiens
ttctgaaaatagatagtggctcc

SEQ ID NO: 8345321 - DNA, 20 bp, Homo sapiens
ttctgaaagcagcagaggga

SEQ ID NO: 8345322 - DNA, 22 bp, Homo sapiens
ttctgaaaccttcagtatgaag

SEQ ID NO: 8345323 - DNA, 22 bp, Homo sapiens
ttctgaaaccttcagtatgaag

SEQ ID NO: 8345324 - DNA, 22 bp, Homo sapiens
ttctgaaaccactgaccaacta

SEQ ID NO: 8345325 - DNA, 22 bp, Homo sapiens
ttcttacaaacaagatcattga

SEQ ID NO: 8345326 - DNA, 22 bp, Homo sapiens
ttcttacaagtatgacgtagca

SEQ ID NO: 8345327 - DNA, 20 bp, Homo sapiens
ttcttaaagacctcactttg

SEQ ID NO: 8345328 - DNA, 22 bp, Homo sapiens
ttcttaaagaggcaaaacacag

SEQ ID NO: 8345329 - DNA, 22 bp, Homo sapiens
ttcttaactcaaatatatatcc

SEQ ID NO: 8345330 - DNA, 22 bp, Homo sapiens
ttcttaagaaaccatcacattc

SEQ ID NO: 8345331 - DNA, 22 bp, Homo sapiens
ttgcaccaaatgagttaaaatt

SEQ ID NO: 8345332 - DNA, 21 bp, Homo sapiens
ttgcaccatgataaattcaga

SEQ ID NO: 8345333 - DNA, 22 bp, Homo sapiens
ttgcaccatttcacttccatta

SEQ ID NO: 8345334 - DNA, 18 bp, Homo sapiens
ctcaggcctttccctgtg

SEQ ID NO: 8345335 - DNA, 22 bp, Homo sapiens
ctcaggcctgagtggcagtccc

SEQ ID NO: 8345336 - DNA, 22 bp, Homo sapiens
ttgcacagatgagcttatttaa

SEQ ID NO: 8345337 - DNA, 22 bp, Homo sapiens
ttgcacagatgagggtgatgct

SEQ ID NO: 8345338 - DNA, 22 bp, Homo sapiens
ttgcacaggcagtaattgcttg

SEQ ID NO: 8345339 - DNA, 22 bp, Homo sapiens
ttgctgccttggagaagctcct

SEQ ID NO: 8345340 - DNA, 22 bp, Homo sapiens
ttgctgataccatgaatgttaa

SEQ ID NO: 8345341 - DNA, 22 bp, Homo sapiens
ttgctgatggagggaatgctca

SEQ ID NO: 8345342 - DNA, 22 bp, Homo sapiens
ttgctgatctgaaacgttactg

SEQ ID NO: 8345343 - DNA, 22 bp, Homo sapiens
ttgctgtagctactatgtattc

SEQ ID NO: 8345344 - DNA, 22 bp, Homo sapiens
ttgatcaaatcagctactgagg

SEQ ID NO: 8345345 - DNA, 22 bp, Homo sapiens
ttgcaaaaccatcctaagtaaa

SEQ ID NO: 8345346 - DNA, 22 bp, Homo sapiens
ttgcaaaagcaattgcagtttt

SEQ ID NO: 8345347 - DNA, 22 bp, Homo sapiens
ttgcaaagaattttacattcta

SEQ ID NO: 8345348 - DNA, 22 bp, Homo sapiens
ctcaggccattcttccagctgc

SEQ ID NO: 8345349 - DNA, 22 bp, Homo sapiens
ctcaggccaataagctccagcc

SEQ ID NO: 8345350 - DNA, 22 bp, Homo sapiens
ctcaggccaggtttctcccaca

SEQ ID NO: 8345351 - DNA, 22 bp, Homo sapiens
ctcagccccaattctccccatt

SEQ ID NO: 8345352 - DNA, 22 bp, Homo sapiens
ctcagccatgcaacatgctggg

SEQ ID NO: 8345353 - DNA, 22 bp, Homo sapiens
ctcagccaggtgggggtcggga

SEQ ID NO: 8345354 - DNA, 22 bp, Homo sapiens
ctcagccagacatgacccagtc

SEQ ID NO: 8345355 - DNA, 22 bp, Homo sapiens
ttattattttgtgtacagcaaa

SEQ ID NO: 8345356 - DNA, 22 bp, Homo sapiens
ttattattgtggttgcattatc

SEQ ID NO: 8345357 - DNA, 22 bp, Homo sapiens
ttattattgtgacctgagaatg

SEQ ID NO: 8345358 - DNA, 22 bp, Homo sapiens
ttatttcattgatttctaagac

SEQ ID NO: 8345359 - DNA, 22 bp, Homo sapiens
ttatttttaaaagttcacacag

SEQ ID NO: 8345360 - DNA, 17 bp, Homo sapiens
ttattttttgggctgag

SEQ ID NO: 8345361 - DNA, 22 bp, Homo sapiens
ttcaaaaaggtatgttcaagtc

SEQ ID NO: 8345362 - DNA, 22 bp, Homo sapiens
ttatttttaaaagttcacacag

SEQ ID NO: 8345363 - DNA, 22 bp, Homo sapiens
cgcagagggagccgcgggctgc

SEQ ID NO: 8345364 - DNA, 22 bp, Homo sapiens
cgatggttctggctgcttgtat

SEQ ID NO: 8345365 - DNA, 22 bp, Homo sapiens
cgcaccactgaattccagcctg

SEQ ID NO: 8345366 - DNA, 19 bp, Homo sapiens
cctttgaatcaggacactt

SEQ ID NO: 8345367 - DNA, 22 bp, Homo sapiens
ttatgtatgaatatagtagaag

SEQ ID NO: 8345368 - DNA, 22 bp, Homo sapiens
ttatgggagcaattggggaggt

SEQ ID NO: 8345369 - DNA, 22 bp, Homo sapiens
ttatctacgtatttaaactctt

SEQ ID NO: 8345370 - DNA, 17 bp, Homo sapiens
ttatctactgctactgt

SEQ ID NO: 8345371 - DNA, 22 bp, Homo sapiens
ttatggcattcattggggcttt

SEQ ID NO: 8345372 - DNA, 22 bp, Homo sapiens
ccttgggaccctgctggaggtt

SEQ ID NO: 8345373 - DNA, 22 bp, Homo sapiens
ccttggggaactggacgtgctg

SEQ ID NO: 8345374 - DNA, 22 bp, Homo sapiens
ccttggggaactggacgtgctg

SEQ ID NO: 8345375 - DNA, 22 bp, Homo sapiens
ttacagaagagaaagaattcag

SEQ ID NO: 8345376 - DNA, 21 bp, Homo sapiens
ccttctcttgcttcagcttca

SEQ ID NO: 8345377 - DNA, 22 bp, Homo sapiens
ttacagaagtattgagagatcc

SEQ ID NO: 8345378 - DNA, 20 bp, Homo sapiens
ttacagaaatgatgttattt

SEQ ID NO: 8345379 - DNA, 22 bp, Homo sapiens
ttacagaaaggaaggactgact

SEQ ID NO: 8345380 - DNA, 22 bp, Homo sapiens
ttacagaaaatgtgttttaact

SEQ ID NO: 8345381 - DNA, 22 bp, Homo sapiens
ttaccgagaacatgactggaat

SEQ ID NO: 8345382 - DNA, 22 bp, Homo sapiens
ttacctaaaatagctcaattta

SEQ ID NO: 8345383 - DNA, 22 bp, Homo sapiens
ttaccacagtgcatgacttctg

SEQ ID NO: 8345384 - DNA, 22 bp, Homo sapiens
ccttctgagcttcaatttcagt

SEQ ID NO: 8345385 - DNA, 22 bp, Homo sapiens
ccttctgataactgtgaaattg

SEQ ID NO: 8345386 - DNA, 22 bp, Homo sapiens
ccttctgatactgacatcattt

SEQ ID NO: 8345387 - DNA, 22 bp, Homo sapiens
ttaatgacttatatttaaagca

SEQ ID NO: 8345388 - DNA, 22 bp, Homo sapiens
ttaatcaagagtggggactgtg

SEQ ID NO: 8345389 - DNA, 22 bp, Homo sapiens
cctgtgctttaggcctcaaact

SEQ ID NO: 8345390 - DNA, 22 bp, Homo sapiens
cctgtggacattctgtgtggaa

SEQ ID NO: 8345391 - DNA, 20 bp, Homo sapiens
cctgtggagctgcctcctcc

SEQ ID NO: 8345392 - DNA, 22 bp, Homo sapiens
cctgtgcttggccagagaggtt

SEQ ID NO: 8345393 - DNA, 22 bp, Homo sapiens
cctgtggagttcccatctgaat

SEQ ID NO: 8345394 - DNA, 22 bp, Homo sapiens
ttacaatagttccttcttttgt

SEQ ID NO: 8345395 - DNA, 18 bp, Homo sapiens
cctgtggctcagcccaca

SEQ ID NO: 8345396 - DNA, 18 bp, Homo sapiens
cctgtggctcagcccaca

SEQ ID NO: 8345397 - DNA, 22 bp, Homo sapiens
cctgtactagggtctcattgcc

SEQ ID NO: 8345398 - DNA, 22 bp, Homo sapiens
cctgtacacggtctatgcctcc

SEQ ID NO: 8345399 - DNA, 21 bp, Homo sapiens
ttaaaatgaggaagtggtggc

SEQ ID NO: 8345400 - DNA, 22 bp, Homo sapiens
ttaaaagggtaagcagcaactt

SEQ ID NO: 8345401 - DNA, 22 bp, Homo sapiens
tggttagactcaccttatagtt

SEQ ID NO: 8345402 - DNA, 22 bp, Homo sapiens
tggttcatagcctcacaggata

SEQ ID NO: 8345403 - DNA, 22 bp, Homo sapiens
cctgcgggctggtaagaggctt

SEQ ID NO: 8345404 - DNA, 22 bp, Homo sapiens
cctgcgggctgtgctgaagcct

SEQ ID NO: 8345405 - DNA, 22 bp, Homo sapiens
cctgctccatgctcaccatcag

SEQ ID NO: 8345406 - DNA, 22 bp, Homo sapiens
cctgctccatgctcaccatcag

SEQ ID NO: 8345407 - DNA, 23 bp, Homo sapiens
cctgctcaggcgtgtgccctgct

SEQ ID NO: 8345408 - DNA, 22 bp, Homo sapiens
cctgctcagctgtcctcacgct

SEQ ID NO: 8345409 - DNA, 22 bp, Homo sapiens
cctgctcagccccagctcaccc

SEQ ID NO: 8345410 - DNA, 20 bp, Homo sapiens
tgttccatgactatttggat

SEQ ID NO: 8345411 - DNA, 22 bp, Homo sapiens
tgttccatgtctttgtaggact

SEQ ID NO: 8345412 - DNA, 17 bp, Homo sapiens
tgttccatttgaccacc

SEQ ID NO: 8345413 - DNA, 22 bp, Homo sapiens
cctgctcccgggacgcgttcac

SEQ ID NO: 8345414 - DNA, 22 bp, Homo sapiens
cctgctccatgctcaccatcag

SEQ ID NO: 8345415 - DNA, 22 bp, Homo sapiens
cctgctcctatctgggctcatt

SEQ ID NO: 8345416 - DNA, 20 bp, Homo sapiens
tgttgattggtgtcatctca

SEQ ID NO: 8345417 - DNA, 20 bp, Homo sapiens
tgttggcaattgttgtttcc

SEQ ID NO: 8345418 - DNA, 22 bp, Homo sapiens
tgttgctcttttttaggtgagt

SEQ ID NO: 8345419 - DNA, 22 bp, Homo sapiens
tgtttcttctcacacaaactca

SEQ ID NO: 8345420 - DNA, 17 bp, Homo sapiens
tgttttcattcattgct

SEQ ID NO: 8345421 - DNA, 22 bp, Homo sapiens
tgtttctatctggatcaataga

SEQ ID NO: 8345422 - DNA, 22 bp, Homo sapiens
tgtttctaggtcaataattttt

SEQ ID NO: 8345423 - DNA, 22 bp, Homo sapiens
tgtttctagagaaaatatttac

SEQ ID NO: 8345424 - DNA, 22 bp, Homo sapiens
cctggggctcaagatggcgccg

SEQ ID NO: 8345425 - DNA, 22 bp, Homo sapiens
cctggggctcaagatggcgccg

SEQ ID NO: 8345426 - DNA, 22 bp, Homo sapiens
cctggggccccgagccagaagc

SEQ ID NO: 8345427 - DNA, 23 bp, Homo sapiens
cctggggcacttgagtcctcatc

SEQ ID NO: 8345428 - DNA, 23 bp, Homo sapiens
cctggggcacttgagtcctcatc

SEQ ID NO: 8345429 - DNA, 22 bp, Homo sapiens
cctggggccccgagccagaagc

SEQ ID NO: 8345430 - DNA, 23 bp, Homo sapiens
cctggggagctgtatccagagtg

SEQ ID NO: 8345431 - DNA, 23 bp, Homo sapiens
cctggggcacttgagtcctcatc

SEQ ID NO: 8345432 - DNA, 22 bp, Homo sapiens
cctggggagccgcctgagcccc

SEQ ID NO: 8345433 - DNA, 22 bp, Homo sapiens
gggctctcaaggcagggcccca

SEQ ID NO: 8345434 - DNA, 21 bp, Homo sapiens
gggctctcctgaggccatgaa

SEQ ID NO: 8345435 - DNA, 22 bp, Homo sapiens
gggctctcccacaacgtgccag

SEQ ID NO: 8345436 - DNA, 19 bp, Homo sapiens
gggctccttgggcctctct

SEQ ID NO: 8345437 - DNA, 22 bp, Homo sapiens
gggctcggcatctgtggactct

SEQ ID NO: 8345438 - DNA, 22 bp, Homo sapiens
gggctcctgcctcctggcacct

SEQ ID NO: 8345439 - DNA, 22 bp, Homo sapiens
gggctcctgcctcctggcacct

SEQ ID NO: 8345440 - DNA, 22 bp, Homo sapiens
gggctcctcctctgactgtggc

SEQ ID NO: 8345441 - DNA, 22 bp, Homo sapiens
gggctctctttttggcctgccc

SEQ ID NO: 8345442 - DNA, 22 bp, Homo sapiens
gggctctgaatcccaggtctgc

SEQ ID NO: 8345443 - DNA, 22 bp, Homo sapiens
gggctggcatcggttgctgaga

SEQ ID NO: 8345444 - DNA, 20 bp, Homo sapiens
gggctggcgcatggggaaag

SEQ ID NO: 8345445 - DNA, 22 bp, Homo sapiens
gggctggcgggaaaggcaattc

SEQ ID NO: 8345446 - DNA, 22 bp, Homo sapiens
gggctggctaagacttttctgt

SEQ ID NO: 8345447 - DNA, 22 bp, Homo sapiens
gggctggctcccaggtgttgaa

SEQ ID NO: 8345448 - DNA, 20 bp, Homo sapiens
gggctggctcaactggatcc

SEQ ID NO: 8345449 - DNA, 17 bp, Homo sapiens
gggctcctcccctgggg

SEQ ID NO: 8345450 - DNA, 22 bp, Homo sapiens
gggctccagccagctccttgtg

SEQ ID NO: 8345451 - DNA, 20 bp, Homo sapiens
gggctccagctgtgattctt

SEQ ID NO: 8345452 - DNA, 22 bp, Homo sapiens
gggctccacctagggacactgg

SEQ ID NO: 8345453 - DNA, 22 bp, Homo sapiens
gggctccagaggctcaccctgg

SEQ ID NO: 8345454 - DNA, 22 bp, Homo sapiens
gggcatgacttttggagtggga

SEQ ID NO: 8345455 - DNA, 22 bp, Homo sapiens
gggcatgagagggcagctggca

SEQ ID NO: 8345456 - DNA, 22 bp, Homo sapiens
gggcagtttattctagatggtt

SEQ ID NO: 8345457 - DNA, 22 bp, Homo sapiens
gggcatcttctgtagccatctc

SEQ ID NO: 8345458 - DNA, 21 bp, Homo sapiens
gggcatcctttcccaccctgc

SEQ ID NO: 8345459 - DNA, 23 bp, Homo sapiens
gggcagttatgttgtccttggct

SEQ ID NO: 8345460 - DNA, 19 bp, Homo sapiens
gggcatcaaagtgctggtg

SEQ ID NO: 8345461 - DNA, 22 bp, Homo sapiens
gggcagttgctacaatatggct

SEQ ID NO: 8345462 - DNA, 22 bp, Homo sapiens
gggcagttgatggaggtctgga

SEQ ID NO: 8345463 - DNA, 22 bp, Homo sapiens
gggcctcagctctgctctgcaa

SEQ ID NO: 8345464 - DNA, 22 bp, Homo sapiens
gggcctcagctggagtctgcct

SEQ ID NO: 8345465 - DNA, 22 bp, Homo sapiens
gggcctcagctgccaacaggat

SEQ ID NO: 8345466 - DNA, 22 bp, Homo sapiens
gggcctctcccttctcacgcat

SEQ ID NO: 8345467 - DNA, 22 bp, Homo sapiens
gggcctgccaggctttcagcat

SEQ ID NO: 8345468 - DNA, 22 bp, Homo sapiens
gggcctgaggcttccctaatgc

SEQ ID NO: 8345469 - DNA, 22 bp, Homo sapiens
gggcctgccattgctgccccag

SEQ ID NO: 8345470 - DNA, 22 bp, Homo sapiens
gggcctggcatgcagccccgtt

SEQ ID NO: 8345471 - DNA, 22 bp, Homo sapiens
gggcctggggacaccaccatga

SEQ ID NO: 8345472 - DNA, 22 bp, Homo sapiens
gggggcagtaaggatatggaaa

SEQ ID NO: 8345473 - DNA, 20 bp, Homo sapiens
gggggccagcagcagacgcc

SEQ ID NO: 8345474 - DNA, 22 bp, Homo sapiens
gggggccagtcatctcccaaga

SEQ ID NO: 8345475 - DNA, 22 bp, Homo sapiens
gggggagagacgagcggctctg

SEQ ID NO: 8345476 - DNA, 22 bp, Homo sapiens
gggggagagacgagcggctctg

SEQ ID NO: 8345477 - DNA, 22 bp, Homo sapiens
gggggccagtgtctcttccttg

SEQ ID NO: 8345478 - DNA, 22 bp, Homo sapiens
gggggccatcttcaaggatgtg

SEQ ID NO: 8345479 - DNA, 23 bp, Homo sapiens
gggggccgtcctggggattatag

SEQ ID NO: 8345480 - DNA, 22 bp, Homo sapiens
gggggcgccccatggaggtgag

SEQ ID NO: 8345481 - DNA, 22 bp, Homo sapiens
gggggcgccgccgctcatctca

SEQ ID NO: 8345482 - DNA, 22 bp, Homo sapiens
gggggcgcacagtcaccacaaa

SEQ ID NO: 8345483 - DNA, 21 bp, Homo sapiens
gggtataaaatggtatctcat

SEQ ID NO: 8345484 - DNA, 22 bp, Homo sapiens
gggggcgggagacagcagtgac

SEQ ID NO: 8345485 - DNA, 22 bp, Homo sapiens
gggggcgggagacagcagtgac

SEQ ID NO: 8345486 - DNA, 22 bp, Homo sapiens
gggggaagactgggctagtgat

SEQ ID NO: 8345487 - DNA, 22 bp, Homo sapiens
gggggactggaccgtcctgggt

SEQ ID NO: 8345488 - DNA, 22 bp, Homo sapiens
ggggcttccagcgcccgccggt

SEQ ID NO: 8345489 - DNA, 22 bp, Homo sapiens
ggggcttctttctgccaccgac

SEQ ID NO: 8345490 - DNA, 22 bp, Homo sapiens
ggggctggtggtggtttctcca

SEQ ID NO: 8345491 - DNA, 22 bp, Homo sapiens
ggggcaggaggtgttctctttt

SEQ ID NO: 8345492 - DNA, 22 bp, Homo sapiens
ggggcaggagcccttcttcagc

SEQ ID NO: 8345493 - DNA, 22 bp, Homo sapiens
ggggcaggagcccttcttcagc

SEQ ID NO: 8345494 - DNA, 22 bp, Homo sapiens
ggggcagctcccgagggcagga

SEQ ID NO: 8345495 - DNA, 22 bp, Homo sapiens
ggggcagaaagcccacagagtg

SEQ ID NO: 8345496 - DNA, 22 bp, Homo sapiens
ggggcagaaagcccacagagtg

SEQ ID NO: 8345497 - DNA, 22 bp, Homo sapiens
ggggcagctcccgagggcagga

SEQ ID NO: 8345498 - DNA, 22 bp, Homo sapiens
ggggcagctcccgagggcagga

SEQ ID NO: 8345499 - DNA, 22 bp, Homo sapiens
ggggcacctcctcttggcaatt

SEQ ID NO: 8345500 - DNA, 22 bp, Homo sapiens
ggggatggattccgggtccctg

SEQ ID NO: 8345501 - DNA, 22 bp, Homo sapiens
ggggatggaggcgtgtggtcct

SEQ ID NO: 8345502 - DNA, 22 bp, Homo sapiens
ggggatggtagaccggtgacgt

SEQ ID NO: 8345503 - DNA, 22 bp, Homo sapiens
ggggatggaatgtagtagtgat

SEQ ID NO: 8345504 - DNA, 22 bp, Homo sapiens
ggggatggaggcgtgtggtcct

SEQ ID NO: 8345505 - DNA, 22 bp, Homo sapiens
gggctgggatggcttgaagatt

SEQ ID NO: 8345506 - DNA, 22 bp, Homo sapiens
gggctgggatggcttgaagatt

SEQ ID NO: 8345507 - DNA, 22 bp, Homo sapiens
gggctggctctgtctagaaagg

SEQ ID NO: 8345508 - DNA, 22 bp, Homo sapiens
gggctggctgattttcctctct

SEQ ID NO: 8345509 - DNA, 22 bp, Homo sapiens
gggctgggcatggtgttccctc

SEQ ID NO: 8345510 - DNA, 22 bp, Homo sapiens
gggctgggattgcttgctgtga

SEQ ID NO: 8345511 - DNA, 23 bp, Homo sapiens
ggtaccagcacagagtggagagg

SEQ ID NO: 8345512 - DNA, 23 bp, Homo sapiens
gggtccagccaattccaaggaaa

SEQ ID NO: 8345513 - DNA, 22 bp, Homo sapiens
ggtaacttgagtgtgttgttca

SEQ ID NO: 8345514 - DNA, 22 bp, Homo sapiens
gggtcaggctagcccagacttc

SEQ ID NO: 8345515 - DNA, 22 bp, Homo sapiens
gggtccagagttttcccgccct

SEQ ID NO: 8345516 - DNA, 23 bp, Homo sapiens
gggtccagagaagccattagggc

SEQ ID NO: 8345517 - DNA, 22 bp, Homo sapiens
gggtccagacactccagaggaa

SEQ ID NO: 8345518 - DNA, 22 bp, Homo sapiens
gggtccagaatgagaatgggct

SEQ ID NO: 8345519 - DNA, 22 bp, Homo sapiens
ggtccagcacaacactggcatg

SEQ ID NO: 8345520 - DNA, 22 bp, Homo sapiens
ggtccagccaggtgctcatgcc

SEQ ID NO: 8345521 - DNA, 21 bp, Homo sapiens
ggtcagggggtgcctccaggt

SEQ ID NO: 8345522 - DNA, 20 bp, Homo sapiens
ggtcagccccacctggcagc

SEQ ID NO: 8345523 - DNA, 22 bp, Homo sapiens
ggtgcagggagaggcaggcccc

SEQ ID NO: 8345524 - DNA, 22 bp, Homo sapiens
ggtgcatggtggaggtgaccct

SEQ ID NO: 8345525 - DNA, 22 bp, Homo sapiens
ggtcttcagctttgcatgtctt

SEQ ID NO: 8345526 - DNA, 22 bp, Homo sapiens
ggtctgtgctctggagcctctg

SEQ ID NO: 8345527 - DNA, 22 bp, Homo sapiens
ggtctgggcttgagtccttttg

SEQ ID NO: 8345528 - DNA, 22 bp, Homo sapiens
ggtgggaggcaggctgctccca

SEQ ID NO: 8345529 - DNA, 22 bp, Homo sapiens
ggtggctctgttgtcaactgat

SEQ ID NO: 8345530 - DNA, 16 bp, Homo sapiens
ggtgggaggtgaggtg

SEQ ID NO: 8345531 - DNA, 22 bp, Homo sapiens
ggtgggagtggaacgtggaaga

SEQ ID NO: 8345532 - DNA, 22 bp, Homo sapiens
ggtgggcaacatttggcctgag

SEQ ID NO: 8345533 - DNA, 22 bp, Homo sapiens
ggtgccactgcactctggcctg

SEQ ID NO: 8345534 - DNA, 22 bp, Homo sapiens
ggtgccagatgaggcccgcgat

SEQ ID NO: 8345535 - DNA, 22 bp, Homo sapiens
ggtgccagagtggcccaggggc

SEQ ID NO: 8345536 - DNA, 22 bp, Homo sapiens
ggtgccaggctgtagtcagggt

SEQ ID NO: 8345537 - DNA, 22 bp, Homo sapiens
ggtgccagcctagtgcagtggt

SEQ ID NO: 8345538 - DNA, 22 bp, Homo sapiens
ggtgcgggccgcctgcccttgg

SEQ ID NO: 8345539 - DNA, 20 bp, Homo sapiens
ggtgcgaggccagagcagac

SEQ ID NO: 8345540 - DNA, 22 bp, Homo sapiens
ggtgcgggccgcctgcccttgg

SEQ ID NO: 8345541 - DNA, 22 bp, Homo sapiens
ggtgccctcggccaccttcctg

SEQ ID NO: 8345542 - DNA, 22 bp, Homo sapiens
gtgattgcccagcaccattgtt

SEQ ID NO: 8345543 - DNA, 22 bp, Homo sapiens
gtgatttctaatcatctgaatg

SEQ ID NO: 8345544 - DNA, 22 bp, Homo sapiens
gtgatttcaggtttttcatact

SEQ ID NO: 8345545 - DNA, 22 bp, Homo sapiens
gtgatttcaggtttttcatact

SEQ ID NO: 8345546 - DNA, 22 bp, Homo sapiens
gtgatttcaaatatagagtgag

SEQ ID NO: 8345547 - DNA, 23 bp, Homo sapiens
gtgatttcagggaacagaatcag

SEQ ID NO: 8345548 - DNA, 22 bp, Homo sapiens
gtgattctgtgtgtaaatttta

SEQ ID NO: 8345549 - DNA, 18 bp, Homo sapiens
gtgattcttatttgtaca

SEQ ID NO: 8345550 - DNA, 22 bp, Homo sapiens
gtgattcctattagtacatgca

SEQ ID NO: 8345551 - DNA, 19 bp, Homo sapiens
gtgatttctttccacaagc

SEQ ID NO: 8345552 - DNA, 22 bp, Homo sapiens
gtgccctgcatgccccgggtat

SEQ ID NO: 8345553 - DNA, 21 bp, Homo sapiens
gtgccctgttcccacatgccc

SEQ ID NO: 8345554 - DNA, 22 bp, Homo sapiens
gtgcccttataatagagaccca

SEQ ID NO: 8345555 - DNA, 22 bp, Homo sapiens
gtgcccttcagcggcctcatct

SEQ ID NO: 8345556 - DNA, 22 bp, Homo sapiens
gtgcccttcagcggcctcatct

SEQ ID NO: 8345557 - DNA, 22 bp, Homo sapiens
gtgcccttcagctttgctgaaa

SEQ ID NO: 8345558 - DNA, 22 bp, Homo sapiens
gtgccctggctcacagtgtctc

SEQ ID NO: 8345559 - DNA, 22 bp, Homo sapiens
gtgcccttattagatgtcatca

SEQ ID NO: 8345560 - DNA, 22 bp, Homo sapiens
gtgcctcccggggctcttcctt

SEQ ID NO: 8345561 - DNA, 22 bp, Homo sapiens
gtgcctctcattggctgagccc

SEQ ID NO: 8345562 - DNA, 22 bp, Homo sapiens
gtgctgggggtttctgtaggtc

SEQ ID NO: 8345563 - DNA, 22 bp, Homo sapiens
gtgctgggccctgagaccaggg

SEQ ID NO: 8345564 - DNA, 23 bp, Homo sapiens
gtgctgtgagccccttggcctcc

SEQ ID NO: 8345565 - DNA, 22 bp, Homo sapiens
gtctggggtgaggcccgggatt

SEQ ID NO: 8345566 - DNA, 22 bp, Homo sapiens
gtctggggtgaggcccgggatt

SEQ ID NO: 8345567 - DNA, 22 bp, Homo sapiens
gtcttctaagtatcaaagcaga

SEQ ID NO: 8345568 - DNA, 20 bp, Homo sapiens
gtcttcataatgaccttatt

SEQ ID NO: 8345569 - DNA, 22 bp, Homo sapiens
gtcttcattcaacaaatattca

SEQ ID NO: 8345570 - DNA, 22 bp, Homo sapiens
gtcttcattctcatagccctgg

SEQ ID NO: 8345571 - DNA, 22 bp, Homo sapiens
gtcttcatcgggggaatagaaa

SEQ ID NO: 8345572 - DNA, 22 bp, Homo sapiens
gtcttcaactggactccaggga

SEQ ID NO: 8345573 - DNA, 22 bp, Homo sapiens
gtctctatcatagctgaaccct

SEQ ID NO: 8345574 - DNA, 22 bp, Homo sapiens
gtgatacaggtgttctggatat

SEQ ID NO: 8345575 - DNA, 22 bp, Homo sapiens
gtgagtaaaggttcattgaatt

SEQ ID NO: 8345576 - DNA, 22 bp, Homo sapiens
gtgaggtcctaatagacatcga

SEQ ID NO: 8345577 - DNA, 22 bp, Homo sapiens
gtgaggcgaaggtgctggcgcc

SEQ ID NO: 8345578 - DNA, 22 bp, Homo sapiens
gtaaattatttcaagatcatct

SEQ ID NO: 8345579 - DNA, 22 bp, Homo sapiens
gtaaatgtttgctgatgattct

SEQ ID NO: 8345580 - DNA, 22 bp, Homo sapiens
gtaaatcagtgtcattttagaa

SEQ ID NO: 8345581 - DNA, 22 bp, Homo sapiens
gtaaatcataaaatttgagctc

SEQ ID NO: 8345582 - DNA, 22 bp, Homo sapiens
gtaaatgtgctaaaatgtgtcg

SEQ ID NO: 8345583 - DNA, 22 bp, Homo sapiens
gtaaatgtgaatgtcatttagc

SEQ ID NO: 8345584 - DNA, 22 bp, Homo sapiens
ggtgggcacccgagactggatc

SEQ ID NO: 8345585 - DNA, 21 bp, Homo sapiens
ggtgggcacaggagagcagag

SEQ ID NO: 8345586 - DNA, 22 bp, Homo sapiens
ggtgggcacattcagtctctgt

SEQ ID NO: 8345587 - DNA, 22 bp, Homo sapiens
ggtgggcacccgagactggatc

SEQ ID NO: 8345588 - DNA, 22 bp, Homo sapiens
ggtgggcagctcttggcaggca

SEQ ID NO: 8345589 - DNA, 22 bp, Homo sapiens
ggtgggcagctcttggcaggca

SEQ ID NO: 8345590 - DNA, 22 bp, Homo sapiens
gtaaatattccctcggttccta

SEQ ID NO: 8345591 - DNA, 22 bp, Homo sapiens
gtaatcatctgcatgacttgat

SEQ ID NO: 8345592 - DNA, 17 bp, Homo sapiens
gtaatataataagcctt

SEQ ID NO: 8345593 - DNA, 22 bp, Homo sapiens
gtaagggatttgaacataggtt

SEQ ID NO: 8345594 - DNA, 22 bp, Homo sapiens
gtaacattattcatgagataca

SEQ ID NO: 8345595 - DNA, 20 bp, Homo sapiens
gtcaagtccctggggcagct

SEQ ID NO: 8345596 - DNA, 17 bp, Homo sapiens
gtcaacaggatttcttt

SEQ ID NO: 8345597 - DNA, 22 bp, Homo sapiens
gtagatcagtttttgtctataa

SEQ ID NO: 8345598 - DNA, 21 bp, Homo sapiens
gtagataaagcattttcatta

SEQ ID NO: 8345599 - DNA, 22 bp, Homo sapiens
gtagactgatgggactgaggta

SEQ ID NO: 8345600 - DNA, 22 bp, Homo sapiens
gtagcacatgattttgatatgt

SEQ ID NO: 8345601 - DNA, 22 bp, Homo sapiens
gtcctcagcaccagaactaggg

SEQ ID NO: 8345602 - DNA, 22 bp, Homo sapiens
gtcctcagagtgggcaggtcct

SEQ ID NO: 8345603 - DNA, 22 bp, Homo sapiens
gtcctcagagtgggcaggtcct

SEQ ID NO: 8345604 - DNA, 21 bp, Homo sapiens
gtcctcacgctccggcctccc

SEQ ID NO: 8345605 - DNA, 22 bp, Homo sapiens
gtcctcacctctagtgcagaca

SEQ ID NO: 8345606 - DNA, 22 bp, Homo sapiens
gtcctcagggagtcccagtcat

SEQ ID NO: 8345607 - DNA, 22 bp, Homo sapiens
gtcctcagtaagagggcctctg

SEQ ID NO: 8345608 - DNA, 22 bp, Homo sapiens
gtcctcagtaagagggcctctg

SEQ ID NO: 8345609 - DNA, 22 bp, Homo sapiens
gtccctggatctgggacagctg

SEQ ID NO: 8345610 - DNA, 22 bp, Homo sapiens
gtccctggagctgagcagtgct

SEQ ID NO: 8345611 - DNA, 22 bp, Homo sapiens
gtcattttatgggaacagattt

SEQ ID NO: 8345612 - DNA, 18 bp, Homo sapiens
gtcattgcaacatactgt

SEQ ID NO: 8345613 - DNA, 22 bp, Homo sapiens
gtcattgcagtggcaaatcaca

SEQ ID NO: 8345614 - DNA, 22 bp, Homo sapiens
gtcattgtgtggacatggagaa

SEQ ID NO: 8345615 - DNA, 22 bp, Homo sapiens
gtcatttctgtttcttcagtgc

SEQ ID NO: 8345616 - DNA, 22 bp, Homo sapiens
gtctcccatgtccctgtccagt

SEQ ID NO: 8345617 - DNA, 22 bp, Homo sapiens
gtctccggccgccctggtgctg

SEQ ID NO: 8345618 - DNA, 22 bp, Homo sapiens
gtctcctaaaccatcctggtac

SEQ ID NO: 8345619 - DNA, 22 bp, Homo sapiens
gtctcccatctctgtccttgtg

SEQ ID NO: 8345620 - DNA, 22 bp, Homo sapiens
gtctcccatctctgtccttgtg

SEQ ID NO: 8345621 - DNA, 22 bp, Homo sapiens
gtctcccatcgtttgtgaggaa

SEQ ID NO: 8345622 - DNA, 22 bp, Homo sapiens
gtctcccactttctggcctctt

SEQ ID NO: 8345623 - DNA, 22 bp, Homo sapiens
gtcctctgcttcatgccctgat

SEQ ID NO: 8345624 - DNA, 22 bp, Homo sapiens
gtcctccatggtcttgaagtaa

SEQ ID NO: 8345625 - DNA, 22 bp, Homo sapiens
gtcctctgagggggctgcacgc

SEQ ID NO: 8345626 - DNA, 22 bp, Homo sapiens
gtcctctgagggggctgcacgc

SEQ ID NO: 8345627 - DNA, 22 bp, Homo sapiens
gtcagtaggaacctagggtcaa

SEQ ID NO: 8345628 - DNA, 22 bp, Homo sapiens
gtcaggggatgtgctggtggcc

SEQ ID NO: 8345629 - DNA, 22 bp, Homo sapiens
gtcagttattttgagcaattgg

SEQ ID NO: 8345630 - DNA, 18 bp, Homo sapiens
gtcagttttgaagccaga

SEQ ID NO: 8345631 - DNA, 22 bp, Homo sapiens
gtcattatttaatgtaggctaa

SEQ ID NO: 8345632 - DNA, 19 bp, Homo sapiens
gtcacatttgtctcccagg

SEQ ID NO: 8345633 - DNA, 22 bp, Homo sapiens
gtcacattcatgcagaatcaaa

SEQ ID NO: 8345634 - DNA, 22 bp, Homo sapiens
gtcaccagtcccagctcctgaa

SEQ ID NO: 8345635 - DNA, 22 bp, Homo sapiens
gggcactcctgatcgggacttg

SEQ ID NO: 8345636 - DNA, 22 bp, Homo sapiens
gggcactgaacaccctcttcgc

SEQ ID NO: 8345637 - DNA, 22 bp, Homo sapiens
gggcactgaatgccaagctagg

SEQ ID NO: 8345638 - DNA, 22 bp, Homo sapiens
gggcaccagcggccgcactgcc

SEQ ID NO: 8345639 - DNA, 22 bp, Homo sapiens
gggcacaggagaaggatctggc

SEQ ID NO: 8345640 - DNA, 22 bp, Homo sapiens
gggcacagtctaaagttgggcc

SEQ ID NO: 8345641 - DNA, 22 bp, Homo sapiens
gggcactgctttgctctgtcac

SEQ ID NO: 8345642 - DNA, 22 bp, Homo sapiens
gggcactggaggccaaggagct

SEQ ID NO: 8345643 - DNA, 22 bp, Homo sapiens
gggcactggaaggctctcaggc

SEQ ID NO: 8345644 - DNA, 22 bp, Homo sapiens
gggcactggccgcccatccctg

SEQ ID NO: 8345645 - DNA, 22 bp, Homo sapiens
gggcactggcagtcggggacgc

SEQ ID NO: 8345646 - DNA, 18 bp, Homo sapiens
gggcactggggactggag

SEQ ID NO: 8345647 - DNA, 22 bp, Homo sapiens
gggcaggttattggagtaggga

SEQ ID NO: 8345648 - DNA, 22 bp, Homo sapiens
gggcaggttggcatcccgggca

SEQ ID NO: 8345649 - DNA, 23 bp, Homo sapiens
gggcaggtttttataggcttcag

SEQ ID NO: 8345650 - DNA, 18 bp, Homo sapiens
gggcagtaagtgtggggt

SEQ ID NO: 8345651 - DNA, 22 bp, Homo sapiens
gggcaggttattggagtaggga

SEQ ID NO: 8345652 - DNA, 22 bp, Homo sapiens
gggcagtgaatattggtgggaa

SEQ ID NO: 8345653 - DNA, 22 bp, Homo sapiens
gggcagtcacagtgctggagca

SEQ ID NO: 8345654 - DNA, 21 bp, Homo sapiens
gggcagtctggtggctatggc

SEQ ID NO: 8345655 - DNA, 22 bp, Homo sapiens
gggcagtgaatattggtgggaa

SEQ ID NO: 8345656 - DNA, 22 bp, Homo sapiens
gggcagtgacaaaggggatgaa

SEQ ID NO: 8345657 - DNA, 22 bp, Homo sapiens
gggcagtgacaaaggggatgaa

SEQ ID NO: 8345658 - DNA, 22 bp, Homo sapiens
gggaggttgaggctgcagtgag

SEQ ID NO: 8345659 - DNA, 22 bp, Homo sapiens
gggcacaggagaaggatctggc

SEQ ID NO: 8345660 - DNA, 22 bp, Homo sapiens
gggaggtgttctgccaacgcgg

SEQ ID NO: 8345661 - DNA, 22 bp, Homo sapiens
gggaggtgttccagtgttggta

SEQ ID NO: 8345662 - DNA, 22 bp, Homo sapiens
gggaggtgattaggaccatgta

SEQ ID NO: 8345663 - DNA, 22 bp, Homo sapiens
gggaggtgatggcaagcagcgg

SEQ ID NO: 8345664 - DNA, 22 bp, Homo sapiens
gggaggtgaaaggttgctgcag

SEQ ID NO: 8345665 - DNA, 22 bp, Homo sapiens
gggagctggcggattccccagg

SEQ ID NO: 8345666 - DNA, 22 bp, Homo sapiens
gggagctggatgattgaggcaa

SEQ ID NO: 8345667 - DNA, 22 bp, Homo sapiens
gggagctggagttgtgttgcct

SEQ ID NO: 8345668 - DNA, 22 bp, Homo sapiens
gggagctggagttgtgttgcct

SEQ ID NO: 8345669 - DNA, 22 bp, Homo sapiens
gggaagtgatggagccaggatt

SEQ ID NO: 8345670 - DNA, 22 bp, Homo sapiens
gggaagggagggcctccagtca

SEQ ID NO: 8345671 - DNA, 19 bp, Homo sapiens
gggaatgatggaagacttc

SEQ ID NO: 8345672 - DNA, 22 bp, Homo sapiens
gggagctggagctggaagactc

SEQ ID NO: 8345673 - DNA, 22 bp, Homo sapiens
gggagctggagctggaagactc

SEQ ID NO: 8345674 - DNA, 22 bp, Homo sapiens
gggagctgagggacctctgtgg

SEQ ID NO: 8345675 - DNA, 22 bp, Homo sapiens
gggagctgaggagccccgtcgg

SEQ ID NO: 8345676 - DNA, 22 bp, Homo sapiens
gggagctgaggagccccgtcgg

SEQ ID NO: 8345677 - DNA, 21 bp, Homo sapiens
gggagctgacagcagcacggc

SEQ ID NO: 8345678 - DNA, 22 bp, Homo sapiens
gggagctgagctctgagccacg

SEQ ID NO: 8345679 - DNA, 22 bp, Homo sapiens
gggagctgacctgcaggttccc

SEQ ID NO: 8345680 - DNA, 22 bp, Homo sapiens
gggagctgagctctgagccacg

SEQ ID NO: 8345681 - DNA, 22 bp, Homo sapiens
gggagctgagctggaagagaat

SEQ ID NO: 8345682 - DNA, 22 bp, Homo sapiens
gggaaggccttgtcagcggatt

SEQ ID NO: 8345683 - DNA, 22 bp, Homo sapiens
gggaaggctgcctgagggatgg

SEQ ID NO: 8345684 - DNA, 22 bp, Homo sapiens
gggaagggagggacctcagtct

SEQ ID NO: 8345685 - DNA, 20 bp, Homo sapiens
ggctttctgtgatcctcagt

SEQ ID NO: 8345686 - DNA, 22 bp, Homo sapiens
ggctttgacatgctgaattaaa

SEQ ID NO: 8345687 - DNA, 22 bp, Homo sapiens
ggctggtggggaaagaggacca

SEQ ID NO: 8345688 - DNA, 20 bp, Homo sapiens
ggctgtgcccttccgtggcc

SEQ ID NO: 8345689 - DNA, 22 bp, Homo sapiens
ggctggtctcagtgctgggttc

SEQ ID NO: 8345690 - DNA, 22 bp, Homo sapiens
ggctgggtttgactcctggctt

SEQ ID NO: 8345691 - DNA, 22 bp, Homo sapiens
ggctggactttttgcaggtcat

SEQ ID NO: 8345692 - DNA, 19 bp, Homo sapiens
ggctggagaaaggaatcag

SEQ ID NO: 8345693 - DNA, 19 bp, Homo sapiens
ggctggagaaaggaatcag

SEQ ID NO: 8345694 - DNA, 19 bp, Homo sapiens
ggctgggtctggcaggttc

SEQ ID NO: 8345695 - DNA, 22 bp, Homo sapiens
ggctgggtcccagctgggagga

SEQ ID NO: 8345696 - DNA, 22 bp, Homo sapiens
ggctgctgggtcatgatgcaga

SEQ ID NO: 8345697 - DNA, 22 bp, Homo sapiens
ggctgctggggacgtgggagag

SEQ ID NO: 8345698 - DNA, 21 bp, Homo sapiens
ggctgctgggggttggcacag

SEQ ID NO: 8345699 - DNA, 22 bp, Homo sapiens
ggctgctgtttcagagactgtt

SEQ ID NO: 8345700 - DNA, 22 bp, Homo sapiens
ggctgctgtttcagagactgtt

SEQ ID NO: 8345701 - DNA, 20 bp, Homo sapiens
ggctgctgtgggcagagagg

SEQ ID NO: 8345702 - DNA, 22 bp, Homo sapiens
ggctgctgtttcagagactgtt

SEQ ID NO: 8345703 - DNA, 22 bp, Homo sapiens
ggctggaaactcaggtagggtt

SEQ ID NO: 8345704 - DNA, 18 bp, Homo sapiens
ggctggaagctgttgctg

SEQ ID NO: 8345705 - DNA, 22 bp, Homo sapiens
ggctggaatgcaactgtgtgtt

SEQ ID NO: 8345706 - DNA, 22 bp, Homo sapiens
ggctggaatgtgtggatgtgat

SEQ ID NO: 8345707 - DNA, 18 bp, Homo sapiens
ggctgaggttgactagaa

SEQ ID NO: 8345708 - DNA, 22 bp, Homo sapiens
ggctgagtgctgctgttcacga

SEQ ID NO: 8345709 - DNA, 22 bp, Homo sapiens
ggctgagtggctgggtctagtt

SEQ ID NO: 8345710 - DNA, 22 bp, Homo sapiens
ggctccagggagtggagagaag

SEQ ID NO: 8345711 - DNA, 22 bp, Homo sapiens
ggctaggctcacctggagagtt

SEQ ID NO: 8345712 - DNA, 23 bp, Homo sapiens
ggctccaggcctgacgggcgcgg

SEQ ID NO: 8345713 - DNA, 22 bp, Homo sapiens
ggctccccaggtccaggagctg

SEQ ID NO: 8345714 - DNA, 22 bp, Homo sapiens
ggctccctggaaatcccgaggc

SEQ ID NO: 8345715 - DNA, 22 bp, Homo sapiens
ggctacagggtacaccacatct

SEQ ID NO: 8345716 - DNA, 22 bp, Homo sapiens
ggcgtggggccttctgcccgct

SEQ ID NO: 8345717 - DNA, 22 bp, Homo sapiens
ggcggtggttgagaggacggcg

SEQ ID NO: 8345718 - DNA, 22 bp, Homo sapiens
ggcggtggcgtgaaggtggctg

SEQ ID NO: 8345719 - DNA, 22 bp, Homo sapiens
ggcgtgggaagtggggcttctg

SEQ ID NO: 8345720 - DNA, 22 bp, Homo sapiens
ggcgtgggaagtggggcttctg

SEQ ID NO: 8345721 - DNA, 22 bp, Homo sapiens
ggcgtgggcgaggtgctctatc

SEQ ID NO: 8345722 - DNA, 22 bp, Homo sapiens
ggctcttccgccaccagccaca

SEQ ID NO: 8345723 - DNA, 22 bp, Homo sapiens
ggctctgtggctggccatgatg

SEQ ID NO: 8345724 - DNA, 22 bp, Homo sapiens
ggctctgtaaagtgacacctgc

SEQ ID NO: 8345725 - DNA, 22 bp, Homo sapiens
ggctctgtaaagtgacacctgc

SEQ ID NO: 8345726 - DNA, 22 bp, Homo sapiens
ggctctgtcacctatgagctga

SEQ ID NO: 8345727 - DNA, 22 bp, Homo sapiens
ggctctggtgtgaagcagcctc

SEQ ID NO: 8345728 - DNA, 22 bp, Homo sapiens
ggctctggttgaccatgatggc

SEQ ID NO: 8345729 - DNA, 22 bp, Homo sapiens
ggctctggtgtgaagcagcctc

SEQ ID NO: 8345730 - DNA, 22 bp, Homo sapiens
ggctcctctctggccgctcccg

SEQ ID NO: 8345731 - DNA, 22 bp, Homo sapiens
ggctctgggccagagttggctt

SEQ ID NO: 8345732 - DNA, 22 bp, Homo sapiens
ggctctggggcctcctcccttg

SEQ ID NO: 8345733 - DNA, 22 bp, Homo sapiens
ggctctggggaagctctcttca

SEQ ID NO: 8345734 - DNA, 22 bp, Homo sapiens
ggccaggagcaagccaggctct

SEQ ID NO: 8345735 - DNA, 22 bp, Homo sapiens
ggccaggaggcaggggctcaat

SEQ ID NO: 8345736 - DNA, 22 bp, Homo sapiens
ggccctgctgagtggagtggag

SEQ ID NO: 8345737 - DNA, 22 bp, Homo sapiens
ggccctgctcaggctgcgatga

SEQ ID NO: 8345738 - DNA, 22 bp, Homo sapiens
ggccctgctgaagccgggtcta

SEQ ID NO: 8345739 - DNA, 22 bp, Homo sapiens
ggccaggcactgtgtgagatat

SEQ ID NO: 8345740 - DNA, 22 bp, Homo sapiens
ggccaggccaagagggttggaa

SEQ ID NO: 8345741 - DNA, 22 bp, Homo sapiens
ggcctcacccatcggtgccttt

SEQ ID NO: 8345742 - DNA, 23 bp, Homo sapiens
ggcctaacagaggcagggctgag

SEQ ID NO: 8345743 - DNA, 22 bp, Homo sapiens
ggccctgggatgctcagcagtg

SEQ ID NO: 8345744 - DNA, 22 bp, Homo sapiens
ggccctgggatgctcagcagtg

SEQ ID NO: 8345745 - DNA, 22 bp, Homo sapiens
ggccctgggatgctcagcagtg

SEQ ID NO: 8345746 - DNA, 22 bp, Homo sapiens
ggccctgggcagaggagtgggc

SEQ ID NO: 8345747 - DNA, 18 bp, Homo sapiens
ggcgggtgttttattcac

SEQ ID NO: 8345748 - DNA, 18 bp, Homo sapiens
ggcgggtgttttattcac

SEQ ID NO: 8345749 - DNA, 22 bp, Homo sapiens
ggcgggtgtaagtaggacagcg

SEQ ID NO: 8345750 - DNA, 19 bp, Homo sapiens
ggcgggtggactggagccc

SEQ ID NO: 8345751 - DNA, 19 bp, Homo sapiens
ggcgggtggactggagccc

SEQ ID NO: 8345752 - DNA, 22 bp, Homo sapiens
ggcgggtgtaagtaggacagcg

SEQ ID NO: 8345753 - DNA, 22 bp, Homo sapiens
ggcgggtggcgaggcttctcgg

SEQ ID NO: 8345754 - DNA, 22 bp, Homo sapiens
ggcgggggtccaggagcctgca

SEQ ID NO: 8345755 - DNA, 22 bp, Homo sapiens
ggcgggtgataggatgagcagg

SEQ ID NO: 8345756 - DNA, 22 bp, Homo sapiens
ggcctggagcagagactaggga

SEQ ID NO: 8345757 - DNA, 19 bp, Homo sapiens
ggcctggatttagggctcc

SEQ ID NO: 8345758 - DNA, 22 bp, Homo sapiens
ggcctggcctccagatgtgggc

SEQ ID NO: 8345759 - DNA, 23 bp, Homo sapiens
ggcctggcccagggccctgatga

SEQ ID NO: 8345760 - DNA, 22 bp, Homo sapiens
ggcctggcagagcgcgcggctg

SEQ ID NO: 8345761 - DNA, 22 bp, Homo sapiens
ggcctgcctcacagtcagcacc

SEQ ID NO: 8345762 - DNA, 19 bp, Homo sapiens
ggccagctgtctcctgcta

SEQ ID NO: 8345763 - DNA, 22 bp, Homo sapiens
ggccagctgtggggccgagcct

SEQ ID NO: 8345764 - DNA, 22 bp, Homo sapiens
ggccagcttctctgctgcctgt

SEQ ID NO: 8345765 - DNA, 22 bp, Homo sapiens
ggcatctgtccatctctccagc

SEQ ID NO: 8345766 - DNA, 22 bp, Homo sapiens
ggcagtggtgggaggctcgctc

SEQ ID NO: 8345767 - DNA, 21 bp, Homo sapiens
ggcatcccaggccagtgactg

SEQ ID NO: 8345768 - DNA, 20 bp, Homo sapiens
ggcatctataaacacatcca

SEQ ID NO: 8345769 - DNA, 22 bp, Homo sapiens
ggcagggtggccctccagtgag

SEQ ID NO: 8345770 - DNA, 22 bp, Homo sapiens
ggcagggtggccctccagtgag

SEQ ID NO: 8345771 - DNA, 17 bp, Homo sapiens
ggcagggtgctgggtat

SEQ ID NO: 8345772 - DNA, 22 bp, Homo sapiens
ggcagggtgtggagttgggaca

SEQ ID NO: 8345773 - DNA, 22 bp, Homo sapiens
ggcagggtggccctccagtgag

SEQ ID NO: 8345774 - DNA, 22 bp, Homo sapiens
ggcaggtgacggggatgagtat

SEQ ID NO: 8345775 - DNA, 22 bp, Homo sapiens
ggcaggtgacctggcctcccag

SEQ ID NO: 8345776 - DNA, 22 bp, Homo sapiens
ggcagggtccacacctgggaaa

SEQ ID NO: 8345777 - DNA, 17 bp, Homo sapiens
ggattgcatatacagtg

SEQ ID NO: 8345778 - DNA, 22 bp, Homo sapiens
ggatttcttccttcctcagaag

SEQ ID NO: 8345779 - DNA, 22 bp, Homo sapiens
ggcactgccccctgcccaggac

SEQ ID NO: 8345780 - DNA, 21 bp, Homo sapiens
ggcactgctgggccatctgct

SEQ ID NO: 8345781 - DNA, 22 bp, Homo sapiens
ggcactgggtgagggtcactgg

SEQ ID NO: 8345782 - DNA, 22 bp, Homo sapiens
ggcagcagcaaggttggagctg

SEQ ID NO: 8345783 - DNA, 22 bp, Homo sapiens
ggcagcagcaaggttggagctg

SEQ ID NO: 8345784 - DNA, 22 bp, Homo sapiens
ggcagctgtttgtcctcctgtt

SEQ ID NO: 8345785 - DNA, 22 bp, Homo sapiens
ggcagctgtttgtcctcctgtt

SEQ ID NO: 8345786 - DNA, 22 bp, Homo sapiens
ggatggaggttctcagatgctc

SEQ ID NO: 8345787 - DNA, 23 bp, Homo sapiens
ggatggagccactttgaaaccac

SEQ ID NO: 8345788 - DNA, 22 bp, Homo sapiens
ggatgctgactttggagcatgg

SEQ ID NO: 8345789 - DNA, 18 bp, Homo sapiens
ggatgctgtgtgctcctt

SEQ ID NO: 8345790 - DNA, 22 bp, Homo sapiens
ggatctgttttgcctctgaggg

SEQ ID NO: 8345791 - DNA, 22 bp, Homo sapiens
ggagcagagctgggcttggctg

SEQ ID NO: 8345792 - DNA, 22 bp, Homo sapiens
gcaggctgaaactcggggtcta

SEQ ID NO: 8345793 - DNA, 22 bp, Homo sapiens
gcagggccttagcagcggctgc

SEQ ID NO: 8345794 - DNA, 20 bp, Homo sapiens
gcagggcgacacgggggagg

SEQ ID NO: 8345795 - DNA, 20 bp, Homo sapiens
gcagggcgacacgggggagg

SEQ ID NO: 8345796 - DNA, 22 bp, Homo sapiens
gcagggccttggtcatcttttt

SEQ ID NO: 8345797 - DNA, 22 bp, Homo sapiens
gcagggctaatggggcaagtag

SEQ ID NO: 8345798 - DNA, 22 bp, Homo sapiens
gcagggctaatggggcaagtag

SEQ ID NO: 8345799 - DNA, 22 bp, Homo sapiens
gcagggcggcccagagcaggcc

SEQ ID NO: 8345800 - DNA, 22 bp, Homo sapiens
gcagggcgcgtttgagcgggct

SEQ ID NO: 8345801 - DNA, 22 bp, Homo sapiens
gcagggcgcgtttgagcgggct

SEQ ID NO: 8345802 - DNA, 22 bp, Homo sapiens
gcagggcggcccagagcaggcc

SEQ ID NO: 8345803 - DNA, 22 bp, Homo sapiens
gcagctggagaaataccaccct

SEQ ID NO: 8345804 - DNA, 22 bp, Homo sapiens
gcagctggccctgacacgcaga

SEQ ID NO: 8345805 - DNA, 22 bp, Homo sapiens
gcaggagctggaaagtgatgtt

SEQ ID NO: 8345806 - DNA, 22 bp, Homo sapiens
gcaggaggttgagccaggactg

SEQ ID NO: 8345807 - DNA, 22 bp, Homo sapiens
gcaggaggttgagccaggactg

SEQ ID NO: 8345808 - DNA, 22 bp, Homo sapiens
gcagcatgttgaaagggccaca

SEQ ID NO: 8345809 - DNA, 21 bp, Homo sapiens
gcagcagtgttctagaatact

SEQ ID NO: 8345810 - DNA, 22 bp, Homo sapiens
gcagctgccagtccccttccag

SEQ ID NO: 8345811 - DNA, 22 bp, Homo sapiens
gcagccacactgttacagaatg

SEQ ID NO: 8345812 - DNA, 22 bp, Homo sapiens
gcagcaggagagtttgtcctgc

SEQ ID NO: 8345813 - DNA, 22 bp, Homo sapiens
gcagcaggtctgtcaatgtcat

SEQ ID NO: 8345814 - DNA, 23 bp, Homo sapiens
gcagaggagcaagctggacacca

SEQ ID NO: 8345815 - DNA, 22 bp, Homo sapiens
gcagaggagcaagttgctacag

SEQ ID NO: 8345816 - DNA, 22 bp, Homo sapiens
gcagaggaggacccaggaatta

SEQ ID NO: 8345817 - DNA, 21 bp, Homo sapiens
gcagaggaatggtatacataa

SEQ ID NO: 8345818 - DNA, 22 bp, Homo sapiens
gcagaggacacaggagggcaag

SEQ ID NO: 8345819 - DNA, 22 bp, Homo sapiens
gcagaggacagggatttagatt

SEQ ID NO: 8345820 - DNA, 22 bp, Homo sapiens
gcagaggactcaatcaaggtat

SEQ ID NO: 8345821 - DNA, 22 bp, Homo sapiens
gcagaggagcaagctggacacc

SEQ ID NO: 8345822 - DNA, 22 bp, Homo sapiens
gcagaggagcaagctggacacc

SEQ ID NO: 8345823 - DNA, 22 bp, Homo sapiens
gcagaggagatgaagatacttt

SEQ ID NO: 8345824 - DNA, 22 bp, Homo sapiens
gcagaggagatgaagatacttt

SEQ ID NO: 8345825 - DNA, 23 bp, Homo sapiens
gcactgccatgtgctctgcaggc

SEQ ID NO: 8345826 - DNA, 18 bp, Homo sapiens
gcactgaggaaaacctct

SEQ ID NO: 8345827 - DNA, 22 bp, Homo sapiens
gcactgaactttaatcatttct

SEQ ID NO: 8345828 - DNA, 19 bp, Homo sapiens
gcactgaagagttggtcac

SEQ ID NO: 8345829 - DNA, 20 bp, Homo sapiens
gcactgaaggttccagggga

SEQ ID NO: 8345830 - DNA, 17 bp, Homo sapiens
gcactgaacaatcctgt

SEQ ID NO: 8345831 - DNA, 20 bp, Homo sapiens
gcactgaaattcaatgtttg

SEQ ID NO: 8345832 - DNA, 22 bp, Homo sapiens
gcactgaatgcttttactgtaa

SEQ ID NO: 8345833 - DNA, 22 bp, Homo sapiens
gcactgaatgccaaagtgtagg

SEQ ID NO: 8345834 - DNA, 22 bp, Homo sapiens
gcactgagatacatttctaagg

SEQ ID NO: 8345835 - DNA, 22 bp, Homo sapiens
gcactgagaactgttttctaga

SEQ ID NO: 8345836 - DNA, 22 bp, Homo sapiens
gcactgagagctttattctaga

SEQ ID NO: 8345837 - DNA, 22 bp, Homo sapiens
gcactgaaaatgttggattcca

SEQ ID NO: 8345838 - DNA, 22 bp, Homo sapiens
gcactgaaattatatgcatttg

SEQ ID NO: 8345839 - DNA, 22 bp, Homo sapiens
gcacagccttgccctgtgccct

SEQ ID NO: 8345840 - DNA, 22 bp, Homo sapiens
gcacagcctgtccctgtcctgg

SEQ ID NO: 8345841 - DNA, 22 bp, Homo sapiens
gcacagccagcatctgagggat

SEQ ID NO: 8345842 - DNA, 22 bp, Homo sapiens
gcacagccagcatctgagggat

SEQ ID NO: 8345843 - DNA, 22 bp, Homo sapiens
gcacaggaggccgatgctcatg

SEQ ID NO: 8345844 - DNA, 22 bp, Homo sapiens
gcaagaaaagagccttcagtgg

SEQ ID NO: 8345845 - DNA, 22 bp, Homo sapiens
gcaaatgcactgcatttagatt

SEQ ID NO: 8345846 - DNA, 22 bp, Homo sapiens
gagggtccctgctcagggccag

SEQ ID NO: 8345847 - DNA, 22 bp, Homo sapiens
gagggtccccatgcagagctca

SEQ ID NO: 8345848 - DNA, 19 bp, Homo sapiens
gcaaatctgaccaaatagt

SEQ ID NO: 8345849 - DNA, 22 bp, Homo sapiens
gcaagcaagcaggtagagctga

SEQ ID NO: 8345850 - DNA, 23 bp, Homo sapiens
gcaagcaaggcagggtaaagaga

SEQ ID NO: 8345851 - DNA, 22 bp, Homo sapiens
gcaagcaagtatctggcaggga

SEQ ID NO: 8345852 - DNA, 22 bp, Homo sapiens
gcaagcaatggacggtgacttt

SEQ ID NO: 8345853 - DNA, 22 bp, Homo sapiens
gcaagcaaattatttataggca

SEQ ID NO: 8345854 - DNA, 22 bp, Homo sapiens
gcaagcaaaatgggagattccc

SEQ ID NO: 8345855 - DNA, 22 bp, Homo sapiens
gaggggtcacatgggctggctt

SEQ ID NO: 8345856 - DNA, 22 bp, Homo sapiens
gaggggtgtggagccatcagtt

SEQ ID NO: 8345857 - DNA, 22 bp, Homo sapiens
gagggtcagaagggcctggttc

SEQ ID NO: 8345858 - DNA, 22 bp, Homo sapiens
gaggggtgtggagccatcagtt

SEQ ID NO: 8345859 - DNA, 22 bp, Homo sapiens
gaggggtgtggagccatcagtt

SEQ ID NO: 8345860 - DNA, 22 bp, Homo sapiens
gaggggcttgaggccctgatgg

SEQ ID NO: 8345861 - DNA, 22 bp, Homo sapiens
gaggggctgtggagctctctgg

SEQ ID NO: 8345862 - DNA, 22 bp, Homo sapiens
gaggggctggggttgactccaa

SEQ ID NO: 8345863 - DNA, 22 bp, Homo sapiens
gaggggctgggtagggcaaccc

SEQ ID NO: 8345864 - DNA, 22 bp, Homo sapiens
gaggggctgtggagctctctgg

SEQ ID NO: 8345865 - DNA, 22 bp, Homo sapiens
gaggggctggggttgactccaa

SEQ ID NO: 8345866 - DNA, 22 bp, Homo sapiens
gaggggctggggttgactccaa

SEQ ID NO: 8345867 - DNA, 22 bp, Homo sapiens
gaggggctgggtagggcaaccc

SEQ ID NO: 8345868 - DNA, 22 bp, Homo sapiens
gcagggctcattgccaggcatt

SEQ ID NO: 8345869 - DNA, 22 bp, Homo sapiens
gcagggctccactgtggccaag

SEQ ID NO: 8345870 - DNA, 22 bp, Homo sapiens
gcagtcagtaaggcagccagaa

SEQ ID NO: 8345871 - DNA, 22 bp, Homo sapiens
gcagtatatggattttaaacat

SEQ ID NO: 8345872 - DNA, 22 bp, Homo sapiens
gcagtccccgtcgtggcaggga

SEQ ID NO: 8345873 - DNA, 22 bp, Homo sapiens
gcagtcatggaaaaatgtatac

SEQ ID NO: 8345874 - DNA, 22 bp, Homo sapiens
gcagtcctctcattggcctcct

SEQ ID NO: 8345875 - DNA, 22 bp, Homo sapiens
gcagtcctctcattggcctcct

SEQ ID NO: 8345876 - DNA, 17 bp, Homo sapiens
gcagtgaaaagagatca

SEQ ID NO: 8345877 - DNA, 22 bp, Homo sapiens
gcagtgaaacaataggatcaaa

SEQ ID NO: 8345878 - DNA, 22 bp, Homo sapiens
gcagtctataaatcagctttgc

SEQ ID NO: 8345879 - DNA, 18 bp, Homo sapiens
gcagtctctctggtcttc

SEQ ID NO: 8345880 - DNA, 19 bp, Homo sapiens
gcagtctgttgaagggcag

SEQ ID NO: 8345881 - DNA, 19 bp, Homo sapiens
gcataaatacactattgtc

SEQ ID NO: 8345882 - DNA, 22 bp, Homo sapiens
gcatctaaatcactttaatgta

SEQ ID NO: 8345883 - DNA, 22 bp, Homo sapiens
gcatctaaataaacgtgggagt

SEQ ID NO: 8345884 - DNA, 22 bp, Homo sapiens
gcatctaaacttgcatcattgt

SEQ ID NO: 8345885 - DNA, 20 bp, Homo sapiens
gcatctccagggctgtctcc

SEQ ID NO: 8345886 - DNA, 22 bp, Homo sapiens
gcatctaaggtggataacttct

SEQ ID NO: 8345887 - DNA, 22 bp, Homo sapiens
gcatgaaatgagcgaatataat

SEQ ID NO: 8345888 - DNA, 23 bp, Homo sapiens
gcatcttaaaacctacatatgtg

SEQ ID NO: 8345889 - DNA, 18 bp, Homo sapiens
gcattttaatctgaggca

SEQ ID NO: 8345890 - DNA, 22 bp, Homo sapiens
gcattttaataagattcatagg

SEQ ID NO: 8345891 - DNA, 22 bp, Homo sapiens
gccagagaggccttagaatcca

SEQ ID NO: 8345892 - DNA, 22 bp, Homo sapiens
gccagagagagtccctgggcct

SEQ ID NO: 8345893 - DNA, 22 bp, Homo sapiens
gccagcagtcctgctgtgtgcc

SEQ ID NO: 8345894 - DNA, 22 bp, Homo sapiens
gccagccataggccagcactgg

SEQ ID NO: 8345895 - DNA, 22 bp, Homo sapiens
gccagcagtcctgctgtgtgcc

SEQ ID NO: 8345896 - DNA, 21 bp, Homo sapiens
gccagccatgcttgcctaggc

SEQ ID NO: 8345897 - DNA, 22 bp, Homo sapiens
gccagcagtatgtcctggcagt

SEQ ID NO: 8345898 - DNA, 22 bp, Homo sapiens
gccagcaggttgtcaaggagct

SEQ ID NO: 8345899 - DNA, 22 bp, Homo sapiens
gccagcaggtggagagatcaag

SEQ ID NO: 8345900 - DNA, 22 bp, Homo sapiens
gccagaggaacgctgcgcgccc

SEQ ID NO: 8345901 - DNA, 22 bp, Homo sapiens
gccagtgcctgctgctcagggc

SEQ ID NO: 8345902 - DNA, 20 bp, Homo sapiens
gcccactctaatccactgtc

SEQ ID NO: 8345903 - DNA, 22 bp, Homo sapiens
gcccactctggagcctgttccc

SEQ ID NO: 8345904 - DNA, 22 bp, Homo sapiens
gcccactgagtgactccctcag

SEQ ID NO: 8345905 - DNA, 22 bp, Homo sapiens
gcccactggctggagtgctggt

SEQ ID NO: 8345906 - DNA, 19 bp, Homo sapiens
gcccactgtctttgccaac

SEQ ID NO: 8345907 - DNA, 18 bp, Homo sapiens
gcccagagccctcttatt

SEQ ID NO: 8345908 - DNA, 18 bp, Homo sapiens
gcccagaggtctgggccc

SEQ ID NO: 8345909 - DNA, 18 bp, Homo sapiens
gcccagaggtctgggccc

SEQ ID NO: 8345910 - DNA, 21 bp, Homo sapiens
gcccagagtcctcccactcca

SEQ ID NO: 8345911 - DNA, 21 bp, Homo sapiens
gcccagagtcctcccactcca

SEQ ID NO: 8345912 - DNA, 22 bp, Homo sapiens
gccaggagccagcttcttagca

SEQ ID NO: 8345913 - DNA, 22 bp, Homo sapiens
gccaggagccctgggcaagttc

SEQ ID NO: 8345914 - DNA, 22 bp, Homo sapiens
gccaggagaatgctagcagagg

SEQ ID NO: 8345915 - DNA, 22 bp, Homo sapiens
gccaggagagctccttcaggtt

SEQ ID NO: 8345916 - DNA, 22 bp, Homo sapiens
gccaggactgagaatgggagca

SEQ ID NO: 8345917 - DNA, 22 bp, Homo sapiens
gccaggagaaaaggcgaatgat

SEQ ID NO: 8345918 - DNA, 22 bp, Homo sapiens
gccaggactcttcctagaaggt

SEQ ID NO: 8345919 - DNA, 22 bp, Homo sapiens
gccaggacctcagatgcagggc

SEQ ID NO: 8345920 - DNA, 22 bp, Homo sapiens
gccaggaatttcaagagccact

SEQ ID NO: 8345921 - DNA, 21 bp, Homo sapiens
gccaggaccagcagaccactt

SEQ ID NO: 8345922 - DNA, 22 bp, Homo sapiens
gccaggtctgggtagcagagga

SEQ ID NO: 8345923 - DNA, 22 bp, Homo sapiens
gccaggtgtagtggccacacct

SEQ ID NO: 8345924 - DNA, 22 bp, Homo sapiens
gccaggagttcagatgcatgtt

SEQ ID NO: 8345925 - DNA, 22 bp, Homo sapiens
gccaggtccagggtggagcgct

SEQ ID NO: 8345926 - DNA, 20 bp, Homo sapiens
gcctcagccaacccatgggg

SEQ ID NO: 8345927 - DNA, 22 bp, Homo sapiens
gcctcagccggcggacgccagg

SEQ ID NO: 8345928 - DNA, 22 bp, Homo sapiens
gcctcagctcccagcccaggct

SEQ ID NO: 8345929 - DNA, 22 bp, Homo sapiens
gcctcaggactggcatactcat

SEQ ID NO: 8345930 - DNA, 22 bp, Homo sapiens
gcctcagctgttgcaggggccc

SEQ ID NO: 8345931 - DNA, 22 bp, Homo sapiens
gcctcaggactggcatactcat

SEQ ID NO: 8345932 - DNA, 22 bp, Homo sapiens
gccctgagaagaagtcggaggg

SEQ ID NO: 8345933 - DNA, 22 bp, Homo sapiens
gccctctgttattgcatcctta

SEQ ID NO: 8345934 - DNA, 22 bp, Homo sapiens
gccctgaccttcactgactctc

SEQ ID NO: 8345935 - DNA, 22 bp, Homo sapiens
gccctgacactttgcagctgag

SEQ ID NO: 8345936 - DNA, 22 bp, Homo sapiens
gccctgagctagtgtgggcagg

SEQ ID NO: 8345937 - DNA, 22 bp, Homo sapiens
gccctgagcactgctgctgggg

SEQ ID NO: 8345938 - DNA, 22 bp, Homo sapiens
gcccagggctgcaagtggacgc

SEQ ID NO: 8345939 - DNA, 22 bp, Homo sapiens
gcccagggcgatggtcggggcc

SEQ ID NO: 8345940 - DNA, 22 bp, Homo sapiens
gcccaggctggagtgcagtggt

SEQ ID NO: 8345941 - DNA, 22 bp, Homo sapiens
gcccatgcccctccttctggca

SEQ ID NO: 8345942 - DNA, 22 bp, Homo sapiens
gcccatgaggtggaggctgcag

SEQ ID NO: 8345943 - DNA, 20 bp, Homo sapiens
gcccatgaggactgcagctg

SEQ ID NO: 8345944 - DNA, 23 bp, Homo sapiens
gcccatgctgttgggcccgagca

SEQ ID NO: 8345945 - DNA, 22 bp, Homo sapiens
gccctctggggcacacagagga

SEQ ID NO: 8345946 - DNA, 22 bp, Homo sapiens
gccctctggtggccgcctcggc

SEQ ID NO: 8345947 - DNA, 22 bp, Homo sapiens
gcccagtggtaaaagcaggcct

SEQ ID NO: 8345948 - DNA, 22 bp, Homo sapiens
gcccatcatcactgtggaggct

SEQ ID NO: 8345949 - DNA, 22 bp, Homo sapiens
gctgatctcccttttctcacag

SEQ ID NO: 8345950 - DNA, 22 bp, Homo sapiens
gctgaaggtctctggagaggtc

SEQ ID NO: 8345951 - DNA, 22 bp, Homo sapiens
gctgaagctgcagcaggaggaa

SEQ ID NO: 8345952 - DNA, 22 bp, Homo sapiens
gctgcaggagctggagctgtgg

SEQ ID NO: 8345953 - DNA, 22 bp, Homo sapiens
gctgcaggatgaggctctgctc

SEQ ID NO: 8345954 - DNA, 22 bp, Homo sapiens
gctgcaggttgggcaacagagt

SEQ ID NO: 8345955 - DNA, 22 bp, Homo sapiens
gctgcagggggtgggcgtctcc

SEQ ID NO: 8345956 - DNA, 22 bp, Homo sapiens
gctgcaggtttgtctagtctgg

SEQ ID NO: 8345957 - DNA, 22 bp, Homo sapiens
gctgcaggagctggagctgtgg

SEQ ID NO: 8345958 - DNA, 22 bp, Homo sapiens
gctgcagacctcatgcaggtgg

SEQ ID NO: 8345959 - DNA, 22 bp, Homo sapiens
gctgcagactgggaggcaggtg

SEQ ID NO: 8345960 - DNA, 22 bp, Homo sapiens
gctctgcccaggaccgtccttg

SEQ ID NO: 8345961 - DNA, 17 bp, Homo sapiens
gctctgccccagcctct

SEQ ID NO: 8345962 - DNA, 17 bp, Homo sapiens
gctctgccccagcctct

SEQ ID NO: 8345963 - DNA, 22 bp, Homo sapiens
gctctgcccagtgccctgagac

SEQ ID NO: 8345964 - DNA, 18 bp, Homo sapiens
gctctgcccaggctgccc

SEQ ID NO: 8345965 - DNA, 22 bp, Homo sapiens
gctctgcccagtgccctgagac

SEQ ID NO: 8345966 - DNA, 22 bp, Homo sapiens
gctctgcccagtgccctgagac

SEQ ID NO: 8345967 - DNA, 18 bp, Homo sapiens
gctctgcccaggctgccc

SEQ ID NO: 8345968 - DNA, 22 bp, Homo sapiens
gctctgcccaggaccgtccttg

SEQ ID NO: 8345969 - DNA, 22 bp, Homo sapiens
gctctgccctgggccgttgtaa

SEQ ID NO: 8345970 - DNA, 22 bp, Homo sapiens
gctctgccctgggccgttgtaa

SEQ ID NO: 8345971 - DNA, 22 bp, Homo sapiens
gctctgcctcccctagtgttac

SEQ ID NO: 8345972 - DNA, 22 bp, Homo sapiens
gctctgccctgggccgttgtaa

SEQ ID NO: 8345973 - DNA, 22 bp, Homo sapiens
gctctgccccaggaactcagcc

SEQ ID NO: 8345974 - DNA, 22 bp, Homo sapiens
gctctgccccaggaactcagcc

SEQ ID NO: 8345975 - DNA, 17 bp, Homo sapiens
gctctgccccagcctct

SEQ ID NO: 8345976 - DNA, 22 bp, Homo sapiens
gctctgcctctttgctgcgtca

SEQ ID NO: 8345977 - DNA, 22 bp, Homo sapiens
gctctgcctctttgctgcgtca

SEQ ID NO: 8345978 - DNA, 17 bp, Homo sapiens
gctctgcctctcccacc

SEQ ID NO: 8345979 - DNA, 17 bp, Homo sapiens
gctctgcctctcccacc

SEQ ID NO: 8345980 - DNA, 22 bp, Homo sapiens
gctctgcctttgtcttacacgg

SEQ ID NO: 8345981 - DNA, 22 bp, Homo sapiens
gctctgcgattattgggccttt

SEQ ID NO: 8345982 - DNA, 22 bp, Homo sapiens
gctctgcctggtcgcgtgctgg

SEQ ID NO: 8345983 - DNA, 22 bp, Homo sapiens
gctctgcctggtcgcgtgctgg

SEQ ID NO: 8345984 - DNA, 22 bp, Homo sapiens
gctctgccttctcactgggttc

SEQ ID NO: 8345985 - DNA, 23 bp, Homo sapiens
gctctggcagcttgtgtcagcac

SEQ ID NO: 8345986 - DNA, 22 bp, Homo sapiens
gctcagggaaagagctcctgtc

SEQ ID NO: 8345987 - DNA, 21 bp, Homo sapiens
gctcaggctcttgacagagca

SEQ ID NO: 8345988 - DNA, 22 bp, Homo sapiens
gctcaggctggattgcagtggc

SEQ ID NO: 8345989 - DNA, 22 bp, Homo sapiens
gctcagggaaagagctcctgtc

SEQ ID NO: 8345990 - DNA, 22 bp, Homo sapiens
gctcaggcctccagaggggcaa

SEQ ID NO: 8345991 - DNA, 18 bp, Homo sapiens
gctcaggccctagtcagt

SEQ ID NO: 8345992 - DNA, 22 bp, Homo sapiens
gctcaggctctcccaggggaat

SEQ ID NO: 8345993 - DNA, 22 bp, Homo sapiens
gctcaggcctggcccatgggac

SEQ ID NO: 8345994 - DNA, 21 bp, Homo sapiens
gctcaggctcaggttcaggtt

SEQ ID NO: 8345995 - DNA, 22 bp, Homo sapiens
gctatcttcatggaaatacagg

SEQ ID NO: 8345996 - DNA, 22 bp, Homo sapiens
gctatcttcctcaatgtcagct

SEQ ID NO: 8345997 - DNA, 22 bp, Homo sapiens
gctatctttctgcaccataatt

SEQ ID NO: 8345998 - DNA, 22 bp, Homo sapiens
gcgggggcggcgcagacctcag

SEQ ID NO: 8345999 - DNA, 22 bp, Homo sapiens
gcgggggcagactgggcagttc

SEQ ID NO: 8346000 - DNA, 22 bp, Homo sapiens
gcggggcccccggccgagctct

SEQ ID NO: 8346001 - DNA, 22 bp, Homo sapiens
gcggggccatgtccaacggcct

SEQ ID NO: 8346002 - DNA, 22 bp, Homo sapiens
gcggggcccggacccagcctct

SEQ ID NO: 8346003 - DNA, 22 bp, Homo sapiens
gcggggcccggacccagcctct

SEQ ID NO: 8346004 - DNA, 22 bp, Homo sapiens
gcggggcctgactctgacccgc

SEQ ID NO: 8346005 - DNA, 22 bp, Homo sapiens
gcggggcgtgctgctgctgagg

SEQ ID NO: 8346006 - DNA, 22 bp, Homo sapiens
gcggggcctgactctgacccgc

SEQ ID NO: 8346007 - DNA, 22 bp, Homo sapiens
gctcaagccttctgcccacctc

SEQ ID NO: 8346008 - DNA, 22 bp, Homo sapiens
gctcactaaataacaggaagaa

SEQ ID NO: 8346009 - DNA, 23 bp, Homo sapiens
gctcaggcatcattcttcctggc

SEQ ID NO: 8346010 - DNA, 22 bp, Homo sapiens
gctcaggcatgtatgtggttgc

SEQ ID NO: 8346011 - DNA, 22 bp, Homo sapiens
gctcaggcccagcggctggtgt

SEQ ID NO: 8346012 - DNA, 22 bp, Homo sapiens
gcgggccggttcgatccgtatg

SEQ ID NO: 8346013 - DNA, 22 bp, Homo sapiens
gcgggcgctcaggctgcagctg

SEQ ID NO: 8346014 - DNA, 18 bp, Homo sapiens
gcgggcggtgcagtgggc

SEQ ID NO: 8346015 - DNA, 18 bp, Homo sapiens
gcgggcggtgcagtgggc

SEQ ID NO: 8346016 - DNA, 22 bp, Homo sapiens
gcgggcgggggttcccaggtct

SEQ ID NO: 8346017 - DNA, 22 bp, Homo sapiens
gcggcgcctaagccccgacctc

SEQ ID NO: 8346018 - DNA, 21 bp, Homo sapiens
gcggcgatacgcgcaggggag

SEQ ID NO: 8346019 - DNA, 22 bp, Homo sapiens
gcggctccgaagccaggccgcg

SEQ ID NO: 8346020 - DNA, 22 bp, Homo sapiens
gcggcccgagcaggacgggtgg

SEQ ID NO: 8346021 - DNA, 22 bp, Homo sapiens
gcggcccgggtccccagcagca

SEQ ID NO: 8346022 - DNA, 22 bp, Homo sapiens
gcggagggagataggccttgct

SEQ ID NO: 8346023 - DNA, 22 bp, Homo sapiens
gcggaggaaactgaggcaagag

SEQ ID NO: 8346024 - DNA, 22 bp, Homo sapiens
gcggcaggagtaaaggaggaag

SEQ ID NO: 8346025 - DNA, 22 bp, Homo sapiens
gcggcagaggtgttgcgagcga

SEQ ID NO: 8346026 - DNA, 22 bp, Homo sapiens
gcggagggcgagcccgcggagc

SEQ ID NO: 8346027 - DNA, 22 bp, Homo sapiens
gcggagggcgagcccgcggagc

SEQ ID NO: 8346028 - DNA, 18 bp, Homo sapiens
gcgctggctgtcctgtcc

SEQ ID NO: 8346029 - DNA, 22 bp, Homo sapiens
gcgctgcctctgctctccccac

SEQ ID NO: 8346030 - DNA, 22 bp, Homo sapiens
gcgctgcgcctcctcttccgca

SEQ ID NO: 8346031 - DNA, 22 bp, Homo sapiens
gcgctctgtctcaggggtccag

SEQ ID NO: 8346032 - DNA, 22 bp, Homo sapiens
gcgctcctcccggccctggtgg

SEQ ID NO: 8346033 - DNA, 22 bp, Homo sapiens
gcgcgtcctccctcggctgctg

SEQ ID NO: 8346034 - DNA, 22 bp, Homo sapiens
gcgcggggtacacgcggtggcc

SEQ ID NO: 8346035 - DNA, 22 bp, Homo sapiens
gcgcgggcaggccttccgagtg

SEQ ID NO: 8346036 - DNA, 22 bp, Homo sapiens
gcgcctgccaccatgccaggct

SEQ ID NO: 8346037 - DNA, 22 bp, Homo sapiens
gcgcgctgagtgtccgttgggg

SEQ ID NO: 8346038 - DNA, 22 bp, Homo sapiens
gcgccctccacccacagcggct

SEQ ID NO: 8346039 - DNA, 22 bp, Homo sapiens
gccttttgatctataactgtgt

SEQ ID NO: 8346040 - DNA, 22 bp, Homo sapiens
gcgaaaaatgtgtaaatatgtt

SEQ ID NO: 8346041 - DNA, 22 bp, Homo sapiens
gccttgccaaggggcagcagag

SEQ ID NO: 8346042 - DNA, 22 bp, Homo sapiens
gccttttgaaatagaaatctga

SEQ ID NO: 8346043 - DNA, 22 bp, Homo sapiens
gccttctgattgctggactgac

SEQ ID NO: 8346044 - DNA, 22 bp, Homo sapiens
gccttctgatcgctggactgac

SEQ ID NO: 8346045 - DNA, 17 bp, Homo sapiens
gccttctctgccctcac

SEQ ID NO: 8346046 - DNA, 22 bp, Homo sapiens
gccttccacctaggcctctgct

SEQ ID NO: 8346047 - DNA, 22 bp, Homo sapiens
gcctggggtctctgactcacag

SEQ ID NO: 8346048 - DNA, 22 bp, Homo sapiens
gcctggggtcccttgttggcac

SEQ ID NO: 8346049 - DNA, 22 bp, Homo sapiens
gcctggggtctctgactcacag

SEQ ID NO: 8346050 - DNA, 22 bp, Homo sapiens
gcctggggggcatgtcataata

SEQ ID NO: 8346051 - DNA, 22 bp, Homo sapiens
gcctggggtcccttgttggcac

SEQ ID NO: 8346052 - DNA, 22 bp, Homo sapiens
gcctggggccagcttgggctga

SEQ ID NO: 8346053 - DNA, 22 bp, Homo sapiens
gcctggggggcatgtcataata

SEQ ID NO: 8346054 - DNA, 22 bp, Homo sapiens
gcctggggcatgcagctgatac

SEQ ID NO: 8346055 - DNA, 22 bp, Homo sapiens
gcctggggccagcttgggctga

SEQ ID NO: 8346056 - DNA, 22 bp, Homo sapiens
gcctggggcatgcagctgatac

SEQ ID NO: 8346057 - DNA, 22 bp, Homo sapiens
gcctggggaacttgatcctgtc

SEQ ID NO: 8346058 - DNA, 22 bp, Homo sapiens
gccttcagtaactgagacggaa

SEQ ID NO: 8346059 - DNA, 22 bp, Homo sapiens
gcctggctgggcaccaggggag

SEQ ID NO: 8346060 - DNA, 22 bp, Homo sapiens
gcctggctgtcaaacccagaag

SEQ ID NO: 8346061 - DNA, 22 bp, Homo sapiens
gcctggggaacttgatcctgtc

SEQ ID NO: 8346062 - DNA, 22 bp, Homo sapiens
gcctcaggcctatagctgctgt

SEQ ID NO: 8346063 - DNA, 22 bp, Homo sapiens
gcctcaggcctatagctgctgt

SEQ ID NO: 8346064 - DNA, 22 bp, Homo sapiens
gcctcaggccgccctgctgctc

SEQ ID NO: 8346065 - DNA, 22 bp, Homo sapiens
gcctcaggccgccctgctgctc

SEQ ID NO: 8346066 - DNA, 22 bp, Homo sapiens
gcctcagggataggatgagcat

SEQ ID NO: 8346067 - DNA, 22 bp, Homo sapiens
gctggggctgggctgaggaaga

SEQ ID NO: 8346068 - DNA, 16 bp, Homo sapiens
gctgggagggagaggt

SEQ ID NO: 8346069 - DNA, 22 bp, Homo sapiens
gctgggagtcgcgtctgtggcc

SEQ ID NO: 8346070 - DNA, 22 bp, Homo sapiens
gctgggaggatctctccctgtc

SEQ ID NO: 8346071 - DNA, 20 bp, Homo sapiens
gctgggggtgtgctgagtga

SEQ ID NO: 8346072 - DNA, 22 bp, Homo sapiens
gctgggtgtcacggggctcgtg

SEQ ID NO: 8346073 - DNA, 22 bp, Homo sapiens
gctgtcttcacttcctggtttc

SEQ ID NO: 8346074 - DNA, 22 bp, Homo sapiens
gctgtgagggcttctgaggcat

SEQ ID NO: 8346075 - DNA, 22 bp, Homo sapiens
gctgtgagggcttctgaggcat

SEQ ID NO: 8346076 - DNA, 22 bp, Homo sapiens
gctgtgagggtctagtgaggtg

SEQ ID NO: 8346077 - DNA, 22 bp, Homo sapiens
gctgtgagggtctagtgaggtg

SEQ ID NO: 8346078 - DNA, 22 bp, Homo sapiens
gctgtgagtggaggaggctgag

SEQ ID NO: 8346079 - DNA, 22 bp, Homo sapiens
gctgtctttcccctgctccaga

SEQ ID NO: 8346080 - DNA, 22 bp, Homo sapiens
gctgtgagaaacagggagtgtc

SEQ ID NO: 8346081 - DNA, 22 bp, Homo sapiens
gcttccacctactaaatgccac

SEQ ID NO: 8346082 - DNA, 22 bp, Homo sapiens
gctgtgcaggtccccactgcct

SEQ ID NO: 8346083 - DNA, 22 bp, Homo sapiens
gctggcacaggtggatgctggc

SEQ ID NO: 8346084 - DNA, 22 bp, Homo sapiens
gctggctccaaaagcaggggct

SEQ ID NO: 8346085 - DNA, 22 bp, Homo sapiens
gctggctcccattggtccttcc

SEQ ID NO: 8346086 - DNA, 21 bp, Homo sapiens
gctggctcaaatgcttgtgtc

SEQ ID NO: 8346087 - DNA, 22 bp, Homo sapiens
gctggctcgggaagcaggggat

SEQ ID NO: 8346088 - DNA, 22 bp, Homo sapiens
gctggctctacatttgaggtca

SEQ ID NO: 8346089 - DNA, 22 bp, Homo sapiens
gctggctctcctcacagtacag

SEQ ID NO: 8346090 - DNA, 21 bp, Homo sapiens
gctggctctctgacgtgcttt

SEQ ID NO: 8346091 - DNA, 22 bp, Homo sapiens
gctgggacaggcttggccctgt

SEQ ID NO: 8346092 - DNA, 22 bp, Homo sapiens
gctgggagaggccctgaagtga

SEQ ID NO: 8346093 - DNA, 22 bp, Homo sapiens
gcttccgcgatgtcctaggtgg

SEQ ID NO: 8346094 - DNA, 17 bp, Homo sapiens
gcttcccctgccctctc

SEQ ID NO: 8346095 - DNA, 20 bp, Homo sapiens
gcttcccaattcttgatctg

SEQ ID NO: 8346096 - DNA, 23 bp, Homo sapiens
gcttcccagacaatactgcttcc

SEQ ID NO: 8346097 - DNA, 22 bp, Homo sapiens
gcttcctgagacaacattgagt

SEQ ID NO: 8346098 - DNA, 22 bp, Homo sapiens
gcttcctgagtacaccctcatc

SEQ ID NO: 8346099 - DNA, 22 bp, Homo sapiens
gcttcctgagagagacagttcc

SEQ ID NO: 8346100 - DNA, 18 bp, Homo sapiens
gcttcctgaaagctgccc

SEQ ID NO: 8346101 - DNA, 22 bp, Homo sapiens
gcttcctgagaaacaatctgat

SEQ ID NO: 8346102 - DNA, 22 bp, Homo sapiens
ggaaatattttgtctaatttgt

SEQ ID NO: 8346103 - DNA, 22 bp, Homo sapiens
gcttcctgatattcatactgtt

SEQ ID NO: 8346104 - DNA, 22 bp, Homo sapiens
ggaaaggagatattggagagtg

SEQ ID NO: 8346105 - DNA, 22 bp, Homo sapiens
ggaacagttgagatgatgtacc

SEQ ID NO: 8346106 - DNA, 22 bp, Homo sapiens
ggagagcttggagtgcgatttt

SEQ ID NO: 8346107 - DNA, 19 bp, Homo sapiens
ggagaggctggagggatgc

SEQ ID NO: 8346108 - DNA, 19 bp, Homo sapiens
ggagaggctggagggatgc

SEQ ID NO: 8346109 - DNA, 22 bp, Homo sapiens
ggagaggagctattgggggctc

SEQ ID NO: 8346110 - DNA, 22 bp, Homo sapiens
ggagagctggtagctggctcca

SEQ ID NO: 8346111 - DNA, 22 bp, Homo sapiens
ggactctggtatttcactcttg

SEQ ID NO: 8346112 - DNA, 22 bp, Homo sapiens
ggacggggagctggaaagggga

SEQ ID NO: 8346113 - DNA, 22 bp, Homo sapiens
ggacctgccagaactcaggcta

SEQ ID NO: 8346114 - DNA, 22 bp, Homo sapiens
ggaccctgcagccacccgacat

SEQ ID NO: 8346115 - DNA, 18 bp, Homo sapiens
ggacccagggcctcaccc

SEQ ID NO: 8346116 - DNA, 22 bp, Homo sapiens
ggacccagctctgagaccctgc

SEQ ID NO: 8346117 - DNA, 22 bp, Homo sapiens
ggaccctgggcttgctcctggg

SEQ ID NO: 8346118 - DNA, 22 bp, Homo sapiens
ggaccctgggcagctggctgct

SEQ ID NO: 8346119 - DNA, 22 bp, Homo sapiens
ggaccctgcgtgtatccacact

SEQ ID NO: 8346120 - DNA, 22 bp, Homo sapiens
ggaccctggagacccactggga

SEQ ID NO: 8346121 - DNA, 23 bp, Homo sapiens
ggaccctgtggagggtgagagtc

SEQ ID NO: 8346122 - DNA, 23 bp, Homo sapiens
ggaccctgtggagggtgagagtc

SEQ ID NO: 8346123 - DNA, 22 bp, Homo sapiens
ggacagagcagacgagcagcgg

SEQ ID NO: 8346124 - DNA, 22 bp, Homo sapiens
tagatgcatagagcacagcaca

SEQ ID NO: 8346125 - DNA, 20 bp, Homo sapiens
tagatgataattcctagact

SEQ ID NO: 8346126 - DNA, 22 bp, Homo sapiens
tagaggagagttgctggatgga

SEQ ID NO: 8346127 - DNA, 22 bp, Homo sapiens
tagaggagcggcgagctgagct

SEQ ID NO: 8346128 - DNA, 22 bp, Homo sapiens
tagaggaggcaaggccctccct

SEQ ID NO: 8346129 - DNA, 23 bp, Homo sapiens
tagaggaggatgtgatgcatatt

SEQ ID NO: 8346130 - DNA, 22 bp, Homo sapiens
tagaggagggctgttcttcagt

SEQ ID NO: 8346131 - DNA, 22 bp, Homo sapiens
tagaggaggtgattcttgagct

SEQ ID NO: 8346132 - DNA, 22 bp, Homo sapiens
tagagctcattttaagcagaca

SEQ ID NO: 8346133 - DNA, 23 bp, Homo sapiens
tagagcattgctgaggcctccct

SEQ ID NO: 8346134 - DNA, 22 bp, Homo sapiens
tagagcatttagaggggcagga

SEQ ID NO: 8346135 - DNA, 20 bp, Homo sapiens
tagagcatgaagtcctatcc

SEQ ID NO: 8346136 - DNA, 22 bp, Homo sapiens
tagagcattaagtattgttgtt

SEQ ID NO: 8346137 - DNA, 22 bp, Homo sapiens
tagagcattagaaattagtgta

SEQ ID NO: 8346138 - DNA, 22 bp, Homo sapiens
tagagcattatgacaaccccat

SEQ ID NO: 8346139 - DNA, 22 bp, Homo sapiens
tagagcattctatctccaacag

SEQ ID NO: 8346140 - DNA, 22 bp, Homo sapiens
tagagatagcagtattgattcg

SEQ ID NO: 8346141 - DNA, 22 bp, Homo sapiens
tagagatgaattctgcagtctt

SEQ ID NO: 8346142 - DNA, 22 bp, Homo sapiens
tagaatctgcctgcagcaaaga

SEQ ID NO: 8346143 - DNA, 20 bp, Homo sapiens
tagaatctggtgatgtatcg

SEQ ID NO: 8346144 - DNA, 22 bp, Homo sapiens
tactttctttctgatccttatg

SEQ ID NO: 8346145 - DNA, 22 bp, Homo sapiens
tactttcttgttcctttcataa

SEQ ID NO: 8346146 - DNA, 22 bp, Homo sapiens
tagaagcagaaggaaggtggct

SEQ ID NO: 8346147 - DNA, 19 bp, Homo sapiens
tagaagcagggaagctgag

SEQ ID NO: 8346148 - DNA, 22 bp, Homo sapiens
tactttctgtccttctgttaaa

SEQ ID NO: 8346149 - DNA, 22 bp, Homo sapiens
tactttctgtccttctgttaaa

SEQ ID NO: 8346150 - DNA, 22 bp, Homo sapiens
tactttccctcatcaacaatca

SEQ ID NO: 8346151 - DNA, 22 bp, Homo sapiens
tagaataagttgatgatatatg

SEQ ID NO: 8346152 - DNA, 22 bp, Homo sapiens
tagaatcagaagatttgactgt

SEQ ID NO: 8346153 - DNA, 23 bp, Homo sapiens
tagaatcctctgagatggaatag

SEQ ID NO: 8346154 - DNA, 22 bp, Homo sapiens
tagaatcatacctctaggaaca

SEQ ID NO: 8346155 - DNA, 22 bp, Homo sapiens
tagaatcattgagaataacagg

SEQ ID NO: 8346156 - DNA, 22 bp, Homo sapiens
tagaatccagattctatgctaa

SEQ ID NO: 8346157 - DNA, 22 bp, Homo sapiens
tagaatccacctacacaagaga

SEQ ID NO: 8346158 - DNA, 22 bp, Homo sapiens
tagcactccattatgatgtggc

SEQ ID NO: 8346159 - DNA, 22 bp, Homo sapiens
tagcagggttttgaagagggtt

SEQ ID NO: 8346160 - DNA, 22 bp, Homo sapiens
tagccaggtcacactgtgtgtt

SEQ ID NO: 8346161 - DNA, 22 bp, Homo sapiens
tagccagggagacactgtggag

SEQ ID NO: 8346162 - DNA, 22 bp, Homo sapiens
tagccaggctggaagcaaaagg

SEQ ID NO: 8346163 - DNA, 22 bp, Homo sapiens
tagccagtgaatgtttccagtg

SEQ ID NO: 8346164 - DNA, 23 bp, Homo sapiens
tagccaggcccagcatggacacc

SEQ ID NO: 8346165 - DNA, 22 bp, Homo sapiens
tagccaggctgcagctgatccg

SEQ ID NO: 8346166 - DNA, 22 bp, Homo sapiens
tagcatttcccaaatgcatttg

SEQ ID NO: 8346167 - DNA, 22 bp, Homo sapiens
tagcatttctggcctctactca

SEQ ID NO: 8346168 - DNA, 22 bp, Homo sapiens
tagcatttggcaccagttattt

SEQ ID NO: 8346169 - DNA, 22 bp, Homo sapiens
tagcatttggacattgtcacct

SEQ ID NO: 8346170 - DNA, 22 bp, Homo sapiens
tagcatttggacattgtcacct

SEQ ID NO: 8346171 - DNA, 22 bp, Homo sapiens
tagcattttagctgttttctct

SEQ ID NO: 8346172 - DNA, 21 bp, Homo sapiens
tagcatttttgtattgctgaa

SEQ ID NO: 8346173 - DNA, 22 bp, Homo sapiens
tagcatttatggtcatgtgtcc

SEQ ID NO: 8346174 - DNA, 17 bp, Homo sapiens
tagcatttatcttcctt

SEQ ID NO: 8346175 - DNA, 22 bp, Homo sapiens
tagcatttattccagatttgga

SEQ ID NO: 8346176 - DNA, 17 bp, Homo sapiens
tagcatttatcttcctt

SEQ ID NO: 8346177 - DNA, 22 bp, Homo sapiens
tagcatttagaacaccttgaga

SEQ ID NO: 8346178 - DNA, 22 bp, Homo sapiens
tagcatttattccagatttgga

SEQ ID NO: 8346179 - DNA, 22 bp, Homo sapiens
tagcatttcactgatcttcact

SEQ ID NO: 8346180 - DNA, 18 bp, Homo sapiens
tagattaaaattgaattc

SEQ ID NO: 8346181 - DNA, 22 bp, Homo sapiens
tagcaaaaaaactggcatctcc

SEQ ID NO: 8346182 - DNA, 22 bp, Homo sapiens
tagatgtttccttccatgtgga

SEQ ID NO: 8346183 - DNA, 23 bp, Homo sapiens
tagatgtttggggaactttgccc

SEQ ID NO: 8346184 - DNA, 22 bp, Homo sapiens
tagatgtttgagaagtttatgt

SEQ ID NO: 8346185 - DNA, 22 bp, Homo sapiens
tagatgttgaagtcatatttgg

SEQ ID NO: 8346186 - DNA, 22 bp, Homo sapiens
tagatgttccacatatatatgt

SEQ ID NO: 8346187 - DNA, 20 bp, Homo sapiens
tagatgtttcctgtcataaa

SEQ ID NO: 8346188 - DNA, 22 bp, Homo sapiens
tagatgttggtgagtgctgagg

SEQ ID NO: 8346189 - DNA, 22 bp, Homo sapiens
tagatgttgaagtcatatttgg

SEQ ID NO: 8346190 - DNA, 20 bp, Homo sapiens
tagatgtttcctgtcataaa

SEQ ID NO: 8346191 - DNA, 22 bp, Homo sapiens
tagatgtatcttctcttatcgt

SEQ ID NO: 8346192 - DNA, 22 bp, Homo sapiens
tagcaaaaactgcagttacttt

SEQ ID NO: 8346193 - DNA, 22 bp, Homo sapiens
tagcacacgcattagcaaatca

SEQ ID NO: 8346194 - DNA, 18 bp, Homo sapiens
tagcacagagcaggatgt

SEQ ID NO: 8346195 - DNA, 22 bp, Homo sapiens
tagcacagcttcttgatgtcac

SEQ ID NO: 8346196 - DNA, 22 bp, Homo sapiens
tagtctatcgcctctcacacgt

SEQ ID NO: 8346197 - DNA, 22 bp, Homo sapiens
tagtccattaaattagattcaa

SEQ ID NO: 8346198 - DNA, 22 bp, Homo sapiens
tagtccatcttgaattcagtga

SEQ ID NO: 8346199 - DNA, 22 bp, Homo sapiens
tagtcctcagctgaactgctgc

SEQ ID NO: 8346200 - DNA, 22 bp, Homo sapiens
tagtccagccttgggtgtagcc

SEQ ID NO: 8346201 - DNA, 22 bp, Homo sapiens
tagtcacacaattgtgtacatt

SEQ ID NO: 8346202 - DNA, 22 bp, Homo sapiens
tagtcacaggaagtttcaatgt

SEQ ID NO: 8346203 - DNA, 22 bp, Homo sapiens
tagtcagcatgaaataagcagc

SEQ ID NO: 8346204 - DNA, 22 bp, Homo sapiens
tagtatttcctgtaagctatag

SEQ ID NO: 8346205 - DNA, 22 bp, Homo sapiens
tagtattttagaaaaccatgaa

SEQ ID NO: 8346206 - DNA, 20 bp, Homo sapiens
tagtatttgcataaggatag

SEQ ID NO: 8346207 - DNA, 22 bp, Homo sapiens
tagtaaaagtttagttgaaagt

SEQ ID NO: 8346208 - DNA, 22 bp, Homo sapiens
tagtaaaaagcaatggtgagta

SEQ ID NO: 8346209 - DNA, 22 bp, Homo sapiens
tagtacttatctctgtcattgt

SEQ ID NO: 8346210 - DNA, 22 bp, Homo sapiens
tagtagaaaaatgttaatccct

SEQ ID NO: 8346211 - DNA, 22 bp, Homo sapiens
tagtatatctttagtacatagt

SEQ ID NO: 8346212 - DNA, 22 bp, Homo sapiens
tagtatatctttagtacatagt

SEQ ID NO: 8346213 - DNA, 22 bp, Homo sapiens
tagtatctattagtaacaagag

SEQ ID NO: 8346214 - DNA, 22 bp, Homo sapiens
tagtatattttgttgcaattca

SEQ ID NO: 8346215 - DNA, 22 bp, Homo sapiens
taggtgtgattcgaagagcaaa

SEQ ID NO: 8346216 - DNA, 22 bp, Homo sapiens
taggtgtgggctcaggaatgtg

SEQ ID NO: 8346217 - DNA, 22 bp, Homo sapiens
taggctggaacttaggcagagg

SEQ ID NO: 8346218 - DNA, 22 bp, Homo sapiens
taggctggaggaagcagtgcct

SEQ ID NO: 8346219 - DNA, 22 bp, Homo sapiens
taggctggaggaagcagtgcct

SEQ ID NO: 8346220 - DNA, 22 bp, Homo sapiens
taggaaatatttgaacatagga

SEQ ID NO: 8346221 - DNA, 22 bp, Homo sapiens
taggaaagaaatgagtagtgat

SEQ ID NO: 8346222 - DNA, 22 bp, Homo sapiens
taggaagcccttctgccatagt

SEQ ID NO: 8346223 - DNA, 22 bp, Homo sapiens
taggaacccgcagcagtccgag

SEQ ID NO: 8346224 - DNA, 22 bp, Homo sapiens
taggaacctactgtggttttaa

SEQ ID NO: 8346225 - DNA, 22 bp, Homo sapiens
taggaaccttgatcttggattt

SEQ ID NO: 8346226 - DNA, 22 bp, Homo sapiens
taggaaatgctccattgcataa

SEQ ID NO: 8346227 - DNA, 20 bp, Homo sapiens
taggacaggcagccgagggg

SEQ ID NO: 8346228 - DNA, 22 bp, Homo sapiens
taggctaggctgaaggttttgg

SEQ ID NO: 8346229 - DNA, 22 bp, Homo sapiens
tagttaaagccctaaattgata

SEQ ID NO: 8346230 - DNA, 22 bp, Homo sapiens
tagtgtatgtctaacatacact

SEQ ID NO: 8346231 - DNA, 22 bp, Homo sapiens
tagtgtttgggaattgtagaga

SEQ ID NO: 8346232 - DNA, 22 bp, Homo sapiens
tagtgtttttcattggcagagg

SEQ ID NO: 8346233 - DNA, 19 bp, Homo sapiens
tagtgtttttctggagcag

SEQ ID NO: 8346234 - DNA, 22 bp, Homo sapiens
tagtgtttagtacatatgcata

SEQ ID NO: 8346235 - DNA, 22 bp, Homo sapiens
tatactttcctgcaactttgat

SEQ ID NO: 8346236 - DNA, 22 bp, Homo sapiens
tatagacaagcgtaacaagaag

SEQ ID NO: 8346237 - DNA, 22 bp, Homo sapiens
tatactctgagaaacgtgtcac

SEQ ID NO: 8346238 - DNA, 22 bp, Homo sapiens
tatacttatgctaaaaaatgtt

SEQ ID NO: 8346239 - DNA, 22 bp, Homo sapiens
tatactctgaaaacaatagtag

SEQ ID NO: 8346240 - DNA, 22 bp, Homo sapiens
tatactctgagaaacgtgtcac

SEQ ID NO: 8346241 - DNA, 22 bp, Homo sapiens
tatactattattgtcagtttat

SEQ ID NO: 8346242 - DNA, 22 bp, Homo sapiens
tatactattattgtcagtttat

SEQ ID NO: 8346243 - DNA, 22 bp, Homo sapiens
tatattacctgcctgatctata

SEQ ID NO: 8346244 - DNA, 22 bp, Homo sapiens
tatattacctgcctgatctata

SEQ ID NO: 8346245 - DNA, 22 bp, Homo sapiens
tatattaaaccctctctgtagg

SEQ ID NO: 8346246 - DNA, 22 bp, Homo sapiens
tatatgttgatactaattctgg

SEQ ID NO: 8346247 - DNA, 22 bp, Homo sapiens
tatattaacacccacttgcctc

SEQ ID NO: 8346248 - DNA, 22 bp, Homo sapiens
tatatgtagattgtaccaatgt

SEQ ID NO: 8346249 - DNA, 22 bp, Homo sapiens
tatatgtgcagcatttttaatt

SEQ ID NO: 8346250 - DNA, 22 bp, Homo sapiens
tatatgcatgcccatgtataca

SEQ ID NO: 8346251 - DNA, 22 bp, Homo sapiens
tatatgcatgcccatgtataca

SEQ ID NO: 8346252 - DNA, 22 bp, Homo sapiens
tatatgcttgggaaatggtaga

SEQ ID NO: 8346253 - DNA, 22 bp, Homo sapiens
tatagactgtgaaatttaggca

SEQ ID NO: 8346254 - DNA, 22 bp, Homo sapiens
tatagcaaggacataatatgct

SEQ ID NO: 8346255 - DNA, 22 bp, Homo sapiens
tatatgatgccaaataacctgt

SEQ ID NO: 8346256 - DNA, 22 bp, Homo sapiens
tatatgcagtgtgtcattcaag

SEQ ID NO: 8346257 - DNA, 22 bp, Homo sapiens
tatatgcagtgtgtcattcaag

SEQ ID NO: 8346258 - DNA, 22 bp, Homo sapiens
tatcaatacatgttatcagtgt

SEQ ID NO: 8346259 - DNA, 20 bp, Homo sapiens
tatcaatcagaaagaagact

SEQ ID NO: 8346260 - DNA, 22 bp, Homo sapiens
tatctataagtactaacatggt

SEQ ID NO: 8346261 - DNA, 20 bp, Homo sapiens
tatattttctctttggcctt

SEQ ID NO: 8346262 - DNA, 19 bp, Homo sapiens
tatatttgttgaataaaaa

SEQ ID NO: 8346263 - DNA, 19 bp, Homo sapiens
tatatttgttgaataaaaa

SEQ ID NO: 8346264 - DNA, 22 bp, Homo sapiens
tatatttgtgtgtgatttatga

SEQ ID NO: 8346265 - DNA, 22 bp, Homo sapiens
tatattttagacaccctcacgc

SEQ ID NO: 8346266 - DNA, 22 bp, Homo sapiens
tatatttaattagttgctggat

SEQ ID NO: 8346267 - DNA, 22 bp, Homo sapiens
tatatttaatcctagagccatt

SEQ ID NO: 8346268 - DNA, 22 bp, Homo sapiens
tatattcaacaggctaatgtca

SEQ ID NO: 8346269 - DNA, 22 bp, Homo sapiens
tatattcaacaggctaatgtca

SEQ ID NO: 8346270 - DNA, 22 bp, Homo sapiens
tatatttgtgtgtgatttatga

SEQ ID NO: 8346271 - DNA, 18 bp, Homo sapiens
tatatttcacacatattc

SEQ ID NO: 8346272 - DNA, 22 bp, Homo sapiens
tatctttgcaaatatctctaag

SEQ ID NO: 8346273 - DNA, 22 bp, Homo sapiens
tatctttgatgccagatgttac

SEQ ID NO: 8346274 - DNA, 22 bp, Homo sapiens
tatctttgcaaatatctctaag

SEQ ID NO: 8346275 - DNA, 22 bp, Homo sapiens
tatctttgtatcaatctccatt

SEQ ID NO: 8346276 - DNA, 22 bp, Homo sapiens
tatgagtttaaggctaaaatag

SEQ ID NO: 8346277 - DNA, 22 bp, Homo sapiens
tatgcagtgtatgcactgagat

SEQ ID NO: 8346278 - DNA, 22 bp, Homo sapiens
tatgcattatacattaatttct

SEQ ID NO: 8346279 - DNA, 22 bp, Homo sapiens
tatgccaaggatcaatatgtat

SEQ ID NO: 8346280 - DNA, 22 bp, Homo sapiens
tatctttctgtcctagattctg

SEQ ID NO: 8346281 - DNA, 22 bp, Homo sapiens
tatctttgatgccagatgttac

SEQ ID NO: 8346282 - DNA, 22 bp, Homo sapiens
tatcttggcttgaaagatgctt

SEQ ID NO: 8346283 - DNA, 22 bp, Homo sapiens
tatcttaaaaatcgaagcagat

SEQ ID NO: 8346284 - DNA, 22 bp, Homo sapiens
tatctgttcttagctatagatg

SEQ ID NO: 8346285 - DNA, 22 bp, Homo sapiens
tatctgttgtccatgcagaaag

SEQ ID NO: 8346286 - DNA, 22 bp, Homo sapiens
tatctgtttcctatgcatgtga

SEQ ID NO: 8346287 - DNA, 22 bp, Homo sapiens
tatcttcaactaggattcattt

SEQ ID NO: 8346288 - DNA, 22 bp, Homo sapiens
tatcttcaactaggattcattt

SEQ ID NO: 8346289 - DNA, 22 bp, Homo sapiens
tatcttcaatttattcaaggag

SEQ ID NO: 8346290 - DNA, 22 bp, Homo sapiens
tatcttcagctgaagcagagtc

SEQ ID NO: 8346291 - DNA, 22 bp, Homo sapiens
tatcttcacttatatctttctt

SEQ ID NO: 8346292 - DNA, 22 bp, Homo sapiens
tatcttcagcacagatcctgtg

SEQ ID NO: 8346293 - DNA, 22 bp, Homo sapiens
tatcttcatagatttttacacc

SEQ ID NO: 8346294 - DNA, 22 bp, Homo sapiens
tatttcaacgtatgaaaagctg

SEQ ID NO: 8346295 - DNA, 22 bp, Homo sapiens
tatttcacatgtgggaaacata

SEQ ID NO: 8346296 - DNA, 22 bp, Homo sapiens
tattgcaatttggctaaagaat

SEQ ID NO: 8346297 - DNA, 22 bp, Homo sapiens
tattggtttattgtgtatgaga

SEQ ID NO: 8346298 - DNA, 22 bp, Homo sapiens
tattggtaggactcagctgaga

SEQ ID NO: 8346299 - DNA, 22 bp, Homo sapiens
tattggtataggcattgaaact

SEQ ID NO: 8346300 - DNA, 22 bp, Homo sapiens
tatttgtatgtgtgtacatata

SEQ ID NO: 8346301 - DNA, 22 bp, Homo sapiens
tatttggcaaagaattttctgg

SEQ ID NO: 8346302 - DNA, 22 bp, Homo sapiens
tatttggagtgatggaaatgtt

SEQ ID NO: 8346303 - DNA, 22 bp, Homo sapiens
tatttcccagggagcaacaagc

SEQ ID NO: 8346304 - DNA, 18 bp, Homo sapiens
tatttcccaatggaaaca

SEQ ID NO: 8346305 - DNA, 22 bp, Homo sapiens
tatttccatgttagaactaagt

SEQ ID NO: 8346306 - DNA, 22 bp, Homo sapiens
tatttcctgcatggtgatgtaa

SEQ ID NO: 8346307 - DNA, 22 bp, Homo sapiens
tatttctaagagatatctgtac

SEQ ID NO: 8346308 - DNA, 22 bp, Homo sapiens
tatttgttgcgggaattgctat

SEQ ID NO: 8346309 - DNA, 22 bp, Homo sapiens
tattttcaccttctctggatat

SEQ ID NO: 8346310 - DNA, 22 bp, Homo sapiens
tattttcaccttctctggatat

SEQ ID NO: 8346311 - DNA, 22 bp, Homo sapiens
tattttcattctgtgtgactgt

SEQ ID NO: 8346312 - DNA, 22 bp, Homo sapiens
tattttcattctgtgtgactgt

SEQ ID NO: 8346313 - DNA, 22 bp, Homo sapiens
tattttcattctgtgtgactgt

SEQ ID NO: 8346314 - DNA, 22 bp, Homo sapiens
tatttgtccaggtaaatttcag

SEQ ID NO: 8346315 - DNA, 22 bp, Homo sapiens
tatttgtcagctgttgagttca

SEQ ID NO: 8346316 - DNA, 22 bp, Homo sapiens
tatttgtctttcttataagaat

SEQ ID NO: 8346317 - DNA, 22 bp, Homo sapiens
tatttgtctaagaggctgacag

SEQ ID NO: 8346318 - DNA, 22 bp, Homo sapiens
tatttgtgtgggtatctatata

SEQ ID NO: 8346319 - DNA, 22 bp, Homo sapiens
tatttgttccagagataaaaat

SEQ ID NO: 8346320 - DNA, 22 bp, Homo sapiens
tatttgttgagttgttatgtct

SEQ ID NO: 8346321 - DNA, 22 bp, Homo sapiens
tatgcctgataactgtgtctct

SEQ ID NO: 8346322 - DNA, 22 bp, Homo sapiens
tatgcctggaacctttctcttt

SEQ ID NO: 8346323 - DNA, 22 bp, Homo sapiens
tatgctagatggaaaaatattg

SEQ ID NO: 8346324 - DNA, 22 bp, Homo sapiens
tatgctactagaaataaaatgg

SEQ ID NO: 8346325 - DNA, 22 bp, Homo sapiens
tatgctgattatatctttggtt

SEQ ID NO: 8346326 - DNA, 22 bp, Homo sapiens
tatgctgaatttggtttgctat

SEQ ID NO: 8346327 - DNA, 22 bp, Homo sapiens
tatgctttaacattaaacaaca

SEQ ID NO: 8346328 - DNA, 22 bp, Homo sapiens
tatgttaagtgggataatcaaa

SEQ ID NO: 8346329 - DNA, 22 bp, Homo sapiens
tatgttaagtgggataatcaaa

SEQ ID NO: 8346330 - DNA, 19 bp, Homo sapiens
tatgttatgttgtttactc

SEQ ID NO: 8346331 - DNA, 22 bp, Homo sapiens
tatgttattttcatacaacaga

SEQ ID NO: 8346332 - DNA, 22 bp, Homo sapiens
tatgttcatgtcaaacaaatgc

SEQ ID NO: 8346333 - DNA, 22 bp, Homo sapiens
tatgttcttggactaagttgtt

SEQ ID NO: 8346334 - DNA, 22 bp, Homo sapiens
tatgtttaaatgtatgtgtatg

SEQ ID NO: 8346335 - DNA, 22 bp, Homo sapiens
tatgtttaaatgtatgtgtatg

SEQ ID NO: 8346336 - DNA, 22 bp, Homo sapiens
tattgatatgcagaactgactt

SEQ ID NO: 8346337 - DNA, 22 bp, Homo sapiens
tattgaggtgcttagctggggg

SEQ ID NO: 8346338 - DNA, 22 bp, Homo sapiens
tattcacattctcaggcctggt

SEQ ID NO: 8346339 - DNA, 22 bp, Homo sapiens
tattcagaataaagactacatt

SEQ ID NO: 8346340 - DNA, 22 bp, Homo sapiens
tattcagaaaactgagcgatga

SEQ ID NO: 8346341 - DNA, 22 bp, Homo sapiens
tattcagagtgtagcaaataga

SEQ ID NO: 8346342 - DNA, 22 bp, Homo sapiens
tattcacatgtacatatgctca

SEQ ID NO: 8346343 - DNA, 22 bp, Homo sapiens
tattcacagttgatttacagtt

SEQ ID NO: 8346344 - DNA, 22 bp, Homo sapiens
tattcacaaaatgaggtcctca

SEQ ID NO: 8346345 - DNA, 22 bp, Homo sapiens
tatgtttatactttgatgtact

SEQ ID NO: 8346346 - DNA, 22 bp, Homo sapiens
tatgtttatactttgatgtact

SEQ ID NO: 8346347 - DNA, 22 bp, Homo sapiens
tatgtttatactttgatgtact

SEQ ID NO: 8346348 - DNA, 22 bp, Homo sapiens
gttacaaaggtcataaaagtgt

SEQ ID NO: 8346349 - DNA, 22 bp, Homo sapiens
gttaggaacattaatgtgattt

SEQ ID NO: 8346350 - DNA, 22 bp, Homo sapiens
gttcattttactgtaaatagca

SEQ ID NO: 8346351 - DNA, 22 bp, Homo sapiens
gttcattttactgtaaatagca

SEQ ID NO: 8346352 - DNA, 22 bp, Homo sapiens
gtgtgttcgtatcaacagagga

SEQ ID NO: 8346353 - DNA, 22 bp, Homo sapiens
gtgttaaccagctaaactttgc

SEQ ID NO: 8346354 - DNA, 22 bp, Homo sapiens
gtttcctttctattgccttgat

SEQ ID NO: 8346355 - DNA, 22 bp, Homo sapiens
gtttataaggcccaatatttct

SEQ ID NO: 8346356 - DNA, 22 bp, Homo sapiens
gtttctcaagcttgaatgcaca

SEQ ID NO: 8346357 - DNA, 22 bp, Homo sapiens
gtttctcagaggcccccaaaca

SEQ ID NO: 8346358 - DNA, 22 bp, Homo sapiens
gtttctcagcatgtcagtacaa

SEQ ID NO: 8346359 - DNA, 22 bp, Homo sapiens
gtttctcagtttggtctgcaga

SEQ ID NO: 8346360 - DNA, 22 bp, Homo sapiens
gtttctcatcagtttctgatat

SEQ ID NO: 8346361 - DNA, 22 bp, Homo sapiens
gttttagataaagctgtccttg

SEQ ID NO: 8346362 - DNA, 22 bp, Homo sapiens
gtttagaatggcaaaattaagt

SEQ ID NO: 8346363 - DNA, 22 bp, Homo sapiens
gtttagaaaatagtgaagcaag

SEQ ID NO: 8346364 - DNA, 22 bp, Homo sapiens
gtttagaacacggaaatactga

SEQ ID NO: 8346365 - DNA, 21 bp, Homo sapiens
gtttagaagtagtctggctca

SEQ ID NO: 8346366 - DNA, 22 bp, Homo sapiens
gtttagaagccaagatttgggt

SEQ ID NO: 8346367 - DNA, 22 bp, Homo sapiens
gttccatatcacagcagacgaa

SEQ ID NO: 8346368 - DNA, 22 bp, Homo sapiens
gttcctgggcctgcattcacca

SEQ ID NO: 8346369 - DNA, 21 bp, Homo sapiens
taaataataagttgctgagat

SEQ ID NO: 8346370 - DNA, 22 bp, Homo sapiens
taaataagtcactgaccattta

SEQ ID NO: 8346371 - DNA, 22 bp, Homo sapiens
taaataagttcttcattgtttg

SEQ ID NO: 8346372 - DNA, 22 bp, Homo sapiens
taaagttggacctgattttatt

SEQ ID NO: 8346373 - DNA, 22 bp, Homo sapiens
taaagtgtggatatgattagta

SEQ ID NO: 8346374 - DNA, 22 bp, Homo sapiens
taaagaataatacccatggagc

SEQ ID NO: 8346375 - DNA, 22 bp, Homo sapiens
taaacatcaccttctgcagttg

SEQ ID NO: 8346376 - DNA, 22 bp, Homo sapiens
taaacatcaggaatgaaaacct

SEQ ID NO: 8346377 - DNA, 22 bp, Homo sapiens
taaacatcagtacaaagactaa

SEQ ID NO: 8346378 - DNA, 22 bp, Homo sapiens
taaacagttaacatgccagaat

SEQ ID NO: 8346379 - DNA, 22 bp, Homo sapiens
taaacagtgatacgttccagct

SEQ ID NO: 8346380 - DNA, 20 bp, Homo sapiens
taaacagtatttactaggag

SEQ ID NO: 8346381 - DNA, 20 bp, Homo sapiens
taaacagtatttactaggag

SEQ ID NO: 8346382 - DNA, 22 bp, Homo sapiens
gttttcagccaggagcacattt

SEQ ID NO: 8346383 - DNA, 22 bp, Homo sapiens
gttttattggaacacagccatg

SEQ ID NO: 8346384 - DNA, 22 bp, Homo sapiens
gttttatttccatgagagaccg

SEQ ID NO: 8346385 - DNA, 22 bp, Homo sapiens
gttttataggctgttgctatat

SEQ ID NO: 8346386 - DNA, 22 bp, Homo sapiens
gttttataggctgttgctatat

SEQ ID NO: 8346387 - DNA, 22 bp, Homo sapiens
gttttataattgcttcataaga

SEQ ID NO: 8346388 - DNA, 22 bp, Homo sapiens
taagaaacccaggaatttctta

SEQ ID NO: 8346389 - DNA, 22 bp, Homo sapiens
taagaaacttaactgggaacta

SEQ ID NO: 8346390 - DNA, 22 bp, Homo sapiens
taagagtatctattaagtactt

SEQ ID NO: 8346391 - DNA, 22 bp, Homo sapiens
taagagtataaagtaatgcgga

SEQ ID NO: 8346392 - DNA, 22 bp, Homo sapiens
taagaaatttagttatagaatg

SEQ ID NO: 8346393 - DNA, 22 bp, Homo sapiens
taagaaatttagttatagaatg

SEQ ID NO: 8346394 - DNA, 22 bp, Homo sapiens
taagcaagatttattgaatttt

SEQ ID NO: 8346395 - DNA, 22 bp, Homo sapiens
taagcaagggtctctgtatcag

SEQ ID NO: 8346396 - DNA, 22 bp, Homo sapiens
taacacattttaagccatttta

SEQ ID NO: 8346397 - DNA, 22 bp, Homo sapiens
taacacagttctctgttgcaca

SEQ ID NO: 8346398 - DNA, 22 bp, Homo sapiens
taacacatatttgcagtaagca

SEQ ID NO: 8346399 - DNA, 22 bp, Homo sapiens
taacaatgattagtgactacag

SEQ ID NO: 8346400 - DNA, 22 bp, Homo sapiens
taataaatgaaagtgctggcat

SEQ ID NO: 8346401 - DNA, 22 bp, Homo sapiens
taagtttctccaaagcacagaa

SEQ ID NO: 8346402 - DNA, 22 bp, Homo sapiens
taagtgttgctctctctcagct

SEQ ID NO: 8346403 - DNA, 22 bp, Homo sapiens
taagtgtttctccagtgtcttt

SEQ ID NO: 8346404 - DNA, 22 bp, Homo sapiens
taagcataagatacatgagaca

SEQ ID NO: 8346405 - DNA, 22 bp, Homo sapiens
taagcatacattctctcctttc

SEQ ID NO: 8346406 - DNA, 22 bp, Homo sapiens
taatggagatgctgaagtcaca

SEQ ID NO: 8346407 - DNA, 22 bp, Homo sapiens
taatggagatttagcacttacg

SEQ ID NO: 8346408 - DNA, 22 bp, Homo sapiens
taatggagccagaagatcttga

SEQ ID NO: 8346409 - DNA, 22 bp, Homo sapiens
taatggagcctgccttccaggg

SEQ ID NO: 8346410 - DNA, 22 bp, Homo sapiens
taatggagcaagccactgaatg

SEQ ID NO: 8346411 - DNA, 22 bp, Homo sapiens
taatggaggtggcaaaaggtct

SEQ ID NO: 8346412 - DNA, 22 bp, Homo sapiens
taatggagtgacaaattggatt

SEQ ID NO: 8346413 - DNA, 23 bp, Homo sapiens
taatggagtgtggctgcttcgag

SEQ ID NO: 8346414 - DNA, 22 bp, Homo sapiens
taatggagttggaattaataag

SEQ ID NO: 8346415 - DNA, 22 bp, Homo sapiens
taatttctaattcattttcagt

SEQ ID NO: 8346416 - DNA, 22 bp, Homo sapiens
taatgcttaacagctggctttt

SEQ ID NO: 8346417 - DNA, 22 bp, Homo sapiens
taatgctaacatcatatcactg

SEQ ID NO: 8346418 - DNA, 22 bp, Homo sapiens
taatgaataaacttgagagtca

SEQ ID NO: 8346419 - DNA, 22 bp, Homo sapiens
taatgaatgagaatataacaga

SEQ ID NO: 8346420 - DNA, 22 bp, Homo sapiens
taatgcaattttctcagtccat

SEQ ID NO: 8346421 - DNA, 22 bp, Homo sapiens
taatgatatttcccatttctct

SEQ ID NO: 8346422 - DNA, 22 bp, Homo sapiens
tacacatgctcagattcctgtg

SEQ ID NO: 8346423 - DNA, 22 bp, Homo sapiens
tacacattacataatactatct

SEQ ID NO: 8346424 - DNA, 22 bp, Homo sapiens
tacacatttctcttagagacac

SEQ ID NO: 8346425 - DNA, 22 bp, Homo sapiens
tacaccagattatttataacat

SEQ ID NO: 8346426 - DNA, 22 bp, Homo sapiens
tacacattctagggcacagtta

SEQ ID NO: 8346427 - DNA, 22 bp, Homo sapiens
tacaccattcccaggtggattt

SEQ ID NO: 8346428 - DNA, 22 bp, Homo sapiens
tacaatttagtggtgtgtggtt

SEQ ID NO: 8346429 - DNA, 22 bp, Homo sapiens
tacacatctggtgtgactgcca

SEQ ID NO: 8346430 - DNA, 22 bp, Homo sapiens
tacacatctctgtcagtagtga

SEQ ID NO: 8346431 - DNA, 22 bp, Homo sapiens
tacacatatgtccattaatcag

SEQ ID NO: 8346432 - DNA, 22 bp, Homo sapiens
tacacatatgtgtgtatatgtg

SEQ ID NO: 8346433 - DNA, 22 bp, Homo sapiens
tacacatatgtgtgtatatgtg

SEQ ID NO: 8346434 - DNA, 22 bp, Homo sapiens
tacaagctgaccctgaagatga

SEQ ID NO: 8346435 - DNA, 20 bp, Homo sapiens
tacaatattcccactttgct

SEQ ID NO: 8346436 - DNA, 22 bp, Homo sapiens
tacaatatgtggccttttgtga

SEQ ID NO: 8346437 - DNA, 22 bp, Homo sapiens
tacaatgatgatactttactgg

SEQ ID NO: 8346438 - DNA, 22 bp, Homo sapiens
tacaatctttatgttgagtggt

SEQ ID NO: 8346439 - DNA, 22 bp, Homo sapiens
tacaatgaccatattatgtaag

SEQ ID NO: 8346440 - DNA, 22 bp, Homo sapiens
taatttcttcatctctgcagct

SEQ ID NO: 8346441 - DNA, 22 bp, Homo sapiens
taatttcttcatctctgcagct

SEQ ID NO: 8346442 - DNA, 22 bp, Homo sapiens
taattttaatagtatgtggcat

SEQ ID NO: 8346443 - DNA, 22 bp, Homo sapiens
tactaaatagcaggttggctat

SEQ ID NO: 8346444 - DNA, 22 bp, Homo sapiens
tactaaatgattaagcaggaat

SEQ ID NO: 8346445 - DNA, 22 bp, Homo sapiens
tactaaatagtttaattcctca

SEQ ID NO: 8346446 - DNA, 22 bp, Homo sapiens
tacgaacagggccatagaaact

SEQ ID NO: 8346447 - DNA, 22 bp, Homo sapiens
tacgattagagatgaatgcatg

SEQ ID NO: 8346448 - DNA, 22 bp, Homo sapiens
tacgcgaagaaggacctgatgg

SEQ ID NO: 8346449 - DNA, 22 bp, Homo sapiens
tactaacaatgagaacaagcca

SEQ ID NO: 8346450 - DNA, 22 bp, Homo sapiens
tacattccactagtgactggcg

SEQ ID NO: 8346451 - DNA, 22 bp, Homo sapiens
taccttctctagatctttattc

SEQ ID NO: 8346452 - DNA, 22 bp, Homo sapiens
tacctgtcaaaagacatggaga

SEQ ID NO: 8346453 - DNA, 22 bp, Homo sapiens
tactgagctggtccactgaggt

SEQ ID NO: 8346454 - DNA, 18 bp, Homo sapiens
tactgagcaacaggagaa

SEQ ID NO: 8346455 - DNA, 20 bp, Homo sapiens
tacttgaatgttgcagcagt

SEQ ID NO: 8346456 - DNA, 22 bp, Homo sapiens
tacagcttttcatatttgtgtt

SEQ ID NO: 8346457 - DNA, 22 bp, Homo sapiens
tacagcagagtgggatgcatct

SEQ ID NO: 8346458 - DNA, 22 bp, Homo sapiens
tacagcttgatgtttgtgtgtt

SEQ ID NO: 8346459 - DNA, 22 bp, Homo sapiens
tacatacaagatgtgtttaaaa

SEQ ID NO: 8346460 - DNA, 22 bp, Homo sapiens
tacataattgtctttgtcctca

SEQ ID NO: 8346461 - DNA, 22 bp, Homo sapiens
tacagtttttcactgaagatgt

SEQ ID NO: 8346462 - DNA, 22 bp, Homo sapiens
tacagtttttattcatgacaag

SEQ ID NO: 8346463 - DNA, 22 bp, Homo sapiens
tacagtttttattcatgacaag

SEQ ID NO: 8346464 - DNA, 22 bp, Homo sapiens
tacagttttggtgatgatgatg

SEQ ID NO: 8346465 - DNA, 22 bp, Homo sapiens
tacagttaccctggaaagaaat

SEQ ID NO: 8346466 - DNA, 22 bp, Homo sapiens
tacagttaccctggaaagaaat

SEQ ID NO: 8346467 - DNA, 22 bp, Homo sapiens
tacagttaagctactggagaat

SEQ ID NO: 8346468 - DNA, 22 bp, Homo sapiens
tacaggagagatttagtaatca

SEQ ID NO: 8346469 - DNA, 22 bp, Homo sapiens
tacagttttggtgatgatgatg

SEQ ID NO: 8346470 - DNA, 22 bp, Homo sapiens
tacagttactttgaaaattgat

SEQ ID NO: 8346471 - DNA, 22 bp, Homo sapiens
tacagttactttgaaaattgat

SEQ ID NO: 8346472 - DNA, 22 bp, Homo sapiens
tacagttacgctgagaaacgaa

SEQ ID NO: 8346473 - DNA, 22 bp, Homo sapiens
tacagttactgttatatgtgct

SEQ ID NO: 8346474 - DNA, 22 bp, Homo sapiens
tacagttactgttatatgtgct

SEQ ID NO: 8346475 - DNA, 22 bp, Homo sapiens
tacagttacgctgagaaacgaa

SEQ ID NO: 8346476 - DNA, 22 bp, Homo sapiens
tacagttactgttatatgtgct

SEQ ID NO: 8346477 - DNA, 22 bp, Homo sapiens
tacagttactgcatttctaata

SEQ ID NO: 8346478 - DNA, 22 bp, Homo sapiens
tacattaaggatatggacatga

SEQ ID NO: 8346479 - DNA, 22 bp, Homo sapiens
tacattacaggaaagataaaga

SEQ ID NO: 8346480 - DNA, 20 bp, Homo sapiens
tacattcaaaacaaactctg

SEQ ID NO: 8346481 - DNA, 22 bp, Homo sapiens
tacattcaacatgtcactatgt

SEQ ID NO: 8346482 - DNA, 22 bp, Homo sapiens
tacattcaacatgtcactatgt

SEQ ID NO: 8346483 - DNA, 22 bp, Homo sapiens
tacattcaaacgatttattgat

SEQ ID NO: 8346484 - DNA, 22 bp, Homo sapiens
tacattcatggtgacttgtatg

SEQ ID NO: 8346485 - DNA, 22 bp, Homo sapiens
tacattcatatgtgtgcataca

SEQ ID NO: 8346486 - DNA, 22 bp, Homo sapiens
tacattcagcaaaagaatggtt

SEQ ID NO: 8346487 - DNA, 22 bp, Homo sapiens
tacattcagaagaatggacacg

SEQ ID NO: 8346488 - DNA, 22 bp, Homo sapiens
tacatacacaaatgctgaatgg

SEQ ID NO: 8346489 - DNA, 22 bp, Homo sapiens
tacattaacttacgtccacatg

SEQ ID NO: 8346490 - DNA, 22 bp, Homo sapiens
tacatgtattgatttctcttct

SEQ ID NO: 8346491 - DNA, 22 bp, Homo sapiens
tcaggcaccttcctcttatctg

SEQ ID NO: 8346492 - DNA, 22 bp, Homo sapiens
tcaggcagatgcagggatggat

SEQ ID NO: 8346493 - DNA, 22 bp, Homo sapiens
tcaggcactgctttctgatatg

SEQ ID NO: 8346494 - DNA, 22 bp, Homo sapiens
tcaggcagctccaggaatggta

SEQ ID NO: 8346495 - DNA, 20 bp, Homo sapiens
tcagccattccttacctttc

SEQ ID NO: 8346496 - DNA, 22 bp, Homo sapiens
tcagccagttgccccagttagt

SEQ ID NO: 8346497 - DNA, 22 bp, Homo sapiens
tcagccagttaaggcttagaca

SEQ ID NO: 8346498 - DNA, 22 bp, Homo sapiens
tcagccagtgccttgatcttgc

SEQ ID NO: 8346499 - DNA, 22 bp, Homo sapiens
tcagccagttaagtcaagaaat

SEQ ID NO: 8346500 - DNA, 22 bp, Homo sapiens
tcagccagttaagtcaagaaat

SEQ ID NO: 8346501 - DNA, 22 bp, Homo sapiens
tcagccagtgtgcacctggagt

SEQ ID NO: 8346502 - DNA, 22 bp, Homo sapiens
tcagcttgctaaaagggcatct

SEQ ID NO: 8346503 - DNA, 22 bp, Homo sapiens
tcagcctgcgtcatggtgacac

SEQ ID NO: 8346504 - DNA, 22 bp, Homo sapiens
tcagccagggcagagcaggtga

SEQ ID NO: 8346505 - DNA, 22 bp, Homo sapiens
tcagccagggctctggcctcag

SEQ ID NO: 8346506 - DNA, 22 bp, Homo sapiens
tcagagtgcagcgggaggctgg

SEQ ID NO: 8346507 - DNA, 22 bp, Homo sapiens
tcagagtgcagggagtagcagc

SEQ ID NO: 8346508 - DNA, 22 bp, Homo sapiens
tcagccaggccaggcattcaca

SEQ ID NO: 8346509 - DNA, 22 bp, Homo sapiens
tcagccaggccctaagagattg

SEQ ID NO: 8346510 - DNA, 22 bp, Homo sapiens
tcagccagggggagagaatgga

SEQ ID NO: 8346511 - DNA, 22 bp, Homo sapiens
tcagccagtatttgagtgctca

SEQ ID NO: 8346512 - DNA, 22 bp, Homo sapiens
tcagagtgaccttacatggtct

SEQ ID NO: 8346513 - DNA, 22 bp, Homo sapiens
tcagagtgaggcccagcaatct

SEQ ID NO: 8346514 - DNA, 22 bp, Homo sapiens
tcagagtgaggcgtcaacatga

SEQ ID NO: 8346515 - DNA, 22 bp, Homo sapiens
tcagagggtggctgggagcatc

SEQ ID NO: 8346516 - DNA, 22 bp, Homo sapiens
tcagaggctggaagagcctcct

SEQ ID NO: 8346517 - DNA, 22 bp, Homo sapiens
tcagaggcttctggccagtctg

SEQ ID NO: 8346518 - DNA, 17 bp, Homo sapiens
tcagagggatgagcagg

SEQ ID NO: 8346519 - DNA, 21 bp, Homo sapiens
tcagagggccctggaggctca

SEQ ID NO: 8346520 - DNA, 22 bp, Homo sapiens
tcagtttttctatactttgtag

SEQ ID NO: 8346521 - DNA, 22 bp, Homo sapiens
tcagtttttctatactttgtag

SEQ ID NO: 8346522 - DNA, 22 bp, Homo sapiens
tcagtttttgtttgccagatag

SEQ ID NO: 8346523 - DNA, 22 bp, Homo sapiens
tcagttttctcatctgtaattt

SEQ ID NO: 8346524 - DNA, 22 bp, Homo sapiens
tcagttttctcatctgtaattt

SEQ ID NO: 8346525 - DNA, 22 bp, Homo sapiens
tcagttttctcatctgtgaaat

SEQ ID NO: 8346526 - DNA, 22 bp, Homo sapiens
tcagttttctcatttatgagat

SEQ ID NO: 8346527 - DNA, 22 bp, Homo sapiens
tcagttttctcatctgtgaaat

SEQ ID NO: 8346528 - DNA, 22 bp, Homo sapiens
tcagttttgattcctggttctc

SEQ ID NO: 8346529 - DNA, 22 bp, Homo sapiens
tcagttttgattcctggttctc

SEQ ID NO: 8346530 - DNA, 22 bp, Homo sapiens
tcagttttctcatttatgagat

SEQ ID NO: 8346531 - DNA, 22 bp, Homo sapiens
tcagttttgaaaacattgaatg

SEQ ID NO: 8346532 - DNA, 22 bp, Homo sapiens
tcagtttttaaatgatataatt

SEQ ID NO: 8346533 - DNA, 22 bp, Homo sapiens
tcagtttttaagagttatgcga

SEQ ID NO: 8346534 - DNA, 22 bp, Homo sapiens
tcagtttttacggtcacaggga

SEQ ID NO: 8346535 - DNA, 23 bp, Homo sapiens
tcagttttggctgttcagtgttg

SEQ ID NO: 8346536 - DNA, 23 bp, Homo sapiens
tcagttttggctgttcagtgttg

SEQ ID NO: 8346537 - DNA, 22 bp, Homo sapiens
tcagttttgtatgttgtaagtc

SEQ ID NO: 8346538 - DNA, 22 bp, Homo sapiens
tcagtttttaaatgatataatt

SEQ ID NO: 8346539 - DNA, 22 bp, Homo sapiens
tcagttttaaggtttgagaatt

SEQ ID NO: 8346540 - DNA, 19 bp, Homo sapiens
tcagttttagtcatcagtt

SEQ ID NO: 8346541 - DNA, 22 bp, Homo sapiens
tcagttttaaggtttgagaatt

SEQ ID NO: 8346542 - DNA, 22 bp, Homo sapiens
tcagtttgaatgttagcacagt

SEQ ID NO: 8346543 - DNA, 22 bp, Homo sapiens
tcagttttcatttcatgagcag

SEQ ID NO: 8346544 - DNA, 22 bp, Homo sapiens
tcagttttcaatttcatcagag

SEQ ID NO: 8346545 - DNA, 22 bp, Homo sapiens
tcagtgcttttgtcacatggtc

SEQ ID NO: 8346546 - DNA, 23 bp, Homo sapiens
tcagtgcttgggggtgacgcgcc

SEQ ID NO: 8346547 - DNA, 22 bp, Homo sapiens
tcagtgcttgcctctggaggag

SEQ ID NO: 8346548 - DNA, 22 bp, Homo sapiens
tcagtgcttgcctctggaggag

SEQ ID NO: 8346549 - DNA, 22 bp, Homo sapiens
tcagtgcttgacagctctggga

SEQ ID NO: 8346550 - DNA, 22 bp, Homo sapiens
tcagtgcttgacagctctggga

SEQ ID NO: 8346551 - DNA, 20 bp, Homo sapiens
tcagtgggaaagtgagagtg

SEQ ID NO: 8346552 - DNA, 22 bp, Homo sapiens
tcagtgggagcaggagagtgac

SEQ ID NO: 8346553 - DNA, 22 bp, Homo sapiens
tcataaaagtactcatgttcat

SEQ ID NO: 8346554 - DNA, 22 bp, Homo sapiens
tcataaagatactaagtgagtt

SEQ ID NO: 8346555 - DNA, 20 bp, Homo sapiens
tcataaagaggaaataaata

SEQ ID NO: 8346556 - DNA, 22 bp, Homo sapiens
tcatccagagcttcataagtaa

SEQ ID NO: 8346557 - DNA, 22 bp, Homo sapiens
tcatcctgtatcctcagaccat

SEQ ID NO: 8346558 - DNA, 22 bp, Homo sapiens
tcatctcagggcgacatcatgt

SEQ ID NO: 8346559 - DNA, 22 bp, Homo sapiens
tcatctctcaggataccagcag

SEQ ID NO: 8346560 - DNA, 22 bp, Homo sapiens
tcatcctgcactggctcctcct

SEQ ID NO: 8346561 - DNA, 22 bp, Homo sapiens
tcatcccagaccacttattttc

SEQ ID NO: 8346562 - DNA, 22 bp, Homo sapiens
tcatcccagaccacttattttc

SEQ ID NO: 8346563 - DNA, 22 bp, Homo sapiens
tcagggtgaaattgggtcctgg

SEQ ID NO: 8346564 - DNA, 22 bp, Homo sapiens
tcagggtgaaccaggcaggaat

SEQ ID NO: 8346565 - DNA, 22 bp, Homo sapiens
tcagggggaggagactgccagt

SEQ ID NO: 8346566 - DNA, 22 bp, Homo sapiens
tcagggggaggagactgccagt

SEQ ID NO: 8346567 - DNA, 19 bp, Homo sapiens
tcagggggctgataggagg

SEQ ID NO: 8346568 - DNA, 19 bp, Homo sapiens
tcagggggctgataggagg

SEQ ID NO: 8346569 - DNA, 22 bp, Homo sapiens
tcagggggaggagactgccagt

SEQ ID NO: 8346570 - DNA, 22 bp, Homo sapiens
tcagtgcagtgaaaggtttact

SEQ ID NO: 8346571 - DNA, 22 bp, Homo sapiens
tcagtgcatggacagatttaga

SEQ ID NO: 8346572 - DNA, 22 bp, Homo sapiens
tcagtgcattaataatatcagt

SEQ ID NO: 8346573 - DNA, 22 bp, Homo sapiens
tcaggtcctctgggtcccagcc

SEQ ID NO: 8346574 - DNA, 22 bp, Homo sapiens
tcaggggcttgaggtgcatgtc

SEQ ID NO: 8346575 - DNA, 22 bp, Homo sapiens
tcaggggctgtgcatttcccag

SEQ ID NO: 8346576 - DNA, 22 bp, Homo sapiens
tcagggcactgtcacctgatat

SEQ ID NO: 8346577 - DNA, 22 bp, Homo sapiens
tcagggcagcctaaggcacctc

SEQ ID NO: 8346578 - DNA, 22 bp, Homo sapiens
tcagggcacattctgcagtggc

SEQ ID NO: 8346579 - DNA, 22 bp, Homo sapiens
tcagggactaggtgctgcctga

SEQ ID NO: 8346580 - DNA, 22 bp, Homo sapiens
tcagggcaaaagggaaaccatt

SEQ ID NO: 8346581 - DNA, 22 bp, Homo sapiens
tcaggcctttgaacttggagtg

SEQ ID NO: 8346582 - DNA, 22 bp, Homo sapiens
tcaccgccttgcccggccgggc

SEQ ID NO: 8346583 - DNA, 22 bp, Homo sapiens
tcacctcagagattattttgaa

SEQ ID NO: 8346584 - DNA, 22 bp, Homo sapiens
tcacctcagagattattttgaa

SEQ ID NO: 8346585 - DNA, 22 bp, Homo sapiens
tcacgagaggcacagaatagag

SEQ ID NO: 8346586 - DNA, 22 bp, Homo sapiens
tcacatcttggattacaatttt

SEQ ID NO: 8346587 - DNA, 22 bp, Homo sapiens
tcacatcttattagagtatctc

SEQ ID NO: 8346588 - DNA, 20 bp, Homo sapiens
tcacatctggcagctgatga

SEQ ID NO: 8346589 - DNA, 20 bp, Homo sapiens
tcacatctggcagctgatga

SEQ ID NO: 8346590 - DNA, 20 bp, Homo sapiens
tcacatctggcagctgatga

SEQ ID NO: 8346591 - DNA, 22 bp, Homo sapiens
tcactgtagcctcaactcttgg

SEQ ID NO: 8346592 - DNA, 22 bp, Homo sapiens
tcactgtatttgctgatgcata

SEQ ID NO: 8346593 - DNA, 22 bp, Homo sapiens
tcactgggtaggacatgctgat

SEQ ID NO: 8346594 - DNA, 22 bp, Homo sapiens
tcactggggcctttggtcagga

SEQ ID NO: 8346595 - DNA, 20 bp, Homo sapiens
tcactgtaacatttgggggg

SEQ ID NO: 8346596 - DNA, 22 bp, Homo sapiens
tcactgtaaactaggtcagtcc

SEQ ID NO: 8346597 - DNA, 22 bp, Homo sapiens
tcactgtaatttgtatctgtgg

SEQ ID NO: 8346598 - DNA, 22 bp, Homo sapiens
tcactgtaaagtaatactgtca

SEQ ID NO: 8346599 - DNA, 22 bp, Homo sapiens
tcactgtatcatgttgcactta

SEQ ID NO: 8346600 - DNA, 22 bp, Homo sapiens
tcactgtagtgagcagaatata

SEQ ID NO: 8346601 - DNA, 22 bp, Homo sapiens
tcactgtagtgagcagaatata

SEQ ID NO: 8346602 - DNA, 22 bp, Homo sapiens
tcactgtagcctcaacctttca

SEQ ID NO: 8346603 - DNA, 22 bp, Homo sapiens
tcactgtaccttccatttcatt

SEQ ID NO: 8346604 - DNA, 22 bp, Homo sapiens
tcactgtaccttccatttcatt

SEQ ID NO: 8346605 - DNA, 22 bp, Homo sapiens
tcactaatagggggagcatagg

SEQ ID NO: 8346606 - DNA, 22 bp, Homo sapiens
tcactaatgagctaaggaaaag

SEQ ID NO: 8346607 - DNA, 22 bp, Homo sapiens
tcactaatgattttgaaagaag

SEQ ID NO: 8346608 - DNA, 22 bp, Homo sapiens
tcacgttttactgagtgagata

SEQ ID NO: 8346609 - DNA, 22 bp, Homo sapiens
tcactggaaatgcacagctgta

SEQ ID NO: 8346610 - DNA, 22 bp, Homo sapiens
tcactggattaagcattgacat

SEQ ID NO: 8346611 - DNA, 22 bp, Homo sapiens
tcactgggccctgaggtgggac

SEQ ID NO: 8346612 - DNA, 17 bp, Homo sapiens
tcactgggcctgctccc

SEQ ID NO: 8346613 - DNA, 22 bp, Homo sapiens
tcactggggccatgtgagggac

SEQ ID NO: 8346614 - DNA, 22 bp, Homo sapiens
tcagaggcctgaaagaatttgg

SEQ ID NO: 8346615 - DNA, 20 bp, Homo sapiens
tcagaggctgccagctgggg

SEQ ID NO: 8346616 - DNA, 22 bp, Homo sapiens
tcagaggctacagtctgggagt

SEQ ID NO: 8346617 - DNA, 19 bp, Homo sapiens
tcagaggatttggctatga

SEQ ID NO: 8346618 - DNA, 22 bp, Homo sapiens
tcagaggagaccaaggggaata

SEQ ID NO: 8346619 - DNA, 22 bp, Homo sapiens
tcagaggagaagttgggaaaat

SEQ ID NO: 8346620 - DNA, 22 bp, Homo sapiens
tcagaggacaagctccctggtg

SEQ ID NO: 8346621 - DNA, 22 bp, Homo sapiens
tcagaggaagccttggtgggag

SEQ ID NO: 8346622 - DNA, 22 bp, Homo sapiens
tcagagagcctcaggcactgcc

SEQ ID NO: 8346623 - DNA, 22 bp, Homo sapiens
tcagagacagttctggggcagg

SEQ ID NO: 8346624 - DNA, 20 bp, Homo sapiens
tcagagaagggactgagatt

SEQ ID NO: 8346625 - DNA, 22 bp, Homo sapiens
tcaattcaattgcatttctgtg

SEQ ID NO: 8346626 - DNA, 23 bp, Homo sapiens
tcaattatcaatggaaagaagtt

SEQ ID NO: 8346627 - DNA, 22 bp, Homo sapiens
tcaattacagcaatgactgtac

SEQ ID NO: 8346628 - DNA, 22 bp, Homo sapiens
tcaattacagcacagtactcca

SEQ ID NO: 8346629 - DNA, 22 bp, Homo sapiens
tcaatgctgccaaatcttctag

SEQ ID NO: 8346630 - DNA, 20 bp, Homo sapiens
tcaatgtaatcatatcatca

SEQ ID NO: 8346631 - DNA, 22 bp, Homo sapiens
tcacacacatttgctgtctgat

SEQ ID NO: 8346632 - DNA, 22 bp, Homo sapiens
tcacacagcttggagttatggt

SEQ ID NO: 8346633 - DNA, 22 bp, Homo sapiens
tcacacagctgacagagccttt

SEQ ID NO: 8346634 - DNA, 22 bp, Homo sapiens
tcaaaaatggtctttgagctgc

SEQ ID NO: 8346635 - DNA, 22 bp, Homo sapiens
tcaaaaatggtctttgagctgc

SEQ ID NO: 8346636 - DNA, 22 bp, Homo sapiens
tcaaactgaactaagatccaac

SEQ ID NO: 8346637 - DNA, 22 bp, Homo sapiens
tcaatgatgctgaaggtagcgt

SEQ ID NO: 8346638 - DNA, 22 bp, Homo sapiens
tcaatgatagtacaatcagcct

SEQ ID NO: 8346639 - DNA, 22 bp, Homo sapiens
tcaatgatagacaagatctaag

SEQ ID NO: 8346640 - DNA, 22 bp, Homo sapiens
tcaatgatagacaagatctaag

SEQ ID NO: 8346641 - DNA, 22 bp, Homo sapiens
tcaatgatatcagcaggatgtg

SEQ ID NO: 8346642 - DNA, 22 bp, Homo sapiens
tcaatgattagagtttagtgtg

SEQ ID NO: 8346643 - DNA, 22 bp, Homo sapiens
tcacacagggttctggtctcat

SEQ ID NO: 8346644 - DNA, 22 bp, Homo sapiens
tcacacatactcatgtgtgagt

SEQ ID NO: 8346645 - DNA, 22 bp, Homo sapiens
tcacagacccttgctgagctct

SEQ ID NO: 8346646 - DNA, 22 bp, Homo sapiens
tcacagagagaatattgtgttt

SEQ ID NO: 8346647 - DNA, 22 bp, Homo sapiens
tcacagacagaagggatgggat

SEQ ID NO: 8346648 - DNA, 22 bp, Homo sapiens
tcacatcaacattatagcatga

SEQ ID NO: 8346649 - DNA, 22 bp, Homo sapiens
tcacatatttaagaaagttaaa

SEQ ID NO: 8346650 - DNA, 22 bp, Homo sapiens
tcacatcacatgagtgcaagga

SEQ ID NO: 8346651 - DNA, 22 bp, Homo sapiens
tcacatctgaaaaaatattgag

SEQ ID NO: 8346652 - DNA, 22 bp, Homo sapiens
tcacatctgattagtgactgat

SEQ ID NO: 8346653 - DNA, 20 bp, Homo sapiens
tcacatcctctcccaacatg

SEQ ID NO: 8346654 - DNA, 20 bp, Homo sapiens
tcacatcctctcccaacatg

SEQ ID NO: 8346655 - DNA, 22 bp, Homo sapiens
tcacatcatggagaattatggg

SEQ ID NO: 8346656 - DNA, 22 bp, Homo sapiens
tccctgggcacaatctgctggc

SEQ ID NO: 8346657 - DNA, 22 bp, Homo sapiens
tccctgggcaagtttactcttc

SEQ ID NO: 8346658 - DNA, 22 bp, Homo sapiens
tccctgggcatcacgttgcttc

SEQ ID NO: 8346659 - DNA, 22 bp, Homo sapiens
tccctgggccacagctgtgagc

SEQ ID NO: 8346660 - DNA, 23 bp, Homo sapiens
tccctgggcccgtgccagcggtg

SEQ ID NO: 8346661 - DNA, 22 bp, Homo sapiens
tccctgccctcagtgcacccgg

SEQ ID NO: 8346662 - DNA, 22 bp, Homo sapiens
tccctgccagtcctggtctgaa

SEQ ID NO: 8346663 - DNA, 22 bp, Homo sapiens
tccctgccaatgattggagcaa

SEQ ID NO: 8346664 - DNA, 22 bp, Homo sapiens
tccctgccaatgattggagcaa

SEQ ID NO: 8346665 - DNA, 22 bp, Homo sapiens
tccctgccagtcctggtctgaa

SEQ ID NO: 8346666 - DNA, 23 bp, Homo sapiens
tccctgagatgctgctctgtccc

SEQ ID NO: 8346667 - DNA, 21 bp, Homo sapiens
tccctgagcccaaggggctcc

SEQ ID NO: 8346668 - DNA, 22 bp, Homo sapiens
tccctgagggcagctcaagtcc

SEQ ID NO: 8346669 - DNA, 22 bp, Homo sapiens
tccctgagggcagctcaagtcc

SEQ ID NO: 8346670 - DNA, 23 bp, Homo sapiens
tccctgagctggagagactgcac

SEQ ID NO: 8346671 - DNA, 22 bp, Homo sapiens
tccctgggcttctccagacttg

SEQ ID NO: 8346672 - DNA, 22 bp, Homo sapiens
tccctggggaagggcaagcaag

SEQ ID NO: 8346673 - DNA, 22 bp, Homo sapiens
tccctggggatgttggcctgcc

SEQ ID NO: 8346674 - DNA, 22 bp, Homo sapiens
tccctgggcctatcttagctcc

SEQ ID NO: 8346675 - DNA, 22 bp, Homo sapiens
tccctgggcctcctgctatgca

SEQ ID NO: 8346676 - DNA, 22 bp, Homo sapiens
tccctgggcggacattctccca

SEQ ID NO: 8346677 - DNA, 22 bp, Homo sapiens
tccctggggcagtggctcggag

SEQ ID NO: 8346678 - DNA, 22 bp, Homo sapiens
tcccttcacagatgcgatgttt

SEQ ID NO: 8346679 - DNA, 22 bp, Homo sapiens
tcccttcatcagtgagcaagcc

SEQ ID NO: 8346680 - DNA, 19 bp, Homo sapiens
tcccttcctgtcgggctcc

SEQ ID NO: 8346681 - DNA, 22 bp, Homo sapiens
tccggggcttccccgcagtgcc

SEQ ID NO: 8346682 - DNA, 22 bp, Homo sapiens
tccctttcacttaactagccca

SEQ ID NO: 8346683 - DNA, 22 bp, Homo sapiens
tccgagggctggacgcaggggc

SEQ ID NO: 8346684 - DNA, 21 bp, Homo sapiens
tccgggaggtggaggctgcag

SEQ ID NO: 8346685 - DNA, 22 bp, Homo sapiens
tccgcgtgggaggggccggtgt

SEQ ID NO: 8346686 - DNA, 22 bp, Homo sapiens
tccgctggagagggggctgcca

SEQ ID NO: 8346687 - DNA, 22 bp, Homo sapiens
tccgctggcctgtgtcccaggc

SEQ ID NO: 8346688 - DNA, 22 bp, Homo sapiens
tccggcggccggcctgagcccg

SEQ ID NO: 8346689 - DNA, 22 bp, Homo sapiens
tcctccagctactaggcaaata

SEQ ID NO: 8346690 - DNA, 22 bp, Homo sapiens
tcctccagccctctaggaaaat

SEQ ID NO: 8346691 - DNA, 22 bp, Homo sapiens
tcctccagcaggactgaggccc

SEQ ID NO: 8346692 - DNA, 22 bp, Homo sapiens
tcctccagaccacttctgtgcg

SEQ ID NO: 8346693 - DNA, 23 bp, Homo sapiens
tcctccagaggccctccttggcc

SEQ ID NO: 8346694 - DNA, 22 bp, Homo sapiens
tcctccagctgtatcctgcctg

SEQ ID NO: 8346695 - DNA, 22 bp, Homo sapiens
tcctccaggataaaatgtgttg

SEQ ID NO: 8346696 - DNA, 22 bp, Homo sapiens
tcctccaggcacctcactggct

SEQ ID NO: 8346697 - DNA, 22 bp, Homo sapiens
tcctcatgccgggtctcacgct

SEQ ID NO: 8346698 - DNA, 22 bp, Homo sapiens
tcctcattcttggtgcatcaaa

SEQ ID NO: 8346699 - DNA, 22 bp, Homo sapiens
tcctccagaaactgaggcagaa

SEQ ID NO: 8346700 - DNA, 20 bp, Homo sapiens
tcctccagaagggcagggtg

SEQ ID NO: 8346701 - DNA, 22 bp, Homo sapiens
tcctccactttgtctagcaaca

SEQ ID NO: 8346702 - DNA, 22 bp, Homo sapiens
tcctccacgtgagggcatacag

SEQ ID NO: 8346703 - DNA, 22 bp, Homo sapiens
tcctccacgatggcacacctgg

SEQ ID NO: 8346704 - DNA, 23 bp, Homo sapiens
tcctcctgacacagcctgagtga

SEQ ID NO: 8346705 - DNA, 22 bp, Homo sapiens
tcctcctctatcagacagtgcc

SEQ ID NO: 8346706 - DNA, 22 bp, Homo sapiens
tcctcctcctcacagtcacctg

SEQ ID NO: 8346707 - DNA, 21 bp, Homo sapiens
tcctcctccactaggctagcc

SEQ ID NO: 8346708 - DNA, 21 bp, Homo sapiens
tcctcctggccaggcggcccc

SEQ ID NO: 8346709 - DNA, 22 bp, Homo sapiens
tcctccagtggtactggccaat

SEQ ID NO: 8346710 - DNA, 22 bp, Homo sapiens
tcctccagtggtactggccaat

SEQ ID NO: 8346711 - DNA, 22 bp, Homo sapiens
tcctccagtggcccagtccttc

SEQ ID NO: 8346712 - DNA, 22 bp, Homo sapiens
tcctccaggtctagggtggctt

SEQ ID NO: 8346713 - DNA, 22 bp, Homo sapiens
tcctccagtcttggtgaggttg

SEQ ID NO: 8346714 - DNA, 22 bp, Homo sapiens
tcctccagtgtctggggccttg

SEQ ID NO: 8346715 - DNA, 22 bp, Homo sapiens
tcctccagttccttggtttcag

SEQ ID NO: 8346716 - DNA, 22 bp, Homo sapiens
tcctcccctgcccatgaggagg

SEQ ID NO: 8346717 - DNA, 22 bp, Homo sapiens
tcctcccctgcccatgaggagg

SEQ ID NO: 8346718 - DNA, 22 bp, Homo sapiens
tcctccctgtaccattcctctg

SEQ ID NO: 8346719 - DNA, 22 bp, Homo sapiens
tcctccctaactcatgatgagt

SEQ ID NO: 8346720 - DNA, 20 bp, Homo sapiens
tccaggagaactgggagccg

SEQ ID NO: 8346721 - DNA, 22 bp, Homo sapiens
tccaggagaaggccatccagcg

SEQ ID NO: 8346722 - DNA, 22 bp, Homo sapiens
tccaggagctcatccacgtcaa

SEQ ID NO: 8346723 - DNA, 22 bp, Homo sapiens
tccaggactagcatttctgata

SEQ ID NO: 8346724 - DNA, 22 bp, Homo sapiens
tccagccttctcaaggctggct

SEQ ID NO: 8346725 - DNA, 22 bp, Homo sapiens
tccagccttccttttcactctc

SEQ ID NO: 8346726 - DNA, 22 bp, Homo sapiens
tccagcctgaactttgtccaga

SEQ ID NO: 8346727 - DNA, 23 bp, Homo sapiens
tccagcctcttgctctcacatgc

SEQ ID NO: 8346728 - DNA, 21 bp, Homo sapiens
tccagcctttccctcacttcc

SEQ ID NO: 8346729 - DNA, 22 bp, Homo sapiens
tccagccctgcttcctgcctca

SEQ ID NO: 8346730 - DNA, 22 bp, Homo sapiens
tccagccactcagcagggattg

SEQ ID NO: 8346731 - DNA, 22 bp, Homo sapiens
tccagcccatccctagcctggg

SEQ ID NO: 8346732 - DNA, 22 bp, Homo sapiens
tccagaaaattttacagtgcct

SEQ ID NO: 8346733 - DNA, 22 bp, Homo sapiens
tccacgctgtgtgaccttgggc

SEQ ID NO: 8346734 - DNA, 22 bp, Homo sapiens
tccacctccatgctgggcagag

SEQ ID NO: 8346735 - DNA, 22 bp, Homo sapiens
tccacccagcacactgtggtag

SEQ ID NO: 8346736 - DNA, 22 bp, Homo sapiens
tccacccagtgtttctacaggt

SEQ ID NO: 8346737 - DNA, 22 bp, Homo sapiens
tccaccatgtaacaagctctgt

SEQ ID NO: 8346738 - DNA, 22 bp, Homo sapiens
tccacagggatgcctgcggctt

SEQ ID NO: 8346739 - DNA, 22 bp, Homo sapiens
tccacagcattattagaaggat

SEQ ID NO: 8346740 - DNA, 22 bp, Homo sapiens
tcattaataagtctaactctcc

SEQ ID NO: 8346741 - DNA, 22 bp, Homo sapiens
tcattaagattcctatggcatt

SEQ ID NO: 8346742 - DNA, 22 bp, Homo sapiens
tcattaagaaatgaggagtccc

SEQ ID NO: 8346743 - DNA, 22 bp, Homo sapiens
tcattaagattacgtgccagaa

SEQ ID NO: 8346744 - DNA, 22 bp, Homo sapiens
tcattaagtaaggcaggtggtt

SEQ ID NO: 8346745 - DNA, 22 bp, Homo sapiens
tccacacacatttctatgtgca

SEQ ID NO: 8346746 - DNA, 17 bp, Homo sapiens
tcccaggaacagggaat

SEQ ID NO: 8346747 - DNA, 22 bp, Homo sapiens
tcccagcctttcttttctgctg

SEQ ID NO: 8346748 - DNA, 22 bp, Homo sapiens
tcccagcaggagtccagttccc

SEQ ID NO: 8346749 - DNA, 22 bp, Homo sapiens
tcccagcagatgagctgaccta

SEQ ID NO: 8346750 - DNA, 22 bp, Homo sapiens
tcccagaatcctcactctatca

SEQ ID NO: 8346751 - DNA, 22 bp, Homo sapiens
tcccagaagtgaaatttctaga

SEQ ID NO: 8346752 - DNA, 22 bp, Homo sapiens
tcccagaaccttttagcttcac

SEQ ID NO: 8346753 - DNA, 22 bp, Homo sapiens
tcccactgagcccctgctggtg

SEQ ID NO: 8346754 - DNA, 22 bp, Homo sapiens
tcccacagtggtacagccctga

SEQ ID NO: 8346755 - DNA, 22 bp, Homo sapiens
tcccactgctttgctctgctca

SEQ ID NO: 8346756 - DNA, 22 bp, Homo sapiens
tcccactgctttgctctgctca

SEQ ID NO: 8346757 - DNA, 21 bp, Homo sapiens
tcccactgccacagcttcagg

SEQ ID NO: 8346758 - DNA, 22 bp, Homo sapiens
tcccactggacgtctgtgctgg

SEQ ID NO: 8346759 - DNA, 22 bp, Homo sapiens
tcccactggacgtctgtgctgg

SEQ ID NO: 8346760 - DNA, 21 bp, Homo sapiens
tcccactggcccagggctcca

SEQ ID NO: 8346761 - DNA, 20 bp, Homo sapiens
tcccactgggcctcagtttc

SEQ ID NO: 8346762 - DNA, 22 bp, Homo sapiens
tcccactgtctgtcttgctgca

SEQ ID NO: 8346763 - DNA, 22 bp, Homo sapiens
tcccactgtctgtcttgctgca

SEQ ID NO: 8346764 - DNA, 22 bp, Homo sapiens
tcccactgtcttctcgtgctcg

SEQ ID NO: 8346765 - DNA, 22 bp, Homo sapiens
tcccactgtcttctcgtgctcg

SEQ ID NO: 8346766 - DNA, 22 bp, Homo sapiens
tcccactgtgaatccaaggcct

SEQ ID NO: 8346767 - DNA, 22 bp, Homo sapiens
tcccactgtgcctgttgtaatc

SEQ ID NO: 8346768 - DNA, 22 bp, Homo sapiens
tcccactgtgcctgttgtaatc

SEQ ID NO: 8346769 - DNA, 22 bp, Homo sapiens
tcccagaaacgcatatgttcat

SEQ ID NO: 8346770 - DNA, 22 bp, Homo sapiens
tccagtcctatctgcccttgga

SEQ ID NO: 8346771 - DNA, 22 bp, Homo sapiens
tccagtctaatgagtcagagtg

SEQ ID NO: 8346772 - DNA, 22 bp, Homo sapiens
tccagtgctggaccagagcacc

SEQ ID NO: 8346773 - DNA, 22 bp, Homo sapiens
tccagtggcaccttggccctca

SEQ ID NO: 8346774 - DNA, 22 bp, Homo sapiens
tccagggcaccagcgtccccct

SEQ ID NO: 8346775 - DNA, 22 bp, Homo sapiens
tccagtcatctcccttcacatt

SEQ ID NO: 8346776 - DNA, 22 bp, Homo sapiens
tccagtcaggctgaattcaagg

SEQ ID NO: 8346777 - DNA, 22 bp, Homo sapiens
tccagtcatttccattgttccc

SEQ ID NO: 8346778 - DNA, 22 bp, Homo sapiens
tccagtccagggaatggctgat

SEQ ID NO: 8346779 - DNA, 22 bp, Homo sapiens
tccagggagcaagtcaggccgg

SEQ ID NO: 8346780 - DNA, 22 bp, Homo sapiens
tccaggcctaggccaagtgatt

SEQ ID NO: 8346781 - DNA, 22 bp, Homo sapiens
tccaggccgcatagttactctg

SEQ ID NO: 8346782 - DNA, 21 bp, Homo sapiens
tccaggcctcaggaagggatg

SEQ ID NO: 8346783 - DNA, 22 bp, Homo sapiens
tccaggccgcaggggcagcccc

SEQ ID NO: 8346784 - DNA, 22 bp, Homo sapiens
tccaggccctgggatgggagca

SEQ ID NO: 8346785 - DNA, 22 bp, Homo sapiens
tccaggcccatagacacttctc

SEQ ID NO: 8346786 - DNA, 22 bp, Homo sapiens
tccaggcccactcagctgaaat

SEQ ID NO: 8346787 - DNA, 20 bp, Homo sapiens
tccaggcccactcagctgaa

SEQ ID NO: 8346788 - DNA, 22 bp, Homo sapiens
tccaggcccagacggggtgagg

SEQ ID NO: 8346789 - DNA, 22 bp, Homo sapiens
tccaggcccactcggtggggct

SEQ ID NO: 8346790 - DNA, 19 bp, Homo sapiens
tccaggccattcccagagc

SEQ ID NO: 8346791 - DNA, 22 bp, Homo sapiens
tccaggccattgactgcatcct

SEQ ID NO: 8346792 - DNA, 21 bp, Homo sapiens
tccaggccatggtggggaggc

SEQ ID NO: 8346793 - DNA, 22 bp, Homo sapiens
tccaggccagggtaagaggaga

SEQ ID NO: 8346794 - DNA, 22 bp, Homo sapiens
ttctccgctaagttctctgcag

SEQ ID NO: 8346795 - DNA, 22 bp, Homo sapiens
ttctcttcatctcagtaaatgt

SEQ ID NO: 8346796 - DNA, 22 bp, Homo sapiens
ttctcttagctgtaaagtcaat

SEQ ID NO: 8346797 - DNA, 22 bp, Homo sapiens
ttctcttctgttcagtgcccaa

SEQ ID NO: 8346798 - DNA, 22 bp, Homo sapiens
ttctcttgagctggtcatgttt

SEQ ID NO: 8346799 - DNA, 23 bp, Homo sapiens
ttctctttagatttacattactc

SEQ ID NO: 8346800 - DNA, 23 bp, Homo sapiens
ttctctttagatttacattactc

SEQ ID NO: 8346801 - DNA, 22 bp, Homo sapiens
ttctgataacaaacaccaattt

SEQ ID NO: 8346802 - DNA, 22 bp, Homo sapiens
ttctgccctttggtaggtaaag

SEQ ID NO: 8346803 - DNA, 22 bp, Homo sapiens
ttctgcccaccacactttatct

SEQ ID NO: 8346804 - DNA, 19 bp, Homo sapiens
ttctgccctctcttctagc

SEQ ID NO: 8346805 - DNA, 20 bp, Homo sapiens
ttctggaggctacaagtctg

SEQ ID NO: 8346806 - DNA, 22 bp, Homo sapiens
ttctgcacccatagctgatgat

SEQ ID NO: 8346807 - DNA, 22 bp, Homo sapiens
ttctgcattgacttttatttcc

SEQ ID NO: 8346808 - DNA, 22 bp, Homo sapiens
ttctgcattcaaattatgtgag

SEQ ID NO: 8346809 - DNA, 22 bp, Homo sapiens
ttctgcattggagtctattctt

SEQ ID NO: 8346810 - DNA, 22 bp, Homo sapiens
ttctgcatttctaataagttcc

SEQ ID NO: 8346811 - DNA, 22 bp, Homo sapiens
ttctgcatttaaaatattacta

SEQ ID NO: 8346812 - DNA, 22 bp, Homo sapiens
ttctcagagtgaccaagtcttt

SEQ ID NO: 8346813 - DNA, 22 bp, Homo sapiens
ttctatctcatatgtgttctag

SEQ ID NO: 8346814 - DNA, 19 bp, Homo sapiens
ttctatgattaacatgaga

SEQ ID NO: 8346815 - DNA, 22 bp, Homo sapiens
ttctatatttatgggcatcacc

SEQ ID NO: 8346816 - DNA, 22 bp, Homo sapiens
ttctcactatgtatgtagattg

SEQ ID NO: 8346817 - DNA, 23 bp, Homo sapiens
ttctaaccttaaagccctttgga

SEQ ID NO: 8346818 - DNA, 20 bp, Homo sapiens
ttctaactactctccctttg

SEQ ID NO: 8346819 - DNA, 22 bp, Homo sapiens
ttctaactccacttcccactcc

SEQ ID NO: 8346820 - DNA, 22 bp, Homo sapiens
ttctaaatgtaaatagtatgat

SEQ ID NO: 8346821 - DNA, 22 bp, Homo sapiens
ttctaaatgtaaatagtatgat

SEQ ID NO: 8346822 - DNA, 22 bp, Homo sapiens
ttctaaaataagtttatctggt

SEQ ID NO: 8346823 - DNA, 22 bp, Homo sapiens
ttctaaaataagtttatctggt

SEQ ID NO: 8346824 - DNA, 22 bp, Homo sapiens
ttctaaactgaagtattttaaa

SEQ ID NO: 8346825 - DNA, 22 bp, Homo sapiens
ttctaaaaccaattctgcttct

SEQ ID NO: 8346826 - DNA, 22 bp, Homo sapiens
ttccttgtttgtagctctggga

SEQ ID NO: 8346827 - DNA, 22 bp, Homo sapiens
ttcccctttttgtgtgcagctg

SEQ ID NO: 8346828 - DNA, 22 bp, Homo sapiens
ttccctcctatgcccactgaaa

SEQ ID NO: 8346829 - DNA, 22 bp, Homo sapiens
ttgacataagacttagagtatt

SEQ ID NO: 8346830 - DNA, 22 bp, Homo sapiens
ttgacataggatgtatcagtca

SEQ ID NO: 8346831 - DNA, 22 bp, Homo sapiens
ttgagaaactaacggcttgagc

SEQ ID NO: 8346832 - DNA, 22 bp, Homo sapiens
ttgagaaacctggcagtagaga

SEQ ID NO: 8346833 - DNA, 22 bp, Homo sapiens
ttgaaagatatgttaatctttc

SEQ ID NO: 8346834 - DNA, 22 bp, Homo sapiens
ttgaaagatatgttaatctttc

SEQ ID NO: 8346835 - DNA, 22 bp, Homo sapiens
ttgaaagacattatttatatat

SEQ ID NO: 8346836 - DNA, 22 bp, Homo sapiens
ttgaaagaggcaaagtttgatc

SEQ ID NO: 8346837 - DNA, 22 bp, Homo sapiens
ttgaaagaacaattctgtgatg

SEQ ID NO: 8346838 - DNA, 22 bp, Homo sapiens
ttgaaactgcttattgaatttg

SEQ ID NO: 8346839 - DNA, 22 bp, Homo sapiens
ttgaaactttagtaaactaagg

SEQ ID NO: 8346840 - DNA, 22 bp, Homo sapiens
ttgaaaatggtaagcatgatat

SEQ ID NO: 8346841 - DNA, 22 bp, Homo sapiens
ttgaaaatggtaagcatgatat

SEQ ID NO: 8346842 - DNA, 19 bp, Homo sapiens
ttgaaaatatggatctgag

SEQ ID NO: 8346843 - DNA, 19 bp, Homo sapiens
ttgaaaatatggatctgag

SEQ ID NO: 8346844 - DNA, 20 bp, Homo sapiens
ttgaaaatgcattgtgcagt

SEQ ID NO: 8346845 - DNA, 20 bp, Homo sapiens
ttgaaaatgcattgtgcagt

SEQ ID NO: 8346846 - DNA, 20 bp, Homo sapiens
ttgaaaatgcattgtgcagt

SEQ ID NO: 8346847 - DNA, 22 bp, Homo sapiens
ttgaaaatatcacaggagcagc

SEQ ID NO: 8346848 - DNA, 22 bp, Homo sapiens
ttgaaaatatcacaggagcagc

SEQ ID NO: 8346849 - DNA, 22 bp, Homo sapiens
ttgagaatgtgttttgctaagt

SEQ ID NO: 8346850 - DNA, 22 bp, Homo sapiens
ttgagactcctggtgtagaata

SEQ ID NO: 8346851 - DNA, 22 bp, Homo sapiens
ttgagaaggtggtcatttgcaa

SEQ ID NO: 8346852 - DNA, 19 bp, Homo sapiens
ttgagaaagttgatttggg

SEQ ID NO: 8346853 - DNA, 22 bp, Homo sapiens
ttgagaaaggggtcaatatctc

SEQ ID NO: 8346854 - DNA, 22 bp, Homo sapiens
ttgaggcccggcaggccgagcg

SEQ ID NO: 8346855 - DNA, 22 bp, Homo sapiens
ttgaggctgcacagtacaggct

SEQ ID NO: 8346856 - DNA, 22 bp, Homo sapiens
ttgagatacattgggaaatgcc

SEQ ID NO: 8346857 - DNA, 22 bp, Homo sapiens
ttgagggtctggatctgctgct

SEQ ID NO: 8346858 - DNA, 22 bp, Homo sapiens
ttctggatatgggagagggagc

SEQ ID NO: 8346859 - DNA, 22 bp, Homo sapiens
ttctttctttgtagtcctgaac

SEQ ID NO: 8346860 - DNA, 22 bp, Homo sapiens
ttctttcttggggaacacactc

SEQ ID NO: 8346861 - DNA, 22 bp, Homo sapiens
ttctttgagttagtacagtcca

SEQ ID NO: 8346862 - DNA, 22 bp, Homo sapiens
ttctttggggaatattctggtt

SEQ ID NO: 8346863 - DNA, 22 bp, Homo sapiens
ttcttcttcatttctgacgatg

SEQ ID NO: 8346864 - DNA, 22 bp, Homo sapiens
ttcttcttcatttctgacgatg

SEQ ID NO: 8346865 - DNA, 20 bp, Homo sapiens
ttcttctctagttatcttca

SEQ ID NO: 8346866 - DNA, 22 bp, Homo sapiens
ttccataatcaccttattcttt

SEQ ID NO: 8346867 - DNA, 22 bp, Homo sapiens
ttccataataacctgagagaaa

SEQ ID NO: 8346868 - DNA, 22 bp, Homo sapiens
ttccataataggcttaagtgaa

SEQ ID NO: 8346869 - DNA, 22 bp, Homo sapiens
ttccataactgaccgaatgcat

SEQ ID NO: 8346870 - DNA, 22 bp, Homo sapiens
ttccataatgagattcccagcc

SEQ ID NO: 8346871 - DNA, 18 bp, Homo sapiens
ttccataatgtatgtaac

SEQ ID NO: 8346872 - DNA, 22 bp, Homo sapiens
ttccatatgtatatagctgtta

SEQ ID NO: 8346873 - DNA, 22 bp, Homo sapiens
ttccataattaagtggagagaa

SEQ ID NO: 8346874 - DNA, 18 bp, Homo sapiens
ttccataatgtatgtaac

SEQ ID NO: 8346875 - DNA, 22 bp, Homo sapiens
ttccataaaggtgatagtatac

SEQ ID NO: 8346876 - DNA, 22 bp, Homo sapiens
ttccataaaggtgatagtatac

SEQ ID NO: 8346877 - DNA, 22 bp, Homo sapiens
ttccaacttcccatccctgctg

SEQ ID NO: 8346878 - DNA, 22 bp, Homo sapiens
ttccccttatcaccagcctgtc

SEQ ID NO: 8346879 - DNA, 22 bp, Homo sapiens
ttccccttataagtctggcttc

SEQ ID NO: 8346880 - DNA, 22 bp, Homo sapiens
ttccccttataagtctggcttc

SEQ ID NO: 8346881 - DNA, 22 bp, Homo sapiens
ttccccttgataatgcagtaag

SEQ ID NO: 8346882 - DNA, 22 bp, Homo sapiens
ttccccttgataatgcagtaag

SEQ ID NO: 8346883 - DNA, 22 bp, Homo sapiens
ttccccttgcactatcaccctg

SEQ ID NO: 8346884 - DNA, 22 bp, Homo sapiens
ttccccttgataagcagggttg

SEQ ID NO: 8346885 - DNA, 22 bp, Homo sapiens
ttcccctttttgtgtgcagctg

SEQ ID NO: 8346886 - DNA, 22 bp, Homo sapiens
ttcccccacctggggtacagga

SEQ ID NO: 8346887 - DNA, 22 bp, Homo sapiens
ttcccatttgtggtagtgaatt

SEQ ID NO: 8346888 - DNA, 22 bp, Homo sapiens
ttcccagtattaccttcaggaa

SEQ ID NO: 8346889 - DNA, 22 bp, Homo sapiens
ttcccagtcccaagaaaagcca

SEQ ID NO: 8346890 - DNA, 22 bp, Homo sapiens
ttccatatttgtgtggcaaaag

SEQ ID NO: 8346891 - DNA, 22 bp, Homo sapiens
ttccatattagactatgtgggg

SEQ ID NO: 8346892 - DNA, 22 bp, Homo sapiens
ttccatattcccaattttgcca

SEQ ID NO: 8346893 - DNA, 22 bp, Homo sapiens
ttccatattgtactctttggag

SEQ ID NO: 8346894 - DNA, 22 bp, Homo sapiens
ttccatgagctctgagttcaca

SEQ ID NO: 8346895 - DNA, 22 bp, Homo sapiens
ttccatttattcttgtccagat

SEQ ID NO: 8346896 - DNA, 22 bp, Homo sapiens
ttccattgtttctgtcttcact

SEQ ID NO: 8346897 - DNA, 22 bp, Homo sapiens
ttccatgtgagtacactgtgat

SEQ ID NO: 8346898 - DNA, 22 bp, Homo sapiens
ttcatataaatggaatcagaat

SEQ ID NO: 8346899 - DNA, 22 bp, Homo sapiens
ttcatataaatggaatcagaat

SEQ ID NO: 8346900 - DNA, 22 bp, Homo sapiens
ttcatagtgacatgcattctgg

SEQ ID NO: 8346901 - DNA, 22 bp, Homo sapiens
ttcatagtgattgttcagatag

SEQ ID NO: 8346902 - DNA, 22 bp, Homo sapiens
ttcagaccaagctggtggcatg

SEQ ID NO: 8346903 - DNA, 22 bp, Homo sapiens
ttcagaatgtactgatagaaca

SEQ ID NO: 8346904 - DNA, 22 bp, Homo sapiens
ttcagaatgctatttctgaaat

SEQ ID NO: 8346905 - DNA, 22 bp, Homo sapiens
ttcagaatgatttcagcgagca

SEQ ID NO: 8346906 - DNA, 22 bp, Homo sapiens
ttcagaatgacttatgtaaggc

SEQ ID NO: 8346907 - DNA, 22 bp, Homo sapiens
ttcagaataactttttattgaa

SEQ ID NO: 8346908 - DNA, 22 bp, Homo sapiens
ttcagaagtgctttcacactct

SEQ ID NO: 8346909 - DNA, 22 bp, Homo sapiens
ttcagaataatgtgttagagaa

SEQ ID NO: 8346910 - DNA, 22 bp, Homo sapiens
ttcagaatattattttaaaggc

SEQ ID NO: 8346911 - DNA, 22 bp, Homo sapiens
ttcagaatatccgtttaagttt

SEQ ID NO: 8346912 - DNA, 22 bp, Homo sapiens
ttcagaaggatgacaccagttg

SEQ ID NO: 8346913 - DNA, 22 bp, Homo sapiens
ttcagaaggatgacaccagttg

SEQ ID NO: 8346914 - DNA, 17 bp, Homo sapiens
ttcagaagcattttggc

SEQ ID NO: 8346915 - DNA, 22 bp, Homo sapiens
ttcagaagtagctaagcagtca

SEQ ID NO: 8346916 - DNA, 22 bp, Homo sapiens
ttcagaagtagctaagcagtca

SEQ ID NO: 8346917 - DNA, 22 bp, Homo sapiens
ttcaagtcagagcaagccaagt

SEQ ID NO: 8346918 - DNA, 22 bp, Homo sapiens
ttcaagtatgagaaaggggact

SEQ ID NO: 8346919 - DNA, 22 bp, Homo sapiens
ttcaatcattagaatctcaggc

SEQ ID NO: 8346920 - DNA, 22 bp, Homo sapiens
ttcaatgagcccggggccatag

SEQ ID NO: 8346921 - DNA, 22 bp, Homo sapiens
ttcaatgaggatagaactggat

SEQ ID NO: 8346922 - DNA, 22 bp, Homo sapiens
ttcaatgatttttagggatcat

SEQ ID NO: 8346923 - DNA, 17 bp, Homo sapiens
ttcaatgattaatgcat

SEQ ID NO: 8346924 - DNA, 22 bp, Homo sapiens
ttcaatgagcccaagaacgtga

SEQ ID NO: 8346925 - DNA, 21 bp, Homo sapiens
ttcaatgaaaacaaagtgagg

SEQ ID NO: 8346926 - DNA, 22 bp, Homo sapiens
ttataactttggatatgacaag

SEQ ID NO: 8346927 - DNA, 22 bp, Homo sapiens
ttataagagtatatagtgtact

SEQ ID NO: 8346928 - DNA, 22 bp, Homo sapiens
ttatgcaacaggtgagcagaca

SEQ ID NO: 8346929 - DNA, 22 bp, Homo sapiens
ttatgcagagttgagaggaatg

SEQ ID NO: 8346930 - DNA, 22 bp, Homo sapiens
ttatgctgttaggaaaatcaaa

SEQ ID NO: 8346931 - DNA, 22 bp, Homo sapiens
ttatgcagtcgacatctgatca

SEQ ID NO: 8346932 - DNA, 22 bp, Homo sapiens
ttatgcagcaaagtgcttgaaa

SEQ ID NO: 8346933 - DNA, 22 bp, Homo sapiens
ttatgcagatggcatgaggagg

SEQ ID NO: 8346934 - DNA, 22 bp, Homo sapiens
ttatgtgtacctcaatctgagg

SEQ ID NO: 8346935 - DNA, 22 bp, Homo sapiens
ttatggcatattcctcattgta

SEQ ID NO: 8346936 - DNA, 22 bp, Homo sapiens
tcctctggctctttccctagga

SEQ ID NO: 8346937 - DNA, 22 bp, Homo sapiens
tcctctggctctttccctagga

SEQ ID NO: 8346938 - DNA, 22 bp, Homo sapiens
tcctctggcccagctgcctctg

SEQ ID NO: 8346939 - DNA, 21 bp, Homo sapiens
tcctcctgtagagggtcctgg

SEQ ID NO: 8346940 - DNA, 22 bp, Homo sapiens
tcctcctgtttctcaggcctgg

SEQ ID NO: 8346941 - DNA, 22 bp, Homo sapiens
tcctctactcgcttgccctttg

SEQ ID NO: 8346942 - DNA, 22 bp, Homo sapiens
tcctctcagtgtggttgtggga

SEQ ID NO: 8346943 - DNA, 22 bp, Homo sapiens
tcctctcagtgtggttgtggga

SEQ ID NO: 8346944 - DNA, 22 bp, Homo sapiens
tcctctccagcaaactggctat

SEQ ID NO: 8346945 - DNA, 22 bp, Homo sapiens
ttattgtttgggtataatttga

SEQ ID NO: 8346946 - DNA, 22 bp, Homo sapiens
ttatttaaaagtggtaagattc

SEQ ID NO: 8346947 - DNA, 22 bp, Homo sapiens
ttatttaaaatgtaggttggga

SEQ ID NO: 8346948 - DNA, 22 bp, Homo sapiens
ttattgtttgggtataatttga

SEQ ID NO: 8346949 - DNA, 22 bp, Homo sapiens
ttatgttatgctatttcagata

SEQ ID NO: 8346950 - DNA, 22 bp, Homo sapiens
ttatgttttatggctatatcat

SEQ ID NO: 8346951 - DNA, 22 bp, Homo sapiens
ttatttatatctctgcagttta

SEQ ID NO: 8346952 - DNA, 22 bp, Homo sapiens
ttatttatatctctgcagttta

SEQ ID NO: 8346953 - DNA, 22 bp, Homo sapiens
ttatttatatctctgcagttta

SEQ ID NO: 8346954 - DNA, 22 bp, Homo sapiens
ttatttatggcactgttggtgg

SEQ ID NO: 8346955 - DNA, 22 bp, Homo sapiens
ttatttgtggcatatgagacga

SEQ ID NO: 8346956 - DNA, 18 bp, Homo sapiens
ttatttgttacagcacat

SEQ ID NO: 8346957 - DNA, 20 bp, Homo sapiens
ttatttgtttactttggtcc

SEQ ID NO: 8346958 - DNA, 22 bp, Homo sapiens
ttatttaattttctcactcaga

SEQ ID NO: 8346959 - DNA, 22 bp, Homo sapiens
ttatttaattttctcactcaga

SEQ ID NO: 8346960 - DNA, 22 bp, Homo sapiens
ttattttgtagctctgatcttt

SEQ ID NO: 8346961 - DNA, 22 bp, Homo sapiens
ttattttcagctaggaaagcca

SEQ ID NO: 8346962 - DNA, 22 bp, Homo sapiens
ttattttgagagaatgtgtgct

SEQ ID NO: 8346963 - DNA, 22 bp, Homo sapiens
ttcaagatccagcacaacagtg

SEQ ID NO: 8346964 - DNA, 21 bp, Homo sapiens
ttcaagatatttaaaaggtgg

SEQ ID NO: 8346965 - DNA, 23 bp, Homo sapiens
ttcaagatacggtttccaggctg

SEQ ID NO: 8346966 - DNA, 17 bp, Homo sapiens
ttcaagatattgaaatg

SEQ ID NO: 8346967 - DNA, 22 bp, Homo sapiens
ttcaagataataggaatgaaaa

SEQ ID NO: 8346968 - DNA, 22 bp, Homo sapiens
ttcaagatgtcttcacaatagt

SEQ ID NO: 8346969 - DNA, 22 bp, Homo sapiens
ttcaagatggctgcaaatactt

SEQ ID NO: 8346970 - DNA, 22 bp, Homo sapiens
ttcaagatggccccagtgagcc

SEQ ID NO: 8346971 - DNA, 22 bp, Homo sapiens
ttcaagatgcacagtggcattc

SEQ ID NO: 8346972 - DNA, 22 bp, Homo sapiens
ttcaagatgccagggacgcggc

SEQ ID NO: 8346973 - DNA, 22 bp, Homo sapiens
ttcaagatggcaccagtgagtg

SEQ ID NO: 8346974 - DNA, 22 bp, Homo sapiens
ttcaagatcgagtttaaagtga

SEQ ID NO: 8346975 - DNA, 22 bp, Homo sapiens
ttcaagatctgggttttcagct

SEQ ID NO: 8346976 - DNA, 22 bp, Homo sapiens
ttcaagatgacccagtcacacg

SEQ ID NO: 8346977 - DNA, 22 bp, Homo sapiens
ttcaagatcttccaaaggatac

SEQ ID NO: 8346978 - DNA, 22 bp, Homo sapiens
ttgcattttggttgtaaatatg

SEQ ID NO: 8346979 - DNA, 21 bp, Homo sapiens
ttgcattttaagtttactgct

SEQ ID NO: 8346980 - DNA, 22 bp, Homo sapiens
ttgcatttgtttgagtagaatg

SEQ ID NO: 8346981 - DNA, 22 bp, Homo sapiens
ttgccacacaagtaaagaaaca

SEQ ID NO: 8346982 - DNA, 22 bp, Homo sapiens
ttgcatttttgagcacgaagtt

SEQ ID NO: 8346983 - DNA, 22 bp, Homo sapiens
ttgcatttttagatgcttctgt

SEQ ID NO: 8346984 - DNA, 22 bp, Homo sapiens
ttgaggtattgatattttatga

SEQ ID NO: 8346985 - DNA, 19 bp, Homo sapiens
ttgcatttcatgtttgatt

SEQ ID NO: 8346986 - DNA, 22 bp, Homo sapiens
ttgagtcagtaattccatttct

SEQ ID NO: 8346987 - DNA, 22 bp, Homo sapiens
ttgcatttcctgtactgtttga

SEQ ID NO: 8346988 - DNA, 22 bp, Homo sapiens
ttgcatttgctcatttgatatg

SEQ ID NO: 8346989 - DNA, 22 bp, Homo sapiens
ttgctattttgagagtcatagt

SEQ ID NO: 8346990 - DNA, 22 bp, Homo sapiens
ttgccttgattcttctcatgtg

SEQ ID NO: 8346991 - DNA, 22 bp, Homo sapiens
ttgccttactgcattcagtaaa

SEQ ID NO: 8346992 - DNA, 22 bp, Homo sapiens
ttgcgcatgtacccatacatct

SEQ ID NO: 8346993 - DNA, 22 bp, Homo sapiens
ttggcacagtaatctctcttca

SEQ ID NO: 8346994 - DNA, 22 bp, Homo sapiens
ttggcacagccacttctgctgc

SEQ ID NO: 8346995 - DNA, 22 bp, Homo sapiens
ttggcacagctccatggctttg

SEQ ID NO: 8346996 - DNA, 23 bp, Homo sapiens
ttggattcagtttctgggcttct

SEQ ID NO: 8346997 - DNA, 22 bp, Homo sapiens
ttggattctttctaggctgtga

SEQ ID NO: 8346998 - DNA, 22 bp, Homo sapiens
ttggcagactgacaatctgttt

SEQ ID NO: 8346999 - DNA, 22 bp, Homo sapiens
ttggaatagatttgttagaaaa

SEQ ID NO: 8347000 - DNA, 22 bp, Homo sapiens
ttggaatatgtgtatgaaaagc

SEQ ID NO: 8347001 - DNA, 23 bp, Homo sapiens
ttggaatatattgtttgacatag

SEQ ID NO: 8347002 - DNA, 22 bp, Homo sapiens
ttgctttatgtgtatgacttga

SEQ ID NO: 8347003 - DNA, 22 bp, Homo sapiens
ttgctttatctaagcatggcca

SEQ ID NO: 8347004 - DNA, 23 bp, Homo sapiens
ttggaacacagtaaatgcacaat

SEQ ID NO: 8347005 - DNA, 22 bp, Homo sapiens
ttggaacatccaggacagatat

SEQ ID NO: 8347006 - DNA, 20 bp, Homo sapiens
ttggaacagtggatcagcag

SEQ ID NO: 8347007 - DNA, 22 bp, Homo sapiens
ttggaacagtgtgaaaaggtta

SEQ ID NO: 8347008 - DNA, 22 bp, Homo sapiens
ttggaacaggattcaattaaag

SEQ ID NO: 8347009 - DNA, 22 bp, Homo sapiens
ttggaacagaactgcgttcatt

SEQ ID NO: 8347010 - DNA, 22 bp, Homo sapiens
ttggaacagagccctaaggaca

SEQ ID NO: 8347011 - DNA, 22 bp, Homo sapiens
ttggaacagaaacagacaaata

SEQ ID NO: 8347012 - DNA, 22 bp, Homo sapiens
ttgcttctaagtataaatatga

SEQ ID NO: 8347013 - DNA, 22 bp, Homo sapiens
ttggctcaggacccctgtgact

SEQ ID NO: 8347014 - DNA, 22 bp, Homo sapiens
ttggcagcaagaggctcttctg

SEQ ID NO: 8347015 - DNA, 22 bp, Homo sapiens
ttggcagatgaacacaactgga

SEQ ID NO: 8347016 - DNA, 22 bp, Homo sapiens
ttggccttctcatttgcttatt

SEQ ID NO: 8347017 - DNA, 22 bp, Homo sapiens
ttggccgtttcactgggcagtt

SEQ ID NO: 8347018 - DNA, 22 bp, Homo sapiens
ttggccctttatgggatgggca

SEQ ID NO: 8347019 - DNA, 22 bp, Homo sapiens
ttggcttggagagttgaaatgt

SEQ ID NO: 8347020 - DNA, 22 bp, Homo sapiens
ttgggcttgacaagctgtcaag

SEQ ID NO: 8347021 - DNA, 22 bp, Homo sapiens
ttgggcttggtcggtttgaggc

SEQ ID NO: 8347022 - DNA, 22 bp, Homo sapiens
ttgtgagtagtgccgcaataaa

SEQ ID NO: 8347023 - DNA, 22 bp, Homo sapiens
ttgtgcatttctctgagtgtgt

SEQ ID NO: 8347024 - DNA, 22 bp, Homo sapiens
ttgtgctcctgtgagaatctag

SEQ ID NO: 8347025 - DNA, 22 bp, Homo sapiens
ttgtgctcctatgagaatctaa

SEQ ID NO: 8347026 - DNA, 22 bp, Homo sapiens
ttgtgcttaagcaagctttctt

SEQ ID NO: 8347027 - DNA, 22 bp, Homo sapiens
ttgtggaaatacagactccaag

SEQ ID NO: 8347028 - DNA, 23 bp, Homo sapiens
ttgttctatcaacctagacttag

SEQ ID NO: 8347029 - DNA, 22 bp, Homo sapiens
ttgttcatctggaacccagagc

SEQ ID NO: 8347030 - DNA, 22 bp, Homo sapiens
ttgggggcatattgagtagtgg

SEQ ID NO: 8347031 - DNA, 22 bp, Homo sapiens
ttggggcatgattagattatga

SEQ ID NO: 8347032 - DNA, 22 bp, Homo sapiens
ttggggcagttattctgtgccc

SEQ ID NO: 8347033 - DNA, 22 bp, Homo sapiens
ttgggggcagagggagcatctg

SEQ ID NO: 8347034 - DNA, 22 bp, Homo sapiens
ttgtagaatcattatttctagt

SEQ ID NO: 8347035 - DNA, 22 bp, Homo sapiens
ttgtacttaaatatgcaaatag

SEQ ID NO: 8347036 - DNA, 22 bp, Homo sapiens
ttgtagatataaattttattgt

SEQ ID NO: 8347037 - DNA, 22 bp, Homo sapiens
ttgtagatggcttatttctgtg

SEQ ID NO: 8347038 - DNA, 22 bp, Homo sapiens
ttgtagatgtgtttttatctca

SEQ ID NO: 8347039 - DNA, 22 bp, Homo sapiens
ttgtatttcctataacctttct

SEQ ID NO: 8347040 - DNA, 22 bp, Homo sapiens
tttatctgtgggagttgtttgg

SEQ ID NO: 8347041 - DNA, 22 bp, Homo sapiens
tttaggaatattttctttcagg

SEQ ID NO: 8347042 - DNA, 22 bp, Homo sapiens
tttaggcaaatttcagatgtgc

SEQ ID NO: 8347043 - DNA, 22 bp, Homo sapiens
tttagcatgtgtgccatgtggc

SEQ ID NO: 8347044 - DNA, 22 bp, Homo sapiens
tttattgctgagaaggattcca

SEQ ID NO: 8347045 - DNA, 22 bp, Homo sapiens
tttatgtttgacaatgatctgg

SEQ ID NO: 8347046 - DNA, 22 bp, Homo sapiens
tttatgtttgacaatgatctgg

SEQ ID NO: 8347047 - DNA, 22 bp, Homo sapiens
tttatgaactacagatataact

SEQ ID NO: 8347048 - DNA, 22 bp, Homo sapiens
tttatgtaatttcataggtgtg

SEQ ID NO: 8347049 - DNA, 21 bp, Homo sapiens
tttatgtacttcatagagtag

SEQ ID NO: 8347050 - DNA, 22 bp, Homo sapiens
tttaagaagttatgttataaat

SEQ ID NO: 8347051 - DNA, 22 bp, Homo sapiens
tttaagaagttatgttataaat

SEQ ID NO: 8347052 - DNA, 23 bp, Homo sapiens
tttaacatttgaacatgtggcca

SEQ ID NO: 8347053 - DNA, 22 bp, Homo sapiens
tttaacatgttcaagaaacata

SEQ ID NO: 8347054 - DNA, 22 bp, Homo sapiens
tttacagagaatgtacataaag

SEQ ID NO: 8347055 - DNA, 22 bp, Homo sapiens
tttacagagaatgtacataaag

SEQ ID NO: 8347056 - DNA, 22 bp, Homo sapiens
tttacagaatgttgaatttggg

SEQ ID NO: 8347057 - DNA, 22 bp, Homo sapiens
tttacagaagagaaggatgctt

SEQ ID NO: 8347058 - DNA, 22 bp, Homo sapiens
tttacagatgaggatactgagg

SEQ ID NO: 8347059 - DNA, 22 bp, Homo sapiens
tttaagatcatttgtattatcc

SEQ ID NO: 8347060 - DNA, 19 bp, Homo sapiens
tttacaagttctttgtatg

SEQ ID NO: 8347061 - DNA, 22 bp, Homo sapiens
tttacacattattttcagtgtg

SEQ ID NO: 8347062 - DNA, 22 bp, Homo sapiens
tttacaagtttacagaatgatg

SEQ ID NO: 8347063 - DNA, 22 bp, Homo sapiens
tttacacattattttcagtgtg

SEQ ID NO: 8347064 - DNA, 22 bp, Homo sapiens
tttcaatgacacaaaagagaaa

SEQ ID NO: 8347065 - DNA, 19 bp, Homo sapiens
tttcaatggcttagagaaa

SEQ ID NO: 8347066 - DNA, 22 bp, Homo sapiens
tttatttataagccacttgctg

SEQ ID NO: 8347067 - DNA, 20 bp, Homo sapiens
tttcaagtcagcaattctca

SEQ ID NO: 8347068 - DNA, 22 bp, Homo sapiens
tttcacattcttctgaatctac

SEQ ID NO: 8347069 - DNA, 22 bp, Homo sapiens
tttcacattggcttctatttct

SEQ ID NO: 8347070 - DNA, 23 bp, Homo sapiens
tttcacatttactgttagatggc

SEQ ID NO: 8347071 - DNA, 22 bp, Homo sapiens
tttcacattcagatatagactt

SEQ ID NO: 8347072 - DNA, 22 bp, Homo sapiens
tttcataaacagtagaagacta

SEQ ID NO: 8347073 - DNA, 22 bp, Homo sapiens
tttcagtttttgctcgatgtat

SEQ ID NO: 8347074 - DNA, 22 bp, Homo sapiens
tttcacatttgttttaagaagt

SEQ ID NO: 8347075 - DNA, 22 bp, Homo sapiens
tttcagtgtaaggtttccagga

SEQ ID NO: 8347076 - DNA, 22 bp, Homo sapiens
tttcagtgggtttatttcatgt

SEQ ID NO: 8347077 - DNA, 20 bp, Homo sapiens
tttcagtggtttgtgcctag

SEQ ID NO: 8347078 - DNA, 23 bp, Homo sapiens
tttcacagcttttattctgcatc

SEQ ID NO: 8347079 - DNA, 22 bp, Homo sapiens
tttcacatatggttgttgattg

SEQ ID NO: 8347080 - DNA, 22 bp, Homo sapiens
tttcacatcccgcgcgccctta

SEQ ID NO: 8347081 - DNA, 22 bp, Homo sapiens
tttcacatggtactgcctgttt

SEQ ID NO: 8347082 - DNA, 22 bp, Homo sapiens
tttcacatgtggaatgccaggt

SEQ ID NO: 8347083 - DNA, 22 bp, Homo sapiens
tttccatatttggtctttggga

SEQ ID NO: 8347084 - DNA, 22 bp, Homo sapiens
tttccatattctgcgtctgcca

SEQ ID NO: 8347085 - DNA, 22 bp, Homo sapiens
tttcataatactgtacatgaaa

SEQ ID NO: 8347086 - DNA, 22 bp, Homo sapiens
tttcataagggtttctagactt

SEQ ID NO: 8347087 - DNA, 22 bp, Homo sapiens
tttcataatatccagagatttt

SEQ ID NO: 8347088 - DNA, 22 bp, Homo sapiens
tttcatattattccttgagtct

SEQ ID NO: 8347089 - DNA, 23 bp, Homo sapiens
tttcatatggtgtggatgaagaa

SEQ ID NO: 8347090 - DNA, 22 bp, Homo sapiens
tttcatatgggcattggcaata

SEQ ID NO: 8347091 - DNA, 22 bp, Homo sapiens
tttcatatgggcattggcaata

SEQ ID NO: 8347092 - DNA, 22 bp, Homo sapiens
tttcatcttatttgtctacatc

SEQ ID NO: 8347093 - DNA, 22 bp, Homo sapiens
tttctagtggttaagatttaca

SEQ ID NO: 8347094 - DNA, 22 bp, Homo sapiens
tttctatatcttacctattgta

SEQ ID NO: 8347095 - DNA, 22 bp, Homo sapiens
tttctatatgaggagctaaagt

SEQ ID NO: 8347096 - DNA, 22 bp, Homo sapiens
tttctagtctcgatctcttaat

SEQ ID NO: 8347097 - DNA, 22 bp, Homo sapiens
tttctagtcagccatatctagt

SEQ ID NO: 8347098 - DNA, 22 bp, Homo sapiens
tttctagagtgggcatgtctta

SEQ ID NO: 8347099 - DNA, 22 bp, Homo sapiens
tttctagatattcgcagataga

SEQ ID NO: 8347100 - DNA, 17 bp, Homo sapiens
tttctagattatcctct

SEQ ID NO: 8347101 - DNA, 22 bp, Homo sapiens
tttctattggcgtcactgttgt

SEQ ID NO: 8347102 - DNA, 22 bp, Homo sapiens
tttctattctggatctgtggca

SEQ ID NO: 8347103 - DNA, 22 bp, Homo sapiens
tttgaaatatgaggcattatga

SEQ ID NO: 8347104 - DNA, 22 bp, Homo sapiens
tttgaaattaagatattgtcca

SEQ ID NO: 8347105 - DNA, 22 bp, Homo sapiens
tttgaacaggagtatctatagt

SEQ ID NO: 8347106 - DNA, 22 bp, Homo sapiens
tttgaacaagagcttcacatta

SEQ ID NO: 8347107 - DNA, 22 bp, Homo sapiens
tttgaacagacactttctacag

SEQ ID NO: 8347108 - DNA, 22 bp, Homo sapiens
tttgaacatgctgcatgataat

SEQ ID NO: 8347109 - DNA, 22 bp, Homo sapiens
tttgaagacatattgttacata

SEQ ID NO: 8347110 - DNA, 20 bp, Homo sapiens
tttgacatatacagttcagg

SEQ ID NO: 8347111 - DNA, 22 bp, Homo sapiens
tttgacatcactgacctgtttt

SEQ ID NO: 8347112 - DNA, 22 bp, Homo sapiens
tttgacaggactaacatatggc

SEQ ID NO: 8347113 - DNA, 22 bp, Homo sapiens
tttgacagcttgttacaaagtt

SEQ ID NO: 8347114 - DNA, 22 bp, Homo sapiens
tttgacagtaataaagcacaag

SEQ ID NO: 8347115 - DNA, 19 bp, Homo sapiens
tttgagaagttattatcta

SEQ ID NO: 8347116 - DNA, 22 bp, Homo sapiens
tttgagaaggtgacaaattcta

SEQ ID NO: 8347117 - DNA, 22 bp, Homo sapiens
tttgagaagtaattcaagacat

SEQ ID NO: 8347118 - DNA, 22 bp, Homo sapiens
tttgacattggcttattctgtt

SEQ ID NO: 8347119 - DNA, 22 bp, Homo sapiens
tttgacattgccaatttgctca

SEQ ID NO: 8347120 - DNA, 22 bp, Homo sapiens
tttgacatctaagaattcttac

SEQ ID NO: 8347121 - DNA, 18 bp, Homo sapiens
tttgagaatgcatgactg

SEQ ID NO: 8347122 - DNA, 22 bp, Homo sapiens
tttgagatctcaatgaggacta

SEQ ID NO: 8347123 - DNA, 22 bp, Homo sapiens
tttgagatagtctagagtaact

SEQ ID NO: 8347124 - DNA, 22 bp, Homo sapiens
tttgagcagaagggtgacatgc

SEQ ID NO: 8347125 - DNA, 22 bp, Homo sapiens
tttgagattccttagctcagag

SEQ ID NO: 8347126 - DNA, 22 bp, Homo sapiens
tttgagcagcagatgcacttag

SEQ ID NO: 8347127 - DNA, 22 bp, Homo sapiens
tttgagcttgcatgagccttga

SEQ ID NO: 8347128 - DNA, 17 bp, Homo sapiens
tttgagctggaccctgg

SEQ ID NO: 8347129 - DNA, 23 bp, Homo sapiens
tttgagctctagatggccctccc

SEQ ID NO: 8347130 - DNA, 22 bp, Homo sapiens
tttgagctaagtaggtgtcaac

SEQ ID NO: 8347131 - DNA, 22 bp, Homo sapiens
tttgcattatatttatagaaga

SEQ ID NO: 8347132 - DNA, 22 bp, Homo sapiens
tttgcattatctcacttatata

SEQ ID NO: 8347133 - DNA, 22 bp, Homo sapiens
tttgcattcctgcctgcattca

SEQ ID NO: 8347134 - DNA, 22 bp, Homo sapiens
tttgcattagtttagatttcaa

SEQ ID NO: 8347135 - DNA, 22 bp, Homo sapiens
tttgcattacttgactttagtt

SEQ ID NO: 8347136 - DNA, 22 bp, Homo sapiens
tttgcattacttgactttagtt

SEQ ID NO: 8347137 - DNA, 18 bp, Homo sapiens
tttgcatggtaacattga

SEQ ID NO: 8347138 - DNA, 22 bp, Homo sapiens
tttgcagtttcattgctgaaat

SEQ ID NO: 8347139 - DNA, 22 bp, Homo sapiens
tttgctgctgtatatggagccc

SEQ ID NO: 8347140 - DNA, 21 bp, Homo sapiens
tttgctgaagattttaggctg

SEQ ID NO: 8347141 - DNA, 22 bp, Homo sapiens
tttgcatttctcgtaaggaaac

SEQ ID NO: 8347142 - DNA, 22 bp, Homo sapiens
tttgcatttgcaaataatgaaa

SEQ ID NO: 8347143 - DNA, 22 bp, Homo sapiens
tttgcatttctaatgagctccg

SEQ ID NO: 8347144 - DNA, 22 bp, Homo sapiens
tttgcatttctaatgagctccg

SEQ ID NO: 8347145 - DNA, 22 bp, Homo sapiens
tttgcatttccagagtagcaga

SEQ ID NO: 8347146 - DNA, 22 bp, Homo sapiens
tttgcatttataagttggtgga

SEQ ID NO: 8347147 - DNA, 22 bp, Homo sapiens
tttgcatttataagttggtgga

SEQ ID NO: 8347148 - DNA, 22 bp, Homo sapiens
tttgcatttgttcaagtattga

SEQ ID NO: 8347149 - DNA, 21 bp, Homo sapiens
tttgcattttacatgtgggga

SEQ ID NO: 8347150 - DNA, 22 bp, Homo sapiens
tttgcatttgtttagaacctga

SEQ ID NO: 8347151 - DNA, 22 bp, Homo sapiens
tttgcattgcattaagtattct

SEQ ID NO: 8347152 - DNA, 22 bp, Homo sapiens
tttgcattgcagtggtttacag

SEQ ID NO: 8347153 - DNA, 22 bp, Homo sapiens
tttgcattgcatacaaggaact

SEQ ID NO: 8347154 - DNA, 22 bp, Homo sapiens
tttgcattctagaaaaatttct

SEQ ID NO: 8347155 - DNA, 22 bp, Homo sapiens
tttgcattgtttcaaaagtgaa

SEQ ID NO: 8347156 - DNA, 22 bp, Homo sapiens
tttgcattgcctctgacttatg

SEQ ID NO: 8347157 - DNA, 22 bp, Homo sapiens
tttgcattgtaatatttagttc

SEQ ID NO: 8347158 - DNA, 22 bp, Homo sapiens
tttggctaggttaagactggga

SEQ ID NO: 8347159 - DNA, 22 bp, Homo sapiens
tttggctacttgatattctgaa

SEQ ID NO: 8347160 - DNA, 22 bp, Homo sapiens
tttggctacttgatattctgaa

SEQ ID NO: 8347161 - DNA, 22 bp, Homo sapiens
tttggctaactgcaaaaagtac

SEQ ID NO: 8347162 - DNA, 22 bp, Homo sapiens
tttgtcatgctttccttatgga

SEQ ID NO: 8347163 - DNA, 22 bp, Homo sapiens
tttgtcatcccttttgaaactg

SEQ ID NO: 8347164 - DNA, 21 bp, Homo sapiens
tttgtccacctgtgttcacca

SEQ ID NO: 8347165 - DNA, 22 bp, Homo sapiens
tttgtcattctgtgtatttaaa

SEQ ID NO: 8347166 - DNA, 22 bp, Homo sapiens
tttgtcatgtccttaactgtct

SEQ ID NO: 8347167 - DNA, 20 bp, Homo sapiens
tttgtccagcgtctactctg

SEQ ID NO: 8347168 - DNA, 22 bp, Homo sapiens
tttgtccagatgcacagataat

SEQ ID NO: 8347169 - DNA, 20 bp, Homo sapiens
tttgtccagcgtctactctg

SEQ ID NO: 8347170 - DNA, 22 bp, Homo sapiens
tttgggaaacttaggggtcaga

SEQ ID NO: 8347171 - DNA, 22 bp, Homo sapiens
tttgggctcactatgctgaaga

SEQ ID NO: 8347172 - DNA, 22 bp, Homo sapiens
tttgggctcttgctgacctggg

SEQ ID NO: 8347173 - DNA, 21 bp, Homo sapiens
tttgggcttttactggacgtg

SEQ ID NO: 8347174 - DNA, 22 bp, Homo sapiens
tttgggctgagatgtgggccga

SEQ ID NO: 8347175 - DNA, 18 bp, Homo sapiens
tttgggctgatgttgggc

SEQ ID NO: 8347176 - DNA, 22 bp, Homo sapiens
tttttgttctgattatactggt

SEQ ID NO: 8347177 - DNA, 22 bp, Homo sapiens
ttttttagttaggtcagaatgt

SEQ ID NO: 8347178 - DNA, 22 bp, Homo sapiens
ttttttatagcaatgaacccac

SEQ ID NO: 8347179 - DNA, 22 bp, Homo sapiens
ttttttatatcaactgaagtct

SEQ ID NO: 8347180 - DNA, 22 bp, Homo sapiens
ttttgttgacctctcccacctt

SEQ ID NO: 8347181 - DNA, 22 bp, Homo sapiens
tttttgtatagaaatgaactaa

SEQ ID NO: 8347182 - DNA, 22 bp, Homo sapiens
tttttgtagtcattagaagagg

SEQ ID NO: 8347183 - DNA, 22 bp, Homo sapiens
tttttgtagtcattagaagagg

SEQ ID NO: 8347184 - DNA, 22 bp, Homo sapiens
ttttgtctaagaactttgcaaa

SEQ ID NO: 8347185 - DNA, 19 bp, Homo sapiens
ttttgtcttcccttagttt

SEQ ID NO: 8347186 - DNA, 22 bp, Homo sapiens
ttttgtatcctccctttcactg

SEQ ID NO: 8347187 - DNA, 22 bp, Homo sapiens
ttttccagcataggtacatata

SEQ ID NO: 8347188 - DNA, 22 bp, Homo sapiens
ttttccagatggatactagaat

SEQ ID NO: 8347189 - DNA, 22 bp, Homo sapiens
ttttcctatatgcaaagaatgc

SEQ ID NO: 8347190 - DNA, 22 bp, Homo sapiens
ttttcctcaggaatgctaagct

SEQ ID NO: 8347191 - DNA, 22 bp, Homo sapiens
ttttcctactgataaacagtta

SEQ ID NO: 8347192 - DNA, 22 bp, Homo sapiens
ttttcctagtaggcctattaga

SEQ ID NO: 8347193 - DNA, 22 bp, Homo sapiens
ttttcctctgcaataaaagcag

SEQ ID NO: 8347194 - DNA, 22 bp, Homo sapiens
ttttcctctgcagagcagttag

SEQ ID NO: 8347195 - DNA, 22 bp, Homo sapiens
ttttcctctgagctttgaataa

SEQ ID NO: 8347196 - DNA, 22 bp, Homo sapiens
ttttcctcaggaatgctaagct

SEQ ID NO: 8347197 - DNA, 22 bp, Homo sapiens
ttttccttctagagcagatttc

SEQ ID NO: 8347198 - DNA, 22 bp, Homo sapiens
ttttggtgcacctagctttttc

SEQ ID NO: 8347199 - DNA, 17 bp, Homo sapiens
ttttggtgagttgtttc

SEQ ID NO: 8347200 - DNA, 22 bp, Homo sapiens
ttttggtcaggttggtctcgaa

SEQ ID NO: 8347201 - DNA, 20 bp, Homo sapiens
ttttggtcttcagacaaggc

SEQ ID NO: 8347202 - DNA, 22 bp, Homo sapiens
ttttggtagaatcaacaatgta

SEQ ID NO: 8347203 - DNA, 22 bp, Homo sapiens
tttgtctataaattactactgc

SEQ ID NO: 8347204 - DNA, 22 bp, Homo sapiens
tttgtgcacattgcttttctat

SEQ ID NO: 8347205 - DNA, 22 bp, Homo sapiens
tttgtgcaatttatgtactata

SEQ ID NO: 8347206 - DNA, 19 bp, Homo sapiens
tttgtgcagcaacattaat

SEQ ID NO: 8347207 - DNA, 22 bp, Homo sapiens
tttgtgcagatgtatatttgtg

SEQ ID NO: 8347208 - DNA, 22 bp, Homo sapiens
tttgtgcacttctgtagctgcc

SEQ ID NO: 8347209 - DNA, 22 bp, Homo sapiens
ttttacacttcggttgtgtgca

SEQ ID NO: 8347210 - DNA, 22 bp, Homo sapiens
ttttacacctgttaactctaag

SEQ ID NO: 8347211 - DNA, 22 bp, Homo sapiens
ttttacacctcagatgagcaga

SEQ ID NO: 8347212 - DNA, 22 bp, Homo sapiens
ttttaattttgcaaatctggtg

SEQ ID NO: 8347213 - DNA, 22 bp, Homo sapiens
ttttattgtctcccagttctgg

SEQ ID NO: 8347214 - DNA, 22 bp, Homo sapiens
ttttattgtcaatgaagacaga

SEQ ID NO: 8347215 - DNA, 22 bp, Homo sapiens
ttttcacaagggtccaactagt

SEQ ID NO: 8347216 - DNA, 22 bp, Homo sapiens
ttttcaaagactggaggctgat

SEQ ID NO: 8347217 - DNA, 22 bp, Homo sapiens
ttttagaaatactgatttagtg

SEQ ID NO: 8347218 - DNA, 22 bp, Homo sapiens
ttttagaagtgcctatcctatg

SEQ ID NO: 8347219 - DNA, 22 bp, Homo sapiens
ttttacattgggaaatgcctct

SEQ ID NO: 8347220 - DNA, 21 bp, Homo sapiens
ttttttcttgcgtgaggcctg

SEQ ID NO: 8347221 - DNA, 22 bp, Homo sapiens
acactgcagcatcagctacgga

SEQ ID NO: 8347222 - DNA, 22 bp, Homo sapiens
aagatttcttacttattgatgc

SEQ ID NO: 8347223 - DNA, 22 bp, Homo sapiens
aagatttctgctcctgagagaa

SEQ ID NO: 8347224 - DNA, 22 bp, Homo sapiens
aagatttctgcttttggaggca

SEQ ID NO: 8347225 - DNA, 22 bp, Homo sapiens
aagatttctctcctggaaagca

SEQ ID NO: 8347226 - DNA, 22 bp, Homo sapiens
aagatttccttcagtagagcta

SEQ ID NO: 8347227 - DNA, 22 bp, Homo sapiens
aagatttccatttctagctcat

SEQ ID NO: 8347228 - DNA, 22 bp, Homo sapiens
aagatttcctggatgtaattcc

SEQ ID NO: 8347229 - DNA, 22 bp, Homo sapiens
aagatttcagagtttgggggaa

SEQ ID NO: 8347230 - DNA, 17 bp, Homo sapiens
aagatttcattagctga

SEQ ID NO: 8347231 - DNA, 22 bp, Homo sapiens
aagcacaggggaaataagttgt

SEQ ID NO: 8347232 - DNA, 22 bp, Homo sapiens
aagcacagggtgtctgcattca

SEQ ID NO: 8347233 - DNA, 22 bp, Homo sapiens
aagcacaggatcttgaggagcg

SEQ ID NO: 8347234 - DNA, 22 bp, Homo sapiens
acacaggggaaagtggagctga

SEQ ID NO: 8347235 - DNA, 22 bp, Homo sapiens
acacaggaaatggtttagtttt

SEQ ID NO: 8347236 - DNA, 22 bp, Homo sapiens
acacagggggcattctaggagt

SEQ ID NO: 8347237 - DNA, 22 bp, Homo sapiens
acacagggggcattctaggagt

SEQ ID NO: 8347238 - DNA, 22 bp, Homo sapiens
acacagggtctagagttaggcc

SEQ ID NO: 8347239 - DNA, 22 bp, Homo sapiens
aagaggccccccagcaggtgaa

SEQ ID NO: 8347240 - DNA, 22 bp, Homo sapiens
aagaggcctggaggcagaggtg

SEQ ID NO: 8347241 - DNA, 22 bp, Homo sapiens
aagaggccttggtctgacctga

SEQ ID NO: 8347242 - DNA, 22 bp, Homo sapiens
aagaggctgaatgagaaagtac

SEQ ID NO: 8347243 - DNA, 22 bp, Homo sapiens
acagaattgaaagtataatctg

SEQ ID NO: 8347244 - DNA, 22 bp, Homo sapiens
acagaatttacacatctctaaa

SEQ ID NO: 8347245 - DNA, 22 bp, Homo sapiens
acagaatttaaagctctagact

SEQ ID NO: 8347246 - DNA, 22 bp, Homo sapiens
aagcagcatgctatgctggtgg

SEQ ID NO: 8347247 - DNA, 21 bp, Homo sapiens
acagagtagttgaaacagaga

SEQ ID NO: 8347248 - DNA, 22 bp, Homo sapiens
acagagtaggtgctcagtaaat

SEQ ID NO: 8347249 - DNA, 22 bp, Homo sapiens
aagcatagagacacaaatttgg

SEQ ID NO: 8347250 - DNA, 22 bp, Homo sapiens
acagagtagctcaagaagattg

SEQ ID NO: 8347251 - DNA, 22 bp, Homo sapiens
aagcagcctcatttgtggtaag

SEQ ID NO: 8347252 - DNA, 22 bp, Homo sapiens
aagcagcctcatttgtggtaag

SEQ ID NO: 8347253 - DNA, 19 bp, Homo sapiens
aagcagccctggcaagagc

SEQ ID NO: 8347254 - DNA, 22 bp, Homo sapiens
aagcagcctggcatgatgcttt

SEQ ID NO: 8347255 - DNA, 22 bp, Homo sapiens
aagcagcctggacttgggctgg

SEQ ID NO: 8347256 - DNA, 22 bp, Homo sapiens
aagcagccagccatcatgcccg

SEQ ID NO: 8347257 - DNA, 22 bp, Homo sapiens
aagcagccactggccagttata

SEQ ID NO: 8347258 - DNA, 22 bp, Homo sapiens
aagcagccacctcatctccact

SEQ ID NO: 8347259 - DNA, 22 bp, Homo sapiens
aagcagcattgtggtaggggag

SEQ ID NO: 8347260 - DNA, 22 bp, Homo sapiens
aagcagctgatttcacagctca

SEQ ID NO: 8347261 - DNA, 22 bp, Homo sapiens
aagcagctgaaggattcagggt

SEQ ID NO: 8347262 - DNA, 22 bp, Homo sapiens
acagaggtgtgtgtaggacagt

SEQ ID NO: 8347263 - DNA, 22 bp, Homo sapiens
aagcatttatagataagaattt

SEQ ID NO: 8347264 - DNA, 17 bp, Homo sapiens
aagcatttaatttgcta

SEQ ID NO: 8347265 - DNA, 22 bp, Homo sapiens
aagcatttcaatataatattca

SEQ ID NO: 8347266 - DNA, 22 bp, Homo sapiens
aagcatttctgtttatctatcg

SEQ ID NO: 8347267 - DNA, 22 bp, Homo sapiens
aagcatttcaggtagagatatt

SEQ ID NO: 8347268 - DNA, 22 bp, Homo sapiens
aagcatttggttctgaagactc

SEQ ID NO: 8347269 - DNA, 22 bp, Homo sapiens
acagcagctaacccctgggcca

SEQ ID NO: 8347270 - DNA, 22 bp, Homo sapiens
aagcatttgtgaaattcagatg

SEQ ID NO: 8347271 - DNA, 22 bp, Homo sapiens
acagcagctgccttcaggctct

SEQ ID NO: 8347272 - DNA, 22 bp, Homo sapiens
acagcagctaacccctgggcca

SEQ ID NO: 8347273 - DNA, 22 bp, Homo sapiens
acagcagcttgcgtgtctggtc

SEQ ID NO: 8347274 - DNA, 22 bp, Homo sapiens
acagcagcttgtctgttcttta

SEQ ID NO: 8347275 - DNA, 22 bp, Homo sapiens
aagccaggagcgaggcctcggc

SEQ ID NO: 8347276 - DNA, 22 bp, Homo sapiens
aagaaatgcacacaactgctgg

SEQ ID NO: 8347277 - DNA, 22 bp, Homo sapiens
aagaaatacatggtttttgagt

SEQ ID NO: 8347278 - DNA, 22 bp, Homo sapiens
aagaaatacatggtttttgagt

SEQ ID NO: 8347279 - DNA, 22 bp, Homo sapiens
aagaaatacatggtttttgagt

SEQ ID NO: 8347280 - DNA, 18 bp, Homo sapiens
aacttcaactacaatgga

SEQ ID NO: 8347281 - DNA, 22 bp, Homo sapiens
aagaaagcattagacaggcatt

SEQ ID NO: 8347282 - DNA, 22 bp, Homo sapiens
aagaaagcattagacaggcatt

SEQ ID NO: 8347283 - DNA, 22 bp, Homo sapiens
aacttcagggacagaaaagagc

SEQ ID NO: 8347284 - DNA, 22 bp, Homo sapiens
aagaaatgcacacaactgctgg

SEQ ID NO: 8347285 - DNA, 22 bp, Homo sapiens
aatgttttacagatcccattag

SEQ ID NO: 8347286 - DNA, 22 bp, Homo sapiens
aatgttttacagatcccattag

SEQ ID NO: 8347287 - DNA, 22 bp, Homo sapiens
aatgttttatagctcaagcaat

SEQ ID NO: 8347288 - DNA, 22 bp, Homo sapiens
aatgttttatagctcaagcaat

SEQ ID NO: 8347289 - DNA, 22 bp, Homo sapiens
aatgttttcattatcctaactg

SEQ ID NO: 8347290 - DNA, 22 bp, Homo sapiens
aatgttttcccagtgcagacga

SEQ ID NO: 8347291 - DNA, 22 bp, Homo sapiens
aatgttttctgactgctaactt

SEQ ID NO: 8347292 - DNA, 22 bp, Homo sapiens
aatgttttctgactgctaactt

SEQ ID NO: 8347293 - DNA, 22 bp, Homo sapiens
aagaataagaggatttagaaca

SEQ ID NO: 8347294 - DNA, 22 bp, Homo sapiens
aagaataaattaagatacttag

SEQ ID NO: 8347295 - DNA, 22 bp, Homo sapiens
aagaataaattaagatacttag

SEQ ID NO: 8347296 - DNA, 23 bp, Homo sapiens
aagaataaatgacattaaaggtg

SEQ ID NO: 8347297 - DNA, 22 bp, Homo sapiens
aagaatacgtatcaacaatggt

SEQ ID NO: 8347298 - DNA, 22 bp, Homo sapiens
aagaatacgtatcaacaatggt

SEQ ID NO: 8347299 - DNA, 22 bp, Homo sapiens
aagaataagaggatttagaaca

SEQ ID NO: 8347300 - DNA, 22 bp, Homo sapiens
aattggaaaatgctacatatca

SEQ ID NO: 8347301 - DNA, 22 bp, Homo sapiens
aattggtttgagttgtctctat

SEQ ID NO: 8347302 - DNA, 22 bp, Homo sapiens
aattgtgaacctttacagttgt

SEQ ID NO: 8347303 - DNA, 22 bp, Homo sapiens
aattgtgctatgattatgaaag

SEQ ID NO: 8347304 - DNA, 20 bp, Homo sapiens
acaaagactggaaaagcaag

SEQ ID NO: 8347305 - DNA, 22 bp, Homo sapiens
aagacattactggaatctgact

SEQ ID NO: 8347306 - DNA, 22 bp, Homo sapiens
aagacatgcagtttgttccatt

SEQ ID NO: 8347307 - DNA, 17 bp, Homo sapiens
aagagaggctgagctgg

SEQ ID NO: 8347308 - DNA, 22 bp, Homo sapiens
aagagaggggttgcatggaaat

SEQ ID NO: 8347309 - DNA, 22 bp, Homo sapiens
aagagattaaagtaacttgcct

SEQ ID NO: 8347310 - DNA, 22 bp, Homo sapiens
aagagctgattaagtcatgagg

SEQ ID NO: 8347311 - DNA, 22 bp, Homo sapiens
aagagctgcatctaagccatga

SEQ ID NO: 8347312 - DNA, 22 bp, Homo sapiens
aagagctggctcttgcagcagc

SEQ ID NO: 8347313 - DNA, 22 bp, Homo sapiens
aagagctgtatgccatatgatt

SEQ ID NO: 8347314 - DNA, 22 bp, Homo sapiens
aagagcttccctgttgtagagg

SEQ ID NO: 8347315 - DNA, 22 bp, Homo sapiens
aagagctggagtttgcagccct

SEQ ID NO: 8347316 - DNA, 22 bp, Homo sapiens
aagagctggaagtgaagataac

SEQ ID NO: 8347317 - DNA, 22 bp, Homo sapiens
aagagctggcccaatctgagca

SEQ ID NO: 8347318 - DNA, 22 bp, Homo sapiens
aatcatgacaggaatagaaggg

SEQ ID NO: 8347319 - DNA, 22 bp, Homo sapiens
aatcatgacaggaatagaaggg

SEQ ID NO: 8347320 - DNA, 22 bp, Homo sapiens
aactgcataatatatcatgcag

SEQ ID NO: 8347321 - DNA, 22 bp, Homo sapiens
aacggctgtggctggcggcagc

SEQ ID NO: 8347322 - DNA, 22 bp, Homo sapiens
aacgtgcattaggacctctcca

SEQ ID NO: 8347323 - DNA, 22 bp, Homo sapiens
aatcataattttgtgaatgtag

SEQ ID NO: 8347324 - DNA, 22 bp, Homo sapiens
aactacatcaccctatttctgt

SEQ ID NO: 8347325 - DNA, 22 bp, Homo sapiens
aactacagtagtttgcccttct

SEQ ID NO: 8347326 - DNA, 22 bp, Homo sapiens
aactgttattattttgcatggt

SEQ ID NO: 8347327 - DNA, 22 bp, Homo sapiens
aactgtttaccatacacagtga

SEQ ID NO: 8347328 - DNA, 22 bp, Homo sapiens
aactgtttaccatacacagtga

SEQ ID NO: 8347329 - DNA, 22 bp, Homo sapiens
aacttagagctctcctaaatga

SEQ ID NO: 8347330 - DNA, 22 bp, Homo sapiens
aatgatctactctcattatctc

SEQ ID NO: 8347331 - DNA, 22 bp, Homo sapiens
aatgatatgcaaattatcatca

SEQ ID NO: 8347332 - DNA, 22 bp, Homo sapiens
aatgatatttattgaatagatg

SEQ ID NO: 8347333 - DNA, 22 bp, Homo sapiens
aacatgctttgataaataaaag

SEQ ID NO: 8347334 - DNA, 22 bp, Homo sapiens
aacatgtaaatatcattgtact

SEQ ID NO: 8347335 - DNA, 22 bp, Homo sapiens
aataagaaagagtcagcttcag

SEQ ID NO: 8347336 - DNA, 22 bp, Homo sapiens
aacatttttaagaccaagtgct

SEQ ID NO: 8347337 - DNA, 22 bp, Homo sapiens
aatagtttgaatttatcagatg

SEQ ID NO: 8347338 - DNA, 22 bp, Homo sapiens
aatataaattcctgggcccagc

SEQ ID NO: 8347339 - DNA, 21 bp, Homo sapiens
aaccagagccaggctctcagc

SEQ ID NO: 8347340 - DNA, 22 bp, Homo sapiens
aaccagagagtcttcttcattg

SEQ ID NO: 8347341 - DNA, 22 bp, Homo sapiens
aaccaccattctctcctcttcc

SEQ ID NO: 8347342 - DNA, 22 bp, Homo sapiens
aaccaccattctctcctcttcc

SEQ ID NO: 8347343 - DNA, 22 bp, Homo sapiens
aacaggcctcattccagctctc

SEQ ID NO: 8347344 - DNA, 22 bp, Homo sapiens
aacaggaccttccaatccatca

SEQ ID NO: 8347345 - DNA, 22 bp, Homo sapiens
aacaggacatttcagaagcagg

SEQ ID NO: 8347346 - DNA, 22 bp, Homo sapiens
aacagggctttggaagtctccg

SEQ ID NO: 8347347 - DNA, 22 bp, Homo sapiens
aacatgctatgtgtctgaatca

SEQ ID NO: 8347348 - DNA, 22 bp, Homo sapiens
aacatgctatgtgtctgaatca

SEQ ID NO: 8347349 - DNA, 22 bp, Homo sapiens
aacatgctgggtgtttttgatg

SEQ ID NO: 8347350 - DNA, 22 bp, Homo sapiens
aaattctttcatggctaataag

SEQ ID NO: 8347351 - DNA, 19 bp, Homo sapiens
aaattctgacagtctttta

SEQ ID NO: 8347352 - DNA, 20 bp, Homo sapiens
aacaaactacaaaattatgt

SEQ ID NO: 8347353 - DNA, 22 bp, Homo sapiens
aaatgtctatctggcatattcc

SEQ ID NO: 8347354 - DNA, 19 bp, Homo sapiens
aaatgtgatggtacaattc

SEQ ID NO: 8347355 - DNA, 22 bp, Homo sapiens
aagctgaggatacatgaagcct

SEQ ID NO: 8347356 - DNA, 22 bp, Homo sapiens
aaatgtctacttcccatctgta

SEQ ID NO: 8347357 - DNA, 22 bp, Homo sapiens
aaatgtctacttcccatctgta

SEQ ID NO: 8347358 - DNA, 22 bp, Homo sapiens
aaatgttcaccagatccatgac

SEQ ID NO: 8347359 - DNA, 22 bp, Homo sapiens
aaatgtttaagtgtaggagcaa

SEQ ID NO: 8347360 - DNA, 22 bp, Homo sapiens
aaatgttttgctcccatgtggt

SEQ ID NO: 8347361 - DNA, 22 bp, Homo sapiens
aagtcattatctcttctaatct

SEQ ID NO: 8347362 - DNA, 22 bp, Homo sapiens
aagtcattggtagcttgatagg

SEQ ID NO: 8347363 - DNA, 22 bp, Homo sapiens
aacagcttgaggaatatcatca

SEQ ID NO: 8347364 - DNA, 22 bp, Homo sapiens
aacaggaatgaggagaaaaggt

SEQ ID NO: 8347365 - DNA, 22 bp, Homo sapiens
aacagcttgaggaatatcatca

SEQ ID NO: 8347366 - DNA, 22 bp, Homo sapiens
aacagaggatgtttgaaattca

SEQ ID NO: 8347367 - DNA, 22 bp, Homo sapiens
aacagagtggagccaaactttg

SEQ ID NO: 8347368 - DNA, 22 bp, Homo sapiens
aacagcagggggacctgctggt

SEQ ID NO: 8347369 - DNA, 22 bp, Homo sapiens
aacagcagggacttgaatggaa

SEQ ID NO: 8347370 - DNA, 22 bp, Homo sapiens
aacagcagtggcaggagaaggc

SEQ ID NO: 8347371 - DNA, 23 bp, Homo sapiens
aaggtcacagaacttagcaagcc

SEQ ID NO: 8347372 - DNA, 22 bp, Homo sapiens
aaggtcattttttcctctgttg

SEQ ID NO: 8347373 - DNA, 22 bp, Homo sapiens
aaggtcatggcaaattactttt

SEQ ID NO: 8347374 - DNA, 22 bp, Homo sapiens
aaggtcattggttctgaattct

SEQ ID NO: 8347375 - DNA, 22 bp, Homo sapiens
aaggtcatttaacaatttatga

SEQ ID NO: 8347376 - DNA, 22 bp, Homo sapiens
aaggtcattgttgcatgttctc

SEQ ID NO: 8347377 - DNA, 22 bp, Homo sapiens
aaggtcattgttgcatgttctc

SEQ ID NO: 8347378 - DNA, 22 bp, Homo sapiens
aaggtattttctaatgtatact

SEQ ID NO: 8347379 - DNA, 22 bp, Homo sapiens
aaggtattattgtctatgtact

SEQ ID NO: 8347380 - DNA, 22 bp, Homo sapiens
aaggtattgttccctagtttct

SEQ ID NO: 8347381 - DNA, 22 bp, Homo sapiens
aacaaatgataccagttctcaa

SEQ ID NO: 8347382 - DNA, 22 bp, Homo sapiens
aacaaatgacctgatttcttcc

SEQ ID NO: 8347383 - DNA, 22 bp, Homo sapiens
aacaaatgattgttggttggag

SEQ ID NO: 8347384 - DNA, 22 bp, Homo sapiens
aacaaatggaacacaaatcttt

SEQ ID NO: 8347385 - DNA, 22 bp, Homo sapiens
aacaaatggggccttgtatgaa

SEQ ID NO: 8347386 - DNA, 22 bp, Homo sapiens
aacaaatgtaaaatgcagatgc

SEQ ID NO: 8347387 - DNA, 22 bp, Homo sapiens
aacactaacatatagtcagtgg

SEQ ID NO: 8347388 - DNA, 22 bp, Homo sapiens
aaaagtattggccaccatttct

SEQ ID NO: 8347389 - DNA, 22 bp, Homo sapiens
aaactctaggacgatgggatag

SEQ ID NO: 8347390 - DNA, 22 bp, Homo sapiens
aaactctacatggtcgcaaaaa

SEQ ID NO: 8347391 - DNA, 22 bp, Homo sapiens
aaactagattaccactgctaga

SEQ ID NO: 8347392 - DNA, 22 bp, Homo sapiens
aaacccagagactagaaagacc

SEQ ID NO: 8347393 - DNA, 22 bp, Homo sapiens
aaacccagagactagaaagacc

SEQ ID NO: 8347394 - DNA, 22 bp, Homo sapiens
aaactagccacacagaatacac

SEQ ID NO: 8347395 - DNA, 22 bp, Homo sapiens
aaactagccaaggagagataga

SEQ ID NO: 8347396 - DNA, 21 bp, Homo sapiens
aaactagcagcaaccatgatc

SEQ ID NO: 8347397 - DNA, 22 bp, Homo sapiens
aaactcagaaggtacagaaggg

SEQ ID NO: 8347398 - DNA, 22 bp, Homo sapiens
aaactcagaaggtacagaaggg

SEQ ID NO: 8347399 - DNA, 22 bp, Homo sapiens
aaacaagagtcttgctccacct

SEQ ID NO: 8347400 - DNA, 22 bp, Homo sapiens
aaacaagcaagcacataatttt

SEQ ID NO: 8347401 - DNA, 22 bp, Homo sapiens
aaacaagctgcagacaagccat

SEQ ID NO: 8347402 - DNA, 22 bp, Homo sapiens
aaaatctgcttccttttacaga

SEQ ID NO: 8347403 - DNA, 22 bp, Homo sapiens
aaagacctgaaatataatctag

SEQ ID NO: 8347404 - DNA, 22 bp, Homo sapiens
aaagacattagcttagatgtca

SEQ ID NO: 8347405 - DNA, 22 bp, Homo sapiens
aaaatccacaacgctcatttca

SEQ ID NO: 8347406 - DNA, 23 bp, Homo sapiens
aaaatcattaatttaccctgaaa

SEQ ID NO: 8347407 - DNA, 22 bp, Homo sapiens
aaagactaaccagttgtcaaaa

SEQ ID NO: 8347408 - DNA, 22 bp, Homo sapiens
aaagactaaccagttgtcaaaa

SEQ ID NO: 8347409 - DNA, 22 bp, Homo sapiens
aaagactaagaagagtattatt

SEQ ID NO: 8347410 - DNA, 22 bp, Homo sapiens
aaaatcagtacactttattttg

SEQ ID NO: 8347411 - DNA, 22 bp, Homo sapiens
aaaatagttaacgttcagagta

SEQ ID NO: 8347412 - DNA, 22 bp, Homo sapiens
aaaatctggtaatttgaatgtg

SEQ ID NO: 8347413 - DNA, 22 bp, Homo sapiens
aaaaacagaatgtgtctaactc

SEQ ID NO: 8347414 - DNA, 20 bp, Homo sapiens
aaaaacagtaatgctgaaga

SEQ ID NO: 8347415 - DNA, 22 bp, Homo sapiens
aaaaaatcagatctttggttaa

SEQ ID NO: 8347416 - DNA, 22 bp, Homo sapiens
aaacacttcaaggacttctgtc

SEQ ID NO: 8347417 - DNA, 22 bp, Homo sapiens
aaacagaagggtaggtaaacat

SEQ ID NO: 8347418 - DNA, 22 bp, Homo sapiens
aaacagaagggtaggtaaacat

SEQ ID NO: 8347419 - DNA, 21 bp, Homo sapiens
aaacagagctgagtaatagat

SEQ ID NO: 8347420 - DNA, 22 bp, Homo sapiens
aaaatgacattccagtgatatt

SEQ ID NO: 8347421 - DNA, 22 bp, Homo sapiens
aaaaatagaaggattgactgag

SEQ ID NO: 8347422 - DNA, 22 bp, Homo sapiens
aaaatgaataagttaacccagg

SEQ ID NO: 8347423 - DNA, 22 bp, Homo sapiens
aaaaataggtcaaccgtgtatg

SEQ ID NO: 8347424 - DNA, 22 bp, Homo sapiens
aaaaataggtcaaccgtgtatg

SEQ ID NO: 8347425 - DNA, 22 bp, Homo sapiens
aaaaatagcttctcttgtccct

SEQ ID NO: 8347426 - DNA, 22 bp, Homo sapiens
aaaaatagcttctcttgtccct

SEQ ID NO: 8347427 - DNA, 22 bp, Homo sapiens
aaaaatagaaggattgactgag

SEQ ID NO: 8347428 - DNA, 22 bp, Homo sapiens
aaaaatagaaggattgactgag

SEQ ID NO: 8347429 - DNA, 22 bp, Homo sapiens
aaaaatcacttttataggcagc

SEQ ID NO: 8347430 - DNA, 22 bp, Homo sapiens
aaagaatgtctgaacagctggc

SEQ ID NO: 8347431 - DNA, 22 bp, Homo sapiens
aaagaatcacatccttcagcaa

SEQ ID NO: 8347432 - DNA, 22 bp, Homo sapiens
aaagaatagttaagtttagggc

SEQ ID NO: 8347433 - DNA, 22 bp, Homo sapiens
aaagaatagcctttgtccaaat

SEQ ID NO: 8347434 - DNA, 22 bp, Homo sapiens
aaactgataaaataagtacatt

SEQ ID NO: 8347435 - DNA, 22 bp, Homo sapiens
aaactgaattcccaagggcatg

SEQ ID NO: 8347436 - DNA, 22 bp, Homo sapiens
aaactgaggcaggggatgatta

SEQ ID NO: 8347437 - DNA, 17 bp, Homo sapiens
aaactgaaaaattcact

SEQ ID NO: 8347438 - DNA, 22 bp, Homo sapiens
aaactgaaacatcatcatgttg

SEQ ID NO: 8347439 - DNA, 22 bp, Homo sapiens
aaatgcagatccctgaatctca

SEQ ID NO: 8347440 - DNA, 22 bp, Homo sapiens
aaagagttacacagtttcagaa

SEQ ID NO: 8347441 - DNA, 22 bp, Homo sapiens
aaagagttgttgtataacagga

SEQ ID NO: 8347442 - DNA, 22 bp, Homo sapiens
aaagagttgaggcagttatcca

SEQ ID NO: 8347443 - DNA, 22 bp, Homo sapiens
aaactagatgattatgaagcat

SEQ ID NO: 8347444 - DNA, 22 bp, Homo sapiens
aaacccagggttttgtcttccc

SEQ ID NO: 8347445 - DNA, 22 bp, Homo sapiens
aaacagtgatgttgagtgtaaa

SEQ ID NO: 8347446 - DNA, 22 bp, Homo sapiens
aaacaatgtctaaggtgcacag

SEQ ID NO: 8347447 - DNA, 22 bp, Homo sapiens
aaacaatgtagattaccattta

SEQ ID NO: 8347448 - DNA, 22 bp, Homo sapiens
aaacaatgttcctatattagag

SEQ ID NO: 8347449 - DNA, 22 bp, Homo sapiens
aaacaatgaaattcattcttca

SEQ ID NO: 8347450 - DNA, 22 bp, Homo sapiens
aaacaatgagcttttacacact

SEQ ID NO: 8347451 - DNA, 22 bp, Homo sapiens
aaacagttaattgctttcagtt

SEQ ID NO: 8347452 - DNA, 22 bp, Homo sapiens
aaacagttacgagcgcagacct

SEQ ID NO: 8347453 - DNA, 22 bp, Homo sapiens
aaacagtggccaattctggaga

SEQ ID NO: 8347454 - DNA, 22 bp, Homo sapiens
aaacagtttcattttcatgacc

SEQ ID NO: 8347455 - DNA, 22 bp, Homo sapiens
aaacagtttcattttcatgacc

SEQ ID NO: 8347456 - DNA, 22 bp, Homo sapiens
aaacagtttcattttcatgacc

SEQ ID NO: 8347457 - DNA, 22 bp, Homo sapiens
aaacagtttataacatgatact

SEQ ID NO: 8347458 - DNA, 22 bp, Homo sapiens
aaacagtttataacatgatact

SEQ ID NO: 8347459 - DNA, 22 bp, Homo sapiens
aaacagttctcatttgtttaga

SEQ ID NO: 8347460 - DNA, 22 bp, Homo sapiens
aaaggtcagctgccatcgttct

SEQ ID NO: 8347461 - DNA, 22 bp, Homo sapiens
aaaggtcattgaaaaggaggaa

SEQ ID NO: 8347462 - DNA, 22 bp, Homo sapiens
aaaggtcaagctggactcaggt

SEQ ID NO: 8347463 - DNA, 22 bp, Homo sapiens
aaaggtcagacttaggctgggc

SEQ ID NO: 8347464 - DNA, 22 bp, Homo sapiens
aaaggtcaaaatcgtgacattg

SEQ ID NO: 8347465 - DNA, 22 bp, Homo sapiens
aaaggtaactggggttttgcca

SEQ ID NO: 8347466 - DNA, 22 bp, Homo sapiens
aaaggtaaagtatctgcccaag

SEQ ID NO: 8347467 - DNA, 22 bp, Homo sapiens
aaacagttttcctagctgtctg

SEQ ID NO: 8347468 - DNA, 22 bp, Homo sapiens
aaacagttttcctagctgtctg

SEQ ID NO: 8347469 - DNA, 22 bp, Homo sapiens
aaacagtttctaatcatggaga

SEQ ID NO: 8347470 - DNA, 22 bp, Homo sapiens
aaacagtttctaatcatggaga

SEQ ID NO: 8347471 - DNA, 22 bp, Homo sapiens
aaataattatagcgagtctatc

SEQ ID NO: 8347472 - DNA, 22 bp, Homo sapiens
aaataagttagcagattccagt

SEQ ID NO: 8347473 - DNA, 22 bp, Homo sapiens
aaataagtgtgggccagtcaaa

SEQ ID NO: 8347474 - DNA, 22 bp, Homo sapiens
aaataagttaaactagaatgat

SEQ ID NO: 8347475 - DNA, 22 bp, Homo sapiens
aaataagaaattcttctttgca

SEQ ID NO: 8347476 - DNA, 22 bp, Homo sapiens
aaataagaaattcttctttgca

SEQ ID NO: 8347477 - DNA, 22 bp, Homo sapiens
aaataagaggacagatgtttgg

SEQ ID NO: 8347478 - DNA, 22 bp, Homo sapiens
aaataagaggacagatgtttgg

SEQ ID NO: 8347479 - DNA, 22 bp, Homo sapiens
aaataagaggacagatgtttgg

SEQ ID NO: 8347480 - DNA, 22 bp, Homo sapiens
aaagtgtttttgagctgtagtt

SEQ ID NO: 8347481 - DNA, 22 bp, Homo sapiens
aaagtgttttgtgagcagtctg

SEQ ID NO: 8347482 - DNA, 22 bp, Homo sapiens
aaagtgttgggattacaggtgt

SEQ ID NO: 8347483 - DNA, 22 bp, Homo sapiens
aaagtgttgggattataggcgt

SEQ ID NO: 8347484 - DNA, 22 bp, Homo sapiens
aaagtgttgggattacaggcat

SEQ ID NO: 8347485 - DNA, 22 bp, Homo sapiens
aaagtgtttacattgctataag

SEQ ID NO: 8347486 - DNA, 22 bp, Homo sapiens
aaagtgttaacactggctactt

SEQ ID NO: 8347487 - DNA, 22 bp, Homo sapiens
aaagtgtactatgtcatgaaca

SEQ ID NO: 8347488 - DNA, 22 bp, Homo sapiens
aaagtgttatgcaaaactctgt

SEQ ID NO: 8347489 - DNA, 22 bp, Homo sapiens
aaagtgttgatatgtgacatcc

SEQ ID NO: 8347490 - DNA, 22 bp, Homo sapiens
aaagtgttgattttatagtgca

SEQ ID NO: 8347491 - DNA, 22 bp, Homo sapiens
aaatagcattgtatttagctga

SEQ ID NO: 8347492 - DNA, 22 bp, Homo sapiens
aaatagcttttcataattctca

SEQ ID NO: 8347493 - DNA, 23 bp, Homo sapiens
aaataggagtatctggatcatga

SEQ ID NO: 8347494 - DNA, 22 bp, Homo sapiens
aaataggagcttaagcacttct

SEQ ID NO: 8347495 - DNA, 22 bp, Homo sapiens
aaatcagatgcttcctagttgg

SEQ ID NO: 8347496 - DNA, 22 bp, Homo sapiens
aaatcagattatttgattggca

SEQ ID NO: 8347497 - DNA, 23 bp, Homo sapiens
aaataggagtatctggatcatga

SEQ ID NO: 8347498 - DNA, 22 bp, Homo sapiens
aaatcagagtggttggtcatcc

SEQ ID NO: 8347499 - DNA, 22 bp, Homo sapiens
aaatcagtaaatgttcattaac

SEQ ID NO: 8347500 - DNA, 22 bp, Homo sapiens
aaatcccactcagaaactgcca

SEQ ID NO: 8347501 - DNA, 22 bp, Homo sapiens
aaatagagctgggttaaacttt

SEQ ID NO: 8347502 - DNA, 22 bp, Homo sapiens
aaatagagctgggttaaacttt

SEQ ID NO: 8347503 - DNA, 22 bp, Homo sapiens
aaatactgtagataatagagtt

SEQ ID NO: 8347504 - DNA, 22 bp, Homo sapiens
aaataattatagcgagtctatc

SEQ ID NO: 8347505 - DNA, 22 bp, Homo sapiens
aaatacaaaaattagccaggca

SEQ ID NO: 8347506 - DNA, 22 bp, Homo sapiens
aaatgcatcagctcataagaga

SEQ ID NO: 8347507 - DNA, 22 bp, Homo sapiens
aaatgcaggtagtatttatttt

SEQ ID NO: 8347508 - DNA, 22 bp, Homo sapiens
aaatgcaccttgctgtgagact

SEQ ID NO: 8347509 - DNA, 22 bp, Homo sapiens
aaatctaggctcatcctggtcc

SEQ ID NO: 8347510 - DNA, 22 bp, Homo sapiens
aagcacagagaggtaaagtaac

SEQ ID NO: 8347511 - DNA, 22 bp, Homo sapiens
aagcacagataaaacaggattc

SEQ ID NO: 8347512 - DNA, 22 bp, Homo sapiens
aagcacagaccagatctccagg

SEQ ID NO: 8347513 - DNA, 22 bp, Homo sapiens
aaatgtatcctacttcctgagt

SEQ ID NO: 8347514 - DNA, 22 bp, Homo sapiens
aaatgtagttgaaaagttaagg

SEQ ID NO: 8347515 - DNA, 22 bp, Homo sapiens
aaatgtagtatgttgcatgtat

SEQ ID NO: 8347516 - DNA, 22 bp, Homo sapiens
aaatgtactgatacttatttta

SEQ ID NO: 8347517 - DNA, 18 bp, Homo sapiens
aaatgtactgtccatggc

SEQ ID NO: 8347518 - DNA, 22 bp, Homo sapiens
aaatgtactgatacttatttta

SEQ ID NO: 8347519 - DNA, 22 bp, Homo sapiens
aaatgtacgggagtagaattag

SEQ ID NO: 8347520 - DNA, 22 bp, Homo sapiens
aaatgtaccttgatagtttggt

SEQ ID NO: 8347521 - DNA, 22 bp, Homo sapiens
aaatgtacactttgcatcttga

SEQ ID NO: 8347522 - DNA, 22 bp, Homo sapiens
aaatgtaccttgatagtttggt

SEQ ID NO: 8347523 - DNA, 22 bp, Homo sapiens
aaatgtacaacatccatatata

SEQ ID NO: 8347524 - DNA, 22 bp, Homo sapiens
aaatgtacactttgcatcttga

SEQ ID NO: 8347525 - DNA, 22 bp, Homo sapiens
aaatgtacaacatccatatata

SEQ ID NO: 8347526 - DNA, 22 bp, Homo sapiens
aagcatctaggtgactgacata

SEQ ID NO: 8347527 - DNA, 22 bp, Homo sapiens
aagcatcattcacttccttctg

SEQ ID NO: 8347528 - DNA, 20 bp, Homo sapiens
aagcatctggatgtagcaat

SEQ ID NO: 8347529 - DNA, 22 bp, Homo sapiens
aagcatcttaaaaagtatcaga

SEQ ID NO: 8347530 - DNA, 22 bp, Homo sapiens
aagcatcttctatcagttagac

SEQ ID NO: 8347531 - DNA, 19 bp, Homo sapiens
aagcatctttgaaactggg

SEQ ID NO: 8347532 - DNA, 22 bp, Homo sapiens
aagcatgcactccaaacagctt

SEQ ID NO: 8347533 - DNA, 22 bp, Homo sapiens
aagcatgagctttcaaaccaga

SEQ ID NO: 8347534 - DNA, 22 bp, Homo sapiens
aaagatacttaatagttgtctg

SEQ ID NO: 8347535 - DNA, 22 bp, Homo sapiens
aaagatacttaatagttgtctg

SEQ ID NO: 8347536 - DNA, 22 bp, Homo sapiens
aacaaaagccgaagtaggtgtc

SEQ ID NO: 8347537 - DNA, 22 bp, Homo sapiens
aaattttgtattctagttctag

SEQ ID NO: 8347538 - DNA, 22 bp, Homo sapiens
aaattgtgctcacactgatatt

SEQ ID NO: 8347539 - DNA, 22 bp, Homo sapiens
aaagccagttcttagagaaagc

SEQ ID NO: 8347540 - DNA, 22 bp, Homo sapiens
aaagccagttcttagagaaagc

SEQ ID NO: 8347541 - DNA, 22 bp, Homo sapiens
aaagccagttcttttatattgg

SEQ ID NO: 8347542 - DNA, 22 bp, Homo sapiens
aaagccagttcttttatattgg

SEQ ID NO: 8347543 - DNA, 22 bp, Homo sapiens
aaagccataagcctaatactaa

SEQ ID NO: 8347544 - DNA, 20 bp, Homo sapiens
aaagatactttttgtaatgg

SEQ ID NO: 8347545 - DNA, 22 bp, Homo sapiens
aacagatggccaagtgcatggg

SEQ ID NO: 8347546 - DNA, 22 bp, Homo sapiens
aacagatggccaagtgcatggg

SEQ ID NO: 8347547 - DNA, 22 bp, Homo sapiens
aacagattgtaacctgatagcc

SEQ ID NO: 8347548 - DNA, 22 bp, Homo sapiens
aacagagtttcaaataacatct

SEQ ID NO: 8347549 - DNA, 22 bp, Homo sapiens
aacagagtttcaaataacatct

SEQ ID NO: 8347550 - DNA, 22 bp, Homo sapiens
aacagcaatagcactattcatt

SEQ ID NO: 8347551 - DNA, 22 bp, Homo sapiens
aacagcagcaagtaagcaggtc

SEQ ID NO: 8347552 - DNA, 22 bp, Homo sapiens
aaagctcttttccaagtattga

SEQ ID NO: 8347553 - DNA, 22 bp, Homo sapiens
aaagtactttgggctatgtttg

SEQ ID NO: 8347554 - DNA, 22 bp, Homo sapiens
aactaaatgtgtatctactcaa

SEQ ID NO: 8347555 - DNA, 22 bp, Homo sapiens
aaagtaattgtggtttctgtca

SEQ ID NO: 8347556 - DNA, 22 bp, Homo sapiens
aaagtaattgtggtttctgtca

SEQ ID NO: 8347557 - DNA, 22 bp, Homo sapiens
aaagtacaaggaaaggatctga

SEQ ID NO: 8347558 - DNA, 22 bp, Homo sapiens
aactaaatctggcatttagagc

SEQ ID NO: 8347559 - DNA, 22 bp, Homo sapiens
aaaggaagatctatacacccca

SEQ ID NO: 8347560 - DNA, 22 bp, Homo sapiens
aaaggaagatgccaggactctg

SEQ ID NO: 8347561 - DNA, 22 bp, Homo sapiens
aaagtagagttgtggaattact

SEQ ID NO: 8347562 - DNA, 22 bp, Homo sapiens
aaagtatttttgacaggcatta

SEQ ID NO: 8347563 - DNA, 22 bp, Homo sapiens
aaagtatttgtgatttttacca

SEQ ID NO: 8347564 - DNA, 22 bp, Homo sapiens
aaagtattcaaaaatatttggt

SEQ ID NO: 8347565 - DNA, 22 bp, Homo sapiens
aaagtgtaaaagcatgttaggg

SEQ ID NO: 8347566 - DNA, 20 bp, Homo sapiens
aaagtgtaagcatataatta

SEQ ID NO: 8347567 - DNA, 22 bp, Homo sapiens
acacaggaactctgagaggtgg

SEQ ID NO: 8347568 - DNA, 22 bp, Homo sapiens
acaatttcttatagttcaattc

SEQ ID NO: 8347569 - DNA, 22 bp, Homo sapiens
acaatttctaatatagatctta

SEQ ID NO: 8347570 - DNA, 22 bp, Homo sapiens
acaattttccccataggttatc

SEQ ID NO: 8347571 - DNA, 22 bp, Homo sapiens
acacaggagaaaagatctccca

SEQ ID NO: 8347572 - DNA, 22 bp, Homo sapiens
acacaggacggccctgtggctt

SEQ ID NO: 8347573 - DNA, 22 bp, Homo sapiens
acacaggacggccctgtggctt

SEQ ID NO: 8347574 - DNA, 23 bp, Homo sapiens
acacaggatacatacggaagcaa

SEQ ID NO: 8347575 - DNA, 21 bp, Homo sapiens
acacaggagtttcttctttct

SEQ ID NO: 8347576 - DNA, 22 bp, Homo sapiens
acaatttatccattgtatagtt

SEQ ID NO: 8347577 - DNA, 22 bp, Homo sapiens
agcaccccatagtcagtcacgt

SEQ ID NO: 8347578 - DNA, 22 bp, Homo sapiens
acacatatgtatgcatcatgtg

SEQ ID NO: 8347579 - DNA, 22 bp, Homo sapiens
acacatatctaagatagatgac

SEQ ID NO: 8347580 - DNA, 22 bp, Homo sapiens
agcagcagtcatgcctatgctc

SEQ ID NO: 8347581 - DNA, 22 bp, Homo sapiens
agcagcagtcatgcctatgctc

SEQ ID NO: 8347582 - DNA, 22 bp, Homo sapiens
acagaaattagcagtgagttta

SEQ ID NO: 8347583 - DNA, 19 bp, Homo sapiens
acagaaattagttattttc

SEQ ID NO: 8347584 - DNA, 22 bp, Homo sapiens
acagaaattctgggacagaaaa

SEQ ID NO: 8347585 - DNA, 22 bp, Homo sapiens
acagaaattgctaatagctcat

SEQ ID NO: 8347586 - DNA, 22 bp, Homo sapiens
acagaaattgggcaaatggaag

SEQ ID NO: 8347587 - DNA, 20 bp, Homo sapiens
agcagtgtggggagactgtg

SEQ ID NO: 8347588 - DNA, 22 bp, Homo sapiens
agcagttactagttaaatgcat

SEQ ID NO: 8347589 - DNA, 22 bp, Homo sapiens
agcagtgggtgacagagctgag

SEQ ID NO: 8347590 - DNA, 22 bp, Homo sapiens
acactgtgcttagatgctgaac

SEQ ID NO: 8347591 - DNA, 22 bp, Homo sapiens
acaccagggatatgaggaagga

SEQ ID NO: 8347592 - DNA, 22 bp, Homo sapiens
acacattatctcattaaatact

SEQ ID NO: 8347593 - DNA, 22 bp, Homo sapiens
agcagggcagttaaagggtcct

SEQ ID NO: 8347594 - DNA, 22 bp, Homo sapiens
acagagttgtaaacatttacca

SEQ ID NO: 8347595 - DNA, 22 bp, Homo sapiens
agcccctgggagtagctgctgc

SEQ ID NO: 8347596 - DNA, 22 bp, Homo sapiens
agccccctccctagtgactgga

SEQ ID NO: 8347597 - DNA, 22 bp, Homo sapiens
agcccctctccgccctgagtcg

SEQ ID NO: 8347598 - DNA, 22 bp, Homo sapiens
acagagcatataaagtgctttg

SEQ ID NO: 8347599 - DNA, 22 bp, Homo sapiens
acagagcatataaagtgctttg

SEQ ID NO: 8347600 - DNA, 22 bp, Homo sapiens
acagagaggtaaaatatatagt

SEQ ID NO: 8347601 - DNA, 22 bp, Homo sapiens
agccattgaatttagtgccttt

SEQ ID NO: 8347602 - DNA, 22 bp, Homo sapiens
agccattgagttttatgtgcta

SEQ ID NO: 8347603 - DNA, 22 bp, Homo sapiens
agccatgcaccttactcttgct

SEQ ID NO: 8347604 - DNA, 22 bp, Homo sapiens
agccatggcgccactagaggga

SEQ ID NO: 8347605 - DNA, 21 bp, Homo sapiens
agccagggtggacactgtatg

SEQ ID NO: 8347606 - DNA, 22 bp, Homo sapiens
agccacagtcaacctgtccata

SEQ ID NO: 8347607 - DNA, 22 bp, Homo sapiens
agctctgggggaaagtctgctc

SEQ ID NO: 8347608 - DNA, 22 bp, Homo sapiens
agctctgggggaaagtctgctc

SEQ ID NO: 8347609 - DNA, 18 bp, Homo sapiens
agctctggggagatgggc

SEQ ID NO: 8347610 - DNA, 18 bp, Homo sapiens
agctctggggagatgggc

SEQ ID NO: 8347611 - DNA, 22 bp, Homo sapiens
acagcagctaaaggtgtctcct

SEQ ID NO: 8347612 - DNA, 22 bp, Homo sapiens
acagcaggagccttcatatgct

SEQ ID NO: 8347613 - DNA, 22 bp, Homo sapiens
agctatttctcttattatatcc

SEQ ID NO: 8347614 - DNA, 22 bp, Homo sapiens
agctcaaagctgttacattgta

SEQ ID NO: 8347615 - DNA, 22 bp, Homo sapiens
agctcctgtgtgcccacctgct

SEQ ID NO: 8347616 - DNA, 22 bp, Homo sapiens
agctagggctttcgtagacagt

SEQ ID NO: 8347617 - DNA, 22 bp, Homo sapiens
agctagtatttcattgaggatt

SEQ ID NO: 8347618 - DNA, 21 bp, Homo sapiens
acagcaagccttcctttcagg

SEQ ID NO: 8347619 - DNA, 21 bp, Homo sapiens
acagattgctgagctctacct

SEQ ID NO: 8347620 - DNA, 22 bp, Homo sapiens
acaattactcaactttgctgct

SEQ ID NO: 8347621 - DNA, 22 bp, Homo sapiens
agcacaggtacggagatgctac

SEQ ID NO: 8347622 - DNA, 22 bp, Homo sapiens
agcaccatcagatgcaatatct

SEQ ID NO: 8347623 - DNA, 22 bp, Homo sapiens
agcaaggaaactatggagagat

SEQ ID NO: 8347624 - DNA, 22 bp, Homo sapiens
acaaggaacaagcatgtagttt

SEQ ID NO: 8347625 - DNA, 22 bp, Homo sapiens
acaaattgaccgcaagattcat

SEQ ID NO: 8347626 - DNA, 22 bp, Homo sapiens
agatggggctcagtgtggaggc

SEQ ID NO: 8347627 - DNA, 22 bp, Homo sapiens
agatggggcagaatggagccat

SEQ ID NO: 8347628 - DNA, 22 bp, Homo sapiens
agatggggcagaatggagccat

SEQ ID NO: 8347629 - DNA, 22 bp, Homo sapiens
agatggggcagaatggagccat

SEQ ID NO: 8347630 - DNA, 22 bp, Homo sapiens
acaaactaaaattctttattga

SEQ ID NO: 8347631 - DNA, 22 bp, Homo sapiens
acaaactaaaattctttattga

SEQ ID NO: 8347632 - DNA, 22 bp, Homo sapiens
acaaacagagttgaaaaatagg

SEQ ID NO: 8347633 - DNA, 22 bp, Homo sapiens
acaaatgcagcataaagtgaac

SEQ ID NO: 8347634 - DNA, 22 bp, Homo sapiens
acaaatgcttagttcaccaaaa

SEQ ID NO: 8347635 - DNA, 23 bp, Homo sapiens
acaaatgcccatacatctagttc

SEQ ID NO: 8347636 - DNA, 22 bp, Homo sapiens
acaaatgccatatataaattct

SEQ ID NO: 8347637 - DNA, 19 bp, Homo sapiens
acaaatgatgttgcactga

SEQ ID NO: 8347638 - DNA, 19 bp, Homo sapiens
acaaatagttacatatcct

SEQ ID NO: 8347639 - DNA, 22 bp, Homo sapiens
acaaatatggtactcggagaaa

SEQ ID NO: 8347640 - DNA, 21 bp, Homo sapiens
acaaactgaaatgagtttcct

SEQ ID NO: 8347641 - DNA, 22 bp, Homo sapiens
acaaactacctacagatgttca

SEQ ID NO: 8347642 - DNA, 19 bp, Homo sapiens
acaaactgagtacacttgt

SEQ ID NO: 8347643 - DNA, 22 bp, Homo sapiens
acaaactgggataggatcctgt

SEQ ID NO: 8347644 - DNA, 22 bp, Homo sapiens
acaaactgaatgggttttctgt

SEQ ID NO: 8347645 - DNA, 22 bp, Homo sapiens
aattttatgccttgcacgttgg

SEQ ID NO: 8347646 - DNA, 22 bp, Homo sapiens
aattttattaactggatgtagc

SEQ ID NO: 8347647 - DNA, 22 bp, Homo sapiens
aattttattagaaggcaagggg

SEQ ID NO: 8347648 - DNA, 22 bp, Homo sapiens
agagctgggtggtggtgactca

SEQ ID NO: 8347649 - DNA, 22 bp, Homo sapiens
agagctggggccagagtcaagg

SEQ ID NO: 8347650 - DNA, 22 bp, Homo sapiens
agaggccatgctagaggcctgg

SEQ ID NO: 8347651 - DNA, 20 bp, Homo sapiens
agaggccagttaggagtcta

SEQ ID NO: 8347652 - DNA, 22 bp, Homo sapiens
aatgcaaagcaagcagagattt

SEQ ID NO: 8347653 - DNA, 22 bp, Homo sapiens
aatgcaagatcaaatctaacac

SEQ ID NO: 8347654 - DNA, 22 bp, Homo sapiens
aatgcaaacttcttgttacttg

SEQ ID NO: 8347655 - DNA, 21 bp, Homo sapiens
agaagggattgtggtaaagat

SEQ ID NO: 8347656 - DNA, 22 bp, Homo sapiens
agaagggctacacgggctctcc

SEQ ID NO: 8347657 - DNA, 21 bp, Homo sapiens
agacagagtgcagtctacata

SEQ ID NO: 8347658 - DNA, 22 bp, Homo sapiens
aatgtcttacatttactgagca

SEQ ID NO: 8347659 - DNA, 22 bp, Homo sapiens
aatgtcatttttaaatgtgaga

SEQ ID NO: 8347660 - DNA, 22 bp, Homo sapiens
agacagggccactcatcctcac

SEQ ID NO: 8347661 - DNA, 22 bp, Homo sapiens
agacagggagggagcgcggctg

SEQ ID NO: 8347662 - DNA, 22 bp, Homo sapiens
aatgtattctctttataagata

SEQ ID NO: 8347663 - DNA, 22 bp, Homo sapiens
aatgtattctctttataagata

SEQ ID NO: 8347664 - DNA, 22 bp, Homo sapiens
aatgtcatagcatttcttcaat

SEQ ID NO: 8347665 - DNA, 22 bp, Homo sapiens
aatttacagttgctgatggtac

SEQ ID NO: 8347666 - DNA, 20 bp, Homo sapiens
aatttactcacagaatgaat

SEQ ID NO: 8347667 - DNA, 22 bp, Homo sapiens
aatttacaggtgcactcgccat

SEQ ID NO: 8347668 - DNA, 22 bp, Homo sapiens
aatttacacttcatttggaggg

SEQ ID NO: 8347669 - DNA, 22 bp, Homo sapiens
agagctgggacttggactcaat

SEQ ID NO: 8347670 - DNA, 22 bp, Homo sapiens
aatttatatgtaattaggcaca

SEQ ID NO: 8347671 - DNA, 22 bp, Homo sapiens
aattatattgtggtgtgaatgt

SEQ ID NO: 8347672 - DNA, 22 bp, Homo sapiens
aattatatgttaatcttcaatt

SEQ ID NO: 8347673 - DNA, 20 bp, Homo sapiens
aattatataactccaacatt

SEQ ID NO: 8347674 - DNA, 20 bp, Homo sapiens
aattatataactccaacatt

SEQ ID NO: 8347675 - DNA, 22 bp, Homo sapiens
aattatattgaagttgaatgtc

SEQ ID NO: 8347676 - DNA, 22 bp, Homo sapiens
aatgttcagtatctggtccacc

SEQ ID NO: 8347677 - DNA, 22 bp, Homo sapiens
aatgttgtgcatgtattttgta

SEQ ID NO: 8347678 - DNA, 22 bp, Homo sapiens
aatgttgttggctcttcatgat

SEQ ID NO: 8347679 - DNA, 22 bp, Homo sapiens
aattaccaggatttttcagtat

SEQ ID NO: 8347680 - DNA, 22 bp, Homo sapiens
aattaccatcgtcaaatcatat

SEQ ID NO: 8347681 - DNA, 22 bp, Homo sapiens
aagtcacactagacaactgagg

SEQ ID NO: 8347682 - DNA, 22 bp, Homo sapiens
aagtcacaagcatatatgcatt

SEQ ID NO: 8347683 - DNA, 22 bp, Homo sapiens
aagtcacaaagtgctgtacatg

SEQ ID NO: 8347684 - DNA, 23 bp, Homo sapiens
aagtacatatatttagatagtga

SEQ ID NO: 8347685 - DNA, 22 bp, Homo sapiens
aagtacatcctagtctctttca

SEQ ID NO: 8347686 - DNA, 22 bp, Homo sapiens
aagtacagagcctcagtttgac

SEQ ID NO: 8347687 - DNA, 22 bp, Homo sapiens
aagtacagaatcattggaagca

SEQ ID NO: 8347688 - DNA, 22 bp, Homo sapiens
aagtacatgttgttcaaaagcc

SEQ ID NO: 8347689 - DNA, 22 bp, Homo sapiens
aagtacatgctgtaatgattgg

SEQ ID NO: 8347690 - DNA, 22 bp, Homo sapiens
aagggctgagcacagtgagcca

SEQ ID NO: 8347691 - DNA, 22 bp, Homo sapiens
accatcagtcattgtcagtggg

SEQ ID NO: 8347692 - DNA, 22 bp, Homo sapiens
aaggtggggtcctgtcatctga

SEQ ID NO: 8347693 - DNA, 18 bp, Homo sapiens
aaggcttcaaagagtaga

SEQ ID NO: 8347694 - DNA, 22 bp, Homo sapiens
aaggctgtccaggagaaaatag

SEQ ID NO: 8347695 - DNA, 22 bp, Homo sapiens
aaggctggtttccttgatgttt

SEQ ID NO: 8347696 - DNA, 22 bp, Homo sapiens
aagggactttgtcagctttcca

SEQ ID NO: 8347697 - DNA, 22 bp, Homo sapiens
aagggagaaaacttgtggctta

SEQ ID NO: 8347698 - DNA, 22 bp, Homo sapiens
aagggcccattctctcagaaaa

SEQ ID NO: 8347699 - DNA, 22 bp, Homo sapiens
aagggcccggctgtgggcagag

SEQ ID NO: 8347700 - DNA, 22 bp, Homo sapiens
aagggcccttctgttagtggca

SEQ ID NO: 8347701 - DNA, 22 bp, Homo sapiens
aagggctcacccaactcacttc

SEQ ID NO: 8347702 - DNA, 22 bp, Homo sapiens
aagggctccacttgaatcacac

SEQ ID NO: 8347703 - DNA, 22 bp, Homo sapiens
aagggcccagccaagctatgct

SEQ ID NO: 8347704 - DNA, 22 bp, Homo sapiens
acagtactctaatgaaaagtgc

SEQ ID NO: 8347705 - DNA, 22 bp, Homo sapiens
acagtacaggacgagttttcct

SEQ ID NO: 8347706 - DNA, 22 bp, Homo sapiens
acagtacaggacgagttttcct

SEQ ID NO: 8347707 - DNA, 22 bp, Homo sapiens
acagtacagctgaaactttagt

SEQ ID NO: 8347708 - DNA, 22 bp, Homo sapiens
acagggctcgtcgggccctcgg

SEQ ID NO: 8347709 - DNA, 22 bp, Homo sapiens
aaggaaagacatataaatgact

SEQ ID NO: 8347710 - DNA, 22 bp, Homo sapiens
aaggaaagacatataaatgact

SEQ ID NO: 8347711 - DNA, 22 bp, Homo sapiens
aaggaaagattctctctctaga

SEQ ID NO: 8347712 - DNA, 22 bp, Homo sapiens
aagccagggtcaggggcctcct

SEQ ID NO: 8347713 - DNA, 22 bp, Homo sapiens
aagccaggctgcacttgctggg

SEQ ID NO: 8347714 - DNA, 22 bp, Homo sapiens
aagccaggccattctctggttc

SEQ ID NO: 8347715 - DNA, 22 bp, Homo sapiens
aagccagggtttgtggatctat

SEQ ID NO: 8347716 - DNA, 22 bp, Homo sapiens
acaggcaggtcctgtcccagct

SEQ ID NO: 8347717 - DNA, 22 bp, Homo sapiens
acagtactgagtactgagttgg

SEQ ID NO: 8347718 - DNA, 22 bp, Homo sapiens
acagtagagtaaatggttagat

SEQ ID NO: 8347719 - DNA, 22 bp, Homo sapiens
acagtagaccctggataaacat

SEQ ID NO: 8347720 - DNA, 22 bp, Homo sapiens
acagtataaactcctaaaagcc

SEQ ID NO: 8347721 - DNA, 22 bp, Homo sapiens
acagtagctaatattgcattat

SEQ ID NO: 8347722 - DNA, 22 bp, Homo sapiens
aaggaacctgagggaccccaaa

SEQ ID NO: 8347723 - DNA, 22 bp, Homo sapiens
aaggaaccatttgtgtgcatgg

SEQ ID NO: 8347724 - DNA, 22 bp, Homo sapiens
aaggaacctggagtagagggag

SEQ ID NO: 8347725 - DNA, 19 bp, Homo sapiens
aaggaaccctgggttgctc

SEQ ID NO: 8347726 - DNA, 22 bp, Homo sapiens
aaggaacctctaagcctctgtt

SEQ ID NO: 8347727 - DNA, 22 bp, Homo sapiens
aaggcacttttctaaagacctt

SEQ ID NO: 8347728 - DNA, 22 bp, Homo sapiens
aaggcacttttcctgagatgat

SEQ ID NO: 8347729 - DNA, 21 bp, Homo sapiens
aaggcagaagcatggaatgag

SEQ ID NO: 8347730 - DNA, 22 bp, Homo sapiens
aaggcactacgctgctggggcg

SEQ ID NO: 8347731 - DNA, 22 bp, Homo sapiens
aaggaagaagactctttactcc

SEQ ID NO: 8347732 - DNA, 22 bp, Homo sapiens
aaggcacttgcccagagctgca

SEQ ID NO: 8347733 - DNA, 22 bp, Homo sapiens
aaggaagaaatgaataggtgga

SEQ ID NO: 8347734 - DNA, 22 bp, Homo sapiens
aaggaacctgggaacctatcat

SEQ ID NO: 8347735 - DNA, 22 bp, Homo sapiens
acagttgttttccagatatgtt

SEQ ID NO: 8347736 - DNA, 22 bp, Homo sapiens
acagttgttttccagatatgtt

SEQ ID NO: 8347737 - DNA, 22 bp, Homo sapiens
aaggcagccgtgtgactgcatg

SEQ ID NO: 8347738 - DNA, 22 bp, Homo sapiens
acagtttacagggatttgagct

SEQ ID NO: 8347739 - DNA, 22 bp, Homo sapiens
acagttcttaaaacttgaatta

SEQ ID NO: 8347740 - DNA, 22 bp, Homo sapiens
acagttctttgtttatagcttg

SEQ ID NO: 8347741 - DNA, 22 bp, Homo sapiens
acagttctgcctgtttgagaag

SEQ ID NO: 8347742 - DNA, 22 bp, Homo sapiens
acagttctgagctataattgct

SEQ ID NO: 8347743 - DNA, 23 bp, Homo sapiens
acagttctctgatgggtttaaca

SEQ ID NO: 8347744 - DNA, 22 bp, Homo sapiens
acagttctccagtgcctttgag

SEQ ID NO: 8347745 - DNA, 22 bp, Homo sapiens
acagttctaaatcttggataat

SEQ ID NO: 8347746 - DNA, 22 bp, Homo sapiens
aatgaacatataaagagatctt

SEQ ID NO: 8347747 - DNA, 22 bp, Homo sapiens
aatgaacagatacacataggca

SEQ ID NO: 8347748 - DNA, 22 bp, Homo sapiens
aatgaacaggtgaatgtcagat

SEQ ID NO: 8347749 - DNA, 22 bp, Homo sapiens
aatgaacagtgggtgaggtacc

SEQ ID NO: 8347750 - DNA, 22 bp, Homo sapiens
agaaatacaaagtactaagata

SEQ ID NO: 8347751 - DNA, 22 bp, Homo sapiens
agaaataagagctttccttggg

SEQ ID NO: 8347752 - DNA, 20 bp, Homo sapiens
agaaataccacatttggcaa

SEQ ID NO: 8347753 - DNA, 18 bp, Homo sapiens
agaaataccagtattgga

SEQ ID NO: 8347754 - DNA, 18 bp, Homo sapiens
agaaataccagtattgga

SEQ ID NO: 8347755 - DNA, 22 bp, Homo sapiens
agaaaacagaaagtcattggtg

SEQ ID NO: 8347756 - DNA, 22 bp, Homo sapiens
agaaaacataggagacaggaaa

SEQ ID NO: 8347757 - DNA, 22 bp, Homo sapiens
agaaaacataggagacaggaaa

SEQ ID NO: 8347758 - DNA, 22 bp, Homo sapiens
agaaaactctacatctgtatgt

SEQ ID NO: 8347759 - DNA, 22 bp, Homo sapiens
agaaaactctacatctgtatgt

SEQ ID NO: 8347760 - DNA, 22 bp, Homo sapiens
aatgaaactcgaaataatcaca

SEQ ID NO: 8347761 - DNA, 22 bp, Homo sapiens
aatgacctgggtgtcatttcat

SEQ ID NO: 8347762 - DNA, 22 bp, Homo sapiens
agaaatactgcctaagactgta

SEQ ID NO: 8347763 - DNA, 22 bp, Homo sapiens
agaaatacttaatctttgcagg

SEQ ID NO: 8347764 - DNA, 22 bp, Homo sapiens
aatgagaatgtaagtgaagaga

SEQ ID NO: 8347765 - DNA, 22 bp, Homo sapiens
aatgagatcagagataactcaa

SEQ ID NO: 8347766 - DNA, 22 bp, Homo sapiens
aatgagaaaacacagaggaggt

SEQ ID NO: 8347767 - DNA, 22 bp, Homo sapiens
aatgagaaccttgaaaggaact

SEQ ID NO: 8347768 - DNA, 22 bp, Homo sapiens
aatgagttagatgagaaaataa

SEQ ID NO: 8347769 - DNA, 22 bp, Homo sapiens
agaagggaactcagagatgatt

SEQ ID NO: 8347770 - DNA, 22 bp, Homo sapiens
aatgagatggcaatgacttaaa

SEQ ID NO: 8347771 - DNA, 22 bp, Homo sapiens
aatgagatggaggactcttaat

SEQ ID NO: 8347772 - DNA, 22 bp, Homo sapiens
aatgagattccaatagctcctg

SEQ ID NO: 8347773 - DNA, 21 bp, Homo sapiens
aatgaggcaaggaggaggata

SEQ ID NO: 8347774 - DNA, 22 bp, Homo sapiens
aatgaggcttgtggggtagggc

SEQ ID NO: 8347775 - DNA, 20 bp, Homo sapiens
aatgaggcaatggagggcat

SEQ ID NO: 8347776 - DNA, 22 bp, Homo sapiens
aatattctaataaatgcccatc

SEQ ID NO: 8347777 - DNA, 19 bp, Homo sapiens
aatattttagcctcttcct

SEQ ID NO: 8347778 - DNA, 19 bp, Homo sapiens
aatattttagcctcttcct

SEQ ID NO: 8347779 - DNA, 22 bp, Homo sapiens
aatatatttgaatcaggaacaa

SEQ ID NO: 8347780 - DNA, 22 bp, Homo sapiens
aatatatagaagtacccgttgt

SEQ ID NO: 8347781 - DNA, 22 bp, Homo sapiens
aatatatagaagtacccgttgt

SEQ ID NO: 8347782 - DNA, 22 bp, Homo sapiens
aatacagagaatgttatttgga

SEQ ID NO: 8347783 - DNA, 22 bp, Homo sapiens
aatacagagaatgttatttgga

SEQ ID NO: 8347784 - DNA, 22 bp, Homo sapiens
acttcctggcgtagctgacatt

SEQ ID NO: 8347785 - DNA, 22 bp, Homo sapiens
acttcctgctatgagcttctgt

SEQ ID NO: 8347786 - DNA, 22 bp, Homo sapiens
acttcctgctatgagcttctgt

SEQ ID NO: 8347787 - DNA, 22 bp, Homo sapiens
acttcctggattcccaagggct

SEQ ID NO: 8347788 - DNA, 22 bp, Homo sapiens
acttcctggattcccaagggct

SEQ ID NO: 8347789 - DNA, 22 bp, Homo sapiens
acttcctggcgtagctgacatt

SEQ ID NO: 8347790 - DNA, 22 bp, Homo sapiens
aatattttaggctttccaggct

SEQ ID NO: 8347791 - DNA, 22 bp, Homo sapiens
aatatttgttagtgttttaatg

SEQ ID NO: 8347792 - DNA, 22 bp, Homo sapiens
aatattttaggctttccaggct

SEQ ID NO: 8347793 - DNA, 22 bp, Homo sapiens
aatatttttgaggccctgttat

SEQ ID NO: 8347794 - DNA, 22 bp, Homo sapiens
acttgtgtaacacagaaagaac

SEQ ID NO: 8347795 - DNA, 22 bp, Homo sapiens
acttgtaaacaaatctaatgta

SEQ ID NO: 8347796 - DNA, 22 bp, Homo sapiens
aatcaagagctgactatatttt

SEQ ID NO: 8347797 - DNA, 22 bp, Homo sapiens
aatcaagaataagttgtaaagc

SEQ ID NO: 8347798 - DNA, 22 bp, Homo sapiens
aatcaagaaaatgaggattctt

SEQ ID NO: 8347799 - DNA, 22 bp, Homo sapiens
actttaaaaagagccttctaac

SEQ ID NO: 8347800 - DNA, 22 bp, Homo sapiens
aatcataattgtatacattcat

SEQ ID NO: 8347801 - DNA, 22 bp, Homo sapiens
acttgtttgaatctctctagag

SEQ ID NO: 8347802 - DNA, 22 bp, Homo sapiens
acttgtttggagccagctgtaa

SEQ ID NO: 8347803 - DNA, 22 bp, Homo sapiens
acttgtttggtctcatgtttaa

SEQ ID NO: 8347804 - DNA, 22 bp, Homo sapiens
aagtcacagctaaatagctaag

SEQ ID NO: 8347805 - DNA, 22 bp, Homo sapiens
aagtcacagaacccattgtaac

SEQ ID NO: 8347806 - DNA, 22 bp, Homo sapiens
actaaatggaatgattactata

SEQ ID NO: 8347807 - DNA, 23 bp, Homo sapiens
actaaatggggctttgcttaaag

SEQ ID NO: 8347808 - DNA, 22 bp, Homo sapiens
actaaatgctgcataaatgctt

SEQ ID NO: 8347809 - DNA, 22 bp, Homo sapiens
actaaatgctgcataaatgctt

SEQ ID NO: 8347810 - DNA, 22 bp, Homo sapiens
actaaatggaatgattactata

SEQ ID NO: 8347811 - DNA, 22 bp, Homo sapiens
actaaatgaactattaatactt

SEQ ID NO: 8347812 - DNA, 22 bp, Homo sapiens
actaaatgaactattaatactt

SEQ ID NO: 8347813 - DNA, 22 bp, Homo sapiens
actaaatgcattggtatctatt

SEQ ID NO: 8347814 - DNA, 22 bp, Homo sapiens
aagttattgcagcaatccaagt

SEQ ID NO: 8347815 - DNA, 22 bp, Homo sapiens
actaaggaatatgacaaactca

SEQ ID NO: 8347816 - DNA, 22 bp, Homo sapiens
actaacttgctgagtgaccatg

SEQ ID NO: 8347817 - DNA, 22 bp, Homo sapiens
actacacagggatgtgactacc

SEQ ID NO: 8347818 - DNA, 20 bp, Homo sapiens
actccaggtggcatgaggac

SEQ ID NO: 8347819 - DNA, 22 bp, Homo sapiens
actcccaggttgcctggcaggc

SEQ ID NO: 8347820 - DNA, 22 bp, Homo sapiens
actcccagaacatgctcttctt

SEQ ID NO: 8347821 - DNA, 22 bp, Homo sapiens
aataatgttgacgatagtctta

SEQ ID NO: 8347822 - DNA, 20 bp, Homo sapiens
actgccttggttcagtaggt

SEQ ID NO: 8347823 - DNA, 22 bp, Homo sapiens
actgccttgtctcttgcctgtt

SEQ ID NO: 8347824 - DNA, 22 bp, Homo sapiens
actgcgctccagcctgggtgac

SEQ ID NO: 8347825 - DNA, 22 bp, Homo sapiens
aataatagttgcaaagtgttta

SEQ ID NO: 8347826 - DNA, 22 bp, Homo sapiens
actgccttgaaagattgttgag

SEQ ID NO: 8347827 - DNA, 22 bp, Homo sapiens
actgccttctttaatcctagtt

SEQ ID NO: 8347828 - DNA, 22 bp, Homo sapiens
actgccttatatgctgtgtgtg

SEQ ID NO: 8347829 - DNA, 22 bp, Homo sapiens
actgccttagaacaaagcagga

SEQ ID NO: 8347830 - DNA, 22 bp, Homo sapiens
actgccttcatgcagacccctg

SEQ ID NO: 8347831 - DNA, 22 bp, Homo sapiens
aagttgtagatgaagtaattca

SEQ ID NO: 8347832 - DNA, 22 bp, Homo sapiens
aagttgtaacagaaatttaatg

SEQ ID NO: 8347833 - DNA, 22 bp, Homo sapiens
aagttggtaggagacagaaggt

SEQ ID NO: 8347834 - DNA, 22 bp, Homo sapiens
aagttggttctgtgacatgttg

SEQ ID NO: 8347835 - DNA, 22 bp, Homo sapiens
aagttggtgtatgagacagaag

SEQ ID NO: 8347836 - DNA, 22 bp, Homo sapiens
aagttgtatgtcttagaaagta

SEQ ID NO: 8347837 - DNA, 22 bp, Homo sapiens
aagttgttgttgaggtgggtaa

SEQ ID NO: 8347838 - DNA, 22 bp, Homo sapiens
aagtttaacttgaattctttct

SEQ ID NO: 8347839 - DNA, 20 bp, Homo sapiens
aagtttcatgctctggggat

SEQ ID NO: 8347840 - DNA, 22 bp, Homo sapiens
aagtttcattgttcatgtaaca

SEQ ID NO: 8347841 - DNA, 22 bp, Homo sapiens
aagtttcatgacttggttatta

SEQ ID NO: 8347842 - DNA, 22 bp, Homo sapiens
aagtttcaagaggttctttgaa

SEQ ID NO: 8347843 - DNA, 22 bp, Homo sapiens
aagtttcaaatgttgattatgc

SEQ ID NO: 8347844 - DNA, 22 bp, Homo sapiens
aataagaattgccagatttgaa

SEQ ID NO: 8347845 - DNA, 22 bp, Homo sapiens
aataagaattgccagatttgaa

SEQ ID NO: 8347846 - DNA, 22 bp, Homo sapiens
atgcacctgaactccatcagct

SEQ ID NO: 8347847 - DNA, 22 bp, Homo sapiens
atgcacatcttacagatgcaga

SEQ ID NO: 8347848 - DNA, 22 bp, Homo sapiens
agacatttattgaacacctagc

SEQ ID NO: 8347849 - DNA, 22 bp, Homo sapiens
agacatttcctagacatcaatg

SEQ ID NO: 8347850 - DNA, 22 bp, Homo sapiens
agacatttggaagatacacata

SEQ ID NO: 8347851 - DNA, 22 bp, Homo sapiens
agacagctgggaaatggagtgt

SEQ ID NO: 8347852 - DNA, 22 bp, Homo sapiens
agacagcatgatacatgatgct

SEQ ID NO: 8347853 - DNA, 22 bp, Homo sapiens
agacagctatcaacaactttct

SEQ ID NO: 8347854 - DNA, 22 bp, Homo sapiens
atgaacaatctgttgacttctg

SEQ ID NO: 8347855 - DNA, 22 bp, Homo sapiens
agacaaaccttgttttatgatg

SEQ ID NO: 8347856 - DNA, 22 bp, Homo sapiens
agacaaagaaaccgtagaagca

SEQ ID NO: 8347857 - DNA, 22 bp, Homo sapiens
agacaaatttcctgcaatgaag

SEQ ID NO: 8347858 - DNA, 22 bp, Homo sapiens
agacaaatggtaattatgtcta

SEQ ID NO: 8347859 - DNA, 22 bp, Homo sapiens
agacaaatggagtatgagcaac

SEQ ID NO: 8347860 - DNA, 22 bp, Homo sapiens
agacaaaggattaatgatgatg

SEQ ID NO: 8347861 - DNA, 22 bp, Homo sapiens
atgaaattttaattatacctct

SEQ ID NO: 8347862 - DNA, 23 bp, Homo sapiens
atgaaagttcttaaaatgtcatg

SEQ ID NO: 8347863 - DNA, 22 bp, Homo sapiens
atgaaattgatcttgaactttt

SEQ ID NO: 8347864 - DNA, 20 bp, Homo sapiens
atgaaattcctgttttctga

SEQ ID NO: 8347865 - DNA, 22 bp, Homo sapiens
atgaaatttgaccaattattta

SEQ ID NO: 8347866 - DNA, 22 bp, Homo sapiens
atgaaactgggataactatagc

SEQ ID NO: 8347867 - DNA, 22 bp, Homo sapiens
atgaaagcaggaattgttctgt

SEQ ID NO: 8347868 - DNA, 22 bp, Homo sapiens
atgaaagcaacttatttgagat

SEQ ID NO: 8347869 - DNA, 22 bp, Homo sapiens
atgaaagtgtttaagtttatgt

SEQ ID NO: 8347870 - DNA, 22 bp, Homo sapiens
atgaaagtgaaggtttactaag

SEQ ID NO: 8347871 - DNA, 22 bp, Homo sapiens
atctttgttgctctcatttctg

SEQ ID NO: 8347872 - DNA, 22 bp, Homo sapiens
atctttgttatctcagatcttg

SEQ ID NO: 8347873 - DNA, 22 bp, Homo sapiens
atctttgttatctcagatcttg

SEQ ID NO: 8347874 - DNA, 22 bp, Homo sapiens
agaagtttggtcctataaactc

SEQ ID NO: 8347875 - DNA, 22 bp, Homo sapiens
agaagtatttggctaaaagaca

SEQ ID NO: 8347876 - DNA, 22 bp, Homo sapiens
atctcagacatgttgtccatga

SEQ ID NO: 8347877 - DNA, 22 bp, Homo sapiens
agagaccttcctgactccagag

SEQ ID NO: 8347878 - DNA, 22 bp, Homo sapiens
agagaccttttgccttctagtt

SEQ ID NO: 8347879 - DNA, 22 bp, Homo sapiens
atggcctggccagagctctgct

SEQ ID NO: 8347880 - DNA, 22 bp, Homo sapiens
atggcctgggcccgcttcagat

SEQ ID NO: 8347881 - DNA, 22 bp, Homo sapiens
agagacagggttttgtcgtgtt

SEQ ID NO: 8347882 - DNA, 22 bp, Homo sapiens
agagaagattcttatatgtctt

SEQ ID NO: 8347883 - DNA, 19 bp, Homo sapiens
agagaccacagagctgcct

SEQ ID NO: 8347884 - DNA, 22 bp, Homo sapiens
agagacccattgccggaatcac

SEQ ID NO: 8347885 - DNA, 22 bp, Homo sapiens
agagacccgcagcctcggagct

SEQ ID NO: 8347886 - DNA, 22 bp, Homo sapiens
agaccatggccatcctaggaaa

SEQ ID NO: 8347887 - DNA, 22 bp, Homo sapiens
agaccagggtcccacagagtct

SEQ ID NO: 8347888 - DNA, 22 bp, Homo sapiens
agaccaggtctttatggctcca

SEQ ID NO: 8347889 - DNA, 22 bp, Homo sapiens
agacattttggaaagtattact

SEQ ID NO: 8347890 - DNA, 22 bp, Homo sapiens
agacattttggaaagtattact

SEQ ID NO: 8347891 - DNA, 22 bp, Homo sapiens
agaccacaggcatgcacagagc

SEQ ID NO: 8347892 - DNA, 22 bp, Homo sapiens
agacattttacattcttccatt

SEQ ID NO: 8347893 - DNA, 22 bp, Homo sapiens
agagaagagcaatgataaattt

SEQ ID NO: 8347894 - DNA, 22 bp, Homo sapiens
agagaagacttacagccacagt

SEQ ID NO: 8347895 - DNA, 22 bp, Homo sapiens
atgtggggacaaaatgatggcc

SEQ ID NO: 8347896 - DNA, 22 bp, Homo sapiens
atgtgggccttcaggagaaaga

SEQ ID NO: 8347897 - DNA, 22 bp, Homo sapiens
atgtgtaatgtggtattttaat

SEQ ID NO: 8347898 - DNA, 22 bp, Homo sapiens
agagcctgttcggaggcgcccc

SEQ ID NO: 8347899 - DNA, 22 bp, Homo sapiens
agagcctgtctgcctttctacc

SEQ ID NO: 8347900 - DNA, 22 bp, Homo sapiens
atgtattttaagatttgcctca

SEQ ID NO: 8347901 - DNA, 22 bp, Homo sapiens
atgtattttgccagactgtctc

SEQ ID NO: 8347902 - DNA, 22 bp, Homo sapiens
atgtattttgccagactgtctc

SEQ ID NO: 8347903 - DNA, 22 bp, Homo sapiens
agagcctgggcagctcctctgg

SEQ ID NO: 8347904 - DNA, 22 bp, Homo sapiens
atgtatttgcttgttatggatt

SEQ ID NO: 8347905 - DNA, 22 bp, Homo sapiens
atgtatttgcgtatggacatac

SEQ ID NO: 8347906 - DNA, 22 bp, Homo sapiens
atgtatttgcgaggttaggaaa

SEQ ID NO: 8347907 - DNA, 22 bp, Homo sapiens
agagccaagttgtcaaggcact

SEQ ID NO: 8347908 - DNA, 22 bp, Homo sapiens
agagccaaggctgagagctatt

SEQ ID NO: 8347909 - DNA, 22 bp, Homo sapiens
agagccaaggctgagagctatt

SEQ ID NO: 8347910 - DNA, 22 bp, Homo sapiens
agagccaatcttcagagcagag

SEQ ID NO: 8347911 - DNA, 22 bp, Homo sapiens
agagccagaccattgccgtgca

SEQ ID NO: 8347912 - DNA, 22 bp, Homo sapiens
atggggtggagtccgggcagcg

SEQ ID NO: 8347913 - DNA, 22 bp, Homo sapiens
agagccaaggcctcagtctcaa

SEQ ID NO: 8347914 - DNA, 22 bp, Homo sapiens
agagcatctaacacataagcct

SEQ ID NO: 8347915 - DNA, 22 bp, Homo sapiens
agagatgaatcttgagactctg

SEQ ID NO: 8347916 - DNA, 22 bp, Homo sapiens
agagatgaatcttgagactctg

SEQ ID NO: 8347917 - DNA, 22 bp, Homo sapiens
agagatgaatcttgagactctg

SEQ ID NO: 8347918 - DNA, 22 bp, Homo sapiens
atggggctgttctctgccctgc

SEQ ID NO: 8347919 - DNA, 22 bp, Homo sapiens
atgtttactggtttatagaata

SEQ ID NO: 8347920 - DNA, 22 bp, Homo sapiens
agagctggtttactcaggaatt

SEQ ID NO: 8347921 - DNA, 22 bp, Homo sapiens
agagctggtgcatattcagaaa

SEQ ID NO: 8347922 - DNA, 21 bp, Homo sapiens
attattataaagaccacaggg

SEQ ID NO: 8347923 - DNA, 22 bp, Homo sapiens
attattataaagtgcatgacct

SEQ ID NO: 8347924 - DNA, 22 bp, Homo sapiens
attattatatagggaaagtccc

SEQ ID NO: 8347925 - DNA, 22 bp, Homo sapiens
attattaaagcttaggtcttat

SEQ ID NO: 8347926 - DNA, 22 bp, Homo sapiens
agaggaggctgggtccagataa

SEQ ID NO: 8347927 - DNA, 22 bp, Homo sapiens
attattcaaattcccactatac

SEQ ID NO: 8347928 - DNA, 22 bp, Homo sapiens
agaggaggccaggcccacacct

SEQ ID NO: 8347929 - DNA, 22 bp, Homo sapiens
agaggaggctctgggatcgtcc

SEQ ID NO: 8347930 - DNA, 22 bp, Homo sapiens
agaggaggccaggcccacacct

SEQ ID NO: 8347931 - DNA, 22 bp, Homo sapiens
agaggaggatttgtaaaggtct

SEQ ID NO: 8347932 - DNA, 22 bp, Homo sapiens
agaggaggcagcttaactcagt

SEQ ID NO: 8347933 - DNA, 22 bp, Homo sapiens
agaggagctgggaggccctcgt

SEQ ID NO: 8347934 - DNA, 22 bp, Homo sapiens
agaggaggaagagctttaaaat

SEQ ID NO: 8347935 - DNA, 20 bp, Homo sapiens
agaggaggattattttattc

SEQ ID NO: 8347936 - DNA, 22 bp, Homo sapiens
attcatttgctattgtgtatgg

SEQ ID NO: 8347937 - DNA, 22 bp, Homo sapiens
attcatttgctattgtgtatgg

SEQ ID NO: 8347938 - DNA, 22 bp, Homo sapiens
attcatttagagggattaagca

SEQ ID NO: 8347939 - DNA, 21 bp, Homo sapiens
agaggcggggttttggaggcc

SEQ ID NO: 8347940 - DNA, 22 bp, Homo sapiens
agaggcggaggttgcagtgagc

SEQ ID NO: 8347941 - DNA, 22 bp, Homo sapiens
agaggcggagcttgcagtgagc

SEQ ID NO: 8347942 - DNA, 22 bp, Homo sapiens
agaggcctttctgttgagtgaa

SEQ ID NO: 8347943 - DNA, 22 bp, Homo sapiens
attcattctgacctcaagagaa

SEQ ID NO: 8347944 - DNA, 19 bp, Homo sapiens
attcattggccagggtggt

SEQ ID NO: 8347945 - DNA, 22 bp, Homo sapiens
attcagtaggtctagaataaga

SEQ ID NO: 8347946 - DNA, 22 bp, Homo sapiens
attcagtaggtctagaataaga

SEQ ID NO: 8347947 - DNA, 22 bp, Homo sapiens
attcatgtaacattagagaaat

SEQ ID NO: 8347948 - DNA, 22 bp, Homo sapiens
agaggctgtctcatattttgta

SEQ ID NO: 8347949 - DNA, 22 bp, Homo sapiens
agaggctgtgcagagggagtgc

SEQ ID NO: 8347950 - DNA, 20 bp, Homo sapiens
attccatagttggcactttt

SEQ ID NO: 8347951 - DNA, 22 bp, Homo sapiens
agatacattgttctaagcattg

SEQ ID NO: 8347952 - DNA, 22 bp, Homo sapiens
agatactacatgaatgggaatt

SEQ ID NO: 8347953 - DNA, 22 bp, Homo sapiens
agatacgcggctcttttcttga

SEQ ID NO: 8347954 - DNA, 22 bp, Homo sapiens
agatactatggaattttatgag

SEQ ID NO: 8347955 - DNA, 22 bp, Homo sapiens
atttcctcatgatcataatgca

SEQ ID NO: 8347956 - DNA, 17 bp, Homo sapiens
atttcctcagggctgag

SEQ ID NO: 8347957 - DNA, 22 bp, Homo sapiens
atttcctgacttccattgaggc

SEQ ID NO: 8347958 - DNA, 22 bp, Homo sapiens
atttcctgatctgtaaaatagc

SEQ ID NO: 8347959 - DNA, 22 bp, Homo sapiens
atttcctgatttgtaaaattcc

SEQ ID NO: 8347960 - DNA, 22 bp, Homo sapiens
atttcctggttgcattggcttt

SEQ ID NO: 8347961 - DNA, 22 bp, Homo sapiens
atttctcattttgcttcaaagg

SEQ ID NO: 8347962 - DNA, 22 bp, Homo sapiens
atttctcatgtacaaaaacact

SEQ ID NO: 8347963 - DNA, 22 bp, Homo sapiens
atttctcttagcaagacattac

SEQ ID NO: 8347964 - DNA, 21 bp, Homo sapiens
caaaaggataggaaattaggg

SEQ ID NO: 8347965 - DNA, 22 bp, Homo sapiens
caaaagtaccttgtgtgctttg

SEQ ID NO: 8347966 - DNA, 22 bp, Homo sapiens
caaaagtaatgtatgctcatcg

SEQ ID NO: 8347967 - DNA, 22 bp, Homo sapiens
caaaagtaatcgtggcttttgc

SEQ ID NO: 8347968 - DNA, 22 bp, Homo sapiens
atttgttgaataaattagtatt

SEQ ID NO: 8347969 - DNA, 22 bp, Homo sapiens
atttgtgccaaattatttctaa

SEQ ID NO: 8347970 - DNA, 22 bp, Homo sapiens
atttgtgaattaagcatgtcaa

SEQ ID NO: 8347971 - DNA, 22 bp, Homo sapiens
atttggctgggtgttagaaaga

SEQ ID NO: 8347972 - DNA, 22 bp, Homo sapiens
atttggcacagcttttcctacc

SEQ ID NO: 8347973 - DNA, 22 bp, Homo sapiens
atttggcagtataaattctggc

SEQ ID NO: 8347974 - DNA, 22 bp, Homo sapiens
atttcactctccctgccactta

SEQ ID NO: 8347975 - DNA, 22 bp, Homo sapiens
atttcactcattcatgttactt

SEQ ID NO: 8347976 - DNA, 22 bp, Homo sapiens
atttcactcttaattgcttcct

SEQ ID NO: 8347977 - DNA, 22 bp, Homo sapiens
atttcacagctgctgttcaggt

SEQ ID NO: 8347978 - DNA, 22 bp, Homo sapiens
atttcacagctgtcagtgttac

SEQ ID NO: 8347979 - DNA, 22 bp, Homo sapiens
atttcacatctatctcagattt

SEQ ID NO: 8347980 - DNA, 22 bp, Homo sapiens
atttcacagctgtcagtgttac

SEQ ID NO: 8347981 - DNA, 22 bp, Homo sapiens
agatacattagtagttacttgt

SEQ ID NO: 8347982 - DNA, 22 bp, Homo sapiens
agatacatcatttataccttca

SEQ ID NO: 8347983 - DNA, 22 bp, Homo sapiens
agatacatcatttataccttca

SEQ ID NO: 8347984 - DNA, 22 bp, Homo sapiens
agatacatcatttataccttca

SEQ ID NO: 8347985 - DNA, 22 bp, Homo sapiens
agatacatcttgaacttctaga

SEQ ID NO: 8347986 - DNA, 22 bp, Homo sapiens
agatacatcttgaacttctaga

SEQ ID NO: 8347987 - DNA, 17 bp, Homo sapiens
atttcacttagcatgag

SEQ ID NO: 8347988 - DNA, 22 bp, Homo sapiens
atttcacttagtgtaatgtctt

SEQ ID NO: 8347989 - DNA, 21 bp, Homo sapiens
atttcagaaatattggtggga

SEQ ID NO: 8347990 - DNA, 20 bp, Homo sapiens
agatacagtttaattactct

SEQ ID NO: 8347991 - DNA, 22 bp, Homo sapiens
agataaattcctaagatttcag

SEQ ID NO: 8347992 - DNA, 22 bp, Homo sapiens
atttcacaaagaacagatgcag

SEQ ID NO: 8347993 - DNA, 22 bp, Homo sapiens
atttcacagcgtggttgactgc

SEQ ID NO: 8347994 - DNA, 22 bp, Homo sapiens
agataaaatgattttctggatc

SEQ ID NO: 8347995 - DNA, 22 bp, Homo sapiens
agaggtcttcacatggcaatga

SEQ ID NO: 8347996 - DNA, 22 bp, Homo sapiens
agagttcttgccctagaaaatg

SEQ ID NO: 8347997 - DNA, 22 bp, Homo sapiens
agagttggagaaattaaaattt

SEQ ID NO: 8347998 - DNA, 19 bp, Homo sapiens
agagttgggcactgtttca

SEQ ID NO: 8347999 - DNA, 22 bp, Homo sapiens
attgctgaacttataaatgaat

SEQ ID NO: 8348000 - DNA, 22 bp, Homo sapiens
agaggtatgtgtcagtgcttat

SEQ ID NO: 8348001 - DNA, 22 bp, Homo sapiens
agaggtattgcacgtgctctct

SEQ ID NO: 8348002 - DNA, 22 bp, Homo sapiens
agaggtccccagatgattccag

SEQ ID NO: 8348003 - DNA, 22 bp, Homo sapiens
agcagggctttgtctctgtgaa

SEQ ID NO: 8348004 - DNA, 22 bp, Homo sapiens
agcaggggctcctccacagcca

SEQ ID NO: 8348005 - DNA, 22 bp, Homo sapiens
agcagggggccacagtcacagc

SEQ ID NO: 8348006 - DNA, 22 bp, Homo sapiens
cacctctgcctcaagcttccca

SEQ ID NO: 8348007 - DNA, 22 bp, Homo sapiens
cactgcacttcagcctgggtga

SEQ ID NO: 8348008 - DNA, 22 bp, Homo sapiens
cactgctttaaggctgagtaac

SEQ ID NO: 8348009 - DNA, 22 bp, Homo sapiens
agcatagaataagctgaagtca

SEQ ID NO: 8348010 - DNA, 22 bp, Homo sapiens
agcatagaaaagattcccagag

SEQ ID NO: 8348011 - DNA, 19 bp, Homo sapiens
agcatagacttctcaggaa

SEQ ID NO: 8348012 - DNA, 20 bp, Homo sapiens
agcatagagcaccagaaggc

SEQ ID NO: 8348013 - DNA, 19 bp, Homo sapiens
agcatagacttctcaggaa

SEQ ID NO: 8348014 - DNA, 22 bp, Homo sapiens
cactgcttctggaggaatttgg

SEQ ID NO: 8348015 - DNA, 22 bp, Homo sapiens
cactgcttataaattctaggca

SEQ ID NO: 8348016 - DNA, 22 bp, Homo sapiens
cactgcttagttggtaaatgtg

SEQ ID NO: 8348017 - DNA, 22 bp, Homo sapiens
cactgctgtttttaccacactg

SEQ ID NO: 8348018 - DNA, 22 bp, Homo sapiens
cactgctacctctgcctcccgg

SEQ ID NO: 8348019 - DNA, 22 bp, Homo sapiens
cacagtttcaataattattctt

SEQ ID NO: 8348020 - DNA, 22 bp, Homo sapiens
cacagtttcaataattattctt

SEQ ID NO: 8348021 - DNA, 22 bp, Homo sapiens
cacagtttcaataattattctt

SEQ ID NO: 8348022 - DNA, 22 bp, Homo sapiens
cacagtttatgatctcagtgaa

SEQ ID NO: 8348023 - DNA, 22 bp, Homo sapiens
cacagtttctataggtcagaat

SEQ ID NO: 8348024 - DNA, 22 bp, Homo sapiens
cacagttatgggaaacgtagtt

SEQ ID NO: 8348025 - DNA, 16 bp, Homo sapiens
cacagttatgggtgtg

SEQ ID NO: 8348026 - DNA, 22 bp, Homo sapiens
cacagtttctgaacactttgca

SEQ ID NO: 8348027 - DNA, 22 bp, Homo sapiens
cacagtttctgaacactttgca

SEQ ID NO: 8348028 - DNA, 22 bp, Homo sapiens
agcaggcagctgggggagttga

SEQ ID NO: 8348029 - DNA, 22 bp, Homo sapiens
cacagtcctacagagatcagag

SEQ ID NO: 8348030 - DNA, 22 bp, Homo sapiens
cacagttaagggatgtcatgtt

SEQ ID NO: 8348031 - DNA, 22 bp, Homo sapiens
cacagttagaggtagagtccag

SEQ ID NO: 8348032 - DNA, 22 bp, Homo sapiens
cacagttatatgttcacaagga

SEQ ID NO: 8348033 - DNA, 22 bp, Homo sapiens
cacagttagctccagtcttagc

SEQ ID NO: 8348034 - DNA, 21 bp, Homo sapiens
agcaggcaaaggtgaagtctt

SEQ ID NO: 8348035 - DNA, 22 bp, Homo sapiens
agcagctgatggggaaggagtt

SEQ ID NO: 8348036 - DNA, 22 bp, Homo sapiens
agcagctgcagggagggtctgc

SEQ ID NO: 8348037 - DNA, 22 bp, Homo sapiens
agcacagttttcattgcagggt

SEQ ID NO: 8348038 - DNA, 22 bp, Homo sapiens
agcacaggtgaaacagtcaggt

SEQ ID NO: 8348039 - DNA, 22 bp, Homo sapiens
caaatagacttcaatctcttga

SEQ ID NO: 8348040 - DNA, 22 bp, Homo sapiens
agcacatgtattctccttgaat

SEQ ID NO: 8348041 - DNA, 22 bp, Homo sapiens
caaaataccacgacttgtttta

SEQ ID NO: 8348042 - DNA, 22 bp, Homo sapiens
caaaagtagtgaagttgtacat

SEQ ID NO: 8348043 - DNA, 22 bp, Homo sapiens
agcaaagccgagacagccagtg

SEQ ID NO: 8348044 - DNA, 18 bp, Homo sapiens
agcaaagcaagagatcac

SEQ ID NO: 8348045 - DNA, 21 bp, Homo sapiens
agcacagctttaagccatgtg

SEQ ID NO: 8348046 - DNA, 22 bp, Homo sapiens
agcaaagctaccaattattgag

SEQ ID NO: 8348047 - DNA, 22 bp, Homo sapiens
agcacagcttcaccgagcccat

SEQ ID NO: 8348048 - DNA, 22 bp, Homo sapiens
caagacttcaccgctctgtgct

SEQ ID NO: 8348049 - DNA, 22 bp, Homo sapiens
caagactttggaaggctgaggc

SEQ ID NO: 8348050 - DNA, 22 bp, Homo sapiens
agcaccaggctgttggaagccc

SEQ ID NO: 8348051 - DNA, 22 bp, Homo sapiens
caactttagaccccaagtagct

SEQ ID NO: 8348052 - DNA, 23 bp, Homo sapiens
agcaccaggaacagtgtggtcct

SEQ ID NO: 8348053 - DNA, 22 bp, Homo sapiens
caaatagtttttcatgtattat

SEQ ID NO: 8348054 - DNA, 22 bp, Homo sapiens
caacagaaggtgtactactgaa

SEQ ID NO: 8348055 - DNA, 20 bp, Homo sapiens
caacagaggggtctggagta

SEQ ID NO: 8348056 - DNA, 22 bp, Homo sapiens
caacagaggagtggcctgatcc

SEQ ID NO: 8348057 - DNA, 20 bp, Homo sapiens
cacaagagaatacacactgg

SEQ ID NO: 8348058 - DNA, 21 bp, Homo sapiens
cacaagacacatagggtgttt

SEQ ID NO: 8348059 - DNA, 22 bp, Homo sapiens
cacaagacttatttgtgtagaa

SEQ ID NO: 8348060 - DNA, 22 bp, Homo sapiens
agcagcagggctctgcccgtgc

SEQ ID NO: 8348061 - DNA, 22 bp, Homo sapiens
cacaaggccctgggtcaccaca

SEQ ID NO: 8348062 - DNA, 22 bp, Homo sapiens
agcagccaaggtaacctgtgct

SEQ ID NO: 8348063 - DNA, 22 bp, Homo sapiens
agcagccaaatgaagattttac

SEQ ID NO: 8348064 - DNA, 22 bp, Homo sapiens
agcagccaaccttacattcatc

SEQ ID NO: 8348065 - DNA, 22 bp, Homo sapiens
agcagcatttaagtttcttcta

SEQ ID NO: 8348066 - DNA, 22 bp, Homo sapiens
agcagccacccagctgctcatt

SEQ ID NO: 8348067 - DNA, 22 bp, Homo sapiens
agcagccacccagctgctcatt

SEQ ID NO: 8348068 - DNA, 22 bp, Homo sapiens
agcagccacagtctgggacagg

SEQ ID NO: 8348069 - DNA, 22 bp, Homo sapiens
agcagccacagcagatctgagt

SEQ ID NO: 8348070 - DNA, 22 bp, Homo sapiens
agcagccacacgcctccttctc

SEQ ID NO: 8348071 - DNA, 22 bp, Homo sapiens
agcagccacacgcctccttctc

SEQ ID NO: 8348072 - DNA, 22 bp, Homo sapiens
agcagccaattggaggatgaag

SEQ ID NO: 8348073 - DNA, 22 bp, Homo sapiens
agcagccagaaagggcagtcga

SEQ ID NO: 8348074 - DNA, 22 bp, Homo sapiens
agcagccagaaatccagaggtg

SEQ ID NO: 8348075 - DNA, 22 bp, Homo sapiens
caagagatacatttctagtagg

SEQ ID NO: 8348076 - DNA, 22 bp, Homo sapiens
caagagcacgtgccctccataa

SEQ ID NO: 8348077 - DNA, 22 bp, Homo sapiens
caagagcatccctgcatccagc

SEQ ID NO: 8348078 - DNA, 22 bp, Homo sapiens
caagagcatccctgcatccagc

SEQ ID NO: 8348079 - DNA, 22 bp, Homo sapiens
caagagcaggtgctgcttccat

SEQ ID NO: 8348080 - DNA, 22 bp, Homo sapiens
agcagcaggaggccattgtctt

SEQ ID NO: 8348081 - DNA, 22 bp, Homo sapiens
cagcagctcactcaggtggctc

SEQ ID NO: 8348082 - DNA, 20 bp, Homo sapiens
cagcagccaaacttctattc

SEQ ID NO: 8348083 - DNA, 20 bp, Homo sapiens
cagcagccaaacttctattc

SEQ ID NO: 8348084 - DNA, 22 bp, Homo sapiens
cagcaggatatggtggagagag

SEQ ID NO: 8348085 - DNA, 22 bp, Homo sapiens
cagcagggcccccgggtgcgcc

SEQ ID NO: 8348086 - DNA, 22 bp, Homo sapiens
agcctggcactgaggcagggcg

SEQ ID NO: 8348087 - DNA, 22 bp, Homo sapiens
agcctctgtagaaagcagtgtg

SEQ ID NO: 8348088 - DNA, 22 bp, Homo sapiens
agcctctgtagaaagcagtgtg

SEQ ID NO: 8348089 - DNA, 22 bp, Homo sapiens
agcctctgtgactcacaggtca

SEQ ID NO: 8348090 - DNA, 22 bp, Homo sapiens
agcctctggccctagactgctt

SEQ ID NO: 8348091 - DNA, 22 bp, Homo sapiens
agcctctgggggagctgggagc

SEQ ID NO: 8348092 - DNA, 22 bp, Homo sapiens
agcctctggtcctccctcagct

SEQ ID NO: 8348093 - DNA, 22 bp, Homo sapiens
agcctctgctggccctggcact

SEQ ID NO: 8348094 - DNA, 22 bp, Homo sapiens
agcctctgctggccctggcact

SEQ ID NO: 8348095 - DNA, 22 bp, Homo sapiens
agcctctgcttatgcaaaggta

SEQ ID NO: 8348096 - DNA, 22 bp, Homo sapiens
agcctctgcacttcttacaggt

SEQ ID NO: 8348097 - DNA, 22 bp, Homo sapiens
agcctctgatggctcccaagga

SEQ ID NO: 8348098 - DNA, 22 bp, Homo sapiens
agcctctgcacttcttacaggt

SEQ ID NO: 8348099 - DNA, 22 bp, Homo sapiens
cagagggccccctggccacagt

SEQ ID NO: 8348100 - DNA, 22 bp, Homo sapiens
cagaggtgcatacaggtcatta

SEQ ID NO: 8348101 - DNA, 22 bp, Homo sapiens
cagcagggtatacagggaattt

SEQ ID NO: 8348102 - DNA, 22 bp, Homo sapiens
cagcagggtaggttgtatcagt

SEQ ID NO: 8348103 - DNA, 22 bp, Homo sapiens
cagcatactgcatcaaatgagg

SEQ ID NO: 8348104 - DNA, 22 bp, Homo sapiens
cagcagttttgaagtgtggaga

SEQ ID NO: 8348105 - DNA, 22 bp, Homo sapiens
cagcagttctgtactttagagt

SEQ ID NO: 8348106 - DNA, 22 bp, Homo sapiens
cagcagttatgagtagaatagt

SEQ ID NO: 8348107 - DNA, 22 bp, Homo sapiens
cagccctgagaaggaggatctc

SEQ ID NO: 8348108 - DNA, 22 bp, Homo sapiens
cagccctgagaaggaggatctc

SEQ ID NO: 8348109 - DNA, 22 bp, Homo sapiens
cagccctgcagagggcgctcct

SEQ ID NO: 8348110 - DNA, 22 bp, Homo sapiens
cagccctgcacgctgcctccgc

SEQ ID NO: 8348111 - DNA, 22 bp, Homo sapiens
cagccctgcacgctgcctccgc

SEQ ID NO: 8348112 - DNA, 23 bp, Homo sapiens
agctcctgaggccagcctctcct

SEQ ID NO: 8348113 - DNA, 22 bp, Homo sapiens
cagctaagaatgtctgagatca

SEQ ID NO: 8348114 - DNA, 19 bp, Homo sapiens
cagctcaggactcagcccc

SEQ ID NO: 8348115 - DNA, 22 bp, Homo sapiens
cagctcaggaaggaaggccggc

SEQ ID NO: 8348116 - DNA, 19 bp, Homo sapiens
cagctcaggactcagcccc

SEQ ID NO: 8348117 - DNA, 22 bp, Homo sapiens
cagctcagtctggagagatgca

SEQ ID NO: 8348118 - DNA, 22 bp, Homo sapiens
agctcagcttcctctccatgct

SEQ ID NO: 8348119 - DNA, 21 bp, Homo sapiens
agctcagccgggcacagtggc

SEQ ID NO: 8348120 - DNA, 21 bp, Homo sapiens
agctcagcaagatggaggctc

SEQ ID NO: 8348121 - DNA, 21 bp, Homo sapiens
agctcagcaagatggaggctc

SEQ ID NO: 8348122 - DNA, 22 bp, Homo sapiens
agctcagcactgtcagcactcc

SEQ ID NO: 8348123 - DNA, 22 bp, Homo sapiens
agctcagcccgttagtaagccc

SEQ ID NO: 8348124 - DNA, 22 bp, Homo sapiens
agccactggtaaactggtagga

SEQ ID NO: 8348125 - DNA, 22 bp, Homo sapiens
cagaaatatcagttgaaagtgc

SEQ ID NO: 8348126 - DNA, 22 bp, Homo sapiens
cagaaatattccaagtactgca

SEQ ID NO: 8348127 - DNA, 22 bp, Homo sapiens
cagaaatatttattgagtgaca

SEQ ID NO: 8348128 - DNA, 22 bp, Homo sapiens
cagaaatattccaagtactgca

SEQ ID NO: 8348129 - DNA, 22 bp, Homo sapiens
cagaaatattccaagtactgca

SEQ ID NO: 8348130 - DNA, 22 bp, Homo sapiens
agcatagattctttcctttgcc

SEQ ID NO: 8348131 - DNA, 22 bp, Homo sapiens
agcatagatacattgagccaca

SEQ ID NO: 8348132 - DNA, 22 bp, Homo sapiens
agcatatacaaactcatataca

SEQ ID NO: 8348133 - DNA, 22 bp, Homo sapiens
agccacagtctgtagccagctt

SEQ ID NO: 8348134 - DNA, 22 bp, Homo sapiens
agccacgtccctgtcagggtca

SEQ ID NO: 8348135 - DNA, 22 bp, Homo sapiens
agccacatgagtgagccatctt

SEQ ID NO: 8348136 - DNA, 22 bp, Homo sapiens
agccagagaacagcaggaaatg

SEQ ID NO: 8348137 - DNA, 22 bp, Homo sapiens
agccagagactgtgtctgtaat

SEQ ID NO: 8348138 - DNA, 22 bp, Homo sapiens
agccagagactttacctgtgca

SEQ ID NO: 8348139 - DNA, 22 bp, Homo sapiens
agccagagagccccaggttcta

SEQ ID NO: 8348140 - DNA, 22 bp, Homo sapiens
cagacagggttttggtctttgg

SEQ ID NO: 8348141 - DNA, 21 bp, Homo sapiens
cagaggcaggtcctgggacgg

SEQ ID NO: 8348142 - DNA, 22 bp, Homo sapiens
agcccagccggattcccagttc

SEQ ID NO: 8348143 - DNA, 22 bp, Homo sapiens
cagaggcagtggggttgctcct

SEQ ID NO: 8348144 - DNA, 20 bp, Homo sapiens
cagaggcattttcagactct

SEQ ID NO: 8348145 - DNA, 23 bp, Homo sapiens
cagaggcatcggattcaacatca

SEQ ID NO: 8348146 - DNA, 22 bp, Homo sapiens
cagagggacagtatgatgaaag

SEQ ID NO: 8348147 - DNA, 22 bp, Homo sapiens
cagagggacagtatgatgaaag

SEQ ID NO: 8348148 - DNA, 20 bp, Homo sapiens
agcccaggcctgtgtgagtc

SEQ ID NO: 8348149 - DNA, 22 bp, Homo sapiens
cagagaaagacttgcccttagt

SEQ ID NO: 8348150 - DNA, 22 bp, Homo sapiens
cagagaaagggtgaattccttc

SEQ ID NO: 8348151 - DNA, 22 bp, Homo sapiens
cagagaaaaaatcctgctctca

SEQ ID NO: 8348152 - DNA, 22 bp, Homo sapiens
cagacatggaaatttagtgtta

SEQ ID NO: 8348153 - DNA, 22 bp, Homo sapiens
cagagaaagaagcccattcatt

SEQ ID NO: 8348154 - DNA, 22 bp, Homo sapiens
cagagaaactcagatagctgat

SEQ ID NO: 8348155 - DNA, 22 bp, Homo sapiens
acctgcccacacttccttccca

SEQ ID NO: 8348156 - DNA, 22 bp, Homo sapiens
acctgcaggggtgctctctggg

SEQ ID NO: 8348157 - DNA, 22 bp, Homo sapiens
accctcccatttccatgtagca

SEQ ID NO: 8348158 - DNA, 22 bp, Homo sapiens
accctccccaagaggtcgtgcc

SEQ ID NO: 8348159 - DNA, 19 bp, Homo sapiens
accctctccccactgggtc

SEQ ID NO: 8348160 - DNA, 22 bp, Homo sapiens
acctctggccttcaggcatcat

SEQ ID NO: 8348161 - DNA, 22 bp, Homo sapiens
acctctgtatagttgcctgtgg

SEQ ID NO: 8348162 - DNA, 22 bp, Homo sapiens
aggtctcaaactggcaccctgt

SEQ ID NO: 8348163 - DNA, 22 bp, Homo sapiens
aggtctcaattcctgctcctgt

SEQ ID NO: 8348164 - DNA, 22 bp, Homo sapiens
aggtctctagaaattcagccag

SEQ ID NO: 8348165 - DNA, 22 bp, Homo sapiens
aggtggctatgaggatgcagtc

SEQ ID NO: 8348166 - DNA, 22 bp, Homo sapiens
acctggccatccagctggcatc

SEQ ID NO: 8348167 - DNA, 22 bp, Homo sapiens
aggtggcatgcctgagacataa

SEQ ID NO: 8348168 - DNA, 22 bp, Homo sapiens
actagacaggttgtactattgg

SEQ ID NO: 8348169 - DNA, 22 bp, Homo sapiens
actagaatgcaggattggtctc

SEQ ID NO: 8348170 - DNA, 22 bp, Homo sapiens
actagaatgcaagctccacaag

SEQ ID NO: 8348171 - DNA, 23 bp, Homo sapiens
actagacttcatcgaaggttacc

SEQ ID NO: 8348172 - DNA, 22 bp, Homo sapiens
actagactgggccagtcaaatt

SEQ ID NO: 8348173 - DNA, 22 bp, Homo sapiens
actagattttggccattataca

SEQ ID NO: 8348174 - DNA, 22 bp, Homo sapiens
actagcagaaactgatcatggc

SEQ ID NO: 8348175 - DNA, 22 bp, Homo sapiens
agtaaaatcaccatctctttgt

SEQ ID NO: 8348176 - DNA, 22 bp, Homo sapiens
agtaaaactcacaaaaggatgg

SEQ ID NO: 8348177 - DNA, 22 bp, Homo sapiens
agtaaaacagagaaatcactca

SEQ ID NO: 8348178 - DNA, 22 bp, Homo sapiens
agtaaaacagagaaatcactca

SEQ ID NO: 8348179 - DNA, 22 bp, Homo sapiens
acggcgggagggtcactggcca

SEQ ID NO: 8348180 - DNA, 22 bp, Homo sapiens
acgcctgtaatcccagcacttt

SEQ ID NO: 8348181 - DNA, 22 bp, Homo sapiens
agtcaacacctggttctattac

SEQ ID NO: 8348182 - DNA, 23 bp, Homo sapiens
actcagctttgggagatgactca

SEQ ID NO: 8348183 - DNA, 22 bp, Homo sapiens
agtatttcttctgagcccaagg

SEQ ID NO: 8348184 - DNA, 22 bp, Homo sapiens
agtatatagtggcgctgtatgc

SEQ ID NO: 8348185 - DNA, 22 bp, Homo sapiens
agtcccagttcggttcttcctc

SEQ ID NO: 8348186 - DNA, 22 bp, Homo sapiens
agtcccagcttcccccatgcag

SEQ ID NO: 8348187 - DNA, 22 bp, Homo sapiens
actctaaaatgctatgagatct

SEQ ID NO: 8348188 - DNA, 22 bp, Homo sapiens
actctaaaagtgaagtgtggtc

SEQ ID NO: 8348189 - DNA, 22 bp, Homo sapiens
actcggccatggcgccccggcc

SEQ ID NO: 8348190 - DNA, 22 bp, Homo sapiens
agtcttggtctccctggcagct

SEQ ID NO: 8348191 - DNA, 22 bp, Homo sapiens
actctgtgaagatgcaggcttg

SEQ ID NO: 8348192 - DNA, 22 bp, Homo sapiens
actctgtgaactctatcagata

SEQ ID NO: 8348193 - DNA, 22 bp, Homo sapiens
actctgtcttcatatttgcatt

SEQ ID NO: 8348194 - DNA, 22 bp, Homo sapiens
actctgtgtgagtagagcctgt

SEQ ID NO: 8348195 - DNA, 22 bp, Homo sapiens
actctgtgttttggtggcagca

SEQ ID NO: 8348196 - DNA, 19 bp, Homo sapiens
agtgcatgggcgaggtgca

SEQ ID NO: 8348197 - DNA, 20 bp, Homo sapiens
agtgcatggagggagagggc

SEQ ID NO: 8348198 - DNA, 22 bp, Homo sapiens
agtgcatgcgcttgggaggggt

SEQ ID NO: 8348199 - DNA, 22 bp, Homo sapiens
actgagggagagtcttaggttg

SEQ ID NO: 8348200 - DNA, 22 bp, Homo sapiens
actgaggacagtgaggagggct

SEQ ID NO: 8348201 - DNA, 22 bp, Homo sapiens
actggaaaacactactacatgc

SEQ ID NO: 8348202 - DNA, 22 bp, Homo sapiens
actggaaattgagaggtcactg

SEQ ID NO: 8348203 - DNA, 22 bp, Homo sapiens
actgcttttcagagtctgcctg

SEQ ID NO: 8348204 - DNA, 22 bp, Homo sapiens
actgcttttctaagattctgtg

SEQ ID NO: 8348205 - DNA, 22 bp, Homo sapiens
actgcttttagaaatctataga

SEQ ID NO: 8348206 - DNA, 22 bp, Homo sapiens
agtgttcttcctatctgctgtt

SEQ ID NO: 8348207 - DNA, 22 bp, Homo sapiens
agtggcagtggctgggcagagc

SEQ ID NO: 8348208 - DNA, 22 bp, Homo sapiens
agtggcagtggaaagcacacgg

SEQ ID NO: 8348209 - DNA, 22 bp, Homo sapiens
actgcagagcttttcagttgag

SEQ ID NO: 8348210 - DNA, 22 bp, Homo sapiens
agtgtactgctgcggccgggac

SEQ ID NO: 8348211 - DNA, 22 bp, Homo sapiens
atatgctttgggattagatcat

SEQ ID NO: 8348212 - DNA, 22 bp, Homo sapiens
atatggaaatagcaatatggtt

SEQ ID NO: 8348213 - DNA, 22 bp, Homo sapiens
agaaaaggttgaaagtaggatt

SEQ ID NO: 8348214 - DNA, 22 bp, Homo sapiens
atatggaatggtaatctacaat

SEQ ID NO: 8348215 - DNA, 22 bp, Homo sapiens
atatgcttgggactgatacagt

SEQ ID NO: 8348216 - DNA, 22 bp, Homo sapiens
actttctcaggaattcacagac

SEQ ID NO: 8348217 - DNA, 20 bp, Homo sapiens
actttctcggtttctcacct

SEQ ID NO: 8348218 - DNA, 22 bp, Homo sapiens
actttcatgttcatttggaacc

SEQ ID NO: 8348219 - DNA, 22 bp, Homo sapiens
actttcaagccctctagagaca

SEQ ID NO: 8348220 - DNA, 22 bp, Homo sapiens
actttcaagccctctagagaca

SEQ ID NO: 8348221 - DNA, 22 bp, Homo sapiens
actttctaaaattgctagcact

SEQ ID NO: 8348222 - DNA, 23 bp, Homo sapiens
agaaaagttcatacctttttaac

SEQ ID NO: 8348223 - DNA, 23 bp, Homo sapiens
agaaaagttcatacctttttaac

SEQ ID NO: 8348224 - DNA, 22 bp, Homo sapiens
agaaaagtttaaatcttggcac

SEQ ID NO: 8348225 - DNA, 22 bp, Homo sapiens
agaaaagttttctgagactgac

SEQ ID NO: 8348226 - DNA, 22 bp, Homo sapiens
agaaaataaattgatggtggaa

SEQ ID NO: 8348227 - DNA, 22 bp, Homo sapiens
agaaaataaattgatggtggaa

SEQ ID NO: 8348228 - DNA, 22 bp, Homo sapiens
agaaaagtgctctagtgagagc

SEQ ID NO: 8348229 - DNA, 22 bp, Homo sapiens
agaaaagtgctctagtgagagc

SEQ ID NO: 8348230 - DNA, 22 bp, Homo sapiens
agaaaagtgctctagtgagagc

SEQ ID NO: 8348231 - DNA, 21 bp, Homo sapiens
agaaaagtatttgaatcaaga

SEQ ID NO: 8348232 - DNA, 21 bp, Homo sapiens
agaaaagtagagttttcagag

SEQ ID NO: 8348233 - DNA, 21 bp, Homo sapiens
agaaaagtagagttttcagag

SEQ ID NO: 8348234 - DNA, 22 bp, Homo sapiens
atattacacacggtatcacggg

SEQ ID NO: 8348235 - DNA, 22 bp, Homo sapiens
atattacacacggtatcacggg

SEQ ID NO: 8348236 - DNA, 22 bp, Homo sapiens
atattcatcgtgtagaaatact

SEQ ID NO: 8348237 - DNA, 22 bp, Homo sapiens
atattcgtggtcaagtaaggcc

SEQ ID NO: 8348238 - DNA, 22 bp, Homo sapiens
atattcctgtttttaacacttt

SEQ ID NO: 8348239 - DNA, 22 bp, Homo sapiens
atattctagccaaagtgtgagc

SEQ ID NO: 8348240 - DNA, 22 bp, Homo sapiens
atattctgcttttgatgcattc

SEQ ID NO: 8348241 - DNA, 21 bp, Homo sapiens
atatttctcataaggttatgg

SEQ ID NO: 8348242 - DNA, 22 bp, Homo sapiens
atattcttccaaaacatcattt

SEQ ID NO: 8348243 - DNA, 22 bp, Homo sapiens
atattctgggttagatatgttt

SEQ ID NO: 8348244 - DNA, 22 bp, Homo sapiens
atattcttatccttttctctgt

SEQ ID NO: 8348245 - DNA, 22 bp, Homo sapiens
atattcttcttgttcagactat

SEQ ID NO: 8348246 - DNA, 22 bp, Homo sapiens
atattcttcttgttcagactat

SEQ ID NO: 8348247 - DNA, 22 bp, Homo sapiens
atatttataaggcaggcaagta

SEQ ID NO: 8348248 - DNA, 22 bp, Homo sapiens
atatttataagcaagcaggact

SEQ ID NO: 8348249 - DNA, 22 bp, Homo sapiens
atctaaacaggtgttctttaga

SEQ ID NO: 8348250 - DNA, 22 bp, Homo sapiens
atctaaaaggagctctttatct

SEQ ID NO: 8348251 - DNA, 22 bp, Homo sapiens
atctaaaaggagctctttatct

SEQ ID NO: 8348252 - DNA, 22 bp, Homo sapiens
atctaactgggctattttattg

SEQ ID NO: 8348253 - DNA, 22 bp, Homo sapiens
atctaaaccctactttctttct

SEQ ID NO: 8348254 - DNA, 22 bp, Homo sapiens
atctaataccctctttatttct

SEQ ID NO: 8348255 - DNA, 22 bp, Homo sapiens
atcatctgtctctgcagttgaa

SEQ ID NO: 8348256 - DNA, 22 bp, Homo sapiens
atcatctgtctccttgtatgtt

SEQ ID NO: 8348257 - DNA, 22 bp, Homo sapiens
atcatctgtcccaaataagaga

SEQ ID NO: 8348258 - DNA, 22 bp, Homo sapiens
agaaagggctattttgaggtag

SEQ ID NO: 8348259 - DNA, 22 bp, Homo sapiens
agaaagtgcctcccttgggagc

SEQ ID NO: 8348260 - DNA, 22 bp, Homo sapiens
agaaagtgaccttgaaaactgg

SEQ ID NO: 8348261 - DNA, 22 bp, Homo sapiens
agaaagtgaacgtgttcagttt

SEQ ID NO: 8348262 - DNA, 22 bp, Homo sapiens
agaaagtgtgtcatactaagtg

SEQ ID NO: 8348263 - DNA, 22 bp, Homo sapiens
agaacagcagtagtatacagta

SEQ ID NO: 8348264 - DNA, 22 bp, Homo sapiens
agaacagatgtgggcagacctg

SEQ ID NO: 8348265 - DNA, 22 bp, Homo sapiens
ataaacaagactggccaacttt

SEQ ID NO: 8348266 - DNA, 22 bp, Homo sapiens
ataaaatgtctccactgggctc

SEQ ID NO: 8348267 - DNA, 22 bp, Homo sapiens
ataaaatggtaaacgaagctga

SEQ ID NO: 8348268 - DNA, 22 bp, Homo sapiens
ataaacacttctagggcacaca

SEQ ID NO: 8348269 - DNA, 22 bp, Homo sapiens
ataaacagagtagttgctactg

SEQ ID NO: 8348270 - DNA, 22 bp, Homo sapiens
actgtgcaatgagtaataaact

SEQ ID NO: 8348271 - DNA, 22 bp, Homo sapiens
actgtgagtgatttccttctgg

SEQ ID NO: 8348272 - DNA, 19 bp, Homo sapiens
ataatgaaggtggagccag

SEQ ID NO: 8348273 - DNA, 22 bp, Homo sapiens
ataatgaatgcagagttatttt

SEQ ID NO: 8348274 - DNA, 22 bp, Homo sapiens
actgggactgtatgtgctggac

SEQ ID NO: 8348275 - DNA, 22 bp, Homo sapiens
actgggaatggagcctgggcct

SEQ ID NO: 8348276 - DNA, 22 bp, Homo sapiens
actgtaaattttggttgcaggt

SEQ ID NO: 8348277 - DNA, 22 bp, Homo sapiens
actgtacttacgcatatacagg

SEQ ID NO: 8348278 - DNA, 22 bp, Homo sapiens
actgtactttagaaagtgtagt

SEQ ID NO: 8348279 - DNA, 22 bp, Homo sapiens
actgtcaggatggcagcttgtt

SEQ ID NO: 8348280 - DNA, 22 bp, Homo sapiens
actgtcagggatcatgaaagct

SEQ ID NO: 8348281 - DNA, 22 bp, Homo sapiens
actgtatttttgaatcattgtg

SEQ ID NO: 8348282 - DNA, 22 bp, Homo sapiens
actgtatttggatataagatct

SEQ ID NO: 8348283 - DNA, 22 bp, Homo sapiens
actgtatacttctgtatacaat

SEQ ID NO: 8348284 - DNA, 22 bp, Homo sapiens
atactgtagaggcatagctagt

SEQ ID NO: 8348285 - DNA, 22 bp, Homo sapiens
atactgtagaggcatagctagt

SEQ ID NO: 8348286 - DNA, 22 bp, Homo sapiens
atactgtgtgtgctcaaggaat

SEQ ID NO: 8348287 - DNA, 22 bp, Homo sapiens
atacattcaaaggaaggataga

SEQ ID NO: 8348288 - DNA, 22 bp, Homo sapiens
atactgtaatacctaaatgaac

SEQ ID NO: 8348289 - DNA, 22 bp, Homo sapiens
atactgtacgtcccagatagga

SEQ ID NO: 8348290 - DNA, 22 bp, Homo sapiens
atacattattgttaaagaacat

SEQ ID NO: 8348291 - DNA, 22 bp, Homo sapiens
atacattagctcatatgattaa

SEQ ID NO: 8348292 - DNA, 22 bp, Homo sapiens
acttctgtatgtcctgcattca

SEQ ID NO: 8348293 - DNA, 22 bp, Homo sapiens
atacagattgctatacttacaa

SEQ ID NO: 8348294 - DNA, 22 bp, Homo sapiens
atacagtaaccacattctatag

SEQ ID NO: 8348295 - DNA, 22 bp, Homo sapiens
acttagaacaggcagaattcca

SEQ ID NO: 8348296 - DNA, 22 bp, Homo sapiens
acttagaaattcagttttgtca

SEQ ID NO: 8348297 - DNA, 22 bp, Homo sapiens
acttacaatcaaccaccttgga

SEQ ID NO: 8348298 - DNA, 22 bp, Homo sapiens
acttacaagttccctttctcag

SEQ ID NO: 8348299 - DNA, 22 bp, Homo sapiens
agggggagcttggctactcctg

SEQ ID NO: 8348300 - DNA, 22 bp, Homo sapiens
agggggaggctgtgctgcgtct

SEQ ID NO: 8348301 - DNA, 22 bp, Homo sapiens
agggggaggctgtgctgcgtct

SEQ ID NO: 8348302 - DNA, 22 bp, Homo sapiens
aggggcctggcactgagctggc

SEQ ID NO: 8348303 - DNA, 22 bp, Homo sapiens
agggggagtttcagttagaaag

SEQ ID NO: 8348304 - DNA, 22 bp, Homo sapiens
agggggcaggagagacctgctg

SEQ ID NO: 8348305 - DNA, 22 bp, Homo sapiens
accctcagtaatcgtgcagttt

SEQ ID NO: 8348306 - DNA, 22 bp, Homo sapiens
agggggctcagcaggctctgga

SEQ ID NO: 8348307 - DNA, 22 bp, Homo sapiens
agggggcccttgcaggtgagcg

SEQ ID NO: 8348308 - DNA, 22 bp, Homo sapiens
agggctgccccagtccagccgg

SEQ ID NO: 8348309 - DNA, 22 bp, Homo sapiens
agggctgcctgctctgcattga

SEQ ID NO: 8348310 - DNA, 22 bp, Homo sapiens
agggctgcctgactccagagcc

SEQ ID NO: 8348311 - DNA, 22 bp, Homo sapiens
agggctgctaccttaatcagtt

SEQ ID NO: 8348312 - DNA, 19 bp, Homo sapiens
agggctgctctggcctggg

SEQ ID NO: 8348313 - DNA, 22 bp, Homo sapiens
agggctgctcctccttcaggcc

SEQ ID NO: 8348314 - DNA, 22 bp, Homo sapiens
agggctgctatgttgattcaga

SEQ ID NO: 8348315 - DNA, 22 bp, Homo sapiens
agggctgcccagtgtgagagct

SEQ ID NO: 8348316 - DNA, 22 bp, Homo sapiens
agggctgccatttctggcccaa

SEQ ID NO: 8348317 - DNA, 22 bp, Homo sapiens
accaggcctggctgggcagcca

SEQ ID NO: 8348318 - DNA, 22 bp, Homo sapiens
agggcagatggaacttccccga

SEQ ID NO: 8348319 - DNA, 21 bp, Homo sapiens
agggcagattagctgtaagag

SEQ ID NO: 8348320 - DNA, 22 bp, Homo sapiens
accagctcttctgctctagttg

SEQ ID NO: 8348321 - DNA, 22 bp, Homo sapiens
accagctctctagccctggtcc

SEQ ID NO: 8348322 - DNA, 22 bp, Homo sapiens
agggcagcacaaggcatggact

SEQ ID NO: 8348323 - DNA, 22 bp, Homo sapiens
agggcagcagctcctcctagct

SEQ ID NO: 8348324 - DNA, 17 bp, Homo sapiens
accagcctctcctgggg

SEQ ID NO: 8348325 - DNA, 22 bp, Homo sapiens
accagcctcctagctgctcctg

SEQ ID NO: 8348326 - DNA, 22 bp, Homo sapiens
accagctcagagcaggctcctg

SEQ ID NO: 8348327 - DNA, 22 bp, Homo sapiens
aggcttggtgccaaggagcctg

SEQ ID NO: 8348328 - DNA, 21 bp, Homo sapiens
accagcaggagatcagaagga

SEQ ID NO: 8348329 - DNA, 22 bp, Homo sapiens
acatttgtatgcgtttttactg

SEQ ID NO: 8348330 - DNA, 22 bp, Homo sapiens
acatttgtacattggcatgtct

SEQ ID NO: 8348331 - DNA, 22 bp, Homo sapiens
acatttgtctggctagaaagtt

SEQ ID NO: 8348332 - DNA, 22 bp, Homo sapiens
acatttgtatgcgtttttactg

SEQ ID NO: 8348333 - DNA, 19 bp, Homo sapiens
acatttgtcaagagaaggt

SEQ ID NO: 8348334 - DNA, 22 bp, Homo sapiens
accagcagttatgaggccagga

SEQ ID NO: 8348335 - DNA, 22 bp, Homo sapiens
accagcagggctgggccaatgg

SEQ ID NO: 8348336 - DNA, 22 bp, Homo sapiens
accagccaccaccaggagatcg

SEQ ID NO: 8348337 - DNA, 22 bp, Homo sapiens
acatgttgctaaatccaatggt

SEQ ID NO: 8348338 - DNA, 22 bp, Homo sapiens
acatgttagggacagagtatgt

SEQ ID NO: 8348339 - DNA, 22 bp, Homo sapiens
acatgttagaaatgcagaatct

SEQ ID NO: 8348340 - DNA, 22 bp, Homo sapiens
acatgttagctactattgttat

SEQ ID NO: 8348341 - DNA, 22 bp, Homo sapiens
acatgtttaagtttgttatatg

SEQ ID NO: 8348342 - DNA, 22 bp, Homo sapiens
acatgtttggctctatgctata

SEQ ID NO: 8348343 - DNA, 22 bp, Homo sapiens
aggcctcttgtcttcctcacat

SEQ ID NO: 8348344 - DNA, 20 bp, Homo sapiens
aggcctcttcatgacagctg

SEQ ID NO: 8348345 - DNA, 22 bp, Homo sapiens
acatgcatacaagcacatgtag

SEQ ID NO: 8348346 - DNA, 22 bp, Homo sapiens
acatgcataagcctagccatca

SEQ ID NO: 8348347 - DNA, 22 bp, Homo sapiens
acatgctaattgcaaagtcttg

SEQ ID NO: 8348348 - DNA, 22 bp, Homo sapiens
acatgccagcctcagcagcagt

SEQ ID NO: 8348349 - DNA, 22 bp, Homo sapiens
acatgccatctttgtcaggagt

SEQ ID NO: 8348350 - DNA, 22 bp, Homo sapiens
acatcacagagcccagataaag

SEQ ID NO: 8348351 - DNA, 22 bp, Homo sapiens
acatcacacgccttccaggagg

SEQ ID NO: 8348352 - DNA, 22 bp, Homo sapiens
aggctgagctggtagtgagtac

SEQ ID NO: 8348353 - DNA, 18 bp, Homo sapiens
acatttctatgcttctgg

SEQ ID NO: 8348354 - DNA, 22 bp, Homo sapiens
acatttgaggatgttaagaatg

SEQ ID NO: 8348355 - DNA, 22 bp, Homo sapiens
acatttgagcatctactaagtg

SEQ ID NO: 8348356 - DNA, 22 bp, Homo sapiens
acatttgagtcatatttgctta

SEQ ID NO: 8348357 - DNA, 22 bp, Homo sapiens
acatttgatatggagttgtgta

SEQ ID NO: 8348358 - DNA, 22 bp, Homo sapiens
acatttgataattataaagaca

SEQ ID NO: 8348359 - DNA, 22 bp, Homo sapiens
acatttgattgatgaatcaaat

SEQ ID NO: 8348360 - DNA, 23 bp, Homo sapiens
acatttggccaaaaattatttct

SEQ ID NO: 8348361 - DNA, 22 bp, Homo sapiens
acatttgagcatatttcttgtc

SEQ ID NO: 8348362 - DNA, 22 bp, Homo sapiens
acatttgactctgttcatatta

SEQ ID NO: 8348363 - DNA, 22 bp, Homo sapiens
acatttcttttcatctctatat

SEQ ID NO: 8348364 - DNA, 22 bp, Homo sapiens
acatttgaaattctgaacagat

SEQ ID NO: 8348365 - DNA, 22 bp, Homo sapiens
acattgattgagcacccattat

SEQ ID NO: 8348366 - DNA, 22 bp, Homo sapiens
acattgatcagcctcccatgca

SEQ ID NO: 8348367 - DNA, 22 bp, Homo sapiens
acattgatgatcccacttacag

SEQ ID NO: 8348368 - DNA, 22 bp, Homo sapiens
aggctctgtttgctgtggtacc

SEQ ID NO: 8348369 - DNA, 22 bp, Homo sapiens
aggctctgtttgctgtggtacc

SEQ ID NO: 8348370 - DNA, 18 bp, Homo sapiens
aggcctgcccagcactgt

SEQ ID NO: 8348371 - DNA, 22 bp, Homo sapiens
aggctctggctactacagagct

SEQ ID NO: 8348372 - DNA, 22 bp, Homo sapiens
aggctctggctactacagagct

SEQ ID NO: 8348373 - DNA, 22 bp, Homo sapiens
acatttctagttgttcatctcc

SEQ ID NO: 8348374 - DNA, 22 bp, Homo sapiens
acatttctatagtgcatctgtt

SEQ ID NO: 8348375 - DNA, 17 bp, Homo sapiens
acatttcctaactgaag

SEQ ID NO: 8348376 - DNA, 22 bp, Homo sapiens
acatttcctaacgtatacactg

SEQ ID NO: 8348377 - DNA, 17 bp, Homo sapiens
acatttcctaactgaag

SEQ ID NO: 8348378 - DNA, 22 bp, Homo sapiens
acattgtactcttagcgttgtt

SEQ ID NO: 8348379 - DNA, 22 bp, Homo sapiens
acattgtataatgattatcaca

SEQ ID NO: 8348380 - DNA, 22 bp, Homo sapiens
aggaagaacagataatggacgc

SEQ ID NO: 8348381 - DNA, 21 bp, Homo sapiens
aggaagaaaggttggaggttg

SEQ ID NO: 8348382 - DNA, 23 bp, Homo sapiens
aggaagagagagtgcctctttct

SEQ ID NO: 8348383 - DNA, 22 bp, Homo sapiens
aggaagaatgtttacatatcaa

SEQ ID NO: 8348384 - DNA, 22 bp, Homo sapiens
aggaagagcatctttgggtctg

SEQ ID NO: 8348385 - DNA, 19 bp, Homo sapiens
acagggcttggcctgacat

SEQ ID NO: 8348386 - DNA, 22 bp, Homo sapiens
aggacacactgttctcacgtaa

SEQ ID NO: 8348387 - DNA, 22 bp, Homo sapiens
acaggggacctaggaccctcgg

SEQ ID NO: 8348388 - DNA, 22 bp, Homo sapiens
acaggcagccctctccctggtt

SEQ ID NO: 8348389 - DNA, 22 bp, Homo sapiens
acaggcagccctctccctggtt

SEQ ID NO: 8348390 - DNA, 22 bp, Homo sapiens
acaggcaggcgggacagcccga

SEQ ID NO: 8348391 - DNA, 22 bp, Homo sapiens
acaggcaggagctccccattcc

SEQ ID NO: 8348392 - DNA, 22 bp, Homo sapiens
acaggcagattaagggtaggca

SEQ ID NO: 8348393 - DNA, 22 bp, Homo sapiens
acagggacctgtgagctccata

SEQ ID NO: 8348394 - DNA, 22 bp, Homo sapiens
agctggaggggccagcaggtgt

SEQ ID NO: 8348395 - DNA, 22 bp, Homo sapiens
agctggaggggccagcaggtgt

SEQ ID NO: 8348396 - DNA, 22 bp, Homo sapiens
acagctgctctacaggttattt

SEQ ID NO: 8348397 - DNA, 21 bp, Homo sapiens
acagctggccgcgcgggtcgg

SEQ ID NO: 8348398 - DNA, 22 bp, Homo sapiens
acagctgggaactcacacagca

SEQ ID NO: 8348399 - DNA, 22 bp, Homo sapiens
agctgaagcactgggatggaag

SEQ ID NO: 8348400 - DNA, 22 bp, Homo sapiens
agctctggggtggagcccagga

SEQ ID NO: 8348401 - DNA, 22 bp, Homo sapiens
agctctggggtggagcccagga

SEQ ID NO: 8348402 - DNA, 22 bp, Homo sapiens
agctctgggtcacggctgccga

SEQ ID NO: 8348403 - DNA, 22 bp, Homo sapiens
agctgacaggatggcattatta

SEQ ID NO: 8348404 - DNA, 22 bp, Homo sapiens
agctgactcactcactcacaat

SEQ ID NO: 8348405 - DNA, 22 bp, Homo sapiens
agctggcacagaccaggagatc

SEQ ID NO: 8348406 - DNA, 23 bp, Homo sapiens
acaggaggggacaggtggccgtg

SEQ ID NO: 8348407 - DNA, 22 bp, Homo sapiens
agctggtgtcctcctggagctg

SEQ ID NO: 8348408 - DNA, 22 bp, Homo sapiens
agctggtggggaagctgcaggt

SEQ ID NO: 8348409 - DNA, 22 bp, Homo sapiens
acaggatcgccctgttgcccag

SEQ ID NO: 8348410 - DNA, 22 bp, Homo sapiens
acaggagttaaccatgggaagt

SEQ ID NO: 8348411 - DNA, 22 bp, Homo sapiens
acagtccccataccacctgtcc

SEQ ID NO: 8348412 - DNA, 20 bp, Homo sapiens
acagtcctgcactggtgttt

SEQ ID NO: 8348413 - DNA, 23 bp, Homo sapiens
acagtcgtaggtatccttttcct

SEQ ID NO: 8348414 - DNA, 22 bp, Homo sapiens
acagtctacttgagcttgtata

SEQ ID NO: 8348415 - DNA, 17 bp, Homo sapiens
acagtctgcctgacagt

SEQ ID NO: 8348416 - DNA, 22 bp, Homo sapiens
acagtgtctgacacattgtagc

SEQ ID NO: 8348417 - DNA, 22 bp, Homo sapiens
acagtgggatgaggctggcccc

SEQ ID NO: 8348418 - DNA, 22 bp, Homo sapiens
acagtgtctgacacgtaggaag

SEQ ID NO: 8348419 - DNA, 22 bp, Homo sapiens
acaggtttgtctgatgtaatga

SEQ ID NO: 8348420 - DNA, 22 bp, Homo sapiens
acaggtttttggataatccttt

SEQ ID NO: 8348421 - DNA, 22 bp, Homo sapiens
aggacacagctcttcagtaaga

SEQ ID NO: 8348422 - DNA, 22 bp, Homo sapiens
aggacacacttctgaggtcttt

SEQ ID NO: 8348423 - DNA, 22 bp, Homo sapiens
acaggtttagctcttagtagtc

SEQ ID NO: 8348424 - DNA, 22 bp, Homo sapiens
acaggtttgctgctgttttagg

SEQ ID NO: 8348425 - DNA, 22 bp, Homo sapiens
acaggtttgcagcttgttacct

SEQ ID NO: 8348426 - DNA, 22 bp, Homo sapiens
acaggtttgctgctgttttagg

SEQ ID NO: 8348427 - DNA, 22 bp, Homo sapiens
acaggtttagctcttagtagtc

SEQ ID NO: 8348428 - DNA, 22 bp, Homo sapiens
acaggttgataaggtgatattc

SEQ ID NO: 8348429 - DNA, 22 bp, Homo sapiens
acaggtttagctcttagtagtc

SEQ ID NO: 8348430 - DNA, 22 bp, Homo sapiens
acagtatatatagtctaaaagc

SEQ ID NO: 8348431 - DNA, 22 bp, Homo sapiens
acagtatagggcttatattgta

SEQ ID NO: 8348432 - DNA, 21 bp, Homo sapiens
acagtatattagatatttgaa

SEQ ID NO: 8348433 - DNA, 22 bp, Homo sapiens
aggagcagaccgtagtcctgca

SEQ ID NO: 8348434 - DNA, 22 bp, Homo sapiens
aggagattgtactgtcatcact

SEQ ID NO: 8348435 - DNA, 22 bp, Homo sapiens
aggagattggctgaaaaatatt

SEQ ID NO: 8348436 - DNA, 22 bp, Homo sapiens
aggagcagaactgttgtggagg

SEQ ID NO: 8348437 - DNA, 22 bp, Homo sapiens
aggagcagaactgattctgact

SEQ ID NO: 8348438 - DNA, 22 bp, Homo sapiens
acagtttatggtgttttatata

SEQ ID NO: 8348439 - DNA, 21 bp, Homo sapiens
acagtttattagagtaagtgc

SEQ ID NO: 8348440 - DNA, 17 bp, Homo sapiens
acagtttgattttagca

SEQ ID NO: 8348441 - DNA, 22 bp, Homo sapiens
acagtttgcactgttcatcaaa

SEQ ID NO: 8348442 - DNA, 22 bp, Homo sapiens
acagtttgaataatttagatag

SEQ ID NO: 8348443 - DNA, 22 bp, Homo sapiens
acagtttgagaaccactagcct

SEQ ID NO: 8348444 - DNA, 20 bp, Homo sapiens
acagtttattttacttggtt

SEQ ID NO: 8348445 - DNA, 20 bp, Homo sapiens
acagtttattttacttggtt

SEQ ID NO: 8348446 - DNA, 22 bp, Homo sapiens
aggcactgggtaattagtagct

SEQ ID NO: 8348447 - DNA, 20 bp, Homo sapiens
aggcactggggataggtaag

SEQ ID NO: 8348448 - DNA, 22 bp, Homo sapiens
aggcactgggggatgagcaagg

SEQ ID NO: 8348449 - DNA, 20 bp, Homo sapiens
aggcactggatttcttatat

SEQ ID NO: 8348450 - DNA, 22 bp, Homo sapiens
aggcactgggaatatgctgagg

SEQ ID NO: 8348451 - DNA, 18 bp, Homo sapiens
aggcactggaattaaggg

SEQ ID NO: 8348452 - DNA, 22 bp, Homo sapiens
aggcactgcttctaagtaggaa

SEQ ID NO: 8348453 - DNA, 21 bp, Homo sapiens
acagttcatgataactccatc

SEQ ID NO: 8348454 - DNA, 22 bp, Homo sapiens
acagtttagagcatgatgacca

SEQ ID NO: 8348455 - DNA, 22 bp, Homo sapiens
acagtttataaaaataatgagg

SEQ ID NO: 8348456 - DNA, 22 bp, Homo sapiens
acagtttatcgattcacctacc

SEQ ID NO: 8348457 - DNA, 22 bp, Homo sapiens
acagtttaggatgagagaacac

SEQ ID NO: 8348458 - DNA, 20 bp, Homo sapiens
aggatgcagggagtctgcag

SEQ ID NO: 8348459 - DNA, 22 bp, Homo sapiens
acatattttgaaagctttctaa

SEQ ID NO: 8348460 - DNA, 22 bp, Homo sapiens
acatattgaggctttgatttaa

SEQ ID NO: 8348461 - DNA, 22 bp, Homo sapiens
acatatattttcacacatggtt

SEQ ID NO: 8348462 - DNA, 21 bp, Homo sapiens
aggcagctggaaggcctggct

SEQ ID NO: 8348463 - DNA, 22 bp, Homo sapiens
acatatgttgtaaacattccaa

SEQ ID NO: 8348464 - DNA, 20 bp, Homo sapiens
acatatcatggtagagtcct

SEQ ID NO: 8348465 - DNA, 22 bp, Homo sapiens
acatagtaagtgctcagtaaat

SEQ ID NO: 8348466 - DNA, 22 bp, Homo sapiens
acatagaacttcgatgtctttt

SEQ ID NO: 8348467 - DNA, 22 bp, Homo sapiens
acatagaacttcgatgtctttt

SEQ ID NO: 8348468 - DNA, 22 bp, Homo sapiens
acatagaaggaagagtagtagg

SEQ ID NO: 8348469 - DNA, 22 bp, Homo sapiens
acatagaaggaggctggcagct

SEQ ID NO: 8348470 - DNA, 22 bp, Homo sapiens
acatagagtatcatactggatg

SEQ ID NO: 8348471 - DNA, 22 bp, Homo sapiens
ctgccctgacctgcctcagagt

SEQ ID NO: 8348472 - DNA, 22 bp, Homo sapiens
ctgccctgacctgcctcagagt

SEQ ID NO: 8348473 - DNA, 22 bp, Homo sapiens
ctgccctctagggatgcactgg

SEQ ID NO: 8348474 - DNA, 22 bp, Homo sapiens
ctgccctcgggccctcccatag

SEQ ID NO: 8348475 - DNA, 18 bp, Homo sapiens
ctgccccttctctgagat

SEQ ID NO: 8348476 - DNA, 22 bp, Homo sapiens
ctgcccgtccctttgctctcgc

SEQ ID NO: 8348477 - DNA, 22 bp, Homo sapiens
agttttcaggaaagagttggtg

SEQ ID NO: 8348478 - DNA, 22 bp, Homo sapiens
agttttcctctcatttatcaat

SEQ ID NO: 8348479 - DNA, 22 bp, Homo sapiens
agttttctgttctacaatttga

SEQ ID NO: 8348480 - DNA, 22 bp, Homo sapiens
ctgcctgcttctgagccagagg

SEQ ID NO: 8348481 - DNA, 22 bp, Homo sapiens
ctgcctgcttttctgggagccg

SEQ ID NO: 8348482 - DNA, 23 bp, Homo sapiens
ctgcctgctggggagacagatct

SEQ ID NO: 8348483 - DNA, 22 bp, Homo sapiens
ctgcctgctgcctgtggagggt

SEQ ID NO: 8348484 - DNA, 21 bp, Homo sapiens
ataagttgtgcaactgtttga

SEQ ID NO: 8348485 - DNA, 22 bp, Homo sapiens
ataagtgatatttagctataga

SEQ ID NO: 8348486 - DNA, 22 bp, Homo sapiens
ctgccctgtttggacagcccgg

SEQ ID NO: 8348487 - DNA, 22 bp, Homo sapiens
ctgccctgtggctctgagtcat

SEQ ID NO: 8348488 - DNA, 22 bp, Homo sapiens
ataagtgagaacaaaaattaga

SEQ ID NO: 8348489 - DNA, 22 bp, Homo sapiens
ctgatacactccctaaaatata

SEQ ID NO: 8348490 - DNA, 22 bp, Homo sapiens
ctgatacaatgctaataaattt

SEQ ID NO: 8348491 - DNA, 22 bp, Homo sapiens
ctgagtggaacataggatgata

SEQ ID NO: 8348492 - DNA, 22 bp, Homo sapiens
agtttgtgcaatggtgtcacct

SEQ ID NO: 8348493 - DNA, 23 bp, Homo sapiens
agttttcaagttggtggctggca

SEQ ID NO: 8348494 - DNA, 22 bp, Homo sapiens
agttttattccaatgtgcagca

SEQ ID NO: 8348495 - DNA, 22 bp, Homo sapiens
agttttattaaatccacagaag

SEQ ID NO: 8348496 - DNA, 22 bp, Homo sapiens
agtttctcttaatctagtatct

SEQ ID NO: 8348497 - DNA, 22 bp, Homo sapiens
agtttctgtgactcttggcata

SEQ ID NO: 8348498 - DNA, 22 bp, Homo sapiens
agtttctattttcatgtctgtt

SEQ ID NO: 8348499 - DNA, 22 bp, Homo sapiens
agtttcatattaccatgtcacc

SEQ ID NO: 8348500 - DNA, 22 bp, Homo sapiens
agtgttctcagctactagagag

SEQ ID NO: 8348501 - DNA, 23 bp, Homo sapiens
agtgttccagttggttgagagtg

SEQ ID NO: 8348502 - DNA, 22 bp, Homo sapiens
agtgttccacacatctggggaa

SEQ ID NO: 8348503 - DNA, 22 bp, Homo sapiens
agtgttcctgctctcaggaagc

SEQ ID NO: 8348504 - DNA, 20 bp, Homo sapiens
agtgttccggaagactggca

SEQ ID NO: 8348505 - DNA, 22 bp, Homo sapiens
agtgttccttgctttcccagag

SEQ ID NO: 8348506 - DNA, 22 bp, Homo sapiens
atagaatatgacttttagatcc

SEQ ID NO: 8348507 - DNA, 22 bp, Homo sapiens
atagaatatgacttttagatcc

SEQ ID NO: 8348508 - DNA, 22 bp, Homo sapiens
atagaatatgacttttagatcc

SEQ ID NO: 8348509 - DNA, 20 bp, Homo sapiens
atagaatcacaagtcctgaa

SEQ ID NO: 8348510 - DNA, 22 bp, Homo sapiens
atagaaaggtctttggcagaca

SEQ ID NO: 8348511 - DNA, 19 bp, Homo sapiens
atagaaagggttaaagaca

SEQ ID NO: 8348512 - DNA, 22 bp, Homo sapiens
atagaaacagggaagcaaagca

SEQ ID NO: 8348513 - DNA, 22 bp, Homo sapiens
atagaaaacagatgtccttaaa

SEQ ID NO: 8348514 - DNA, 22 bp, Homo sapiens
atagaaaacagatgtccttaaa

SEQ ID NO: 8348515 - DNA, 21 bp, Homo sapiens
ctggagcttggtgagaagtgt

SEQ ID NO: 8348516 - DNA, 22 bp, Homo sapiens
ctggccagtgactgctcacccg

SEQ ID NO: 8348517 - DNA, 22 bp, Homo sapiens
ataggcagactctttttggagg

SEQ ID NO: 8348518 - DNA, 22 bp, Homo sapiens
ataggctgtaataattcacatt

SEQ ID NO: 8348519 - DNA, 22 bp, Homo sapiens
atagacattttgcattcaagca

SEQ ID NO: 8348520 - DNA, 22 bp, Homo sapiens
atagcatataagttataaaact

SEQ ID NO: 8348521 - DNA, 22 bp, Homo sapiens
atagtacacatcctacaatgtt

SEQ ID NO: 8348522 - DNA, 22 bp, Homo sapiens
atagtacagatccattaattat

SEQ ID NO: 8348523 - DNA, 22 bp, Homo sapiens
atagtacaatcagttaattagt

SEQ ID NO: 8348524 - DNA, 22 bp, Homo sapiens
atagtacaatcagttaattagt

SEQ ID NO: 8348525 - DNA, 22 bp, Homo sapiens
atagaattctttgaaatttatg

SEQ ID NO: 8348526 - DNA, 22 bp, Homo sapiens
atagaattcgtgtttgtaattc

SEQ ID NO: 8348527 - DNA, 22 bp, Homo sapiens
atagaattatggaaagcatctt

SEQ ID NO: 8348528 - DNA, 22 bp, Homo sapiens
atagaatcatctgtgcactagt

SEQ ID NO: 8348529 - DNA, 22 bp, Homo sapiens
atagaatcctgcagcaagcctt

SEQ ID NO: 8348530 - DNA, 22 bp, Homo sapiens
atagaatgtattatagtacaga

SEQ ID NO: 8348531 - DNA, 22 bp, Homo sapiens
atagaatctttgtaaaacactt

SEQ ID NO: 8348532 - DNA, 22 bp, Homo sapiens
atagaatttgcactaaatctgc

SEQ ID NO: 8348533 - DNA, 22 bp, Homo sapiens
atagaattctttgaaatttatg

SEQ ID NO: 8348534 - DNA, 22 bp, Homo sapiens
atagaatttgcactaaatctgc

SEQ ID NO: 8348535 - DNA, 22 bp, Homo sapiens
atagacatatggctttgtttct

SEQ ID NO: 8348536 - DNA, 22 bp, Homo sapiens
atagacatagccgtaatttatt

SEQ ID NO: 8348537 - DNA, 22 bp, Homo sapiens
atagacatggtcttttgtcatt

SEQ ID NO: 8348538 - DNA, 22 bp, Homo sapiens
atagacatttactgagcacgta

SEQ ID NO: 8348539 - DNA, 22 bp, Homo sapiens
atagacattataacacagagct

SEQ ID NO: 8348540 - DNA, 22 bp, Homo sapiens
atagacagcgcattaaaaatgt

SEQ ID NO: 8348541 - DNA, 21 bp, Homo sapiens
atacagaacattgatccaaga

SEQ ID NO: 8348542 - DNA, 22 bp, Homo sapiens
atacagaactctcagttgtata

SEQ ID NO: 8348543 - DNA, 22 bp, Homo sapiens
atacagaaaatgatgcagagtt

SEQ ID NO: 8348544 - DNA, 22 bp, Homo sapiens
ataatttaattttcacagtggt

SEQ ID NO: 8348545 - DNA, 22 bp, Homo sapiens
ataatttacaactgcttttaat

SEQ ID NO: 8348546 - DNA, 20 bp, Homo sapiens
ataatttaccctgcaccact

SEQ ID NO: 8348547 - DNA, 20 bp, Homo sapiens
ataattatttacttttgtgc

SEQ ID NO: 8348548 - DNA, 22 bp, Homo sapiens
ataattcatgggcctttcacct

SEQ ID NO: 8348549 - DNA, 22 bp, Homo sapiens
ataatttaaattagtatgtgat

SEQ ID NO: 8348550 - DNA, 22 bp, Homo sapiens
ataattctccaatttttgttgt

SEQ ID NO: 8348551 - DNA, 22 bp, Homo sapiens
ataattaatttcagtaatctcc

SEQ ID NO: 8348552 - DNA, 22 bp, Homo sapiens
ataatgtacaactgcttttaat

SEQ ID NO: 8348553 - DNA, 21 bp, Homo sapiens
ataatgtacaaaaactgtctt

SEQ ID NO: 8348554 - DNA, 22 bp, Homo sapiens
ataatgtaaggctccctacagt

SEQ ID NO: 8348555 - DNA, 22 bp, Homo sapiens
ataatgtttttgtataagcatg

SEQ ID NO: 8348556 - DNA, 22 bp, Homo sapiens
ctggaaatcactactagtcaat

SEQ ID NO: 8348557 - DNA, 22 bp, Homo sapiens
atacagaagcctgtatttctgg

SEQ ID NO: 8348558 - DNA, 22 bp, Homo sapiens
atacatctcatgtaagagataa

SEQ ID NO: 8348559 - DNA, 22 bp, Homo sapiens
atacatatatggtacttcctgg

SEQ ID NO: 8348560 - DNA, 22 bp, Homo sapiens
ctggaagaccccccaggactca

SEQ ID NO: 8348561 - DNA, 22 bp, Homo sapiens
atacatgatcactgtattataa

SEQ ID NO: 8348562 - DNA, 22 bp, Homo sapiens
atacatgatcactgtattataa

SEQ ID NO: 8348563 - DNA, 22 bp, Homo sapiens
ctggagctggtatagggacaaa

SEQ ID NO: 8348564 - DNA, 22 bp, Homo sapiens
atacatgactcacacattctgc

SEQ ID NO: 8348565 - DNA, 22 bp, Homo sapiens
atacatgaggctcatttatgtc

SEQ ID NO: 8348566 - DNA, 22 bp, Homo sapiens
atacatgacagcatagcatcct

SEQ ID NO: 8348567 - DNA, 22 bp, Homo sapiens
atacatctctttgaagtgcttt

SEQ ID NO: 8348568 - DNA, 22 bp, Homo sapiens
atacatctctttgaagtgcttt

SEQ ID NO: 8348569 - DNA, 22 bp, Homo sapiens
atacatctcatgtaagagataa

SEQ ID NO: 8348570 - DNA, 21 bp, Homo sapiens
ctgtccacatcacagagcctc

SEQ ID NO: 8348571 - DNA, 19 bp, Homo sapiens
ctgtccacacactcgcttc

SEQ ID NO: 8348572 - DNA, 19 bp, Homo sapiens
ctgtccacacactcgcttc

SEQ ID NO: 8348573 - DNA, 20 bp, Homo sapiens
ctgtatcaggttacaaagta

SEQ ID NO: 8348574 - DNA, 22 bp, Homo sapiens
ctgtatcagactctgcttgagg

SEQ ID NO: 8348575 - DNA, 22 bp, Homo sapiens
atattttggcaaatgtctagat

SEQ ID NO: 8348576 - DNA, 22 bp, Homo sapiens
ctgtaattcactagggtcagcg

SEQ ID NO: 8348577 - DNA, 22 bp, Homo sapiens
atattttgaagttaataatgtg

SEQ ID NO: 8348578 - DNA, 22 bp, Homo sapiens
atattttccgaacttgaggtag

SEQ ID NO: 8348579 - DNA, 22 bp, Homo sapiens
atattttcacagaacttgcaaa

SEQ ID NO: 8348580 - DNA, 22 bp, Homo sapiens
atatttgtttggcagagttcag

SEQ ID NO: 8348581 - DNA, 22 bp, Homo sapiens
atatttgttgagttcttatgat

SEQ ID NO: 8348582 - DNA, 22 bp, Homo sapiens
atatttgttagagtctatgtgt

SEQ ID NO: 8348583 - DNA, 22 bp, Homo sapiens
ctggggaggcagggctgcccct

SEQ ID NO: 8348584 - DNA, 22 bp, Homo sapiens
ctggggaggcagggctgcccct

SEQ ID NO: 8348585 - DNA, 22 bp, Homo sapiens
ctggggaggcagggctgcccct

SEQ ID NO: 8348586 - DNA, 22 bp, Homo sapiens
ctggggaggcagggctgcccct

SEQ ID NO: 8348587 - DNA, 22 bp, Homo sapiens
ctggtgggagcagcaggcagct

SEQ ID NO: 8348588 - DNA, 22 bp, Homo sapiens
ctggtgggaggcaaggtggaag

SEQ ID NO: 8348589 - DNA, 22 bp, Homo sapiens
ctggtggaatggcagagggaac

SEQ ID NO: 8348590 - DNA, 22 bp, Homo sapiens
ctggtggaagcctgggctcaga

SEQ ID NO: 8348591 - DNA, 22 bp, Homo sapiens
ctggtgctttgctcatttgata

SEQ ID NO: 8348592 - DNA, 22 bp, Homo sapiens
ctggtgctgtagcctgattgag

SEQ ID NO: 8348593 - DNA, 22 bp, Homo sapiens
atagtcataggcaaatagaaga

SEQ ID NO: 8348594 - DNA, 22 bp, Homo sapiens
atagtcatccagaaagattaca

SEQ ID NO: 8348595 - DNA, 22 bp, Homo sapiens
atagtatttaatagttagctca

SEQ ID NO: 8348596 - DNA, 22 bp, Homo sapiens
atagtatttccagaaatagtct

SEQ ID NO: 8348597 - DNA, 22 bp, Homo sapiens
atagtacagatccattaattat

SEQ ID NO: 8348598 - DNA, 22 bp, Homo sapiens
atagtactccaccagtacatgt

SEQ ID NO: 8348599 - DNA, 22 bp, Homo sapiens
atatattttttgagacagagtc

SEQ ID NO: 8348600 - DNA, 22 bp, Homo sapiens
atatattttgcggtcacgtggc

SEQ ID NO: 8348601 - DNA, 22 bp, Homo sapiens
atatcattatgttatgagcaca

SEQ ID NO: 8348602 - DNA, 22 bp, Homo sapiens
atatcattatgttatgagcaca

SEQ ID NO: 8348603 - DNA, 22 bp, Homo sapiens
atatcacagctctttcattgct

SEQ ID NO: 8348604 - DNA, 23 bp, Homo sapiens
atatcacacccagtacagtctcc

SEQ ID NO: 8348605 - DNA, 22 bp, Homo sapiens
atatcaaacgaagttattttaa

SEQ ID NO: 8348606 - DNA, 22 bp, Homo sapiens
ctgggcagtttacattcctacc

SEQ ID NO: 8348607 - DNA, 22 bp, Homo sapiens
ctgggcagttcgctttcgtttt

SEQ ID NO: 8348608 - DNA, 22 bp, Homo sapiens
atatcattctgatgtatatctt

SEQ ID NO: 8348609 - DNA, 22 bp, Homo sapiens
ctgggccagtctcggccgctct

SEQ ID NO: 8348610 - DNA, 22 bp, Homo sapiens
ctgggcctggacgggcagatct

SEQ ID NO: 8348611 - DNA, 22 bp, Homo sapiens
ctgtccagcttggctcctgggg

SEQ ID NO: 8348612 - DNA, 22 bp, Homo sapiens
ctgtccagggtgtgcaggggct

SEQ ID NO: 8348613 - DNA, 22 bp, Homo sapiens
ctgtgccctttgtcctcgtctc

SEQ ID NO: 8348614 - DNA, 22 bp, Homo sapiens
ctgtgcctccctttactttgag

SEQ ID NO: 8348615 - DNA, 22 bp, Homo sapiens
atcaggcagaagcagaaagatg

SEQ ID NO: 8348616 - DNA, 20 bp, Homo sapiens
ctgtgctccgggttcctgga

SEQ ID NO: 8348617 - DNA, 22 bp, Homo sapiens
atcaggaagtctgccacaaggc

SEQ ID NO: 8348618 - DNA, 22 bp, Homo sapiens
atcaggaagcctgcactgagct

SEQ ID NO: 8348619 - DNA, 22 bp, Homo sapiens
atcattccacatgtaccactag

SEQ ID NO: 8348620 - DNA, 22 bp, Homo sapiens
ctgtttattgagcaatctgcca

SEQ ID NO: 8348621 - DNA, 22 bp, Homo sapiens
ctgtttatccctttggtcagca

SEQ ID NO: 8348622 - DNA, 22 bp, Homo sapiens
ctgtttatctctaacctgttta

SEQ ID NO: 8348623 - DNA, 22 bp, Homo sapiens
ctgttattttataattcaagaa

SEQ ID NO: 8348624 - DNA, 22 bp, Homo sapiens
ctgttatttgctggaagagttt

SEQ ID NO: 8348625 - DNA, 22 bp, Homo sapiens
ctgttactggacgcacgcagct

SEQ ID NO: 8348626 - DNA, 22 bp, Homo sapiens
ctgttattcaagacaaaggcag

SEQ ID NO: 8348627 - DNA, 19 bp, Homo sapiens
ctgttattgtcagagctcc

SEQ ID NO: 8348628 - DNA, 22 bp, Homo sapiens
ctgttatttctgccaggtgagt

SEQ ID NO: 8348629 - DNA, 22 bp, Homo sapiens
ctgttatttgagagtgttgaat

SEQ ID NO: 8348630 - DNA, 22 bp, Homo sapiens
ctgttatttatgctgctccatt

SEQ ID NO: 8348631 - DNA, 22 bp, Homo sapiens
ctgttatttagaacatggaatc

SEQ ID NO: 8348632 - DNA, 22 bp, Homo sapiens
ctgttatttatgctgctccatt

SEQ ID NO: 8348633 - DNA, 22 bp, Homo sapiens
atctccagatgcctggaaatga

SEQ ID NO: 8348634 - DNA, 22 bp, Homo sapiens
atctatttctgctaataacaat

SEQ ID NO: 8348635 - DNA, 22 bp, Homo sapiens
atctcccaaactcatttcttca

SEQ ID NO: 8348636 - DNA, 22 bp, Homo sapiens
atccttcaaggggctgacagct

SEQ ID NO: 8348637 - DNA, 22 bp, Homo sapiens
atccttgacacactccagtact

SEQ ID NO: 8348638 - DNA, 22 bp, Homo sapiens
atccttgaatgactctgccctc

SEQ ID NO: 8348639 - DNA, 22 bp, Homo sapiens
atccttgaacttagacactagg

SEQ ID NO: 8348640 - DNA, 17 bp, Homo sapiens
atccttctgttctttct

SEQ ID NO: 8348641 - DNA, 22 bp, Homo sapiens
atccttgagaaaataaatgacc

SEQ ID NO: 8348642 - DNA, 22 bp, Homo sapiens
atccttgagccttatcttttgt

SEQ ID NO: 8348643 - DNA, 22 bp, Homo sapiens
atccttgagccaatgactgatt

SEQ ID NO: 8348644 - DNA, 21 bp, Homo sapiens
atccttgatcagaagagtgct

SEQ ID NO: 8348645 - DNA, 18 bp, Homo sapiens
atccttgatgagaggtct

SEQ ID NO: 8348646 - DNA, 22 bp, Homo sapiens
atccttggcacagtggaattca

SEQ ID NO: 8348647 - DNA, 22 bp, Homo sapiens
atccttgggtctctggaaattg

SEQ ID NO: 8348648 - DNA, 22 bp, Homo sapiens
cttcagagtgactcagcatctt

SEQ ID NO: 8348649 - DNA, 22 bp, Homo sapiens
cttcagagagtccagggactgc

SEQ ID NO: 8348650 - DNA, 22 bp, Homo sapiens
cttcagatccctctgccactgt

SEQ ID NO: 8348651 - DNA, 22 bp, Homo sapiens
cttcagaatgggactgtgtttg

SEQ ID NO: 8348652 - DNA, 22 bp, Homo sapiens
cttcagagaacttgatcgctgc

SEQ ID NO: 8348653 - DNA, 22 bp, Homo sapiens
ctcccagggtagggagagacta

SEQ ID NO: 8348654 - DNA, 22 bp, Homo sapiens
ctcccagggtctaggctgctgg

SEQ ID NO: 8348655 - DNA, 22 bp, Homo sapiens
ctcccaggggagtcatctgctt

SEQ ID NO: 8348656 - DNA, 22 bp, Homo sapiens
ctcccaggttacatctgagcct

SEQ ID NO: 8348657 - DNA, 21 bp, Homo sapiens
ctcccagggtgactgttcaac

SEQ ID NO: 8348658 - DNA, 22 bp, Homo sapiens
ctcccaggtgtcccttctgcca

SEQ ID NO: 8348659 - DNA, 21 bp, Homo sapiens
ctcccagggtgactgttcaac

SEQ ID NO: 8348660 - DNA, 22 bp, Homo sapiens
ctcctcccacggtctcaggaag

SEQ ID NO: 8348661 - DNA, 22 bp, Homo sapiens
ctcctccccttgagtctgggat

SEQ ID NO: 8348662 - DNA, 22 bp, Homo sapiens
ctcctccccttgagtctgggat

SEQ ID NO: 8348663 - DNA, 22 bp, Homo sapiens
ctcctccctctttgccacacat

SEQ ID NO: 8348664 - DNA, 18 bp, Homo sapiens
ctcctccctaagggctca

SEQ ID NO: 8348665 - DNA, 22 bp, Homo sapiens
ctccagtgtctcagagcagatg

SEQ ID NO: 8348666 - DNA, 22 bp, Homo sapiens
ctccagtgtctcagagcagatg

SEQ ID NO: 8348667 - DNA, 22 bp, Homo sapiens
ctccagtgtctcagagcagatg

SEQ ID NO: 8348668 - DNA, 22 bp, Homo sapiens
agtgacattattttgtgtacta

SEQ ID NO: 8348669 - DNA, 18 bp, Homo sapiens
agtgacatcaaaaggcat

SEQ ID NO: 8348670 - DNA, 22 bp, Homo sapiens
agtgaccgaggcacttggcaac

SEQ ID NO: 8348671 - DNA, 22 bp, Homo sapiens
agtgactcactagctctcagtg

SEQ ID NO: 8348672 - DNA, 22 bp, Homo sapiens
agtgcacttttccacatccata

SEQ ID NO: 8348673 - DNA, 22 bp, Homo sapiens
agtgcactggcaccatctcagc

SEQ ID NO: 8348674 - DNA, 22 bp, Homo sapiens
agtgcagactgaaatgaccttc

SEQ ID NO: 8348675 - DNA, 22 bp, Homo sapiens
agtgcagagagcaatactctac

SEQ ID NO: 8348676 - DNA, 21 bp, Homo sapiens
agtctgaggtggggcctagga

SEQ ID NO: 8348677 - DNA, 22 bp, Homo sapiens
agtctgcactcaggtggaggtc

SEQ ID NO: 8348678 - DNA, 22 bp, Homo sapiens
agtccaaagcagatgagggcca

SEQ ID NO: 8348679 - DNA, 22 bp, Homo sapiens
agtccaaagcagatgagggcca

SEQ ID NO: 8348680 - DNA, 22 bp, Homo sapiens
agtcatatgtggcattttctaa

SEQ ID NO: 8348681 - DNA, 19 bp, Homo sapiens
agtcatattgttcatcttg

SEQ ID NO: 8348682 - DNA, 22 bp, Homo sapiens
agtcatatttatataatttccc

SEQ ID NO: 8348683 - DNA, 22 bp, Homo sapiens
agtcatcatggaaaatgttgtt

SEQ ID NO: 8348684 - DNA, 22 bp, Homo sapiens
agtcattaattagtaggaaggt

SEQ ID NO: 8348685 - DNA, 22 bp, Homo sapiens
agtcattaaatgctgtcatggc

SEQ ID NO: 8348686 - DNA, 23 bp, Homo sapiens
agtcattaagaagttcaggaact

SEQ ID NO: 8348687 - DNA, 22 bp, Homo sapiens
agtcattattatttgtcaaagg

SEQ ID NO: 8348688 - DNA, 22 bp, Homo sapiens
agtcattacggactagtactac

SEQ ID NO: 8348689 - DNA, 22 bp, Homo sapiens
agtctggaggtggcaggtgtgt

SEQ ID NO: 8348690 - DNA, 22 bp, Homo sapiens
ctcaggatttaaaggggcactc

SEQ ID NO: 8348691 - DNA, 22 bp, Homo sapiens
ctcaggatttactaatttcaag

SEQ ID NO: 8348692 - DNA, 22 bp, Homo sapiens
ctcaggatgcaggtcacaggac

SEQ ID NO: 8348693 - DNA, 22 bp, Homo sapiens
ctcaggatggaagcctacagga

SEQ ID NO: 8348694 - DNA, 21 bp, Homo sapiens
ctcaggatggcggcctggtgg

SEQ ID NO: 8348695 - DNA, 22 bp, Homo sapiens
ctcaggatgtactacagaaggc

SEQ ID NO: 8348696 - DNA, 22 bp, Homo sapiens
ctcaggattctcgacactcaca

SEQ ID NO: 8348697 - DNA, 20 bp, Homo sapiens
ctcaggattgtctagcccct

SEQ ID NO: 8348698 - DNA, 22 bp, Homo sapiens
ctcaggattgtgcctagggaga

SEQ ID NO: 8348699 - DNA, 22 bp, Homo sapiens
ctcaggattaaggaatctaaat

SEQ ID NO: 8348700 - DNA, 22 bp, Homo sapiens
ctcaggatgtcggtgactattg

SEQ ID NO: 8348701 - DNA, 22 bp, Homo sapiens
ctcaggatccatctcctgccct

SEQ ID NO: 8348702 - DNA, 22 bp, Homo sapiens
ctcaggatcgcttgccctaggg

SEQ ID NO: 8348703 - DNA, 21 bp, Homo sapiens
ctcaggatcttatatattagt

SEQ ID NO: 8348704 - DNA, 22 bp, Homo sapiens
ctcaggatgaaagtcatggtga

SEQ ID NO: 8348705 - DNA, 22 bp, Homo sapiens
ctcaggatgcaattccatcaag

SEQ ID NO: 8348706 - DNA, 20 bp, Homo sapiens
ctcaggatactgcaaagttg

SEQ ID NO: 8348707 - DNA, 22 bp, Homo sapiens
ctcaggatagattgtcctctca

SEQ ID NO: 8348708 - DNA, 22 bp, Homo sapiens
ctcaggatagctgcgcagcctg

SEQ ID NO: 8348709 - DNA, 22 bp, Homo sapiens
ctcaggatattgggctggagca

SEQ ID NO: 8348710 - DNA, 22 bp, Homo sapiens
agtctgtgtgaatgtgggcttt

SEQ ID NO: 8348711 - DNA, 22 bp, Homo sapiens
agtctgtgtgaatgtgggcttt

SEQ ID NO: 8348712 - DNA, 22 bp, Homo sapiens
agtggggacaatgagagcaggt

SEQ ID NO: 8348713 - DNA, 22 bp, Homo sapiens
ctcttaaataacatcattgctt

SEQ ID NO: 8348714 - DNA, 22 bp, Homo sapiens
ctcttaaaattacctttgcaaa

SEQ ID NO: 8348715 - DNA, 22 bp, Homo sapiens
ctcttaaaaacttgatatattt

SEQ ID NO: 8348716 - DNA, 21 bp, Homo sapiens
ctctgtttgcctgctgccatc

SEQ ID NO: 8348717 - DNA, 21 bp, Homo sapiens
ctctgtttgcctgctgccatc

SEQ ID NO: 8348718 - DNA, 22 bp, Homo sapiens
ctctgtttggcgctgctccttc

SEQ ID NO: 8348719 - DNA, 22 bp, Homo sapiens
ctctgtttttcaatagttcttg

SEQ ID NO: 8348720 - DNA, 22 bp, Homo sapiens
ctgaagcaaatgaaacagctct

SEQ ID NO: 8348721 - DNA, 22 bp, Homo sapiens
ctgaagcacagcatataaataa

SEQ ID NO: 8348722 - DNA, 22 bp, Homo sapiens
ctgaagcaattgagagatgttt

SEQ ID NO: 8348723 - DNA, 22 bp, Homo sapiens
ctgaagcagatgtggctgagat

SEQ ID NO: 8348724 - DNA, 22 bp, Homo sapiens
ctgagaaagtgagggttaaaca

SEQ ID NO: 8348725 - DNA, 23 bp, Homo sapiens
ctgaagcagttccctctctgccc

SEQ ID NO: 8348726 - DNA, 22 bp, Homo sapiens
ctgaagcaggaggggaggcgct

SEQ ID NO: 8348727 - DNA, 22 bp, Homo sapiens
ctctgacattctgtgactctga

SEQ ID NO: 8348728 - DNA, 22 bp, Homo sapiens
ctctgacctctagccagctctg

SEQ ID NO: 8348729 - DNA, 22 bp, Homo sapiens
ctctgagaagagttcaagtaaa

SEQ ID NO: 8348730 - DNA, 23 bp, Homo sapiens
ctctgagacccaggtggacacgg

SEQ ID NO: 8348731 - DNA, 22 bp, Homo sapiens
ctctgagactcaagtgagtggg

SEQ ID NO: 8348732 - DNA, 22 bp, Homo sapiens
ctctgagagtgctcagagggta

SEQ ID NO: 8348733 - DNA, 22 bp, Homo sapiens
ctctgagaggctgccctgccat

SEQ ID NO: 8348734 - DNA, 22 bp, Homo sapiens
ctctgagaggtgagaagcagca

SEQ ID NO: 8348735 - DNA, 22 bp, Homo sapiens
agtgggcttttttccgttccat

SEQ ID NO: 8348736 - DNA, 22 bp, Homo sapiens
agtgggcttactgagggagtgt

SEQ ID NO: 8348737 - DNA, 22 bp, Homo sapiens
agtgggcttactgagggagtgt

SEQ ID NO: 8348738 - DNA, 22 bp, Homo sapiens
agtgggctggtggcagggagaa

SEQ ID NO: 8348739 - DNA, 22 bp, Homo sapiens
agtgggctggtggcagggagaa

SEQ ID NO: 8348740 - DNA, 22 bp, Homo sapiens
agtgggcccttgtcacactgat

SEQ ID NO: 8348741 - DNA, 22 bp, Homo sapiens
agtgggcccgagccagtggtct

SEQ ID NO: 8348742 - DNA, 22 bp, Homo sapiens
agtgggcatgatctggtgtctg

SEQ ID NO: 8348743 - DNA, 22 bp, Homo sapiens
agtgggcaggcagggtgcgcag

SEQ ID NO: 8348744 - DNA, 22 bp, Homo sapiens
agtgggcagcccaggaggtctt

SEQ ID NO: 8348745 - DNA, 22 bp, Homo sapiens
ctctgagatgcttgaagaggat

SEQ ID NO: 8348746 - DNA, 22 bp, Homo sapiens
ctctgagatagtttctatcaat

SEQ ID NO: 8348747 - DNA, 22 bp, Homo sapiens
ctctgagagtgctcagagggta

SEQ ID NO: 8348748 - DNA, 22 bp, Homo sapiens
ctctgagatgataccttctgga

SEQ ID NO: 8348749 - DNA, 22 bp, Homo sapiens
agtgcaggccccaggccaggcc

SEQ ID NO: 8348750 - DNA, 22 bp, Homo sapiens
ctctctccttagctgcagacca

SEQ ID NO: 8348751 - DNA, 22 bp, Homo sapiens
ctctctccttagctgcagacca

SEQ ID NO: 8348752 - DNA, 22 bp, Homo sapiens
agtggcagccgagcaggagatg

SEQ ID NO: 8348753 - DNA, 22 bp, Homo sapiens
agtggctgacaactgggttaac

SEQ ID NO: 8348754 - DNA, 22 bp, Homo sapiens
aggtgctgtttgtcagcagttt

SEQ ID NO: 8348755 - DNA, 22 bp, Homo sapiens
cctgggcagtgctggagttgaa

SEQ ID NO: 8348756 - DNA, 22 bp, Homo sapiens
cctgggcagggagaccaggctc

SEQ ID NO: 8348757 - DNA, 22 bp, Homo sapiens
cctgggcaggccggacgctggg

SEQ ID NO: 8348758 - DNA, 22 bp, Homo sapiens
cctgggtgtcatgggcagctgg

SEQ ID NO: 8348759 - DNA, 22 bp, Homo sapiens
aggtggagtgaaggaaaggcag

SEQ ID NO: 8348760 - DNA, 22 bp, Homo sapiens
aggtcctgtccttggtctctga

SEQ ID NO: 8348761 - DNA, 22 bp, Homo sapiens
aggtattattagcatctctatt

SEQ ID NO: 8348762 - DNA, 22 bp, Homo sapiens
aggtattagaagagtcatggga

SEQ ID NO: 8348763 - DNA, 22 bp, Homo sapiens
aggtctggaaacagcagggaga

SEQ ID NO: 8348764 - DNA, 22 bp, Homo sapiens
aggtctgtgaattcctgagaaa

SEQ ID NO: 8348765 - DNA, 22 bp, Homo sapiens
aggtctgtgcgctgttgataga

SEQ ID NO: 8348766 - DNA, 22 bp, Homo sapiens
aggtctgtgattcactttgagt

SEQ ID NO: 8348767 - DNA, 22 bp, Homo sapiens
aggtctggaggcggagtcagga

SEQ ID NO: 8348768 - DNA, 22 bp, Homo sapiens
aggtctgggcaccactggctgc

SEQ ID NO: 8348769 - DNA, 22 bp, Homo sapiens
aggtctggtgagagcaggtgct

SEQ ID NO: 8348770 - DNA, 22 bp, Homo sapiens
aggtctggtgagagcaggtgct

SEQ ID NO: 8348771 - DNA, 21 bp, Homo sapiens
agggtggctctgggtcagaac

SEQ ID NO: 8348772 - DNA, 22 bp, Homo sapiens
agggtggccatgagggagagat

SEQ ID NO: 8348773 - DNA, 22 bp, Homo sapiens
agggtggcagttactggagcaa

SEQ ID NO: 8348774 - DNA, 22 bp, Homo sapiens
cctggagcccctctggccagcc

SEQ ID NO: 8348775 - DNA, 22 bp, Homo sapiens
cctggagcccctctggccagcc

SEQ ID NO: 8348776 - DNA, 19 bp, Homo sapiens
agggtggcaaaggagggtg

SEQ ID NO: 8348777 - DNA, 22 bp, Homo sapiens
cctgcctgcgtcctctgagggc

SEQ ID NO: 8348778 - DNA, 22 bp, Homo sapiens
agggtggagggagtccctgagc

SEQ ID NO: 8348779 - DNA, 22 bp, Homo sapiens
aggggctttggtgctggtcctg

SEQ ID NO: 8348780 - DNA, 22 bp, Homo sapiens
aggggctgtggaaaccaactct

SEQ ID NO: 8348781 - DNA, 22 bp, Homo sapiens
aggggctgtggaaaccaactct

SEQ ID NO: 8348782 - DNA, 22 bp, Homo sapiens
aggggctgtggaaaccaactct

SEQ ID NO: 8348783 - DNA, 22 bp, Homo sapiens
cctggagcactctccctggctg

SEQ ID NO: 8348784 - DNA, 18 bp, Homo sapiens
cctggacctgtctccttt

SEQ ID NO: 8348785 - DNA, 22 bp, Homo sapiens
ctacacagagcctacttctgca

SEQ ID NO: 8348786 - DNA, 21 bp, Homo sapiens
ctacacagctttctataggaa

SEQ ID NO: 8348787 - DNA, 22 bp, Homo sapiens
agtcataattataaacatcagt

SEQ ID NO: 8348788 - DNA, 22 bp, Homo sapiens
agtcagttcatggctctgtcct

SEQ ID NO: 8348789 - DNA, 22 bp, Homo sapiens
agtcagagaccctagatctaat

SEQ ID NO: 8348790 - DNA, 23 bp, Homo sapiens
agtcagagcagaagggctgcttg

SEQ ID NO: 8348791 - DNA, 22 bp, Homo sapiens
agtcagcaccccagcggggtca

SEQ ID NO: 8348792 - DNA, 22 bp, Homo sapiens
ctacaagaggaatggaggtctg

SEQ ID NO: 8348793 - DNA, 22 bp, Homo sapiens
ctacaagaggaatggaggtctg

SEQ ID NO: 8348794 - DNA, 23 bp, Homo sapiens
ctacaagagcaagcatggacaag

SEQ ID NO: 8348795 - DNA, 22 bp, Homo sapiens
agtcagagtctattgctgtggt

SEQ ID NO: 8348796 - DNA, 22 bp, Homo sapiens
ctaaacagtgcatatgggtgtt

SEQ ID NO: 8348797 - DNA, 22 bp, Homo sapiens
cgtgctctggactcgtggcaca

SEQ ID NO: 8348798 - DNA, 22 bp, Homo sapiens
cgtggctctgggctcctttgcc

SEQ ID NO: 8348799 - DNA, 22 bp, Homo sapiens
cgtgatatttgtggtggatgaa

SEQ ID NO: 8348800 - DNA, 22 bp, Homo sapiens
cgtgatgaatggtgagacccgc

SEQ ID NO: 8348801 - DNA, 18 bp, Homo sapiens
cgtgagtggaggctgcgg

SEQ ID NO: 8348802 - DNA, 22 bp, Homo sapiens
cgcggtggcggcctccagcgcc

SEQ ID NO: 8348803 - DNA, 22 bp, Homo sapiens
cgcgctctccttctggcaccca

SEQ ID NO: 8348804 - DNA, 22 bp, Homo sapiens
cgcgcgtcctcagctctgcgag

SEQ ID NO: 8348805 - DNA, 22 bp, Homo sapiens
cgcgggggtcctcaggcaggcg

SEQ ID NO: 8348806 - DNA, 22 bp, Homo sapiens
cgcgctgcagacagcggaggcc

SEQ ID NO: 8348807 - DNA, 22 bp, Homo sapiens
cgcggaggaggtcaggaggtga

SEQ ID NO: 8348808 - DNA, 22 bp, Homo sapiens
cgcggctctgcgggccgctgag

SEQ ID NO: 8348809 - DNA, 22 bp, Homo sapiens
cgcgggcccctgcgctccgggc

SEQ ID NO: 8348810 - DNA, 22 bp, Homo sapiens
cgcgggcctccagacccagtat

SEQ ID NO: 8348811 - DNA, 22 bp, Homo sapiens
cgcggaggaggtcaggaggtga

SEQ ID NO: 8348812 - DNA, 22 bp, Homo sapiens
aggtttattatagaggatgacg

SEQ ID NO: 8348813 - DNA, 22 bp, Homo sapiens
aggtttcatgggagacaactca

SEQ ID NO: 8348814 - DNA, 22 bp, Homo sapiens
agtaacaggatccaaagaatgt

SEQ ID NO: 8348815 - DNA, 22 bp, Homo sapiens
agtaacaggatccaaagaatgt

SEQ ID NO: 8348816 - DNA, 22 bp, Homo sapiens
aggttccaagaaatcatcagtg

SEQ ID NO: 8348817 - DNA, 22 bp, Homo sapiens
aggttattttgctcagggaact

SEQ ID NO: 8348818 - DNA, 22 bp, Homo sapiens
aggttatttgcagatggaattc

SEQ ID NO: 8348819 - DNA, 22 bp, Homo sapiens
aggtggggttcagtctcagccg

SEQ ID NO: 8348820 - DNA, 22 bp, Homo sapiens
aggtgtctggatgggtgtcctt

SEQ ID NO: 8348821 - DNA, 22 bp, Homo sapiens
aggtgtgaagagttgacacatt

SEQ ID NO: 8348822 - DNA, 22 bp, Homo sapiens
cctggtgcaccaagtaagggtg

SEQ ID NO: 8348823 - DNA, 22 bp, Homo sapiens
cctggtgaatgttcatggactg

SEQ ID NO: 8348824 - DNA, 22 bp, Homo sapiens
cctggtccttacgtcattgctt

SEQ ID NO: 8348825 - DNA, 19 bp, Homo sapiens
aggtgtgggggctgcagac

SEQ ID NO: 8348826 - DNA, 19 bp, Homo sapiens
aggtgtgggggctgcagac

SEQ ID NO: 8348827 - DNA, 17 bp, Homo sapiens
aggtgtggtcaagggag

SEQ ID NO: 8348828 - DNA, 22 bp, Homo sapiens
aggtgtgggaaacgggtgacct

SEQ ID NO: 8348829 - DNA, 22 bp, Homo sapiens
aggtgtgagaaacgtgaccagt

SEQ ID NO: 8348830 - DNA, 22 bp, Homo sapiens
aggtgtgaagagttgacacatt

SEQ ID NO: 8348831 - DNA, 23 bp, Homo sapiens
aggtgtgcttctgggcacctggg

SEQ ID NO: 8348832 - DNA, 22 bp, Homo sapiens
aggtgtggcttgaagtctctat

SEQ ID NO: 8348833 - DNA, 22 bp, Homo sapiens
aggtgtggcttgaagtctctat

SEQ ID NO: 8348834 - DNA, 22 bp, Homo sapiens
agctgctgcctcactggtctgt

SEQ ID NO: 8348835 - DNA, 22 bp, Homo sapiens
caggcactggccagtcagcaca

SEQ ID NO: 8348836 - DNA, 22 bp, Homo sapiens
caggcactcattcagagaggtg

SEQ ID NO: 8348837 - DNA, 22 bp, Homo sapiens
caggcactgtgctagatccttg

SEQ ID NO: 8348838 - DNA, 22 bp, Homo sapiens
caggcactgtgcaagggtctcg

SEQ ID NO: 8348839 - DNA, 22 bp, Homo sapiens
caggcactggggatgctgggat

SEQ ID NO: 8348840 - DNA, 22 bp, Homo sapiens
caggcactgtgttaggcactgt

SEQ ID NO: 8348841 - DNA, 22 bp, Homo sapiens
caggcacttctgctgcttgtct

SEQ ID NO: 8348842 - DNA, 20 bp, Homo sapiens
agctggcccacaggtgtggg

SEQ ID NO: 8348843 - DNA, 18 bp, Homo sapiens
agctggccctggctgccg

SEQ ID NO: 8348844 - DNA, 22 bp, Homo sapiens
agctggccctcgagagccaatt

SEQ ID NO: 8348845 - DNA, 22 bp, Homo sapiens
agctggcctcactgcagaatgc

SEQ ID NO: 8348846 - DNA, 22 bp, Homo sapiens
caggccagcagggcctccgtgg

SEQ ID NO: 8348847 - DNA, 22 bp, Homo sapiens
caggccagcggcccgcgcgttc

SEQ ID NO: 8348848 - DNA, 22 bp, Homo sapiens
caggccagggagaatatgaagc

SEQ ID NO: 8348849 - DNA, 22 bp, Homo sapiens
caggccaggctgcatttgcccc

SEQ ID NO: 8348850 - DNA, 22 bp, Homo sapiens
agctgggctgggctgagctgag

SEQ ID NO: 8348851 - DNA, 19 bp, Homo sapiens
agctgggctgtcacagtga

SEQ ID NO: 8348852 - DNA, 22 bp, Homo sapiens
agctgcagattctatctagaag

SEQ ID NO: 8348853 - DNA, 23 bp, Homo sapiens
agctgcagatgctcagcgggcag

SEQ ID NO: 8348854 - DNA, 22 bp, Homo sapiens
agctgcagatcaataggctcac

SEQ ID NO: 8348855 - DNA, 22 bp, Homo sapiens
agctgcagagaaaagaggctgg

SEQ ID NO: 8348856 - DNA, 22 bp, Homo sapiens
agctgcagttcgttccagctct

SEQ ID NO: 8348857 - DNA, 22 bp, Homo sapiens
cagctgagaagtgatagctgca

SEQ ID NO: 8348858 - DNA, 22 bp, Homo sapiens
cagctgacttcataggaagaca

SEQ ID NO: 8348859 - DNA, 22 bp, Homo sapiens
cagctgacgccagagtggaatt

SEQ ID NO: 8348860 - DNA, 22 bp, Homo sapiens
cagctctgtaaattccttcatc

SEQ ID NO: 8348861 - DNA, 22 bp, Homo sapiens
cagctctgtctgtagaaacttc

SEQ ID NO: 8348862 - DNA, 22 bp, Homo sapiens
cagctctgtaaattccttcatc

SEQ ID NO: 8348863 - DNA, 22 bp, Homo sapiens
cagctctgtaaattccttcatc

SEQ ID NO: 8348864 - DNA, 22 bp, Homo sapiens
cagctctgggtgacaggagggc

SEQ ID NO: 8348865 - DNA, 22 bp, Homo sapiens
cagctctggtccagggagggca

SEQ ID NO: 8348866 - DNA, 22 bp, Homo sapiens
cagctctggttcctgggcccag

SEQ ID NO: 8348867 - DNA, 22 bp, Homo sapiens
cagctctgggtaggaggaatct

SEQ ID NO: 8348868 - DNA, 22 bp, Homo sapiens
cagctctgggtgacaggagggc

SEQ ID NO: 8348869 - DNA, 22 bp, Homo sapiens
cagctctggggcagagtgacta

SEQ ID NO: 8348870 - DNA, 22 bp, Homo sapiens
cagggtgcgggagatgtgcacc

SEQ ID NO: 8348871 - DNA, 22 bp, Homo sapiens
caggtgataccctttaacaggc

SEQ ID NO: 8348872 - DNA, 22 bp, Homo sapiens
caggtgagtaacaatgggtgat

SEQ ID NO: 8348873 - DNA, 22 bp, Homo sapiens
cagggtgactgccctggccact

SEQ ID NO: 8348874 - DNA, 22 bp, Homo sapiens
cagggtgagcctctggagccct

SEQ ID NO: 8348875 - DNA, 22 bp, Homo sapiens
cagggtgcatacccatgcatac

SEQ ID NO: 8348876 - DNA, 22 bp, Homo sapiens
caggggctgtttgcctcaggcc

SEQ ID NO: 8348877 - DNA, 22 bp, Homo sapiens
caggggctgtgggcggagcctc

SEQ ID NO: 8348878 - DNA, 22 bp, Homo sapiens
caggggctgtgggcggagcctc

SEQ ID NO: 8348879 - DNA, 22 bp, Homo sapiens
cagggtgactgccctggccact

SEQ ID NO: 8348880 - DNA, 23 bp, Homo sapiens
cagggtgaccaatgtggccatca

SEQ ID NO: 8348881 - DNA, 22 bp, Homo sapiens
caggggctgtttgcctcaggcc

SEQ ID NO: 8348882 - DNA, 22 bp, Homo sapiens
caggggctgtgggcggagcctc

SEQ ID NO: 8348883 - DNA, 22 bp, Homo sapiens
caggggctgtggcacatggtgt

SEQ ID NO: 8348884 - DNA, 22 bp, Homo sapiens
caggggctgagaaggaacgtcc

SEQ ID NO: 8348885 - DNA, 22 bp, Homo sapiens
caggggctgaaatgttggggtt

SEQ ID NO: 8348886 - DNA, 22 bp, Homo sapiens
caggggctgagaaggaacgtcc

SEQ ID NO: 8348887 - DNA, 22 bp, Homo sapiens
caggggctctaatgcatgatca

SEQ ID NO: 8348888 - DNA, 22 bp, Homo sapiens
caggggctccctgggtgccagt

SEQ ID NO: 8348889 - DNA, 22 bp, Homo sapiens
caggggctctaatgcatgatca

SEQ ID NO: 8348890 - DNA, 22 bp, Homo sapiens
caggggctctgagattgtctaa

SEQ ID NO: 8348891 - DNA, 22 bp, Homo sapiens
caggggctctgggtgatgtgag

SEQ ID NO: 8348892 - DNA, 22 bp, Homo sapiens
caggggctctgggtgatgtgag

SEQ ID NO: 8348893 - DNA, 22 bp, Homo sapiens
caggggctgaaatgttggggtt

SEQ ID NO: 8348894 - DNA, 22 bp, Homo sapiens
cagggctcccaaatatctcttc

SEQ ID NO: 8348895 - DNA, 22 bp, Homo sapiens
cagggcctgagggctgctctgc

SEQ ID NO: 8348896 - DNA, 22 bp, Homo sapiens
cagggcctgcctggttcctgga

SEQ ID NO: 8348897 - DNA, 22 bp, Homo sapiens
cagggctccctgcagcctctgt

SEQ ID NO: 8348898 - DNA, 22 bp, Homo sapiens
cagggctccctgcagcctctgt

SEQ ID NO: 8348899 - DNA, 22 bp, Homo sapiens
caggggctagcacttaatgttt

SEQ ID NO: 8348900 - DNA, 22 bp, Homo sapiens
caggggctccctgggtgccagt

SEQ ID NO: 8348901 - DNA, 22 bp, Homo sapiens
cagggctcgctgccagcttcag

SEQ ID NO: 8348902 - DNA, 22 bp, Homo sapiens
cagggctcgctgccagcttcag

SEQ ID NO: 8348903 - DNA, 22 bp, Homo sapiens
cagggctcgctcgctcgctcgc

SEQ ID NO: 8348904 - DNA, 22 bp, Homo sapiens
cagggctcgctcttgcccttcg

SEQ ID NO: 8348905 - DNA, 22 bp, Homo sapiens
cagggcctgagggctgctctgc

SEQ ID NO: 8348906 - DNA, 22 bp, Homo sapiens
cagggcctctgtgggctctctc

SEQ ID NO: 8348907 - DNA, 22 bp, Homo sapiens
cagggcctgcaagagacctggg

SEQ ID NO: 8348908 - DNA, 22 bp, Homo sapiens
cagggcctgcctggttcctgga

SEQ ID NO: 8348909 - DNA, 22 bp, Homo sapiens
cagggcctctcctccaggaact

SEQ ID NO: 8348910 - DNA, 22 bp, Homo sapiens
cagggcctctgtgggctctctc

SEQ ID NO: 8348911 - DNA, 22 bp, Homo sapiens
cagggcctcgaagcctctgggc

SEQ ID NO: 8348912 - DNA, 22 bp, Homo sapiens
cagggcctcctaaggcatctaa

SEQ ID NO: 8348913 - DNA, 22 bp, Homo sapiens
cagggcctcctaaggcatctaa

SEQ ID NO: 8348914 - DNA, 22 bp, Homo sapiens
cagggcctccccggcagtcttt

SEQ ID NO: 8348915 - DNA, 22 bp, Homo sapiens
cagggagctttcccaggaccct

SEQ ID NO: 8348916 - DNA, 22 bp, Homo sapiens
cagggagctggtgccagccgac

SEQ ID NO: 8348917 - DNA, 22 bp, Homo sapiens
cagggagctggctggcgtgagt

SEQ ID NO: 8348918 - DNA, 22 bp, Homo sapiens
cagggagctctgggccggactc

SEQ ID NO: 8348919 - DNA, 22 bp, Homo sapiens
caggctggagtgcagtgtcgcc

SEQ ID NO: 8348920 - DNA, 22 bp, Homo sapiens
caggctggagtgcagtggtgcc

SEQ ID NO: 8348921 - DNA, 22 bp, Homo sapiens
caggctggagtgcagtggtgcc

SEQ ID NO: 8348922 - DNA, 22 bp, Homo sapiens
caggctggacattagatacata

SEQ ID NO: 8348923 - DNA, 22 bp, Homo sapiens
caggctggagtgcagttgtgca

SEQ ID NO: 8348924 - DNA, 22 bp, Homo sapiens
caggctggagtgcagtgtcgcc

SEQ ID NO: 8348925 - DNA, 18 bp, Homo sapiens
agctggggcctctggtcc

SEQ ID NO: 8348926 - DNA, 22 bp, Homo sapiens
agctggggcatttatccactaa

SEQ ID NO: 8348927 - DNA, 22 bp, Homo sapiens
agctgggcttggccaggtcgct

SEQ ID NO: 8348928 - DNA, 22 bp, Homo sapiens
agctggggcatttatccactaa

SEQ ID NO: 8348929 - DNA, 22 bp, Homo sapiens
caggctgcggtcggctctggtc

SEQ ID NO: 8348930 - DNA, 22 bp, Homo sapiens
cagtggccaacttcctgcctct

SEQ ID NO: 8348931 - DNA, 22 bp, Homo sapiens
aggactcatccctgcttgtcag

SEQ ID NO: 8348932 - DNA, 22 bp, Homo sapiens
cagtgcccttccaggactgcag

SEQ ID NO: 8348933 - DNA, 19 bp, Homo sapiens
cagtgcccgacgcaggtct

SEQ ID NO: 8348934 - DNA, 22 bp, Homo sapiens
cagtgctcccgctgccgctgtg

SEQ ID NO: 8348935 - DNA, 22 bp, Homo sapiens
cagtgctcccgctgccgctgtg

SEQ ID NO: 8348936 - DNA, 22 bp, Homo sapiens
cagtgctcctgatgtacccttg

SEQ ID NO: 8348937 - DNA, 22 bp, Homo sapiens
cagtgctcatagctgttcctcc

SEQ ID NO: 8348938 - DNA, 21 bp, Homo sapiens
cagtgctcaggaatagagaga

SEQ ID NO: 8348939 - DNA, 21 bp, Homo sapiens
cagtgctcaatctgacagtgg

SEQ ID NO: 8348940 - DNA, 22 bp, Homo sapiens
cagtgctaggtcgtgtgctggg

SEQ ID NO: 8348941 - DNA, 22 bp, Homo sapiens
cagtgcctggatagcaacatga

SEQ ID NO: 8348942 - DNA, 22 bp, Homo sapiens
cagtgcctgggacccggctgtg

SEQ ID NO: 8348943 - DNA, 22 bp, Homo sapiens
caggtgggagccacagcgtaca

SEQ ID NO: 8348944 - DNA, 22 bp, Homo sapiens
caggtgattctaaagtctagcc

SEQ ID NO: 8348945 - DNA, 22 bp, Homo sapiens
caggtgccatagacgggcctgg

SEQ ID NO: 8348946 - DNA, 22 bp, Homo sapiens
aggacccaagcacagttcctgg

SEQ ID NO: 8348947 - DNA, 22 bp, Homo sapiens
catattttagttgctgaacagc

SEQ ID NO: 8348948 - DNA, 22 bp, Homo sapiens
catatttggtataacttaagca

SEQ ID NO: 8348949 - DNA, 22 bp, Homo sapiens
catatttattcttctgccagtg

SEQ ID NO: 8348950 - DNA, 22 bp, Homo sapiens
catattctgttggtcacataga

SEQ ID NO: 8348951 - DNA, 22 bp, Homo sapiens
catattctttaagcaatgctct

SEQ ID NO: 8348952 - DNA, 22 bp, Homo sapiens
catatttagtgtttggagatcg

SEQ ID NO: 8348953 - DNA, 22 bp, Homo sapiens
catatttatagatctggcattt

SEQ ID NO: 8348954 - DNA, 22 bp, Homo sapiens
catataaatacaacatgtgtta

SEQ ID NO: 8348955 - DNA, 22 bp, Homo sapiens
catataaatacaacatgtgtta

SEQ ID NO: 8348956 - DNA, 22 bp, Homo sapiens
catagatagaggttcctaatag

SEQ ID NO: 8348957 - DNA, 22 bp, Homo sapiens
catagcaacagcatcaagtcaa

SEQ ID NO: 8348958 - DNA, 22 bp, Homo sapiens
catagcaagatcacattctgta

SEQ ID NO: 8348959 - DNA, 22 bp, Homo sapiens
cagtggtccctgaggttgctgg

SEQ ID NO: 8348960 - DNA, 22 bp, Homo sapiens
cagtggtagaagccaagtagat

SEQ ID NO: 8348961 - DNA, 22 bp, Homo sapiens
cagtgggtggctaagtggctga

SEQ ID NO: 8348962 - DNA, 18 bp, Homo sapiens
cagtggtgctgggatgtg

SEQ ID NO: 8348963 - DNA, 22 bp, Homo sapiens
cagttttaaattttgaatgtct

SEQ ID NO: 8348964 - DNA, 21 bp, Homo sapiens
aggatttctgtcatttcagat

SEQ ID NO: 8348965 - DNA, 22 bp, Homo sapiens
aggatttctgtgcctggaaaat

SEQ ID NO: 8348966 - DNA, 22 bp, Homo sapiens
catgggggctgaggctgctgta

SEQ ID NO: 8348967 - DNA, 23 bp, Homo sapiens
catggggagcagtgctcctgacc

SEQ ID NO: 8348968 - DNA, 22 bp, Homo sapiens
catggggagacacctagggaaa

SEQ ID NO: 8348969 - DNA, 22 bp, Homo sapiens
catgtacattctgtagatggag

SEQ ID NO: 8348970 - DNA, 22 bp, Homo sapiens
catgtatacagtagaatactat

SEQ ID NO: 8348971 - DNA, 17 bp, Homo sapiens
catgtatttgaaacaga

SEQ ID NO: 8348972 - DNA, 22 bp, Homo sapiens
aggcactgcagattacaggcgc

SEQ ID NO: 8348973 - DNA, 22 bp, Homo sapiens
catggactctggtttggggagc

SEQ ID NO: 8348974 - DNA, 22 bp, Homo sapiens
catggacaacctccattcgagt

SEQ ID NO: 8348975 - DNA, 22 bp, Homo sapiens
catggaggaccctcagggagct

SEQ ID NO: 8348976 - DNA, 22 bp, Homo sapiens
catggaggaccctcagggagct

SEQ ID NO: 8348977 - DNA, 22 bp, Homo sapiens
aggattctagaaatttgatact

SEQ ID NO: 8348978 - DNA, 16 bp, Homo sapiens
aggaggggaattagga

SEQ ID NO: 8348979 - DNA, 22 bp, Homo sapiens
catgcgggttccaggctgcact

SEQ ID NO: 8348980 - DNA, 20 bp, Homo sapiens
aggaggggatagaatcaaag

SEQ ID NO: 8348981 - DNA, 22 bp, Homo sapiens
aggagggcaggctggctgccta

SEQ ID NO: 8348982 - DNA, 21 bp, Homo sapiens
aggagggcacaaggccaggaa

SEQ ID NO: 8348983 - DNA, 21 bp, Homo sapiens
aggagggcacaaggccaggaa

SEQ ID NO: 8348984 - DNA, 22 bp, Homo sapiens
ccaatagagtgctgtaagaatt

SEQ ID NO: 8348985 - DNA, 18 bp, Homo sapiens
aggcaggctggagtgact

SEQ ID NO: 8348986 - DNA, 22 bp, Homo sapiens
ccaagtccccaagcatgccagg

SEQ ID NO: 8348987 - DNA, 22 bp, Homo sapiens
ccaagtcctgctgccactctac

SEQ ID NO: 8348988 - DNA, 22 bp, Homo sapiens
ccaaggtgggcagatcacgagg

SEQ ID NO: 8348989 - DNA, 22 bp, Homo sapiens
ccaaggagaatgacaccatgga

SEQ ID NO: 8348990 - DNA, 22 bp, Homo sapiens
ccaaggagaaatgctgtgcttt

SEQ ID NO: 8348991 - DNA, 23 bp, Homo sapiens
aggcagcaggttgtccagggtga

SEQ ID NO: 8348992 - DNA, 23 bp, Homo sapiens
aggcagcaggttgtccagggtga

SEQ ID NO: 8348993 - DNA, 22 bp, Homo sapiens
ccaagagttcaagagtgaacca

SEQ ID NO: 8348994 - DNA, 22 bp, Homo sapiens
ccaagatgagctggctccatgg

SEQ ID NO: 8348995 - DNA, 22 bp, Homo sapiens
ccaagcaaggctaattcacttg

SEQ ID NO: 8348996 - DNA, 22 bp, Homo sapiens
ccaagcaaataatcacccacta

SEQ ID NO: 8348997 - DNA, 22 bp, Homo sapiens
ccaagccgcggctcctcctgcg

SEQ ID NO: 8348998 - DNA, 22 bp, Homo sapiens
aggcactgtggaagacatggtt

SEQ ID NO: 8348999 - DNA, 22 bp, Homo sapiens
aggcactgtgcttcttatatgt

SEQ ID NO: 8349000 - DNA, 15 bp, Homo sapiens
aggcactgtgggacc

SEQ ID NO: 8349001 - DNA, 22 bp, Homo sapiens
aggcactgtgctgatgtcttat

SEQ ID NO: 8349002 - DNA, 22 bp, Homo sapiens
aggcactgtgcagtcccaagca

SEQ ID NO: 8349003 - DNA, 22 bp, Homo sapiens
aggcactgtactaggtacaggg

SEQ ID NO: 8349004 - DNA, 22 bp, Homo sapiens
aggcactggtctaccccttagt

SEQ ID NO: 8349005 - DNA, 22 bp, Homo sapiens
catttgttaattactattatct

SEQ ID NO: 8349006 - DNA, 22 bp, Homo sapiens
catttgttaattactattatct

SEQ ID NO: 8349007 - DNA, 22 bp, Homo sapiens
aggcaggggagctggaagggta

SEQ ID NO: 8349008 - DNA, 22 bp, Homo sapiens
aggcaggggagctggaagggta

SEQ ID NO: 8349009 - DNA, 19 bp, Homo sapiens
ccagcagacacagctgccc

SEQ ID NO: 8349010 - DNA, 22 bp, Homo sapiens
ccagcagaggggcggagtgcag

SEQ ID NO: 8349011 - DNA, 22 bp, Homo sapiens
ccagcagagggcgcttcacacc

SEQ ID NO: 8349012 - DNA, 22 bp, Homo sapiens
aggcatggcactgagcagcttc

SEQ ID NO: 8349013 - DNA, 23 bp, Homo sapiens
aggcatggcatggatggtggctc

SEQ ID NO: 8349014 - DNA, 22 bp, Homo sapiens
aggcatggatgtagcagtgacc

SEQ ID NO: 8349015 - DNA, 19 bp, Homo sapiens
aggcccagcgctgggggct

SEQ ID NO: 8349016 - DNA, 22 bp, Homo sapiens
ccagcttctctctgatgcagct

SEQ ID NO: 8349017 - DNA, 19 bp, Homo sapiens
aggcccagcgctgggggct

SEQ ID NO: 8349018 - DNA, 22 bp, Homo sapiens
aggcccagcccgtcctcgtgct

SEQ ID NO: 8349019 - DNA, 22 bp, Homo sapiens
aggcccagcccgtcctcgtgct

SEQ ID NO: 8349020 - DNA, 22 bp, Homo sapiens
aggcccagagcaggaaagggtt

SEQ ID NO: 8349021 - DNA, 22 bp, Homo sapiens
ccagcctggactgggtcttgtg

SEQ ID NO: 8349022 - DNA, 22 bp, Homo sapiens
ccagccctgccagagagagctg

SEQ ID NO: 8349023 - DNA, 17 bp, Homo sapiens
aggccagatgaggcaag

SEQ ID NO: 8349024 - DNA, 22 bp, Homo sapiens
aggccagagaggggaccagcct

SEQ ID NO: 8349025 - DNA, 22 bp, Homo sapiens
ccagcctgaaatgcctcatcct

SEQ ID NO: 8349026 - DNA, 19 bp, Homo sapiens
ccagcctctcttccacccc

SEQ ID NO: 8349027 - DNA, 22 bp, Homo sapiens
aggccctggcccccagagattc

SEQ ID NO: 8349028 - DNA, 22 bp, Homo sapiens
aggccctggcccccagagattc

SEQ ID NO: 8349029 - DNA, 22 bp, Homo sapiens
aggccctggcccccagagattc

SEQ ID NO: 8349030 - DNA, 22 bp, Homo sapiens
aggccctggcactgcctgggag

SEQ ID NO: 8349031 - DNA, 22 bp, Homo sapiens
aggccctgggcagttctgtagc

SEQ ID NO: 8349032 - DNA, 22 bp, Homo sapiens
aggccctgggcagttctgtagc

SEQ ID NO: 8349033 - DNA, 22 bp, Homo sapiens
aggccctggggtctgttaaatt

SEQ ID NO: 8349034 - DNA, 22 bp, Homo sapiens
aggccctggggtctgttaaatt

SEQ ID NO: 8349035 - DNA, 22 bp, Homo sapiens
ccaggacaagtgtggccatggc

SEQ ID NO: 8349036 - DNA, 18 bp, Homo sapiens
aggccctggcctcgaaca

SEQ ID NO: 8349037 - DNA, 18 bp, Homo sapiens
aggccctggcctcgaaca

SEQ ID NO: 8349038 - DNA, 22 bp, Homo sapiens
aggccctggcctgactcaatgt

SEQ ID NO: 8349039 - DNA, 22 bp, Homo sapiens
aggccctggcctgactcaatgt

SEQ ID NO: 8349040 - DNA, 22 bp, Homo sapiens
aggccctggctgggtttcttta

SEQ ID NO: 8349041 - DNA, 22 bp, Homo sapiens
aggccctgggagcagagatgca

SEQ ID NO: 8349042 - DNA, 22 bp, Homo sapiens
aggccctgggagcagagatgca

SEQ ID NO: 8349043 - DNA, 22 bp, Homo sapiens
ccatgcacaccagcaggcagac

SEQ ID NO: 8349044 - DNA, 22 bp, Homo sapiens
aggctgaggtaggaggatcgct

SEQ ID NO: 8349045 - DNA, 22 bp, Homo sapiens
aggctgaggggcgagggaccct

SEQ ID NO: 8349046 - DNA, 22 bp, Homo sapiens
aggctctgtgcagcctgcatct

SEQ ID NO: 8349047 - DNA, 22 bp, Homo sapiens
aggctctgtgatgtgccaggca

SEQ ID NO: 8349048 - DNA, 22 bp, Homo sapiens
aggctctgtgactaaagaggat

SEQ ID NO: 8349049 - DNA, 22 bp, Homo sapiens
aggctctgtgacaatcaagctg

SEQ ID NO: 8349050 - DNA, 22 bp, Homo sapiens
ccatgggcgcacaggcctggag

SEQ ID NO: 8349051 - DNA, 19 bp, Homo sapiens
aggctgcctcaccctccct

SEQ ID NO: 8349052 - DNA, 22 bp, Homo sapiens
cccactgctgctctccatggca

SEQ ID NO: 8349053 - DNA, 22 bp, Homo sapiens
aggctgcctggctgtgagtgaa

SEQ ID NO: 8349054 - DNA, 22 bp, Homo sapiens
aggctgcctcgtgagctcgctg

SEQ ID NO: 8349055 - DNA, 22 bp, Homo sapiens
aggctgcctctgcaggatccct

SEQ ID NO: 8349056 - DNA, 22 bp, Homo sapiens
aggctgcctcttttgagagggt

SEQ ID NO: 8349057 - DNA, 17 bp, Homo sapiens
aggctggctcacaggga

SEQ ID NO: 8349058 - DNA, 22 bp, Homo sapiens
aggctggctcggcttttctgtc

SEQ ID NO: 8349059 - DNA, 22 bp, Homo sapiens
aggctggctgaaaaacaccctt

SEQ ID NO: 8349060 - DNA, 22 bp, Homo sapiens
ccagggtgagaaaaggctggat

SEQ ID NO: 8349061 - DNA, 22 bp, Homo sapiens
ccagggtgaccctcccggtggc

SEQ ID NO: 8349062 - DNA, 22 bp, Homo sapiens
ccagggtgaccctcccggtggc

SEQ ID NO: 8349063 - DNA, 22 bp, Homo sapiens
ccagggtgaccagctggcctag

SEQ ID NO: 8349064 - DNA, 22 bp, Homo sapiens
ccagggtgagtgtcatgggtta

SEQ ID NO: 8349065 - DNA, 22 bp, Homo sapiens
ccagggtgaggaggctcccacg

SEQ ID NO: 8349066 - DNA, 22 bp, Homo sapiens
ccagggtgaggaggctcccacg

SEQ ID NO: 8349067 - DNA, 22 bp, Homo sapiens
ccagggtgagtgtcatgggtta

SEQ ID NO: 8349068 - DNA, 22 bp, Homo sapiens
ccagggtgagtgtcatgggtta

SEQ ID NO: 8349069 - DNA, 22 bp, Homo sapiens
ccagggtcttggagaggagtgc

SEQ ID NO: 8349070 - DNA, 17 bp, Homo sapiens
ccagggaggggccgcgc

SEQ ID NO: 8349071 - DNA, 17 bp, Homo sapiens
ccaggagcgtgggtctc

SEQ ID NO: 8349072 - DNA, 22 bp, Homo sapiens
ccaggagctatgtacacactat

SEQ ID NO: 8349073 - DNA, 22 bp, Homo sapiens
ccaggagctggagggtgcagtg

SEQ ID NO: 8349074 - DNA, 22 bp, Homo sapiens
ccaggaggaaagaccagcccat

SEQ ID NO: 8349075 - DNA, 22 bp, Homo sapiens
aggctcagtctgttcatgcact

SEQ ID NO: 8349076 - DNA, 22 bp, Homo sapiens
aggctcagtatagctggcaagt

SEQ ID NO: 8349077 - DNA, 22 bp, Homo sapiens
aggctcagtatagctggcaagt

SEQ ID NO: 8349078 - DNA, 22 bp, Homo sapiens
aggctcagtcccggcccgcgcc

SEQ ID NO: 8349079 - DNA, 22 bp, Homo sapiens
aggctcaggtctcaggtctggc

SEQ ID NO: 8349080 - DNA, 22 bp, Homo sapiens
aggctcagcctgggcctagagc

SEQ ID NO: 8349081 - DNA, 22 bp, Homo sapiens
aggctcagtgcaaatcattctg

SEQ ID NO: 8349082 - DNA, 22 bp, Homo sapiens
aggctcagttcacgtcaacttt

SEQ ID NO: 8349083 - DNA, 22 bp, Homo sapiens
aggctcagttctgtggtgagcc

SEQ ID NO: 8349084 - DNA, 22 bp, Homo sapiens
aggctcagtttggtttccattg

SEQ ID NO: 8349085 - DNA, 22 bp, Homo sapiens
aggctcagttctgtggtgagcc

SEQ ID NO: 8349086 - DNA, 22 bp, Homo sapiens
cctgaggacacacgctgcagga

SEQ ID NO: 8349087 - DNA, 22 bp, Homo sapiens
cctgagagtggtgtacaggaga

SEQ ID NO: 8349088 - DNA, 22 bp, Homo sapiens
aggggagaggtgagcaacttct

SEQ ID NO: 8349089 - DNA, 17 bp, Homo sapiens
aggggagagtgggaaga

SEQ ID NO: 8349090 - DNA, 22 bp, Homo sapiens
aggggagaaaaatgccttctgt

SEQ ID NO: 8349091 - DNA, 22 bp, Homo sapiens
aggggagaaaaatgccttctgt

SEQ ID NO: 8349092 - DNA, 22 bp, Homo sapiens
aggggacacggcttctccaggg

SEQ ID NO: 8349093 - DNA, 22 bp, Homo sapiens
aggggagagaacataaggaagt

SEQ ID NO: 8349094 - DNA, 22 bp, Homo sapiens
cctgaggatattcaccagcatg

SEQ ID NO: 8349095 - DNA, 22 bp, Homo sapiens
aggggctgctgggtccgcccct

SEQ ID NO: 8349096 - DNA, 22 bp, Homo sapiens
aggggctgcctggcttggcact

SEQ ID NO: 8349097 - DNA, 22 bp, Homo sapiens
aggggctggagttcgaggttac

SEQ ID NO: 8349098 - DNA, 22 bp, Homo sapiens
aggggctgctgggtccgcccct

SEQ ID NO: 8349099 - DNA, 22 bp, Homo sapiens
aggggctggcttatctgagagt

SEQ ID NO: 8349100 - DNA, 22 bp, Homo sapiens
aggggctgggacagagccaagc

SEQ ID NO: 8349101 - DNA, 22 bp, Homo sapiens
aggggctgggacagagccaagc

SEQ ID NO: 8349102 - DNA, 22 bp, Homo sapiens
cctcctggagcattggtgagga

SEQ ID NO: 8349103 - DNA, 22 bp, Homo sapiens
cctcctggccctgggcctggaa

SEQ ID NO: 8349104 - DNA, 22 bp, Homo sapiens
agggctgcaatgggagataact

SEQ ID NO: 8349105 - DNA, 19 bp, Homo sapiens
cctctgccagcccgcctct

SEQ ID NO: 8349106 - DNA, 19 bp, Homo sapiens
cctctgccagcccgcctct

SEQ ID NO: 8349107 - DNA, 19 bp, Homo sapiens
cctctgccagcccgcctct

SEQ ID NO: 8349108 - DNA, 22 bp, Homo sapiens
agggctgcaccggggcttcgcg

SEQ ID NO: 8349109 - DNA, 22 bp, Homo sapiens
agggctgcaggcaagatatggc

SEQ ID NO: 8349110 - DNA, 22 bp, Homo sapiens
cctctgggcaggtagcagcagc

SEQ ID NO: 8349111 - DNA, 16 bp, Homo sapiens
cctctgggcctgcaag

SEQ ID NO: 8349112 - DNA, 22 bp, Homo sapiens
agggccacttgtagactggtga

SEQ ID NO: 8349113 - DNA, 22 bp, Homo sapiens
ccctggagggacagctgctcta

SEQ ID NO: 8349114 - DNA, 22 bp, Homo sapiens
agggccagaatccctcagtcta

SEQ ID NO: 8349115 - DNA, 22 bp, Homo sapiens
agggccagaatccctcagtcta

SEQ ID NO: 8349116 - DNA, 22 bp, Homo sapiens
agggccagagtacatcagggct

SEQ ID NO: 8349117 - DNA, 22 bp, Homo sapiens
ccgcccacactaaatatgagcg

SEQ ID NO: 8349118 - DNA, 22 bp, Homo sapiens
agggccctaaggaaggcacaca

SEQ ID NO: 8349119 - DNA, 22 bp, Homo sapiens
ccgagagcaggtggccgctggt

SEQ ID NO: 8349120 - DNA, 22 bp, Homo sapiens
ccgagcccggagaggagctctt

SEQ ID NO: 8349121 - DNA, 22 bp, Homo sapiens
ccgaggctggcctcagggctgt

SEQ ID NO: 8349122 - DNA, 22 bp, Homo sapiens
ccgaggctggagtgcagtggcg

SEQ ID NO: 8349123 - DNA, 22 bp, Homo sapiens
cccttcagtgctaggctgcctg

SEQ ID NO: 8349124 - DNA, 22 bp, Homo sapiens
ccctttctgggacccctgtctc

SEQ ID NO: 8349125 - DNA, 22 bp, Homo sapiens
agggctcttcctttgcctctca

SEQ ID NO: 8349126 - DNA, 22 bp, Homo sapiens
agggctcttcctttgcctctca

SEQ ID NO: 8349127 - DNA, 22 bp, Homo sapiens
agggctctgttggggtcagcac

SEQ ID NO: 8349128 - DNA, 20 bp, Homo sapiens
agggctctgccttgctgatg

SEQ ID NO: 8349129 - DNA, 22 bp, Homo sapiens
agggctctggggtggcagagat

SEQ ID NO: 8349130 - DNA, 22 bp, Homo sapiens
agggctctgtccccagaggccc

SEQ ID NO: 8349131 - DNA, 22 bp, Homo sapiens
agggctctgtccccagaggccc

SEQ ID NO: 8349132 - DNA, 22 bp, Homo sapiens
agggctctgtgactatcactgc

SEQ ID NO: 8349133 - DNA, 18 bp, Homo sapiens
agggctctctgctgggtt

SEQ ID NO: 8349134 - DNA, 22 bp, Homo sapiens
agggctctgagctggaccacct

SEQ ID NO: 8349135 - DNA, 22 bp, Homo sapiens
agggctctgagctggaccacct

SEQ ID NO: 8349136 - DNA, 22 bp, Homo sapiens
agggctctcttggacaactgct

SEQ ID NO: 8349137 - DNA, 22 bp, Homo sapiens
agggctccaggggaccatcagt

SEQ ID NO: 8349138 - DNA, 22 bp, Homo sapiens
agggcccttacgcaggcccttc

SEQ ID NO: 8349139 - DNA, 22 bp, Homo sapiens
agggcccttacgcaggcccttc

SEQ ID NO: 8349140 - DNA, 23 bp, Homo sapiens
agggcctcaggagggctgcatgg

SEQ ID NO: 8349141 - DNA, 22 bp, Homo sapiens
agggccctctggcaggccaggc

SEQ ID NO: 8349142 - DNA, 22 bp, Homo sapiens
agggccctgagttgcagccctg

SEQ ID NO: 8349143 - DNA, 22 bp, Homo sapiens
agggccctgagttgcagccctg

SEQ ID NO: 8349144 - DNA, 22 bp, Homo sapiens
agggccctagggaatgagacat

SEQ ID NO: 8349145 - DNA, 22 bp, Homo sapiens
agggccctccccgctcagggca

SEQ ID NO: 8349146 - DNA, 22 bp, Homo sapiens
cccaggggtatccatggagaag

SEQ ID NO: 8349147 - DNA, 22 bp, Homo sapiens
agggagtgtaaatggtgctcag

SEQ ID NO: 8349148 - DNA, 22 bp, Homo sapiens
agggatcaaaaaatgtacatgc

SEQ ID NO: 8349149 - DNA, 18 bp, Homo sapiens
agggatcatcactgcagc

SEQ ID NO: 8349150 - DNA, 22 bp, Homo sapiens
agggatgatcagggtagaggct

SEQ ID NO: 8349151 - DNA, 22 bp, Homo sapiens
agggatggagtgcggcccggac

SEQ ID NO: 8349152 - DNA, 22 bp, Homo sapiens
agggatggaagctcgtctgcaa

SEQ ID NO: 8349153 - DNA, 22 bp, Homo sapiens
agggatgatggaaagaagcagg

SEQ ID NO: 8349154 - DNA, 22 bp, Homo sapiens
ccctctgcctctgagtaggaca

SEQ ID NO: 8349155 - DNA, 22 bp, Homo sapiens
ccctctgcaggctggacctgcc

SEQ ID NO: 8349156 - DNA, 22 bp, Homo sapiens
ccctctgctcaggtgcataggc

SEQ ID NO: 8349157 - DNA, 22 bp, Homo sapiens
agggatggatcttggccctgga

SEQ ID NO: 8349158 - DNA, 22 bp, Homo sapiens
ccctctgacctcctgccacagt

SEQ ID NO: 8349159 - DNA, 22 bp, Homo sapiens
ccctctgagacaggtagctcac

SEQ ID NO: 8349160 - DNA, 22 bp, Homo sapiens
agggcagaggcggacacggaag

SEQ ID NO: 8349161 - DNA, 22 bp, Homo sapiens
ccctggaggagcttagagcttg

SEQ ID NO: 8349162 - DNA, 20 bp, Homo sapiens
agggcagagggattacaggc

SEQ ID NO: 8349163 - DNA, 22 bp, Homo sapiens
agggcagagctgtctaaatggc

SEQ ID NO: 8349164 - DNA, 22 bp, Homo sapiens
agggcagaggcggacacggaag

SEQ ID NO: 8349165 - DNA, 22 bp, Homo sapiens
agggcagagacatgcttcctga

SEQ ID NO: 8349166 - DNA, 22 bp, Homo sapiens
agggcagagaaatgtagttgag

SEQ ID NO: 8349167 - DNA, 22 bp, Homo sapiens
agggcagagagatgaatgggat

SEQ ID NO: 8349168 - DNA, 22 bp, Homo sapiens
agggcagagattaattaagaca

SEQ ID NO: 8349169 - DNA, 22 bp, Homo sapiens
agggcagagcactgaattggga

SEQ ID NO: 8349170 - DNA, 22 bp, Homo sapiens
agggcagagatctgagtgggca

SEQ ID NO: 8349171 - DNA, 22 bp, Homo sapiens
aggctggctgagctgcagcctg

SEQ ID NO: 8349172 - DNA, 22 bp, Homo sapiens
aggctggctgacttctgaagca

SEQ ID NO: 8349173 - DNA, 22 bp, Homo sapiens
aggctggctgagctgcagcctg

SEQ ID NO: 8349174 - DNA, 22 bp, Homo sapiens
aggctggctggcaggggacaca

SEQ ID NO: 8349175 - DNA, 21 bp, Homo sapiens
aggcttggatctagacaggcc

SEQ ID NO: 8349176 - DNA, 23 bp, Homo sapiens
agggaagaaacatgaagggctgt

SEQ ID NO: 8349177 - DNA, 22 bp, Homo sapiens
cccagggctgtagaatgtccaa

SEQ ID NO: 8349178 - DNA, 22 bp, Homo sapiens
cccagggcttgagtcatccatg

SEQ ID NO: 8349179 - DNA, 22 bp, Homo sapiens
cccagggcttgagtcatccatg

SEQ ID NO: 8349180 - DNA, 22 bp, Homo sapiens
cccaggggaggtcctcagggaa

SEQ ID NO: 8349181 - DNA, 22 bp, Homo sapiens
cccaggagttggaggctgcagt

SEQ ID NO: 8349182 - DNA, 22 bp, Homo sapiens
caaagaatgagtgagtacataa

SEQ ID NO: 8349183 - DNA, 22 bp, Homo sapiens
caaagaatgagtgagtacataa

SEQ ID NO: 8349184 - DNA, 22 bp, Homo sapiens
caaagaatgagtgagtacataa

SEQ ID NO: 8349185 - DNA, 22 bp, Homo sapiens
gctcccatagcagatttttgac

SEQ ID NO: 8349186 - DNA, 22 bp, Homo sapiens
gctccccagcttagccctggct

SEQ ID NO: 8349187 - DNA, 22 bp, Homo sapiens
gctccccagcttagccctggct

SEQ ID NO: 8349188 - DNA, 20 bp, Homo sapiens
caaaagcaatgaagttatga

SEQ ID NO: 8349189 - DNA, 22 bp, Homo sapiens
caaaagatacttgcatctaact

SEQ ID NO: 8349190 - DNA, 22 bp, Homo sapiens
caaaagaagctcttggggctag

SEQ ID NO: 8349191 - DNA, 22 bp, Homo sapiens
gctcagagaatcagcagacacc

SEQ ID NO: 8349192 - DNA, 22 bp, Homo sapiens
gctcagagaatttactgctgcc

SEQ ID NO: 8349193 - DNA, 22 bp, Homo sapiens
attttcatcatgggtttaacat

SEQ ID NO: 8349194 - DNA, 22 bp, Homo sapiens
attttcagttgaaaaagttggt

SEQ ID NO: 8349195 - DNA, 21 bp, Homo sapiens
attttcattaattcagtgtgg

SEQ ID NO: 8349196 - DNA, 22 bp, Homo sapiens
attttccagcctttctagaact

SEQ ID NO: 8349197 - DNA, 22 bp, Homo sapiens
attttccagcctttctagaact

SEQ ID NO: 8349198 - DNA, 22 bp, Homo sapiens
attttctaagcctgtcagactt

SEQ ID NO: 8349199 - DNA, 22 bp, Homo sapiens
attttccatctccacaccaggg

SEQ ID NO: 8349200 - DNA, 22 bp, Homo sapiens
atttgtcactgagagagttaga

SEQ ID NO: 8349201 - DNA, 22 bp, Homo sapiens
atttgtcacacatagtttatcc

SEQ ID NO: 8349202 - DNA, 22 bp, Homo sapiens
atttgtctagtggtattcacgt

SEQ ID NO: 8349203 - DNA, 22 bp, Homo sapiens
atttgtctctgcactttactca

SEQ ID NO: 8349204 - DNA, 22 bp, Homo sapiens
atttgtctctgcactttactca

SEQ ID NO: 8349205 - DNA, 22 bp, Homo sapiens
attttagatttaagaataaggt

SEQ ID NO: 8349206 - DNA, 22 bp, Homo sapiens
attttcagcccccactcgtggc

SEQ ID NO: 8349207 - DNA, 22 bp, Homo sapiens
attttcagcccccactcgtggc

SEQ ID NO: 8349208 - DNA, 22 bp, Homo sapiens
attttcaggttttgccattgta

SEQ ID NO: 8349209 - DNA, 22 bp, Homo sapiens
atttgtatcttctaatattatc

SEQ ID NO: 8349210 - DNA, 22 bp, Homo sapiens
atttgtcaaaacacagagaaca

SEQ ID NO: 8349211 - DNA, 22 bp, Homo sapiens
atttgtcaataagatgaacata

SEQ ID NO: 8349212 - DNA, 22 bp, Homo sapiens
atttggaattcgagtaattcca

SEQ ID NO: 8349213 - DNA, 22 bp, Homo sapiens
atttggcttctctaatactata

SEQ ID NO: 8349214 - DNA, 22 bp, Homo sapiens
atttggtagtgattgaaattat

SEQ ID NO: 8349215 - DNA, 22 bp, Homo sapiens
atttgggaattatttgcctaat

SEQ ID NO: 8349216 - DNA, 20 bp, Homo sapiens
atttgggacgattggccacc

SEQ ID NO: 8349217 - DNA, 22 bp, Homo sapiens
atttgggaatgtgcattatact

SEQ ID NO: 8349218 - DNA, 22 bp, Homo sapiens
atttgtaagctagagccatgat

SEQ ID NO: 8349219 - DNA, 22 bp, Homo sapiens
atttgtaatttcttatctgtgt

SEQ ID NO: 8349220 - DNA, 22 bp, Homo sapiens
atttgtaatttcttatctgtgt

SEQ ID NO: 8349221 - DNA, 22 bp, Homo sapiens
gccatgcctgtgtctccaggcc

SEQ ID NO: 8349222 - DNA, 22 bp, Homo sapiens
gccatgcctgtgtctccaggcc

SEQ ID NO: 8349223 - DNA, 22 bp, Homo sapiens
gccatgcctgtgtctccaggcc

SEQ ID NO: 8349224 - DNA, 23 bp, Homo sapiens
gccatcctaaaacccctgtctgt

SEQ ID NO: 8349225 - DNA, 22 bp, Homo sapiens
gccatcctctgagcactaggca

SEQ ID NO: 8349226 - DNA, 23 bp, Homo sapiens
gccatgagttccctttcacttgt

SEQ ID NO: 8349227 - DNA, 22 bp, Homo sapiens
atttcaagtgttgagctcataa

SEQ ID NO: 8349228 - DNA, 22 bp, Homo sapiens
atttctgtttgctactataagt

SEQ ID NO: 8349229 - DNA, 22 bp, Homo sapiens
atttctgtttgctactataagt

SEQ ID NO: 8349230 - DNA, 22 bp, Homo sapiens
gccctggggaaggtgtctccaa

SEQ ID NO: 8349231 - DNA, 22 bp, Homo sapiens
gccctgtcctcctgactgagtg

SEQ ID NO: 8349232 - DNA, 22 bp, Homo sapiens
gccctgtgatggagactagagg

SEQ ID NO: 8349233 - DNA, 22 bp, Homo sapiens
gccctgtgccagtcacgctgtg

SEQ ID NO: 8349234 - DNA, 22 bp, Homo sapiens
gcccagtgctgagggtgctgct

SEQ ID NO: 8349235 - DNA, 22 bp, Homo sapiens
atttcccactctactacatgct

SEQ ID NO: 8349236 - DNA, 22 bp, Homo sapiens
atttcccagggccctcatagtt

SEQ ID NO: 8349237 - DNA, 17 bp, Homo sapiens
gccctgcctgctgccct

SEQ ID NO: 8349238 - DNA, 22 bp, Homo sapiens
gccctgcctgccggtgtgggtc

SEQ ID NO: 8349239 - DNA, 22 bp, Homo sapiens
gccctgcctgccggtgtgggtc

SEQ ID NO: 8349240 - DNA, 22 bp, Homo sapiens
gccctgggctccctgctccaca

SEQ ID NO: 8349241 - DNA, 22 bp, Homo sapiens
atttccggtctcagtctctcaa

SEQ ID NO: 8349242 - DNA, 23 bp, Homo sapiens
atttcctactataaaagaggtaa

SEQ ID NO: 8349243 - DNA, 22 bp, Homo sapiens
atttatgactggtgaatagaac

SEQ ID NO: 8349244 - DNA, 22 bp, Homo sapiens
atttatgacagaagatatgctg

SEQ ID NO: 8349245 - DNA, 22 bp, Homo sapiens
atttatagggcattgaaaactg

SEQ ID NO: 8349246 - DNA, 22 bp, Homo sapiens
atttatcaacatgtaccattgg

SEQ ID NO: 8349247 - DNA, 21 bp, Homo sapiens
atttagaaggaaattttgcaa

SEQ ID NO: 8349248 - DNA, 22 bp, Homo sapiens
gccatcatatcccctgtgacct

SEQ ID NO: 8349249 - DNA, 22 bp, Homo sapiens
atttatgatagctgcattaaag

SEQ ID NO: 8349250 - DNA, 22 bp, Homo sapiens
atttatgtatctgtgtagatca

SEQ ID NO: 8349251 - DNA, 22 bp, Homo sapiens
gccagccagagtccatctgaga

SEQ ID NO: 8349252 - DNA, 23 bp, Homo sapiens
gccagccagaatttctccactgt

SEQ ID NO: 8349253 - DNA, 22 bp, Homo sapiens
gccagctgctcgcgtagggtag

SEQ ID NO: 8349254 - DNA, 22 bp, Homo sapiens
gccagctgccctctgctggtcc

SEQ ID NO: 8349255 - DNA, 22 bp, Homo sapiens
gccagctgcatctcctgggctg

SEQ ID NO: 8349256 - DNA, 21 bp, Homo sapiens
gccagctgcagggcttccttg

SEQ ID NO: 8349257 - DNA, 19 bp, Homo sapiens
attcatttttgccttctaa

SEQ ID NO: 8349258 - DNA, 22 bp, Homo sapiens
attcacaaaatgatatagatac

SEQ ID NO: 8349259 - DNA, 22 bp, Homo sapiens
attccacataggccttcatgac

SEQ ID NO: 8349260 - DNA, 22 bp, Homo sapiens
attccacagtgccttccgtgaa

SEQ ID NO: 8349261 - DNA, 22 bp, Homo sapiens
gcaggcaaggaacagagactgt

SEQ ID NO: 8349262 - DNA, 22 bp, Homo sapiens
gcaggcaggaaggactaagtaa

SEQ ID NO: 8349263 - DNA, 22 bp, Homo sapiens
attctgagaggcacaatgtgga

SEQ ID NO: 8349264 - DNA, 22 bp, Homo sapiens
attctccacacatccagacctt

SEQ ID NO: 8349265 - DNA, 22 bp, Homo sapiens
attctctttgtataacatcttg

SEQ ID NO: 8349266 - DNA, 22 bp, Homo sapiens
attctgatatcttattctagct

SEQ ID NO: 8349267 - DNA, 22 bp, Homo sapiens
attctgagtggaaactatcaat

SEQ ID NO: 8349268 - DNA, 22 bp, Homo sapiens
attctgagtacaacaagatgtt

SEQ ID NO: 8349269 - DNA, 22 bp, Homo sapiens
attcttttgtcctagcttgata

SEQ ID NO: 8349270 - DNA, 20 bp, Homo sapiens
gcagggcatcttggccccca

SEQ ID NO: 8349271 - DNA, 20 bp, Homo sapiens
gcaggcagggaatgggggtg

SEQ ID NO: 8349272 - DNA, 22 bp, Homo sapiens
gcagtaaagcctgagatatatg

SEQ ID NO: 8349273 - DNA, 22 bp, Homo sapiens
gcagtaaagcctgagatatatg

SEQ ID NO: 8349274 - DNA, 18 bp, Homo sapiens
gcaggtgtggagaagggg

SEQ ID NO: 8349275 - DNA, 22 bp, Homo sapiens
attcttttttaaggaatagaac

SEQ ID NO: 8349276 - DNA, 22 bp, Homo sapiens
gcaggtgttctcagaggaggct

SEQ ID NO: 8349277 - DNA, 22 bp, Homo sapiens
gcaggtgttctcagaggaggct

SEQ ID NO: 8349278 - DNA, 22 bp, Homo sapiens
attgcaccttgggttttgaaag

SEQ ID NO: 8349279 - DNA, 22 bp, Homo sapiens
gcatcatttgtcctctaggact

SEQ ID NO: 8349280 - DNA, 22 bp, Homo sapiens
attatccaacacccagttacat

SEQ ID NO: 8349281 - DNA, 22 bp, Homo sapiens
attatatttgaaaggttggaag

SEQ ID NO: 8349282 - DNA, 22 bp, Homo sapiens
attatataggacttgcccttcc

SEQ ID NO: 8349283 - DNA, 22 bp, Homo sapiens
attatatgtgggatagaattta

SEQ ID NO: 8349284 - DNA, 22 bp, Homo sapiens
attataggcttgagccaccgtg

SEQ ID NO: 8349285 - DNA, 22 bp, Homo sapiens
attatataaaattctggaagct

SEQ ID NO: 8349286 - DNA, 22 bp, Homo sapiens
gcaccagggtgctgtgttctgg

SEQ ID NO: 8349287 - DNA, 22 bp, Homo sapiens
gcaccaggtgcagccgggcccc

SEQ ID NO: 8349288 - DNA, 22 bp, Homo sapiens
gcacacagccagctgagggcta

SEQ ID NO: 8349289 - DNA, 22 bp, Homo sapiens
attatctatgtagaatgatttt

SEQ ID NO: 8349290 - DNA, 22 bp, Homo sapiens
attatgcatttgttagtattaa

SEQ ID NO: 8349291 - DNA, 22 bp, Homo sapiens
attatctcaagggatagcagat

SEQ ID NO: 8349292 - DNA, 22 bp, Homo sapiens
attatcttgataaaatggcagt

SEQ ID NO: 8349293 - DNA, 22 bp, Homo sapiens
attatgtatttggtatagtttg

SEQ ID NO: 8349294 - DNA, 22 bp, Homo sapiens
gcagagagttgggctgcgccag

SEQ ID NO: 8349295 - DNA, 22 bp, Homo sapiens
gagtggggcgtggatccagcgt

SEQ ID NO: 8349296 - DNA, 22 bp, Homo sapiens
gagtggggcgaagtcggcgagt

SEQ ID NO: 8349297 - DNA, 22 bp, Homo sapiens
atgttattaaagtacagattct

SEQ ID NO: 8349298 - DNA, 22 bp, Homo sapiens
atgttattaaagtacagattct

SEQ ID NO: 8349299 - DNA, 23 bp, Homo sapiens
atgttattattagcagtcttgcc

SEQ ID NO: 8349300 - DNA, 23 bp, Homo sapiens
atgttattattagcagtcttgcc

SEQ ID NO: 8349301 - DNA, 22 bp, Homo sapiens
atgttattcaatttgaatccaa

SEQ ID NO: 8349302 - DNA, 22 bp, Homo sapiens
atgttattgatgcctgaggctt

SEQ ID NO: 8349303 - DNA, 21 bp, Homo sapiens
atgttattctgttcctccagc

SEQ ID NO: 8349304 - DNA, 21 bp, Homo sapiens
gagtgggctgagatggggctg

SEQ ID NO: 8349305 - DNA, 21 bp, Homo sapiens
gagtgggctgagatggggctg

SEQ ID NO: 8349306 - DNA, 22 bp, Homo sapiens
gagtggggaaagccaggacaga

SEQ ID NO: 8349307 - DNA, 22 bp, Homo sapiens
gagtggggcccactgctgggtg

SEQ ID NO: 8349308 - DNA, 22 bp, Homo sapiens
atgttatttctgaaagatcatt

SEQ ID NO: 8349309 - DNA, 22 bp, Homo sapiens
atgttatttcaaaattcccttg

SEQ ID NO: 8349310 - DNA, 22 bp, Homo sapiens
atgttatttcaaaattcccttg

SEQ ID NO: 8349311 - DNA, 22 bp, Homo sapiens
atgttatttattatcctcggtt

SEQ ID NO: 8349312 - DNA, 22 bp, Homo sapiens
atgttatttattgaaacacttt

SEQ ID NO: 8349313 - DNA, 22 bp, Homo sapiens
gatggagtgccagggtggaact

SEQ ID NO: 8349314 - DNA, 22 bp, Homo sapiens
gatggagtctgaagctgggaac

SEQ ID NO: 8349315 - DNA, 22 bp, Homo sapiens
gatggcagtcaaccaggtgagg

SEQ ID NO: 8349316 - DNA, 22 bp, Homo sapiens
gatggcaggcaggtgagtagag

SEQ ID NO: 8349317 - DNA, 22 bp, Homo sapiens
gatggcagtgggcctcgagtcc

SEQ ID NO: 8349318 - DNA, 22 bp, Homo sapiens
gatgtgaggactcatgtggagg

SEQ ID NO: 8349319 - DNA, 22 bp, Homo sapiens
gatgtgaggtggtaaacaggga

SEQ ID NO: 8349320 - DNA, 22 bp, Homo sapiens
gattcataccgtttcttctcca

SEQ ID NO: 8349321 - DNA, 18 bp, Homo sapiens
gatgtgggccctggatat

SEQ ID NO: 8349322 - DNA, 22 bp, Homo sapiens
gatgtggggataatactggtac

SEQ ID NO: 8349323 - DNA, 22 bp, Homo sapiens
gatgtggggttgagggaccagc

SEQ ID NO: 8349324 - DNA, 22 bp, Homo sapiens
gatgtgggtgtcttcagctggt

SEQ ID NO: 8349325 - DNA, 22 bp, Homo sapiens
atgcagtacagataattctaca

SEQ ID NO: 8349326 - DNA, 22 bp, Homo sapiens
atgcagtactgatacatgccac

SEQ ID NO: 8349327 - DNA, 22 bp, Homo sapiens
atgcagtggcagctcctggtgt

SEQ ID NO: 8349328 - DNA, 22 bp, Homo sapiens
atgcagttagcagtagctcccc

SEQ ID NO: 8349329 - DNA, 22 bp, Homo sapiens
atgcagttagcactacagaaga

SEQ ID NO: 8349330 - DNA, 22 bp, Homo sapiens
gaaggagggagcggcgcggatt

SEQ ID NO: 8349331 - DNA, 22 bp, Homo sapiens
gaagcagcagctggggacagtt

SEQ ID NO: 8349332 - DNA, 22 bp, Homo sapiens
gaagcagcaagtataggacagg

SEQ ID NO: 8349333 - DNA, 22 bp, Homo sapiens
gaagcagcaaatctgcagtatc

SEQ ID NO: 8349334 - DNA, 22 bp, Homo sapiens
gaagcagcaaatctgcagtatc

SEQ ID NO: 8349335 - DNA, 22 bp, Homo sapiens
gaagcggggagggtgagcccgg

SEQ ID NO: 8349336 - DNA, 22 bp, Homo sapiens
gaagctctaaggtcattgcatt

SEQ ID NO: 8349337 - DNA, 22 bp, Homo sapiens
gaagctggggtgctgagggcaa

SEQ ID NO: 8349338 - DNA, 19 bp, Homo sapiens
atgatggtcccattcacct

SEQ ID NO: 8349339 - DNA, 22 bp, Homo sapiens
atgatggtgggagatgacccag

SEQ ID NO: 8349340 - DNA, 22 bp, Homo sapiens
atgatggtgaggttgagcacag

SEQ ID NO: 8349341 - DNA, 22 bp, Homo sapiens
atgatggtgggtaatgtgtaaa

SEQ ID NO: 8349342 - DNA, 22 bp, Homo sapiens
atgatggttgtcctaggtgcat

SEQ ID NO: 8349343 - DNA, 22 bp, Homo sapiens
atgatggtaaattcagtatccg

SEQ ID NO: 8349344 - DNA, 22 bp, Homo sapiens
atgagcatctgagccagtgact

SEQ ID NO: 8349345 - DNA, 22 bp, Homo sapiens
gaatttcctctaaacccctgag

SEQ ID NO: 8349346 - DNA, 22 bp, Homo sapiens
gaatttcctctaaacccctgag

SEQ ID NO: 8349347 - DNA, 19 bp, Homo sapiens
gaattttaggacttcagca

SEQ ID NO: 8349348 - DNA, 22 bp, Homo sapiens
atgctaaggcccaggagaaaat

SEQ ID NO: 8349349 - DNA, 22 bp, Homo sapiens
atgctacagagataggttgggt

SEQ ID NO: 8349350 - DNA, 22 bp, Homo sapiens
atgctacagagtttgaatatgt

SEQ ID NO: 8349351 - DNA, 22 bp, Homo sapiens
atgctacagcatctctcatcag

SEQ ID NO: 8349352 - DNA, 22 bp, Homo sapiens
atgctacaacattatctggggt

SEQ ID NO: 8349353 - DNA, 23 bp, Homo sapiens
atgctacaccaacacaggggaat

SEQ ID NO: 8349354 - DNA, 22 bp, Homo sapiens
atgctacactatttgctgagca

SEQ ID NO: 8349355 - DNA, 22 bp, Homo sapiens
atgctacactccgcgaaaatgt

SEQ ID NO: 8349356 - DNA, 22 bp, Homo sapiens
atgctaaatccagaagcagtca

SEQ ID NO: 8349357 - DNA, 22 bp, Homo sapiens
atgctatgtaactggcagatag

SEQ ID NO: 8349358 - DNA, 22 bp, Homo sapiens
atgctacattttggtttataaa

SEQ ID NO: 8349359 - DNA, 22 bp, Homo sapiens
atgctacaggaagacgtcaggc

SEQ ID NO: 8349360 - DNA, 22 bp, Homo sapiens
atgctacagccctctttgcata

SEQ ID NO: 8349361 - DNA, 22 bp, Homo sapiens
atgctacatagatacaaaaatg

SEQ ID NO: 8349362 - DNA, 18 bp, Homo sapiens
atgctacaggcaggtgtc

SEQ ID NO: 8349363 - DNA, 22 bp, Homo sapiens
atgctacaggattctccttatc

SEQ ID NO: 8349364 - DNA, 22 bp, Homo sapiens
atgctacaggagccccacttag

SEQ ID NO: 8349365 - DNA, 22 bp, Homo sapiens
atgcatttgacgggatatattt

SEQ ID NO: 8349366 - DNA, 22 bp, Homo sapiens
gaagtcagctccccaggtcccc

SEQ ID NO: 8349367 - DNA, 22 bp, Homo sapiens
gaagtacactactccttgagtc

SEQ ID NO: 8349368 - DNA, 22 bp, Homo sapiens
gaagtacaggttgtgagagaat

SEQ ID NO: 8349369 - DNA, 21 bp, Homo sapiens
gaagtacaccaggaaggccac

SEQ ID NO: 8349370 - DNA, 19 bp, Homo sapiens
gaatttatctcttcagtcc

SEQ ID NO: 8349371 - DNA, 22 bp, Homo sapiens
atgccactgcacttcagcctgg

SEQ ID NO: 8349372 - DNA, 22 bp, Homo sapiens
atgccactgcacttcagcctgg

SEQ ID NO: 8349373 - DNA, 22 bp, Homo sapiens
atgccactgcactccagcctgg

SEQ ID NO: 8349374 - DNA, 22 bp, Homo sapiens
atgccactgcactccagcctag

SEQ ID NO: 8349375 - DNA, 22 bp, Homo sapiens
cttctccctggcttctgcacac

SEQ ID NO: 8349376 - DNA, 22 bp, Homo sapiens
atctttcaatcaggaaaaatct

SEQ ID NO: 8349377 - DNA, 22 bp, Homo sapiens
ctttcaaaacgctctgtatgca

SEQ ID NO: 8349378 - DNA, 22 bp, Homo sapiens
ctttacaccaagcagatctttc

SEQ ID NO: 8349379 - DNA, 22 bp, Homo sapiens
ctttacacttggacccacactt

SEQ ID NO: 8349380 - DNA, 22 bp, Homo sapiens
ctttacacaatgattttcttta

SEQ ID NO: 8349381 - DNA, 22 bp, Homo sapiens
ctttacacatcctaaccagtgt

SEQ ID NO: 8349382 - DNA, 22 bp, Homo sapiens
ctttacacatgagacctgcaat

SEQ ID NO: 8349383 - DNA, 22 bp, Homo sapiens
atctttgactgccattcttgac

SEQ ID NO: 8349384 - DNA, 22 bp, Homo sapiens
atctttgatgtgtgcccattca

SEQ ID NO: 8349385 - DNA, 22 bp, Homo sapiens
atctttgatctttattgctaag

SEQ ID NO: 8349386 - DNA, 21 bp, Homo sapiens
atgagagtaatgctataaatt

SEQ ID NO: 8349387 - DNA, 22 bp, Homo sapiens
atgagaaatttattacaagcta

SEQ ID NO: 8349388 - DNA, 22 bp, Homo sapiens
atgagaaagttaatcatcatga

SEQ ID NO: 8349389 - DNA, 22 bp, Homo sapiens
atgagaatggtgattctgcaga

SEQ ID NO: 8349390 - DNA, 22 bp, Homo sapiens
ctttttataccgtgccagttga

SEQ ID NO: 8349391 - DNA, 22 bp, Homo sapiens
ctttttatctcttaatgatgtt

SEQ ID NO: 8349392 - DNA, 19 bp, Homo sapiens
ctttttcaccttctagaag

SEQ ID NO: 8349393 - DNA, 22 bp, Homo sapiens
atgaattgaggaaaacagtcgt

SEQ ID NO: 8349394 - DNA, 22 bp, Homo sapiens
atgaatttttctaagcttttgt

SEQ ID NO: 8349395 - DNA, 22 bp, Homo sapiens
atgacaaaagaagacatgaggt

SEQ ID NO: 8349396 - DNA, 22 bp, Homo sapiens
atgacacaattttagagctgaa

SEQ ID NO: 8349397 - DNA, 22 bp, Homo sapiens
ctttgccaaaagctgcaggtgg

SEQ ID NO: 8349398 - DNA, 22 bp, Homo sapiens
atgtggccagtcatgtagtaac

SEQ ID NO: 8349399 - DNA, 22 bp, Homo sapiens
atgtggccttaatgacagcagc

SEQ ID NO: 8349400 - DNA, 22 bp, Homo sapiens
atgtggcccagcggtcaggctg

SEQ ID NO: 8349401 - DNA, 22 bp, Homo sapiens
gaggtgtgaggaatgaatgggg

SEQ ID NO: 8349402 - DNA, 22 bp, Homo sapiens
gaggtgtgttacagattgtcat

SEQ ID NO: 8349403 - DNA, 22 bp, Homo sapiens
gaggtgtgcacagcgtgctgac

SEQ ID NO: 8349404 - DNA, 22 bp, Homo sapiens
gaggtgtgatgcagagtggtgg

SEQ ID NO: 8349405 - DNA, 22 bp, Homo sapiens
atgttatagttataaaatgagg

SEQ ID NO: 8349406 - DNA, 22 bp, Homo sapiens
gaggttggagggctggcctgca

SEQ ID NO: 8349407 - DNA, 22 bp, Homo sapiens
atgttagcttgtgtgaaaatgc

SEQ ID NO: 8349408 - DNA, 22 bp, Homo sapiens
atgttagcattgagcacttact

SEQ ID NO: 8349409 - DNA, 22 bp, Homo sapiens
atgttacagttgagtaaattaa

SEQ ID NO: 8349410 - DNA, 22 bp, Homo sapiens
atgtatgtgttgcaattatgtt

SEQ ID NO: 8349411 - DNA, 22 bp, Homo sapiens
atgtattgaccatactactaaa

SEQ ID NO: 8349412 - DNA, 23 bp, Homo sapiens
atgtatttaaatttcagtgatga

SEQ ID NO: 8349413 - DNA, 22 bp, Homo sapiens
atgtatttactgagaaggaaac

SEQ ID NO: 8349414 - DNA, 22 bp, Homo sapiens
gaggcctgggttggaggtgcat

SEQ ID NO: 8349415 - DNA, 22 bp, Homo sapiens
atgtatttctatgtagtgaaga

SEQ ID NO: 8349416 - DNA, 22 bp, Homo sapiens
gaggctctgtgatgtgccaggc

SEQ ID NO: 8349417 - DNA, 22 bp, Homo sapiens
gaggaggggcacttgtctccta

SEQ ID NO: 8349418 - DNA, 22 bp, Homo sapiens
gaggaggggacagtacttgtgc

SEQ ID NO: 8349419 - DNA, 22 bp, Homo sapiens
gaggaggggacagtacttgtgc

SEQ ID NO: 8349420 - DNA, 22 bp, Homo sapiens
gaggaggggcacttgtctccta

SEQ ID NO: 8349421 - DNA, 23 bp, Homo sapiens
gaggagggtcgtgctgtgttcct

SEQ ID NO: 8349422 - DNA, 22 bp, Homo sapiens
gaggcacagtcccgaggcaagg

SEQ ID NO: 8349423 - DNA, 22 bp, Homo sapiens
atgggcagcagctgccattcat

SEQ ID NO: 8349424 - DNA, 22 bp, Homo sapiens
atgggcagagtggggacaggaa

SEQ ID NO: 8349425 - DNA, 22 bp, Homo sapiens
atgggcagcagctgtcattttc

SEQ ID NO: 8349426 - DNA, 22 bp, Homo sapiens
atgggcaggcactggctctcag

SEQ ID NO: 8349427 - DNA, 22 bp, Homo sapiens
atgggcagctgcagcagtggtg

SEQ ID NO: 8349428 - DNA, 22 bp, Homo sapiens
atgggcaggcaaggtggcgagt

SEQ ID NO: 8349429 - DNA, 22 bp, Homo sapiens
gaggagggagctggaagctctt

SEQ ID NO: 8349430 - DNA, 22 bp, Homo sapiens
gaggagggcagttcctctttta

SEQ ID NO: 8349431 - DNA, 22 bp, Homo sapiens
gaggagggcagttcctctttta

SEQ ID NO: 8349432 - DNA, 22 bp, Homo sapiens
gaggagggcctggtgtcccttc

SEQ ID NO: 8349433 - DNA, 22 bp, Homo sapiens
gaggagggcctggtgtcccttc

SEQ ID NO: 8349434 - DNA, 22 bp, Homo sapiens
gaggagggctttgttgatgtta

SEQ ID NO: 8349435 - DNA, 22 bp, Homo sapiens
gaggagggctttgttgatgtta

SEQ ID NO: 8349436 - DNA, 23 bp, Homo sapiens
gagaacagccacagagagctgtg

SEQ ID NO: 8349437 - DNA, 22 bp, Homo sapiens
gagaatattagagttagtttat

SEQ ID NO: 8349438 - DNA, 22 bp, Homo sapiens
gagaatatattgaagtagttcc

SEQ ID NO: 8349439 - DNA, 22 bp, Homo sapiens
gagacagcctactccagtctca

SEQ ID NO: 8349440 - DNA, 22 bp, Homo sapiens
atggcaaaaattaacagatcaa

SEQ ID NO: 8349441 - DNA, 22 bp, Homo sapiens
atggcagacacaggcaggcaga

SEQ ID NO: 8349442 - DNA, 22 bp, Homo sapiens
atgggcagagctggtgggaggc

SEQ ID NO: 8349443 - DNA, 22 bp, Homo sapiens
atgggcagacagggagctcacg

SEQ ID NO: 8349444 - DNA, 17 bp, Homo sapiens
gagcccgttatcgggga

SEQ ID NO: 8349445 - DNA, 22 bp, Homo sapiens
gagccccaggacagctctagtt

SEQ ID NO: 8349446 - DNA, 21 bp, Homo sapiens
atgggcagaggcagagaggct

SEQ ID NO: 8349447 - DNA, 22 bp, Homo sapiens
gagctgcatgcggaaacctgtt

SEQ ID NO: 8349448 - DNA, 22 bp, Homo sapiens
gagctctgtgtagcctgagggt

SEQ ID NO: 8349449 - DNA, 22 bp, Homo sapiens
atgggaggaagagaagatgtct

SEQ ID NO: 8349450 - DNA, 22 bp, Homo sapiens
gagcacagctggaggtagcatt

SEQ ID NO: 8349451 - DNA, 22 bp, Homo sapiens
gagcacaggctttggtggacac

SEQ ID NO: 8349452 - DNA, 20 bp, Homo sapiens
atggctctgattctgagccc

SEQ ID NO: 8349453 - DNA, 22 bp, Homo sapiens
atggctctgctgggcaaagcaa

SEQ ID NO: 8349454 - DNA, 20 bp, Homo sapiens
atggctctgtttggcagtga

SEQ ID NO: 8349455 - DNA, 22 bp, Homo sapiens
atggctctttattctgctgcat

SEQ ID NO: 8349456 - DNA, 22 bp, Homo sapiens
atggctcatttatcttgcagcc

SEQ ID NO: 8349457 - DNA, 22 bp, Homo sapiens
atggctctaggttgggcagttt

SEQ ID NO: 8349458 - DNA, 22 bp, Homo sapiens
gctgccctgacaagctactccc

SEQ ID NO: 8349459 - DNA, 22 bp, Homo sapiens
gctgccctctgtgacccggccc

SEQ ID NO: 8349460 - DNA, 22 bp, Homo sapiens
gctgccctctctggccccacac

SEQ ID NO: 8349461 - DNA, 22 bp, Homo sapiens
gctgccctctctggccccacac

SEQ ID NO: 8349462 - DNA, 22 bp, Homo sapiens
gctgccctcccagggcaagctt

SEQ ID NO: 8349463 - DNA, 22 bp, Homo sapiens
gctgccctcccagggcaagctt

SEQ ID NO: 8349464 - DNA, 22 bp, Homo sapiens
gctgccctgcatctgtgccttc

SEQ ID NO: 8349465 - DNA, 21 bp, Homo sapiens
gctgccctggctcagcattca

SEQ ID NO: 8349466 - DNA, 22 bp, Homo sapiens
gctgccctgactccagcagcct

SEQ ID NO: 8349467 - DNA, 22 bp, Homo sapiens
gctgccctgactccagcagcct

SEQ ID NO: 8349468 - DNA, 22 bp, Homo sapiens
gctgccctgactccagcagcct

SEQ ID NO: 8349469 - DNA, 22 bp, Homo sapiens
gctgccctccagttcccacagt

SEQ ID NO: 8349470 - DNA, 22 bp, Homo sapiens
gctgccctccagttcccacagt

SEQ ID NO: 8349471 - DNA, 18 bp, Homo sapiens
gctgccctagctcccctc

SEQ ID NO: 8349472 - DNA, 22 bp, Homo sapiens
gctctggatccggctgggtctg

SEQ ID NO: 8349473 - DNA, 22 bp, Homo sapiens
gctctggaggctggaagaccat

SEQ ID NO: 8349474 - DNA, 22 bp, Homo sapiens
gctctggaagcatctgagagga

SEQ ID NO: 8349475 - DNA, 22 bp, Homo sapiens
gctctggaccctgccagcctta

SEQ ID NO: 8349476 - DNA, 22 bp, Homo sapiens
gctctggaacctgccaggatgc

SEQ ID NO: 8349477 - DNA, 22 bp, Homo sapiens
gctctggaccctggagtggctg

SEQ ID NO: 8349478 - DNA, 22 bp, Homo sapiens
gctgccctgtccggctctcctg

SEQ ID NO: 8349479 - DNA, 22 bp, Homo sapiens
caaattttgtgtgttctctagt

SEQ ID NO: 8349480 - DNA, 22 bp, Homo sapiens
gctgccctgtctgcagcaggac

SEQ ID NO: 8349481 - DNA, 22 bp, Homo sapiens
caactttcacactccacatgct

SEQ ID NO: 8349482 - DNA, 22 bp, Homo sapiens
caacttttctgtgaatttaagt

SEQ ID NO: 8349483 - DNA, 22 bp, Homo sapiens
caagaacattgtgatcacttca

SEQ ID NO: 8349484 - DNA, 22 bp, Homo sapiens
gctggggactccccaccatagc

SEQ ID NO: 8349485 - DNA, 22 bp, Homo sapiens
gctggggagcaagagtagtgag

SEQ ID NO: 8349486 - DNA, 22 bp, Homo sapiens
gctggggagcaagagtagtgag

SEQ ID NO: 8349487 - DNA, 22 bp, Homo sapiens
caagcctgtctcaccagtgcta

SEQ ID NO: 8349488 - DNA, 22 bp, Homo sapiens
gctggctctttttgccgggctc

SEQ ID NO: 8349489 - DNA, 22 bp, Homo sapiens
caagaatgaattcaatgtgtgg

SEQ ID NO: 8349490 - DNA, 22 bp, Homo sapiens
gctggcccagcgcccagggcag

SEQ ID NO: 8349491 - DNA, 22 bp, Homo sapiens
caagaattaagaattttgatgt

SEQ ID NO: 8349492 - DNA, 22 bp, Homo sapiens
caagaattgtacaaactgggtg

SEQ ID NO: 8349493 - DNA, 22 bp, Homo sapiens
caagaatagctacctcccatat

SEQ ID NO: 8349494 - DNA, 22 bp, Homo sapiens
caagaataaccagacaatagca

SEQ ID NO: 8349495 - DNA, 22 bp, Homo sapiens
caatatataatgagtactttcc

SEQ ID NO: 8349496 - DNA, 22 bp, Homo sapiens
caatatataggaacaacttagg

SEQ ID NO: 8349497 - DNA, 22 bp, Homo sapiens
caatagatgtttttgcttacca

SEQ ID NO: 8349498 - DNA, 22 bp, Homo sapiens
caatagaaaactcaatacttaa

SEQ ID NO: 8349499 - DNA, 22 bp, Homo sapiens
caatagaaggcacagataggta

SEQ ID NO: 8349500 - DNA, 22 bp, Homo sapiens
caaggctgtgttagctgccctc

SEQ ID NO: 8349501 - DNA, 22 bp, Homo sapiens
caatttcattaatagatataga

SEQ ID NO: 8349502 - DNA, 22 bp, Homo sapiens
caatttccttcatagatgactg

SEQ ID NO: 8349503 - DNA, 22 bp, Homo sapiens
caatttcatggataaaagatgt

SEQ ID NO: 8349504 - DNA, 22 bp, Homo sapiens
caatttcatcttgtgcttcaat

SEQ ID NO: 8349505 - DNA, 22 bp, Homo sapiens
caatttcactaataatatttac

SEQ ID NO: 8349506 - DNA, 22 bp, Homo sapiens
caatttcaatacaaaatacatt

SEQ ID NO: 8349507 - DNA, 22 bp, Homo sapiens
caatcatttatgcttgcggagg

SEQ ID NO: 8349508 - DNA, 22 bp, Homo sapiens
caatcagatatgtgacatattt

SEQ ID NO: 8349509 - DNA, 22 bp, Homo sapiens
caatattcagtggaaaagccat

SEQ ID NO: 8349510 - DNA, 19 bp, Homo sapiens
caatatatagtgagtggat

SEQ ID NO: 8349511 - DNA, 22 bp, Homo sapiens
caattgacaatgacagtgtcaa

SEQ ID NO: 8349512 - DNA, 22 bp, Homo sapiens
cacacaggatgaagcagcagaa

SEQ ID NO: 8349513 - DNA, 22 bp, Homo sapiens
cacacagggagaaagaaagcct

SEQ ID NO: 8349514 - DNA, 22 bp, Homo sapiens
ggagagaggagcccactgctgt

SEQ ID NO: 8349515 - DNA, 22 bp, Homo sapiens
ggaagctgtgctctcaggcctc

SEQ ID NO: 8349516 - DNA, 22 bp, Homo sapiens
cacaaataccagtttcctaaca

SEQ ID NO: 8349517 - DNA, 22 bp, Homo sapiens
cacaaataccagtttcctaaca

SEQ ID NO: 8349518 - DNA, 22 bp, Homo sapiens
cacaaatgactgaaacgactgt

SEQ ID NO: 8349519 - DNA, 19 bp, Homo sapiens
cacaaatgatgaggacctg

SEQ ID NO: 8349520 - DNA, 22 bp, Homo sapiens
ggaagcggccctgagcgcaggg

SEQ ID NO: 8349521 - DNA, 22 bp, Homo sapiens
cacaacttagcagcttgaaaca

SEQ ID NO: 8349522 - DNA, 19 bp, Homo sapiens
cacaacttcgcttgattcc

SEQ ID NO: 8349523 - DNA, 22 bp, Homo sapiens
cacaaatgtagtagcttaaaac

SEQ ID NO: 8349524 - DNA, 22 bp, Homo sapiens
cacaaatgtgcagaaatgtgag

SEQ ID NO: 8349525 - DNA, 22 bp, Homo sapiens
cacaaatggttgtagacattaa

SEQ ID NO: 8349526 - DNA, 22 bp, Homo sapiens
cacaaatggccgtgttcaaaga

SEQ ID NO: 8349527 - DNA, 22 bp, Homo sapiens
cactgcactccagcctgggaga

SEQ ID NO: 8349528 - DNA, 22 bp, Homo sapiens
cactgcactccagcctgggtca

SEQ ID NO: 8349529 - DNA, 22 bp, Homo sapiens
cactgggagagctggacttggg

SEQ ID NO: 8349530 - DNA, 22 bp, Homo sapiens
cactgcactccagcctgggtga

SEQ ID NO: 8349531 - DNA, 22 bp, Homo sapiens
ggctctgcttgaggccagcctg

SEQ ID NO: 8349532 - DNA, 22 bp, Homo sapiens
ggctctgcttcagaaggctcat

SEQ ID NO: 8349533 - DNA, 22 bp, Homo sapiens
ggctctgcttcctggaattgtg

SEQ ID NO: 8349534 - DNA, 22 bp, Homo sapiens
ggctctgctggtaagatgcctc

SEQ ID NO: 8349535 - DNA, 22 bp, Homo sapiens
ggctctgctggattgaggccag

SEQ ID NO: 8349536 - DNA, 22 bp, Homo sapiens
cactgtactgtgaataaggagg

SEQ ID NO: 8349537 - DNA, 22 bp, Homo sapiens
cactgggatttggggtgtctta

SEQ ID NO: 8349538 - DNA, 22 bp, Homo sapiens
cactgtacccatttaaataaat

SEQ ID NO: 8349539 - DNA, 20 bp, Homo sapiens
ggctctgcttgtgagcagcc

SEQ ID NO: 8349540 - DNA, 20 bp, Homo sapiens
ggctctggaatctggtgggc

SEQ ID NO: 8349541 - DNA, 22 bp, Homo sapiens
cacttcaattaacttcagcatt

SEQ ID NO: 8349542 - DNA, 22 bp, Homo sapiens
cacttaagcagttaatttatct

SEQ ID NO: 8349543 - DNA, 22 bp, Homo sapiens
ggctggatttttggaaggagag

SEQ ID NO: 8349544 - DNA, 17 bp, Homo sapiens
ggctgctgtgctggtgc

SEQ ID NO: 8349545 - DNA, 17 bp, Homo sapiens
ggctgctgtgctggtgc

SEQ ID NO: 8349546 - DNA, 17 bp, Homo sapiens
ggctgctgtgctggtgc

SEQ ID NO: 8349547 - DNA, 22 bp, Homo sapiens
cacttgttggtggtgaaatcac

SEQ ID NO: 8349548 - DNA, 22 bp, Homo sapiens
cacttgttggtggtgaaatcac

SEQ ID NO: 8349549 - DNA, 23 bp, Homo sapiens
cacggcagcctccgagggtgctg

SEQ ID NO: 8349550 - DNA, 22 bp, Homo sapiens
cactatatgcctttgaaataca

SEQ ID NO: 8349551 - DNA, 22 bp, Homo sapiens
cactatatctctttcatctttt

SEQ ID NO: 8349552 - DNA, 22 bp, Homo sapiens
cactatttatacttcctgatcc

SEQ ID NO: 8349553 - DNA, 22 bp, Homo sapiens
cactatttttcacttaggctta

SEQ ID NO: 8349554 - DNA, 22 bp, Homo sapiens
cactgcactccagcctgggaga

SEQ ID NO: 8349555 - DNA, 22 bp, Homo sapiens
cactccagtctgggaacaaagc

SEQ ID NO: 8349556 - DNA, 22 bp, Homo sapiens
cactccaggtcccagttcctgg

SEQ ID NO: 8349557 - DNA, 22 bp, Homo sapiens
cactccagccatttgtccccag

SEQ ID NO: 8349558 - DNA, 22 bp, Homo sapiens
cactccagccatttgtccccag

SEQ ID NO: 8349559 - DNA, 22 bp, Homo sapiens
cactccagatcacaccccttgg

SEQ ID NO: 8349560 - DNA, 22 bp, Homo sapiens
cacctgcctgctagagcctgac

SEQ ID NO: 8349561 - DNA, 23 bp, Homo sapiens
cacctggcttgagttggtgggtc

SEQ ID NO: 8349562 - DNA, 22 bp, Homo sapiens
ggccaggctggtctcagacttc

SEQ ID NO: 8349563 - DNA, 22 bp, Homo sapiens
ggccaggctgccctgggagcag

SEQ ID NO: 8349564 - DNA, 22 bp, Homo sapiens
ggccaggctgccctgggagcag

SEQ ID NO: 8349565 - DNA, 22 bp, Homo sapiens
caccaggagtgagaatgaaggg

SEQ ID NO: 8349566 - DNA, 22 bp, Homo sapiens
caccaggcacagctctcctgct

SEQ ID NO: 8349567 - DNA, 22 bp, Homo sapiens
caccaggatgggcaggtaggtc

SEQ ID NO: 8349568 - DNA, 22 bp, Homo sapiens
caccctgggagtggaagtcagt

SEQ ID NO: 8349569 - DNA, 22 bp, Homo sapiens
cacaggttaggtattatactat

SEQ ID NO: 8349570 - DNA, 23 bp, Homo sapiens
cacaggtgtttcatcttctcagt

SEQ ID NO: 8349571 - DNA, 22 bp, Homo sapiens
cacaggtagatgccatgcagca

SEQ ID NO: 8349572 - DNA, 22 bp, Homo sapiens
cacagggcaggtactctcagag

SEQ ID NO: 8349573 - DNA, 22 bp, Homo sapiens
cacaggcctggggttgagcggg

SEQ ID NO: 8349574 - DNA, 20 bp, Homo sapiens
cacaggccttgtgagcagac

SEQ ID NO: 8349575 - DNA, 20 bp, Homo sapiens
cacaggccttgtgagcagac

SEQ ID NO: 8349576 - DNA, 22 bp, Homo sapiens
cacaggccaataccctctctct

SEQ ID NO: 8349577 - DNA, 22 bp, Homo sapiens
cacaggccagtaagactgtgtt

SEQ ID NO: 8349578 - DNA, 22 bp, Homo sapiens
cacaggatacattgtctatatc

SEQ ID NO: 8349579 - DNA, 22 bp, Homo sapiens
cacaggagttaacataattaag

SEQ ID NO: 8349580 - DNA, 22 bp, Homo sapiens
cacaggagtgctgctattgttg

SEQ ID NO: 8349581 - DNA, 22 bp, Homo sapiens
ggagagcctccacggcttctgt

SEQ ID NO: 8349582 - DNA, 22 bp, Homo sapiens
cacaggcacccctgactgctca

SEQ ID NO: 8349583 - DNA, 22 bp, Homo sapiens
cacatatatgaaatgaggaatt

SEQ ID NO: 8349584 - DNA, 22 bp, Homo sapiens
ggcaataatgacattttaaaaa

SEQ ID NO: 8349585 - DNA, 22 bp, Homo sapiens
cacatgaaggctggggtcgtga

SEQ ID NO: 8349586 - DNA, 22 bp, Homo sapiens
cacatgaaggctggggtcgtga

SEQ ID NO: 8349587 - DNA, 22 bp, Homo sapiens
cacatgcaagtcctcagttcta

SEQ ID NO: 8349588 - DNA, 22 bp, Homo sapiens
ggcagagtgctctgggcagggg

SEQ ID NO: 8349589 - DNA, 22 bp, Homo sapiens
ggcagagtggagtgcggcctcc

SEQ ID NO: 8349590 - DNA, 22 bp, Homo sapiens
ggcagagtgctctgggcagggg

SEQ ID NO: 8349591 - DNA, 22 bp, Homo sapiens
ggcagatatattcgtgaaatag

SEQ ID NO: 8349592 - DNA, 22 bp, Homo sapiens
ggcagatggaagaggctgggtc

SEQ ID NO: 8349593 - DNA, 22 bp, Homo sapiens
cacattaagaataatgagacta

SEQ ID NO: 8349594 - DNA, 20 bp, Homo sapiens
cacattaaggaaaacaactg

SEQ ID NO: 8349595 - DNA, 22 bp, Homo sapiens
cacattaaaatcctaacttcca

SEQ ID NO: 8349596 - DNA, 22 bp, Homo sapiens
cacattaaatagtagggatgct

SEQ ID NO: 8349597 - DNA, 22 bp, Homo sapiens
caccactgcttcctgccatctg

SEQ ID NO: 8349598 - DNA, 22 bp, Homo sapiens
cagatttattttacatccttca

SEQ ID NO: 8349599 - DNA, 22 bp, Homo sapiens
cagatttatgcaaaaaggaaga

SEQ ID NO: 8349600 - DNA, 22 bp, Homo sapiens
cagcaaaagccagcataagctc

SEQ ID NO: 8349601 - DNA, 22 bp, Homo sapiens
cagattactttgtagcagtcag

SEQ ID NO: 8349602 - DNA, 22 bp, Homo sapiens
cagcagcctacaatgcacagaa

SEQ ID NO: 8349603 - DNA, 22 bp, Homo sapiens
cagcagccagacaagatacatc

SEQ ID NO: 8349604 - DNA, 20 bp, Homo sapiens
cagcagccattctagtagta

SEQ ID NO: 8349605 - DNA, 22 bp, Homo sapiens
cagcagccatgtaccacactca

SEQ ID NO: 8349606 - DNA, 22 bp, Homo sapiens
gtagaaaattaggatgaggctt

SEQ ID NO: 8349607 - DNA, 22 bp, Homo sapiens
gtagaaatagtggttgacagga

SEQ ID NO: 8349608 - DNA, 22 bp, Homo sapiens
gtagaaatatttatctctgaga

SEQ ID NO: 8349609 - DNA, 22 bp, Homo sapiens
gtagaaaaagcagtaagtctca

SEQ ID NO: 8349610 - DNA, 22 bp, Homo sapiens
gtacttccagccaagtgagaca

SEQ ID NO: 8349611 - DNA, 22 bp, Homo sapiens
gtacttccctgggaggcaagca

SEQ ID NO: 8349612 - DNA, 22 bp, Homo sapiens
gtacttccgtggactaattgtt

SEQ ID NO: 8349613 - DNA, 22 bp, Homo sapiens
gtactctcttgaaggcctttct

SEQ ID NO: 8349614 - DNA, 22 bp, Homo sapiens
gtactaagtcaggagaagaatt

SEQ ID NO: 8349615 - DNA, 22 bp, Homo sapiens
gtacacatatattaaaaattgt

SEQ ID NO: 8349616 - DNA, 22 bp, Homo sapiens
gtacacattatgcttctctaaa

SEQ ID NO: 8349617 - DNA, 22 bp, Homo sapiens
gtacacattgtctgtttacttc

SEQ ID NO: 8349618 - DNA, 20 bp, Homo sapiens
gtacacatatatgtatgtgt

SEQ ID NO: 8349619 - DNA, 23 bp, Homo sapiens
gtacacatagtgtagttatattt

SEQ ID NO: 8349620 - DNA, 22 bp, Homo sapiens
gtacacattatgcttctctaaa

SEQ ID NO: 8349621 - DNA, 22 bp, Homo sapiens
gtacacataggttactgattaa

SEQ ID NO: 8349622 - DNA, 22 bp, Homo sapiens
gtacacaggcagcccagtgctg

SEQ ID NO: 8349623 - DNA, 22 bp, Homo sapiens
gtcacagatctcttgagtcaag

SEQ ID NO: 8349624 - DNA, 22 bp, Homo sapiens
gtcacactcagaatgactagag

SEQ ID NO: 8349625 - DNA, 22 bp, Homo sapiens
gtcacactagggccaagtggag

SEQ ID NO: 8349626 - DNA, 22 bp, Homo sapiens
cagcatccgttctcaggactga

SEQ ID NO: 8349627 - DNA, 22 bp, Homo sapiens
cagcatcccagagcccagagct

SEQ ID NO: 8349628 - DNA, 21 bp, Homo sapiens
gtcagcagatccagcacttgt

SEQ ID NO: 8349629 - DNA, 22 bp, Homo sapiens
gtcagcagggctccctggcagg

SEQ ID NO: 8349630 - DNA, 22 bp, Homo sapiens
gtcagcagggtccccttgagtg

SEQ ID NO: 8349631 - DNA, 22 bp, Homo sapiens
gtccagagggctgcaggatgct

SEQ ID NO: 8349632 - DNA, 22 bp, Homo sapiens
gtccagagggctgcaggatgct

SEQ ID NO: 8349633 - DNA, 22 bp, Homo sapiens
gtccagagatggacgagcagat

SEQ ID NO: 8349634 - DNA, 22 bp, Homo sapiens
gtccagccaccctggaggcacg

SEQ ID NO: 8349635 - DNA, 22 bp, Homo sapiens
cagccaggacagggaaactagt

SEQ ID NO: 8349636 - DNA, 22 bp, Homo sapiens
cagccagctgtcccaagtgcct

SEQ ID NO: 8349637 - DNA, 22 bp, Homo sapiens
cagccagctggtgcggcagagc

SEQ ID NO: 8349638 - DNA, 22 bp, Homo sapiens
cagccaggagctccccctgctc

SEQ ID NO: 8349639 - DNA, 22 bp, Homo sapiens
cagccaggagcctctgcaacta

SEQ ID NO: 8349640 - DNA, 22 bp, Homo sapiens
cagccaggactcccatttagga

SEQ ID NO: 8349641 - DNA, 22 bp, Homo sapiens
gtgagcagacatcaaaggctgc

SEQ ID NO: 8349642 - DNA, 20 bp, Homo sapiens
cagccctccagtggaggcag

SEQ ID NO: 8349643 - DNA, 19 bp, Homo sapiens
cagccctcttaccactgtg

SEQ ID NO: 8349644 - DNA, 22 bp, Homo sapiens
gtcctgtgcccagaccctctgt

SEQ ID NO: 8349645 - DNA, 22 bp, Homo sapiens
gtcctgtgctcagacatggggg

SEQ ID NO: 8349646 - DNA, 22 bp, Homo sapiens
gtgaatttctgactaaaagtgc

SEQ ID NO: 8349647 - DNA, 22 bp, Homo sapiens
gtcctggtgccacctgcgggat

SEQ ID NO: 8349648 - DNA, 22 bp, Homo sapiens
cagccaggcccccgagtcgttg

SEQ ID NO: 8349649 - DNA, 22 bp, Homo sapiens
gtcctggtggagtctctgggga

SEQ ID NO: 8349650 - DNA, 22 bp, Homo sapiens
gtcctgtgacctgcatcctgag

SEQ ID NO: 8349651 - DNA, 22 bp, Homo sapiens
gtcctgtgatgagtaccaggtg

SEQ ID NO: 8349652 - DNA, 22 bp, Homo sapiens
gtcctgtgagattcatgctcaa

SEQ ID NO: 8349653 - DNA, 22 bp, Homo sapiens
cagccctggcccaggtgcctta

SEQ ID NO: 8349654 - DNA, 22 bp, Homo sapiens
cagccctgtctatgactgatga

SEQ ID NO: 8349655 - DNA, 22 bp, Homo sapiens
cagaaaatagagtttctctgag

SEQ ID NO: 8349656 - DNA, 22 bp, Homo sapiens
cagaaaataaagtttctacgca

SEQ ID NO: 8349657 - DNA, 22 bp, Homo sapiens
cagaaaatagagtttctctgag

SEQ ID NO: 8349658 - DNA, 22 bp, Homo sapiens
ggctggcactgaggagagctct

SEQ ID NO: 8349659 - DNA, 22 bp, Homo sapiens
ggctggcactctgtccagtgtc

SEQ ID NO: 8349660 - DNA, 22 bp, Homo sapiens
cagaaacacttgtagagaagtt

SEQ ID NO: 8349661 - DNA, 22 bp, Homo sapiens
cagaaacagacatgacgcagta

SEQ ID NO: 8349662 - DNA, 22 bp, Homo sapiens
cagacaaagcggaaactgttta

SEQ ID NO: 8349663 - DNA, 22 bp, Homo sapiens
cagaatttttcactcaatcttc

SEQ ID NO: 8349664 - DNA, 22 bp, Homo sapiens
gggaggcacgaggcgcgcagtg

SEQ ID NO: 8349665 - DNA, 22 bp, Homo sapiens
gggaggcagtgctggaggctgg

SEQ ID NO: 8349666 - DNA, 22 bp, Homo sapiens
gggagctgccttagaccggagg

SEQ ID NO: 8349667 - DNA, 22 bp, Homo sapiens
gggagctgccaccacccctggg

SEQ ID NO: 8349668 - DNA, 22 bp, Homo sapiens
gggagctgccttagaccggagg

SEQ ID NO: 8349669 - DNA, 22 bp, Homo sapiens
gggagctgcggtcttgcgaaga

SEQ ID NO: 8349670 - DNA, 22 bp, Homo sapiens
gggagctgctgaacacaagggt

SEQ ID NO: 8349671 - DNA, 21 bp, Homo sapiens
gggagctggaaactgggtgac

SEQ ID NO: 8349672 - DNA, 21 bp, Homo sapiens
gggagctggaaactgggtgac

SEQ ID NO: 8349673 - DNA, 22 bp, Homo sapiens
cagacacagcaattctgtgttg

SEQ ID NO: 8349674 - DNA, 22 bp, Homo sapiens
cagacacagatatgcatatggc

SEQ ID NO: 8349675 - DNA, 18 bp, Homo sapiens
cagacactctgctctgca

SEQ ID NO: 8349676 - DNA, 22 bp, Homo sapiens
gggagctgcacacgccccggaa

SEQ ID NO: 8349677 - DNA, 22 bp, Homo sapiens
cagagacaacaagtttaactat

SEQ ID NO: 8349678 - DNA, 22 bp, Homo sapiens
cagagacaatgtctctgcttgt

SEQ ID NO: 8349679 - DNA, 22 bp, Homo sapiens
cagagaggaggctatatgcaaa

SEQ ID NO: 8349680 - DNA, 22 bp, Homo sapiens
cagagcagaaacctgggtgatt

SEQ ID NO: 8349681 - DNA, 22 bp, Homo sapiens
cagagcagaaacctgggtgatt

SEQ ID NO: 8349682 - DNA, 22 bp, Homo sapiens
cagagcactgcttggaggattt

SEQ ID NO: 8349683 - DNA, 22 bp, Homo sapiens
gggatgagagctgggacagaag

SEQ ID NO: 8349684 - DNA, 23 bp, Homo sapiens
gggatctgtaagttgaagacaaa

SEQ ID NO: 8349685 - DNA, 22 bp, Homo sapiens
gggatctgggcctcacacacat

SEQ ID NO: 8349686 - DNA, 20 bp, Homo sapiens
cagagccaagagcagcatct

SEQ ID NO: 8349687 - DNA, 22 bp, Homo sapiens
cagagcattgagggtctgccaa

SEQ ID NO: 8349688 - DNA, 22 bp, Homo sapiens
cagagcatttggaagccacgtg

SEQ ID NO: 8349689 - DNA, 22 bp, Homo sapiens
cagagcatgaataaaagttaca

SEQ ID NO: 8349690 - DNA, 22 bp, Homo sapiens
cagagcatgtcaactagcttta

SEQ ID NO: 8349691 - DNA, 22 bp, Homo sapiens
cagagcattaaaaccagctctg

SEQ ID NO: 8349692 - DNA, 22 bp, Homo sapiens
cagagcataattgacatgaggt

SEQ ID NO: 8349693 - DNA, 22 bp, Homo sapiens
cagagcatcgcgcagagagcct

SEQ ID NO: 8349694 - DNA, 20 bp, Homo sapiens
cagagcagtgcccaggcggc

SEQ ID NO: 8349695 - DNA, 20 bp, Homo sapiens
cagagcagtgcccaggcggc

SEQ ID NO: 8349696 - DNA, 22 bp, Homo sapiens
gggcaggggtcagtggccccaa

SEQ ID NO: 8349697 - DNA, 22 bp, Homo sapiens
gggcaggtacaagatgcttctt

SEQ ID NO: 8349698 - DNA, 22 bp, Homo sapiens
gggcaggggtcagtggccccaa

SEQ ID NO: 8349699 - DNA, 22 bp, Homo sapiens
gggcaggtactgggtggtgagc

SEQ ID NO: 8349700 - DNA, 17 bp, Homo sapiens
gggcagggactcctggg

SEQ ID NO: 8349701 - DNA, 18 bp, Homo sapiens
cagagcagaggtggagcg

SEQ ID NO: 8349702 - DNA, 20 bp, Homo sapiens
gggtacagatatgcagtgaa

SEQ ID NO: 8349703 - DNA, 18 bp, Homo sapiens
gggtccccagctgcaggg

SEQ ID NO: 8349704 - DNA, 22 bp, Homo sapiens
gggtccagtagttggtggccgt

SEQ ID NO: 8349705 - DNA, 22 bp, Homo sapiens
gggtcctgcgtgggcccaggac

SEQ ID NO: 8349706 - DNA, 22 bp, Homo sapiens
ggtatacaagagcaatttaggg

SEQ ID NO: 8349707 - DNA, 20 bp, Homo sapiens
gggtgtgggcccggccaggc

SEQ ID NO: 8349708 - DNA, 22 bp, Homo sapiens
ggtccctggttccctctgagct

SEQ ID NO: 8349709 - DNA, 22 bp, Homo sapiens
ggtcctgcattgccagcaagct

SEQ ID NO: 8349710 - DNA, 19 bp, Homo sapiens
cagatgttttcagttcatt

SEQ ID NO: 8349711 - DNA, 22 bp, Homo sapiens
ggtcctgctggctcagctgagc

SEQ ID NO: 8349712 - DNA, 22 bp, Homo sapiens
ggtcctgcgtctggctcgcccg

SEQ ID NO: 8349713 - DNA, 22 bp, Homo sapiens
ggtcaagtattttggccccagc

SEQ ID NO: 8349714 - DNA, 22 bp, Homo sapiens
cagatatgataggattagcaca

SEQ ID NO: 8349715 - DNA, 22 bp, Homo sapiens
ggtattctaagctgtgtttact

SEQ ID NO: 8349716 - DNA, 22 bp, Homo sapiens
gggtaaatctcttttcatggct

SEQ ID NO: 8349717 - DNA, 22 bp, Homo sapiens
gggtaactgtctgtgaaataag

SEQ ID NO: 8349718 - DNA, 22 bp, Homo sapiens
ggggcgactgtatcttggggca

SEQ ID NO: 8349719 - DNA, 22 bp, Homo sapiens
ggggcctgtagagcttcaggga

SEQ ID NO: 8349720 - DNA, 22 bp, Homo sapiens
ggggcagagcatagctccaatt

SEQ ID NO: 8349721 - DNA, 21 bp, Homo sapiens
ggggcagagctaggccctgca

SEQ ID NO: 8349722 - DNA, 21 bp, Homo sapiens
ggggcagagctaggccctgca

SEQ ID NO: 8349723 - DNA, 22 bp, Homo sapiens
ggggcagagtagctggggtgtg

SEQ ID NO: 8349724 - DNA, 22 bp, Homo sapiens
ggggcagagagaaggaagcttg

SEQ ID NO: 8349725 - DNA, 22 bp, Homo sapiens
ggggcagagagaaggaagcttg

SEQ ID NO: 8349726 - DNA, 22 bp, Homo sapiens
ggggcagaagtagtgcccctga

SEQ ID NO: 8349727 - DNA, 22 bp, Homo sapiens
ggggcagagaataaaaacctaa

SEQ ID NO: 8349728 - DNA, 22 bp, Homo sapiens
ggggcagcctccaggaaagctg

SEQ ID NO: 8349729 - DNA, 22 bp, Homo sapiens
ggggcagatggaacagagcaca

SEQ ID NO: 8349730 - DNA, 22 bp, Homo sapiens
ggggcagagtctggactgttgt

SEQ ID NO: 8349731 - DNA, 23 bp, Homo sapiens
ggggcctgcaccggtctgcgcgg

SEQ ID NO: 8349732 - DNA, 22 bp, Homo sapiens
ggggcctctgggaacccctgtg

SEQ ID NO: 8349733 - DNA, 22 bp, Homo sapiens
gggctggaggaccggcctcgga

SEQ ID NO: 8349734 - DNA, 22 bp, Homo sapiens
gggctggaggaccggcctcgga

SEQ ID NO: 8349735 - DNA, 21 bp, Homo sapiens
cagagccagactgctgaattt

SEQ ID NO: 8349736 - DNA, 22 bp, Homo sapiens
cagagccactgtctgccaggca

SEQ ID NO: 8349737 - DNA, 22 bp, Homo sapiens
cagagccacttggagatgagaa

SEQ ID NO: 8349738 - DNA, 21 bp, Homo sapiens
gggctggaggatgggaagccc

SEQ ID NO: 8349739 - DNA, 22 bp, Homo sapiens
gggctggaggagatccagaggc

SEQ ID NO: 8349740 - DNA, 22 bp, Homo sapiens
gggctggaggagatccagaggc

SEQ ID NO: 8349741 - DNA, 22 bp, Homo sapiens
gggctggaggcctgcctggtta

SEQ ID NO: 8349742 - DNA, 19 bp, Homo sapiens
gggctggagggatagagcc

SEQ ID NO: 8349743 - DNA, 22 bp, Homo sapiens
gggctggaggtgagcaggacag

SEQ ID NO: 8349744 - DNA, 22 bp, Homo sapiens
gggctggagtcttctgaaagcc

SEQ ID NO: 8349745 - DNA, 22 bp, Homo sapiens
gggctgtggagccgcgagggct

SEQ ID NO: 8349746 - DNA, 20 bp, Homo sapiens
gggctgtgcctcctcgtggt

SEQ ID NO: 8349747 - DNA, 22 bp, Homo sapiens
gggctgtgctgagtaggaggtg

SEQ ID NO: 8349748 - DNA, 22 bp, Homo sapiens
gggctgtgcctcaggtggggtc

SEQ ID NO: 8349749 - DNA, 18 bp, Homo sapiens
gggctgtgagatgggaag

SEQ ID NO: 8349750 - DNA, 22 bp, Homo sapiens
gggctgtgagagtggggctgct

SEQ ID NO: 8349751 - DNA, 22 bp, Homo sapiens
gggctgtaggagctggaatggg

SEQ ID NO: 8349752 - DNA, 22 bp, Homo sapiens
tcctctgacaccttgtgcagtg

SEQ ID NO: 8349753 - DNA, 22 bp, Homo sapiens
ccacatgctcttgttacagtgt

SEQ ID NO: 8349754 - DNA, 22 bp, Homo sapiens
ccacatttactggatgctcagg

SEQ ID NO: 8349755 - DNA, 22 bp, Homo sapiens
ccacatttggagaagatacttt

SEQ ID NO: 8349756 - DNA, 22 bp, Homo sapiens
tcctgaccacactgccttctgc

SEQ ID NO: 8349757 - DNA, 22 bp, Homo sapiens
tcctgacctcttgctctgacct

SEQ ID NO: 8349758 - DNA, 22 bp, Homo sapiens
ccacatgaatcttggaagcagg

SEQ ID NO: 8349759 - DNA, 22 bp, Homo sapiens
ccacatgctcaccaagtccctg

SEQ ID NO: 8349760 - DNA, 22 bp, Homo sapiens
ccacatgatgaggaagctgaac

SEQ ID NO: 8349761 - DNA, 22 bp, Homo sapiens
tcgggctcgctctcctagcgga

SEQ ID NO: 8349762 - DNA, 22 bp, Homo sapiens
tcgggccataggctaggtccct

SEQ ID NO: 8349763 - DNA, 22 bp, Homo sapiens
tcggagcgtcactggctggagg

SEQ ID NO: 8349764 - DNA, 22 bp, Homo sapiens
ccacccttgggttcggaggccg

SEQ ID NO: 8349765 - DNA, 22 bp, Homo sapiens
ccaccgccttggcgtgttcccc

SEQ ID NO: 8349766 - DNA, 22 bp, Homo sapiens
tcgctgaggctgcacggctgcc

SEQ ID NO: 8349767 - DNA, 22 bp, Homo sapiens
tcgcgggctcccagctccgggt

SEQ ID NO: 8349768 - DNA, 22 bp, Homo sapiens
tcgcggggaagtggtgggctaa

SEQ ID NO: 8349769 - DNA, 22 bp, Homo sapiens
ccaccagctttgccaccctgct

SEQ ID NO: 8349770 - DNA, 22 bp, Homo sapiens
ccaccacatttgcctagacttt

SEQ ID NO: 8349771 - DNA, 22 bp, Homo sapiens
ccacattttgctttgcctaggt

SEQ ID NO: 8349772 - DNA, 22 bp, Homo sapiens
ccacatttttgatactctcact

SEQ ID NO: 8349773 - DNA, 20 bp, Homo sapiens
ccacattttactgtttgcca

SEQ ID NO: 8349774 - DNA, 22 bp, Homo sapiens
ccacatttcttcacttgtccca

SEQ ID NO: 8349775 - DNA, 22 bp, Homo sapiens
tctccgggtggcggcgaaggga

SEQ ID NO: 8349776 - DNA, 22 bp, Homo sapiens
tctccgggtgcatgtgtgtgcc

SEQ ID NO: 8349777 - DNA, 23 bp, Homo sapiens
tctccctgaggttgttagcatta

SEQ ID NO: 8349778 - DNA, 21 bp, Homo sapiens
tctccagagtgggaggaaatc

SEQ ID NO: 8349779 - DNA, 22 bp, Homo sapiens
tctccagagtaaccttggagca

SEQ ID NO: 8349780 - DNA, 22 bp, Homo sapiens
tctccaggaaccatcatggtaa

SEQ ID NO: 8349781 - DNA, 22 bp, Homo sapiens
ccactttgtaatgtgttatgtt

SEQ ID NO: 8349782 - DNA, 22 bp, Homo sapiens
ccacttgtgaaataatcaaata

SEQ ID NO: 8349783 - DNA, 22 bp, Homo sapiens
tctccacactttctctcccagg

SEQ ID NO: 8349784 - DNA, 20 bp, Homo sapiens
tctccaccacagagagcaga

SEQ ID NO: 8349785 - DNA, 22 bp, Homo sapiens
tctatattccagatacagatta

SEQ ID NO: 8349786 - DNA, 18 bp, Homo sapiens
tctatatggacatagaga

SEQ ID NO: 8349787 - DNA, 22 bp, Homo sapiens
ccacctcctaggcctggagaag

SEQ ID NO: 8349788 - DNA, 22 bp, Homo sapiens
tctcaaatttgttagataaaat

SEQ ID NO: 8349789 - DNA, 22 bp, Homo sapiens
tctcaagaccccatttatttta

SEQ ID NO: 8349790 - DNA, 21 bp, Homo sapiens
tctcaacttttctctttgggc

SEQ ID NO: 8349791 - DNA, 22 bp, Homo sapiens
tctcaagctagtgtttatagta

SEQ ID NO: 8349792 - DNA, 21 bp, Homo sapiens
tctctgtgttcaaggtgccag

SEQ ID NO: 8349793 - DNA, 22 bp, Homo sapiens
tctctgtgtgtgtgacagcatt

SEQ ID NO: 8349794 - DNA, 19 bp, Homo sapiens
ccagcaggttcatttcagg

SEQ ID NO: 8349795 - DNA, 22 bp, Homo sapiens
ccagcaggtgtagggctcatgg

SEQ ID NO: 8349796 - DNA, 22 bp, Homo sapiens
ccagcatctatgtgctgttgat

SEQ ID NO: 8349797 - DNA, 22 bp, Homo sapiens
ccagcatctaacgctcctggga

SEQ ID NO: 8349798 - DNA, 22 bp, Homo sapiens
tctgcagaagtggctgggccac

SEQ ID NO: 8349799 - DNA, 22 bp, Homo sapiens
tctgagagctgtagaagcctat

SEQ ID NO: 8349800 - DNA, 22 bp, Homo sapiens
tctgagagctctggggcccctt

SEQ ID NO: 8349801 - DNA, 21 bp, Homo sapiens
tctgagagcaactgcccttta

SEQ ID NO: 8349802 - DNA, 22 bp, Homo sapiens
ccagcatggcacctgagatgag

SEQ ID NO: 8349803 - DNA, 22 bp, Homo sapiens
ccagccctgtttatgtgtcact

SEQ ID NO: 8349804 - DNA, 19 bp, Homo sapiens
ccagccctgtcacttcttg

SEQ ID NO: 8349805 - DNA, 22 bp, Homo sapiens
ccagccctgtaaggatgaggca

SEQ ID NO: 8349806 - DNA, 22 bp, Homo sapiens
tctctgcccaagtttctcaagt

SEQ ID NO: 8349807 - DNA, 22 bp, Homo sapiens
tctctgccacagcttctgcctt

SEQ ID NO: 8349808 - DNA, 22 bp, Homo sapiens
tctctgccaccatgagatgggc

SEQ ID NO: 8349809 - DNA, 22 bp, Homo sapiens
tctctgcccatcctcagtccac

SEQ ID NO: 8349810 - DNA, 22 bp, Homo sapiens
tctctgcccatcctcagtccac

SEQ ID NO: 8349811 - DNA, 22 bp, Homo sapiens
tctctgggagttgagcagcagc

SEQ ID NO: 8349812 - DNA, 22 bp, Homo sapiens
ccagcagctgcaaagcctgggt

SEQ ID NO: 8349813 - DNA, 22 bp, Homo sapiens
ccagcagctccctcagggtccg

SEQ ID NO: 8349814 - DNA, 22 bp, Homo sapiens
ccagcagctcagctactggtca

SEQ ID NO: 8349815 - DNA, 22 bp, Homo sapiens
ccagcagctttattggctctcc

SEQ ID NO: 8349816 - DNA, 22 bp, Homo sapiens
ccagcagggaaaaacccaccaa

SEQ ID NO: 8349817 - DNA, 22 bp, Homo sapiens
ccagcagggcagtgccctggac

SEQ ID NO: 8349818 - DNA, 22 bp, Homo sapiens
ccagcactgctctcagactgag

SEQ ID NO: 8349819 - DNA, 22 bp, Homo sapiens
ccagcactgctctcagactgag

SEQ ID NO: 8349820 - DNA, 22 bp, Homo sapiens
ccagcagagggtcttggccatt

SEQ ID NO: 8349821 - DNA, 22 bp, Homo sapiens
ccagcagcagcgtccaaggaga

SEQ ID NO: 8349822 - DNA, 22 bp, Homo sapiens
ccagcagcaggccaggccctcc

SEQ ID NO: 8349823 - DNA, 22 bp, Homo sapiens
ccagcagcagcgtccaaggaga

SEQ ID NO: 8349824 - DNA, 22 bp, Homo sapiens
ccagcagagtggggtttagagt

SEQ ID NO: 8349825 - DNA, 22 bp, Homo sapiens
ccagcagcccctcaatgatctg

SEQ ID NO: 8349826 - DNA, 22 bp, Homo sapiens
cattatattttactgcatggga

SEQ ID NO: 8349827 - DNA, 22 bp, Homo sapiens
cattcattagaatagatatgta

SEQ ID NO: 8349828 - DNA, 22 bp, Homo sapiens
cattcataagactttgctcttg

SEQ ID NO: 8349829 - DNA, 22 bp, Homo sapiens
cattcactcagcgatgccagta

SEQ ID NO: 8349830 - DNA, 22 bp, Homo sapiens
cattcacaaaaccacatgccat

SEQ ID NO: 8349831 - DNA, 22 bp, Homo sapiens
cattcacaatggattgcttcaa

SEQ ID NO: 8349832 - DNA, 22 bp, Homo sapiens
cattcacaaagctgattgatgg

SEQ ID NO: 8349833 - DNA, 22 bp, Homo sapiens
cattcacaactgagcattgttg

SEQ ID NO: 8349834 - DNA, 22 bp, Homo sapiens
cattcatttatgaaatatctat

SEQ ID NO: 8349835 - DNA, 22 bp, Homo sapiens
tcccactgagcatatgcagatg

SEQ ID NO: 8349836 - DNA, 22 bp, Homo sapiens
cattcatttactttcaacagct

SEQ ID NO: 8349837 - DNA, 22 bp, Homo sapiens
tcccagaggaaatggcagctga

SEQ ID NO: 8349838 - DNA, 22 bp, Homo sapiens
tcccagagcctctgccactctg

SEQ ID NO: 8349839 - DNA, 22 bp, Homo sapiens
tcccagccacagtttccacctg

SEQ ID NO: 8349840 - DNA, 22 bp, Homo sapiens
tcccagccacagtttccacctg

SEQ ID NO: 8349841 - DNA, 22 bp, Homo sapiens
tcccagccaggctctaccactt

SEQ ID NO: 8349842 - DNA, 22 bp, Homo sapiens
tcccagccaggctctaccactt

SEQ ID NO: 8349843 - DNA, 22 bp, Homo sapiens
tcccagcccagacttctccagt

SEQ ID NO: 8349844 - DNA, 22 bp, Homo sapiens
cattgcacagccctgtggtgat

SEQ ID NO: 8349845 - DNA, 22 bp, Homo sapiens
cattgcacatctgagaagagat

SEQ ID NO: 8349846 - DNA, 22 bp, Homo sapiens
cattgcaccacattgcatccct

SEQ ID NO: 8349847 - DNA, 22 bp, Homo sapiens
cattgcacgggcgtctgtctgt

SEQ ID NO: 8349848 - DNA, 22 bp, Homo sapiens
cattgcacaccagcctgggcaa

SEQ ID NO: 8349849 - DNA, 22 bp, Homo sapiens
tccccactcaccactggccaaa

SEQ ID NO: 8349850 - DNA, 22 bp, Homo sapiens
cattgacatcaggcttggccaa

SEQ ID NO: 8349851 - DNA, 22 bp, Homo sapiens
cattgagagaatcacatagaag

SEQ ID NO: 8349852 - DNA, 20 bp, Homo sapiens
cattgcaaagtagcagactg

SEQ ID NO: 8349853 - DNA, 22 bp, Homo sapiens
cattgacagttctttaagttgc

SEQ ID NO: 8349854 - DNA, 22 bp, Homo sapiens
cattgaaaaacgttgactgagt

SEQ ID NO: 8349855 - DNA, 22 bp, Homo sapiens
tccccagcattgagggtctctc

SEQ ID NO: 8349856 - DNA, 19 bp, Homo sapiens
tccccagcacctctgagtc

SEQ ID NO: 8349857 - DNA, 19 bp, Homo sapiens
tccccagcacctctgagtc

SEQ ID NO: 8349858 - DNA, 22 bp, Homo sapiens
tccccactctctcctggagctt

SEQ ID NO: 8349859 - DNA, 22 bp, Homo sapiens
tccccactcctgggcagatgcg

SEQ ID NO: 8349860 - DNA, 22 bp, Homo sapiens
tccccactctgggccaccacaa

SEQ ID NO: 8349861 - DNA, 22 bp, Homo sapiens
tccccactgggcctcctctttc

SEQ ID NO: 8349862 - DNA, 22 bp, Homo sapiens
catttgtagttaaaaatgtctc

SEQ ID NO: 8349863 - DNA, 22 bp, Homo sapiens
catttgtagtatctgtttatat

SEQ ID NO: 8349864 - DNA, 22 bp, Homo sapiens
catttgtatctgggctgctgtg

SEQ ID NO: 8349865 - DNA, 22 bp, Homo sapiens
catcttttggcctattctgagg

SEQ ID NO: 8349866 - DNA, 22 bp, Homo sapiens
catcttttggtaggagccgggc

SEQ ID NO: 8349867 - DNA, 22 bp, Homo sapiens
tcatgtggcttatagaatttgt

SEQ ID NO: 8349868 - DNA, 22 bp, Homo sapiens
tcattcatgaggtgctagtgct

SEQ ID NO: 8349869 - DNA, 22 bp, Homo sapiens
tcattcatttgctcactccaca

SEQ ID NO: 8349870 - DNA, 22 bp, Homo sapiens
catctttggttttctatatgcc

SEQ ID NO: 8349871 - DNA, 22 bp, Homo sapiens
catcttttcagaagccattctg

SEQ ID NO: 8349872 - DNA, 22 bp, Homo sapiens
catctttgttttggatataatc

SEQ ID NO: 8349873 - DNA, 22 bp, Homo sapiens
catctttgggctgcatggaagg

SEQ ID NO: 8349874 - DNA, 22 bp, Homo sapiens
tcatgcacatgtgtcaccatca

SEQ ID NO: 8349875 - DNA, 22 bp, Homo sapiens
tcatgcaatgttagtttgaaag

SEQ ID NO: 8349876 - DNA, 22 bp, Homo sapiens
tcatgcaagaataataggaagg

SEQ ID NO: 8349877 - DNA, 22 bp, Homo sapiens
tcatgcaaatactgttccagaa

SEQ ID NO: 8349878 - DNA, 22 bp, Homo sapiens
tcatgcaacaacacattctggc

SEQ ID NO: 8349879 - DNA, 22 bp, Homo sapiens
tcatgacaactatattattcca

SEQ ID NO: 8349880 - DNA, 22 bp, Homo sapiens
tcatgaatattgaatgcttcat

SEQ ID NO: 8349881 - DNA, 22 bp, Homo sapiens
tcatgaatcgtggaatgattta

SEQ ID NO: 8349882 - DNA, 21 bp, Homo sapiens
tcatgaagcatcacttctgcc

SEQ ID NO: 8349883 - DNA, 22 bp, Homo sapiens
tcatgacatctgtttatctcaa

SEQ ID NO: 8349884 - DNA, 21 bp, Homo sapiens
tcatgaacattcactgactgc

SEQ ID NO: 8349885 - DNA, 22 bp, Homo sapiens
tccacagtctatttttagtcta

SEQ ID NO: 8349886 - DNA, 22 bp, Homo sapiens
tccacaggtcctctttgcaaag

SEQ ID NO: 8349887 - DNA, 22 bp, Homo sapiens
tccacaggtatgaggccccacc

SEQ ID NO: 8349888 - DNA, 19 bp, Homo sapiens
tcattgaacataattactt

SEQ ID NO: 8349889 - DNA, 22 bp, Homo sapiens
tcattctgcatcactcttgctc

SEQ ID NO: 8349890 - DNA, 22 bp, Homo sapiens
tcattcttgatcactagttagt

SEQ ID NO: 8349891 - DNA, 22 bp, Homo sapiens
tcattctggatgactttctaga

SEQ ID NO: 8349892 - DNA, 22 bp, Homo sapiens
tccaggctcccctgcgtgctcc

SEQ ID NO: 8349893 - DNA, 22 bp, Homo sapiens
catgttaaaatatacattctga

SEQ ID NO: 8349894 - DNA, 22 bp, Homo sapiens
tccaggcccgagatgggctgga

SEQ ID NO: 8349895 - DNA, 22 bp, Homo sapiens
tccaggcccctgcctgggcctg

SEQ ID NO: 8349896 - DNA, 22 bp, Homo sapiens
tccaggccccccacgctaatgg

SEQ ID NO: 8349897 - DNA, 22 bp, Homo sapiens
tccaggccccagaccgtactgc

SEQ ID NO: 8349898 - DNA, 22 bp, Homo sapiens
tccaggccccagcaccttggga

SEQ ID NO: 8349899 - DNA, 22 bp, Homo sapiens
tccaggcccatggagcagagct

SEQ ID NO: 8349900 - DNA, 22 bp, Homo sapiens
tccaggcccatggagcagagct

SEQ ID NO: 8349901 - DNA, 22 bp, Homo sapiens
tccaggccccactgaagcccct

SEQ ID NO: 8349902 - DNA, 17 bp, Homo sapiens
tccagcctcctctgctg

SEQ ID NO: 8349903 - DNA, 22 bp, Homo sapiens
tccagcctaggggaacagctgc

SEQ ID NO: 8349904 - DNA, 22 bp, Homo sapiens
tccagcctcatttctcctgctt

SEQ ID NO: 8349905 - DNA, 22 bp, Homo sapiens
tccagctgacagttcaaaatga

SEQ ID NO: 8349906 - DNA, 22 bp, Homo sapiens
tccagctgctgccagccaagct

SEQ ID NO: 8349907 - DNA, 22 bp, Homo sapiens
tccagccgccggccctgcaggt

SEQ ID NO: 8349908 - DNA, 22 bp, Homo sapiens
tccagccgtcacagccacattc

SEQ ID NO: 8349909 - DNA, 22 bp, Homo sapiens
tccagccctgtgtctgggagag

SEQ ID NO: 8349910 - DNA, 22 bp, Homo sapiens
tccagcccaggctggagtgtag

SEQ ID NO: 8349911 - DNA, 22 bp, Homo sapiens
tccagagagaaaaacaagcttt

SEQ ID NO: 8349912 - DNA, 22 bp, Homo sapiens
tccagactggggccatgtctgc

SEQ ID NO: 8349913 - DNA, 22 bp, Homo sapiens
tccagactgcttctaggatgag

SEQ ID NO: 8349914 - DNA, 19 bp, Homo sapiens
tccagactgtccaggctat

SEQ ID NO: 8349915 - DNA, 22 bp, Homo sapiens
tagaataatctgaggaaatgct

SEQ ID NO: 8349916 - DNA, 22 bp, Homo sapiens
tagaataatctgaggaaatgct

SEQ ID NO: 8349917 - DNA, 22 bp, Homo sapiens
caggctggagtgcagtggggcg

SEQ ID NO: 8349918 - DNA, 22 bp, Homo sapiens
tagaatatacactacagcttaa

SEQ ID NO: 8349919 - DNA, 18 bp, Homo sapiens
tagaatataggtcattct

SEQ ID NO: 8349920 - DNA, 18 bp, Homo sapiens
tagaatataggtcattct

SEQ ID NO: 8349921 - DNA, 22 bp, Homo sapiens
caggctggagtgcagtggcgct

SEQ ID NO: 8349922 - DNA, 22 bp, Homo sapiens
caggctggagtgcagtggcgcc

SEQ ID NO: 8349923 - DNA, 22 bp, Homo sapiens
caggctggagtgcagtggcgcc

SEQ ID NO: 8349924 - DNA, 22 bp, Homo sapiens
caggctggagtgcagtggggcg

SEQ ID NO: 8349925 - DNA, 22 bp, Homo sapiens
caggctggagtgcagtggcgct

SEQ ID NO: 8349926 - DNA, 23 bp, Homo sapiens
tactgtgctgaatatttgagagg

SEQ ID NO: 8349927 - DNA, 22 bp, Homo sapiens
tactgtgcagctgtgctttggg

SEQ ID NO: 8349928 - DNA, 22 bp, Homo sapiens
tactgtgcaaaaatgaatattg

SEQ ID NO: 8349929 - DNA, 22 bp, Homo sapiens
caggctggagtgcaatgacgcc

SEQ ID NO: 8349930 - DNA, 22 bp, Homo sapiens
caggctggagtgcaatggcaca

SEQ ID NO: 8349931 - DNA, 22 bp, Homo sapiens
caggctggagtgagtgtagtgg

SEQ ID NO: 8349932 - DNA, 22 bp, Homo sapiens
caggctggagtgcaatggtgct

SEQ ID NO: 8349933 - DNA, 22 bp, Homo sapiens
caggctggagtgcaatggcaca

SEQ ID NO: 8349934 - DNA, 22 bp, Homo sapiens
tactatttttgcaacgtataca

SEQ ID NO: 8349935 - DNA, 21 bp, Homo sapiens
tactgtagccttgcactgtag

SEQ ID NO: 8349936 - DNA, 22 bp, Homo sapiens
gtgaggggtggctgagcagttt

SEQ ID NO: 8349937 - DNA, 22 bp, Homo sapiens
gtgaggggccaagagtagggca

SEQ ID NO: 8349938 - DNA, 22 bp, Homo sapiens
tactatttggaattttaaattg

SEQ ID NO: 8349939 - DNA, 20 bp, Homo sapiens
cagccctgtgacctggccct

SEQ ID NO: 8349940 - DNA, 22 bp, Homo sapiens
tagaatatgtggtaggatctgg

SEQ ID NO: 8349941 - DNA, 22 bp, Homo sapiens
tagaatatgtggtgtatacttt

SEQ ID NO: 8349942 - DNA, 22 bp, Homo sapiens
caggctgggcagcctccccggc

SEQ ID NO: 8349943 - DNA, 22 bp, Homo sapiens
caggctggtcccagagcattgc

SEQ ID NO: 8349944 - DNA, 22 bp, Homo sapiens
caggctgggctggtgttagagt

SEQ ID NO: 8349945 - DNA, 22 bp, Homo sapiens
caggctgggctccggagataaa

SEQ ID NO: 8349946 - DNA, 22 bp, Homo sapiens
caggctgggctccggagataaa

SEQ ID NO: 8349947 - DNA, 22 bp, Homo sapiens
tagaggagaacacaaattatag

SEQ ID NO: 8349948 - DNA, 19 bp, Homo sapiens
tagaggagaagggaagtgg

SEQ ID NO: 8349949 - DNA, 22 bp, Homo sapiens
tagagcttagagaatgagtttg

SEQ ID NO: 8349950 - DNA, 22 bp, Homo sapiens
tagagcttggggatttagtagt

SEQ ID NO: 8349951 - DNA, 22 bp, Homo sapiens
tagcaagtgttggtgaagatgt

SEQ ID NO: 8349952 - DNA, 22 bp, Homo sapiens
tagcaagatgtcactccaagtt

SEQ ID NO: 8349953 - DNA, 22 bp, Homo sapiens
tagataatttggcatcatattg

SEQ ID NO: 8349954 - DNA, 22 bp, Homo sapiens
tagataagaatggcatcttctc

SEQ ID NO: 8349955 - DNA, 22 bp, Homo sapiens
cagggcaaggcagagcgtcccc

SEQ ID NO: 8349956 - DNA, 22 bp, Homo sapiens
cagggatggcgctggctgcccg

SEQ ID NO: 8349957 - DNA, 22 bp, Homo sapiens
cagggcaaagagagcacatgct

SEQ ID NO: 8349958 - DNA, 22 bp, Homo sapiens
tagatacacacacagtcatgtg

SEQ ID NO: 8349959 - DNA, 22 bp, Homo sapiens
cagggcagaaggcactctactc

SEQ ID NO: 8349960 - DNA, 22 bp, Homo sapiens
tatcagtggtcacaagatacat

SEQ ID NO: 8349961 - DNA, 23 bp, Homo sapiens
tatcagtgtgatgaggctgctgc

SEQ ID NO: 8349962 - DNA, 22 bp, Homo sapiens
tatcagtgtggtttctggactg

SEQ ID NO: 8349963 - DNA, 22 bp, Homo sapiens
tatatttaaatccaggttgaaa

SEQ ID NO: 8349964 - DNA, 22 bp, Homo sapiens
tatcataagttaattaaacagt

SEQ ID NO: 8349965 - DNA, 22 bp, Homo sapiens
tatcatttaacagaatcattgc

SEQ ID NO: 8349966 - DNA, 22 bp, Homo sapiens
cagggtggcactcagcgcatct

SEQ ID NO: 8349967 - DNA, 22 bp, Homo sapiens
cagggtggcaggcaccatggcc

SEQ ID NO: 8349968 - DNA, 22 bp, Homo sapiens
cagggtggcaggcaccatggcc

SEQ ID NO: 8349969 - DNA, 22 bp, Homo sapiens
cagggtggcactcagcgcatct

SEQ ID NO: 8349970 - DNA, 22 bp, Homo sapiens
tatcattgctgatgtgctgaga

SEQ ID NO: 8349971 - DNA, 22 bp, Homo sapiens
cagggtggcaggcaccatggcc

SEQ ID NO: 8349972 - DNA, 22 bp, Homo sapiens
cagggtggccctgtggtctcat

SEQ ID NO: 8349973 - DNA, 22 bp, Homo sapiens
tagtctggacttcttagtgtca

SEQ ID NO: 8349974 - DNA, 22 bp, Homo sapiens
tagtcttcctggaagaagtgtt

SEQ ID NO: 8349975 - DNA, 22 bp, Homo sapiens
tagtgaaacagttatcaatctg

SEQ ID NO: 8349976 - DNA, 22 bp, Homo sapiens
tagtgatataattaacttcatt

SEQ ID NO: 8349977 - DNA, 22 bp, Homo sapiens
tatatttaaatccaggttgaaa

SEQ ID NO: 8349978 - DNA, 22 bp, Homo sapiens
tagtgaaatttatgcacagcta

SEQ ID NO: 8349979 - DNA, 22 bp, Homo sapiens
tagtgaaatgagaatgtatgac

SEQ ID NO: 8349980 - DNA, 22 bp, Homo sapiens
tagggtgggcagttcttgggga

SEQ ID NO: 8349981 - DNA, 22 bp, Homo sapiens
tagggtggagactggaagcagg

SEQ ID NO: 8349982 - DNA, 22 bp, Homo sapiens
tagggtacatgtgcacaacatg

SEQ ID NO: 8349983 - DNA, 22 bp, Homo sapiens
tagggtggttagaaggagtatg

SEQ ID NO: 8349984 - DNA, 22 bp, Homo sapiens
taggtacaaggagggattcttg

SEQ ID NO: 8349985 - DNA, 22 bp, Homo sapiens
taggtacattattagatgcatg

SEQ ID NO: 8349986 - DNA, 22 bp, Homo sapiens
taggtacagctaaaaattatct

SEQ ID NO: 8349987 - DNA, 22 bp, Homo sapiens
cagggctcatctgtgtgaccag

SEQ ID NO: 8349988 - DNA, 22 bp, Homo sapiens
cagggctcagaagacagacctc

SEQ ID NO: 8349989 - DNA, 22 bp, Homo sapiens
cagggctcactcggctggcgtc

SEQ ID NO: 8349990 - DNA, 22 bp, Homo sapiens
cagggctcaccactgggatcct

SEQ ID NO: 8349991 - DNA, 22 bp, Homo sapiens
cagggctcagggactgcagaaa

SEQ ID NO: 8349992 - DNA, 22 bp, Homo sapiens
cagggctcaggctctgggattc

SEQ ID NO: 8349993 - DNA, 22 bp, Homo sapiens
cagggccttcgtaagtgtccgg

SEQ ID NO: 8349994 - DNA, 22 bp, Homo sapiens
cagggcctgtcacgacgctcat

SEQ ID NO: 8349995 - DNA, 22 bp, Homo sapiens
cagggcggggtctgccggccct

SEQ ID NO: 8349996 - DNA, 22 bp, Homo sapiens
cagggcggggtctgccggccct

SEQ ID NO: 8349997 - DNA, 22 bp, Homo sapiens
cagggcctccccggcagtcttt

SEQ ID NO: 8349998 - DNA, 22 bp, Homo sapiens
cagggcctgcttccttcttgtt

SEQ ID NO: 8349999 - DNA, 22 bp, Homo sapiens
cagggcctgcttccttcttgtt

SEQ ID NO: 8350000 - DNA, 22 bp, Homo sapiens
cagggcctggagctgggcctgc

SEQ ID NO: 8350001 - DNA, 22 bp, Homo sapiens
taggagaggtgaatggcacact

SEQ ID NO: 8350002 - DNA, 22 bp, Homo sapiens
tagctcaaaggttaagtgtgga

SEQ ID NO: 8350003 - DNA, 22 bp, Homo sapiens
cagggcagccaggccccgtggg

SEQ ID NO: 8350004 - DNA, 22 bp, Homo sapiens
cagggcagagggaaactccttt

SEQ ID NO: 8350005 - DNA, 22 bp, Homo sapiens
cagggcagccaggccccgtggg

SEQ ID NO: 8350006 - DNA, 22 bp, Homo sapiens
taggaaattgccaatatatgac

SEQ ID NO: 8350007 - DNA, 18 bp, Homo sapiens
taggaaccacttgcagag

SEQ ID NO: 8350008 - DNA, 22 bp, Homo sapiens
taggaaccagagcactctgggc

SEQ ID NO: 8350009 - DNA, 22 bp, Homo sapiens
cataaactctctgtaccaatat

SEQ ID NO: 8350010 - DNA, 22 bp, Homo sapiens
cataaagtctcataattcactt

SEQ ID NO: 8350011 - DNA, 22 bp, Homo sapiens
cataaagtgtataagtgaagaa

SEQ ID NO: 8350012 - DNA, 22 bp, Homo sapiens
cagtttatagttgttatgtgtg

SEQ ID NO: 8350013 - DNA, 20 bp, Homo sapiens
cagtttacaacataaattgt

SEQ ID NO: 8350014 - DNA, 22 bp, Homo sapiens
cagttaaatttggctgttttct

SEQ ID NO: 8350015 - DNA, 22 bp, Homo sapiens
cagttaaattctccagttacca

SEQ ID NO: 8350016 - DNA, 22 bp, Homo sapiens
cagttaaaggcccaatatctgg

SEQ ID NO: 8350017 - DNA, 22 bp, Homo sapiens
cagttacatgctcatgtcatca

SEQ ID NO: 8350018 - DNA, 19 bp, Homo sapiens
cagttacaggcactgtggg

SEQ ID NO: 8350019 - DNA, 21 bp, Homo sapiens
tcagcagcatctgcctagagt

SEQ ID NO: 8350020 - DNA, 22 bp, Homo sapiens
tcagcagcagctcagcatgttt

SEQ ID NO: 8350021 - DNA, 19 bp, Homo sapiens
tcagcagcactgtgatttc

SEQ ID NO: 8350022 - DNA, 22 bp, Homo sapiens
tcagcagagtggaacattgtca

SEQ ID NO: 8350023 - DNA, 22 bp, Homo sapiens
tcagcagatgtggtgaaaagtc

SEQ ID NO: 8350024 - DNA, 22 bp, Homo sapiens
tcagcagagtttcatcttggga

SEQ ID NO: 8350025 - DNA, 22 bp, Homo sapiens
tcagcagaatgtggcatgtcac

SEQ ID NO: 8350026 - DNA, 22 bp, Homo sapiens
tcagcagagctcaggctccagc

SEQ ID NO: 8350027 - DNA, 22 bp, Homo sapiens
tcagcagagctcaggctccagc

SEQ ID NO: 8350028 - DNA, 22 bp, Homo sapiens
tcagcagagcgagaccaagtca

SEQ ID NO: 8350029 - DNA, 22 bp, Homo sapiens
cagtgtctccagatgctccaat

SEQ ID NO: 8350030 - DNA, 22 bp, Homo sapiens
cagtgtctccagatgctccaat

SEQ ID NO: 8350031 - DNA, 22 bp, Homo sapiens
tcagagaaataattgctgagtt

SEQ ID NO: 8350032 - DNA, 22 bp, Homo sapiens
cagtgtgaggaattagtgtcca

SEQ ID NO: 8350033 - DNA, 22 bp, Homo sapiens
cagtgggaagggcagaggcttt

SEQ ID NO: 8350034 - DNA, 22 bp, Homo sapiens
cagtgggaagaatgcagcctcc

SEQ ID NO: 8350035 - DNA, 22 bp, Homo sapiens
cagtgggacatgggcactgggc

SEQ ID NO: 8350036 - DNA, 22 bp, Homo sapiens
cagtgggaatgaagtggaggcc

SEQ ID NO: 8350037 - DNA, 21 bp, Homo sapiens
cagtgggctgctgcgctccag

SEQ ID NO: 8350038 - DNA, 22 bp, Homo sapiens
cagtgggggtgaggccgaggta

SEQ ID NO: 8350039 - DNA, 22 bp, Homo sapiens
cagtgggtaaataagtgggtaa

SEQ ID NO: 8350040 - DNA, 22 bp, Homo sapiens
cagtgggtagtggggattagca

SEQ ID NO: 8350041 - DNA, 22 bp, Homo sapiens
cagtgggtaggaaaggctcttc

SEQ ID NO: 8350042 - DNA, 22 bp, Homo sapiens
cagtgggtaggaaaggctcttc

SEQ ID NO: 8350043 - DNA, 22 bp, Homo sapiens
cagtggggggactgaggcctga

SEQ ID NO: 8350044 - DNA, 22 bp, Homo sapiens
cagtgggggggccatgctgcag

SEQ ID NO: 8350045 - DNA, 22 bp, Homo sapiens
cagtggggaggccaggatagaa

SEQ ID NO: 8350046 - DNA, 23 bp, Homo sapiens
cagtgggcttctaactgctcctg

SEQ ID NO: 8350047 - DNA, 22 bp, Homo sapiens
caggtttagttccacacagctc

SEQ ID NO: 8350048 - DNA, 22 bp, Homo sapiens
caggttggtattcatctccaca

SEQ ID NO: 8350049 - DNA, 22 bp, Homo sapiens
caggttggggacttaggatgac

SEQ ID NO: 8350050 - DNA, 22 bp, Homo sapiens
caggttggagatctgtctatgg

SEQ ID NO: 8350051 - DNA, 22 bp, Homo sapiens
caggttgggatcggttgcaatg

SEQ ID NO: 8350052 - DNA, 22 bp, Homo sapiens
caggttgggctgcgaggaggag

SEQ ID NO: 8350053 - DNA, 21 bp, Homo sapiens
caggtttgctatggagcagcc

SEQ ID NO: 8350054 - DNA, 22 bp, Homo sapiens
tatttcagtcacttcttctctg

SEQ ID NO: 8350055 - DNA, 22 bp, Homo sapiens
cagggtggccctgtggtctcat

SEQ ID NO: 8350056 - DNA, 22 bp, Homo sapiens
cagggtggccctgtggtctcat

SEQ ID NO: 8350057 - DNA, 22 bp, Homo sapiens
cagggtgggcacccagcctcca

SEQ ID NO: 8350058 - DNA, 22 bp, Homo sapiens
cagggtggggaaatagcgccct

SEQ ID NO: 8350059 - DNA, 22 bp, Homo sapiens
tatttccagatgaggttacatt

SEQ ID NO: 8350060 - DNA, 22 bp, Homo sapiens
tatttccagaggagtatagaag

SEQ ID NO: 8350061 - DNA, 22 bp, Homo sapiens
tatttccagaggagtatagaag

SEQ ID NO: 8350062 - DNA, 22 bp, Homo sapiens
tatttccacttaggtgcctgtt

SEQ ID NO: 8350063 - DNA, 22 bp, Homo sapiens
tatttccaccctcagtaaggaa

SEQ ID NO: 8350064 - DNA, 22 bp, Homo sapiens
tatttctttcaggtatgtgttg

SEQ ID NO: 8350065 - DNA, 20 bp, Homo sapiens
cagtccactggagttcctac

SEQ ID NO: 8350066 - DNA, 22 bp, Homo sapiens
tcacaggaaccatcagagaaat

SEQ ID NO: 8350067 - DNA, 22 bp, Homo sapiens
tcacaggaagaggtgtctatct

SEQ ID NO: 8350068 - DNA, 22 bp, Homo sapiens
tcacaggaagaggtgtctatct

SEQ ID NO: 8350069 - DNA, 22 bp, Homo sapiens
tcacagctttgagcagagacca

SEQ ID NO: 8350070 - DNA, 22 bp, Homo sapiens
tcacaggagaatgtacttacca

SEQ ID NO: 8350071 - DNA, 22 bp, Homo sapiens
tcacaggagaatgtacttacca

SEQ ID NO: 8350072 - DNA, 22 bp, Homo sapiens
cagtgcatgtctgtgtggggat

SEQ ID NO: 8350073 - DNA, 22 bp, Homo sapiens
tcacaggagtcaaggaatagta

SEQ ID NO: 8350074 - DNA, 22 bp, Homo sapiens
tcacagacgcatcctcaggtag

SEQ ID NO: 8350075 - DNA, 22 bp, Homo sapiens
cagtgagataccacagagcaaa

SEQ ID NO: 8350076 - DNA, 22 bp, Homo sapiens
cagtgaggaagctgtctggacc

SEQ ID NO: 8350077 - DNA, 22 bp, Homo sapiens
tcacaaatcattttatctgtgt

SEQ ID NO: 8350078 - DNA, 22 bp, Homo sapiens
tcacaaatattttaacagtagg

SEQ ID NO: 8350079 - DNA, 22 bp, Homo sapiens
tcacaactctttccatttaata

SEQ ID NO: 8350080 - DNA, 22 bp, Homo sapiens
tcacaaatgtctcctgtcctgt

SEQ ID NO: 8350081 - DNA, 22 bp, Homo sapiens
tcacaaatgtttgcatgtgtct

SEQ ID NO: 8350082 - DNA, 22 bp, Homo sapiens
ccaggctcacagcatcccagga

SEQ ID NO: 8350083 - DNA, 17 bp, Homo sapiens
ccaggctccatcactgt

SEQ ID NO: 8350084 - DNA, 17 bp, Homo sapiens
ccaggctccatcactgt

SEQ ID NO: 8350085 - DNA, 22 bp, Homo sapiens
tctttaagccaagatatattta

SEQ ID NO: 8350086 - DNA, 19 bp, Homo sapiens
ccaggcctggcgtctccgc

SEQ ID NO: 8350087 - DNA, 22 bp, Homo sapiens
tctttcaaagctgtagtagatt

SEQ ID NO: 8350088 - DNA, 22 bp, Homo sapiens
tctttcaaagtaacaaccacga

SEQ ID NO: 8350089 - DNA, 22 bp, Homo sapiens
tctgcagacttgataaccactg

SEQ ID NO: 8350090 - DNA, 22 bp, Homo sapiens
tctgcagacaggaagctgaggc

SEQ ID NO: 8350091 - DNA, 22 bp, Homo sapiens
ccagcccttgagatggaaggga

SEQ ID NO: 8350092 - DNA, 22 bp, Homo sapiens
ccagcctcactggcatcaccta

SEQ ID NO: 8350093 - DNA, 22 bp, Homo sapiens
ccagccggactccacttcccgt

SEQ ID NO: 8350094 - DNA, 22 bp, Homo sapiens
tctttaagagttcatttgcatg

SEQ ID NO: 8350095 - DNA, 22 bp, Homo sapiens
tctttaaagttggagcttgcaa

SEQ ID NO: 8350096 - DNA, 22 bp, Homo sapiens
tcttgtctgcagatactttgaa

SEQ ID NO: 8350097 - DNA, 22 bp, Homo sapiens
tcttgttacagtttattacatg

SEQ ID NO: 8350098 - DNA, 22 bp, Homo sapiens
tcttgtaattaactagaaagat

SEQ ID NO: 8350099 - DNA, 22 bp, Homo sapiens
tcttggggtagacctgagaatt

SEQ ID NO: 8350100 - DNA, 21 bp, Homo sapiens
ccagcctcagatcagggagct

SEQ ID NO: 8350101 - DNA, 22 bp, Homo sapiens
tgaaggaaatgacggcagaaga

SEQ ID NO: 8350102 - DNA, 22 bp, Homo sapiens
tgaaggaaagagggaacatccc

SEQ ID NO: 8350103 - DNA, 22 bp, Homo sapiens
tgaagctttaggatgggttcat

SEQ ID NO: 8350104 - DNA, 22 bp, Homo sapiens
tgaaggaatgagggagtgggtc

SEQ ID NO: 8350105 - DNA, 22 bp, Homo sapiens
tgaaggaagaataggcagtgtt

SEQ ID NO: 8350106 - DNA, 17 bp, Homo sapiens
tgaaggaaggatgatgt

SEQ ID NO: 8350107 - DNA, 22 bp, Homo sapiens
tgaaggaatggaggatcagagc

SEQ ID NO: 8350108 - DNA, 22 bp, Homo sapiens
tgaaggaatgagtatactgttt

SEQ ID NO: 8350109 - DNA, 22 bp, Homo sapiens
tgaacagagctgattcagctca

SEQ ID NO: 8350110 - DNA, 22 bp, Homo sapiens
tgaacagatcaatagaactgac

SEQ ID NO: 8350111 - DNA, 22 bp, Homo sapiens
tgaacagctatcttgtcagtgt

SEQ ID NO: 8350112 - DNA, 22 bp, Homo sapiens
tgaacactgtccagagccatta

SEQ ID NO: 8350113 - DNA, 20 bp, Homo sapiens
tgaacactggggtgtttcag

SEQ ID NO: 8350114 - DNA, 22 bp, Homo sapiens
tgaagagaagaaaattatcttt

SEQ ID NO: 8350115 - DNA, 22 bp, Homo sapiens
tgaagagattaagttggttttg

SEQ ID NO: 8350116 - DNA, 22 bp, Homo sapiens
tgaagaggccgtgtgcaggtga

SEQ ID NO: 8350117 - DNA, 22 bp, Homo sapiens
tgaaaggggttgagttacagct

SEQ ID NO: 8350118 - DNA, 22 bp, Homo sapiens
tgaaaggaagagggctactcct

SEQ ID NO: 8350119 - DNA, 22 bp, Homo sapiens
tgaaacagattgatggtttcta

SEQ ID NO: 8350120 - DNA, 21 bp, Homo sapiens
tgaaacagatggaagtatttg

SEQ ID NO: 8350121 - DNA, 22 bp, Homo sapiens
tgaaagctctgtcatcattcct

SEQ ID NO: 8350122 - DNA, 22 bp, Homo sapiens
tgaaagcattagtctaaggtag

SEQ ID NO: 8350123 - DNA, 22 bp, Homo sapiens
tgaaagcagtgccatgattatg

SEQ ID NO: 8350124 - DNA, 22 bp, Homo sapiens
tgaaagcagtgatttctccttc

SEQ ID NO: 8350125 - DNA, 22 bp, Homo sapiens
tgacaattgtgggcagtttgtg

SEQ ID NO: 8350126 - DNA, 22 bp, Homo sapiens
tgacagagcaagatcttatctc

SEQ ID NO: 8350127 - DNA, 22 bp, Homo sapiens
tgacagagatggaatgaatctt

SEQ ID NO: 8350128 - DNA, 23 bp, Homo sapiens
tgacagagcaagacttggtctca

SEQ ID NO: 8350129 - DNA, 22 bp, Homo sapiens
tgacagagagcttttgactgtc

SEQ ID NO: 8350130 - DNA, 22 bp, Homo sapiens
tgacagagcatgtagtgacagc

SEQ ID NO: 8350131 - DNA, 22 bp, Homo sapiens
tgacagaggagctggaatgatt

SEQ ID NO: 8350132 - DNA, 22 bp, Homo sapiens
tgacagagccaagatcagtact

SEQ ID NO: 8350133 - DNA, 22 bp, Homo sapiens
ccagggccaagagacctcgagg

SEQ ID NO: 8350134 - DNA, 22 bp, Homo sapiens
ccagggccaagagacctcgagg

SEQ ID NO: 8350135 - DNA, 22 bp, Homo sapiens
ccagggcatgggaagaactgaa

SEQ ID NO: 8350136 - DNA, 22 bp, Homo sapiens
tgacagagttcggattgagttt

SEQ ID NO: 8350137 - DNA, 22 bp, Homo sapiens
tgacagaggcacccacaactat

SEQ ID NO: 8350138 - DNA, 22 bp, Homo sapiens
tgacagagtcggggcaagctgt

SEQ ID NO: 8350139 - DNA, 22 bp, Homo sapiens
ccagggcccacggccagaatag

SEQ ID NO: 8350140 - DNA, 23 bp, Homo sapiens
ccagggcccctacaccactgtcc

SEQ ID NO: 8350141 - DNA, 22 bp, Homo sapiens
ccagggccagtaagattggcat

SEQ ID NO: 8350142 - DNA, 22 bp, Homo sapiens
ccagggccagtaagattggcat

SEQ ID NO: 8350143 - DNA, 22 bp, Homo sapiens
tgacatgcttgttttccttgaa

SEQ ID NO: 8350144 - DNA, 22 bp, Homo sapiens
tgaccaatactgtggatgccag

SEQ ID NO: 8350145 - DNA, 18 bp, Homo sapiens
tgactttctttttcaacc

SEQ ID NO: 8350146 - DNA, 22 bp, Homo sapiens
ccagggtcttcgaggcagcaat

SEQ ID NO: 8350147 - DNA, 22 bp, Homo sapiens
tgagaaaactcaaagacagatc

SEQ ID NO: 8350148 - DNA, 22 bp, Homo sapiens
ccagggtctctgctgcctgaga

SEQ ID NO: 8350149 - DNA, 22 bp, Homo sapiens
tgaccccactgtgctcagaggt

SEQ ID NO: 8350150 - DNA, 19 bp, Homo sapiens
tgaccccacgctccagagc

SEQ ID NO: 8350151 - DNA, 19 bp, Homo sapiens
tgagctggctgagcctctc

SEQ ID NO: 8350152 - DNA, 22 bp, Homo sapiens
tgagctgggaagagcagccaga

SEQ ID NO: 8350153 - DNA, 22 bp, Homo sapiens
tgaggaagttgtttctcttcta

SEQ ID NO: 8350154 - DNA, 22 bp, Homo sapiens
tgaggaatttctttatgaatga

SEQ ID NO: 8350155 - DNA, 22 bp, Homo sapiens
tgagcacctccctgacagtggg

SEQ ID NO: 8350156 - DNA, 22 bp, Homo sapiens
tgagataagcaaggataaaggt

SEQ ID NO: 8350157 - DNA, 22 bp, Homo sapiens
tgagataaggatgttatactcg

SEQ ID NO: 8350158 - DNA, 22 bp, Homo sapiens
tgagataacaaaattatcttca

SEQ ID NO: 8350159 - DNA, 22 bp, Homo sapiens
tgagataactctgatttatgtt

SEQ ID NO: 8350160 - DNA, 22 bp, Homo sapiens
tgagataacatggaagagtagc

SEQ ID NO: 8350161 - DNA, 22 bp, Homo sapiens
tgagataactctgatttatgtt

SEQ ID NO: 8350162 - DNA, 22 bp, Homo sapiens
tgagagtggttcagctcagaag

SEQ ID NO: 8350163 - DNA, 18 bp, Homo sapiens
tgagagtgtgtgctcttg

SEQ ID NO: 8350164 - DNA, 18 bp, Homo sapiens
tgagagtgtgtgctcttg

SEQ ID NO: 8350165 - DNA, 22 bp, Homo sapiens
tgagagtgattggttcgaatgt

SEQ ID NO: 8350166 - DNA, 19 bp, Homo sapiens
tgagagtgaggaaggcttc

SEQ ID NO: 8350167 - DNA, 22 bp, Homo sapiens
tgagagtgaaatgtcacatgtc

SEQ ID NO: 8350168 - DNA, 22 bp, Homo sapiens
ccagggtggcgtagatgctggg

SEQ ID NO: 8350169 - DNA, 22 bp, Homo sapiens
ccagggtgggaggctgaaggcg

SEQ ID NO: 8350170 - DNA, 22 bp, Homo sapiens
ccagggtgtgagaaggaagtag

SEQ ID NO: 8350171 - DNA, 22 bp, Homo sapiens
ccagggtgtgagaaggaagtag

SEQ ID NO: 8350172 - DNA, 22 bp, Homo sapiens
ccagggtgtagggattccagat

SEQ ID NO: 8350173 - DNA, 22 bp, Homo sapiens
ccagggtggggcaggcccactg

SEQ ID NO: 8350174 - DNA, 22 bp, Homo sapiens
ccagggtggggtccaggaacca

SEQ ID NO: 8350175 - DNA, 22 bp, Homo sapiens
ccagggttgcagggagccagca

SEQ ID NO: 8350176 - DNA, 22 bp, Homo sapiens
ccaggtcctgttttcaccacag

SEQ ID NO: 8350177 - DNA, 22 bp, Homo sapiens
tgccctctcaagttgagtcaga

SEQ ID NO: 8350178 - DNA, 22 bp, Homo sapiens
tgccctcctcctgagcccatgt

SEQ ID NO: 8350179 - DNA, 22 bp, Homo sapiens
tgccctctttctgtacagctcc

SEQ ID NO: 8350180 - DNA, 22 bp, Homo sapiens
tgccctctgcctcctctgcaga

SEQ ID NO: 8350181 - DNA, 22 bp, Homo sapiens
tgccctcagccacctccaagtt

SEQ ID NO: 8350182 - DNA, 22 bp, Homo sapiens
cccaggaggcggaggttgcagt

SEQ ID NO: 8350183 - DNA, 19 bp, Homo sapiens
tgccctgcacgctgtcctg

SEQ ID NO: 8350184 - DNA, 23 bp, Homo sapiens
tgcctcagtggaatgtgagggtg

SEQ ID NO: 8350185 - DNA, 22 bp, Homo sapiens
cccaggaggcagagcttgcagt

SEQ ID NO: 8350186 - DNA, 22 bp, Homo sapiens
cccaggaggcctgcctggccgg

SEQ ID NO: 8350187 - DNA, 22 bp, Homo sapiens
cccaggaggcctgcctggccgg

SEQ ID NO: 8350188 - DNA, 22 bp, Homo sapiens
cccaggaggccaaggttgcagt

SEQ ID NO: 8350189 - DNA, 22 bp, Homo sapiens
cccaggaggcagaggttgcagt

SEQ ID NO: 8350190 - DNA, 22 bp, Homo sapiens
tgcatatttgattgagatacct

SEQ ID NO: 8350191 - DNA, 22 bp, Homo sapiens
tgcatattataaagagaattag

SEQ ID NO: 8350192 - DNA, 22 bp, Homo sapiens
tgcatatcttcaatgctgttgc

SEQ ID NO: 8350193 - DNA, 22 bp, Homo sapiens
cccaggacccttcaatggctcc

SEQ ID NO: 8350194 - DNA, 22 bp, Homo sapiens
cccaggaccgcgcggctgagcg

SEQ ID NO: 8350195 - DNA, 22 bp, Homo sapiens
cccaggaccgcgcggctgagcg

SEQ ID NO: 8350196 - DNA, 22 bp, Homo sapiens
tgcagtgaaagtatcttaattt

SEQ ID NO: 8350197 - DNA, 21 bp, Homo sapiens
tgcagtgaggggagctgtcag

SEQ ID NO: 8350198 - DNA, 22 bp, Homo sapiens
tgcagtgcagctggaagttggc

SEQ ID NO: 8350199 - DNA, 22 bp, Homo sapiens
tgcagtgcctcggcagtgcagc

SEQ ID NO: 8350200 - DNA, 22 bp, Homo sapiens
cccagcagtaaccagtggaaat

SEQ ID NO: 8350201 - DNA, 20 bp, Homo sapiens
cccagcccctacctgttgcc

SEQ ID NO: 8350202 - DNA, 19 bp, Homo sapiens
cccagccaggtcttgcatc

SEQ ID NO: 8350203 - DNA, 22 bp, Homo sapiens
tgatgacccaaggtgtcctctg

SEQ ID NO: 8350204 - DNA, 22 bp, Homo sapiens
tgatacataaaccatcattttg

SEQ ID NO: 8350205 - DNA, 22 bp, Homo sapiens
tgatacataaaccatcattttg

SEQ ID NO: 8350206 - DNA, 22 bp, Homo sapiens
tgattacacagcagtaatttca

SEQ ID NO: 8350207 - DNA, 22 bp, Homo sapiens
tgattacagtatttgagatcca

SEQ ID NO: 8350208 - DNA, 22 bp, Homo sapiens
tgattacagtatttgagatcca

SEQ ID NO: 8350209 - DNA, 22 bp, Homo sapiens
tgattacagtctgacagatgtt

SEQ ID NO: 8350210 - DNA, 22 bp, Homo sapiens
tgattacagtctgacagatgtt

SEQ ID NO: 8350211 - DNA, 22 bp, Homo sapiens
tgattacattggtaatgtttat

SEQ ID NO: 8350212 - DNA, 22 bp, Homo sapiens
cccaacactcacctccggatta

SEQ ID NO: 8350213 - DNA, 22 bp, Homo sapiens
ccatggcctcgctctacgtggg

SEQ ID NO: 8350214 - DNA, 22 bp, Homo sapiens
cccaaacatccaggtgctggac

SEQ ID NO: 8350215 - DNA, 22 bp, Homo sapiens
cccaaacagttcctgtggtact

SEQ ID NO: 8350216 - DNA, 22 bp, Homo sapiens
ccatggagttcctctggtctat

SEQ ID NO: 8350217 - DNA, 23 bp, Homo sapiens
ccatggccaatgtcaagctacta

SEQ ID NO: 8350218 - DNA, 20 bp, Homo sapiens
ccatggccacatctgtgctg

SEQ ID NO: 8350219 - DNA, 22 bp, Homo sapiens
ccatggccaattgcaccttgct

SEQ ID NO: 8350220 - DNA, 22 bp, Homo sapiens
ccatggccgccgctgctcagga

SEQ ID NO: 8350221 - DNA, 20 bp, Homo sapiens
ccatggccacatctgtgctg

SEQ ID NO: 8350222 - DNA, 22 bp, Homo sapiens
ccatggccaggaaagccaaggt

SEQ ID NO: 8350223 - DNA, 22 bp, Homo sapiens
cccagcagccagaatgaggagc

SEQ ID NO: 8350224 - DNA, 22 bp, Homo sapiens
cccagcagaccgctgtgatggc

SEQ ID NO: 8350225 - DNA, 22 bp, Homo sapiens
cccagcagaatctgatgagggc

SEQ ID NO: 8350226 - DNA, 22 bp, Homo sapiens
cccagcagaatctgatgagggc

SEQ ID NO: 8350227 - DNA, 23 bp, Homo sapiens
cccagcagagatgaggaggggtc

SEQ ID NO: 8350228 - DNA, 22 bp, Homo sapiens
tgcagaggtttttaatacattt

SEQ ID NO: 8350229 - DNA, 22 bp, Homo sapiens
tgcagaggtttgtggtgttgct

SEQ ID NO: 8350230 - DNA, 22 bp, Homo sapiens
tgcagaggtttccaggcaagtt

SEQ ID NO: 8350231 - DNA, 22 bp, Homo sapiens
cccagagaaccttctgtgccac

SEQ ID NO: 8350232 - DNA, 22 bp, Homo sapiens
cccagagaagtgaagtgacttg

SEQ ID NO: 8350233 - DNA, 22 bp, Homo sapiens
tgcagaggtgaaagactagcaa

SEQ ID NO: 8350234 - DNA, 22 bp, Homo sapiens
tgcagaggtttccaggcaagtt

SEQ ID NO: 8350235 - DNA, 22 bp, Homo sapiens
tgcagagatagaactactttct

SEQ ID NO: 8350236 - DNA, 22 bp, Homo sapiens
cccacccagctgagccgctcac

SEQ ID NO: 8350237 - DNA, 23 bp, Homo sapiens
cccacatgtctgagtcagtgcca

SEQ ID NO: 8350238 - DNA, 22 bp, Homo sapiens
cctgaggctcgcgcgcccctgg

SEQ ID NO: 8350239 - DNA, 22 bp, Homo sapiens
cctgaggctggcccttccatcc

SEQ ID NO: 8350240 - DNA, 22 bp, Homo sapiens
cctgaggcttaatctgtcccaa

SEQ ID NO: 8350241 - DNA, 22 bp, Homo sapiens
cctgaccatttgccacatgggt

SEQ ID NO: 8350242 - DNA, 23 bp, Homo sapiens
cctgaccctgtctccctcacatg

SEQ ID NO: 8350243 - DNA, 22 bp, Homo sapiens
cctgagaaatagcatcattttt

SEQ ID NO: 8350244 - DNA, 22 bp, Homo sapiens
cctgagaataacaaattgctgc

SEQ ID NO: 8350245 - DNA, 22 bp, Homo sapiens
cctgccaggagctggtgctgca

SEQ ID NO: 8350246 - DNA, 22 bp, Homo sapiens
cctgcaccaggcccagcatggt

SEQ ID NO: 8350247 - DNA, 22 bp, Homo sapiens
cctgcacccaggccgcacctct

SEQ ID NO: 8350248 - DNA, 22 bp, Homo sapiens
cctgcaccacaaggcttcagag

SEQ ID NO: 8350249 - DNA, 22 bp, Homo sapiens
tgggggtgtgccagggacctcc

SEQ ID NO: 8350250 - DNA, 22 bp, Homo sapiens
tgggggtgtcctggtgcacaca

SEQ ID NO: 8350251 - DNA, 21 bp, Homo sapiens
tgggggagaattggttgcttt

SEQ ID NO: 8350252 - DNA, 22 bp, Homo sapiens
tgggggagagaggcattctttc

SEQ ID NO: 8350253 - DNA, 22 bp, Homo sapiens
tgggggtggttcttgcctccag

SEQ ID NO: 8350254 - DNA, 22 bp, Homo sapiens
tgggccagaggcatggagctat

SEQ ID NO: 8350255 - DNA, 22 bp, Homo sapiens
tgggccagaagtatgcatgttt

SEQ ID NO: 8350256 - DNA, 22 bp, Homo sapiens
cctctggccagagaaaggccag

SEQ ID NO: 8350257 - DNA, 22 bp, Homo sapiens
tgggcagggagctggaaccaca

SEQ ID NO: 8350258 - DNA, 22 bp, Homo sapiens
tgggccacgtgacccttaccct

SEQ ID NO: 8350259 - DNA, 22 bp, Homo sapiens
cctcttctgagtgagactccct

SEQ ID NO: 8350260 - DNA, 22 bp, Homo sapiens
cctcttgatttggctgtgaagt

SEQ ID NO: 8350261 - DNA, 22 bp, Homo sapiens
cctgaagcacaaaagcacagct

SEQ ID NO: 8350262 - DNA, 21 bp, Homo sapiens
tggctctgaaagagtgctgca

SEQ ID NO: 8350263 - DNA, 21 bp, Homo sapiens
tggctctgaaagagtgctgca

SEQ ID NO: 8350264 - DNA, 22 bp, Homo sapiens
tgggagctcctggagggcagga

SEQ ID NO: 8350265 - DNA, 22 bp, Homo sapiens
tgggagctcacaggcctggctc

SEQ ID NO: 8350266 - DNA, 22 bp, Homo sapiens
cctctggcaacttcacagccca

SEQ ID NO: 8350267 - DNA, 22 bp, Homo sapiens
cctgccagggccagaggccagc

SEQ ID NO: 8350268 - DNA, 22 bp, Homo sapiens
tgggtcagagcagacctctgga

SEQ ID NO: 8350269 - DNA, 22 bp, Homo sapiens
tgggtcagacagccagtgggcc

SEQ ID NO: 8350270 - DNA, 22 bp, Homo sapiens
tgggtatacaaataatctcttt

SEQ ID NO: 8350271 - DNA, 22 bp, Homo sapiens
tgggtatatatgttgctacaga

SEQ ID NO: 8350272 - DNA, 22 bp, Homo sapiens
tgggtcagaggacctcgtggcc

SEQ ID NO: 8350273 - DNA, 22 bp, Homo sapiens
cctgctgtagggcccctggggc

SEQ ID NO: 8350274 - DNA, 22 bp, Homo sapiens
tgtaatgttagaaacaattgct

SEQ ID NO: 8350275 - DNA, 22 bp, Homo sapiens
tgtacagtggaaaatggattcg

SEQ ID NO: 8350276 - DNA, 22 bp, Homo sapiens
tgtacatacatagatatacaca

SEQ ID NO: 8350277 - DNA, 22 bp, Homo sapiens
cctggagctcactgggagccgg

SEQ ID NO: 8350278 - DNA, 22 bp, Homo sapiens
cctggagcactctccctggctg

SEQ ID NO: 8350279 - DNA, 22 bp, Homo sapiens
tgtacatagatcttgaaaatta

SEQ ID NO: 8350280 - DNA, 22 bp, Homo sapiens
tgtacattttctcagagtttat

SEQ ID NO: 8350281 - DNA, 19 bp, Homo sapiens
tgtacatatagagctcagt

SEQ ID NO: 8350282 - DNA, 22 bp, Homo sapiens
tgtacatagaaaggatacagct

SEQ ID NO: 8350283 - DNA, 22 bp, Homo sapiens
tgtacatagaaaggatacagct

SEQ ID NO: 8350284 - DNA, 22 bp, Homo sapiens
tgtacatacatagatatacaca

SEQ ID NO: 8350285 - DNA, 22 bp, Homo sapiens
cctggaaaacatgggaatcaca

SEQ ID NO: 8350286 - DNA, 22 bp, Homo sapiens
tgtaatatatataactgtgtgc

SEQ ID NO: 8350287 - DNA, 22 bp, Homo sapiens
tgtaatggaagtgggattgcat

SEQ ID NO: 8350288 - DNA, 22 bp, Homo sapiens
tgtaatgaaatggtacaactgt

SEQ ID NO: 8350289 - DNA, 21 bp, Homo sapiens
tgtaatctaaagaagctcttt

SEQ ID NO: 8350290 - DNA, 21 bp, Homo sapiens
tgtaagtttcatctgaattgg

SEQ ID NO: 8350291 - DNA, 18 bp, Homo sapiens
cctggaggtcttcggggt

SEQ ID NO: 8350292 - DNA, 22 bp, Homo sapiens
cctggagggcgccgcacagtcc

SEQ ID NO: 8350293 - DNA, 22 bp, Homo sapiens
cctggaggggaccaggaccagg

SEQ ID NO: 8350294 - DNA, 23 bp, Homo sapiens
tgtcaacaaaactttcaggagaa

SEQ ID NO: 8350295 - DNA, 22 bp, Homo sapiens
tgtattcagtgcctagcatatg

SEQ ID NO: 8350296 - DNA, 22 bp, Homo sapiens
tgtattctaaatacatcttacc

SEQ ID NO: 8350297 - DNA, 22 bp, Homo sapiens
tgtcaacatttatcaagttatt

SEQ ID NO: 8350298 - DNA, 22 bp, Homo sapiens
tgtcaacaggctttctaaggca

SEQ ID NO: 8350299 - DNA, 22 bp, Homo sapiens
tgtcaacagatactagagagct

SEQ ID NO: 8350300 - DNA, 22 bp, Homo sapiens
cctggaggctctgggagggcag

SEQ ID NO: 8350301 - DNA, 22 bp, Homo sapiens
cctggagggcgccgcacagtcc

SEQ ID NO: 8350302 - DNA, 22 bp, Homo sapiens
cctggagggcagcccattctgg

SEQ ID NO: 8350303 - DNA, 22 bp, Homo sapiens
cctggagggcgccgcacagtcc

SEQ ID NO: 8350304 - DNA, 22 bp, Homo sapiens
cctggaggctctgggagggcag

SEQ ID NO: 8350305 - DNA, 22 bp, Homo sapiens
cctggaggcggaggttgcagtg

SEQ ID NO: 8350306 - DNA, 22 bp, Homo sapiens
cctggaggagcgctgaccagct

SEQ ID NO: 8350307 - DNA, 22 bp, Homo sapiens
cctggagcttggtcacgctgcg

SEQ ID NO: 8350308 - DNA, 22 bp, Homo sapiens
cctggagcttggtcacgctgcg

SEQ ID NO: 8350309 - DNA, 18 bp, Homo sapiens
cctggagctccacagcaa

SEQ ID NO: 8350310 - DNA, 18 bp, Homo sapiens
cctggagctccacagcaa

SEQ ID NO: 8350311 - DNA, 22 bp, Homo sapiens
tggcctctcctggcagcatcca

SEQ ID NO: 8350312 - DNA, 22 bp, Homo sapiens
cctcagccttggccccaggcag

SEQ ID NO: 8350313 - DNA, 22 bp, Homo sapiens
cctcagcccctgaatggagaga

SEQ ID NO: 8350314 - DNA, 22 bp, Homo sapiens
cctcagcccctgaatggagaga

SEQ ID NO: 8350315 - DNA, 22 bp, Homo sapiens
cctcagccttggccccaggcag

SEQ ID NO: 8350316 - DNA, 22 bp, Homo sapiens
cctcagctgcttccctggagcc

SEQ ID NO: 8350317 - DNA, 19 bp, Homo sapiens
cctcaccctgcagaggagg

SEQ ID NO: 8350318 - DNA, 22 bp, Homo sapiens
cctcactctgcaccctgcagca

SEQ ID NO: 8350319 - DNA, 22 bp, Homo sapiens
cctcactctgcaccctgcagca

SEQ ID NO: 8350320 - DNA, 22 bp, Homo sapiens
cctcactcttgtcctggcaggt

SEQ ID NO: 8350321 - DNA, 22 bp, Homo sapiens
cctcactgaagaggtgacattt

SEQ ID NO: 8350322 - DNA, 22 bp, Homo sapiens
cctcactgaagaggtgacattt

SEQ ID NO: 8350323 - DNA, 22 bp, Homo sapiens
cctcactcttgtcctggcaggt

SEQ ID NO: 8350324 - DNA, 22 bp, Homo sapiens
cctcactcttgtcctggcaggt

SEQ ID NO: 8350325 - DNA, 22 bp, Homo sapiens
cctcactttcctttctcctggg

SEQ ID NO: 8350326 - DNA, 22 bp, Homo sapiens
tggcctcaagtctgagggcctt

SEQ ID NO: 8350327 - DNA, 21 bp, Homo sapiens
tggccctggccacggctgcca

SEQ ID NO: 8350328 - DNA, 22 bp, Homo sapiens
tggccctgcttatgtctctctt

SEQ ID NO: 8350329 - DNA, 22 bp, Homo sapiens
tggctcagcgcggcctggtctt

SEQ ID NO: 8350330 - DNA, 22 bp, Homo sapiens
tggctcagcctggccctttcat

SEQ ID NO: 8350331 - DNA, 22 bp, Homo sapiens
tggctcagcctggccctttcat

SEQ ID NO: 8350332 - DNA, 22 bp, Homo sapiens
tggctcagccattcgtgttgcc

SEQ ID NO: 8350333 - DNA, 22 bp, Homo sapiens
tggctcagccattcgtgttgcc

SEQ ID NO: 8350334 - DNA, 22 bp, Homo sapiens
tggctcagccagccctaggaac

SEQ ID NO: 8350335 - DNA, 22 bp, Homo sapiens
tggctcagcggtggcagcagac

SEQ ID NO: 8350336 - DNA, 22 bp, Homo sapiens
tggctcagcgcggcctggtctt

SEQ ID NO: 8350337 - DNA, 23 bp, Homo sapiens
tggctcagctagttttccatttc

SEQ ID NO: 8350338 - DNA, 22 bp, Homo sapiens
tggctcagctgactcggcttct

SEQ ID NO: 8350339 - DNA, 22 bp, Homo sapiens
cctccccatgacccggtgctgg

SEQ ID NO: 8350340 - DNA, 22 bp, Homo sapiens
ccgggggactactgggaaactg

SEQ ID NO: 8350341 - DNA, 22 bp, Homo sapiens
ccgggggaggcaagagacatgc

SEQ ID NO: 8350342 - DNA, 22 bp, Homo sapiens
ccgggtggggactccaggtttc

SEQ ID NO: 8350343 - DNA, 22 bp, Homo sapiens
ccggggacagcaggtccgactt

SEQ ID NO: 8350344 - DNA, 22 bp, Homo sapiens
ccggggacttaaagtgaaggaa

SEQ ID NO: 8350345 - DNA, 18 bp, Homo sapiens
ccgggctttggtgacaca

SEQ ID NO: 8350346 - DNA, 21 bp, Homo sapiens
ccgtgctcggctatggaccac

SEQ ID NO: 8350347 - DNA, 22 bp, Homo sapiens
ccgtccccagccacctgctgat

SEQ ID NO: 8350348 - DNA, 22 bp, Homo sapiens
ccgtcccctctgaccttgctga

SEQ ID NO: 8350349 - DNA, 22 bp, Homo sapiens
ccgtctgcagcctccaggagtt

SEQ ID NO: 8350350 - DNA, 22 bp, Homo sapiens
ccgtggtcacctgagctccttg

SEQ ID NO: 8350351 - DNA, 22 bp, Homo sapiens
ccgtggggggccgtcgtccctg

SEQ ID NO: 8350352 - DNA, 22 bp, Homo sapiens
ccgggcgggggctctcgtcacc

SEQ ID NO: 8350353 - DNA, 22 bp, Homo sapiens
ccgggaggtggagattgcggtg

SEQ ID NO: 8350354 - DNA, 22 bp, Homo sapiens
ccgggccccacggtgacctcag

SEQ ID NO: 8350355 - DNA, 22 bp, Homo sapiens
ccgggccgccccgcgtttctta

SEQ ID NO: 8350356 - DNA, 22 bp, Homo sapiens
ccgggagcaggcgccaccgcca

SEQ ID NO: 8350357 - DNA, 22 bp, Homo sapiens
ccgggagcaggcgccaccgcca

SEQ ID NO: 8350358 - DNA, 22 bp, Homo sapiens
cctcacagggccaggcccctca

SEQ ID NO: 8350359 - DNA, 21 bp, Homo sapiens
cctattgaatataggaagatt

SEQ ID NO: 8350360 - DNA, 22 bp, Homo sapiens
cctattgacaattctcttctcc

SEQ ID NO: 8350361 - DNA, 22 bp, Homo sapiens
ccctgggataccagacaccaga

SEQ ID NO: 8350362 - DNA, 22 bp, Homo sapiens
ccgccgtgtcgacaggccctgg

SEQ ID NO: 8350363 - DNA, 22 bp, Homo sapiens
ccgcggggtcatggctgggccg

SEQ ID NO: 8350364 - DNA, 22 bp, Homo sapiens
ccggagtgtctggcctgctggg

SEQ ID NO: 8350365 - DNA, 22 bp, Homo sapiens
tgcctgccctgaaaactgccca

SEQ ID NO: 8350366 - DNA, 22 bp, Homo sapiens
tgcctcagtttcatctgcagaa

SEQ ID NO: 8350367 - DNA, 22 bp, Homo sapiens
tgcctccatgtttcagcatcta

SEQ ID NO: 8350368 - DNA, 22 bp, Homo sapiens
tgcctccaccattgctcacttt

SEQ ID NO: 8350369 - DNA, 22 bp, Homo sapiens
tgctttcagatatctgtttcaa

SEQ ID NO: 8350370 - DNA, 22 bp, Homo sapiens
ccctagagagatcagatgggga

SEQ ID NO: 8350371 - DNA, 22 bp, Homo sapiens
cccgggttgtccgcgcgtccgg

SEQ ID NO: 8350372 - DNA, 22 bp, Homo sapiens
cccgtccctgtgcgtcgcgagc

SEQ ID NO: 8350373 - DNA, 19 bp, Homo sapiens
tggaggggtttgaatgtgg

SEQ ID NO: 8350374 - DNA, 22 bp, Homo sapiens
tggaggggcaatggagcgcgga

SEQ ID NO: 8350375 - DNA, 22 bp, Homo sapiens
tggaggtgagtgtggtacagca

SEQ ID NO: 8350376 - DNA, 22 bp, Homo sapiens
ccctggagctagtctgagcaga

SEQ ID NO: 8350377 - DNA, 19 bp, Homo sapiens
tggaggccaggacacaggt

SEQ ID NO: 8350378 - DNA, 22 bp, Homo sapiens
tggaggccagaggtactgggac

SEQ ID NO: 8350379 - DNA, 22 bp, Homo sapiens
ccctgctcttagtgcctgtgtg

SEQ ID NO: 8350380 - DNA, 23 bp, Homo sapiens
ccctgctcaggggtctgattctc

SEQ ID NO: 8350381 - DNA, 22 bp, Homo sapiens
ccctgctcttctgactcaagct

SEQ ID NO: 8350382 - DNA, 22 bp, Homo sapiens
ccctgccttggggtccacaccg

SEQ ID NO: 8350383 - DNA, 22 bp, Homo sapiens
tggacagtattgtgaagcaggc

SEQ ID NO: 8350384 - DNA, 22 bp, Homo sapiens
tggacagtgcagatacagaatg

SEQ ID NO: 8350385 - DNA, 20 bp, Homo sapiens
tggacagttactttatctct

SEQ ID NO: 8350386 - DNA, 23 bp, Homo sapiens
tggacagtagggtagacagtgcc

SEQ ID NO: 8350387 - DNA, 22 bp, Homo sapiens
tggacagttgtcttgtagctaa

SEQ ID NO: 8350388 - DNA, 19 bp, Homo sapiens
ccctgccctggtgactggg

SEQ ID NO: 8350389 - DNA, 22 bp, Homo sapiens
ccctgcctctgaagctgctcag

SEQ ID NO: 8350390 - DNA, 22 bp, Homo sapiens
ccctgcctctgaagctgctcag

SEQ ID NO: 8350391 - DNA, 22 bp, Homo sapiens
ccctgcctgtgggcatcaacat

SEQ ID NO: 8350392 - DNA, 22 bp, Homo sapiens
ccctgcctgtgggcatcaacat

SEQ ID NO: 8350393 - DNA, 22 bp, Homo sapiens
ccctgcagagccagccctgacc

SEQ ID NO: 8350394 - DNA, 17 bp, Homo sapiens
ccctgcaccctactctc

SEQ ID NO: 8350395 - DNA, 20 bp, Homo sapiens
ccctgcagccatgggagtgg

SEQ ID NO: 8350396 - DNA, 22 bp, Homo sapiens
ctgcaggaattcaaagtgagct

SEQ ID NO: 8350397 - DNA, 22 bp, Homo sapiens
ctgcaggacagggccggaggcc

SEQ ID NO: 8350398 - DNA, 22 bp, Homo sapiens
ctgaggtttacaagctattgct

SEQ ID NO: 8350399 - DNA, 22 bp, Homo sapiens
ctgcaggaggatcctgagagtg

SEQ ID NO: 8350400 - DNA, 22 bp, Homo sapiens
ctgcaggaggatcctgagagtg

SEQ ID NO: 8350401 - DNA, 22 bp, Homo sapiens
ctgcaggagcaaagcctctgct

SEQ ID NO: 8350402 - DNA, 22 bp, Homo sapiens
ctgcaggattctcccagttgga

SEQ ID NO: 8350403 - DNA, 22 bp, Homo sapiens
ctgcaggagtgaaagcaggcct

SEQ ID NO: 8350404 - DNA, 22 bp, Homo sapiens
ctgcccagattttaccacctgc

SEQ ID NO: 8350405 - DNA, 22 bp, Homo sapiens
ctgcccacacctgagctgggcc

SEQ ID NO: 8350406 - DNA, 20 bp, Homo sapiens
ctgcccagccactgagggat

SEQ ID NO: 8350407 - DNA, 22 bp, Homo sapiens
ctgcccagattttaccacctgc

SEQ ID NO: 8350408 - DNA, 22 bp, Homo sapiens
ctgcccaggctgaaggaacatc

SEQ ID NO: 8350409 - DNA, 22 bp, Homo sapiens
ctgcccataaactttccacctg

SEQ ID NO: 8350410 - DNA, 22 bp, Homo sapiens
ctgcccatctgcagacatgcgt

SEQ ID NO: 8350411 - DNA, 22 bp, Homo sapiens
ctgcccagtttgggagcctttc

SEQ ID NO: 8350412 - DNA, 22 bp, Homo sapiens
ctgcccatctggccacacacag

SEQ ID NO: 8350413 - DNA, 22 bp, Homo sapiens
ctgcccattcaaccagctacag

SEQ ID NO: 8350414 - DNA, 21 bp, Homo sapiens
ctgcccatttgtgatgtcccc

SEQ ID NO: 8350415 - DNA, 22 bp, Homo sapiens
ctgcccccaggctgcatggctg

SEQ ID NO: 8350416 - DNA, 22 bp, Homo sapiens
ctgccccctgctttgtccttga

SEQ ID NO: 8350417 - DNA, 22 bp, Homo sapiens
ctgagcatggccggtccatggt

SEQ ID NO: 8350418 - DNA, 17 bp, Homo sapiens
ctgagcatccgtgctct

SEQ ID NO: 8350419 - DNA, 22 bp, Homo sapiens
ctgaggcctggccccaccacag

SEQ ID NO: 8350420 - DNA, 22 bp, Homo sapiens
ctgaggctaacctcgagagaca

SEQ ID NO: 8350421 - DNA, 18 bp, Homo sapiens
ctgaggctggcaggagcc

SEQ ID NO: 8350422 - DNA, 22 bp, Homo sapiens
ctgaggctggagtgcagtggtg

SEQ ID NO: 8350423 - DNA, 22 bp, Homo sapiens
ctgagcaggcggtggagcggct

SEQ ID NO: 8350424 - DNA, 22 bp, Homo sapiens
ctgagcagtgctttgcagtggg

SEQ ID NO: 8350425 - DNA, 22 bp, Homo sapiens
ctgagcagtctagccaggtgtt

SEQ ID NO: 8350426 - DNA, 19 bp, Homo sapiens
ctgagcagcggcagcactt

SEQ ID NO: 8350427 - DNA, 22 bp, Homo sapiens
ctgagcagaagggtgcacgtgc

SEQ ID NO: 8350428 - DNA, 22 bp, Homo sapiens
ctgagcagctccctgagtggtc

SEQ ID NO: 8350429 - DNA, 22 bp, Homo sapiens
ctgagcagcgtggggagctggc

SEQ ID NO: 8350430 - DNA, 22 bp, Homo sapiens
ctcttctctgcagcctttgaag

SEQ ID NO: 8350431 - DNA, 22 bp, Homo sapiens
ctcttcttatggccgtggctga

SEQ ID NO: 8350432 - DNA, 22 bp, Homo sapiens
ctgccttggccctagttcatgg

SEQ ID NO: 8350433 - DNA, 22 bp, Homo sapiens
ctgccttggaaaatgtggtaat

SEQ ID NO: 8350434 - DNA, 21 bp, Homo sapiens
ctgctctgacagtgaggccag

SEQ ID NO: 8350435 - DNA, 22 bp, Homo sapiens
ctgctctgaccctttcaccttc

SEQ ID NO: 8350436 - DNA, 22 bp, Homo sapiens
ctgcctggggcatcagtcaagg

SEQ ID NO: 8350437 - DNA, 22 bp, Homo sapiens
ctgccttgaaaatgaagcttta

SEQ ID NO: 8350438 - DNA, 21 bp, Homo sapiens
ctgccttgaatggtactggga

SEQ ID NO: 8350439 - DNA, 22 bp, Homo sapiens
ctgccttgaggaggttgtggga

SEQ ID NO: 8350440 - DNA, 22 bp, Homo sapiens
ctgctgaacctttgctagataa

SEQ ID NO: 8350441 - DNA, 22 bp, Homo sapiens
ctgctcttcccactcactccca

SEQ ID NO: 8350442 - DNA, 22 bp, Homo sapiens
ctgctgagaaaagactgaggga

SEQ ID NO: 8350443 - DNA, 22 bp, Homo sapiens
ctgctgagcatcagggctgccc

SEQ ID NO: 8350444 - DNA, 22 bp, Homo sapiens
ctgctgagagccccagctgaga

SEQ ID NO: 8350445 - DNA, 22 bp, Homo sapiens
ctgctgagatgccaggagctct

SEQ ID NO: 8350446 - DNA, 22 bp, Homo sapiens
ctgctgagagctgaaggctgta

SEQ ID NO: 8350447 - DNA, 20 bp, Homo sapiens
ctgctgagagcctggcttgc

SEQ ID NO: 8350448 - DNA, 22 bp, Homo sapiens
ctgctgggtctatgcaagtgga

SEQ ID NO: 8350449 - DNA, 19 bp, Homo sapiens
ctgctgggtgctgagggag

SEQ ID NO: 8350450 - DNA, 22 bp, Homo sapiens
ctgctgtcatagccatccctcc

SEQ ID NO: 8350451 - DNA, 22 bp, Homo sapiens
ctgctgtccaacctgcactcgc

SEQ ID NO: 8350452 - DNA, 22 bp, Homo sapiens
ctgctgtccaggagtgccctgt

SEQ ID NO: 8350453 - DNA, 22 bp, Homo sapiens
ctgctgtccaacctgcactcgc

SEQ ID NO: 8350454 - DNA, 22 bp, Homo sapiens
ctgctgtcccagcctcctcaca

SEQ ID NO: 8350455 - DNA, 22 bp, Homo sapiens
ctgctgtcaaaaatcactccat

SEQ ID NO: 8350456 - DNA, 20 bp, Homo sapiens
ctggaagcctttccagagca

SEQ ID NO: 8350457 - DNA, 22 bp, Homo sapiens
ctggaagctggaacaggtgtgg

SEQ ID NO: 8350458 - DNA, 22 bp, Homo sapiens
ctgctgtctttatttcactgct

SEQ ID NO: 8350459 - DNA, 22 bp, Homo sapiens
ctgctgtctttatttcactgct

SEQ ID NO: 8350460 - DNA, 22 bp, Homo sapiens
ctggaaagtgaggagagttcca

SEQ ID NO: 8350461 - DNA, 22 bp, Homo sapiens
ctggaagggaaatctcttggca

SEQ ID NO: 8350462 - DNA, 22 bp, Homo sapiens
ctggaaggagaaggaggctgtg

SEQ ID NO: 8350463 - DNA, 22 bp, Homo sapiens
ctggagataagtaaagaggcaa

SEQ ID NO: 8350464 - DNA, 22 bp, Homo sapiens
ctggagagttggaagatggact

SEQ ID NO: 8350465 - DNA, 22 bp, Homo sapiens
ctggagagtaatctctgtgtta

SEQ ID NO: 8350466 - DNA, 22 bp, Homo sapiens
ctggagagggagctgttggaag

SEQ ID NO: 8350467 - DNA, 22 bp, Homo sapiens
ctggagagatcctcctgaaaaa

SEQ ID NO: 8350468 - DNA, 22 bp, Homo sapiens
ctggagccggcgagccccagcc

SEQ ID NO: 8350469 - DNA, 22 bp, Homo sapiens
ctggagcaggcttgtcccagct

SEQ ID NO: 8350470 - DNA, 22 bp, Homo sapiens
tttgacattttctcactgtgtt

SEQ ID NO: 8350471 - DNA, 22 bp, Homo sapiens
tttgaccttggtacaggtttac

SEQ ID NO: 8350472 - DNA, 22 bp, Homo sapiens
tttgaaagagctgatacatgaa

SEQ ID NO: 8350473 - DNA, 22 bp, Homo sapiens
ctctgaggtctaggaccatggc

SEQ ID NO: 8350474 - DNA, 22 bp, Homo sapiens
tttcttgtaagatgtttattaa

SEQ ID NO: 8350475 - DNA, 22 bp, Homo sapiens
tttgaaaaaggcctttggtatg

SEQ ID NO: 8350476 - DNA, 22 bp, Homo sapiens
tttgaaaaaggcctttggtatg

SEQ ID NO: 8350477 - DNA, 22 bp, Homo sapiens
tttgaaagaaaccagtgagtga

SEQ ID NO: 8350478 - DNA, 22 bp, Homo sapiens
tttgaaagaatttatgtacttt

SEQ ID NO: 8350479 - DNA, 22 bp, Homo sapiens
tttgaaagacagaatatttttg

SEQ ID NO: 8350480 - DNA, 22 bp, Homo sapiens
tttgcaaacacttaagaagaga

SEQ ID NO: 8350481 - DNA, 22 bp, Homo sapiens
tttgagaagatgtaatgttaag

SEQ ID NO: 8350482 - DNA, 22 bp, Homo sapiens
tttgagaagataggggaatact

SEQ ID NO: 8350483 - DNA, 22 bp, Homo sapiens
tttgagaaactgattattatgg

SEQ ID NO: 8350484 - DNA, 22 bp, Homo sapiens
tttgagaaaggggatttaattc

SEQ ID NO: 8350485 - DNA, 22 bp, Homo sapiens
tttgagaaacagacgaaagaca

SEQ ID NO: 8350486 - DNA, 22 bp, Homo sapiens
tttgagaaaaccagaaagatct

SEQ ID NO: 8350487 - DNA, 22 bp, Homo sapiens
tttgagaaaaccagaaagatct

SEQ ID NO: 8350488 - DNA, 22 bp, Homo sapiens
ctctggcacactccttccaggt

SEQ ID NO: 8350489 - DNA, 22 bp, Homo sapiens
ctctggcaattgctgctgactc

SEQ ID NO: 8350490 - DNA, 22 bp, Homo sapiens
ctctggcaattgctgctgactc

SEQ ID NO: 8350491 - DNA, 22 bp, Homo sapiens
tttgcaaagaaattattgctgt

SEQ ID NO: 8350492 - DNA, 22 bp, Homo sapiens
tttgcaaagaaattattgctgt

SEQ ID NO: 8350493 - DNA, 19 bp, Homo sapiens
ctctggcctctggatgctg

SEQ ID NO: 8350494 - DNA, 22 bp, Homo sapiens
ctctggcctgcttcctcaggta

SEQ ID NO: 8350495 - DNA, 22 bp, Homo sapiens
ctctggcctggggcctgctccc

SEQ ID NO: 8350496 - DNA, 22 bp, Homo sapiens
ctctggcctggggcctgctccc

SEQ ID NO: 8350497 - DNA, 22 bp, Homo sapiens
ctctggccgcagctcagctctg

SEQ ID NO: 8350498 - DNA, 22 bp, Homo sapiens
ctctggccccagtggccccttg

SEQ ID NO: 8350499 - DNA, 22 bp, Homo sapiens
ctctggccagagcctgcgggaa

SEQ ID NO: 8350500 - DNA, 22 bp, Homo sapiens
ctctggcacactccttccaggt

SEQ ID NO: 8350501 - DNA, 22 bp, Homo sapiens
ctctgggtggtctcactgagtg

SEQ ID NO: 8350502 - DNA, 22 bp, Homo sapiens
tttggaagtcctgaaatagagg

SEQ ID NO: 8350503 - DNA, 22 bp, Homo sapiens
ctctggctatggcacggcgctc

SEQ ID NO: 8350504 - DNA, 22 bp, Homo sapiens
ctctgtgattttgtgagccaga

SEQ ID NO: 8350505 - DNA, 22 bp, Homo sapiens
ctctgtgcttatgctccatggg

SEQ ID NO: 8350506 - DNA, 22 bp, Homo sapiens
ctctgtgccctactgctcagct

SEQ ID NO: 8350507 - DNA, 22 bp, Homo sapiens
ctctgtgcttatgctccatggg

SEQ ID NO: 8350508 - DNA, 22 bp, Homo sapiens
tttgttctagatcgtgtttgtg

SEQ ID NO: 8350509 - DNA, 22 bp, Homo sapiens
ctctggttgagtgagaaccaag

SEQ ID NO: 8350510 - DNA, 22 bp, Homo sapiens
ctccaggaggttgctgcttcct

SEQ ID NO: 8350511 - DNA, 19 bp, Homo sapiens
ctccaggatggctgggcga

SEQ ID NO: 8350512 - DNA, 23 bp, Homo sapiens
tttatattcctaatgtcttgagc

SEQ ID NO: 8350513 - DNA, 22 bp, Homo sapiens
ctccaggcccacggccgcggcc

SEQ ID NO: 8350514 - DNA, 22 bp, Homo sapiens
tttattcactcattcagccagt

SEQ ID NO: 8350515 - DNA, 22 bp, Homo sapiens
tttattcactggggtctgcccg

SEQ ID NO: 8350516 - DNA, 22 bp, Homo sapiens
tttattcacttcagtgccaaag

SEQ ID NO: 8350517 - DNA, 22 bp, Homo sapiens
tttattcacttcagtgccaaag

SEQ ID NO: 8350518 - DNA, 19 bp, Homo sapiens
tttattcacctttaccttg

SEQ ID NO: 8350519 - DNA, 22 bp, Homo sapiens
tttatgcagcgtttcaccaccc

SEQ ID NO: 8350520 - DNA, 22 bp, Homo sapiens
tttatgattattttaaagcagc

SEQ ID NO: 8350521 - DNA, 23 bp, Homo sapiens
tttcagaagtggtcctaggaagc

SEQ ID NO: 8350522 - DNA, 22 bp, Homo sapiens
ctccttcccctactcagcatcc

SEQ ID NO: 8350523 - DNA, 22 bp, Homo sapiens
tttcagaaggggagaaaggtca

SEQ ID NO: 8350524 - DNA, 22 bp, Homo sapiens
tttcagaagtcaactaggtaaa

SEQ ID NO: 8350525 - DNA, 22 bp, Homo sapiens
tttcagaaccaagagagacatc

SEQ ID NO: 8350526 - DNA, 22 bp, Homo sapiens
tttcagaaattatattagatgc

SEQ ID NO: 8350527 - DNA, 22 bp, Homo sapiens
tttcagaaattgttattattct

SEQ ID NO: 8350528 - DNA, 22 bp, Homo sapiens
tttattcatcatctgttcatat

SEQ ID NO: 8350529 - DNA, 22 bp, Homo sapiens
tttattcattgtttcgtcgcag

SEQ ID NO: 8350530 - DNA, 20 bp, Homo sapiens
tttattcagcctaccctctt

SEQ ID NO: 8350531 - DNA, 22 bp, Homo sapiens
tttattcagcagcagcagtggt

SEQ ID NO: 8350532 - DNA, 22 bp, Homo sapiens
tttccacactcactgcactcat

SEQ ID NO: 8350533 - DNA, 22 bp, Homo sapiens
tttccaatttttaagtggatga

SEQ ID NO: 8350534 - DNA, 22 bp, Homo sapiens
tttccacaatgtttttgcagga

SEQ ID NO: 8350535 - DNA, 22 bp, Homo sapiens
tttccaataaagtgtcattgtt

SEQ ID NO: 8350536 - DNA, 22 bp, Homo sapiens
ctctctgtcttggcatttggtc

SEQ ID NO: 8350537 - DNA, 22 bp, Homo sapiens
ctctctttctgaatgaggacta

SEQ ID NO: 8350538 - DNA, 22 bp, Homo sapiens
ctctgaaactcctgcaccttct

SEQ ID NO: 8350539 - DNA, 22 bp, Homo sapiens
ctctgaaagcaaaactagagaa

SEQ ID NO: 8350540 - DNA, 22 bp, Homo sapiens
tttctcaaggtgtcatgtattt

SEQ ID NO: 8350541 - DNA, 22 bp, Homo sapiens
ttgcagaaaacagttttcttgt

SEQ ID NO: 8350542 - DNA, 22 bp, Homo sapiens
ttgcagaacttaaagacagagt

SEQ ID NO: 8350543 - DNA, 22 bp, Homo sapiens
ttgcagtttatgttcctgcagt

SEQ ID NO: 8350544 - DNA, 22 bp, Homo sapiens
ttgcatagaatatcatattttc

SEQ ID NO: 8350545 - DNA, 22 bp, Homo sapiens
ttgcataaaagagtatatctta

SEQ ID NO: 8350546 - DNA, 22 bp, Homo sapiens
ctcaggaggtggtagaggccct

SEQ ID NO: 8350547 - DNA, 22 bp, Homo sapiens
ctcaggagacagtgtccacatg

SEQ ID NO: 8350548 - DNA, 22 bp, Homo sapiens
ttgcatatcctccaacacatgg

SEQ ID NO: 8350549 - DNA, 22 bp, Homo sapiens
ctcagggcagtatggctgagag

SEQ ID NO: 8350550 - DNA, 22 bp, Homo sapiens
ctcagggtctggtccttagatt

SEQ ID NO: 8350551 - DNA, 22 bp, Homo sapiens
ctcagggtaatgaaagacgaat

SEQ ID NO: 8350552 - DNA, 21 bp, Homo sapiens
ctcagggcttggtgtcctcat

SEQ ID NO: 8350553 - DNA, 22 bp, Homo sapiens
ctcagggctggaaagccaggaa

SEQ ID NO: 8350554 - DNA, 22 bp, Homo sapiens
ctccagcctcatctcctggctg

SEQ ID NO: 8350555 - DNA, 22 bp, Homo sapiens
ttggctgagagaggaaaagggc

SEQ ID NO: 8350556 - DNA, 22 bp, Homo sapiens
ttggctgaaggttaagtgctgg

SEQ ID NO: 8350557 - DNA, 22 bp, Homo sapiens
ctccagagggtcagactctgag

SEQ ID NO: 8350558 - DNA, 22 bp, Homo sapiens
ctccagaggcgacttgcatcac

SEQ ID NO: 8350559 - DNA, 22 bp, Homo sapiens
ctccagagggtcagactctgag

SEQ ID NO: 8350560 - DNA, 22 bp, Homo sapiens
ctccagaggtccccgcggcact

SEQ ID NO: 8350561 - DNA, 18 bp, Homo sapiens
ctccagagctgtgagaca

SEQ ID NO: 8350562 - DNA, 22 bp, Homo sapiens
ctccagaggatgcaggtgaggg

SEQ ID NO: 8350563 - DNA, 22 bp, Homo sapiens
ctccagagtcacactgcctggg

SEQ ID NO: 8350564 - DNA, 22 bp, Homo sapiens
ctccagagtcatcgagcattcc

SEQ ID NO: 8350565 - DNA, 22 bp, Homo sapiens
ctccagaggttctcatctggga

SEQ ID NO: 8350566 - DNA, 22 bp, Homo sapiens
ttggagttctgggcacagctgc

SEQ ID NO: 8350567 - DNA, 22 bp, Homo sapiens
ttggaagcaatgtaagtcgcat

SEQ ID NO: 8350568 - DNA, 22 bp, Homo sapiens
ttggaagccctctgcaagatcc

SEQ ID NO: 8350569 - DNA, 22 bp, Homo sapiens
ttggaagcctagttaagatgaa

SEQ ID NO: 8350570 - DNA, 22 bp, Homo sapiens
ctatagaaacaacctctctttc

SEQ ID NO: 8350571 - DNA, 22 bp, Homo sapiens
ctcacccatatctccatgactc

SEQ ID NO: 8350572 - DNA, 22 bp, Homo sapiens
ctcacccatatctccatgactc

SEQ ID NO: 8350573 - DNA, 22 bp, Homo sapiens
ctatacagtaaccacagtgatt

SEQ ID NO: 8350574 - DNA, 22 bp, Homo sapiens
ctatacagtaaccacagtgatt

SEQ ID NO: 8350575 - DNA, 22 bp, Homo sapiens
ctatacagcagcttactagtta

SEQ ID NO: 8350576 - DNA, 22 bp, Homo sapiens
ctatacagcagcttactagtta

SEQ ID NO: 8350577 - DNA, 22 bp, Homo sapiens
ctatacagcagcttactagtta

SEQ ID NO: 8350578 - DNA, 22 bp, Homo sapiens
ctatacagtgactagaagtaat

SEQ ID NO: 8350579 - DNA, 22 bp, Homo sapiens
ctatagaaaattgtatcacacg

SEQ ID NO: 8350580 - DNA, 22 bp, Homo sapiens
ctatagaaaattgtatcacacg

SEQ ID NO: 8350581 - DNA, 22 bp, Homo sapiens
ctcactcagacatccagtgcag

SEQ ID NO: 8350582 - DNA, 22 bp, Homo sapiens
ctcacctgcaatcccttccagg

SEQ ID NO: 8350583 - DNA, 22 bp, Homo sapiens
ctcactgcaacctctgcctccc

SEQ ID NO: 8350584 - DNA, 22 bp, Homo sapiens
ctcactgcaacctctgcctccc

SEQ ID NO: 8350585 - DNA, 22 bp, Homo sapiens
ctcactgcaacctccgtctccc

SEQ ID NO: 8350586 - DNA, 22 bp, Homo sapiens
ctcactcagtttttagttcatc

SEQ ID NO: 8350587 - DNA, 22 bp, Homo sapiens
ctcactcagacatccagtgcag

SEQ ID NO: 8350588 - DNA, 22 bp, Homo sapiens
ctcagagatatagtccctgctt

SEQ ID NO: 8350589 - DNA, 22 bp, Homo sapiens
ctcagagatatagtccctgctt

SEQ ID NO: 8350590 - DNA, 22 bp, Homo sapiens
ctcagagaggcagtggaagtca

SEQ ID NO: 8350591 - DNA, 22 bp, Homo sapiens
ctcagagagggcaccagggcca

SEQ ID NO: 8350592 - DNA, 22 bp, Homo sapiens
ctcactgcaagctccacctctt

SEQ ID NO: 8350593 - DNA, 22 bp, Homo sapiens
ctcactgcaagctcagcctccc

SEQ ID NO: 8350594 - DNA, 21 bp, Homo sapiens
ttctttctgaatctgaagtat

SEQ ID NO: 8350595 - DNA, 22 bp, Homo sapiens
ttctttctgaatacagttgagt

SEQ ID NO: 8350596 - DNA, 22 bp, Homo sapiens
ctcagagaagtctttgctaaac

SEQ ID NO: 8350597 - DNA, 22 bp, Homo sapiens
ttctttctgtccataatgagac

SEQ ID NO: 8350598 - DNA, 22 bp, Homo sapiens
ctagaaatattttacagtcaag

SEQ ID NO: 8350599 - DNA, 22 bp, Homo sapiens
ctagagaaaggcagtggagcaa

SEQ ID NO: 8350600 - DNA, 22 bp, Homo sapiens
ctagagaaaggcagtggagcaa

SEQ ID NO: 8350601 - DNA, 21 bp, Homo sapiens
ctagagtgggaccggagtcta

SEQ ID NO: 8350602 - DNA, 22 bp, Homo sapiens
ctagagtgaagggtcttgaggc

SEQ ID NO: 8350603 - DNA, 22 bp, Homo sapiens
ctagataaggtggcttggaatt

SEQ ID NO: 8350604 - DNA, 22 bp, Homo sapiens
ttctatgcctgagaagaagccg

SEQ ID NO: 8350605 - DNA, 22 bp, Homo sapiens
ttctatgcctgagaagaagccg

SEQ ID NO: 8350606 - DNA, 22 bp, Homo sapiens
ttctatgctagtggaaagcttc

SEQ ID NO: 8350607 - DNA, 22 bp, Homo sapiens
ctagatcagattgctgtttcta

SEQ ID NO: 8350608 - DNA, 22 bp, Homo sapiens
ctagagaggtggtgttgggtgg

SEQ ID NO: 8350609 - DNA, 22 bp, Homo sapiens
ctagagagccgctgtggaaaat

SEQ ID NO: 8350610 - DNA, 17 bp, Homo sapiens
ctagagagaaagagcta

SEQ ID NO: 8350611 - DNA, 18 bp, Homo sapiens
cgtttttccgggattgca

SEQ ID NO: 8350612 - DNA, 22 bp, Homo sapiens
cgtgtcatctgagccttgggcg

SEQ ID NO: 8350613 - DNA, 22 bp, Homo sapiens
cgtgtctgggatagcagaagta

SEQ ID NO: 8350614 - DNA, 22 bp, Homo sapiens
ttctggaagggtggagtagctt

SEQ ID NO: 8350615 - DNA, 17 bp, Homo sapiens
ttctgcatgtgaagatg

SEQ ID NO: 8350616 - DNA, 22 bp, Homo sapiens
ttctgaagctcccttttgtagt

SEQ ID NO: 8350617 - DNA, 22 bp, Homo sapiens
ttctatgtgaacgttatagttt

SEQ ID NO: 8350618 - DNA, 22 bp, Homo sapiens
ttctatgctcaatggagccttt

SEQ ID NO: 8350619 - DNA, 22 bp, Homo sapiens
ttctatgtgctggagaatattt

SEQ ID NO: 8350620 - DNA, 23 bp, Homo sapiens
cggggccagggtcaggaccggtc

SEQ ID NO: 8350621 - DNA, 22 bp, Homo sapiens
cggggcaggagtccctgtagag

SEQ ID NO: 8350622 - DNA, 22 bp, Homo sapiens
cggggccctggggctgaaggtc

SEQ ID NO: 8350623 - DNA, 22 bp, Homo sapiens
cggggccctggggctgaaggtc

SEQ ID NO: 8350624 - DNA, 22 bp, Homo sapiens
cggggcagaaagttgtcttttg

SEQ ID NO: 8350625 - DNA, 22 bp, Homo sapiens
cggggcagagggtcttctccag

SEQ ID NO: 8350626 - DNA, 22 bp, Homo sapiens
cggggcaccgacctcctgccgc

SEQ ID NO: 8350627 - DNA, 22 bp, Homo sapiens
cggggagggcagaggctccctc

SEQ ID NO: 8350628 - DNA, 22 bp, Homo sapiens
cggggaggcttcggattaaagc

SEQ ID NO: 8350629 - DNA, 22 bp, Homo sapiens
cggggagaacactgtgtccttc

SEQ ID NO: 8350630 - DNA, 22 bp, Homo sapiens
cggggaagcggttctggcggta

SEQ ID NO: 8350631 - DNA, 22 bp, Homo sapiens
cgggaggaaaggcgaggctctg

SEQ ID NO: 8350632 - DNA, 22 bp, Homo sapiens
cgtgagcaaaatggacactccc

SEQ ID NO: 8350633 - DNA, 22 bp, Homo sapiens
cggggctggcacaggtgaccac

SEQ ID NO: 8350634 - DNA, 22 bp, Homo sapiens
cggggctgctcgtcctcctgtg

SEQ ID NO: 8350635 - DNA, 22 bp, Homo sapiens
cgtgggagtggtgggtgctcag

SEQ ID NO: 8350636 - DNA, 22 bp, Homo sapiens
cgtgggagtggtgggtgctcag

SEQ ID NO: 8350637 - DNA, 22 bp, Homo sapiens
cgtgggaggaaaaatgggcttc

SEQ ID NO: 8350638 - DNA, 22 bp, Homo sapiens
cgtggggacccacgtgcagcac

SEQ ID NO: 8350639 - DNA, 22 bp, Homo sapiens
cggggcctaccgctgcgtggcc

SEQ ID NO: 8350640 - DNA, 22 bp, Homo sapiens
cggggcgagcagacggcggcaa

SEQ ID NO: 8350641 - DNA, 22 bp, Homo sapiens
cggggcgctgggatcccgcccg

SEQ ID NO: 8350642 - DNA, 22 bp, Homo sapiens
cggggctgaggcaacgcggaga

SEQ ID NO: 8350643 - DNA, 22 bp, Homo sapiens
cggggctgaggcaacgcggaga

SEQ ID NO: 8350644 - DNA, 22 bp, Homo sapiens
cggggctgctcgtcctcctgtg

SEQ ID NO: 8350645 - DNA, 22 bp, Homo sapiens
cggggctgacagcaggtgtgct

SEQ ID NO: 8350646 - DNA, 22 bp, Homo sapiens
cggggctgacagcaggtgtgct

SEQ ID NO: 8350647 - DNA, 22 bp, Homo sapiens
ttcaaatacattctttgccact

SEQ ID NO: 8350648 - DNA, 22 bp, Homo sapiens
cggagtggagaaggtcacagaa

SEQ ID NO: 8350649 - DNA, 22 bp, Homo sapiens
cggcagagccctgagtcagcct

SEQ ID NO: 8350650 - DNA, 22 bp, Homo sapiens
cggcagagcttcctgctcagcg

SEQ ID NO: 8350651 - DNA, 22 bp, Homo sapiens
cggcagagtgtgtgcgtgcatg

SEQ ID NO: 8350652 - DNA, 22 bp, Homo sapiens
ccttttctaggatgctttatag

SEQ ID NO: 8350653 - DNA, 22 bp, Homo sapiens
cgaaaatagatctgtttcccag

SEQ ID NO: 8350654 - DNA, 22 bp, Homo sapiens
cgagagtggacagggcgcagct

SEQ ID NO: 8350655 - DNA, 22 bp, Homo sapiens
ttattgcagatggtgtgagaga

SEQ ID NO: 8350656 - DNA, 17 bp, Homo sapiens
ttattgcagtgctgaag

SEQ ID NO: 8350657 - DNA, 22 bp, Homo sapiens
ttattgcaactttagggataga

SEQ ID NO: 8350658 - DNA, 22 bp, Homo sapiens
ttatttattgtgtacctactgt

SEQ ID NO: 8350659 - DNA, 22 bp, Homo sapiens
ttatttattcattctgtctgtc

SEQ ID NO: 8350660 - DNA, 22 bp, Homo sapiens
ttatttcatgtaaaatttatgt

SEQ ID NO: 8350661 - DNA, 22 bp, Homo sapiens
cgctgataaacgtcacgttccc

SEQ ID NO: 8350662 - DNA, 22 bp, Homo sapiens
cgctctggcaggcacaggaggg

SEQ ID NO: 8350663 - DNA, 20 bp, Homo sapiens
cgctcctgttcccggtccca

SEQ ID NO: 8350664 - DNA, 22 bp, Homo sapiens
cgctgccaggatcccctgccgg

SEQ ID NO: 8350665 - DNA, 22 bp, Homo sapiens
cgctgcagatgggagctggttg

SEQ ID NO: 8350666 - DNA, 23 bp, Homo sapiens
ttaagcactgttagtagaaaagg

SEQ ID NO: 8350667 - DNA, 22 bp, Homo sapiens
ttacaaagcgttgagacaagta

SEQ ID NO: 8350668 - DNA, 21 bp, Homo sapiens
ttacagaatccatgggaagtc

SEQ ID NO: 8350669 - DNA, 21 bp, Homo sapiens
ttacagaatccatgggaagtc

SEQ ID NO: 8350670 - DNA, 22 bp, Homo sapiens
ttacagttgcccccagcctcgc

SEQ ID NO: 8350671 - DNA, 22 bp, Homo sapiens
ttacagttgttctatcagcatg

SEQ ID NO: 8350672 - DNA, 22 bp, Homo sapiens
ttaaattccagcctcataatag

SEQ ID NO: 8350673 - DNA, 22 bp, Homo sapiens
ttaaatttctacgtgatccagg

SEQ ID NO: 8350674 - DNA, 22 bp, Homo sapiens
ttaagatgttcagataatttgg

SEQ ID NO: 8350675 - DNA, 22 bp, Homo sapiens
ttaagatgttcagataatttgg

SEQ ID NO: 8350676 - DNA, 23 bp, Homo sapiens
ttataaatattttcaggtgtgtt

SEQ ID NO: 8350677 - DNA, 22 bp, Homo sapiens
ttatattgggtctggtatcagg

SEQ ID NO: 8350678 - DNA, 22 bp, Homo sapiens
ttatcaagggagaaacaggagg

SEQ ID NO: 8350679 - DNA, 22 bp, Homo sapiens
ccttgcccgctgcctctgagtt

SEQ ID NO: 8350680 - DNA, 22 bp, Homo sapiens
ccttgccctgagcaggggtcag

SEQ ID NO: 8350681 - DNA, 22 bp, Homo sapiens
ttataaagattgttatgtatct

SEQ ID NO: 8350682 - DNA, 22 bp, Homo sapiens
ttataaaggtttgtgcatattt

SEQ ID NO: 8350683 - DNA, 22 bp, Homo sapiens
ccttgccccatctgggaatccc

SEQ ID NO: 8350684 - DNA, 22 bp, Homo sapiens
ttacataacggtatgaaaaatg

SEQ ID NO: 8350685 - DNA, 22 bp, Homo sapiens
ttacataaaagttcacgtaggc

SEQ ID NO: 8350686 - DNA, 22 bp, Homo sapiens
ttacatagttaaatagtacagc

SEQ ID NO: 8350687 - DNA, 22 bp, Homo sapiens
ttacatacctcatagactcagg

SEQ ID NO: 8350688 - DNA, 22 bp, Homo sapiens
ttagcactggattaatcaaagt

SEQ ID NO: 8350689 - DNA, 22 bp, Homo sapiens
ttagcaaagaagatgtgagttt

SEQ ID NO: 8350690 - DNA, 21 bp, Homo sapiens
ttagcaaagcaaacacatgct

SEQ ID NO: 8350691 - DNA, 22 bp, Homo sapiens
ttagcaaagtttgccatctagt

SEQ ID NO: 8350692 - DNA, 22 bp, Homo sapiens
ttagacatagaatattgtctag

SEQ ID NO: 8350693 - DNA, 22 bp, Homo sapiens
ctggttattttgtttggcagag

SEQ ID NO: 8350694 - DNA, 22 bp, Homo sapiens
ctggtggttcaggagaatggct

SEQ ID NO: 8350695 - DNA, 22 bp, Homo sapiens
ctggtgtcattttagcctcagg

SEQ ID NO: 8350696 - DNA, 22 bp, Homo sapiens
ctggtacatttgatgataatag

SEQ ID NO: 8350697 - DNA, 22 bp, Homo sapiens
ctggtaacaatatccacaaaga

SEQ ID NO: 8350698 - DNA, 22 bp, Homo sapiens
ctggtacaaaatgctgatatca

SEQ ID NO: 8350699 - DNA, 22 bp, Homo sapiens
ctgggtggctgtccagccagcc

SEQ ID NO: 8350700 - DNA, 22 bp, Homo sapiens
ctgggggtgagcagcagcgacg

SEQ ID NO: 8350701 - DNA, 22 bp, Homo sapiens
ctggggtctcaattctagcggg

SEQ ID NO: 8350702 - DNA, 22 bp, Homo sapiens
ctgggggtcgcgcctctgggca

SEQ ID NO: 8350703 - DNA, 22 bp, Homo sapiens
ctggggtggaggagctcccctg

SEQ ID NO: 8350704 - DNA, 22 bp, Homo sapiens
ctggggtgtctcgtctgccatt

SEQ ID NO: 8350705 - DNA, 22 bp, Homo sapiens
ctggggtggtgcaggcctcatg

SEQ ID NO: 8350706 - DNA, 22 bp, Homo sapiens
ctggggctgtaggaggacttat

SEQ ID NO: 8350707 - DNA, 22 bp, Homo sapiens
ctggggctggtgaggcaggctc

SEQ ID NO: 8350708 - DNA, 22 bp, Homo sapiens
ctgggggccttacggaactcca

SEQ ID NO: 8350709 - DNA, 22 bp, Homo sapiens
ctgggggccttacggaactcca

SEQ ID NO: 8350710 - DNA, 18 bp, Homo sapiens
ctgggctcgagagatcct

SEQ ID NO: 8350711 - DNA, 20 bp, Homo sapiens
ctgggctcggtggccctggc

SEQ ID NO: 8350712 - DNA, 22 bp, Homo sapiens
ctgggcctaacccacagcgttt

SEQ ID NO: 8350713 - DNA, 22 bp, Homo sapiens
ctgggcccaggcggctctcgga

SEQ ID NO: 8350714 - DNA, 23 bp, Homo sapiens
ctgggcctatggtctgaatccaa

SEQ ID NO: 8350715 - DNA, 22 bp, Homo sapiens
ctgggctcaaatcctggccctg

SEQ ID NO: 8350716 - DNA, 22 bp, Homo sapiens
ctgggcccacaagtggaatcgt

SEQ ID NO: 8350717 - DNA, 22 bp, Homo sapiens
ctgggcccacgagggctctggg

SEQ ID NO: 8350718 - DNA, 22 bp, Homo sapiens
ctgggcccacgagggctctggg

SEQ ID NO: 8350719 - DNA, 22 bp, Homo sapiens
ctgggccagatccagcctcaca

SEQ ID NO: 8350720 - DNA, 19 bp, Homo sapiens
ctgggatgtctcctcccag

SEQ ID NO: 8350721 - DNA, 22 bp, Homo sapiens
ctgggatgggaactgagaatca

SEQ ID NO: 8350722 - DNA, 22 bp, Homo sapiens
ctgggatggctttcctgcatta

SEQ ID NO: 8350723 - DNA, 22 bp, Homo sapiens
ctgggatggctttcctgcatta

SEQ ID NO: 8350724 - DNA, 22 bp, Homo sapiens
ctgggatggctccgctgctgct

SEQ ID NO: 8350725 - DNA, 22 bp, Homo sapiens
ctgggagtgtccctctggtaat

SEQ ID NO: 8350726 - DNA, 22 bp, Homo sapiens
ctgggatgctccggcctggatg

SEQ ID NO: 8350727 - DNA, 22 bp, Homo sapiens
ctgggatggctccgctgctgct

SEQ ID NO: 8350728 - DNA, 22 bp, Homo sapiens
ctgggatgctccggcctggatg

SEQ ID NO: 8350729 - DNA, 22 bp, Homo sapiens
ctggagctccagggtctcctct

SEQ ID NO: 8350730 - DNA, 22 bp, Homo sapiens
ctggagctcagcccaggttcca

SEQ ID NO: 8350731 - DNA, 22 bp, Homo sapiens
ctggagctaggaagtccaagat

SEQ ID NO: 8350732 - DNA, 22 bp, Homo sapiens
ctgtggacaaggatgttagcta

SEQ ID NO: 8350733 - DNA, 22 bp, Homo sapiens
ctgtgagggcagggaccagagg

SEQ ID NO: 8350734 - DNA, 22 bp, Homo sapiens
ctgtgagctgggtggccaggac

SEQ ID NO: 8350735 - DNA, 22 bp, Homo sapiens
ctgtgaggcctttggccagata

SEQ ID NO: 8350736 - DNA, 22 bp, Homo sapiens
ctgtgacccagttcctggcacc

SEQ ID NO: 8350737 - DNA, 22 bp, Homo sapiens
ctgtctgttcagattcattact

SEQ ID NO: 8350738 - DNA, 22 bp, Homo sapiens
ctgtccctcatcacctctgggt

SEQ ID NO: 8350739 - DNA, 22 bp, Homo sapiens
ctgtccctcatcacctctgggt

SEQ ID NO: 8350740 - DNA, 22 bp, Homo sapiens
ctggttttaatgttatgtttat

SEQ ID NO: 8350741 - DNA, 22 bp, Homo sapiens
ctggtttagtaggggactgaag

SEQ ID NO: 8350742 - DNA, 22 bp, Homo sapiens
ctggtttactctgcactgctca

SEQ ID NO: 8350743 - DNA, 22 bp, Homo sapiens
ctgtcccaggagctgtaagaca

SEQ ID NO: 8350744 - DNA, 19 bp, Homo sapiens
ctgtcccagactctgctct

SEQ ID NO: 8350745 - DNA, 22 bp, Homo sapiens
ctgtccatggcaatgatgcaga

SEQ ID NO: 8350746 - DNA, 22 bp, Homo sapiens
ctgtccattttcgtgcctcctt

SEQ ID NO: 8350747 - DNA, 20 bp, Homo sapiens
ctgtccccgaggtcaccagg

SEQ ID NO: 8350748 - DNA, 20 bp, Homo sapiens
ctgtccccgaggtcaccagg

SEQ ID NO: 8350749 - DNA, 22 bp, Homo sapiens
ctgtccccgcgagtccagagct

SEQ ID NO: 8350750 - DNA, 22 bp, Homo sapiens
ctgtccctcagttctgggcaaa

SEQ ID NO: 8350751 - DNA, 22 bp, Homo sapiens
ctgtcccatccttactctaccc

SEQ ID NO: 8350752 - DNA, 21 bp, Homo sapiens
ctgtccccagtgagcaccccc

SEQ ID NO: 8350753 - DNA, 21 bp, Homo sapiens
ctgtccccagtgagcaccccc

SEQ ID NO: 8350754 - DNA, 22 bp, Homo sapiens
ctgtggatttaggcagagctga

SEQ ID NO: 8350755 - DNA, 22 bp, Homo sapiens
ctgtggcagaggtgacacctct

SEQ ID NO: 8350756 - DNA, 22 bp, Homo sapiens
ctgtggcattgccgaggctggc

SEQ ID NO: 8350757 - DNA, 22 bp, Homo sapiens
ctgtggcattgtgaggactgca

SEQ ID NO: 8350758 - DNA, 22 bp, Homo sapiens
ctgtgggcgcctgtcagcctca

SEQ ID NO: 8350759 - DNA, 22 bp, Homo sapiens
ctgtgggcagctcctcctgtca

SEQ ID NO: 8350760 - DNA, 22 bp, Homo sapiens
ctgtgggcatttgagtgtgggt

SEQ ID NO: 8350761 - DNA, 22 bp, Homo sapiens
ctgtgggcatttgagtgtgggt

SEQ ID NO: 8350762 - DNA, 22 bp, Homo sapiens
ctgtgggcctagtctggcctag

SEQ ID NO: 8350763 - DNA, 23 bp, Homo sapiens
ctgtggccacccctagctggagg

SEQ ID NO: 8350764 - DNA, 17 bp, Homo sapiens
ctgtggccacctggatg

SEQ ID NO: 8350765 - DNA, 22 bp, Homo sapiens
ctgtgtgagtgactgcatctca

SEQ ID NO: 8350766 - DNA, 22 bp, Homo sapiens
ctgtggggccaaattctcctct

SEQ ID NO: 8350767 - DNA, 22 bp, Homo sapiens
ctgtggggaagatagaaccgac

SEQ ID NO: 8350768 - DNA, 22 bp, Homo sapiens
ctgtggggagctgatcagatca

SEQ ID NO: 8350769 - DNA, 22 bp, Homo sapiens
ctgtggggaaagggtcctgctc

SEQ ID NO: 8350770 - DNA, 22 bp, Homo sapiens
ctgtgggcgcctgtcagcctca

SEQ ID NO: 8350771 - DNA, 22 bp, Homo sapiens
ctgtgggctgaaagtgctcccg

SEQ ID NO: 8350772 - DNA, 22 bp, Homo sapiens
gaaaaatgagctgatgtcaggg

SEQ ID NO: 8350773 - DNA, 22 bp, Homo sapiens
cttttgtctaccctgattccag

SEQ ID NO: 8350774 - DNA, 22 bp, Homo sapiens
ctttggcacagtgtttactagc

SEQ ID NO: 8350775 - DNA, 22 bp, Homo sapiens
ctttggcacagtctcatttgat

SEQ ID NO: 8350776 - DNA, 23 bp, Homo sapiens
ctttggcactttacaataaactc

SEQ ID NO: 8350777 - DNA, 22 bp, Homo sapiens
ctttttctaatcataattgtct

SEQ ID NO: 8350778 - DNA, 22 bp, Homo sapiens
ctttggcaatgaaacacaagaa

SEQ ID NO: 8350779 - DNA, 22 bp, Homo sapiens
ctttggcaagggttttaattgt

SEQ ID NO: 8350780 - DNA, 21 bp, Homo sapiens
ctttggcaagggagaagtcac

SEQ ID NO: 8350781 - DNA, 22 bp, Homo sapiens
ctttggcaacacatgtgggaca

SEQ ID NO: 8350782 - DNA, 22 bp, Homo sapiens
ctttggaatcattgcttattca

SEQ ID NO: 8350783 - DNA, 22 bp, Homo sapiens
ctttggaataatcaagctctga

SEQ ID NO: 8350784 - DNA, 22 bp, Homo sapiens
ctttggaaggaagacctttcag

SEQ ID NO: 8350785 - DNA, 22 bp, Homo sapiens
gaaatatacattgcaggaagag

SEQ ID NO: 8350786 - DNA, 22 bp, Homo sapiens
gaaatatacattgcaggaagag

SEQ ID NO: 8350787 - DNA, 22 bp, Homo sapiens
gaaatattacagtggaggggat

SEQ ID NO: 8350788 - DNA, 22 bp, Homo sapiens
gaaatattcttgtcttgttttc

SEQ ID NO: 8350789 - DNA, 22 bp, Homo sapiens
gaaatattgggactcagagctt

SEQ ID NO: 8350790 - DNA, 22 bp, Homo sapiens
gaaagactaactagaaagtgca

SEQ ID NO: 8350791 - DNA, 22 bp, Homo sapiens
gaaagacatagttgcaagatgg

SEQ ID NO: 8350792 - DNA, 22 bp, Homo sapiens
gaaatattgtactggagatgtt

SEQ ID NO: 8350793 - DNA, 22 bp, Homo sapiens
gaaatgtagaattgcttaactg

SEQ ID NO: 8350794 - DNA, 22 bp, Homo sapiens
gaaatgtagagtatctgaggat

SEQ ID NO: 8350795 - DNA, 22 bp, Homo sapiens
gaaatattcttgtcttgttttc

SEQ ID NO: 8350796 - DNA, 22 bp, Homo sapiens
gaaatattgggactcagagctt

SEQ ID NO: 8350797 - DNA, 22 bp, Homo sapiens
gaaatgtcattgccttcagccc

SEQ ID NO: 8350798 - DNA, 22 bp, Homo sapiens
gaaatgtatttgacagtccttg

SEQ ID NO: 8350799 - DNA, 22 bp, Homo sapiens
gaaatgtatgtcttcccccatt

SEQ ID NO: 8350800 - DNA, 22 bp, Homo sapiens
gaaatgtatttgacagtccttg

SEQ ID NO: 8350801 - DNA, 22 bp, Homo sapiens
gaaatgtaggcataattatttt

SEQ ID NO: 8350802 - DNA, 22 bp, Homo sapiens
gaaatgtataagctggtctttt

SEQ ID NO: 8350803 - DNA, 20 bp, Homo sapiens
gaaatgtatctcttgattct

SEQ ID NO: 8350804 - DNA, 20 bp, Homo sapiens
gaaatgtatctcttgattct

SEQ ID NO: 8350805 - DNA, 22 bp, Homo sapiens
gaaattgtcagtgatatgatac

SEQ ID NO: 8350806 - DNA, 22 bp, Homo sapiens
gaagaagacatggaacaatagt

SEQ ID NO: 8350807 - DNA, 22 bp, Homo sapiens
gaaatgttatgagatatgtact

SEQ ID NO: 8350808 - DNA, 22 bp, Homo sapiens
gaaatgttgtcctgtctcttga

SEQ ID NO: 8350809 - DNA, 22 bp, Homo sapiens
gaaatgttggacacttgaaatt

SEQ ID NO: 8350810 - DNA, 22 bp, Homo sapiens
gaaatgttgtctctgcagcaat

SEQ ID NO: 8350811 - DNA, 22 bp, Homo sapiens
gaaattaagcaggggtctgtgg

SEQ ID NO: 8350812 - DNA, 22 bp, Homo sapiens
cttcccagacggggtggcagcc

SEQ ID NO: 8350813 - DNA, 22 bp, Homo sapiens
cttccccaaccccgactgtgtg

SEQ ID NO: 8350814 - DNA, 22 bp, Homo sapiens
cttccctgataagagcctcaga

SEQ ID NO: 8350815 - DNA, 22 bp, Homo sapiens
cttccctcctggattccagact

SEQ ID NO: 8350816 - DNA, 21 bp, Homo sapiens
cttccccaggctggtctgtat

SEQ ID NO: 8350817 - DNA, 20 bp, Homo sapiens
cttcttcagcctatgcttca

SEQ ID NO: 8350818 - DNA, 22 bp, Homo sapiens
cttcttcagcacaatattgatg

SEQ ID NO: 8350819 - DNA, 22 bp, Homo sapiens
cttcttcatgtattgatagtct

SEQ ID NO: 8350820 - DNA, 22 bp, Homo sapiens
cttcttcagttgcatgtattgg

SEQ ID NO: 8350821 - DNA, 22 bp, Homo sapiens
cttctgtgaagagcagaaccat

SEQ ID NO: 8350822 - DNA, 22 bp, Homo sapiens
cttctgtgaatgaagtgtggga

SEQ ID NO: 8350823 - DNA, 22 bp, Homo sapiens
cttcaaatccccctgagtttga

SEQ ID NO: 8350824 - DNA, 22 bp, Homo sapiens
ctgttaaagatagttaagcttc

SEQ ID NO: 8350825 - DNA, 22 bp, Homo sapiens
cttcacattgggcttgatatga

SEQ ID NO: 8350826 - DNA, 22 bp, Homo sapiens
cttcacattagtttggatcaaa

SEQ ID NO: 8350827 - DNA, 22 bp, Homo sapiens
cttcagaaataacaacaattac

SEQ ID NO: 8350828 - DNA, 20 bp, Homo sapiens
ctttctctaatttataagta

SEQ ID NO: 8350829 - DNA, 22 bp, Homo sapiens
cttggagctcccgcactgatta

SEQ ID NO: 8350830 - DNA, 22 bp, Homo sapiens
cttggagtagagatttagtgaa

SEQ ID NO: 8350831 - DNA, 22 bp, Homo sapiens
cttggagtgaatgggggcaggt

SEQ ID NO: 8350832 - DNA, 22 bp, Homo sapiens
ctttccaatgtcactatgaatc

SEQ ID NO: 8350833 - DNA, 22 bp, Homo sapiens
ctttcctctggcactgtctggt

SEQ ID NO: 8350834 - DNA, 22 bp, Homo sapiens
cttgctttgtccagaaattcag

SEQ ID NO: 8350835 - DNA, 22 bp, Homo sapiens
cttggaaagaatatatgatgct

SEQ ID NO: 8350836 - DNA, 22 bp, Homo sapiens
cttcttctctacatcctttgat

SEQ ID NO: 8350837 - DNA, 22 bp, Homo sapiens
cttgcctgctggagcagggctc

SEQ ID NO: 8350838 - DNA, 22 bp, Homo sapiens
cttgcctgaggaacagagggta

SEQ ID NO: 8350839 - DNA, 22 bp, Homo sapiens
gagaagcaatcgtgacatctcc

SEQ ID NO: 8350840 - DNA, 22 bp, Homo sapiens
gactcagtgatttgacatgcct

SEQ ID NO: 8350841 - DNA, 22 bp, Homo sapiens
gactccagaatctggacggtcc

SEQ ID NO: 8350842 - DNA, 22 bp, Homo sapiens
gactatttttatctaactgggt

SEQ ID NO: 8350843 - DNA, 21 bp, Homo sapiens
gagaactgaaccagagcagct

SEQ ID NO: 8350844 - DNA, 22 bp, Homo sapiens
gagaagaaatagaatcacattt

SEQ ID NO: 8350845 - DNA, 22 bp, Homo sapiens
gagagacagcacacagtgtggg

SEQ ID NO: 8350846 - DNA, 22 bp, Homo sapiens
gagagcatactataatggaggt

SEQ ID NO: 8350847 - DNA, 22 bp, Homo sapiens
gagagcatgtggtctagtttta

SEQ ID NO: 8350848 - DNA, 22 bp, Homo sapiens
gagagccctacaaggcgttttg

SEQ ID NO: 8350849 - DNA, 22 bp, Homo sapiens
gagaggagaagcctgcgcttca

SEQ ID NO: 8350850 - DNA, 22 bp, Homo sapiens
gagaggagacttatccagattg

SEQ ID NO: 8350851 - DNA, 22 bp, Homo sapiens
gagagctgtcagcgtagcaccg

SEQ ID NO: 8350852 - DNA, 22 bp, Homo sapiens
gagaggagtaggctgatggtgc

SEQ ID NO: 8350853 - DNA, 22 bp, Homo sapiens
gagaggagtaggctgatggtgc

SEQ ID NO: 8350854 - DNA, 22 bp, Homo sapiens
gagaggagtagacactttggtt

SEQ ID NO: 8350855 - DNA, 22 bp, Homo sapiens
gagaggaggtggctatgacagc

SEQ ID NO: 8350856 - DNA, 18 bp, Homo sapiens
gagaggagccagaatttt

SEQ ID NO: 8350857 - DNA, 22 bp, Homo sapiens
gagatttcttttgatgcctgtc

SEQ ID NO: 8350858 - DNA, 20 bp, Homo sapiens
gagatttccaatcatgccca

SEQ ID NO: 8350859 - DNA, 22 bp, Homo sapiens
gagaggatccacaaaccaggaa

SEQ ID NO: 8350860 - DNA, 22 bp, Homo sapiens
gagaggagttactatttccgag

SEQ ID NO: 8350861 - DNA, 22 bp, Homo sapiens
gagaggagtccctatcacagtt

SEQ ID NO: 8350862 - DNA, 22 bp, Homo sapiens
gagcaacagggcgaggagaact

SEQ ID NO: 8350863 - DNA, 22 bp, Homo sapiens
gagcaagactcactgcatcttg

SEQ ID NO: 8350864 - DNA, 22 bp, Homo sapiens
gagcacagatcctggagccaca

SEQ ID NO: 8350865 - DNA, 23 bp, Homo sapiens
gagcagagcgggcgggggtcctg

SEQ ID NO: 8350866 - DNA, 22 bp, Homo sapiens
gagcacgttgaagcgcactgtc

SEQ ID NO: 8350867 - DNA, 22 bp, Homo sapiens
gagcaccaaggctctgccatgg

SEQ ID NO: 8350868 - DNA, 22 bp, Homo sapiens
gagcaccctacctgccactgag

SEQ ID NO: 8350869 - DNA, 22 bp, Homo sapiens
gagcacagtaaagcagtgtcac

SEQ ID NO: 8350870 - DNA, 22 bp, Homo sapiens
gacagtgcatttcctggcatgg

SEQ ID NO: 8350871 - DNA, 22 bp, Homo sapiens
gacagtctggcctaaagggtta

SEQ ID NO: 8350872 - DNA, 22 bp, Homo sapiens
gacagtctgggcacacatgaaa

SEQ ID NO: 8350873 - DNA, 20 bp, Homo sapiens
gacatcatgtacacattgcc

SEQ ID NO: 8350874 - DNA, 22 bp, Homo sapiens
gacatcatagggtgggaggaaa

SEQ ID NO: 8350875 - DNA, 22 bp, Homo sapiens
gacatagacaaagtcattgtca

SEQ ID NO: 8350876 - DNA, 22 bp, Homo sapiens
gacatagactgagtttagctga

SEQ ID NO: 8350877 - DNA, 22 bp, Homo sapiens
gacatatactatggatggttct

SEQ ID NO: 8350878 - DNA, 22 bp, Homo sapiens
gacagcatggtgtctgttcagg

SEQ ID NO: 8350879 - DNA, 22 bp, Homo sapiens
gacagccaactggggagggcat

SEQ ID NO: 8350880 - DNA, 22 bp, Homo sapiens
gacagcctcatgaggagcaaaa

SEQ ID NO: 8350881 - DNA, 22 bp, Homo sapiens
gacagcctggcttaatctgtct

SEQ ID NO: 8350882 - DNA, 22 bp, Homo sapiens
gacagccatgcacttctgctgt

SEQ ID NO: 8350883 - DNA, 22 bp, Homo sapiens
gactagaatagggggtaggaag

SEQ ID NO: 8350884 - DNA, 22 bp, Homo sapiens
gactatttccctcatcatcttc

SEQ ID NO: 8350885 - DNA, 22 bp, Homo sapiens
gactattttataaactagtgaa

SEQ ID NO: 8350886 - DNA, 22 bp, Homo sapiens
gactatttccctcatcatcttc

SEQ ID NO: 8350887 - DNA, 22 bp, Homo sapiens
gactatttccctcatcatcttc

SEQ ID NO: 8350888 - DNA, 22 bp, Homo sapiens
gactatttagtttcagattagt

SEQ ID NO: 8350889 - DNA, 22 bp, Homo sapiens
gactagaagggcaagagtccct

SEQ ID NO: 8350890 - DNA, 22 bp, Homo sapiens
gacctggtccttgtactttgaa

SEQ ID NO: 8350891 - DNA, 22 bp, Homo sapiens
gacatgcaacaatttggcattt

SEQ ID NO: 8350892 - DNA, 22 bp, Homo sapiens
gacctggaatgaagggtccctc

SEQ ID NO: 8350893 - DNA, 22 bp, Homo sapiens
gacattaaatgtcttagttgcc

SEQ ID NO: 8350894 - DNA, 22 bp, Homo sapiens
gacatgtgagagctcggttttc

SEQ ID NO: 8350895 - DNA, 22 bp, Homo sapiens
gacattaatggcaaattaatta

SEQ ID NO: 8350896 - DNA, 22 bp, Homo sapiens
gacattaatttctttggtaatt

SEQ ID NO: 8350897 - DNA, 22 bp, Homo sapiens
gacattaatggcaaattaatta

SEQ ID NO: 8350898 - DNA, 22 bp, Homo sapiens
gaatttttctggaagcaattat

SEQ ID NO: 8350899 - DNA, 22 bp, Homo sapiens
gaatttatctacgttaagtatg

SEQ ID NO: 8350900 - DNA, 22 bp, Homo sapiens
gacaaagagaagtaacagtacc

SEQ ID NO: 8350901 - DNA, 22 bp, Homo sapiens
gacaaactgaagtatatttaga

SEQ ID NO: 8350902 - DNA, 22 bp, Homo sapiens
gacaaactgaagtatatttaga

SEQ ID NO: 8350903 - DNA, 22 bp, Homo sapiens
gacaaaagtgttttgaacaagg

SEQ ID NO: 8350904 - DNA, 22 bp, Homo sapiens
gacagcagccacagggagaggg

SEQ ID NO: 8350905 - DNA, 22 bp, Homo sapiens
gacagcagggacatgtaggaag

SEQ ID NO: 8350906 - DNA, 22 bp, Homo sapiens
gacagcaggatgtgaggggatg

SEQ ID NO: 8350907 - DNA, 22 bp, Homo sapiens
gacaaatgaagtcactgacctt

SEQ ID NO: 8350908 - DNA, 22 bp, Homo sapiens
gacaaatgtacccctagagtct

SEQ ID NO: 8350909 - DNA, 22 bp, Homo sapiens
gacaaatgaatgatgaacacca

SEQ ID NO: 8350910 - DNA, 22 bp, Homo sapiens
gacaaatgagtctcatacccgg

SEQ ID NO: 8350911 - DNA, 18 bp, Homo sapiens
gacaaatgcaatttaaag

SEQ ID NO: 8350912 - DNA, 22 bp, Homo sapiens
gacaaatgagacatcaattccc

SEQ ID NO: 8350913 - DNA, 22 bp, Homo sapiens
gaatgcacacgtgtgtgcatgc

SEQ ID NO: 8350914 - DNA, 22 bp, Homo sapiens
gaatgtttttaggaatgttatg

SEQ ID NO: 8350915 - DNA, 22 bp, Homo sapiens
gaattacaaagtgagacaagct

SEQ ID NO: 8350916 - DNA, 22 bp, Homo sapiens
gaatttaaggaccaagcatttt

SEQ ID NO: 8350917 - DNA, 22 bp, Homo sapiens
gagctcagtgtagtcatggctt

SEQ ID NO: 8350918 - DNA, 22 bp, Homo sapiens
gagctcatccccatggtccgtc

SEQ ID NO: 8350919 - DNA, 23 bp, Homo sapiens
gagctcaggtagggctcgcccgc

SEQ ID NO: 8350920 - DNA, 22 bp, Homo sapiens
gagctccagcatctctgccaaa

SEQ ID NO: 8350921 - DNA, 22 bp, Homo sapiens
gagctcagcccaaagagcagtg

SEQ ID NO: 8350922 - DNA, 22 bp, Homo sapiens
gagctcagcccaaagagcagtg

SEQ ID NO: 8350923 - DNA, 22 bp, Homo sapiens
gagctcagcaaaggtctgtgtg

SEQ ID NO: 8350924 - DNA, 22 bp, Homo sapiens
gagcaggcattctagtggctga

SEQ ID NO: 8350925 - DNA, 22 bp, Homo sapiens
gagcaggcaactctgcagtgcc

SEQ ID NO: 8350926 - DNA, 22 bp, Homo sapiens
gagctcagaggattctggggag

SEQ ID NO: 8350927 - DNA, 22 bp, Homo sapiens
gagcaggcctggggtgaggcct

SEQ ID NO: 8350928 - DNA, 22 bp, Homo sapiens
gagctggttctgtccagggaat

SEQ ID NO: 8350929 - DNA, 22 bp, Homo sapiens
gagctggttttaggctatgtct

SEQ ID NO: 8350930 - DNA, 22 bp, Homo sapiens
gaggacaggagactcactgttt

SEQ ID NO: 8350931 - DNA, 22 bp, Homo sapiens
gagctgtgccaatctgtctggg

SEQ ID NO: 8350932 - DNA, 20 bp, Homo sapiens
gagctgtgctctcaggagcc

SEQ ID NO: 8350933 - DNA, 22 bp, Homo sapiens
gagctggtgatcagctggagga

SEQ ID NO: 8350934 - DNA, 22 bp, Homo sapiens
gagctggtcagtttcaggagag

SEQ ID NO: 8350935 - DNA, 22 bp, Homo sapiens
gagctgggtgtttatttgccaa

SEQ ID NO: 8350936 - DNA, 22 bp, Homo sapiens
gagctgggcctcagaacacagt

SEQ ID NO: 8350937 - DNA, 22 bp, Homo sapiens
gagctgggattcatctatgtct

SEQ ID NO: 8350938 - DNA, 22 bp, Homo sapiens
gaggagtgccagccgtggagtc

SEQ ID NO: 8350939 - DNA, 22 bp, Homo sapiens
gaggaggttccgggtggagaag

SEQ ID NO: 8350940 - DNA, 20 bp, Homo sapiens
gaggatgcagacagagggca

SEQ ID NO: 8350941 - DNA, 18 bp, Homo sapiens
gaggatggaaggagatgc

SEQ ID NO: 8350942 - DNA, 22 bp, Homo sapiens
gaggaccacagatgagcctgca

SEQ ID NO: 8350943 - DNA, 22 bp, Homo sapiens
gaggaccactgcttagtaagat

SEQ ID NO: 8350944 - DNA, 22 bp, Homo sapiens
gaggaccagcattttcagagtg

SEQ ID NO: 8350945 - DNA, 22 bp, Homo sapiens
gaggacgggcttcatggggcct

SEQ ID NO: 8350946 - DNA, 22 bp, Homo sapiens
gaggacctttagtagaagtgca

SEQ ID NO: 8350947 - DNA, 22 bp, Homo sapiens
gaggacgggcttcatggggcct

SEQ ID NO: 8350948 - DNA, 22 bp, Homo sapiens
gaggcatgcagagctggagcag

SEQ ID NO: 8350949 - DNA, 22 bp, Homo sapiens
gaggccagaatgagtctctggg

SEQ ID NO: 8350950 - DNA, 22 bp, Homo sapiens
gaggccagaatgagtctctggg

SEQ ID NO: 8350951 - DNA, 22 bp, Homo sapiens
gaggcctggagccgcctaggcg

SEQ ID NO: 8350952 - DNA, 22 bp, Homo sapiens
gaggccagaagtctgagatcag

SEQ ID NO: 8350953 - DNA, 22 bp, Homo sapiens
gaggccagaagtgcctcgggct

SEQ ID NO: 8350954 - DNA, 22 bp, Homo sapiens
gagggtggagctccagaatctg

SEQ ID NO: 8350955 - DNA, 22 bp, Homo sapiens
gagggtggagctccagaatctg

SEQ ID NO: 8350956 - DNA, 22 bp, Homo sapiens
gagggtggaagagctgctgaga

SEQ ID NO: 8350957 - DNA, 22 bp, Homo sapiens
gagggtggcctttagagcccat

SEQ ID NO: 8350958 - DNA, 22 bp, Homo sapiens
gagggtggcctttagagcccat

SEQ ID NO: 8350959 - DNA, 22 bp, Homo sapiens
gagggtggctcctccctgggcc

SEQ ID NO: 8350960 - DNA, 22 bp, Homo sapiens
gagggtggctcctccctgggcc

SEQ ID NO: 8350961 - DNA, 22 bp, Homo sapiens
gagggtgcagctgggccccacg

SEQ ID NO: 8350962 - DNA, 22 bp, Homo sapiens
gagggtggaaagggtgtacctg

SEQ ID NO: 8350963 - DNA, 22 bp, Homo sapiens
gagggtggaaagggtgtacctg

SEQ ID NO: 8350964 - DNA, 22 bp, Homo sapiens
gagggtcttacctaagcagggt

SEQ ID NO: 8350965 - DNA, 22 bp, Homo sapiens
gagggtctcttaatgccagggg

SEQ ID NO: 8350966 - DNA, 22 bp, Homo sapiens
gagggtctcttaatgccagggg

SEQ ID NO: 8350967 - DNA, 22 bp, Homo sapiens
gagggtggggaatagactgcta

SEQ ID NO: 8350968 - DNA, 22 bp, Homo sapiens
gagggtgggtacaccagccctc

SEQ ID NO: 8350969 - DNA, 22 bp, Homo sapiens
gagggtgggtacaccagccctc

SEQ ID NO: 8350970 - DNA, 22 bp, Homo sapiens
gagggtggggaatagactgcta

SEQ ID NO: 8350971 - DNA, 22 bp, Homo sapiens
gagggtgggctttgttcctcca

SEQ ID NO: 8350972 - DNA, 22 bp, Homo sapiens
gagggtgggctcctatctgggt

SEQ ID NO: 8350973 - DNA, 20 bp, Homo sapiens
gagggtgggacttcctaggc

SEQ ID NO: 8350974 - DNA, 20 bp, Homo sapiens
gagggtgggacttcctaggc

SEQ ID NO: 8350975 - DNA, 20 bp, Homo sapiens
gagggtgggacttcctaggc

SEQ ID NO: 8350976 - DNA, 22 bp, Homo sapiens
gagggtgggctcctatctgggt

SEQ ID NO: 8350977 - DNA, 22 bp, Homo sapiens
gagggtgggccagatatgaggg

SEQ ID NO: 8350978 - DNA, 18 bp, Homo sapiens
gaggtcctgctctagccc

SEQ ID NO: 8350979 - DNA, 22 bp, Homo sapiens
gaggtcctctgtgtccgcgggc

SEQ ID NO: 8350980 - DNA, 22 bp, Homo sapiens
gagggtgggtttcttgcacgtc

SEQ ID NO: 8350981 - DNA, 22 bp, Homo sapiens
gaggtctgggatggggcctgaa

SEQ ID NO: 8350982 - DNA, 22 bp, Homo sapiens
gaggtctgggcttgggcctggt

SEQ ID NO: 8350983 - DNA, 18 bp, Homo sapiens
gaggtggctgggccatct

SEQ ID NO: 8350984 - DNA, 22 bp, Homo sapiens
gaggtggctgggagtagggaat

SEQ ID NO: 8350985 - DNA, 22 bp, Homo sapiens
gaggtggctgggagtagggaat

SEQ ID NO: 8350986 - DNA, 22 bp, Homo sapiens
gaggtggctggctcagagccag

SEQ ID NO: 8350987 - DNA, 22 bp, Homo sapiens
gaggtggctgcttgctgggaaa

SEQ ID NO: 8350988 - DNA, 22 bp, Homo sapiens
gaggtggctgcttgctgggaaa

SEQ ID NO: 8350989 - DNA, 22 bp, Homo sapiens
gaggtggatgttgcagtgagct

SEQ ID NO: 8350990 - DNA, 22 bp, Homo sapiens
gagtaagagctggctttggtgt

SEQ ID NO: 8350991 - DNA, 22 bp, Homo sapiens
gagtacatagagccaggcgtgt

SEQ ID NO: 8350992 - DNA, 22 bp, Homo sapiens
gagtacatcttaatttgactaa

SEQ ID NO: 8350993 - DNA, 23 bp, Homo sapiens
gaggtgtgaattctgggtgctgc

SEQ ID NO: 8350994 - DNA, 22 bp, Homo sapiens
gaggtttcttatcaagaaagct

SEQ ID NO: 8350995 - DNA, 22 bp, Homo sapiens
gaggcggccagcgaggccgcaa

SEQ ID NO: 8350996 - DNA, 22 bp, Homo sapiens
gaggcggcggccgagcctggct

SEQ ID NO: 8350997 - DNA, 22 bp, Homo sapiens
gaggcgggcagatcacctgagg

SEQ ID NO: 8350998 - DNA, 22 bp, Homo sapiens
gaggcgggcagatcacctgagg

SEQ ID NO: 8350999 - DNA, 22 bp, Homo sapiens
gaggcggccagcgaggccgcaa

SEQ ID NO: 8351000 - DNA, 22 bp, Homo sapiens
gaggcgcagcccggaggagaca

SEQ ID NO: 8351001 - DNA, 22 bp, Homo sapiens
gaggcggaggttgcagtgagcc

SEQ ID NO: 8351002 - DNA, 22 bp, Homo sapiens
gaggcggaggttgcagtgagct

SEQ ID NO: 8351003 - DNA, 22 bp, Homo sapiens
gaggctggggtctgcctttctg

SEQ ID NO: 8351004 - DNA, 22 bp, Homo sapiens
gaggctggtggttagttccatt

SEQ ID NO: 8351005 - DNA, 22 bp, Homo sapiens
gaggctggtcagccctaagatc

SEQ ID NO: 8351006 - DNA, 22 bp, Homo sapiens
gaggctggtaggaaaggaaaca

SEQ ID NO: 8351007 - DNA, 22 bp, Homo sapiens
gaggctggtaggaaaggaaaca

SEQ ID NO: 8351008 - DNA, 22 bp, Homo sapiens
gaggctggttctgaagtactgt

SEQ ID NO: 8351009 - DNA, 22 bp, Homo sapiens
gaggctggttctgaagtactgt

SEQ ID NO: 8351010 - DNA, 22 bp, Homo sapiens
gaggctggttcccttgatcttt

SEQ ID NO: 8351011 - DNA, 22 bp, Homo sapiens
gaggctggtggttagttccatt

SEQ ID NO: 8351012 - DNA, 19 bp, Homo sapiens
gaggcgaggcgtgcaggag

SEQ ID NO: 8351013 - DNA, 22 bp, Homo sapiens
gaggcctggtgctgtgtccaca

SEQ ID NO: 8351014 - DNA, 22 bp, Homo sapiens
gaggcctgggttggaggtgcat

SEQ ID NO: 8351015 - DNA, 22 bp, Homo sapiens
gaggcctggtctatgagatgtt

SEQ ID NO: 8351016 - DNA, 22 bp, Homo sapiens
gaggcctggtttgcatgagaat

SEQ ID NO: 8351017 - DNA, 22 bp, Homo sapiens
gaggctgtaacttgggcactgg

SEQ ID NO: 8351018 - DNA, 22 bp, Homo sapiens
gaggctgtaagtgtggagccta

SEQ ID NO: 8351019 - DNA, 22 bp, Homo sapiens
gaggctggtttgccttttggca

SEQ ID NO: 8351020 - DNA, 22 bp, Homo sapiens
gagggccacgttcagggctctc

SEQ ID NO: 8351021 - DNA, 22 bp, Homo sapiens
gagggagaattgcagccagcgt

SEQ ID NO: 8351022 - DNA, 22 bp, Homo sapiens
gagggccagcctgccaagggcc

SEQ ID NO: 8351023 - DNA, 22 bp, Homo sapiens
gagggccaggcggagacaggcg

SEQ ID NO: 8351024 - DNA, 22 bp, Homo sapiens
gagggccctggctggctccagc

SEQ ID NO: 8351025 - DNA, 22 bp, Homo sapiens
gagggccctggctggctccagc

SEQ ID NO: 8351026 - DNA, 22 bp, Homo sapiens
gagggcccgcacctcgaaactc

SEQ ID NO: 8351027 - DNA, 22 bp, Homo sapiens
gagggccctggcttcttgctgg

SEQ ID NO: 8351028 - DNA, 22 bp, Homo sapiens
gagggccctggctggctccagc

SEQ ID NO: 8351029 - DNA, 22 bp, Homo sapiens
tcccagggactctctgccttcc

SEQ ID NO: 8351030 - DNA, 22 bp, Homo sapiens
tcccagggactggatgatgcag

SEQ ID NO: 8351031 - DNA, 22 bp, Homo sapiens
tccctccaggcagctgggtact

SEQ ID NO: 8351032 - DNA, 22 bp, Homo sapiens
tccctccccacttctgagcttt

SEQ ID NO: 8351033 - DNA, 22 bp, Homo sapiens
tccctgagaaagcccaggaggt

SEQ ID NO: 8351034 - DNA, 22 bp, Homo sapiens
tccctgagactctggagtgtaa

SEQ ID NO: 8351035 - DNA, 22 bp, Homo sapiens
tccctgccctgccttcatggtt

SEQ ID NO: 8351036 - DNA, 22 bp, Homo sapiens
tccctgcctcctggcagtgcca

SEQ ID NO: 8351037 - DNA, 22 bp, Homo sapiens
tccctgccctgccttcatggtt

SEQ ID NO: 8351038 - DNA, 18 bp, Homo sapiens
tccctccctgctgtggcc

SEQ ID NO: 8351039 - DNA, 18 bp, Homo sapiens
tccctccctgctgtggcc

SEQ ID NO: 8351040 - DNA, 20 bp, Homo sapiens
tccctccctccagctctggg

SEQ ID NO: 8351041 - DNA, 22 bp, Homo sapiens
tccctctgctagtgcttgagct

SEQ ID NO: 8351042 - DNA, 22 bp, Homo sapiens
tcctagaatatttgtggaggtt

SEQ ID NO: 8351043 - DNA, 22 bp, Homo sapiens
tccgtatttgactattgcaccg

SEQ ID NO: 8351044 - DNA, 22 bp, Homo sapiens
tccggtgctgaaggcccaggtg

SEQ ID NO: 8351045 - DNA, 16 bp, Homo sapiens
tccctgggagtggtgg

SEQ ID NO: 8351046 - DNA, 18 bp, Homo sapiens
tccctgggatataattac

SEQ ID NO: 8351047 - DNA, 22 bp, Homo sapiens
tccctgggactcagacatggaa

SEQ ID NO: 8351048 - DNA, 15 bp, Homo sapiens
tccctgggagatggt

SEQ ID NO: 8351049 - DNA, 22 bp, Homo sapiens
tccctgggagatgatgatgagg

SEQ ID NO: 8351050 - DNA, 22 bp, Homo sapiens
tccctgggactcagacatggaa

SEQ ID NO: 8351051 - DNA, 22 bp, Homo sapiens
tccctgggacggccttttggag

SEQ ID NO: 8351052 - DNA, 22 bp, Homo sapiens
tccctgggaccggcagctcaca

SEQ ID NO: 8351053 - DNA, 20 bp, Homo sapiens
tccctggaggtggtggcatc

SEQ ID NO: 8351054 - DNA, 22 bp, Homo sapiens
tccctggagataacttctggga

SEQ ID NO: 8351055 - DNA, 22 bp, Homo sapiens
tccctggacagccttgcctggg

SEQ ID NO: 8351056 - DNA, 22 bp, Homo sapiens
tccctggacaacagacttcact

SEQ ID NO: 8351057 - DNA, 22 bp, Homo sapiens
tccctgcctcctggcagtgcca

SEQ ID NO: 8351058 - DNA, 22 bp, Homo sapiens
tccctgggaaatgtcagtttca

SEQ ID NO: 8351059 - DNA, 22 bp, Homo sapiens
tccctgggaacaaaggatgaga

SEQ ID NO: 8351060 - DNA, 22 bp, Homo sapiens
tccctgggaattaatatttgga

SEQ ID NO: 8351061 - DNA, 22 bp, Homo sapiens
tcctcactttgtagccatcctt

SEQ ID NO: 8351062 - DNA, 22 bp, Homo sapiens
tcctcactgcagtgctccgagc

SEQ ID NO: 8351063 - DNA, 22 bp, Homo sapiens
tcctcactgcagtgctccgagc

SEQ ID NO: 8351064 - DNA, 22 bp, Homo sapiens
tcctattggtagacatttctgt

SEQ ID NO: 8351065 - DNA, 22 bp, Homo sapiens
tcctcaaaggatacccaggctt

SEQ ID NO: 8351066 - DNA, 22 bp, Homo sapiens
tcctataattagaagcaatttg

SEQ ID NO: 8351067 - DNA, 22 bp, Homo sapiens
tcctcacagcatgaccaggcag

SEQ ID NO: 8351068 - DNA, 22 bp, Homo sapiens
tcctcacagagtggcaggcaat

SEQ ID NO: 8351069 - DNA, 22 bp, Homo sapiens
tcctcacaagcaagcacaggta

SEQ ID NO: 8351070 - DNA, 22 bp, Homo sapiens
tcctcagcattagcacagacat

SEQ ID NO: 8351071 - DNA, 22 bp, Homo sapiens
tcctcagacaccctgctggctt

SEQ ID NO: 8351072 - DNA, 22 bp, Homo sapiens
tcccagcctggaccctgccagt

SEQ ID NO: 8351073 - DNA, 22 bp, Homo sapiens
tcccagcctggaccctgccagt

SEQ ID NO: 8351074 - DNA, 22 bp, Homo sapiens
tcccagcctgacagtgcatcaa

SEQ ID NO: 8351075 - DNA, 22 bp, Homo sapiens
tcccagccttccagtctggttt

SEQ ID NO: 8351076 - DNA, 22 bp, Homo sapiens
tcccagcctttctttctccagc

SEQ ID NO: 8351077 - DNA, 22 bp, Homo sapiens
tcccagccttccttgtggtgaa

SEQ ID NO: 8351078 - DNA, 22 bp, Homo sapiens
tcccagccggtgcctgggtccc

SEQ ID NO: 8351079 - DNA, 22 bp, Homo sapiens
tcccagcctcctgacagttttg

SEQ ID NO: 8351080 - DNA, 22 bp, Homo sapiens
tcccagcattaatgcctgtcag

SEQ ID NO: 8351081 - DNA, 22 bp, Homo sapiens
tcccagcataacaaactgcccg

SEQ ID NO: 8351082 - DNA, 22 bp, Homo sapiens
tccattatacttctgattcaaa

SEQ ID NO: 8351083 - DNA, 22 bp, Homo sapiens
tccattatacttctgattcaaa

SEQ ID NO: 8351084 - DNA, 18 bp, Homo sapiens
tccattgttctactgtga

SEQ ID NO: 8351085 - DNA, 21 bp, Homo sapiens
tccattgttttcccagggttt

SEQ ID NO: 8351086 - DNA, 22 bp, Homo sapiens
tccattgtctttggtcctagcc

SEQ ID NO: 8351087 - DNA, 22 bp, Homo sapiens
tcccagagacagagcctcctcc

SEQ ID NO: 8351088 - DNA, 22 bp, Homo sapiens
tcccagagatttcctctccttc

SEQ ID NO: 8351089 - DNA, 22 bp, Homo sapiens
tcccagagatttcctctccttc

SEQ ID NO: 8351090 - DNA, 22 bp, Homo sapiens
tccaggcctttgcacatgttgt

SEQ ID NO: 8351091 - DNA, 22 bp, Homo sapiens
tccaggcctggctccattcagt

SEQ ID NO: 8351092 - DNA, 22 bp, Homo sapiens
tccaggccttgacaggtcagtt

SEQ ID NO: 8351093 - DNA, 20 bp, Homo sapiens
tccaggccttgttctcagat

SEQ ID NO: 8351094 - DNA, 21 bp, Homo sapiens
tccacaagttagaaggaaatt

SEQ ID NO: 8351095 - DNA, 22 bp, Homo sapiens
tccaggcctctagcccctatct

SEQ ID NO: 8351096 - DNA, 22 bp, Homo sapiens
tccaggcctctagccctctctt

SEQ ID NO: 8351097 - DNA, 22 bp, Homo sapiens
tccaggcctgcaatgacaaagc

SEQ ID NO: 8351098 - DNA, 22 bp, Homo sapiens
tccaggcctgcctggtgtttgc

SEQ ID NO: 8351099 - DNA, 18 bp, Homo sapiens
tccaggcctgaagtgtcc

SEQ ID NO: 8351100 - DNA, 22 bp, Homo sapiens
tccaggcctgactataaatgta

SEQ ID NO: 8351101 - DNA, 21 bp, Homo sapiens
tccagggaatttcaactttta

SEQ ID NO: 8351102 - DNA, 22 bp, Homo sapiens
tccagggacacagagtccttct

SEQ ID NO: 8351103 - DNA, 23 bp, Homo sapiens
tccagggctggccagacctcggt

SEQ ID NO: 8351104 - DNA, 22 bp, Homo sapiens
tccagggctgggttggctcagc

SEQ ID NO: 8351105 - DNA, 19 bp, Homo sapiens
tccagggctttatggcttt

SEQ ID NO: 8351106 - DNA, 22 bp, Homo sapiens
tccagtcaagcttgagaatttc

SEQ ID NO: 8351107 - DNA, 21 bp, Homo sapiens
tcctgcaccctccctgtggct

SEQ ID NO: 8351108 - DNA, 22 bp, Homo sapiens
tcctgcagagccgccctcaggt

SEQ ID NO: 8351109 - DNA, 22 bp, Homo sapiens
tcctgccctgaaaagtcagtct

SEQ ID NO: 8351110 - DNA, 22 bp, Homo sapiens
tcctgccctgaaaagtcagtct

SEQ ID NO: 8351111 - DNA, 22 bp, Homo sapiens
tcctgccgtcctccggggcctc

SEQ ID NO: 8351112 - DNA, 22 bp, Homo sapiens
tcctgccccactgtttgaaaga

SEQ ID NO: 8351113 - DNA, 22 bp, Homo sapiens
tcctgccctcgggggtgttcca

SEQ ID NO: 8351114 - DNA, 22 bp, Homo sapiens
tcctgccctaagatgttatatt

SEQ ID NO: 8351115 - DNA, 22 bp, Homo sapiens
tcctgcagctgaagctcatgtg

SEQ ID NO: 8351116 - DNA, 22 bp, Homo sapiens
tcctgcctcacagttgaagttt

SEQ ID NO: 8351117 - DNA, 22 bp, Homo sapiens
tcctgcctctccatgctaacta

SEQ ID NO: 8351118 - DNA, 22 bp, Homo sapiens
tcctgagaggtgtgaggtgcag

SEQ ID NO: 8351119 - DNA, 22 bp, Homo sapiens
tcctgagataaatctcatgtga

SEQ ID NO: 8351120 - DNA, 22 bp, Homo sapiens
tcctgagataaatctcatgtga

SEQ ID NO: 8351121 - DNA, 22 bp, Homo sapiens
tcctgagcacagagacaaggaa

SEQ ID NO: 8351122 - DNA, 22 bp, Homo sapiens
tcctgagatgtggagctccatg

SEQ ID NO: 8351123 - DNA, 22 bp, Homo sapiens
tcctgagccctgtaggaccctg

SEQ ID NO: 8351124 - DNA, 22 bp, Homo sapiens
tcctgaggaaagttcatgaatg

SEQ ID NO: 8351125 - DNA, 22 bp, Homo sapiens
tcctgaggaatgtgaagagaac

SEQ ID NO: 8351126 - DNA, 23 bp, Homo sapiens
tcctgaggaatggcatctcacat

SEQ ID NO: 8351127 - DNA, 22 bp, Homo sapiens
tcctctggggtcagggcactac

SEQ ID NO: 8351128 - DNA, 22 bp, Homo sapiens
tcctctggggtcagggcactac

SEQ ID NO: 8351129 - DNA, 22 bp, Homo sapiens
tcctctggtcctgcagcagatc

SEQ ID NO: 8351130 - DNA, 22 bp, Homo sapiens
tcctctttctcaacattagtta

SEQ ID NO: 8351131 - DNA, 22 bp, Homo sapiens
tcctgaagaggctacactgctt

SEQ ID NO: 8351132 - DNA, 22 bp, Homo sapiens
tcctgagagcagagtccaggtg

SEQ ID NO: 8351133 - DNA, 22 bp, Homo sapiens
tcctgagacatctctgctggtc

SEQ ID NO: 8351134 - DNA, 22 bp, Homo sapiens
tccaattttacgtctgtataaa

SEQ ID NO: 8351135 - DNA, 22 bp, Homo sapiens
tccaaggtcagcgagagtcact

SEQ ID NO: 8351136 - DNA, 21 bp, Homo sapiens
tccaaatcccattctgtagtc

SEQ ID NO: 8351137 - DNA, 22 bp, Homo sapiens
tccaactttctcctccggcttg

SEQ ID NO: 8351138 - DNA, 22 bp, Homo sapiens
tccaactttctcctccggcttg

SEQ ID NO: 8351139 - DNA, 19 bp, Homo sapiens
tccaaaggacccacctcca

SEQ ID NO: 8351140 - DNA, 22 bp, Homo sapiens
tcatttttgaccatgggtagga

SEQ ID NO: 8351141 - DNA, 22 bp, Homo sapiens
tcatttgttcatctgctcttct

SEQ ID NO: 8351142 - DNA, 22 bp, Homo sapiens
tcatttgtaccattttttaaga

SEQ ID NO: 8351143 - DNA, 22 bp, Homo sapiens
tcatttgtgcaatgtagatgaa

SEQ ID NO: 8351144 - DNA, 19 bp, Homo sapiens
tcatttgttagtagaagtt

SEQ ID NO: 8351145 - DNA, 22 bp, Homo sapiens
tcatttacatgtctttctctga

SEQ ID NO: 8351146 - DNA, 22 bp, Homo sapiens
tcatttacgcgcctccttcctt

SEQ ID NO: 8351147 - DNA, 22 bp, Homo sapiens
tcatttacatagaaacaatata

SEQ ID NO: 8351148 - DNA, 22 bp, Homo sapiens
tcatttactgtaggcaaaaatt

SEQ ID NO: 8351149 - DNA, 22 bp, Homo sapiens
tcatttatattgtattctgtag

SEQ ID NO: 8351150 - DNA, 22 bp, Homo sapiens
tcatttaataatttttgagtag

SEQ ID NO: 8351151 - DNA, 22 bp, Homo sapiens
tcatttaatagcttttgtcttt

SEQ ID NO: 8351152 - DNA, 22 bp, Homo sapiens
tcatttacacttcacaaatgga

SEQ ID NO: 8351153 - DNA, 22 bp, Homo sapiens
tcattggtaattatttttgaca

SEQ ID NO: 8351154 - DNA, 22 bp, Homo sapiens
tcattgtcttgatatgattgtc

SEQ ID NO: 8351155 - DNA, 22 bp, Homo sapiens
tcattgttatgttttgctgtct

SEQ ID NO: 8351156 - DNA, 22 bp, Homo sapiens
tcatgcataatggtgacaacct

SEQ ID NO: 8351157 - DNA, 22 bp, Homo sapiens
tcatgcatatggggtcagccca

SEQ ID NO: 8351158 - DNA, 22 bp, Homo sapiens
tcatgcatctgggctggctggt

SEQ ID NO: 8351159 - DNA, 22 bp, Homo sapiens
tcatttctgttgtgcatcactg

SEQ ID NO: 8351160 - DNA, 22 bp, Homo sapiens
tcatttctccgacctgctgtcc

SEQ ID NO: 8351161 - DNA, 22 bp, Homo sapiens
tcatttcctcaaattcaaggtt

SEQ ID NO: 8351162 - DNA, 17 bp, Homo sapiens
tcatttctaggcactcc

SEQ ID NO: 8351163 - DNA, 22 bp, Homo sapiens
tcatttctatctatgcagcttc

SEQ ID NO: 8351164 - DNA, 22 bp, Homo sapiens
tcatttctatctatgcagcttc

SEQ ID NO: 8351165 - DNA, 22 bp, Homo sapiens
tcatagaatgagttaatgaact

SEQ ID NO: 8351166 - DNA, 22 bp, Homo sapiens
tcatagaatgagttaatgaact

SEQ ID NO: 8351167 - DNA, 22 bp, Homo sapiens
tcatagaaggaactgggagata

SEQ ID NO: 8351168 - DNA, 22 bp, Homo sapiens
tcatagaagtagtatccacatt

SEQ ID NO: 8351169 - DNA, 18 bp, Homo sapiens
tcatagaagtgaatcaga

SEQ ID NO: 8351170 - DNA, 22 bp, Homo sapiens
tcatagaagcaccagaagatat

SEQ ID NO: 8351171 - DNA, 22 bp, Homo sapiens
tcatagaagcaccagaagatat

SEQ ID NO: 8351172 - DNA, 22 bp, Homo sapiens
tcatagaaatgtggccagaaac

SEQ ID NO: 8351173 - DNA, 22 bp, Homo sapiens
tcatagaaatggaaagtatatt

SEQ ID NO: 8351174 - DNA, 22 bp, Homo sapiens
tcataaattagctgtctttgaa

SEQ ID NO: 8351175 - DNA, 22 bp, Homo sapiens
tcataaatgcagtgtcataaat

SEQ ID NO: 8351176 - DNA, 22 bp, Homo sapiens
tcataaattatctatttggcta

SEQ ID NO: 8351177 - DNA, 22 bp, Homo sapiens
tcataaattctggtgctgtgag

SEQ ID NO: 8351178 - DNA, 22 bp, Homo sapiens
tcataaattatctatttggcta

SEQ ID NO: 8351179 - DNA, 22 bp, Homo sapiens
tcataaattgattatgtgcttt

SEQ ID NO: 8351180 - DNA, 22 bp, Homo sapiens
tcataaattgggttggctgggt

SEQ ID NO: 8351181 - DNA, 22 bp, Homo sapiens
tcatacatcttgtatatctatc

SEQ ID NO: 8351182 - DNA, 22 bp, Homo sapiens
tcatacatgttgtgttcaaatg

SEQ ID NO: 8351183 - DNA, 22 bp, Homo sapiens
tcatcttgcagtgtgtgttctg

SEQ ID NO: 8351184 - DNA, 22 bp, Homo sapiens
tcatgaaaatagatcagaaatt

SEQ ID NO: 8351185 - DNA, 22 bp, Homo sapiens
tcatgaaaatagatcagaaatt

SEQ ID NO: 8351186 - DNA, 22 bp, Homo sapiens
tcagtctccatctgcttgtctt

SEQ ID NO: 8351187 - DNA, 22 bp, Homo sapiens
tcagtctcctttcctctagaca

SEQ ID NO: 8351188 - DNA, 23 bp, Homo sapiens
tcataaatattagcacagtagga

SEQ ID NO: 8351189 - DNA, 22 bp, Homo sapiens
tcataaatatttgtgggggctt

SEQ ID NO: 8351190 - DNA, 22 bp, Homo sapiens
tcataaatcatactccatttgc

SEQ ID NO: 8351191 - DNA, 22 bp, Homo sapiens
tcataaatagttgtgcctgaat

SEQ ID NO: 8351192 - DNA, 22 bp, Homo sapiens
tcagtaaatgaatgaatatatg

SEQ ID NO: 8351193 - DNA, 22 bp, Homo sapiens
tcagtaacttacttattcacct

SEQ ID NO: 8351194 - DNA, 22 bp, Homo sapiens
tcagtatagcttctaaactaac

SEQ ID NO: 8351195 - DNA, 22 bp, Homo sapiens
tcagtatagcttctaaactaac

SEQ ID NO: 8351196 - DNA, 22 bp, Homo sapiens
tcagtacagcttagtcttctca

SEQ ID NO: 8351197 - DNA, 22 bp, Homo sapiens
tcagtacagcttagtcttctca

SEQ ID NO: 8351198 - DNA, 22 bp, Homo sapiens
tcagggctcagcatctggcatt

SEQ ID NO: 8351199 - DNA, 22 bp, Homo sapiens
tcagggccctggcaggaaacag

SEQ ID NO: 8351200 - DNA, 22 bp, Homo sapiens
tcagggccggggctgtggcgag

SEQ ID NO: 8351201 - DNA, 22 bp, Homo sapiens
tcagggccgccggggatctcgc

SEQ ID NO: 8351202 - DNA, 22 bp, Homo sapiens
tcagggcaggcgagcagctgct

SEQ ID NO: 8351203 - DNA, 22 bp, Homo sapiens
tcagagtgttttactaaacaag

SEQ ID NO: 8351204 - DNA, 21 bp, Homo sapiens
tcagagtgtgttacagcaagc

SEQ ID NO: 8351205 - DNA, 22 bp, Homo sapiens
tcagagtgtggtgagatgtgca

SEQ ID NO: 8351206 - DNA, 22 bp, Homo sapiens
tcagagtgtgagacatattgga

SEQ ID NO: 8351207 - DNA, 22 bp, Homo sapiens
tcagagtggtagcctattttct

SEQ ID NO: 8351208 - DNA, 22 bp, Homo sapiens
tcagagtgtgacttggtcatga

SEQ ID NO: 8351209 - DNA, 22 bp, Homo sapiens
tcagagtggtggttttgccttc

SEQ ID NO: 8351210 - DNA, 22 bp, Homo sapiens
tcagagtgggagaatgtgccaa

SEQ ID NO: 8351211 - DNA, 21 bp, Homo sapiens
tcagagtggaagacagtttga

SEQ ID NO: 8351212 - DNA, 18 bp, Homo sapiens
tcagacaagttagacagg

SEQ ID NO: 8351213 - DNA, 20 bp, Homo sapiens
tcagatgggagtgagccatc

SEQ ID NO: 8351214 - DNA, 21 bp, Homo sapiens
tcagattctctcattttgatg

SEQ ID NO: 8351215 - DNA, 22 bp, Homo sapiens
tcagcagtgtagtttatcattc

SEQ ID NO: 8351216 - DNA, 17 bp, Homo sapiens
tcagcaggggccaagct

SEQ ID NO: 8351217 - DNA, 22 bp, Homo sapiens
tcagcagggctgggagctgtga

SEQ ID NO: 8351218 - DNA, 22 bp, Homo sapiens
tcagcaggcggttccttgtggg

SEQ ID NO: 8351219 - DNA, 22 bp, Homo sapiens
tcagcaggctctggttgaccat

SEQ ID NO: 8351220 - DNA, 22 bp, Homo sapiens
tcagcaggcccatcctccaggc

SEQ ID NO: 8351221 - DNA, 17 bp, Homo sapiens
tcagcaaagacaaagga

SEQ ID NO: 8351222 - DNA, 22 bp, Homo sapiens
tcagcaactatttatcaaattc

SEQ ID NO: 8351223 - DNA, 22 bp, Homo sapiens
tcagcaactctcattccgcttt

SEQ ID NO: 8351224 - DNA, 22 bp, Homo sapiens
tcagccaggccaccttcagctt

SEQ ID NO: 8351225 - DNA, 22 bp, Homo sapiens
tcagccaggcacaatggcagct

SEQ ID NO: 8351226 - DNA, 20 bp, Homo sapiens
tcagccagctaacatgggga

SEQ ID NO: 8351227 - DNA, 22 bp, Homo sapiens
tcagccagctgtgtgcttctgc

SEQ ID NO: 8351228 - DNA, 22 bp, Homo sapiens
tcagctctgcctgtggaggcac

SEQ ID NO: 8351229 - DNA, 22 bp, Homo sapiens
tcagccagccagctacaggctt

SEQ ID NO: 8351230 - DNA, 22 bp, Homo sapiens
tcagccagccagctacaggctt

SEQ ID NO: 8351231 - DNA, 22 bp, Homo sapiens
tcagccagagggggcaaaggaa

SEQ ID NO: 8351232 - DNA, 22 bp, Homo sapiens
tcagccagaggtggatgagtca

SEQ ID NO: 8351233 - DNA, 22 bp, Homo sapiens
tcagccactacccaccttaaca

SEQ ID NO: 8351234 - DNA, 19 bp, Homo sapiens
tcagccaccagaagagata

SEQ ID NO: 8351235 - DNA, 17 bp, Homo sapiens
tcagcatacacagagaa

SEQ ID NO: 8351236 - DNA, 22 bp, Homo sapiens
tcagcagttttatatgcagctt

SEQ ID NO: 8351237 - DNA, 22 bp, Homo sapiens
tcagcattctttacaaggatga

SEQ ID NO: 8351238 - DNA, 22 bp, Homo sapiens
tcagctggcagttcagaggctg

SEQ ID NO: 8351239 - DNA, 19 bp, Homo sapiens
tcaggactgacttgaagtc

SEQ ID NO: 8351240 - DNA, 23 bp, Homo sapiens
tcagaagtttggttgtaacatgg

SEQ ID NO: 8351241 - DNA, 22 bp, Homo sapiens
tcagaagccaccttttgttggg

SEQ ID NO: 8351242 - DNA, 22 bp, Homo sapiens
tcagaaaccccaacaatggaga

SEQ ID NO: 8351243 - DNA, 22 bp, Homo sapiens
tcactgcaacctccacctcctg

SEQ ID NO: 8351244 - DNA, 22 bp, Homo sapiens
tcactgcaacctccacctcctg

SEQ ID NO: 8351245 - DNA, 22 bp, Homo sapiens
tcactgcaacctccacctcccg

SEQ ID NO: 8351246 - DNA, 22 bp, Homo sapiens
tcactgcaacctccacctcccg

SEQ ID NO: 8351247 - DNA, 22 bp, Homo sapiens
tcacatttgttcctctgcactt

SEQ ID NO: 8351248 - DNA, 22 bp, Homo sapiens
tcacagtgtgaaggtcagtcac

SEQ ID NO: 8351249 - DNA, 22 bp, Homo sapiens
tcacagtgtcgtccttgggtgt

SEQ ID NO: 8351250 - DNA, 22 bp, Homo sapiens
tcacagtgctctgggtggcaga

SEQ ID NO: 8351251 - DNA, 22 bp, Homo sapiens
tcacatttctcagcactgatga

SEQ ID NO: 8351252 - DNA, 22 bp, Homo sapiens
tcacatactgaaagtccagtga

SEQ ID NO: 8351253 - DNA, 22 bp, Homo sapiens
tcacattgccattagttcagtt

SEQ ID NO: 8351254 - DNA, 22 bp, Homo sapiens
tcaagaaaatgacgccaacctt

SEQ ID NO: 8351255 - DNA, 22 bp, Homo sapiens
tcaagaaaatgcctgctggtgt

SEQ ID NO: 8351256 - DNA, 22 bp, Homo sapiens
tcaagaaactgtagcaatgggt

SEQ ID NO: 8351257 - DNA, 22 bp, Homo sapiens
tcaagaaactgtgctacagagt

SEQ ID NO: 8351258 - DNA, 22 bp, Homo sapiens
tcaagaaagggcttcaccagga

SEQ ID NO: 8351259 - DNA, 22 bp, Homo sapiens
tcaagaaactgtgctacagagt

SEQ ID NO: 8351260 - DNA, 22 bp, Homo sapiens
tcacagtattgggggtggagga

SEQ ID NO: 8351261 - DNA, 22 bp, Homo sapiens
tcacagtatcaggtggagtgga

SEQ ID NO: 8351262 - DNA, 22 bp, Homo sapiens
tcaagaaatgtgcttggatata

SEQ ID NO: 8351263 - DNA, 22 bp, Homo sapiens
tcaagaacttaggagcaagcca

SEQ ID NO: 8351264 - DNA, 22 bp, Homo sapiens
tcaacactggctacagttatgc

SEQ ID NO: 8351265 - DNA, 22 bp, Homo sapiens
tcaacactctttggcacagtta

SEQ ID NO: 8351266 - DNA, 22 bp, Homo sapiens
tcaaatgcacctctcatttgtt

SEQ ID NO: 8351267 - DNA, 22 bp, Homo sapiens
tcaacactatccaggcaatctt

SEQ ID NO: 8351268 - DNA, 22 bp, Homo sapiens
tcaacactatccaggcaatctt

SEQ ID NO: 8351269 - DNA, 22 bp, Homo sapiens
tagaaccagtccacagaatttg

SEQ ID NO: 8351270 - DNA, 22 bp, Homo sapiens
tacttacattagcaaacaaggt

SEQ ID NO: 8351271 - DNA, 22 bp, Homo sapiens
tagaaatgggttacatttagag

SEQ ID NO: 8351272 - DNA, 23 bp, Homo sapiens
tagaacatcggtgtcttggagca

SEQ ID NO: 8351273 - DNA, 22 bp, Homo sapiens
tagaacatgacttatttttgga

SEQ ID NO: 8351274 - DNA, 22 bp, Homo sapiens
tagactggtgaattagggggaa

SEQ ID NO: 8351275 - DNA, 22 bp, Homo sapiens
tagactgttacagcttttcaga

SEQ ID NO: 8351276 - DNA, 22 bp, Homo sapiens
tagactcagacagaaaatgtgt

SEQ ID NO: 8351277 - DNA, 22 bp, Homo sapiens
tagaccagaattgtcagcacct

SEQ ID NO: 8351278 - DNA, 22 bp, Homo sapiens
tagaccagaacttgtcacctgg

SEQ ID NO: 8351279 - DNA, 21 bp, Homo sapiens
tagaccagctgtgctcctcgg

SEQ ID NO: 8351280 - DNA, 22 bp, Homo sapiens
tagatccagctgttatgttatg

SEQ ID NO: 8351281 - DNA, 22 bp, Homo sapiens
tagatcaagaatgtccacttgt

SEQ ID NO: 8351282 - DNA, 22 bp, Homo sapiens
tagatataaggtccttagaaca

SEQ ID NO: 8351283 - DNA, 22 bp, Homo sapiens
tagatagattctcctatagagt

SEQ ID NO: 8351284 - DNA, 22 bp, Homo sapiens
tagatagataaaatgttgcaga

SEQ ID NO: 8351285 - DNA, 22 bp, Homo sapiens
tagatagactaatccagcaact

SEQ ID NO: 8351286 - DNA, 22 bp, Homo sapiens
tagatacatacattttaaaatg

SEQ ID NO: 8351287 - DNA, 22 bp, Homo sapiens
tagatacatacattttaaaatg

SEQ ID NO: 8351288 - DNA, 22 bp, Homo sapiens
tagagtggttaacagtttagaa

SEQ ID NO: 8351289 - DNA, 22 bp, Homo sapiens
tagagaacaagtatggcacgga

SEQ ID NO: 8351290 - DNA, 22 bp, Homo sapiens
tagagaactcagtgtgcagcct

SEQ ID NO: 8351291 - DNA, 22 bp, Homo sapiens
tagagaatggccttgaagtagt

SEQ ID NO: 8351292 - DNA, 22 bp, Homo sapiens
tagagaaataagctttgccttg

SEQ ID NO: 8351293 - DNA, 21 bp, Homo sapiens
tagagaaaagaagctgttcct

SEQ ID NO: 8351294 - DNA, 22 bp, Homo sapiens
tagctgcttcagtctaggtctc

SEQ ID NO: 8351295 - DNA, 22 bp, Homo sapiens
tagctgcttagaaatcactgag

SEQ ID NO: 8351296 - DNA, 22 bp, Homo sapiens
tagctgctgcagcacagggagg

SEQ ID NO: 8351297 - DNA, 22 bp, Homo sapiens
tagcaggagagaagttttaagt

SEQ ID NO: 8351298 - DNA, 21 bp, Homo sapiens
tagcaggatttggtttatttt

SEQ ID NO: 8351299 - DNA, 22 bp, Homo sapiens
tagcaaataaaacagtattgaa

SEQ ID NO: 8351300 - DNA, 22 bp, Homo sapiens
tagcaaatgtctgaaggaatag

SEQ ID NO: 8351301 - DNA, 22 bp, Homo sapiens
tagcaaatgtaaaatgcctaca

SEQ ID NO: 8351302 - DNA, 21 bp, Homo sapiens
tagcaaatggagagtaagaga

SEQ ID NO: 8351303 - DNA, 22 bp, Homo sapiens
tagcaagaagctgtcacaggtg

SEQ ID NO: 8351304 - DNA, 22 bp, Homo sapiens
tagcaagaagctgtcacaggtg

SEQ ID NO: 8351305 - DNA, 22 bp, Homo sapiens
tagcaactgcctttactatatt

SEQ ID NO: 8351306 - DNA, 21 bp, Homo sapiens
tagcaaattggtggaatggga

SEQ ID NO: 8351307 - DNA, 22 bp, Homo sapiens
tagcaaatgtgttatgctatgc

SEQ ID NO: 8351308 - DNA, 22 bp, Homo sapiens
tagatctgatacaattcatctg

SEQ ID NO: 8351309 - DNA, 22 bp, Homo sapiens
tagatcatgggtactgcatatg

SEQ ID NO: 8351310 - DNA, 22 bp, Homo sapiens
tagatcttgttacagatttcct

SEQ ID NO: 8351311 - DNA, 21 bp, Homo sapiens
tagatgaaatcagagtatttc

SEQ ID NO: 8351312 - DNA, 22 bp, Homo sapiens
tagatgaattagcaattatctt

SEQ ID NO: 8351313 - DNA, 22 bp, Homo sapiens
tagctgtgagcacccaggctgt

SEQ ID NO: 8351314 - DNA, 22 bp, Homo sapiens
tagctgggagtgtctgatgggt

SEQ ID NO: 8351315 - DNA, 22 bp, Homo sapiens
tagctgggactactggccctgc

SEQ ID NO: 8351316 - DNA, 20 bp, Homo sapiens
taggcagcttgacccttggt

SEQ ID NO: 8351317 - DNA, 22 bp, Homo sapiens
tagggcagattcggtggagttt

SEQ ID NO: 8351318 - DNA, 22 bp, Homo sapiens
tagggcagccacccaggctgct

SEQ ID NO: 8351319 - DNA, 22 bp, Homo sapiens
tagggcagccttatagctccca

SEQ ID NO: 8351320 - DNA, 22 bp, Homo sapiens
tagttttataatgttaacatct

SEQ ID NO: 8351321 - DNA, 21 bp, Homo sapiens
tagtttctacccagttaatgg

SEQ ID NO: 8351322 - DNA, 22 bp, Homo sapiens
tagttttttcaacaaatggtgc

SEQ ID NO: 8351323 - DNA, 22 bp, Homo sapiens
tagtttttaagtgtacaatttc

SEQ ID NO: 8351324 - DNA, 22 bp, Homo sapiens
tagtttttaagtgtacaatttc

SEQ ID NO: 8351325 - DNA, 22 bp, Homo sapiens
tagttcttactgttttcagcgt

SEQ ID NO: 8351326 - DNA, 22 bp, Homo sapiens
tagttctttgacggtgctttga

SEQ ID NO: 8351327 - DNA, 22 bp, Homo sapiens
tagttcttggttcttagttctt

SEQ ID NO: 8351328 - DNA, 22 bp, Homo sapiens
tagtttagcactaagaaaaaca

SEQ ID NO: 8351329 - DNA, 22 bp, Homo sapiens
tagttacataaagtggactgtt

SEQ ID NO: 8351330 - DNA, 22 bp, Homo sapiens
tagttacagtgcatagcaagat

SEQ ID NO: 8351331 - DNA, 22 bp, Homo sapiens
tagttacaatgggttctgtgac

SEQ ID NO: 8351332 - DNA, 22 bp, Homo sapiens
tagttacagatctaggactgtt

SEQ ID NO: 8351333 - DNA, 22 bp, Homo sapiens
tagttacagagaaatgatttga

SEQ ID NO: 8351334 - DNA, 18 bp, Homo sapiens
tagtggaactgctctggg

SEQ ID NO: 8351335 - DNA, 22 bp, Homo sapiens
tagtgcccaaatcccagctctg

SEQ ID NO: 8351336 - DNA, 22 bp, Homo sapiens
tagtgctatggccagagccctt

SEQ ID NO: 8351337 - DNA, 22 bp, Homo sapiens
taggggctcagaacatgtcctt

SEQ ID NO: 8351338 - DNA, 23 bp, Homo sapiens
taggggctggcgtggagcctgcg

SEQ ID NO: 8351339 - DNA, 22 bp, Homo sapiens
taggggctcagaacatgtcctt

SEQ ID NO: 8351340 - DNA, 22 bp, Homo sapiens
taggggcagaagcggcggtcca

SEQ ID NO: 8351341 - DNA, 22 bp, Homo sapiens
tatcattttactgtgacatttt

SEQ ID NO: 8351342 - DNA, 22 bp, Homo sapiens
tatcatttagagtatttcttca

SEQ ID NO: 8351343 - DNA, 22 bp, Homo sapiens
tatgaaagaatctcagagcaca

SEQ ID NO: 8351344 - DNA, 22 bp, Homo sapiens
tatgaaaatttagctgaagcat

SEQ ID NO: 8351345 - DNA, 22 bp, Homo sapiens
tatgaaaaggtggccaatgtag

SEQ ID NO: 8351346 - DNA, 23 bp, Homo sapiens
tatctttttcaatgttggaaata

SEQ ID NO: 8351347 - DNA, 23 bp, Homo sapiens
tatctttttcaatgttggaaata

SEQ ID NO: 8351348 - DNA, 22 bp, Homo sapiens
tatcttttgagttctcaagatg

SEQ ID NO: 8351349 - DNA, 22 bp, Homo sapiens
tatcttttgagttctcaagatg

SEQ ID NO: 8351350 - DNA, 18 bp, Homo sapiens
tatcttttccagtggtat

SEQ ID NO: 8351351 - DNA, 22 bp, Homo sapiens
tatctttgtgtcccttttgatg

SEQ ID NO: 8351352 - DNA, 22 bp, Homo sapiens
tatgaatataccacaatttagg

SEQ ID NO: 8351353 - DNA, 22 bp, Homo sapiens
tatgacaaggtggagtatgagt

SEQ ID NO: 8351354 - DNA, 22 bp, Homo sapiens
tatgacaaggtggagtatgagt

SEQ ID NO: 8351355 - DNA, 22 bp, Homo sapiens
tatgaattctcttgtgtatagt

SEQ ID NO: 8351356 - DNA, 22 bp, Homo sapiens
tatgaaattgccatttttatgg

SEQ ID NO: 8351357 - DNA, 22 bp, Homo sapiens
tatgaaatggtagtaggaaggg

SEQ ID NO: 8351358 - DNA, 18 bp, Homo sapiens
tatgaaagtccactctca

SEQ ID NO: 8351359 - DNA, 22 bp, Homo sapiens
tatgaaagcaatcattatgtac

SEQ ID NO: 8351360 - DNA, 22 bp, Homo sapiens
tatgaaatgatggggaaaatag

SEQ ID NO: 8351361 - DNA, 22 bp, Homo sapiens
tatgaaatttaaacacagatca

SEQ ID NO: 8351362 - DNA, 22 bp, Homo sapiens
tatgaaatttaaacacagatca

SEQ ID NO: 8351363 - DNA, 22 bp, Homo sapiens
tataaaacagaaagcactacct

SEQ ID NO: 8351364 - DNA, 22 bp, Homo sapiens
tatcagaaggcacatggagtct

SEQ ID NO: 8351365 - DNA, 21 bp, Homo sapiens
tatcagaagagaaagaatgat

SEQ ID NO: 8351366 - DNA, 22 bp, Homo sapiens
tatcagaagacttacagtatcg

SEQ ID NO: 8351367 - DNA, 22 bp, Homo sapiens
tattaaattatggatttaggag

SEQ ID NO: 8351368 - DNA, 22 bp, Homo sapiens
tattaataagtgactactagct

SEQ ID NO: 8351369 - DNA, 22 bp, Homo sapiens
tattaagtatcttgatgacaaa

SEQ ID NO: 8351370 - DNA, 22 bp, Homo sapiens
tattaagtggtgagtactgcca

SEQ ID NO: 8351371 - DNA, 22 bp, Homo sapiens
tatgtattctcagatttactaa

SEQ ID NO: 8351372 - DNA, 22 bp, Homo sapiens
tatgtattattcatcagtggga

SEQ ID NO: 8351373 - DNA, 22 bp, Homo sapiens
tatgtattctgagtacaagttc

SEQ ID NO: 8351374 - DNA, 18 bp, Homo sapiens
tatgtataacatagttca

SEQ ID NO: 8351375 - DNA, 18 bp, Homo sapiens
tatgtataacatagttca

SEQ ID NO: 8351376 - DNA, 22 bp, Homo sapiens
tatgtacatcgttgaattcaaa

SEQ ID NO: 8351377 - DNA, 22 bp, Homo sapiens
tatgtacaagcacacatgtgac

SEQ ID NO: 8351378 - DNA, 19 bp, Homo sapiens
tatgacaagtactagttct

SEQ ID NO: 8351379 - DNA, 22 bp, Homo sapiens
tatggaaataattagacaagtg

SEQ ID NO: 8351380 - DNA, 22 bp, Homo sapiens
tatggaaataattagacaagtg

SEQ ID NO: 8351381 - DNA, 22 bp, Homo sapiens
tattaatttaatctccatggta

SEQ ID NO: 8351382 - DNA, 22 bp, Homo sapiens
tatttaactggaaacacaatga

SEQ ID NO: 8351383 - DNA, 22 bp, Homo sapiens
tatttaaccagttaaatttcca

SEQ ID NO: 8351384 - DNA, 22 bp, Homo sapiens
tatttaaaataagccccagtgg

SEQ ID NO: 8351385 - DNA, 22 bp, Homo sapiens
tatttaaaatagtgctccagca

SEQ ID NO: 8351386 - DNA, 22 bp, Homo sapiens
tatttaaaaagaggccagctgg

SEQ ID NO: 8351387 - DNA, 22 bp, Homo sapiens
tattgtgcttctgttgtgcaat

SEQ ID NO: 8351388 - DNA, 22 bp, Homo sapiens
tattgtttctggctgtggcagc

SEQ ID NO: 8351389 - DNA, 22 bp, Homo sapiens
tatttggaaatgataaagtact

SEQ ID NO: 8351390 - DNA, 23 bp, Homo sapiens
tatttggaaagagggaagaagac

SEQ ID NO: 8351391 - DNA, 22 bp, Homo sapiens
tatttggaaagtttatctatct

SEQ ID NO: 8351392 - DNA, 21 bp, Homo sapiens
tatttgctgccatctttgagg

SEQ ID NO: 8351393 - DNA, 22 bp, Homo sapiens
tattttctggggagagtgaacc

SEQ ID NO: 8351394 - DNA, 22 bp, Homo sapiens
tattttgacgattttatgcaaa

SEQ ID NO: 8351395 - DNA, 22 bp, Homo sapiens
tatttgcaggacatagatatgg

SEQ ID NO: 8351396 - DNA, 23 bp, Homo sapiens
tatttgctactggtaattctgga

SEQ ID NO: 8351397 - DNA, 22 bp, Homo sapiens
tatttcttgttattctcgttga

SEQ ID NO: 8351398 - DNA, 22 bp, Homo sapiens
tcaaatgaagacagttgacttg

SEQ ID NO: 8351399 - DNA, 22 bp, Homo sapiens
tcaaatctttaacatgtgcaaa

SEQ ID NO: 8351400 - DNA, 22 bp, Homo sapiens
tcaaataggtatgagtagaaat

SEQ ID NO: 8351401 - DNA, 22 bp, Homo sapiens
tcaaataccagcttttccagaa

SEQ ID NO: 8351402 - DNA, 18 bp, Homo sapiens
tcaaatactttgggcagt

SEQ ID NO: 8351403 - DNA, 22 bp, Homo sapiens
tcaaatatgtgatagaagctaa

SEQ ID NO: 8351404 - DNA, 22 bp, Homo sapiens
tcaaatattggctatttcacat

SEQ ID NO: 8351405 - DNA, 22 bp, Homo sapiens
tcaaataccagcaatttcatgt

SEQ ID NO: 8351406 - DNA, 22 bp, Homo sapiens
tcaaataccagcaatttcatgt

SEQ ID NO: 8351407 - DNA, 22 bp, Homo sapiens
tcaaataatgccattcatcatc

SEQ ID NO: 8351408 - DNA, 22 bp, Homo sapiens
tcaaagtttgtggcaatttatt

SEQ ID NO: 8351409 - DNA, 22 bp, Homo sapiens
tcaaagtaggggtaagccaggc

SEQ ID NO: 8351410 - DNA, 22 bp, Homo sapiens
tcaaagtaccattatcagtgga

SEQ ID NO: 8351411 - DNA, 22 bp, Homo sapiens
tcaaaaataagatattctggac

SEQ ID NO: 8351412 - DNA, 22 bp, Homo sapiens
tatttttgcctctcagataaaa

SEQ ID NO: 8351413 - DNA, 22 bp, Homo sapiens
tattttgttttgtatccactgt

SEQ ID NO: 8351414 - DNA, 22 bp, Homo sapiens
tattttgtcttctgctcatcac

SEQ ID NO: 8351415 - DNA, 22 bp, Homo sapiens
tattttgtcttctgctcatcac

SEQ ID NO: 8351416 - DNA, 22 bp, Homo sapiens
tattttgtatttatgcaagaaa

SEQ ID NO: 8351417 - DNA, 22 bp, Homo sapiens
tattttggctgattcatcatgt

SEQ ID NO: 8351418 - DNA, 22 bp, Homo sapiens
tattttgcgttgagtcagattt

SEQ ID NO: 8351419 - DNA, 22 bp, Homo sapiens
tattttgagcccctgacatcta

SEQ ID NO: 8351420 - DNA, 22 bp, Homo sapiens
tattttgacgattttatgcaaa

SEQ ID NO: 8351421 - DNA, 22 bp, Homo sapiens
tcaaactgaattaaacacttgt

SEQ ID NO: 8351422 - DNA, 22 bp, Homo sapiens
tcaaactgctaccttttatgtg

SEQ ID NO: 8351423 - DNA, 22 bp, Homo sapiens
tcaaactggcagacttctactt

SEQ ID NO: 8351424 - DNA, 22 bp, Homo sapiens
tcaaactgttagatttcagctc

SEQ ID NO: 8351425 - DNA, 18 bp, Homo sapiens
tcaaactgtcattggtga

SEQ ID NO: 8351426 - DNA, 22 bp, Homo sapiens
tcaaactggggaacttatttat

SEQ ID NO: 8351427 - DNA, 22 bp, Homo sapiens
tcaaactgttcagaactccttt

SEQ ID NO: 8351428 - DNA, 22 bp, Homo sapiens
tcaaactgtttacagtgagata

SEQ ID NO: 8351429 - DNA, 23 bp, Homo sapiens
tcaaactgttatattgccagagt

SEQ ID NO: 8351430 - DNA, 22 bp, Homo sapiens
tcaaagaacatcatctgaaatg

SEQ ID NO: 8351431 - DNA, 22 bp, Homo sapiens
tactctaaaaagaagcagatct

SEQ ID NO: 8351432 - DNA, 22 bp, Homo sapiens
tacttacataaaaactgaatgt

SEQ ID NO: 8351433 - DNA, 22 bp, Homo sapiens
tacttacactgaagcaaagata

SEQ ID NO: 8351434 - DNA, 22 bp, Homo sapiens
tactatctagctctttgcagag

SEQ ID NO: 8351435 - DNA, 21 bp, Homo sapiens
tactatgtagtgattgcagga

SEQ ID NO: 8351436 - DNA, 22 bp, Homo sapiens
tactatgtgaaaatactatagt

SEQ ID NO: 8351437 - DNA, 22 bp, Homo sapiens
tactagtttctaccttacagaa

SEQ ID NO: 8351438 - DNA, 22 bp, Homo sapiens
tactagaagctgtaatttttca

SEQ ID NO: 8351439 - DNA, 22 bp, Homo sapiens
tactagaaattaccttctcact

SEQ ID NO: 8351440 - DNA, 22 bp, Homo sapiens
tactagaacctcacaacaatcc

SEQ ID NO: 8351441 - DNA, 22 bp, Homo sapiens
tactagaaattaccttctcact

SEQ ID NO: 8351442 - DNA, 22 bp, Homo sapiens
tactagaatgccactgttagtg

SEQ ID NO: 8351443 - DNA, 22 bp, Homo sapiens
tactagttctcatatgaaataa

SEQ ID NO: 8351444 - DNA, 22 bp, Homo sapiens
tactacatacagaatttagaga

SEQ ID NO: 8351445 - DNA, 22 bp, Homo sapiens
tactagaaaaacacatgctctg

SEQ ID NO: 8351446 - DNA, 22 bp, Homo sapiens
tactacatacagaatttagaga

SEQ ID NO: 8351447 - DNA, 22 bp, Homo sapiens
tactacattaataaaacattca

SEQ ID NO: 8351448 - DNA, 22 bp, Homo sapiens
tactacaaggccgaagctctca

SEQ ID NO: 8351449 - DNA, 22 bp, Homo sapiens
taccattttgaaacatttcatc

SEQ ID NO: 8351450 - DNA, 22 bp, Homo sapiens
taccatttgagagagaacataa

SEQ ID NO: 8351451 - DNA, 22 bp, Homo sapiens
taccatttctacatatcttgtc

SEQ ID NO: 8351452 - DNA, 22 bp, Homo sapiens
taccacagacagatttcagtaa

SEQ ID NO: 8351453 - DNA, 22 bp, Homo sapiens
taccatttcagtaaaaacttag

SEQ ID NO: 8351454 - DNA, 22 bp, Homo sapiens
taccatttcagtaaaaacttag

SEQ ID NO: 8351455 - DNA, 22 bp, Homo sapiens
tacatgaatgtttcaatattgt

SEQ ID NO: 8351456 - DNA, 22 bp, Homo sapiens
tacatgaagatgaatgtatggc

SEQ ID NO: 8351457 - DNA, 22 bp, Homo sapiens
tacatgaagatgaatgtatggc

SEQ ID NO: 8351458 - DNA, 22 bp, Homo sapiens
tacatgaagaaaattaagcagt

SEQ ID NO: 8351459 - DNA, 22 bp, Homo sapiens
tacagttaaaaagttcaatggt

SEQ ID NO: 8351460 - DNA, 22 bp, Homo sapiens
tacatgaatttgagtcagagga

SEQ ID NO: 8351461 - DNA, 22 bp, Homo sapiens
tacatgctcagtaactttcagt

SEQ ID NO: 8351462 - DNA, 22 bp, Homo sapiens
tacatgtaattttcatagtaag

SEQ ID NO: 8351463 - DNA, 22 bp, Homo sapiens
tacatgtatgtgttaatatctg

SEQ ID NO: 8351464 - DNA, 22 bp, Homo sapiens
tacatgtaattttcatagtaag

SEQ ID NO: 8351465 - DNA, 22 bp, Homo sapiens
tacatgtacatgcataggtaga

SEQ ID NO: 8351466 - DNA, 22 bp, Homo sapiens
tacagtatgttcttgaatttgg

SEQ ID NO: 8351467 - DNA, 22 bp, Homo sapiens
tacagaggctgggttttcaggg

SEQ ID NO: 8351468 - DNA, 22 bp, Homo sapiens
tacagaggggacatggaagaca

SEQ ID NO: 8351469 - DNA, 22 bp, Homo sapiens
tacagagggtaattgatcaagg

SEQ ID NO: 8351470 - DNA, 22 bp, Homo sapiens
tacagtatagaatgtgtattaa

SEQ ID NO: 8351471 - DNA, 22 bp, Homo sapiens
tacagagatgccgaagagtgaa

SEQ ID NO: 8351472 - DNA, 22 bp, Homo sapiens
tacagagatactctagatcaaa

SEQ ID NO: 8351473 - DNA, 22 bp, Homo sapiens
tacagagatactctagatcaaa

SEQ ID NO: 8351474 - DNA, 22 bp, Homo sapiens
tacagagatttattgctaaggc

SEQ ID NO: 8351475 - DNA, 22 bp, Homo sapiens
tacagtatttgaagaatatgag

SEQ ID NO: 8351476 - DNA, 21 bp, Homo sapiens
tacagtgaggtgttaggatgt

SEQ ID NO: 8351477 - DNA, 22 bp, Homo sapiens
tacagtgctttttggtggagaa

SEQ ID NO: 8351478 - DNA, 22 bp, Homo sapiens
tacagtgcttggtatctagtaa

SEQ ID NO: 8351479 - DNA, 20 bp, Homo sapiens
tacagtgtatgtatttaggc

SEQ ID NO: 8351480 - DNA, 22 bp, Homo sapiens
tacagtgctagaacctgctgta

SEQ ID NO: 8351481 - DNA, 22 bp, Homo sapiens
tacagtgcatagaggcatgata

SEQ ID NO: 8351482 - DNA, 22 bp, Homo sapiens
tacagtgcgatttttaggcctc

SEQ ID NO: 8351483 - DNA, 22 bp, Homo sapiens
tacagtgcgggtgcgggcctct

SEQ ID NO: 8351484 - DNA, 22 bp, Homo sapiens
tacagtgcaatgtgatgtagat

SEQ ID NO: 8351485 - DNA, 22 bp, Homo sapiens
tacagtgcacatttcttaggaa

SEQ ID NO: 8351486 - DNA, 22 bp, Homo sapiens
tacaacataacgggcattcagt

SEQ ID NO: 8351487 - DNA, 22 bp, Homo sapiens
tacaacatgtaaagtggtttaa

SEQ ID NO: 8351488 - DNA, 22 bp, Homo sapiens
taatttatggtatgtgtgtaat

SEQ ID NO: 8351489 - DNA, 22 bp, Homo sapiens
taatttatttcaactgccaagg

SEQ ID NO: 8351490 - DNA, 22 bp, Homo sapiens
tacaagaaactacatgaatgca

SEQ ID NO: 8351491 - DNA, 22 bp, Homo sapiens
tacaacatttacgttaggctgt

SEQ ID NO: 8351492 - DNA, 22 bp, Homo sapiens
tacaagacgagggaagttcttt

SEQ ID NO: 8351493 - DNA, 21 bp, Homo sapiens
tacaagaccggattcgggccc

SEQ ID NO: 8351494 - DNA, 22 bp, Homo sapiens
tacaagaaggaaaactagcaat

SEQ ID NO: 8351495 - DNA, 22 bp, Homo sapiens
tacaagaaggatggagcccact

SEQ ID NO: 8351496 - DNA, 22 bp, Homo sapiens
tacaagaatgtcttaaaagctc

SEQ ID NO: 8351497 - DNA, 20 bp, Homo sapiens
tacaagaatccccagttgtc

SEQ ID NO: 8351498 - DNA, 22 bp, Homo sapiens
tacaagctcacaaatttttaag

SEQ ID NO: 8351499 - DNA, 22 bp, Homo sapiens
tacacaatctgtttttccattt

SEQ ID NO: 8351500 - DNA, 22 bp, Homo sapiens
tacaagagtgagattatcatgt

SEQ ID NO: 8351501 - DNA, 22 bp, Homo sapiens
tacaagagtgagattatcatgt

SEQ ID NO: 8351502 - DNA, 21 bp, Homo sapiens
tacaagatagaggtaatatat

SEQ ID NO: 8351503 - DNA, 22 bp, Homo sapiens
tacagacagtttttcagatatt

SEQ ID NO: 8351504 - DNA, 21 bp, Homo sapiens
tacagaatgcgcttcagtctg

SEQ ID NO: 8351505 - DNA, 22 bp, Homo sapiens
tacagaatgtgtatcattacca

SEQ ID NO: 8351506 - DNA, 22 bp, Homo sapiens
tacagaattagattattagaga

SEQ ID NO: 8351507 - DNA, 22 bp, Homo sapiens
tacagaatgttatgaagcatag

SEQ ID NO: 8351508 - DNA, 22 bp, Homo sapiens
tacagaatgttatgaagcatag

SEQ ID NO: 8351509 - DNA, 22 bp, Homo sapiens
tacacataggagggtaataaaa

SEQ ID NO: 8351510 - DNA, 22 bp, Homo sapiens
tacagaatatagaagctggaag

SEQ ID NO: 8351511 - DNA, 20 bp, Homo sapiens
tacagaatgcaataaaatgg

SEQ ID NO: 8351512 - DNA, 22 bp, Homo sapiens
tacacaattagttgcaaagtga

SEQ ID NO: 8351513 - DNA, 22 bp, Homo sapiens
tacacagtatatgggatcacag

SEQ ID NO: 8351514 - DNA, 22 bp, Homo sapiens
tacacagtaaatggtaaataca

SEQ ID NO: 8351515 - DNA, 22 bp, Homo sapiens
tacacagaacctggtgtacagt

SEQ ID NO: 8351516 - DNA, 22 bp, Homo sapiens
tacacagttttgctcccatgat

SEQ ID NO: 8351517 - DNA, 22 bp, Homo sapiens
taatttatatggaattgttgct

SEQ ID NO: 8351518 - DNA, 22 bp, Homo sapiens
taattgctattggaatgctttg

SEQ ID NO: 8351519 - DNA, 22 bp, Homo sapiens
taattctagattgacattttga

SEQ ID NO: 8351520 - DNA, 22 bp, Homo sapiens
taattatttgaagacattagag

SEQ ID NO: 8351521 - DNA, 22 bp, Homo sapiens
taatatatttctgctaagctca

SEQ ID NO: 8351522 - DNA, 22 bp, Homo sapiens
taatatatttctgctaagctca

SEQ ID NO: 8351523 - DNA, 22 bp, Homo sapiens
taatctgttgactaacttggga

SEQ ID NO: 8351524 - DNA, 22 bp, Homo sapiens
taattattgtctgaagagttat

SEQ ID NO: 8351525 - DNA, 22 bp, Homo sapiens
taatatatacctttgttaggaa

SEQ ID NO: 8351526 - DNA, 22 bp, Homo sapiens
taatataccaaactgtaatttt

SEQ ID NO: 8351527 - DNA, 22 bp, Homo sapiens
taaggaaagtacatgttttgac

SEQ ID NO: 8351528 - DNA, 22 bp, Homo sapiens
taaggaaggggaaagacatgtc

SEQ ID NO: 8351529 - DNA, 22 bp, Homo sapiens
taagcattcaatgcttagcact

SEQ ID NO: 8351530 - DNA, 22 bp, Homo sapiens
taagcattcaatgcttagcact

SEQ ID NO: 8351531 - DNA, 22 bp, Homo sapiens
taacatgcattgacaaatattt

SEQ ID NO: 8351532 - DNA, 22 bp, Homo sapiens
taacatgctaatttgcagatag

SEQ ID NO: 8351533 - DNA, 22 bp, Homo sapiens
taacatgctaggaagagtgatt

SEQ ID NO: 8351534 - DNA, 22 bp, Homo sapiens
taacatgatttgctatttagat

SEQ ID NO: 8351535 - DNA, 22 bp, Homo sapiens
taagacatcattaaacagcaat

SEQ ID NO: 8351536 - DNA, 22 bp, Homo sapiens
taagacatttgaaatgtgatcc

SEQ ID NO: 8351537 - DNA, 22 bp, Homo sapiens
taagacatggttgatctagtgt

SEQ ID NO: 8351538 - DNA, 22 bp, Homo sapiens
taagactagttgaatggttttc

SEQ ID NO: 8351539 - DNA, 22 bp, Homo sapiens
taagacttaggtcgagtttggc

SEQ ID NO: 8351540 - DNA, 22 bp, Homo sapiens
taagaccagtatgcattttcac

SEQ ID NO: 8351541 - DNA, 22 bp, Homo sapiens
taagagcactgaagtcttctta

SEQ ID NO: 8351542 - DNA, 22 bp, Homo sapiens
taagacttcattagtaatatgg

SEQ ID NO: 8351543 - DNA, 22 bp, Homo sapiens
taagagaactggatagatagga

SEQ ID NO: 8351544 - DNA, 22 bp, Homo sapiens
taagagcattgtaaaataatct

SEQ ID NO: 8351545 - DNA, 22 bp, Homo sapiens
taagagcagaggttgaataaat

SEQ ID NO: 8351546 - DNA, 22 bp, Homo sapiens
taagagctcccttctccttgca

SEQ ID NO: 8351547 - DNA, 20 bp, Homo sapiens
taacagttgaagaacaagga

SEQ ID NO: 8351548 - DNA, 22 bp, Homo sapiens
taacagtgtggacttgagatct

SEQ ID NO: 8351549 - DNA, 22 bp, Homo sapiens
taacagtacatccttttctctt

SEQ ID NO: 8351550 - DNA, 22 bp, Homo sapiens
taacatcttattggcaaagata

SEQ ID NO: 8351551 - DNA, 20 bp, Homo sapiens
taacaggaagcattatttta

SEQ ID NO: 8351552 - DNA, 22 bp, Homo sapiens
taacagcatatgaaattactgg

SEQ ID NO: 8351553 - DNA, 22 bp, Homo sapiens
taaatgtttagtcttatttggg

SEQ ID NO: 8351554 - DNA, 22 bp, Homo sapiens
taaatgttgtaagtacatctaa

SEQ ID NO: 8351555 - DNA, 22 bp, Homo sapiens
taaatgttgtaagtacatctaa

SEQ ID NO: 8351556 - DNA, 22 bp, Homo sapiens
taaatgttgtaagtacatctaa

SEQ ID NO: 8351557 - DNA, 22 bp, Homo sapiens
taaatgttactttcctttcaca

SEQ ID NO: 8351558 - DNA, 22 bp, Homo sapiens
taaatgttatgcccatcatcca

SEQ ID NO: 8351559 - DNA, 22 bp, Homo sapiens
taaatgctcaataaatgttgct

SEQ ID NO: 8351560 - DNA, 22 bp, Homo sapiens
taaaagctgagatatcctgtac

SEQ ID NO: 8351561 - DNA, 21 bp, Homo sapiens
taaaactgtaactttgtcctg

SEQ ID NO: 8351562 - DNA, 22 bp, Homo sapiens
taaaagaagcttcaaggccggc

SEQ ID NO: 8351563 - DNA, 22 bp, Homo sapiens
taaaagaagcttcaaggccggc

SEQ ID NO: 8351564 - DNA, 22 bp, Homo sapiens
taaagatgcccacattgcaggt

SEQ ID NO: 8351565 - DNA, 22 bp, Homo sapiens
taaagcaaaaatgaactgccat

SEQ ID NO: 8351566 - DNA, 22 bp, Homo sapiens
taaagcacgtctatttaatgat

SEQ ID NO: 8351567 - DNA, 22 bp, Homo sapiens
taaagcacatatcttacaataa

SEQ ID NO: 8351568 - DNA, 22 bp, Homo sapiens
taaatgcaagggaaaggcaaga

SEQ ID NO: 8351569 - DNA, 22 bp, Homo sapiens
taaatgcagtacaaattgttct

SEQ ID NO: 8351570 - DNA, 22 bp, Homo sapiens
taaatgcaatgtgctttaccag

SEQ ID NO: 8351571 - DNA, 22 bp, Homo sapiens
taaatgcagcagtttctgttct

SEQ ID NO: 8351572 - DNA, 22 bp, Homo sapiens
taaatgcagttagtacttgcca

SEQ ID NO: 8351573 - DNA, 20 bp, Homo sapiens
taaatgcatgaatgtaaggc

SEQ ID NO: 8351574 - DNA, 22 bp, Homo sapiens
gtttcagaaatggtttatgcaa

SEQ ID NO: 8351575 - DNA, 22 bp, Homo sapiens
gtttgaaaaaagcagtatgtaa

SEQ ID NO: 8351576 - DNA, 22 bp, Homo sapiens
gtttgcataaagtggatgcagg

SEQ ID NO: 8351577 - DNA, 22 bp, Homo sapiens
gtttgcatatctgtgaaatgga

SEQ ID NO: 8351578 - DNA, 21 bp, Homo sapiens
gtttgcatgaacaagtcagcc

SEQ ID NO: 8351579 - DNA, 22 bp, Homo sapiens
gtttgcatggaagacagtgagt

SEQ ID NO: 8351580 - DNA, 22 bp, Homo sapiens
gtttgcatatttgcacaggaat

SEQ ID NO: 8351581 - DNA, 22 bp, Homo sapiens
gtttgcatatttgcacaggaat

SEQ ID NO: 8351582 - DNA, 22 bp, Homo sapiens
gtttgattcaagaacaaagagt

SEQ ID NO: 8351583 - DNA, 22 bp, Homo sapiens
gtttgcatgtgtacttaattgg

SEQ ID NO: 8351584 - DNA, 17 bp, Homo sapiens
gtttgcatggtgttaac

SEQ ID NO: 8351585 - DNA, 22 bp, Homo sapiens
gtttgcatgtattaagtcaata

SEQ ID NO: 8351586 - DNA, 22 bp, Homo sapiens
gtttgcattccaatttagggga

SEQ ID NO: 8351587 - DNA, 22 bp, Homo sapiens
gtttgtcaatgacttaggcgtt

SEQ ID NO: 8351588 - DNA, 22 bp, Homo sapiens
gtttgtcttaattaggcatcga

SEQ ID NO: 8351589 - DNA, 22 bp, Homo sapiens
gtttgtcatttgtacttctagc

SEQ ID NO: 8351590 - DNA, 22 bp, Homo sapiens
gtttcaaagtcagaaaaggagg

SEQ ID NO: 8351591 - DNA, 22 bp, Homo sapiens
gttgaaatcctaaccccctagt

SEQ ID NO: 8351592 - DNA, 21 bp, Homo sapiens
gttcttgcaggatttccttcc

SEQ ID NO: 8351593 - DNA, 21 bp, Homo sapiens
gtgctgggacacagccaggct

SEQ ID NO: 8351594 - DNA, 22 bp, Homo sapiens
gtgttattagagcattaatttt

SEQ ID NO: 8351595 - DNA, 22 bp, Homo sapiens
gtgttccatgtttgaggtagtt

SEQ ID NO: 8351596 - DNA, 18 bp, Homo sapiens
gttaacaattactaacgc

SEQ ID NO: 8351597 - DNA, 22 bp, Homo sapiens
gtgtttccagttcagaaagcaa

SEQ ID NO: 8351598 - DNA, 22 bp, Homo sapiens
gtgtttcctagtttaatgaatg

SEQ ID NO: 8351599 - DNA, 22 bp, Homo sapiens
gtgtttcctcacttctctgact

SEQ ID NO: 8351600 - DNA, 21 bp, Homo sapiens
gtgtttcctgtttatggcttg

SEQ ID NO: 8351601 - DNA, 22 bp, Homo sapiens
gtgtttcctctagaagccatgg

SEQ ID NO: 8351602 - DNA, 22 bp, Homo sapiens
gttatattggcagaagagaaga

SEQ ID NO: 8351603 - DNA, 22 bp, Homo sapiens
gttatattgccaagtatattgt

SEQ ID NO: 8351604 - DNA, 22 bp, Homo sapiens
gttatataagacaaatcagagt

SEQ ID NO: 8351605 - DNA, 22 bp, Homo sapiens
gttatagccatgcttatttgtt

SEQ ID NO: 8351606 - DNA, 22 bp, Homo sapiens
gttatataattcctgtggtagt

SEQ ID NO: 8351607 - DNA, 22 bp, Homo sapiens
gttatatatagtatttctctga

SEQ ID NO: 8351608 - DNA, 18 bp, Homo sapiens
gttatagcagcagcattt

SEQ ID NO: 8351609 - DNA, 22 bp, Homo sapiens
gttcttcatcattaacactctg

SEQ ID NO: 8351610 - DNA, 22 bp, Homo sapiens
gttcttcatcttaaccatctgt

SEQ ID NO: 8351611 - DNA, 22 bp, Homo sapiens
gttattttaacttctcagtaat

SEQ ID NO: 8351612 - DNA, 22 bp, Homo sapiens
gttatttaactttgtagcatgg

SEQ ID NO: 8351613 - DNA, 22 bp, Homo sapiens
gccaccctgagctgggccaggg

SEQ ID NO: 8351614 - DNA, 22 bp, Homo sapiens
gcatttcagagaaaatctgctt

SEQ ID NO: 8351615 - DNA, 22 bp, Homo sapiens
gcattgtcaaaagtggtatgac

SEQ ID NO: 8351616 - DNA, 22 bp, Homo sapiens
gcattgtcctgcttctgagtgt

SEQ ID NO: 8351617 - DNA, 23 bp, Homo sapiens
gcattgtctccccacttctgggc

SEQ ID NO: 8351618 - DNA, 22 bp, Homo sapiens
gcatttaaatttgaacttcaga

SEQ ID NO: 8351619 - DNA, 22 bp, Homo sapiens
gcatttacatggagctatctaa

SEQ ID NO: 8351620 - DNA, 22 bp, Homo sapiens
gccacccttgcgtcactgacat

SEQ ID NO: 8351621 - DNA, 22 bp, Homo sapiens
gcaggtgattcaccctgggcct

SEQ ID NO: 8351622 - DNA, 22 bp, Homo sapiens
gcagttctatattattcttggg

SEQ ID NO: 8351623 - DNA, 22 bp, Homo sapiens
gcagtttactgtcaataactct

SEQ ID NO: 8351624 - DNA, 22 bp, Homo sapiens
gcagtttagtagatgacattat

SEQ ID NO: 8351625 - DNA, 22 bp, Homo sapiens
gcagtttgtttgtggacacctt

SEQ ID NO: 8351626 - DNA, 22 bp, Homo sapiens
gcagtttgctggactaatgaag

SEQ ID NO: 8351627 - DNA, 22 bp, Homo sapiens
gcagtttgaaagtatgagtcca

SEQ ID NO: 8351628 - DNA, 22 bp, Homo sapiens
gcccaagagttaagtctctgct

SEQ ID NO: 8351629 - DNA, 22 bp, Homo sapiens
gcccaagaatatttcccaagtt

SEQ ID NO: 8351630 - DNA, 23 bp, Homo sapiens
gccaggctccggtctgtggccac

SEQ ID NO: 8351631 - DNA, 22 bp, Homo sapiens
gccaggctaagaaaggtgtgat

SEQ ID NO: 8351632 - DNA, 22 bp, Homo sapiens
gccagctgaggccgtgcaggct

SEQ ID NO: 8351633 - DNA, 22 bp, Homo sapiens
gccagctgtaggtggtgggttg

SEQ ID NO: 8351634 - DNA, 22 bp, Homo sapiens
gccacttgtgtaagcgcctgtc

SEQ ID NO: 8351635 - DNA, 22 bp, Homo sapiens
gccaggaaaaagggtggccaat

SEQ ID NO: 8351636 - DNA, 22 bp, Homo sapiens
gccaggaaaaaccggccctgct

SEQ ID NO: 8351637 - DNA, 22 bp, Homo sapiens
gccaggaaggctccctggtcac

SEQ ID NO: 8351638 - DNA, 22 bp, Homo sapiens
gccaggaagttgggccagtcta

SEQ ID NO: 8351639 - DNA, 22 bp, Homo sapiens
gccaggaatcactgctgagtaa

SEQ ID NO: 8351640 - DNA, 22 bp, Homo sapiens
gccaggaaattcatgccagatc

SEQ ID NO: 8351641 - DNA, 22 bp, Homo sapiens
gccctgcctgtctgctgggagg

SEQ ID NO: 8351642 - DNA, 17 bp, Homo sapiens
gccctgcctgctgccct

SEQ ID NO: 8351643 - DNA, 22 bp, Homo sapiens
gccctgcgccgtcccgctggtg

SEQ ID NO: 8351644 - DNA, 22 bp, Homo sapiens
gccctgcctgtctgctgggagg

SEQ ID NO: 8351645 - DNA, 22 bp, Homo sapiens
gccctgctctggtctctgcccg

SEQ ID NO: 8351646 - DNA, 22 bp, Homo sapiens
gccctgctcttttgcccaccca

SEQ ID NO: 8351647 - DNA, 22 bp, Homo sapiens
gccctgctgctggcagaggcgc

SEQ ID NO: 8351648 - DNA, 22 bp, Homo sapiens
gccctgctgcgcagcacgcatg

SEQ ID NO: 8351649 - DNA, 23 bp, Homo sapiens
gccctgctgggacctcctgctac

SEQ ID NO: 8351650 - DNA, 23 bp, Homo sapiens
gccctgctgggacctcctgctac

SEQ ID NO: 8351651 - DNA, 22 bp, Homo sapiens
gccctggaaaggaacctgggct

SEQ ID NO: 8351652 - DNA, 22 bp, Homo sapiens
gccctggaatctctccatggga

SEQ ID NO: 8351653 - DNA, 22 bp, Homo sapiens
gccctgcttctggcatgcagaa

SEQ ID NO: 8351654 - DNA, 22 bp, Homo sapiens
gcctcagggggagaggccagct

SEQ ID NO: 8351655 - DNA, 20 bp, Homo sapiens
gcctccaccccaggcttcag

SEQ ID NO: 8351656 - DNA, 18 bp, Homo sapiens
gcctccaccatggagggt

SEQ ID NO: 8351657 - DNA, 19 bp, Homo sapiens
gcctcatttccacctcccc

SEQ ID NO: 8351658 - DNA, 22 bp, Homo sapiens
gcctcaggtgcatctctcattc

SEQ ID NO: 8351659 - DNA, 21 bp, Homo sapiens
gccctaggctacctggagcgc

SEQ ID NO: 8351660 - DNA, 22 bp, Homo sapiens
gccctaggcttttgtgactgcc

SEQ ID NO: 8351661 - DNA, 22 bp, Homo sapiens
gccctagggcttttgggcctgt

SEQ ID NO: 8351662 - DNA, 22 bp, Homo sapiens
gccctagcgccagctcagcacc

SEQ ID NO: 8351663 - DNA, 21 bp, Homo sapiens
gccctaggctacctggagcgc

SEQ ID NO: 8351664 - DNA, 22 bp, Homo sapiens
gccctagggggaaccgaggact

SEQ ID NO: 8351665 - DNA, 22 bp, Homo sapiens
gccctgagttgagccttccaaa

SEQ ID NO: 8351666 - DNA, 22 bp, Homo sapiens
gcccgtgtgcagagtgggagct

SEQ ID NO: 8351667 - DNA, 22 bp, Homo sapiens
gccctacctcagtccagatctg

SEQ ID NO: 8351668 - DNA, 22 bp, Homo sapiens
gccctagccatcctgtgctctg

SEQ ID NO: 8351669 - DNA, 22 bp, Homo sapiens
gccccttctctgaggaacctgc

SEQ ID NO: 8351670 - DNA, 22 bp, Homo sapiens
gcccacagaggcaccaccaggc

SEQ ID NO: 8351671 - DNA, 22 bp, Homo sapiens
gcccctcccagtcaggagcact

SEQ ID NO: 8351672 - DNA, 22 bp, Homo sapiens
gcccctggctggccagctcctc

SEQ ID NO: 8351673 - DNA, 22 bp, Homo sapiens
gcccctgcctttgaacctggag

SEQ ID NO: 8351674 - DNA, 22 bp, Homo sapiens
gcctccactgatcagacttgac

SEQ ID NO: 8351675 - DNA, 22 bp, Homo sapiens
gcctccaccgaacgctctcttg

SEQ ID NO: 8351676 - DNA, 22 bp, Homo sapiens
gcctccacccctggggagtgga

SEQ ID NO: 8351677 - DNA, 22 bp, Homo sapiens
gcctgagggctcctagcaggct

SEQ ID NO: 8351678 - DNA, 22 bp, Homo sapiens
gcctgcagccagggagttctct

SEQ ID NO: 8351679 - DNA, 22 bp, Homo sapiens
gcctgcagaactgtgaggcaat

SEQ ID NO: 8351680 - DNA, 22 bp, Homo sapiens
gcctgccaaaagaagctgctgg

SEQ ID NO: 8351681 - DNA, 20 bp, Homo sapiens
gcctgcaggttggatgggat

SEQ ID NO: 8351682 - DNA, 22 bp, Homo sapiens
gcctggagaaaggaaggtggga

SEQ ID NO: 8351683 - DNA, 22 bp, Homo sapiens
gcctggagacagcagaggcggc

SEQ ID NO: 8351684 - DNA, 22 bp, Homo sapiens
gcctggagcccagtgtggggct

SEQ ID NO: 8351685 - DNA, 22 bp, Homo sapiens
gcctggagtgcagtggcgtgat

SEQ ID NO: 8351686 - DNA, 22 bp, Homo sapiens
gcctggagacctgctcctctac

SEQ ID NO: 8351687 - DNA, 22 bp, Homo sapiens
gcctggagacctgctcctctac

SEQ ID NO: 8351688 - DNA, 22 bp, Homo sapiens
gcctggagaggaagccggtgga

SEQ ID NO: 8351689 - DNA, 22 bp, Homo sapiens
gcctggagcagacgtgtcccgg

SEQ ID NO: 8351690 - DNA, 22 bp, Homo sapiens
gcctggagaggaagccggtgga

SEQ ID NO: 8351691 - DNA, 17 bp, Homo sapiens
gcagccagtgcagcagg

SEQ ID NO: 8351692 - DNA, 22 bp, Homo sapiens
gcagccagtatcctctgagatt

SEQ ID NO: 8351693 - DNA, 22 bp, Homo sapiens
gcagccaggaagcccaggacac

SEQ ID NO: 8351694 - DNA, 22 bp, Homo sapiens
gcagccagtgggatgagaaaga

SEQ ID NO: 8351695 - DNA, 22 bp, Homo sapiens
gcagctggctcagagaggtggg

SEQ ID NO: 8351696 - DNA, 22 bp, Homo sapiens
gcagctgggccccagcctctcc

SEQ ID NO: 8351697 - DNA, 22 bp, Homo sapiens
gcagctggtctggcctagagta

SEQ ID NO: 8351698 - DNA, 21 bp, Homo sapiens
gcagctggtctcagagcttgc

SEQ ID NO: 8351699 - DNA, 22 bp, Homo sapiens
gcagcaatcttcacagtgtcat

SEQ ID NO: 8351700 - DNA, 21 bp, Homo sapiens
gcagccagccgagaccatgcc

SEQ ID NO: 8351701 - DNA, 22 bp, Homo sapiens
gcagccagccctagtcccactt

SEQ ID NO: 8351702 - DNA, 22 bp, Homo sapiens
gcagccaggaaagctggaccct

SEQ ID NO: 8351703 - DNA, 21 bp, Homo sapiens
gcagccagacgggattcagtt

SEQ ID NO: 8351704 - DNA, 22 bp, Homo sapiens
gcagccagagggggtgtgatca

SEQ ID NO: 8351705 - DNA, 22 bp, Homo sapiens
gcagccagcccctctgacctct

SEQ ID NO: 8351706 - DNA, 22 bp, Homo sapiens
gcagccagcaggaagcgggaga

SEQ ID NO: 8351707 - DNA, 22 bp, Homo sapiens
gcagccactgggagtgcttata

SEQ ID NO: 8351708 - DNA, 21 bp, Homo sapiens
gcagccactgccttcaacaat

SEQ ID NO: 8351709 - DNA, 22 bp, Homo sapiens
gcagccactctcattccacgtg

SEQ ID NO: 8351710 - DNA, 22 bp, Homo sapiens
gcagccactttgcaaccaagag

SEQ ID NO: 8351711 - DNA, 22 bp, Homo sapiens
gcagccactttgcaaccaagag

SEQ ID NO: 8351712 - DNA, 22 bp, Homo sapiens
gcagccacctcccatggcgggg

SEQ ID NO: 8351713 - DNA, 22 bp, Homo sapiens
gcagccactagttttcctgttt

SEQ ID NO: 8351714 - DNA, 19 bp, Homo sapiens
gcagccaccgcggcggccg

SEQ ID NO: 8351715 - DNA, 22 bp, Homo sapiens
gcagccaccctcaaggctgaat

SEQ ID NO: 8351716 - DNA, 21 bp, Homo sapiens
gcagccacagccaccaagcta

SEQ ID NO: 8351717 - DNA, 22 bp, Homo sapiens
gcagccacagaggagggatgca

SEQ ID NO: 8351718 - DNA, 22 bp, Homo sapiens
gcagcagcccagggctctcaga

SEQ ID NO: 8351719 - DNA, 19 bp, Homo sapiens
gcagggtgttgactgtccc

SEQ ID NO: 8351720 - DNA, 22 bp, Homo sapiens
gcagggccagggctcaggctgt

SEQ ID NO: 8351721 - DNA, 22 bp, Homo sapiens
gcagggcaggatttgaacccag

SEQ ID NO: 8351722 - DNA, 22 bp, Homo sapiens
gcagggccaggtacaagaagca

SEQ ID NO: 8351723 - DNA, 22 bp, Homo sapiens
gcagggccagtgcagagaggaa

SEQ ID NO: 8351724 - DNA, 22 bp, Homo sapiens
gcagggtgtgtctcatacagtt

SEQ ID NO: 8351725 - DNA, 22 bp, Homo sapiens
gcagggtgtgtctcatacagtt

SEQ ID NO: 8351726 - DNA, 22 bp, Homo sapiens
gcagggccagtgcagagaggaa

SEQ ID NO: 8351727 - DNA, 19 bp, Homo sapiens
gcagggtggcagagctctt

SEQ ID NO: 8351728 - DNA, 22 bp, Homo sapiens
gcagggcagccacaggccccct

SEQ ID NO: 8351729 - DNA, 22 bp, Homo sapiens
gcagggcagcttagtccctgtc

SEQ ID NO: 8351730 - DNA, 22 bp, Homo sapiens
gcaggcctcccctgctggagct

SEQ ID NO: 8351731 - DNA, 19 bp, Homo sapiens
gcaggcccagtcgggctgg

SEQ ID NO: 8351732 - DNA, 22 bp, Homo sapiens
gcaggccagctgtgcagatggg

SEQ ID NO: 8351733 - DNA, 22 bp, Homo sapiens
gcaggcccagagtcgctggcct

SEQ ID NO: 8351734 - DNA, 22 bp, Homo sapiens
gcaggccaagccctcgcagaga

SEQ ID NO: 8351735 - DNA, 21 bp, Homo sapiens
gcaggcatgtctactgcatgt

SEQ ID NO: 8351736 - DNA, 23 bp, Homo sapiens
gcagctggttagaagggaaggag

SEQ ID NO: 8351737 - DNA, 22 bp, Homo sapiens
gagtcaacaagtcagatctcac

SEQ ID NO: 8351738 - DNA, 22 bp, Homo sapiens
gagtacatgtatagagattaac

SEQ ID NO: 8351739 - DNA, 22 bp, Homo sapiens
gcaataaagtagcagctcatca

SEQ ID NO: 8351740 - DNA, 22 bp, Homo sapiens
gcacagagggcagtgagcctct

SEQ ID NO: 8351741 - DNA, 22 bp, Homo sapiens
gcaatagactgtttttattgtt

SEQ ID NO: 8351742 - DNA, 22 bp, Homo sapiens
gcaatagacttggttcttctgt

SEQ ID NO: 8351743 - DNA, 22 bp, Homo sapiens
gcacatgcgtgcttagaaagaa

SEQ ID NO: 8351744 - DNA, 22 bp, Homo sapiens
gcagatttctaataagcaatgt

SEQ ID NO: 8351745 - DNA, 22 bp, Homo sapiens
gcagagtgggagcccagggctg

SEQ ID NO: 8351746 - DNA, 22 bp, Homo sapiens
gcagatttcatttaaacctttc

SEQ ID NO: 8351747 - DNA, 22 bp, Homo sapiens
gcagagtgagccgaggctgctc

SEQ ID NO: 8351748 - DNA, 22 bp, Homo sapiens
gcagagtgagccgaggctgctc

SEQ ID NO: 8351749 - DNA, 22 bp, Homo sapiens
gcagagtgaagggagaggtgtg

SEQ ID NO: 8351750 - DNA, 22 bp, Homo sapiens
gcagagtgaggaagagcttcca

SEQ ID NO: 8351751 - DNA, 22 bp, Homo sapiens
gcagagtgaggaagagcttcca

SEQ ID NO: 8351752 - DNA, 22 bp, Homo sapiens
gcagagtgatggaatgtgggtg

SEQ ID NO: 8351753 - DNA, 22 bp, Homo sapiens
gcagagtgatggaatgtgggtg

SEQ ID NO: 8351754 - DNA, 18 bp, Homo sapiens
gcagagtgcgtctctgtg

SEQ ID NO: 8351755 - DNA, 22 bp, Homo sapiens
gcagaggtgctcagtggcagaa

SEQ ID NO: 8351756 - DNA, 22 bp, Homo sapiens
gcagaggtgtgggaggggccac

SEQ ID NO: 8351757 - DNA, 22 bp, Homo sapiens
gcagaggtgtgggaggggccac

SEQ ID NO: 8351758 - DNA, 22 bp, Homo sapiens
gcagacaggcccagtggaggga

SEQ ID NO: 8351759 - DNA, 22 bp, Homo sapiens
gcagaaggatccgcaggtgcaa

SEQ ID NO: 8351760 - DNA, 22 bp, Homo sapiens
gcacccagaggtcagcagtgct

SEQ ID NO: 8351761 - DNA, 22 bp, Homo sapiens
ggagccaggcatatcggggcac

SEQ ID NO: 8351762 - DNA, 17 bp, Homo sapiens
ggagccaggagcccacc

SEQ ID NO: 8351763 - DNA, 22 bp, Homo sapiens
ggagaaagtacagcaggcaaca

SEQ ID NO: 8351764 - DNA, 18 bp, Homo sapiens
ggagaagaacagatgtgg

SEQ ID NO: 8351765 - DNA, 18 bp, Homo sapiens
ggagccagtctgtctctg

SEQ ID NO: 8351766 - DNA, 22 bp, Homo sapiens
ggagccagtttagacctcagtt

SEQ ID NO: 8351767 - DNA, 22 bp, Homo sapiens
ggagccctagctgtgcatcaga

SEQ ID NO: 8351768 - DNA, 22 bp, Homo sapiens
ggagctgttgattgtttgagga

SEQ ID NO: 8351769 - DNA, 22 bp, Homo sapiens
ggaggaggcggcagaagttcct

SEQ ID NO: 8351770 - DNA, 22 bp, Homo sapiens
ggaggaggggcgctttgtctat

SEQ ID NO: 8351771 - DNA, 22 bp, Homo sapiens
ggaggaggggcgctttgtctat

SEQ ID NO: 8351772 - DNA, 21 bp, Homo sapiens
ggagctggggagctggcccca

SEQ ID NO: 8351773 - DNA, 22 bp, Homo sapiens
ggagctgggaccctgtcatctg

SEQ ID NO: 8351774 - DNA, 18 bp, Homo sapiens
ggagctgggcctggttcc

SEQ ID NO: 8351775 - DNA, 18 bp, Homo sapiens
ggagctgggccccactcc

SEQ ID NO: 8351776 - DNA, 22 bp, Homo sapiens
ggagctgggaccctgtcatctg

SEQ ID NO: 8351777 - DNA, 22 bp, Homo sapiens
ggagctgggaattggatcatct

SEQ ID NO: 8351778 - DNA, 22 bp, Homo sapiens
ggagctggctacagagaactcc

SEQ ID NO: 8351779 - DNA, 22 bp, Homo sapiens
ggagctgcatttagggagcctt

SEQ ID NO: 8351780 - DNA, 22 bp, Homo sapiens
ggaaggctttgaggggtgctgg

SEQ ID NO: 8351781 - DNA, 19 bp, Homo sapiens
ggaaggcagaggggctgtg

SEQ ID NO: 8351782 - DNA, 22 bp, Homo sapiens
ggaaggcagtgaaggggctgat

SEQ ID NO: 8351783 - DNA, 22 bp, Homo sapiens
ggacaggataagagacactgcc

SEQ ID NO: 8351784 - DNA, 19 bp, Homo sapiens
ggaaggagagaaatgcatg

SEQ ID NO: 8351785 - DNA, 22 bp, Homo sapiens
ggacaggccctctggtcagctt

SEQ ID NO: 8351786 - DNA, 22 bp, Homo sapiens
ggacaggcccggggagcctgga

SEQ ID NO: 8351787 - DNA, 22 bp, Homo sapiens
ggacaggcgcagggccaaggaa

SEQ ID NO: 8351788 - DNA, 22 bp, Homo sapiens
ggacaggccgcctcggtggggg

SEQ ID NO: 8351789 - DNA, 22 bp, Homo sapiens
ggacagggctcttggcactcct

SEQ ID NO: 8351790 - DNA, 22 bp, Homo sapiens
ggagaaaggataggaatgtgct

SEQ ID NO: 8351791 - DNA, 22 bp, Homo sapiens
ggagaaagctgtagtggaatgt

SEQ ID NO: 8351792 - DNA, 22 bp, Homo sapiens
ggagaaagctatgtgggggagt

SEQ ID NO: 8351793 - DNA, 22 bp, Homo sapiens
ggagaaagaaatttttgattgg

SEQ ID NO: 8351794 - DNA, 21 bp, Homo sapiens
ggacttacataggtaaggggt

SEQ ID NO: 8351795 - DNA, 22 bp, Homo sapiens
ggactgggtaggagcccagggc

SEQ ID NO: 8351796 - DNA, 22 bp, Homo sapiens
ggactggccggcgctgaggccc

SEQ ID NO: 8351797 - DNA, 22 bp, Homo sapiens
ggactgctgtggacagagtcat

SEQ ID NO: 8351798 - DNA, 22 bp, Homo sapiens
gctttatccgcttgacccttac

SEQ ID NO: 8351799 - DNA, 21 bp, Homo sapiens
gcttggagtagcttgaaggag

SEQ ID NO: 8351800 - DNA, 22 bp, Homo sapiens
gcttggggtcatgaggctgctg

SEQ ID NO: 8351801 - DNA, 22 bp, Homo sapiens
gctggtccactccctggaggct

SEQ ID NO: 8351802 - DNA, 22 bp, Homo sapiens
gctggtcccaatgtgtttcctt

SEQ ID NO: 8351803 - DNA, 23 bp, Homo sapiens
gctgtctgtcatctctgcgggag

SEQ ID NO: 8351804 - DNA, 22 bp, Homo sapiens
gctgtccaggttgtggagcaac

SEQ ID NO: 8351805 - DNA, 22 bp, Homo sapiens
gctgtccaacctgcactcgcgt

SEQ ID NO: 8351806 - DNA, 22 bp, Homo sapiens
gctgtccagagcatgggagcaa

SEQ ID NO: 8351807 - DNA, 23 bp, Homo sapiens
gctgtccccatgctccatccctg

SEQ ID NO: 8351808 - DNA, 22 bp, Homo sapiens
gctgtcccatggttgcaagatg

SEQ ID NO: 8351809 - DNA, 22 bp, Homo sapiens
gctgtccatgtctggcctcagt

SEQ ID NO: 8351810 - DNA, 20 bp, Homo sapiens
gctgtcccaggccaaagggc

SEQ ID NO: 8351811 - DNA, 22 bp, Homo sapiens
gctgtccctttcacaaggtttt

SEQ ID NO: 8351812 - DNA, 17 bp, Homo sapiens
gctgtcccttcaagagt

SEQ ID NO: 8351813 - DNA, 22 bp, Homo sapiens
gctgtcccgctgacttccagct

SEQ ID NO: 8351814 - DNA, 22 bp, Homo sapiens
gctgtcccgctgacttccagct

SEQ ID NO: 8351815 - DNA, 22 bp, Homo sapiens
gctctccaggtctcatgcactg

SEQ ID NO: 8351816 - DNA, 22 bp, Homo sapiens
gctctcccgcagcctggtgggc

SEQ ID NO: 8351817 - DNA, 19 bp, Homo sapiens
gctctccctctcagttgag

SEQ ID NO: 8351818 - DNA, 22 bp, Homo sapiens
gctccctcccaccagcctgcag

SEQ ID NO: 8351819 - DNA, 22 bp, Homo sapiens
gctctccaggtctcatgcactg

SEQ ID NO: 8351820 - DNA, 22 bp, Homo sapiens
gctctctgaggtgctggcagag

SEQ ID NO: 8351821 - DNA, 22 bp, Homo sapiens
gctccccaggctggtcccctcg

SEQ ID NO: 8351822 - DNA, 22 bp, Homo sapiens
gctccccattgatctgcaggct

SEQ ID NO: 8351823 - DNA, 22 bp, Homo sapiens
gctctgtgcccctgccgtggac

SEQ ID NO: 8351824 - DNA, 22 bp, Homo sapiens
gctctgtgctactttgaactct

SEQ ID NO: 8351825 - DNA, 22 bp, Homo sapiens
gctctgtgccagggctgggcca

SEQ ID NO: 8351826 - DNA, 22 bp, Homo sapiens
gctctgtggcattcatgggcag

SEQ ID NO: 8351827 - DNA, 22 bp, Homo sapiens
gctctgtgcaaatagcacccct

SEQ ID NO: 8351828 - DNA, 22 bp, Homo sapiens
gctctgtgccacatgcagtgtt

SEQ ID NO: 8351829 - DNA, 22 bp, Homo sapiens
gctctgtgaccttaggcaagtt

SEQ ID NO: 8351830 - DNA, 22 bp, Homo sapiens
gctctgtgaccttaggcaagtt

SEQ ID NO: 8351831 - DNA, 22 bp, Homo sapiens
gctctgtgaagggtgttgctca

SEQ ID NO: 8351832 - DNA, 22 bp, Homo sapiens
gctctgtgagccacttgatgta

SEQ ID NO: 8351833 - DNA, 22 bp, Homo sapiens
gctctgtgagtattggccctgg

SEQ ID NO: 8351834 - DNA, 22 bp, Homo sapiens
gctctgtcaacagctagctgtg

SEQ ID NO: 8351835 - DNA, 22 bp, Homo sapiens
gctctgtcattttgcagacact

SEQ ID NO: 8351836 - DNA, 20 bp, Homo sapiens
gctctgtctggcctactttt

SEQ ID NO: 8351837 - DNA, 22 bp, Homo sapiens
gctctgggtagccactgcctgg

SEQ ID NO: 8351838 - DNA, 22 bp, Homo sapiens
gctctctgcctttctcaatgac

SEQ ID NO: 8351839 - DNA, 22 bp, Homo sapiens
gctctctggaggccatggacag

SEQ ID NO: 8351840 - DNA, 22 bp, Homo sapiens
gctcagtgaagggtgccaagta

SEQ ID NO: 8351841 - DNA, 22 bp, Homo sapiens
gctcagtgcagcctttctgtat

SEQ ID NO: 8351842 - DNA, 22 bp, Homo sapiens
gctcagtgcatcattccaggct

SEQ ID NO: 8351843 - DNA, 22 bp, Homo sapiens
gctcagtgtttctggtagaaaa

SEQ ID NO: 8351844 - DNA, 20 bp, Homo sapiens
gctcagggcctgggtctgga

SEQ ID NO: 8351845 - DNA, 22 bp, Homo sapiens
gctcagggcctggctgcggact

SEQ ID NO: 8351846 - DNA, 22 bp, Homo sapiens
gctcagggagagagggcagccg

SEQ ID NO: 8351847 - DNA, 22 bp, Homo sapiens
gctcagggccatggaccagcag

SEQ ID NO: 8351848 - DNA, 22 bp, Homo sapiens
gctcagggagagagggcagccg

SEQ ID NO: 8351849 - DNA, 22 bp, Homo sapiens
gctcagggaactttttgcaggc

SEQ ID NO: 8351850 - DNA, 22 bp, Homo sapiens
gctagtgagatgcaactgatat

SEQ ID NO: 8351851 - DNA, 22 bp, Homo sapiens
gctagcagaaagcaggctgctc

SEQ ID NO: 8351852 - DNA, 17 bp, Homo sapiens
gctaggagagggaggag

SEQ ID NO: 8351853 - DNA, 19 bp, Homo sapiens
gctaggctggccttgaggg

SEQ ID NO: 8351854 - DNA, 22 bp, Homo sapiens
gctagaaatcgacttcagaatt

SEQ ID NO: 8351855 - DNA, 22 bp, Homo sapiens
gctagaaaatgaaagataattt

SEQ ID NO: 8351856 - DNA, 22 bp, Homo sapiens
gctggagttggcaaggcatgta

SEQ ID NO: 8351857 - DNA, 22 bp, Homo sapiens
gctggcagggttctcactgaaa

SEQ ID NO: 8351858 - DNA, 22 bp, Homo sapiens
gctggagtctggaggtgtgcca

SEQ ID NO: 8351859 - DNA, 22 bp, Homo sapiens
gctggagtccagtggtatgatc

SEQ ID NO: 8351860 - DNA, 22 bp, Homo sapiens
gctggagtgctgaggtgcagtg

SEQ ID NO: 8351861 - DNA, 22 bp, Homo sapiens
gctggagtacatctttggcggc

SEQ ID NO: 8351862 - DNA, 22 bp, Homo sapiens
gctggaggtttcacctgagttt

SEQ ID NO: 8351863 - DNA, 22 bp, Homo sapiens
gctggaggtggtgagaaaaggt

SEQ ID NO: 8351864 - DNA, 22 bp, Homo sapiens
gctggaggtggtgagaaaaggt

SEQ ID NO: 8351865 - DNA, 22 bp, Homo sapiens
gctggaggtggtgagaaaaggt

SEQ ID NO: 8351866 - DNA, 22 bp, Homo sapiens
gctggaggtagggaggtcctgt

SEQ ID NO: 8351867 - DNA, 22 bp, Homo sapiens
gctgctgcttgaaggctcggag

SEQ ID NO: 8351868 - DNA, 22 bp, Homo sapiens
gctggaggggtaataggatggg

SEQ ID NO: 8351869 - DNA, 22 bp, Homo sapiens
gctggaggggtaataggatggg

SEQ ID NO: 8351870 - DNA, 22 bp, Homo sapiens
gctggagctgcagcctgggcct

SEQ ID NO: 8351871 - DNA, 22 bp, Homo sapiens
gctgctgtctcatgcgatgcgg

SEQ ID NO: 8351872 - DNA, 22 bp, Homo sapiens
gctgctgtcagtctgaatctga

SEQ ID NO: 8351873 - DNA, 18 bp, Homo sapiens
gctgctggtggagggagc

SEQ ID NO: 8351874 - DNA, 18 bp, Homo sapiens
gctgcaggcgcctgcggt

SEQ ID NO: 8351875 - DNA, 22 bp, Homo sapiens
gctgagtgtaatgatggcagag

SEQ ID NO: 8351876 - DNA, 17 bp, Homo sapiens
gctgagtgcagggagtc

SEQ ID NO: 8351877 - DNA, 22 bp, Homo sapiens
gctgagtggagcagtcagcgct

SEQ ID NO: 8351878 - DNA, 22 bp, Homo sapiens
gctgagtgaggctgtcaaaatg

SEQ ID NO: 8351879 - DNA, 22 bp, Homo sapiens
gctctgtggcattcatgggcag

SEQ ID NO: 8351880 - DNA, 22 bp, Homo sapiens
gctctgtggcattcatgggcag

SEQ ID NO: 8351881 - DNA, 22 bp, Homo sapiens
gctctgtggtggggcagagttt

SEQ ID NO: 8351882 - DNA, 20 bp, Homo sapiens
gctctgtggtttgagtctcc

SEQ ID NO: 8351883 - DNA, 22 bp, Homo sapiens
gctctgtgtccacagctggaaa

SEQ ID NO: 8351884 - DNA, 22 bp, Homo sapiens
gctgcctcccagagccctgcag

SEQ ID NO: 8351885 - DNA, 22 bp, Homo sapiens
gctgcaggcggccgtggtggcg

SEQ ID NO: 8351886 - DNA, 22 bp, Homo sapiens
gctgcaggcgcctgcggtctct

SEQ ID NO: 8351887 - DNA, 22 bp, Homo sapiens
gctgcaggctctgcaggaattg

SEQ ID NO: 8351888 - DNA, 22 bp, Homo sapiens
gctgcaggctgtggcaggggag

SEQ ID NO: 8351889 - DNA, 22 bp, Homo sapiens
gctgcagggctctcacaggggg

SEQ ID NO: 8351890 - DNA, 22 bp, Homo sapiens
gctgcagggagctggaaggctc

SEQ ID NO: 8351891 - DNA, 22 bp, Homo sapiens
gctgcagggagctggaaggctc

SEQ ID NO: 8351892 - DNA, 21 bp, Homo sapiens
gggctatgttggccaccttcc

SEQ ID NO: 8351893 - DNA, 22 bp, Homo sapiens
gggcctcacctctccaccgcct

SEQ ID NO: 8351894 - DNA, 19 bp, Homo sapiens
gggcctcacccacacctcc

SEQ ID NO: 8351895 - DNA, 22 bp, Homo sapiens
gggcctcaaatctcccgcttat

SEQ ID NO: 8351896 - DNA, 22 bp, Homo sapiens
gggccctggggcctgatttgca

SEQ ID NO: 8351897 - DNA, 22 bp, Homo sapiens
gggccctggggcctgatttgca

SEQ ID NO: 8351898 - DNA, 22 bp, Homo sapiens
gggccggagctgggtcccgcgc

SEQ ID NO: 8351899 - DNA, 22 bp, Homo sapiens
gggccctgtgatttcttgagga

SEQ ID NO: 8351900 - DNA, 22 bp, Homo sapiens
gggccctgcctaaggaacacac

SEQ ID NO: 8351901 - DNA, 22 bp, Homo sapiens
gggccctgggattcagagcaag

SEQ ID NO: 8351902 - DNA, 22 bp, Homo sapiens
gggccctggggatgtggacgcg

SEQ ID NO: 8351903 - DNA, 22 bp, Homo sapiens
gggccctgatctgtgagcgcag

SEQ ID NO: 8351904 - DNA, 22 bp, Homo sapiens
gggccctctgcagctgcccagg

SEQ ID NO: 8351905 - DNA, 22 bp, Homo sapiens
gggccctgccccgtggctctga

SEQ ID NO: 8351906 - DNA, 22 bp, Homo sapiens
gggccctgccccgtggctctga

SEQ ID NO: 8351907 - DNA, 22 bp, Homo sapiens
gggccctgatctgtgagcgcag

SEQ ID NO: 8351908 - DNA, 22 bp, Homo sapiens
gggccccttgctgctctgctgg

SEQ ID NO: 8351909 - DNA, 22 bp, Homo sapiens
gggccccttgtatctctggctc

SEQ ID NO: 8351910 - DNA, 22 bp, Homo sapiens
gggccccagtcctcccacgtgg

SEQ ID NO: 8351911 - DNA, 22 bp, Homo sapiens
gggcaggtgtttccaaggtgag

SEQ ID NO: 8351912 - DNA, 22 bp, Homo sapiens
gggccccaaaatgccaggctct

SEQ ID NO: 8351913 - DNA, 22 bp, Homo sapiens
gggcccagtaccctctgccaag

SEQ ID NO: 8351914 - DNA, 22 bp, Homo sapiens
gggcaggtgcccagggccagag

SEQ ID NO: 8351915 - DNA, 22 bp, Homo sapiens
gggcaggtggagggcccagcca

SEQ ID NO: 8351916 - DNA, 22 bp, Homo sapiens
gggcaggtggcagggtctctgg

SEQ ID NO: 8351917 - DNA, 22 bp, Homo sapiens
gggcaggtgtgcagagctgttg

SEQ ID NO: 8351918 - DNA, 22 bp, Homo sapiens
gggctctgaatcccaggtctgc

SEQ ID NO: 8351919 - DNA, 22 bp, Homo sapiens
gggctctgaatgagttaccaag

SEQ ID NO: 8351920 - DNA, 22 bp, Homo sapiens
gggctctgaatgagttaccaag

SEQ ID NO: 8351921 - DNA, 22 bp, Homo sapiens
gggctctgagctctgggaatta

SEQ ID NO: 8351922 - DNA, 22 bp, Homo sapiens
gggctctggatggagcctgcag

SEQ ID NO: 8351923 - DNA, 22 bp, Homo sapiens
gggctctggatggagcctgcag

SEQ ID NO: 8351924 - DNA, 22 bp, Homo sapiens
gggctctggatggagcctgcag

SEQ ID NO: 8351925 - DNA, 22 bp, Homo sapiens
gggctctggacccaggcaagag

SEQ ID NO: 8351926 - DNA, 22 bp, Homo sapiens
gggctctggacccaggcaagag

SEQ ID NO: 8351927 - DNA, 22 bp, Homo sapiens
gggctctggagttctagaaaga

SEQ ID NO: 8351928 - DNA, 22 bp, Homo sapiens
gggctctggagttctagaaaga

SEQ ID NO: 8351929 - DNA, 22 bp, Homo sapiens
gggctctggaaggtgcaccatg

SEQ ID NO: 8351930 - DNA, 22 bp, Homo sapiens
gggctctggaaggtgcaccatg

SEQ ID NO: 8351931 - DNA, 22 bp, Homo sapiens
gggctctggaaatgggagctcc

SEQ ID NO: 8351932 - DNA, 22 bp, Homo sapiens
gggctctggaaatgggagctcc

SEQ ID NO: 8351933 - DNA, 22 bp, Homo sapiens
gggctcagctgggcgtgctggt

SEQ ID NO: 8351934 - DNA, 22 bp, Homo sapiens
gggctcagttctgcttcatgct

SEQ ID NO: 8351935 - DNA, 21 bp, Homo sapiens
gggctcagcgctcggctcctc

SEQ ID NO: 8351936 - DNA, 22 bp, Homo sapiens
gggctcagaggagtggcctggg

SEQ ID NO: 8351937 - DNA, 22 bp, Homo sapiens
gggctcagacatccctcctgga

SEQ ID NO: 8351938 - DNA, 22 bp, Homo sapiens
gggctcagccccattgaaccag

SEQ ID NO: 8351939 - DNA, 23 bp, Homo sapiens
gggctcagatttcattctgtgcc

SEQ ID NO: 8351940 - DNA, 22 bp, Homo sapiens
gggctcagccccattgaaccag

SEQ ID NO: 8351941 - DNA, 22 bp, Homo sapiens
gggctcagaggagtggcctggg

SEQ ID NO: 8351942 - DNA, 22 bp, Homo sapiens
gggcagagactcagaaacagaa

SEQ ID NO: 8351943 - DNA, 18 bp, Homo sapiens
gggatcaggctgcctagg

SEQ ID NO: 8351944 - DNA, 22 bp, Homo sapiens
gggcactgggtcttctccacgc

SEQ ID NO: 8351945 - DNA, 22 bp, Homo sapiens
gggcactggtgctgccatcttg

SEQ ID NO: 8351946 - DNA, 20 bp, Homo sapiens
gggcagagccagccagtccc

SEQ ID NO: 8351947 - DNA, 20 bp, Homo sapiens
gggcagagccagccagtccc

SEQ ID NO: 8351948 - DNA, 22 bp, Homo sapiens
gggcagagagctggaactcctt

SEQ ID NO: 8351949 - DNA, 22 bp, Homo sapiens
gggcagaggctctggcccatcc

SEQ ID NO: 8351950 - DNA, 21 bp, Homo sapiens
gggcagaggggcctcctgggt

SEQ ID NO: 8351951 - DNA, 15 bp, Homo sapiens
gggcaggtctggggc

SEQ ID NO: 8351952 - DNA, 22 bp, Homo sapiens
gggcaggtgcccagggccagag

SEQ ID NO: 8351953 - DNA, 22 bp, Homo sapiens
gggcaggtgccagctccctgtc

SEQ ID NO: 8351954 - DNA, 22 bp, Homo sapiens
gggcaggtgacctcttgtcctg

SEQ ID NO: 8351955 - DNA, 22 bp, Homo sapiens
gggcaggtgattttggctccat

SEQ ID NO: 8351956 - DNA, 22 bp, Homo sapiens
gggcaggtctgggtcagcctga

SEQ ID NO: 8351957 - DNA, 22 bp, Homo sapiens
gggagctgaactgctgaagttg

SEQ ID NO: 8351958 - DNA, 22 bp, Homo sapiens
gggagctgaaggagccggcggg

SEQ ID NO: 8351959 - DNA, 22 bp, Homo sapiens
gggagctctccctgaggcctgg

SEQ ID NO: 8351960 - DNA, 22 bp, Homo sapiens
gggagcgggactgcgcaggctt

SEQ ID NO: 8351961 - DNA, 22 bp, Homo sapiens
gggagcgggactgcgcaggctt

SEQ ID NO: 8351962 - DNA, 22 bp, Homo sapiens
gggagctgaatggcaatggaga

SEQ ID NO: 8351963 - DNA, 22 bp, Homo sapiens
gggatcagcaagccactgcacc

SEQ ID NO: 8351964 - DNA, 20 bp, Homo sapiens
gggagtggtggtagcctgtg

SEQ ID NO: 8351965 - DNA, 22 bp, Homo sapiens
gggagtggttgatggtgaaaat

SEQ ID NO: 8351966 - DNA, 22 bp, Homo sapiens
gggagtgggtttggcctaggcc

SEQ ID NO: 8351967 - DNA, 22 bp, Homo sapiens
gggaaggcaccatggtgttcca

SEQ ID NO: 8351968 - DNA, 22 bp, Homo sapiens
gggaaggcaggattctctggtg

SEQ ID NO: 8351969 - DNA, 22 bp, Homo sapiens
gggaaggcagtgtctggttgaa

SEQ ID NO: 8351970 - DNA, 22 bp, Homo sapiens
gggaagatagtgttgagggccc

SEQ ID NO: 8351971 - DNA, 22 bp, Homo sapiens
gggaaggcatacctgagggaga

SEQ ID NO: 8351972 - DNA, 23 bp, Homo sapiens
gggagccaggacctcgcgcccca

SEQ ID NO: 8351973 - DNA, 22 bp, Homo sapiens
ggctgtgggatgcataggagct

SEQ ID NO: 8351974 - DNA, 22 bp, Homo sapiens
ggctgtggggccgggtacagtg

SEQ ID NO: 8351975 - DNA, 22 bp, Homo sapiens
ggctgtgggtgtgacaggcctc

SEQ ID NO: 8351976 - DNA, 22 bp, Homo sapiens
gggaagagggagctggaatgat

SEQ ID NO: 8351977 - DNA, 22 bp, Homo sapiens
ggctgtggcattaggtgaggcc

SEQ ID NO: 8351978 - DNA, 21 bp, Homo sapiens
ggctgtggagccatgactcac

SEQ ID NO: 8351979 - DNA, 22 bp, Homo sapiens
ggctgtggacactgagctcaga

SEQ ID NO: 8351980 - DNA, 22 bp, Homo sapiens
ggctgtggacactgagctcaga

SEQ ID NO: 8351981 - DNA, 22 bp, Homo sapiens
ggctgtggacactgagctcaga

SEQ ID NO: 8351982 - DNA, 22 bp, Homo sapiens
ggctgtgcttggtgtccttgga

SEQ ID NO: 8351983 - DNA, 18 bp, Homo sapiens
ggctgtgcgtggaggctg

SEQ ID NO: 8351984 - DNA, 22 bp, Homo sapiens
ggctgtgcgtcatccggctgca

SEQ ID NO: 8351985 - DNA, 22 bp, Homo sapiens
ggctgtgcgggcagccgtggga

SEQ ID NO: 8351986 - DNA, 22 bp, Homo sapiens
ggctggccagggccctcgctgg

SEQ ID NO: 8351987 - DNA, 17 bp, Homo sapiens
ggctggagcagctcccc

SEQ ID NO: 8351988 - DNA, 17 bp, Homo sapiens
ggctggagcagctcccc

SEQ ID NO: 8351989 - DNA, 22 bp, Homo sapiens
ggctggagacaacgtcctgccc

SEQ ID NO: 8351990 - DNA, 22 bp, Homo sapiens
ggctggagacaacgtcctgccc

SEQ ID NO: 8351991 - DNA, 22 bp, Homo sapiens
ggctggataccaggagacaggg

SEQ ID NO: 8351992 - DNA, 22 bp, Homo sapiens
ggctggcagaagtgtgctggct

SEQ ID NO: 8351993 - DNA, 22 bp, Homo sapiens
ggctggcagtgtgagagaggga

SEQ ID NO: 8351994 - DNA, 18 bp, Homo sapiens
ggctggataccttaggaa

SEQ ID NO: 8351995 - DNA, 19 bp, Homo sapiens
ggctggagtggccatctgt

SEQ ID NO: 8351996 - DNA, 22 bp, Homo sapiens
ggctggagtgggctccagagtt

SEQ ID NO: 8351997 - DNA, 22 bp, Homo sapiens
ggctgcaggttggttggcagct

SEQ ID NO: 8351998 - DNA, 20 bp, Homo sapiens
ggctgcagtgcacctcatct

SEQ ID NO: 8351999 - DNA, 22 bp, Homo sapiens
ggctgcaggcttccctccagca

SEQ ID NO: 8352000 - DNA, 21 bp, Homo sapiens
ggctgcagggagccctggggt

SEQ ID NO: 8352001 - DNA, 22 bp, Homo sapiens
ggctctgcgcctgcggggactt

SEQ ID NO: 8352002 - DNA, 22 bp, Homo sapiens
ggctctgcgcggtaaagtgact

SEQ ID NO: 8352003 - DNA, 22 bp, Homo sapiens
ggctctgcggcgtgtgcgcagg

SEQ ID NO: 8352004 - DNA, 22 bp, Homo sapiens
ggctgccagtgagtgcagaccg

SEQ ID NO: 8352005 - DNA, 22 bp, Homo sapiens
ggctgcagttgtgtgaaggccg

SEQ ID NO: 8352006 - DNA, 22 bp, Homo sapiens
ggctgcagtttgtcttttgctt

SEQ ID NO: 8352007 - DNA, 18 bp, Homo sapiens
ggcctctggactggcagc

SEQ ID NO: 8352008 - DNA, 22 bp, Homo sapiens
ggcctctgcttatgctgatgac

SEQ ID NO: 8352009 - DNA, 22 bp, Homo sapiens
ggcctctggggtcctgagccca

SEQ ID NO: 8352010 - DNA, 22 bp, Homo sapiens
ggcctctggggtcctgagccca

SEQ ID NO: 8352011 - DNA, 22 bp, Homo sapiens
ggcctctggtcaagacaagcat

SEQ ID NO: 8352012 - DNA, 22 bp, Homo sapiens
ggcctctgaggacagccttggc

SEQ ID NO: 8352013 - DNA, 22 bp, Homo sapiens
ggcctctcttgggacagctgtc

SEQ ID NO: 8352014 - DNA, 22 bp, Homo sapiens
ggcctctctgagagcagacgtt

SEQ ID NO: 8352015 - DNA, 22 bp, Homo sapiens
ggcctctctgagagcagacgtt

SEQ ID NO: 8352016 - DNA, 21 bp, Homo sapiens
ggcctcccggaccgcagcgcc

SEQ ID NO: 8352017 - DNA, 22 bp, Homo sapiens
ggcctctgcctcatctgggcac

SEQ ID NO: 8352018 - DNA, 22 bp, Homo sapiens
ggcctctgcctcatctgggcac

SEQ ID NO: 8352019 - DNA, 22 bp, Homo sapiens
ggcctctgccccagccacacct

SEQ ID NO: 8352020 - DNA, 19 bp, Homo sapiens
ggcctctgcaggccgcccc

SEQ ID NO: 8352021 - DNA, 22 bp, Homo sapiens
ggcctctgcaactggctgtggc

SEQ ID NO: 8352022 - DNA, 22 bp, Homo sapiens
ggcctctgcaactggctgtggc

SEQ ID NO: 8352023 - DNA, 22 bp, Homo sapiens
ggctcagcaatgatgagcccct

SEQ ID NO: 8352024 - DNA, 22 bp, Homo sapiens
ggctcagaaactaaaggcgctg

SEQ ID NO: 8352025 - DNA, 22 bp, Homo sapiens
ggctctgccatttcctagctgc

SEQ ID NO: 8352026 - DNA, 22 bp, Homo sapiens
ggctctgcccaggtggacagca

SEQ ID NO: 8352027 - DNA, 20 bp, Homo sapiens
ggctctgccccaccccgtcc

SEQ ID NO: 8352028 - DNA, 22 bp, Homo sapiens
ggctctgcctgcccagcagcac

SEQ ID NO: 8352029 - DNA, 22 bp, Homo sapiens
ggctctgcctgcctgagtgtcc

SEQ ID NO: 8352030 - DNA, 22 bp, Homo sapiens
ggctctgcccgcggctgcccac

SEQ ID NO: 8352031 - DNA, 22 bp, Homo sapiens
ggctctgcctctgaccctctgg

SEQ ID NO: 8352032 - DNA, 22 bp, Homo sapiens
ggctctgcagtgacttgagggg

SEQ ID NO: 8352033 - DNA, 22 bp, Homo sapiens
ggctctgcatgtgagtgggtgg

SEQ ID NO: 8352034 - DNA, 22 bp, Homo sapiens
ggctctgcatgcaggttgtcag

SEQ ID NO: 8352035 - DNA, 22 bp, Homo sapiens
ggctctgcagtgacttgagggg

SEQ ID NO: 8352036 - DNA, 22 bp, Homo sapiens
ggctctgcagagggcccagctt

SEQ ID NO: 8352037 - DNA, 22 bp, Homo sapiens
ggctctgcactcagagtcattc

SEQ ID NO: 8352038 - DNA, 21 bp, Homo sapiens
ggccacagttagggctcagga

SEQ ID NO: 8352039 - DNA, 21 bp, Homo sapiens
ggccagcagcgtccactgtgg

SEQ ID NO: 8352040 - DNA, 22 bp, Homo sapiens
ggccacagcagatgcttcagat

SEQ ID NO: 8352041 - DNA, 22 bp, Homo sapiens
ggccacagcaatgctgtgatgt

SEQ ID NO: 8352042 - DNA, 22 bp, Homo sapiens
ggccacagcaatgctgtgatgt

SEQ ID NO: 8352043 - DNA, 22 bp, Homo sapiens
ggccacagtctctggaaggatg

SEQ ID NO: 8352044 - DNA, 22 bp, Homo sapiens
ggccacagagggcgggatgctg

SEQ ID NO: 8352045 - DNA, 22 bp, Homo sapiens
ggccagctggagttccgggtgg

SEQ ID NO: 8352046 - DNA, 20 bp, Homo sapiens
ggccagctggaggcgccggg

SEQ ID NO: 8352047 - DNA, 22 bp, Homo sapiens
ggccagctgccaccagccctat

SEQ ID NO: 8352048 - DNA, 22 bp, Homo sapiens
ggcccagctgggcggggacacg

SEQ ID NO: 8352049 - DNA, 22 bp, Homo sapiens
ggcccagctgtgcttccagccc

SEQ ID NO: 8352050 - DNA, 22 bp, Homo sapiens
ggcccagctttcattccttgct

SEQ ID NO: 8352051 - DNA, 22 bp, Homo sapiens
ggcccaggctggagtgcagtgg

SEQ ID NO: 8352052 - DNA, 22 bp, Homo sapiens
ggcccaggctggagtgcggtgg

SEQ ID NO: 8352053 - DNA, 22 bp, Homo sapiens
ggcccatgcatcctgtgcagcc

SEQ ID NO: 8352054 - DNA, 22 bp, Homo sapiens
ggcccatgaccctagccaactg

SEQ ID NO: 8352055 - DNA, 22 bp, Homo sapiens
ggcagcaatgctgtgcaggcat

SEQ ID NO: 8352056 - DNA, 22 bp, Homo sapiens
ggcagcagaactggccctgtat

SEQ ID NO: 8352057 - DNA, 22 bp, Homo sapiens
ggcagcagacccctaagtctac

SEQ ID NO: 8352058 - DNA, 22 bp, Homo sapiens
ggcagcaaccaaccaggcattt

SEQ ID NO: 8352059 - DNA, 22 bp, Homo sapiens
ggcagatgttatatgatctgag

SEQ ID NO: 8352060 - DNA, 22 bp, Homo sapiens
ggcagatgttgcagtgagcaga

SEQ ID NO: 8352061 - DNA, 22 bp, Homo sapiens
ggcactgatctgatttccctcc

SEQ ID NO: 8352062 - DNA, 22 bp, Homo sapiens
ggcactgataatgtcctctctc

SEQ ID NO: 8352063 - DNA, 22 bp, Homo sapiens
ggcactgattccattcatgaag

SEQ ID NO: 8352064 - DNA, 22 bp, Homo sapiens
ggcactgaaccaggacacaagc

SEQ ID NO: 8352065 - DNA, 22 bp, Homo sapiens
ggcactcagagattcaggctgt

SEQ ID NO: 8352066 - DNA, 22 bp, Homo sapiens
ggcactgaatttcttggcatct

SEQ ID NO: 8352067 - DNA, 23 bp, Homo sapiens
ggcactgaagctacaatggtgag

SEQ ID NO: 8352068 - DNA, 22 bp, Homo sapiens
ggcactgaagtgggtgttgggt

SEQ ID NO: 8352069 - DNA, 22 bp, Homo sapiens
ggcacgtgcctaaggagcaggc

SEQ ID NO: 8352070 - DNA, 22 bp, Homo sapiens
ggcactgagaacaggctgactt

SEQ ID NO: 8352071 - DNA, 22 bp, Homo sapiens
ggcactgagaggctcttcctaa

SEQ ID NO: 8352072 - DNA, 21 bp, Homo sapiens
ggcactgagccagatggactc

SEQ ID NO: 8352073 - DNA, 22 bp, Homo sapiens
ggcactgagcgggctctgagcg

SEQ ID NO: 8352074 - DNA, 22 bp, Homo sapiens
ggcactgagctgccttggggca

SEQ ID NO: 8352075 - DNA, 22 bp, Homo sapiens
ggcactgactgtgcagcgcacc

SEQ ID NO: 8352076 - DNA, 22 bp, Homo sapiens
ggcactgaatttcttggcatct

SEQ ID NO: 8352077 - DNA, 22 bp, Homo sapiens
ggcactgacactagcatggcac

SEQ ID NO: 8352078 - DNA, 22 bp, Homo sapiens
ggaggaggggtttacattggaa

SEQ ID NO: 8352079 - DNA, 22 bp, Homo sapiens
ggaggaggggtgactgaatgct

SEQ ID NO: 8352080 - DNA, 22 bp, Homo sapiens
ggaggaggggtgactgaatgct

SEQ ID NO: 8352081 - DNA, 22 bp, Homo sapiens
ggaggaggggtttacattggaa

SEQ ID NO: 8352082 - DNA, 22 bp, Homo sapiens
ggaggaggtgggttaagttgta

SEQ ID NO: 8352083 - DNA, 22 bp, Homo sapiens
ggaggaggtgggttaagttgta

SEQ ID NO: 8352084 - DNA, 22 bp, Homo sapiens
ggaggagtcagttgggctgctt

SEQ ID NO: 8352085 - DNA, 22 bp, Homo sapiens
ggaggatgagctacgaggagct

SEQ ID NO: 8352086 - DNA, 23 bp, Homo sapiens
ggaggcacttaggcagagcagag

SEQ ID NO: 8352087 - DNA, 22 bp, Homo sapiens
ggcacctggtaagtgctcagta

SEQ ID NO: 8352088 - DNA, 18 bp, Homo sapiens
ggcacctctcttgcctta

SEQ ID NO: 8352089 - DNA, 22 bp, Homo sapiens
ggcagggcttgtctctgtgatg

SEQ ID NO: 8352090 - DNA, 22 bp, Homo sapiens
ggcagtgcaaggcagcctggat

SEQ ID NO: 8352091 - DNA, 22 bp, Homo sapiens
ggcagtgcccggtgcctcctct

SEQ ID NO: 8352092 - DNA, 22 bp, Homo sapiens
ggcaggcttgatatggggggac

SEQ ID NO: 8352093 - DNA, 20 bp, Homo sapiens
ggcagcgggttcgggcgcag

SEQ ID NO: 8352094 - DNA, 21 bp, Homo sapiens
ggcagcctctgtggaagggga

SEQ ID NO: 8352095 - DNA, 22 bp, Homo sapiens
ggcagccctttctggccagctc

SEQ ID NO: 8352096 - DNA, 20 bp, Homo sapiens
ggggcccaagccctcttgcc

SEQ ID NO: 8352097 - DNA, 22 bp, Homo sapiens
ggggcccagcacccctcctcgc

SEQ ID NO: 8352098 - DNA, 22 bp, Homo sapiens
ggggccagtaggagtgatgtac

SEQ ID NO: 8352099 - DNA, 22 bp, Homo sapiens
ggggccaggtccagcttccaaa

SEQ ID NO: 8352100 - DNA, 22 bp, Homo sapiens
ggggccaggtccagcttccaaa

SEQ ID NO: 8352101 - DNA, 22 bp, Homo sapiens
ggggccagcttcgcgtgctctt

SEQ ID NO: 8352102 - DNA, 22 bp, Homo sapiens
ggggccagatatcactaaggtt

SEQ ID NO: 8352103 - DNA, 22 bp, Homo sapiens
ggggccagcttcgcgtgctctt

SEQ ID NO: 8352104 - DNA, 22 bp, Homo sapiens
ggggtagggcgattgctgcttt

SEQ ID NO: 8352105 - DNA, 22 bp, Homo sapiens
ggggtgagttagcgtcggcttg

SEQ ID NO: 8352106 - DNA, 22 bp, Homo sapiens
ggggcccttgtggctgcaggcc

SEQ ID NO: 8352107 - DNA, 22 bp, Homo sapiens
ggggcccgggcactggccgtca

SEQ ID NO: 8352108 - DNA, 19 bp, Homo sapiens
ggggcccggggtctgcgag

SEQ ID NO: 8352109 - DNA, 22 bp, Homo sapiens
ggggcccagggcagcagtgcag

SEQ ID NO: 8352110 - DNA, 22 bp, Homo sapiens
ggggcccagcacccctcctcgc

SEQ ID NO: 8352111 - DNA, 22 bp, Homo sapiens
ggggcccagggcagcagtgcag

SEQ ID NO: 8352112 - DNA, 22 bp, Homo sapiens
ggggtggccctaccctctggaa

SEQ ID NO: 8352113 - DNA, 22 bp, Homo sapiens
ggggtggctggcacctcctggt

SEQ ID NO: 8352114 - DNA, 22 bp, Homo sapiens
ggggtgggagtgccatccttga

SEQ ID NO: 8352115 - DNA, 22 bp, Homo sapiens
ggggtggctggcacctcctggt

SEQ ID NO: 8352116 - DNA, 19 bp, Homo sapiens
ggggtggctggggctccag

SEQ ID NO: 8352117 - DNA, 22 bp, Homo sapiens
ggggtgagttagcgtcggcttg

SEQ ID NO: 8352118 - DNA, 22 bp, Homo sapiens
ggggtgctgaagatgtcatggt

SEQ ID NO: 8352119 - DNA, 22 bp, Homo sapiens
ggggtggatttcaggcggtgtc

SEQ ID NO: 8352120 - DNA, 22 bp, Homo sapiens
ggggtggattcctacaggtcca

SEQ ID NO: 8352121 - DNA, 22 bp, Homo sapiens
gggtggtggccagcagtgggca

SEQ ID NO: 8352122 - DNA, 22 bp, Homo sapiens
gggtggtcatctgaaggtctgg

SEQ ID NO: 8352123 - DNA, 22 bp, Homo sapiens
gggtggtctggcaggctggaaa

SEQ ID NO: 8352124 - DNA, 22 bp, Homo sapiens
gggtggtggccagcagtgggca

SEQ ID NO: 8352125 - DNA, 22 bp, Homo sapiens
gggtggtgtattagagctgcag

SEQ ID NO: 8352126 - DNA, 22 bp, Homo sapiens
gggtggagccagttgactctgt

SEQ ID NO: 8352127 - DNA, 22 bp, Homo sapiens
gggtggagccagttgactctgt

SEQ ID NO: 8352128 - DNA, 21 bp, Homo sapiens
gggtggggttccagccttttc

SEQ ID NO: 8352129 - DNA, 22 bp, Homo sapiens
gggtgggtggcagcaccgaggc

SEQ ID NO: 8352130 - DNA, 22 bp, Homo sapiens
gggtgaggagctgccagtcatg

SEQ ID NO: 8352131 - DNA, 22 bp, Homo sapiens
gggtgagggatgagccttcttc

SEQ ID NO: 8352132 - DNA, 18 bp, Homo sapiens
gggtgcaggcactgactg

SEQ ID NO: 8352133 - DNA, 23 bp, Homo sapiens
gggtgctgcctgtagtcatgctg

SEQ ID NO: 8352134 - DNA, 18 bp, Homo sapiens
gggtgctggggccccttg

SEQ ID NO: 8352135 - DNA, 21 bp, Homo sapiens
gggtgctgtggtcatgcagga

SEQ ID NO: 8352136 - DNA, 22 bp, Homo sapiens
gggcttctggtcattcctcatc

SEQ ID NO: 8352137 - DNA, 22 bp, Homo sapiens
gggcttcagttctgaccatctt

SEQ ID NO: 8352138 - DNA, 18 bp, Homo sapiens
gggctgtgttcatgccca

SEQ ID NO: 8352139 - DNA, 22 bp, Homo sapiens
gggctggtgaggctgccctgca

SEQ ID NO: 8352140 - DNA, 16 bp, Homo sapiens
gggctgggggattctg

SEQ ID NO: 8352141 - DNA, 22 bp, Homo sapiens
gggctctggggtcagacagcct

SEQ ID NO: 8352142 - DNA, 22 bp, Homo sapiens
gggctctggggtcagacagcct

SEQ ID NO: 8352143 - DNA, 22 bp, Homo sapiens
gggctctggggtgccctggcat

SEQ ID NO: 8352144 - DNA, 22 bp, Homo sapiens
gggctctggggaggacccttca

SEQ ID NO: 8352145 - DNA, 22 bp, Homo sapiens
gggctctgggattcagagcaag

SEQ ID NO: 8352146 - DNA, 22 bp, Homo sapiens
gggctctgggattcagagcaag

SEQ ID NO: 8352147 - DNA, 22 bp, Homo sapiens
gggctctgggatgctcttagag

SEQ ID NO: 8352148 - DNA, 22 bp, Homo sapiens
gggctctgggatgctcttagag

SEQ ID NO: 8352149 - DNA, 22 bp, Homo sapiens
gggctctgggatgctcttagag

SEQ ID NO: 8352150 - DNA, 18 bp, Homo sapiens
gggctctggcatctgggt

SEQ ID NO: 8352151 - DNA, 18 bp, Homo sapiens
gggctctggcatctgggt

SEQ ID NO: 8352152 - DNA, 19 bp, Homo sapiens
gggctctggcctcagtggg

SEQ ID NO: 8352153 - DNA, 19 bp, Homo sapiens
gggctctggcctcagtggg

SEQ ID NO: 8352154 - DNA, 20 bp, Homo sapiens
gggctctggccaatgctttg

SEQ ID NO: 8352155 - DNA, 19 bp, Homo sapiens
gggctctggcctcagtggg

SEQ ID NO: 8352156 - DNA, 22 bp, Homo sapiens
gggcttctgtacctacctggaa

SEQ ID NO: 8352157 - DNA, 22 bp, Homo sapiens
ggggagaattaccaaaagcgct

SEQ ID NO: 8352158 - DNA, 22 bp, Homo sapiens
ggggagaataaatcagatttta

SEQ ID NO: 8352159 - DNA, 22 bp, Homo sapiens
ggggaggaagctggaacacggg

SEQ ID NO: 8352160 - DNA, 22 bp, Homo sapiens
ggggaggacctttccaaggctt

SEQ ID NO: 8352161 - DNA, 22 bp, Homo sapiens
ggggaggccagtggaccgtccc

SEQ ID NO: 8352162 - DNA, 22 bp, Homo sapiens
ggggaggcaagatgaagtgagg

SEQ ID NO: 8352163 - DNA, 22 bp, Homo sapiens
ggggaggcaagatgaagtgagg

SEQ ID NO: 8352164 - DNA, 22 bp, Homo sapiens
ggggaggccagtggaccgtccc

SEQ ID NO: 8352165 - DNA, 22 bp, Homo sapiens
ggggcatcagaaccctgtggga

SEQ ID NO: 8352166 - DNA, 20 bp, Homo sapiens
ggggcaggtttttatggcta

SEQ ID NO: 8352167 - DNA, 22 bp, Homo sapiens
ggggcagtgaggtggcagcccg

SEQ ID NO: 8352168 - DNA, 20 bp, Homo sapiens
ggggcaggtttttatggcta

SEQ ID NO: 8352169 - DNA, 22 bp, Homo sapiens
ggggcagggaggttatcgccga

SEQ ID NO: 8352170 - DNA, 22 bp, Homo sapiens
ggggcagggaggttatcgccga

SEQ ID NO: 8352171 - DNA, 22 bp, Homo sapiens
ggggccagagaggacccaggtg

SEQ ID NO: 8352172 - DNA, 22 bp, Homo sapiens
ggggagtgacgcagggccatag

SEQ ID NO: 8352173 - DNA, 22 bp, Homo sapiens
ggggaggctgatgtgggcaaag

SEQ ID NO: 8352174 - DNA, 22 bp, Homo sapiens
ggggagtgttttcatgggcttg

SEQ ID NO: 8352175 - DNA, 22 bp, Homo sapiens
ggggagtgttttcatgggcttg

SEQ ID NO: 8352176 - DNA, 22 bp, Homo sapiens
ggggcaggaggtgttctctttt

SEQ ID NO: 8352177 - DNA, 22 bp, Homo sapiens
ggggagttcatgcatttgtgga

SEQ ID NO: 8352178 - DNA, 22 bp, Homo sapiens
ggggatgagactagagctaaag

SEQ ID NO: 8352179 - DNA, 22 bp, Homo sapiens
gtaatgtgtgtgtcttctctag

SEQ ID NO: 8352180 - DNA, 22 bp, Homo sapiens
gtaatgctacaggagtctacat

SEQ ID NO: 8352181 - DNA, 22 bp, Homo sapiens
gtaattgactcagctctgttca

SEQ ID NO: 8352182 - DNA, 22 bp, Homo sapiens
ggttggggcgagctggaggccc

SEQ ID NO: 8352183 - DNA, 22 bp, Homo sapiens
ggttggtgagtgcagggtgtta

SEQ ID NO: 8352184 - DNA, 23 bp, Homo sapiens
ggttatttgcatcctgtaattat

SEQ ID NO: 8352185 - DNA, 19 bp, Homo sapiens
ggttatttgagggttaaga

SEQ ID NO: 8352186 - DNA, 22 bp, Homo sapiens
ggttatttctgattatatgata

SEQ ID NO: 8352187 - DNA, 22 bp, Homo sapiens
ggttattagtttcacctggact

SEQ ID NO: 8352188 - DNA, 22 bp, Homo sapiens
ggttattattcatgtaactcag

SEQ ID NO: 8352189 - DNA, 22 bp, Homo sapiens
ggttatttttgattctgtggat

SEQ ID NO: 8352190 - DNA, 22 bp, Homo sapiens
ggttattttggttgtctaaggc

SEQ ID NO: 8352191 - DNA, 23 bp, Homo sapiens
ggtggtgctcatatctcaggcct

SEQ ID NO: 8352192 - DNA, 23 bp, Homo sapiens
ggtggtgctcatatctcaggcct

SEQ ID NO: 8352193 - DNA, 22 bp, Homo sapiens
ggtgggccaggaaggccgccag

SEQ ID NO: 8352194 - DNA, 22 bp, Homo sapiens
ggtgggcaggtcactctgcctc

SEQ ID NO: 8352195 - DNA, 22 bp, Homo sapiens
ggtgggcgactgagaggggttt

SEQ ID NO: 8352196 - DNA, 22 bp, Homo sapiens
ggtggggccctggcactggtat

SEQ ID NO: 8352197 - DNA, 22 bp, Homo sapiens
ggtggggcctgctccagcggcc

SEQ ID NO: 8352198 - DNA, 19 bp, Homo sapiens
ggtgggtgacctccccacc

SEQ ID NO: 8352199 - DNA, 22 bp, Homo sapiens
ggtggggcctgctccagcggcc

SEQ ID NO: 8352200 - DNA, 19 bp, Homo sapiens
ggtgggtgacctccccacc

SEQ ID NO: 8352201 - DNA, 22 bp, Homo sapiens
ggtgggtgcagggggcttctta

SEQ ID NO: 8352202 - DNA, 22 bp, Homo sapiens
ggtgggtgcagggggcttctta

SEQ ID NO: 8352203 - DNA, 22 bp, Homo sapiens
ggtgggtgagccctgggagctg

SEQ ID NO: 8352204 - DNA, 22 bp, Homo sapiens
ggtgggcaggcgaggcccaggt

SEQ ID NO: 8352205 - DNA, 22 bp, Homo sapiens
ggtggcagaataattgaaggtc

SEQ ID NO: 8352206 - DNA, 19 bp, Homo sapiens
ggtggcagaacgtgggtcc

SEQ ID NO: 8352207 - DNA, 22 bp, Homo sapiens
ggtggagctggaccaggagagg

SEQ ID NO: 8352208 - DNA, 22 bp, Homo sapiens
ggtggagctggaccaggagagg

SEQ ID NO: 8352209 - DNA, 22 bp, Homo sapiens
ggtggagcgcagggtgctggcg

SEQ ID NO: 8352210 - DNA, 22 bp, Homo sapiens
ggtggagctatacgggatggct

SEQ ID NO: 8352211 - DNA, 22 bp, Homo sapiens
ggtgagagtcttgtggtcccag

SEQ ID NO: 8352212 - DNA, 22 bp, Homo sapiens
ggtccctggaaggccaagcttg

SEQ ID NO: 8352213 - DNA, 22 bp, Homo sapiens
ggtggacagtgttagctctggg

SEQ ID NO: 8352214 - DNA, 21 bp, Homo sapiens
ggtgctcgctgatgaggagtg

SEQ ID NO: 8352215 - DNA, 21 bp, Homo sapiens
ggtgctcctccatgctgctct

SEQ ID NO: 8352216 - DNA, 18 bp, Homo sapiens
ggtgaggcggcggccagc

SEQ ID NO: 8352217 - DNA, 22 bp, Homo sapiens
ggtgaggcaggtggctgctgag

SEQ ID NO: 8352218 - DNA, 22 bp, Homo sapiens
ggtgaggctggcttgccttctt

SEQ ID NO: 8352219 - DNA, 18 bp, Homo sapiens
ggtgagggagctggaagc

SEQ ID NO: 8352220 - DNA, 22 bp, Homo sapiens
ggtccccgtggaggctggagcg

SEQ ID NO: 8352221 - DNA, 22 bp, Homo sapiens
ggtccctgaagatgcctgagga

SEQ ID NO: 8352222 - DNA, 23 bp, Homo sapiens
ggtcccagtggagaggcctcacc

SEQ ID NO: 8352223 - DNA, 22 bp, Homo sapiens
ggtccccccatggtgagcactg

SEQ ID NO: 8352224 - DNA, 22 bp, Homo sapiens
ggtcccagttgcccaggtcagg

SEQ ID NO: 8352225 - DNA, 22 bp, Homo sapiens
gggttgggactgtcatctggag

SEQ ID NO: 8352226 - DNA, 22 bp, Homo sapiens
gggttggggcccagcagtctgc

SEQ ID NO: 8352227 - DNA, 22 bp, Homo sapiens
gggttgggactgtcatctggag

SEQ ID NO: 8352228 - DNA, 18 bp, Homo sapiens
gggtggtgtgctcttcgc

SEQ ID NO: 8352229 - DNA, 22 bp, Homo sapiens
gggtggtgtattagagctgcag

SEQ ID NO: 8352230 - DNA, 22 bp, Homo sapiens
ggtcccagctggtcactgtcag

SEQ ID NO: 8352231 - DNA, 22 bp, Homo sapiens
gtgcccagctccacctcacaga

SEQ ID NO: 8352232 - DNA, 22 bp, Homo sapiens
gtgcccacgaggccaggctggt

SEQ ID NO: 8352233 - DNA, 22 bp, Homo sapiens
gtgctggaccctggaaggtggt

SEQ ID NO: 8352234 - DNA, 22 bp, Homo sapiens
gtgctgccggcatagcagtgaa

SEQ ID NO: 8352235 - DNA, 22 bp, Homo sapiens
gtgctgccagacagtgagaggg

SEQ ID NO: 8352236 - DNA, 22 bp, Homo sapiens
gtgctgcgatgattttacagag

SEQ ID NO: 8352237 - DNA, 22 bp, Homo sapiens
gtgctgcctgccagcttctggg

SEQ ID NO: 8352238 - DNA, 22 bp, Homo sapiens
gtgcaggcaaaagggccaggcc

SEQ ID NO: 8352239 - DNA, 22 bp, Homo sapiens
gtctccagttacagcagccagg

SEQ ID NO: 8352240 - DNA, 22 bp, Homo sapiens
gtctcccaatccgggacagcct

SEQ ID NO: 8352241 - DNA, 22 bp, Homo sapiens
gtctagaaataggtttcagaaa

SEQ ID NO: 8352242 - DNA, 22 bp, Homo sapiens
gtctatgatattttgttatagc

SEQ ID NO: 8352243 - DNA, 22 bp, Homo sapiens
gtctagcacatcatctcactgc

SEQ ID NO: 8352244 - DNA, 22 bp, Homo sapiens
gtctagggtctgtagtgcatgt

SEQ ID NO: 8352245 - DNA, 22 bp, Homo sapiens
gtctatgtgtaatagcatgtgt

SEQ ID NO: 8352246 - DNA, 22 bp, Homo sapiens
gtgagctgttggagtggcagag

SEQ ID NO: 8352247 - DNA, 22 bp, Homo sapiens
gtgagctgttggagtggcagag

SEQ ID NO: 8352248 - DNA, 22 bp, Homo sapiens
gtgagctgttttggacccatct

SEQ ID NO: 8352249 - DNA, 22 bp, Homo sapiens
gtgaggaagtctgagagccaca

SEQ ID NO: 8352250 - DNA, 22 bp, Homo sapiens
gtgagcagttgtataaagactt

SEQ ID NO: 8352251 - DNA, 22 bp, Homo sapiens
gtgagctggaatagtggagaaa

SEQ ID NO: 8352252 - DNA, 22 bp, Homo sapiens
gtgagctggaatagtggagaaa

SEQ ID NO: 8352253 - DNA, 17 bp, Homo sapiens
gtgagctgagtcaggac

SEQ ID NO: 8352254 - DNA, 22 bp, Homo sapiens
gtgagctgggtgaatggtaggg

SEQ ID NO: 8352255 - DNA, 22 bp, Homo sapiens
gtatacagatacttagacgtgc

SEQ ID NO: 8352256 - DNA, 20 bp, Homo sapiens
gtataagatttcacacatta

SEQ ID NO: 8352257 - DNA, 22 bp, Homo sapiens
gtagttccagatcatagagcat

SEQ ID NO: 8352258 - DNA, 22 bp, Homo sapiens
gtatttttaggtaaggaaagta

SEQ ID NO: 8352259 - DNA, 22 bp, Homo sapiens
gtatttcctcgcttgtgggatt

SEQ ID NO: 8352260 - DNA, 22 bp, Homo sapiens
gtatttccctgagttctgtgag

SEQ ID NO: 8352261 - DNA, 22 bp, Homo sapiens
gtatacatagatgatgaacaag

SEQ ID NO: 8352262 - DNA, 22 bp, Homo sapiens
gtatacatacttctagattaaa

SEQ ID NO: 8352263 - DNA, 22 bp, Homo sapiens
gtatttttagtagagtcggggt

SEQ ID NO: 8352264 - DNA, 22 bp, Homo sapiens
gtatttttcagttaggagctta

SEQ ID NO: 8352265 - DNA, 22 bp, Homo sapiens
gtatttttcattccaagtgaga

SEQ ID NO: 8352266 - DNA, 22 bp, Homo sapiens
gtaggaattggctttggatgtg

SEQ ID NO: 8352267 - DNA, 22 bp, Homo sapiens
gtaggtcagacataagaggaca

SEQ ID NO: 8352268 - DNA, 22 bp, Homo sapiens
gtaggtcaatatttctgtctta

SEQ ID NO: 8352269 - DNA, 22 bp, Homo sapiens
gtagtcttttcaatgattgtgt

SEQ ID NO: 8352270 - DNA, 22 bp, Homo sapiens
gtacaaattttgacatctagga

SEQ ID NO: 8352271 - DNA, 21 bp, Homo sapiens
gtacaagctcaccaagtggac

SEQ ID NO: 8352272 - DNA, 22 bp, Homo sapiens
gtacaagaggagaaaatggagt

SEQ ID NO: 8352273 - DNA, 19 bp, Homo sapiens
gtacaagaatgactgagca

SEQ ID NO: 8352274 - DNA, 22 bp, Homo sapiens
gtaatttttagttcattctatc

SEQ ID NO: 8352275 - DNA, 22 bp, Homo sapiens
gtacaaaagttattgcggtttt

SEQ ID NO: 8352276 - DNA, 22 bp, Homo sapiens
gtacaaatgcaggtttgttaca

SEQ ID NO: 8352277 - DNA, 22 bp, Homo sapiens
gtacaaatgagagttctgtttt

SEQ ID NO: 8352278 - DNA, 22 bp, Homo sapiens
gtacaaatgtacacttgtataa

SEQ ID NO: 8352279 - DNA, 22 bp, Homo sapiens
gtcctgggaactggacagctaa

SEQ ID NO: 8352280 - DNA, 22 bp, Homo sapiens
gtcctggctagtcgtccgcgac

SEQ ID NO: 8352281 - DNA, 22 bp, Homo sapiens
gtcctctgtagggctgggccac

SEQ ID NO: 8352282 - DNA, 22 bp, Homo sapiens
gtcctctgggctttgagcagtc

SEQ ID NO: 8352283 - DNA, 19 bp, Homo sapiens
gtccaggcattgggttggt

SEQ ID NO: 8352284 - DNA, 22 bp, Homo sapiens
gtcactggggccacatgcagaa

SEQ ID NO: 8352285 - DNA, 22 bp, Homo sapiens
gtcactcaggctggagttcagt

SEQ ID NO: 8352286 - DNA, 19 bp, Homo sapiens
gtccagcctttgggtctta

SEQ ID NO: 8352287 - DNA, 22 bp, Homo sapiens
gtccagctccagggaggcaggc

SEQ ID NO: 8352288 - DNA, 22 bp, Homo sapiens
gtccagctctcagatggctgca

SEQ ID NO: 8352289 - DNA, 22 bp, Homo sapiens
gtccagcctgaagagtgggggc

SEQ ID NO: 8352290 - DNA, 22 bp, Homo sapiens
gtccagctgcagctgggcagaa

SEQ ID NO: 8352291 - DNA, 22 bp, Homo sapiens
gtccagagaagggaggggactc

SEQ ID NO: 8352292 - DNA, 22 bp, Homo sapiens
ttctcctctgttggccttccct

SEQ ID NO: 8352293 - DNA, 22 bp, Homo sapiens
ttctcagatgattcagataaac

SEQ ID NO: 8352294 - DNA, 22 bp, Homo sapiens
ttccttggtagagagaatattt

SEQ ID NO: 8352295 - DNA, 22 bp, Homo sapiens
ttctcagatccatcagaagtcc

SEQ ID NO: 8352296 - DNA, 19 bp, Homo sapiens
ttctctgctacattctcag

SEQ ID NO: 8352297 - DNA, 22 bp, Homo sapiens
ttctctgctataggcagggagg

SEQ ID NO: 8352298 - DNA, 22 bp, Homo sapiens
ttctctgcctctagctatattc

SEQ ID NO: 8352299 - DNA, 22 bp, Homo sapiens
ttctctgcctcacaggtctaag

SEQ ID NO: 8352300 - DNA, 22 bp, Homo sapiens
ttctctgctctcacatacagaa

SEQ ID NO: 8352301 - DNA, 22 bp, Homo sapiens
ttctctgaaggttgtggaacta

SEQ ID NO: 8352302 - DNA, 22 bp, Homo sapiens
ttctctctgagagcatctggaa

SEQ ID NO: 8352303 - DNA, 22 bp, Homo sapiens
ttcctgatgcacacagtcattt

SEQ ID NO: 8352304 - DNA, 22 bp, Homo sapiens
ttcctgaatcccaaggagagct

SEQ ID NO: 8352305 - DNA, 22 bp, Homo sapiens
ttcctgaattgagctttagaaa

SEQ ID NO: 8352306 - DNA, 22 bp, Homo sapiens
ttcctgcccctgagagctccca

SEQ ID NO: 8352307 - DNA, 22 bp, Homo sapiens
ttcctggaaattatgctcacct

SEQ ID NO: 8352308 - DNA, 17 bp, Homo sapiens
ttcctggaagtcattcc

SEQ ID NO: 8352309 - DNA, 22 bp, Homo sapiens
ttcctggtggtggtgacagcac

SEQ ID NO: 8352310 - DNA, 22 bp, Homo sapiens
ttcctgtagttgtgcaatgtac

SEQ ID NO: 8352311 - DNA, 20 bp, Homo sapiens
ttcctgtatacaaagagttc

SEQ ID NO: 8352312 - DNA, 22 bp, Homo sapiens
ttgaattcatttctcattgagt

SEQ ID NO: 8352313 - DNA, 22 bp, Homo sapiens
ttgaacattggcaatttcatat

SEQ ID NO: 8352314 - DNA, 22 bp, Homo sapiens
ttgaacattttctatgttatag

SEQ ID NO: 8352315 - DNA, 22 bp, Homo sapiens
ttgaactaataggtatcttgta

SEQ ID NO: 8352316 - DNA, 22 bp, Homo sapiens
ttgaactagaagctttggaact

SEQ ID NO: 8352317 - DNA, 19 bp, Homo sapiens
ttgaaattgtttgatatgg

SEQ ID NO: 8352318 - DNA, 22 bp, Homo sapiens
ttgaacagctgttacattgtta

SEQ ID NO: 8352319 - DNA, 22 bp, Homo sapiens
ttgaacagttttgtcaggttca

SEQ ID NO: 8352320 - DNA, 22 bp, Homo sapiens
ttcttttggactcaaagagaac

SEQ ID NO: 8352321 - DNA, 22 bp, Homo sapiens
ttcttttctttaggcattgtgt

SEQ ID NO: 8352322 - DNA, 22 bp, Homo sapiens
ttgaaaggaatacagaggccta

SEQ ID NO: 8352323 - DNA, 22 bp, Homo sapiens
ttgaaatgagactaattgattg

SEQ ID NO: 8352324 - DNA, 22 bp, Homo sapiens
ttgaaatgatctatttcagtag

SEQ ID NO: 8352325 - DNA, 22 bp, Homo sapiens
ttgaaatgcatcatcatttaga

SEQ ID NO: 8352326 - DNA, 22 bp, Homo sapiens
ttgaaatgcatcatcatttaga

SEQ ID NO: 8352327 - DNA, 22 bp, Homo sapiens
ttgaaaggcctgtttatccagc

SEQ ID NO: 8352328 - DNA, 22 bp, Homo sapiens
ttgaaaggcacaggcacctggg

SEQ ID NO: 8352329 - DNA, 22 bp, Homo sapiens
ttgaaagggatatatctttctg

SEQ ID NO: 8352330 - DNA, 22 bp, Homo sapiens
ttcttttaatgtctggctttca

SEQ ID NO: 8352331 - DNA, 22 bp, Homo sapiens
ttcttttaaaagagagcagaaa

SEQ ID NO: 8352332 - DNA, 17 bp, Homo sapiens
ttcttttctgagccttg

SEQ ID NO: 8352333 - DNA, 22 bp, Homo sapiens
ttcttttctgcagctggtattt

SEQ ID NO: 8352334 - DNA, 22 bp, Homo sapiens
ttcttttcttggcaggagtaga

SEQ ID NO: 8352335 - DNA, 22 bp, Homo sapiens
ttcttcaagggtaaaggcaacg

SEQ ID NO: 8352336 - DNA, 22 bp, Homo sapiens
ttcttcaaccatctacataaac

SEQ ID NO: 8352337 - DNA, 22 bp, Homo sapiens
ttcttcagactactgatgattg

SEQ ID NO: 8352338 - DNA, 22 bp, Homo sapiens
ttcttcaaaatccagcatgatt

SEQ ID NO: 8352339 - DNA, 21 bp, Homo sapiens
ttctctggtcaagcacacata

SEQ ID NO: 8352340 - DNA, 21 bp, Homo sapiens
ttctctggtcaagcacacata

SEQ ID NO: 8352341 - DNA, 19 bp, Homo sapiens
ttctctggactagatgctg

SEQ ID NO: 8352342 - DNA, 22 bp, Homo sapiens
ttctctgggcttttcggatccg

SEQ ID NO: 8352343 - DNA, 22 bp, Homo sapiens
ttctctggggactgtctctatt

SEQ ID NO: 8352344 - DNA, 22 bp, Homo sapiens
ttctctggtaaacacatgcgta

SEQ ID NO: 8352345 - DNA, 22 bp, Homo sapiens
ttctggagctaaagtccactct

SEQ ID NO: 8352346 - DNA, 22 bp, Homo sapiens
ttcttatattgggtcatggata

SEQ ID NO: 8352347 - DNA, 22 bp, Homo sapiens
ttcttagatgattaatgatggg

SEQ ID NO: 8352348 - DNA, 22 bp, Homo sapiens
ttcttacattagtctgtgcttt

SEQ ID NO: 8352349 - DNA, 22 bp, Homo sapiens
ttctgtctgtaaacttctcaat

SEQ ID NO: 8352350 - DNA, 22 bp, Homo sapiens
ttctgtctgtaaacttctcaat

SEQ ID NO: 8352351 - DNA, 22 bp, Homo sapiens
ttctgtctgatggtgccagaac

SEQ ID NO: 8352352 - DNA, 19 bp, Homo sapiens
ttctgtaagggagagaggg

SEQ ID NO: 8352353 - DNA, 22 bp, Homo sapiens
ttctgtgaggacttctcaagga

SEQ ID NO: 8352354 - DNA, 22 bp, Homo sapiens
ttctgtgattagttgtctggct

SEQ ID NO: 8352355 - DNA, 22 bp, Homo sapiens
ttctgtgattcctccagccagc

SEQ ID NO: 8352356 - DNA, 22 bp, Homo sapiens
ttctgtgattgacatgtggctt

SEQ ID NO: 8352357 - DNA, 22 bp, Homo sapiens
ttctgtggttgaaaggagagat

SEQ ID NO: 8352358 - DNA, 22 bp, Homo sapiens
ttctgtggctgggagcctggct

SEQ ID NO: 8352359 - DNA, 22 bp, Homo sapiens
ttctgtggaggtttggaacatt

SEQ ID NO: 8352360 - DNA, 21 bp, Homo sapiens
ttcacagatgggaaaactgag

SEQ ID NO: 8352361 - DNA, 22 bp, Homo sapiens
ttcacagactttccatagattg

SEQ ID NO: 8352362 - DNA, 23 bp, Homo sapiens
ttcacagattaaatatttcttct

SEQ ID NO: 8352363 - DNA, 22 bp, Homo sapiens
ttcacagctcatactgttctca

SEQ ID NO: 8352364 - DNA, 22 bp, Homo sapiens
ttcaaacttaaggagcagcaga

SEQ ID NO: 8352365 - DNA, 21 bp, Homo sapiens
ttcaaagagtgggcattgtca

SEQ ID NO: 8352366 - DNA, 22 bp, Homo sapiens
ttcaaagataattaccaaacat

SEQ ID NO: 8352367 - DNA, 22 bp, Homo sapiens
ttcagagatggaaggcagaatg

SEQ ID NO: 8352368 - DNA, 22 bp, Homo sapiens
ttcagagacatgttctagatca

SEQ ID NO: 8352369 - DNA, 22 bp, Homo sapiens
ttcagagacagcaaccaggaca

SEQ ID NO: 8352370 - DNA, 22 bp, Homo sapiens
ttcagagaagcaaaggcagatt

SEQ ID NO: 8352371 - DNA, 22 bp, Homo sapiens
ttcagactgctggtgcttccct

SEQ ID NO: 8352372 - DNA, 22 bp, Homo sapiens
ttcagaccttaaattcttctgt

SEQ ID NO: 8352373 - DNA, 22 bp, Homo sapiens
ttcatttgagtttatagttgct

SEQ ID NO: 8352374 - DNA, 22 bp, Homo sapiens
ttcatttgcactggattactgg

SEQ ID NO: 8352375 - DNA, 22 bp, Homo sapiens
ttcatttgccatcagtgtaatg

SEQ ID NO: 8352376 - DNA, 22 bp, Homo sapiens
ttcagttttctttagaatgtag

SEQ ID NO: 8352377 - DNA, 21 bp, Homo sapiens
ttcataaaccattctcatgca

SEQ ID NO: 8352378 - DNA, 22 bp, Homo sapiens
ttcatttgtggttatttacaat

SEQ ID NO: 8352379 - DNA, 23 bp, Homo sapiens
ttcatttgtctacttcacttgtt

SEQ ID NO: 8352380 - DNA, 22 bp, Homo sapiens
ttcatttgtctgctatagatcc

SEQ ID NO: 8352381 - DNA, 22 bp, Homo sapiens
ttcatttggatgcgtgtttaag

SEQ ID NO: 8352382 - DNA, 20 bp, Homo sapiens
ttcatttgggaaaatctgcg

SEQ ID NO: 8352383 - DNA, 22 bp, Homo sapiens
ttcatttgtaactctgttaggg

SEQ ID NO: 8352384 - DNA, 22 bp, Homo sapiens
ttccaggtcgccataggtttga

SEQ ID NO: 8352385 - DNA, 22 bp, Homo sapiens
ttccaggtgttgctgtcttcct

SEQ ID NO: 8352386 - DNA, 22 bp, Homo sapiens
ttattaatgagtacaagttatt

SEQ ID NO: 8352387 - DNA, 22 bp, Homo sapiens
ttatatatatgtagaggtcacg

SEQ ID NO: 8352388 - DNA, 22 bp, Homo sapiens
ttatatatcttgatttgttcca

SEQ ID NO: 8352389 - DNA, 22 bp, Homo sapiens
ttatatatcttgatttgttcca

SEQ ID NO: 8352390 - DNA, 22 bp, Homo sapiens
ttatatgaactggactttagga

SEQ ID NO: 8352391 - DNA, 22 bp, Homo sapiens
ttattaaaatgcggatttggct

SEQ ID NO: 8352392 - DNA, 22 bp, Homo sapiens
ttattcttttctccagaatccc

SEQ ID NO: 8352393 - DNA, 22 bp, Homo sapiens
ttattctttaaacatatatgtt
